United States Patent 9,061,059 (MODIFIED POLYNUCLEOTIDES FOR TREATING PROTEIN DEFICIENCY) - sequence listing, part 68

SEQ ID NO: 130062 - DNA, 6450 bp, Artificial Sequence
  Description of Artificial Sequence: Synthetic coding sequence
atgagcgatcggtcaggacccaccgctaaaggtaaagatggtaagaagtattccagcctcaacctgttcgatacatacaaagggaagagcttggagatccagaaaccggccgtggcccctcgccacggtttgcagagcttgggcaaagtggcgattgcgcgccgaatgccccctccggcaaatctcccttctttgaaagctgaaaacaaagggaatgacccaaacgtgagcttagtaccaaaggacggtaccggttgggcaagcaaacaggagcagagcgaccccaagtcatcggatgcttctacagctcaacccccagagtcacagccgctgcccgcaagccagacaccagctagcaatcagcccaaacgaccccccgctgcgcctgaaaatactcctctagtgcctagcggagtgaaatcctgggcccaggcctccgttacgcatggagcgcacggggatggggggagggcttccagtttgctgtcccgtttttcaagagaggaattcccaactctgcaagctgcaggcgatcaggataaggccgctaaagagagggaatccgctgaacagagctctggtccaggcccctctctgaggcctcagaactctactacctggagagatggcggagggcggggcccagatgaactggagggaccagattcaaaactgcatcatgggcacgacccaagaggagggctgcagcctagtggcccaccccagttcccaccctacagaggcatgatgccaccgttcatgtatcctccatacctaccctttccccctccgtacggaccccagggcccataccgatatccaacgcctgacggcccaagccgatttcctagagttgcggggccgcgcggttctggcccgccaatgcggctcgtggaacctgtggggagacctagcatactgaaggaagataaccttaaggagttcgaccagctggatcaggaaaatgatgatggctgggctggggcccacgaggaggtcgattacacagagaaactgaaattttcagatgaggaggacggcagggattccgatgaggaaggtgccgagggtcatagagatagccagtcagcatctggggaggagcgacccccagaggccgatggcaagaagggcaatagcccgaatagtgaacccccaacgccaaaaactgcgtgggccgaaacctctagaccccctgagactgagcctggaccccccgctccaaagcccccgctgccccccccacacagaggcccagcgggtaattgggggcctcccggcgattatccagacagggggggaccgccttgcaaaccacccgctcccgaagatgaagacgaagcctggcggcagagaaggaaacagtccagcagtgaaatttcacttgctgtcgaacgtgctcggaggcgtcgagaggaagaggagagaaggatgcaggaagaaagaagagctgcctgcgccgaaaaattgaagaggctggacgagaaattcggagctcccgacaagaggttgaaggcagaaccggccgcccctcctgctgcgcccagtactcctgccccccctcctgcagttcctaaagagctgcccgcacctccggctcccccccccgcttccgctcctaccccagagaaagagcccgaagaaccagcacaggcgcctcctgcccagagtaccccaacacccggggtcgcagcagctccaacactggtgtccgggggtgggagcaccagctccacatccagcgggagtttcgaggcttcccccgtggaacctcaactgccgagtaaagaggggcctgagcctcctgaagaggtacctccccccaccacccccccagtgcccaaagtcgagccgaagggagatggaatcggcccaacgaggcagcccccgagccaggggctaggttatcccaaataccagaaaagcctgccgccacggttccagagacagcagcaggaacagctgctgaaacagcagcagcagcaccagtggcagcagcaccagcaagggtccgctccacctacgccagtaccaccctccccgccgcagcccgtaaccctgggtgctgtgccagcccctcaggccccaccaccccctccaaaagcattatacccaggcgcccttggtcgcccaccaccaatgccgcccatgaactttgatccgagatggatgatgattccgccatacgttgaccccagattgctccaagggcgaccccctcttgacttctacccccccggggtacacccttctgggctcgtgccccgggaacgcagcgactcgggcgggagttccagcgaacccttcgatagacacgctccggcaatgctaagggagcggggaacccctcccgtcgatcctaagcttgcatgggtgggggatgtgtttaccgctacccccgccgagcctcggccccttacgagccctctgcgacaggccgcggatgaagatgataaaggaatgagatccgagaccccgcccgttcctccaccacctccctaccttgcctcttaccccggctttcccgagaacggcgccccagggccgcccatttctagattccctctcgaggagccgggccccagacctctcccttggcccccagggagcgatgaggtggctaagatccagactccccctcctaagaaggagccacctaaagaagaaaccgcacagttgacaggaccggaagccggcaggaaacccgctagaggcgtcggttcaggggggcagggccccccaccacccagacgagagtctagaacagaaactcgctggggcccgagaccaggctccagtaggcgaggaattcctcccgaggagcccggggctcctccaagaagggccggcccaatcaagaagccaccacctcctacgaaggtggaggaactgccaccgaaacccctggagcagggagatgaaactccaaaaccccccaagcctgatcccctaaaaattaccaagggtaagcttggtgggcccaaggaaacgcccccgaacggaaatttatctcctgcaccccgcctacgacgggactactcatatgaacgggtggggccgacctcatgtcgagggcgagggagaggcgagtattttgcgcgcggcagagggttcagaggcacatatgggggccggggtaggggcgcagctggaaatagcgccgtgaccgaaagtttcgaagaaatgatgggtgtcgaagtcgggcagggcgatcagacaacgctcctcctgccagaggcagccctcccagcacgccacggcgccagagtgcagagcatgaggaaatcccccagtggagccgggagcggagctcagaaacaggccgcccgccctatgcgggtgatttggttattgcagacgagaaggcttccgcacccccggcgggaacactccccccgctccaggtccccaactacgcggagtcccacctttcccgctccggctcgctttacccccggggtcggtgagagctctcttcctgagggtatttctcccggccctcgaagacgggagccaccccaagtgtgcccaggctggagccctcctgctaagtccctcgctccgaagaagcctcccaccggccctctgccacccagtaaggagcccctgaaagaaaaactcatcccaggtcccctaagccctgtggctcgcggagggtcaaacggaggatctaacgtgggtatggaagatggcgagaggccccgcagaaggaggcatggcagggcacagcagcaagataagcctccaaggtttcgacggttgaagcaggagagagaaaatgctgctaggggcagcgagggcaaaccaagtctaacactaccagctagcgcaccgggacccgaggaggcattgactacagtgaccgttgccccagcaccaagacgcgctgccgccaagagccctgacctcagcaaccagaattcagatcaggccaacgaggaatgggagactgcttccgagtcaagcgatttcaccagcgaaagaaggggagataaagaggcccctccaccggtgttacttacacccaaggctgttggtactcccggtggaggaggcgggggcgccgtgccaggcatatctgcaatgagcaggggggatttatctcaacgagctaaagatctgtctaagcggagtttcagctcacagcggccgggtatggagcgtcagaatagaaggccaggacctggagggaaggccgggtcttccggatctagttcaggggggggcggcggaggacctgggggacgaactggccctggccggggggacaagagaagctggcccagtccaaagaaccgcagccgccccccagaggagagacctccggggctgcccttgcctcctccacccccctccagttccgccgtttttcggcttgaccaggtcatccacagtaatcctgccgggattcaacaagctctcgcccagttgtcttctcggcaaggctccgtaacggcccccgggggccatcccaggcataagccgggaccccctcaggcccctcagggacctagccctagaccacctacccggtacgaaccccagcgtgtgaactccggtctctcctctgaccctcacttcgaagaacccggcccgatggtgcgtggtgtaggcggcaccccccgggattctgcaggtgtcagtccatttccacccaaacgccgagaaagaccaccacgtaaaccagaacttctgcaggaagagtctctcccgccccctcatagcagtggctttttagggtcgaagccagagggacccggtccgcaggccgaatcaagagataccggtaccgaggccctgaccccccacatctggaatcgcctccacaccgcgacaagcaggaagtcatacagaccatcatctatggaaccctggatggagcccctgtcccccttcgaagacgtggccggcacagaaatgtcccaaagcgacagcggtgttgatttgtccggcgattctcaggtcagtagcggaccttgctcacagcgctcctccccagacggggggctgaagggcgccgctgaggggccaccaaaacggccaggaggctccagcccccttaatgccgttccttgcgagggcccgcctgggtcggaaccacctcgcaggcctccaccagccccgcatgacggagacaggaaagaactccctcgggagcaacctctgccacccggcccaatagggacagaacggagtcagcacacagatcgtggcactgaacctgggccaatccgacctagccatcggccagggccgccagttcagttcgggacatccgacaaggattccgatctgagactagttgtcggggatagcctcaaagcagaaaaagaactcacggcctcagtgacagaggccatccctgtttctcgcgattgggagctgctgccatccgccgccgcttccgcggaaccccagtcaaagaatcttgacagtgggcattgcgtcccagagccttcttccagtgggcaaagactgtatccagaggtgttttacggttcagcggggccctccagttctcagatcagtggaggacacgggcttagtgtcaccagcaagcagtggcggcgccccggcacaccttcactgcatccctaccgttcacagccactatatttgccacctggccctgcccctccctcagccctgttaagcggcgtcgcactcaaaggacaatttctcgacttcagcaccatgcaggctaccgaactgggcaaactgccagcaggcggcgtcctgtaccctccaccatcgtttctgtacagccccgccttttgtccttcacctttgcctgacacttctctgctgcaagtgagacaggacttgccctcacccagcgatttttattccacacccttgcagcccgggggacaaagtggatttctaccaagcggagccccagcacagcaaatgcttctccctatggttgacagccagctccctgtggtgaatttcggcagtctgccacctgcaccaccgcccgcaccacccagcctgagtttgctgcccgtgggccctgctcttcagcctcccagcctagctgtgcggccacctccagcaccagcaacacgggttctgccatcgccagcacggcccttccctgcatcgttaggccgggctgaactgcaccctgtcgagctgaaaccttttcaggattatcagaaactaagtagtaatttgggcgggcctggatcttctaggacgcctccaaccggaagatctttttcaggtttgaattcaagactcaaggccactccctcaacgtattcgggagtttttcgtacccaacgcgtcgatctttaccagcaggccagtccacctgacgccctgcgctggattccgaagccctgggaacgcacaggacccccacctagggagggtccgtcccgtcgcgcagaggagcccgggtccaggggagataaggagcccggccttcctcctccaagatag

SEQ ID NO: 130063 - DNA, 4149 bp, Artificial Sequence
  Description of Artificial Sequence: Synthetic coding sequence
atgctgcgggagcgagggacacctcccgtggatccaaagcttgcctgggtcggcgacgtgttcacggccactccggccgagccccggccacttaccagccccctgcgccaggcagctgatgaagatgacaaaggcatgcgctcagagaccccaccagtaccgcccccgccgccctatcttgccagctaccctggttttccggagaatggagcaccagggccgcccatatcgagatttccactagaggagccaggacccagacccctgccatggccgccaggtagtgacgaggttgcgaaaatccaaacccccccgcccaagaaggagccacctaaggaggagactgcccagctcacaggccccgaggctggcaggaagcctgctcgcggagtaggaagcgggggccagggccccccgccgccaagaagggagtctagaactgaaacgcgctggggaccccgacccggtagttctcgaaggggaatcccacccgaagaacccggagcgccccccagacgcgctggaccaatcaagaaaccacccccaccaacaaaggtggaggagctcccccctaaacccctggaacagggagacgagaccccgaagcctcctaaaccagacccactaaagatcactaagggaaaactgggcggccccaaggagactcctcccaacgggaatcttagtcctgccccccgactccgccgtgattactcctatgaaagagttggtcccacaagctgcagggggcgcgggcgcggtgaatatttcgcccggggtagggggtttcggggaacctacgggggcaggggaaggggagctcggtcacgggagtttcgtagctatcgggaatttcgcggagatgacggtagaggaggggggacaggcggacccaaccatccacctgccccccgtggaagaacagcgagcgagactagaagcgagggcagtgagtatgaggaaatccctaagcgtcggagacagagaggatccgagactggtagcgaaacgcacgagtccgatctggctccttctgataaagaggcacccaccccgaaggaaggtacattaacgcaggttccactggcccccccaccacccggcgctcctcccagccccgcccccgctcgctttactgccagagggggtcgggttttcacccctaggggagtcccctcacgaagaggacgaggtggcgggaggcctcccccccaggtttgccccggctggtccccgcccgcaaagtctttggccccaaagaagcctcccacgggcccgttgcccccatctaaagagccactgaaagagaaattaattcctgggcccttaagtcctgtagccagggggggctctaatggagggagcaatgttggcatggaagacggcgaacgcccaaggcgtcgcagacatgggcgagcacagcagcaagacaaacctcctcgtttccgaaggctgaagcaggagcgggagaatgcagccagaggatccgaggggaaaccctccctaacactgcctgctagtgcccctggtcccgaagaggcactcactactgtgacagtggccccagctccgagacgcgccgccgcaaaaagcccagacttgtccaaccagaactccgaccaggctaacgaagagtgggagactgcgagcgagtcatctgacttcacctccgagcgccggggagacaaggaggcccccccccccgtcctgttgaccccgaaagcagtaggcacccccggaggcggcggaggcggcgctgtgcccggaattagcgccatgtcgaggggcgatctatctcaaagggctaaggatctttccaagcggtccttctctagccagcggcctgggatggagcgacagaatcggcggccaggcccaggaggtaaagctgggtccagcggctcttcctctggaggcggggggggaggtcccggaggacgtacaggccccggcagaggtgataagcgctcatggccaagccctaagaaccggtctagaccaccagaggaaaggccccccggactacccctcccccccccacccccaagttcaagcgcggtgttccggcttgatcaggtcatccatagcaatcctgcaggcattcagcaggccttggcccaattatccagccggcaaggatccgttaccgcccctggcggtcacccccgccataagccaggccctccacaggccccacagggcccatcaccaaggccacccacacggtacgagccacaacgtgtgaatagcggcctgtccagcgacccccattttgaggagcccgggccaatggtccgaggtgtagggggtaccccccgggattcggctggcgtgagtccattccctcctaaacggagagaaagacctcccaggaaaccagaactgttgcaggaagaatctttgcctccccctcactccagcgggtttcttgggtctaaacccgaaggaccgggaccccaggccgaaagtcgcgacactggaacggaagcgctcacacctcacatttggaatcgtctgcatactgctacgagcagaaaatcctacaggccgtccagcatggagccttggatggaaccgttgagtcctttcgaggacgtggctggtactgagatgagtcaatccgattcaggggtagacctcagtggcgactctcaggttagctccgggccttgttcccaaaggagcagtcccgacggcggcctcaagggagccgctgagggtccacctaaaaggcccggcgggtcatccccattgaacgcggtaccgtgcgaggggccccccggctcagagcctcccagacgaccaccccccgccccacacgacggtgatcgaaaggaactaccccgggagcagcctctgccccccgggccaattggcacggaacgttcacaacacacagatcgagggactgagcccggcccgatcagaccctctcacagaccgggtcctcctgtacaatttggaacaagtgataaggacagcgacctcagattggtggtgggtgacagcctgaaggcagaaaaggaactcaccgcctccgttacagaagctattcctgttagtcgcgattgggagctcttgccatccgcagccgctagcgccgagccccagagcaaaaacttggacagcgggcattgcgtgccagagccatcttcctctggccagaggctttaccccgaggtgttttatgggagcgctggacctagcagttcacagatctccggaggtgccatggatagccagctgcaccctaacagtggaggttttcgcccaggaacaccctccctgcacccctaccgatcacaacctttatacctgccacctggacccgccccacctagcgccctgctatctggggtggccctgaaaggccaattcctggattttagtacaatgcaggcaactgaacttgggaaactgccggctggtggagttctctatcctccacccagtttcttatattctcccgcgttttgcccctcccccttgcctgacacttctcttctacaagtccggcaggaccttccatccccttcagatttctactcaactccgcttcaacctgggggtcaatctgggtttctaccgtctggtgctccagcgcaacagatgttactacctatggtcgactcccagctcccggtggtgaactttggctctcttcccccggctcctccacccgcccctccttcattaagcctgctgcccgtgggacctgccctgcagccaccctccttggctgtgcgacctccaccggccccggctacacgcgtcctgccatccccggctaggccctttcccgcatcattaggccgagctgagctccacccagtggagctcaaacccttccaggattatcagaagcttagcagtaacctggggggcccggggtccagcagaactccacccaccggtcgtagcttctccgggctcaattcccgactcaaggccacgccatcgacctactcaggcgtcttccgcacccagagggtcgatctgtaccaacaggcttcaccacctgacgctctcaggtggattccaaagccctgggagagaactggcccacctccacgggaaggaccatcccgtcgggctgaagagccggggtcccggggggataaagagccgggcctgcctcccccacgatag

SEQ ID NO: 130064 - DNA, 6450 bp, Artificial Sequence
  Description of Artificial Sequence: Synthetic coding sequence
atgagcgacaggtctggcccgacagccaagggtaaggatgggaagaagtactcttctctgaatctctttgatacctataaagggaagagtctggaaatccaaaaacccgccgttgctcctaggcatggcttgcagagcttgggcaaggttgccattgccaggcgtatgcccccaccagccaacctaccatctctgaaggctgagaacaagggaaacgatccaaacgtgtcccttgtgcccaaagacgggacaggttgggcctctaaacaggagcagagcgatccaaaatctagcgatgcctccactgctcagcctcccgaaagtcagcctctgcctgcaagtcagacaccagcttcaaatcagcccaaaagaccaccagccgctcctgagaatacgcccttggtgccaagcggcgtcaagtcctgggcccaggcctcagtcacacacggtgcccatggtgatggtgggcgggcgagcagcctgctgagccgctttagtcgcgaagagttccctactttacaagcagccggagaccaggataaagccgccaaagaaagggagtcagccgagcagtcctccggaccggggccgtccctgcgcccacaaaactccacgacttggcgtgatggaggagggagaggacctgacgaactggaaggacctgactcaaaattgcatcacggccacgacccacgagggggcctccagccttctggccccccccagttccccccttataggggaatgatgcctccgttcatgtatcccccctacttaccttttccacccccttatggtcctcagggaccatatagatatcctacaccagacgggccttcgaggttccccagggtggcaggacctcgcggatccggacctcccatgcggctggtcgagccggtggggagacccagcatcttgaaggaggataacctaaaggaatttgatcagctggatcaggagaatgatgatgggtgggccggggcccacgaagaggtggattatacagaaaaactgaagttttcggacgaggaggatggccgggatagcgatgaggagggcgctgagggccaccgcgacagccagagtgctagtggggaggaacgcccacccgaagcagacgggaagaaaggaaactcccccaactcggaacctccaaccccaaaaactgcctgggcagagaccagtaggccacccgagaccgaacccggacctccagctcctaagcctcctttgccacccccccataggggaccagccggcaactggggaccgcccggagattatccagatcgggggggtccaccctgcaaacctccagcaccagaggatgaggatgaagcttggagacagcgacggaaacagtcaagttcggagatatcactggccgtggaaagagcaagacgaaggcgggaagaagaggagcggcgcatgcaggaggagagacgcgcggcgtgcgctgagaaactcaagcggcttgatgaaaagtttggcgcacccgacaaaagactgaaggcagagcctgcggctcctccagctgcaccctccactcccgcgcctcccccagcagtgccgaaggaacttcccgcccccccagcacccccaccagcgagtgctccaactcctgagaaagaacccgaagagcctgctcaggccccaccagcacaaagcaccccaacacccggtgtggctgccgcacccacactggtgtcagggggcgggtcaacatctagtacaagttccggctcctttgaagcttcacccgtggagcctcagcttcccagtaaagaggggccagagccccccgaggaagtgccacccccaaccacaccccctgtcccaaaggtggaaccaaagggggatggcatcgggccaacgaggcagcccccatcacaaggcctgggctatccaaaataccaaaaatccctcccccctcgatttcagcggcaacagcaagagcagctgctgaaacagcagcaacagcaccaatggcaacaacaccagcagggttccgcgcctcctacacccgtgcccccaagtcccccccaaccagttacattgggggctgtgccggccccacaggctccaccccctcctcctaaggcactgtatcccggggcccttggaaggcccccgccaatgccccccatgaacttcgacccaagatggatgatgatccctccatatgtggaccctcgcctactgcagggaagaccccctctggatttttacccaccgggggtgcaccctagcgggctcgtcccacgcgaacggtcagattccgggggtagctccagcgagccatttgatcggcatgctcccgcaatgctcagggaacgcggaacccctccagtagatcctaaactagcttgggtgggtgatgtgttcaccgcaacgcccgccgagcctagaccactaacctctccattgagacaagctgctgatgaggatgacaaaggaatgagatcagaaacacctcctgttccaccacccccaccctatctggcgagctatcccggcttccccgaaaatggcgctccaggaccacctatcagtcgctttcctctcgaggagccggggccaaggcctctcccctggcctcctggatcagacgaagtcgcaaagattcagacccccccacccaaaaaggaaccccccaaggaggaaacagcccagttgaccgggcctgaggccggacggaagccagcacgaggcgtcggttccggcggacaaggcccacctcctcctcgccgggaatcgaggaccgagacacggtggggaccccggcctggatcatctcggagggggattcctccagaggagccaggtgcgcctcctagacgcgctggcccaataaaaaaacctcccccacctacaaaggtagaagaactgcctccgaagccgttggagcagggcgacgagacgcccaagccgcctaagccagatcccctcaaaattaccaagggaaagctaggagggcccaaagagactcctcccaatggaaacctgagcccagctcctcgactgcgccgtgattacagctacgagcgcgtcggccccacttcctgcagggggagagggcgcggcgagtactttgctagaggaagaggctttaggggaacgtatggaggacgcggccggggcgctgccggaaatagcgctgtcactgagtcttttgaagagatgatgggcgtggaggtcgggcagggggatcagacgacgctgttgctgccagaggctgcgttaccggctaggcacggggcccgggtgcagtctatgcggaagagcccatctggtgcaggaagtggcgcacagaaacaagcagccagaccaatgcgggtcatctggctcctccagacccggcggctaccgcatccacgccgagagcattctcccaggtcgcggtcaccaactacgaggtctcctacctttccagcgcccgccagatttactcccggggtgggtgagagctcactgccagagggcatcagtcctggaccaagaaggagagagcctccgcaggtgtgtccagggtggagtcctccggcgaagagtctggcccctaagaaaccgccaacaggcccactgccgcccagcaaagaaccattgaaggagaagcttatccccggcccattgtcccccgtggcccgtgggggatcaaatggcggatcaaatgtgggaatggaagatggcgaaagaccacggcggaggcggcacgggcgggcacaacagcaagacaaaccccctcggttcaggcgcttaaagcaggaaagggaaaacgccgctcgcgggtcggagggcaagcccagcctgaccttacctgcctccgcccctggcccagaggaggccttgactacagtcactgtggcaccagctcctagaagagccgccgcaaagtcccctgacctgtccaaccagaatagcgaccaggcaaatgaagagtgggaaacagcctctgagagttctgatttcacgagcgaaaggcgcggtgacaaggaagcccctcctcccgtgttattgacccccaaagcggttgggacaccaggggggggcggagggggtgcagtgcccggcatctctgctatgtcacgcggagatttgagccagcgggcgaaggacttgagcaaacgttccttttcatctcaacgcccaggaatggaaagacaaaatcggcgccctggccccggtggcaaggcagggtcttctggctcctctagcggtgggggcggtggaggcccaggaggacgtaccggcccaggccgaggcgataagcgcagctggcctagccccaagaaccgttcgcggccacccgaagagagaccacctggtcttccattgcccccaccccctccgagttcaagcgccgtgtttaggctcgatcaggttatacattctaacccggctgggatacaacaggccctggcccagctcagcagccggcaaggatccgtgaccgctcccgggggacatccccgccataaaccagggcctccccaggcacctcagggcccctccccccgcccacctacgcgttacgagccccagcgcgtgaactctggactgtcctctgatccgcactttgaagaaccaggtccgatggttaggggggtggggggcacacctagagacagtgctggagtatcccctttccccccaaagcgcagagaacggcctcctagaaagcccgagttgctccaggaagagtcgttaccacccccgcacagctcaggctttctgggatctaagccggagggcccagggccccaagcagagagcagggatacaggtacagaggcgttaactccacatatatggaatcgccttcataccgccaccagccggaaaagttacagacccagttctatggagccatggatggagccactgagtccattcgaagatgtggctggtactgagatgtcccagagtgactccggtgttgatctatctggtgactcacaggtgtcatctggcccatgttctcagcgctcttcgccagacgggggccttaagggggcagcagaaggcccacctaagagaccagggggaagctcccccctcaacgccgtaccctgtgagggccctccagggtctgagcctccccgaagaccaccacctgctcctcacgatggcgaccgaaaagagctgcccagagaacagccacttcccccagggccaatcggcaccgagagatcccaacatacggaccgaggcaccgaacctggccctatccgccccagccatcggcccggtccacccgtccaatttgggacttctgataaagacagtgacctgcgcctcgtcgtgggtgactcactgaaggccgagaaggaactgaccgccagcgtaacagaggctattcctgtcagccgcgactgggaactcctgccctcggcggcagcttccgctgaacctcaaagcaaaaatctggacagtggccattgtgttcccgaaccctcctcttccgggcaaaggctttatcccgaggtgttctacggatctgcagggccctcttctagccaaatcagcggaggtcacggactttcagtgaccagcaagcaatggaggcgcccggggacgcccagtctgcacccttaccgtagccagcccctctacctaccacccggcccggccccaccaagtgccctgctctctggggtagccctcaaggggcagttcctggacttctcaaccatgcaggcaaccgagctgggaaagctgcccgctggaggtgtcctttatccacccccgagttttttgtatagccccgccttttgcccatcacccctgcctgacacctccctgctccaggtgaggcaggacctaccctccccatctgacttttacagcacccctctgcagcctgggggccagagcggcttcttgccgtcaggagcccccgctcaacagatgttacttcccatggtggatagccagctccctgtggttaattttggatctctgccaccggctccccctcctgcgcccccctcactgtccctcttgcccgtgggccctgccctacagcccccatcgctcgcagtccgacctcctcccgctccagcaacacgggttcttcctagtcctgctaggccgtttcccgcctctctcgggcgagccgaacttcaccctgttgagctgaaacccttccaggattaccaaaagctctctagcaacttgggaggtcctggcagctcacgcactcctcccacgggcaggtcattttctggactgaattcacggctgaaggccacaccaagtacgtactccggtgtgttccggactcaaagggttgacttataccagcaggcttctccccctgacgccctccggtggattcccaagccctgggagcgcaccggtccaccccctcgagaaggcccatcgcgaagggcagaggagcccgggagtcggggtgacaaagaaccaggtttacctccaccaagatag

SEQ ID NO: 130065 - DNA, 1650 bp, Artificial Sequence
  Description of Artificial Sequence: Synthetic coding sequence
atgtctgacaggtccggtccaactgctaaagggaaagacgggaaaaaatacagtagcctcaacctgttcgacacatataagggtaaatcacttgaaattcagaagcccgctgtagcccccaggcatggactgcagtccttaggaaaagtggcaattgcaagacgcatgcccccccccgccaatctgccgagtctcaaggctgaaaacaaaggaaatgacccaaacgtctctttggtcccgaaggacggaacaggatgggctagcaaacaggagcagtccgatcctaagagtagtgatgcaagtaccgctcagccccccgaatcacaacccctgcctgcttcgcagacacccgcatctaaccagccaaaacggccacccgccgcaccagaaaatacaccactggtgccctcaggggtgaaatcgtgggcccaggcaagcgtgacacacggggcacacggggatggagggcgcgcatcgagcttgctttcaaggtttagcagagaggagttccctacactccaggcagcgggcgaccaagacaaggcggcgaaagaacgcgaaagtgccgagcagtcctctgggccaggaccctcactgcgtccacagaactcaacaacctggcgcgatggcggcggccggggccctgatgagcttgaaggccccgactctaagttacatcacggacacgatcccaggggcggacttcaaccctcagggcccccccagtttccaccatatcgaggcatgatgcccccgttcatgtatcccccctacttaccatttcccccaccgtacggccctcaggggccttatcggtatccaacccctgacgggccttccaggttcccccgcgtagccggtcctcgtgggagcggaccacccatgagactagttgagccagtcggtcgaccgtcaatcctgaaggaagacaatttaaaggagtttgaccagttggatcaggagaacgatgacggctgggcaggtgctcacgaagaagttgattatactgagaagttgaagttcagtgatgaggaggacggccgcgattctgatgaggagggagcagaaggacaccgggactctcaatctgcgtctggcgaagaacggccaccagaagcggacggaaagaaaggtaatagccctaactccgagccgcccactccaaaaactgcgtgggcagaaacctctagacccccagagactgaaccaggccccccagctcctaagccaccactcccccctccccatcgcggaccagctggaaactggggtccccccggggattatccagaccgtggtgggcccccgtgcaaaccacctgcccctgaggacgaagatgaagcttggcggcagcggcgtaagcagagtagttctgaaattagtttggccgttgagagggcgaggcggagaagagaggaggaggagagacgtatgcaggaagagcggcgtgccgcatgcgccgagaaactgaaaagactggatgagaagtttggcgccccggataagcgactgaaggctgaacccgcagctcccccagcagccccttctaccccggctcctcctccggcagcgtcggaggtaccactgatggaggattcccgagggcagcagcgtgatccccccagaggccttgaggctccccacccttag

SEQ ID NO: 130066 - DNA, 1650 bp, Artificial Sequence
  Description of Artificial Sequence: Synthetic coding sequence
atgagcgatagaagcggtccaactgctaaggggaaggacggcaaaaaatattcatccttgaaccttttcgatacctacaaaggaaagagccttgagatacagaaaccagcagtcgcgcctaggcatggattgcagtcactaggtaaggttgccatcgctcgtaggatgccaccacctgccaacttaccgtctctgaaggcggagaataaaggaaatgatcctaatgtgtcgctggttcctaaagacgggaccgggtgggcttctaagcaggagcagtcagacccaaaatccagtgacgcttctaccgctcagcctcccgaatcgcagcctctgcctgcgtcacagactcccgcttcaaatcaacctaaacgaccacccgcggcaccggaaaacaccccattagtcccttccggggtgaagagctgggctcaagctagtgtgacccacggagctcatggcgatgggggccgcgcatccagcttgttgtcaaggttcagccgcgaggagttccctactttgcaagccgccggagatcaagacaaagcagctaaagaacgtgagagcgctgaacaaagctcagggcccggtccctctttgcgcccccagaattccacaacatggagagacggcgggggaaggggccccgacgagctcgaaggtccagacagtaaattgcaccatggtcatgacccaaggggtgggctgcagccctcaggcccacctcagttcccaccctacagaggtatgatgccccctttcatgtacccgccttatctgcccttccctcctccttatgggccacagggcccctaccggtatccaacccctgacggccctagtaggttccctcgggtcgcggggcccaggggctctggacctccaatgcgcttagtggagcctgtcggtaggccttcaattttaaaggaggataatctgaaagaattcgaccaactcgaccaagagaatgacgacggatgggcgggggcacatgaagaagtagattatacagagaaactgaagttttcagatgaagaggatggccgcgactccgatgaagagggtgctgaaggacatcgggatagccagtccgcaagtggggaggaaaggccccccgaggctgatggtaagaaaggaaactccccgaatagcgagcccccaactcccaaaaccgcctgggctgagacaagtcgcccgccagaaactgaaccgggccccccagcacctaaaccacccctgcccccgccacacaggggacctgccggaaattgggggcctcctggtgactacccagatagaggaggacccccttgtaaaccaccggctccggaagacgaggatgaagcatggcgacagcggaggaaacagtcttctagtgagatttcactggctgtggagagggctcgacgacgcagagaggaggaggagagacgcatgcaagaagaacgtagggcagcttgtgccgaaaaactgaagaggctcgacgagaagtttggagcccccgacaaaagactcaaggctgagccggcagctccacccgcagcaccgtctacgcctgcgccgccacctgccgcaagtgaagtacctctgatggaggattctcgcgggcagcagagagatccacctagaggcttggaggctccacacccttag

SEQ ID NO: 130067 - DNA, 4149 bp, Artificial Sequence
  Description of Artificial Sequence: Synthetic coding sequence
atgctgcgtgaacgtggtacaccacctgtggaccctaagctcgcctgggttggcgacgtgtttaccgcgacgcctgccgagcctcggccactcacaagccccctgagacaagccgctgatgaggatgataaaggcatgcgatccgagaccccccctgtgcctcccccacctccttaccttgcgagctacccaggattccctgagaatggagcgcccgggccgccaattagccgattcccgctggaggaacctggcccacgccccttgccttggccacccggcagtgatgaagtcgccaagattcagactcctcctccgaagaaggagccaccaaaggaagaaaccgcccagctaacgggaccagaggctggccgcaagcctgcccgaggggtcggttctgggggacaaggacctccaccacctagaagagagagcaggacagagaccaggtggggtccaagacccggctcctctagaaggggcattcccccagaggagccaggcgccccaccgcgccgagctggacccattaaaaagccgccaccacctacaaaggtggaggagctgccgccgaagcctctggaacagggagacgagacacccaagcccccaaagcctgatcctctgaaaatcacaaaaggaaaactcgggggccccaaggagacgcctccgaatggcaacctttcacctgctccccgactcaggcgagactatagctacgaacgtgttgggcccacgagctgtcgcggtagaggtagaggtgagtactttgctcgtggacgggggttcagaggaacctacgggggtcggggcaggggtgcccgctctcgcgagtttcggtcctaccgggagttcaggggagatgatggaagaggagggggcaccggcggcccaaatcacccccctgctccccggggtcggacggcttcagaaaccagaagcgaaggaagcgagtatgaggagattcctaaacgccgccgccaaaggggatctgagactggttctgagacgcacgaaagtgacctggcgcctagtgacaaggaagcccctaccccaaaggaaggcacgctcacccaggtgccgctggcccccccaccccccggtgctccaccttcccctgctccagccaggttcacagctaggggtgggagagtctttaccccccgaggcgtgccttcacgcagggggagaggtgggggacgtcctcccccccaggtttgccccggatggtctcccccagctaaaagcctcgcccccaagaaacccccaaccggcccactgccgccaagcaaggaacccctgaaagaaaagctcatccccgggcctttatccccagtcgctcggggtggaagtaacggaggatcgaatgtgggtatggaggatggagagaggcccaggcgacggaggcacggaagagctcagcagcaggacaagccaccgcgatttcgaaggctgaagcaggagcgggagaatgccgcccgaggatccgaaggcaagccctcgctcaccctcccagcttccgcacccggccctgaagaggcactgactaccgtgaccgtcgctcccgcacccagacgcgctgccgcaaagtccccagatctgtccaatcagaacagcgaccaggcaaatgaggagtgggagactgccagtgagagctccgatttcaccagcgaaaggagaggcgataaggaagcccctccccccgtccttctgacacctaaggcagtcggcactccaggcggaggcggaggaggcgctgttccgggaataagcgcgatgagcagaggggacctgtctcagagagccaaggacctgagcaaacggagttttagcagccaacggccagggatggaaaggcaaaatcgacgccctgggccaggagggaaagctggcagttcaggttccagcagtgggggaggcggaggaggacctggcgggagaaccggacctggtcgaggtgacaaaaggtcatggcccagtcccaagaataggtctaggcctcctgaggaacggccccctgggctgcctttgccccctcctcccccttcttcctccgctgtcttcaggcttgatcaggttattcactccaaccctgctggaatacagcaggcgctagctcaattgtcatctaggcagggttcggtgactgctcctggagggcatcctaggcataaacccggcccaccacaggcccctcagggtccctccccaagaccgcccacacggtatgagcctcaaagagttaattccggcttaagcagcgatccacatttcgaggaacccggccctatggtccgcggagtgggaggcactcctagagatagcgctggggtgtctcctttcccccccaagcggcgagaaaggccaccacggaaaccagaattgctgcaagaggagagcctgcctccccctcacagctctggttttctcggtagcaagcccgagggccctggcccgcaggcagaaagtagggacaccggcaccgaggcccttacccctcatatctggaatcgactccacactgcgaccagtcgaaagagttacagaccatcatccatggaaccgtggatggaaccgttaagcccatttgaggatgtggcagggactgagatgtcacagtccgactctggggtggacctctccggcgactcacaggtatcctcagggccatgctctcagcgcagcagcccagatggcggacttaagggagccgccgagggcccccccaagcggcccggaggctcatcacctctgaatgcggttccatgcgaaggcccaccgggctctgagccgccgcgacggcccccgcccgctccccacgatggagatcgcaaagagcttcctagagagcagcccctgcccccaggccccataggcactgagcgcagccagcacacagacaggggaaccgagcccggccccattcgtccttctcatcggcccggcccacccgtccagttcgggacgtctgataaggatagcgatctccggctggtcgtgggcgattctttgaaggcggaaaaggagcttacagcttcagtcacggaagccattcccgtaagtcgggattgggaacttctccctagcgcggccgcctcagctgagccccagagtaaaaatcttgatagcggccattgtgtcccagagcccagctcaagcggccagcggctgtaccccgaggtgttctacggcagtgcggggccctcctcaagtcagatatccggcggggctatggacagccagttgcatcccaactctggaggttttcgcccagggaccccatctttgcacccttatagatcccagcccctgtacctaccacccggtcccgctcccccctcggccctgctttcaggcgtggccctgaaaggtcaatttttagacttcagtactatgcaggccaccgaattaggcaaactgccagccggcggggtgctctatcctcctcccagcttcctttacagcccagcattttgtccttccccattacctgatacttctctgctacaagttcggcaagacttaccatcaccttcagacttctattctacgccgctgcagcctggagggcagtcaggcttcctgccttcaggcgcacccgcccagcagatgctgctccccatggttgatagtcaactgccggtggtgaactttggcagccttcctccagctccaccccccgcaccgccatcgctttcgctcctgccagttggccctgcccttcagcctccctctctcgcagtacggcctcccccagcaccagccaccagagtgctgcccagccctgcccgtccattccctgcttcgcttggccgagcggagctgcaccctgttgaactgaagcccttccaggattaccagaaactttcctcgaacctgggaggtcctggctcctcacggacgccacccaccggcaggtccttttccggcctcaacagccgcctcaaagcaactccctccacgtacagtggggtgtttaggacacagcgggtggacttataccaacaggcttcccccccagacgccttgagatggatcccgaaaccatgggagaggactggtccccccccccgtgagggcccttcccggagagcagaagagcctggctctaggggcgataaagagccaggtcttccacccccacggtag

SEQ ID NO: 130068 - DNA, 984 bp, Artificial Sequence
  Description of Artificial Sequence: Synthetic coding sequence
atgaccgtggtttcggtgcctcagcgcgagcctctggtgctgggggggcggctggcgcccctcggattttccagtaggggatattttggcgccctgcctatggttacaacggcacctccaccgctgcctaggattcccgacccacgggctctgccaccgaccctgtttttaccgcactttctgggcggcgatggaccctgtctgactcctcaaccacgggctccagcggctctgccaaacagatctctggcagtggccggcggtactccgagagctgctcccaaaaagcgccggaaaaaaaaggtcagggcctcccctgctggacagctgccctcccggtttcaccaataccagcagcatagaccttccttggagggtggaaggtctcccgcgaccgggccctcaggcgctcaggaggtgccaggaccagcggctgcattggctccctcccctgctgctgccgctggaactgagggggcctctcccgatctggccccgctacggcctgcggccccaggtcagacccccctcaggaaggaagtgctaaagagcaagatgggcaagagcgagaagatagcgctccctcacggtcagctcgtccacggtatccacctgtatgaacagccgaagataaaccggcagaagagcaaatacaaccttccactcactaagataaccagcgctaagagaaacgaaaacaacttttggcaagattccgtttccagcgaccgaattcaaaagcaggaaaaaaaaccctttaaaaatacggagaacataaagaatagccacctgaagaagtcagcattcctaacggaagtcagccagaaagaaaattatgccggagccaagttttccgacccaccaagccccagcgttctgcctaagcccccgtcccattggatgggtagtacagtggaaaactccaatcagaatagggagctgatggctgtgcacttgaaaaccctacttaaggtgcagacctag

SEQ ID NO: 130069 - DNA, 429 bp, Artificial Sequence
  Description of Artificial Sequence: Synthetic coding sequence
atgggcaagtccgaaaaaatcgccctgccacacgggcagctggtacacggtattcacttgtacgaacagcctaagattaatcgccagaagagcaagtacaatctgcccttaaccaagatcacaagcgccaagcgcaacgagaataatttttggcaggatagtgtgagttctgatagaattcagaaacaggagaaaaagccctttaagaacaccgagaatatcaaaaacagccacctcaagaagagcgcatttttgaccgaggtctcccagaaagagaactacgctggtgcaaagttttccgatcctccttctccatccgtcctccccaagccaccgagtcattggatgggttctactgtggagaacagtaaccaaaatcgcgagctgatggcggtgcacctcaaaaccctgcttaaggtccagacatag

SEQ ID NO: 130070 - DNA, 429 bp, Artificial Sequence
  Description of Artificial Sequence: Synthetic coding sequence
atgggtaagtctgagaaaatcgccctccctcatggacaattggttcatgggattcacctttatgagcaaccgaaaatcaataggcagaagtcgaagtacaatttgcccctgaccaagattacatcagcaaagcgcaacgaaaataacttctggcaagattccgtgtcttctgatcggatccagaagcaagaaaaaaagccctttaaaaataccgagaatatcaagaattcacatttgaagaagtcggcattccttaccgaggtctcccagaaggagaactacgccggagctaagttctccgatccacccagcccatctgttcttcctaagcctcctagtcactggatggggagcaccgtggaaaattcaaatcagaatcgggagctcatggcggtgcacttgaagacactcctcaaggttcagacctag

SEQ ID NO: 130071 - DNA, 420 bp, Artificial Sequence
  Description of Artificial Sequence: Synthetic coding sequence
atgggcggcggcgagagatacaacatccccgctccccagagccggaacgtgtctaaaaatcaacagcagctgaatcgccagaagaccaaggaacagaacagccaaatgaagatcgtccacaaaaagaaagagagagggcatgggtataactccagcgcggctgcgtggcaggccatgcagaatggcgggaagaataagaattttcccaacaatcagtcatggaacagcagtttgtctggccctcggctcttatttaaatcccaggcaaatcagaattacgccggtgccaagttctccgagcctccgagtccgagtgtgttgcctaaaccccctagtcactgggtgccagtcagcttcaatccttctgacaaggagataatgacatttcaacttaagaccttgctgaaggtgcaggtatag

SEQ ID NO: 130072 - DNA, 420 bp, Artificial Sequence
  Description of Artificial Sequence: Synthetic coding sequence
atgggcggcggggaaaggtacaatatccccgctcctcagtcacgcaacgtaagcaaaaatcagcagcaactaaataggcagaagactaaggagcagaacagtcagatgaagatcgtgcacaagaagaaagaacgcggacacgggtataatagtagcgcagcagcttggcaagcgatgcagaacggggggaagaacaagaatttcccaaacaaccagtcctggaattcgagcctgtctggccctcgtcttttatttaaatcccaggctaaccagaattatgctggcgccaagttcagtgaaccaccctcgccaagcgtgctgccaaagcccccctctcactgggtccccgttagcttcaacccttctgataaagagatcatgacatttcagctgaagacacttctgaaggtacaagtgtag

SEQ ID NO: 130073 - DNA, 597 bp, Artificial Sequence
  Description of Artificial Sequence: Synthetic coding sequence
atgcttttgattctgcttagtgtggccctgctagcactcagctctgcacagaacctgaatgaggatgtttcccaggaggagagtccctccctaattgccggtaatccccaggggccctctcctcagggcggtaacaagccgcaggggccacctcccccacctggcaaaccccaggggccaccaccccaaggcggcaacaaacctcagggtccacccccgcctggcaaaccacaggggccccctccccagggagacaagtccaggtcaccccggtcacctcctggaaaacctcaaggtccacctccgcagggcggcaagccacagggaccgccgccccaggggggcaacaaaccccaagggcctcctccccctggaaagccccagggcccacctgcgcaggggggatccaagagtcagtctgcccgaagcccccccggtaaaccacagggcccaccacagcaggaaggtaataaccctcaggggccacctcctcccgcaggggggaaccctcagcagcctcaggcgcctccagctggacaacctcaaggaccacctcggcctccacaggggggcaggccttctagacccccacagtag

SEQ ID NO: 130074 - DNA, 537 bp, Artificial Sequence
  Description of Artificial Sequence: Synthetic coding sequence
atgttgctgatcctgttatccgtggctctgctcgccctgagctctgctcagaatttaaacgaagacgtgtcacaggaagagagtccttccctcattgctggcaacccacagggacctagtccgcagggaggaaacaagcctcagggaccaccccctcctccaggtaaaccgcagggtccaccgccacaaggcgggaataagccgcagggccccccaccgcctggaaaacctcaagggccaccccctcagggagataagagtagatccccacgctcccctccaggcaaacctcagggcccacctccccagggcggcaagccccaggggcctccagctcaggggggaagtaagtcccagtcggctcggagtccacctggaaagccccaaggcccaccacaacaggaagggaataaccctcaaggtccgcctcctcccgctggcggaaacccccagcaacctcaagcaccaccagccgggcagccacagggtccacccagacccccccagggagggcgacccagcagaccacctcagtag

SEQ ID NO: 130075 - DNA, 597 bp, Artificial Sequence
  Description of Artificial Sequence: Synthetic coding sequence
atgttattgatcctgctctctgtggccctccttgccctgtcatccgcccagaatctgaacgaggacgttagccaggaagagagtccctcccttatcgccggtaacccacagggccccagcccccaagggggaaataagccccagggtccccctccccccccaggaaaaccccagggtcctcctccccaaggaggcaacaaaccacagggcccaccgcctcccggaaaaccccagggtccaccgccacaaggcgacaagagccgctctcccagaagtcctccagggaaaccccagggacctcctccccaaggcggaaagccccaaggtccacctccccagggggggaataagcctcaggggcctccacctccagggaaaccacaaggaccgccagcacagggtgggtccaagagtcagagcgcaagatctccaccgggcaagccccaaggacctccccagcaggaaggcaataatccacaaggtcctcctcccccagccggggggaaccctcagcaacctcaagcgcctcctgccggtcagccacagggaccgccaagaccaccgcagggaggacggccctcccgcccaccacagtag

SEQ ID NO: 130076 - DNA, 1251 bp, Artificial Sequence
  Description of Artificial Sequence: Synthetic coding sequence
atgctgctgattttgctgagcgttgcccttctggccctgtcctccgcccagaacctgaatgaggacgtgagtcaagaagaaagtccttccctgattgccggcaacccgcagggtgcaccacctcaggggggaaacaaacctcagggcccgcctagccccccggggaaaccccagggacccccccctcaaggagggaaccagcctcagggccctccaccccctcctggaaagccgcaaggacccccacctcaaggaggcaataagcctcaaggacccccccctcccggaaagccccaggggccgccaccccagggcgataaatctagaagcccgaggtccccccccggtaagcctcaggggccacctccgcaaggaggaaatcaaccgcaaggccctccacctccaccaggaaaacctcagggcccgccgccacagggagggaataagccccaaggcccaccgcccccggggaaaccacaaggccctccgccccagggtgataacaagtcaaggtctagccggtccccaccaggtaaaccacagggtcctcctcctcagggcgggaatcagccacagggaccaccacctcccccaggaaagccccagggcccccccccccaggggggcaataagccccagggcccgcctcctcccggtaagcctcaaggccctcccccacagggcgacaacaagtctcagtctgcacgcagtcctcccggaaaaccccagggaccaccccctcaaggggggaaccagccacaaggccccccacctccccctgggaagcctcagggacccccaccccagggtggaaataaaccacaagggcctccaccacctggaaagcctcaggggcccccgccacaaggcggctctaaaagtaggtcttcgagaagtccgccaggtaagccccagggccccccgccccaagggggtaatcaacctcagggaccaccaccaccaccagggaaaccccaggggcctcccccccagggtggaaacaagcctcaggggcccccccctcccgggaagccccaaggcccccctccccagggcggctccaaaagcaggtcggctaggagccccccaggaaaaccccaggggcctcctcagcaggagggtaacaatccgcaaggcccaccaccgccggctggtgggaaccctcagcagcctcaggctcccccagccgggcaaccccaaggcccgccacgtcccccacagggagggcggccatcccgaccaccccagtag

SEQ ID NO: 130077 - DNA, 744 bp, Artificial Sequence
  Description of Artificial Sequence: Synthetic coding sequence
atgctgctgattcttttatccgtggccctcctggccctgtcctccgctgagagcagtagcgaggacgttagtcaggaggagagccttttcttgatatccgggaagcccgagggtcggaggccacaggggggaaaccaaccacagaggcctccgccaccccccggcaagccccagggcccccccccacagggaggtaatcagtcacagggccctccaccacctccaggaaaaccagaaggccgccccccacagggcggcaatcagagccagggaccacccccccatccaggcaagcctgaacggccacctcctcaggggggaaatcagagtcagggaacacccccccctcccggcaaacccgagcgcccacctccgcaagggggcaatcagagccatagaccccctcccccaccgggaaaaccagagcgccctccgccacaggggggtaaccaaagccaggggccccctccccatccaggcaaacccgaaggaccacctccacaagaaggcaataagagccggtcagccagatcacccccagggaaaccccagggtccaccacagcaggaaggtaacaagccccaaggtcctcccccccctgggaagccccagggtcctccacctgcaggagggaatcctcagcaaccccaagccccccccgccggcaagcctcaaggaccaccgccgcctcctcaaggcggtcgcccccctcggcctgcacaaggccaacaaccgcctcaatag

SEQ ID NO: 130078 - DNA, 744 bp, Artificial Sequence
  Description of Artificial Sequence: Synthetic coding sequence
atgttgctgatccttctgtctgtagcgctgctggccctgtcctcggccgagagctcctccgaagatgtaagtcaggaggagagcctcttcctgatatctggaaagccagagggtcgtaggccccagggcggcaaccagccccagcggcctccccctccgcccggtaagcctcagggccctccaccccaggggggcaaccaatcacagggccccccaccccctcctggtaagccagaggggcggcccccccagggcggaaaccagagccagggtcctccacctcatcccgggaagcctgagcggccaccacctcaaggcgggaaccagtcgcagggcacaccacctccacccggaaagcctgagcgccccccaccacagggagggaatcagagccacaggcccccccctccgcccggaaaaccagagaggccgcccccccaggggggtaaccagtcgcaaggaccaccaccacatcctggcaaacctgagggccccccaccacaggaaggcaataaatcgagatccgcaagaagcccccctggcaaaccccaagggccccctcagcaggaaggaaacaaaccgcagggcccacctccccctggtaagccacaagggcctcctcctgctggaggcaacccccaacagccgcaggcaccccctgccggaaagccccaaggacctcctccccctccccagggtggcaggcccccgcgccccgcccagggtcaacagcccccgcagtag

SEQ ID NO: 130079 - DNA, 537 bp, Artificial Sequence
  Description of Artificial Sequence: Synthetic coding sequence
atgttgttaatcttactgtcagtggccttgttggcccttagctccgctgaatcttcctctgaggatgtgagccaggaagagagtctgttccttatttccgggaagcctgagggtcgtaggccacaaggcgggaatcagccccagagacccccccccccaccaggcaagccacagggacctccgcctcaaggaggaaatcagagccagggacctccgccacccccaggcaaaccggaagggagaccaccacagggaggtaaccagtcccagggacctccaccacaccctggaaaaccagagaggcccccccctcaaggaggaaatcagtcacagggtaagccccagggccctccccagcaagagggcaataagccacagggcccacccccgcccgggaagccccagggaccaccacctgccgggggcaacccacagcagccccaggccccacccgctggtaaaccccagggccccccacctccaccacaaggtggaagaccaccaaggcccgcacagggtcaacagccaccccagtag

SEQ ID NO: 130080 - DNA, 501 bp, Artificial Sequence
  Description of Artificial Sequence: Synthetic coding sequence
atgctgcttatccttcttagcgttgcccttctggccttctctagcgcccaggatctaaacgaagacgtaagtcaggaggacgttcccttggtaattagcgacggcggagactcagaacagttcctcgatgaggaaaggcaaggacctccactgggcgggcagcagtcgcagcctagcgctggagacggcaaccaggacgacggacctcagcagggccctcctcaacagggaggtcagcagcagcaggggcctccacctccacagggaaagccccaagggcccccccagcaaggagggcacccgcctcctcctcagggtcgaccccaggggcccccccaacagggaggccaccctcgccccccgcgaggcaggccgcagggcccaccacagcagggcggtcaccaacagggccccccccctccaccacctggcaagcctcagggccccccgccacaggggggacggccgcaggggccaccccaggggcagtccccacagtag

SEQ ID NO: 130081 - DNA, 291 bp, Artificial Sequence
  Description of Artificial Sequence: Synthetic coding sequence
atgctgctgattctactgtccgtcgccctgctggccttctcatcagcccaagacctcgatgaagacgtttctcaagaggacgtccccctggtgatctcagacggcggcgactctgagcagttcatcgacgaagaaggtcataaggatcaccccaaccgagaggctatcagcaaagttcttccacatctgctgctcgaaagcccaagggatcacctccccaagggggctgcccacaaggatttacaccgtgggtcgctactatcaaacctgggctttaacgatcgtaaatag

SEQ ID NO: 130082 - DNA, 501 bp, Artificial Sequence
  Description of Artificial Sequence: Synthetic coding sequence
atgctcctgatcctgctcagcgttgcactgctcgccttcagtagtgcgcaggatttggacgaggacgtgtctcaggaggacgtacccctggtgatcagcgatggtggggattcagaacaattcattgacgaggagcggcaggggcccccgctgggcgggcagcagagccagcctagtgccggagatggcaaccagaacgacggtcctcagcagggtccaccacagcagggaggccaacagcagcaaggccctcctcctccacaggggaagcctcaggggccccctcagcagggaggtcaccccccacctccacagggtcgaccccaaggcccgcctcagcagggggggcacccaagaccaccccgggggcggccgcagggccctccccagcaagggggccatcagcagggacccccaccccccccgccgggaaaacctcagggccctcctccccaggggggacgcccccagggcccgcctcagggccagagcccacagtag

SEQ ID NO: 130083 - DNA, 501 bp, Artificial Sequence
  Description of Artificial Sequence: Synthetic coding sequence
atgctgctcatcctgctatcagtggcactgctcgccttctccagtgcccaagacctcgacgaagacgtctcacaagaggacgtacccctcgtgataagcgacggaggcgactccgaacagttcatagacgaagagagacaaggcccgcctttaggaggccagcagagccagccctccgcaggcgatgggaaccagaacgacggacctcagcaaggtccaccgcagcagggaggacagcagcagcagggaccgccgccccctcagggcaagcctcagggacctcctcagcagggcgggcacccaccaccgccccaggggcgaccacagggccccccccaacagggcggccacccgaggccccctcggggaaggccccaaggccccccgcagcagggaggtcatcagcaggggccccctccgcccccacccggcaagccacaagggccaccgcctcagggggggcgcccccaaggacctccacagggccaaagtccgcagtag

SEQ ID NO: 130084 - DNA, 900 bp, Artificial Sequence
  Description of Artificial Sequence: Synthetic coding sequence
atggctgccagtagtagcgaaattagcgagatgaagggagtggaagagagtcccaaggtgcctggcgagggacctggccattcagaggccgaaacaggacccccacaggttttggccggagtccctgatcagcctgaggcaccccagccagggcccaataccacagctgcacctgtggattctgggcctaaggctggtctggcccccgagactacagagacaccggccggagcgagtgaaacggctcaggcaaccgacctgagtttgtcgccaggaggggagtcaaaagctaactgctctcccgaggacccttgccaagagactgtgtcaaaaccagaggtctccaaagaagcgactgccgatcaagggagcaggcttgaatccgcggcacctcccgaaccggcccctgagcctgcaccccagcccgatcctcggcccgactctcaaccaactccaaaacctgcactgcagcctgagcttccaacccaggaggacccaactcctgagatcctttcagaatccgtgggcgaaaagcaagagaacggagcggtcgtgccattgcaagcaggggatggggaggagggccccgcccccgaaccacattcccctccctcaaagaaatctcctccggccaatggtgctcctccacgggtgctgcagcagctcgtggaggaggataggatgaggagagctcattcaggccatcccggctcgccacggggctcgctttctcgtcacccgagcagccagctagccggtcccggggtggagggcggggaaggcacacagaaaccgcgggactacattatcctcgccatcttaagctgcttttgccccatgtggccagtgaacattgtggcatttgcttatgctgtcatggtgtcgcctatgggcccttag

SEQ ID NO: 130085 - DNA, 1023 bp, Artificial Sequence
  Description of Artificial Sequence: Synthetic coding sequence
atggctgcaagttcgtccgagatctccgagatgaaaggcgtcgaagagtcgcctaaggtgcctggagaggggcccggacattccgaggctgagacggggcccccccaggttctggcgggcgtacctgaccagcctgaagcccctcagcccggtcccaacacgactgccgcacccgtggatagcggacctaaggcaggactcgccccggagaccacagagacacccgctggagcgagcgagaccgctcaggccactgatttaagcctgtccccgggcggggagagcaaagcaaactgttctcccgaggatccctgtcaagagaccgtgtccaaacctgaggtgtccaaggaggcaacggccgatcagggcagccggctggaatccgcagcgccacccgaacccgcccccgagcctgcccctcagccagatcccaggcctgattcacagccaacgccgaaacccgccctgcagcccgaactgccaacgcaagaggaccccacacctgaaattctgtcagagtctgtgggcgagaagcaggagaacggggctgttgtgcccttgcaggctggggacggagaagaaggcccagcccctgagccgcatagtccccccagtaaaaaatcaccgcctgctaacggagcgccccctcgtgtgcttcaacagttggtggaagaagacagaatgcgccgagcccactcaggacacccaggcagtcctcgaggcagcctgtcccggcatcccagctcacaactggcagggcctggggtggagggtggcgagggaacgcagaaacctagagactacatcatccttgctatactctcttgcttctgtcctatgtggcctgttaatatcgtcgcattcgcgtacgctgtgatgtcacgcaacagccttcagcagggagatgttgacggggcacaacggctaggccgggttgcaaagctcctctccatcgtggcactggtgggcggagtgctgatcattattgcttcctgcgtgatcaacttgggcgtgtataagtag

SEQ ID NO: 130086 - DNA, 1191 bp, Artificial Sequence
  Description of Artificial Sequence: Synthetic coding sequence
atgccacaactgcagttcaaagacgccttctggtgccgtgatttcacggctcacaccggctacgaagtcctgctccagcgtttgcttgacggacgtaagatgtgcaaagacatggaagagctgcttcgccagcgggcccaggctgaagaacggtatggtaaggagctcgtgcagattgccaggaaggccgggggccagaccgagatcaacagcctcagagcatcttttgacagtttaaagcagcagatggaaaacgtgggtagctcacatatccaactggcactcacccttagagaggaacttaggtccttggaggagttcagagagaggcaaaaggaacagagaaagaagtacgaggccgtaatggaccgggttcagaaaagcaagctgagcctctataagaaggcgatggagtcgaagaagacctacgagcaaaagtgtagagacgctgacgacgcagaacaggccttcgaaagaatcagcgcaaacggccaccaaaaacaagtggagaagtctcagaacaaggcgcgacagtgtaaagatagcgccacagaggcagagagggtttaccggcaaagtatagcgcaactggaaaaggtacgagctgaatgggaacaggaacaccgaacgacttgtgaggctttccagctccaggagttcgaccgactgacaattctgcggaatgcgctttgggtgcacagcaatcaactgagcatgcagtgtgtgaaggatgatgagctttatgaggaagtcaggcttaccctagaggggtgctcaatcgacgctgacatagattcattcatccaggccaagtccactggaacggagccaccaggcgaggtgcgccttgcagactcggccgcttctcgtttttctggactgctgcacgggagccctaaaaccacctcattggccgcctccgcagccagtacggagacactgactcctaccccggagaggaatgaaggggtgtacactgccatagcagtgcaggagatccagggcaaccccgctagtcccgctcaggagtacagggccttgtacgactacaccgctcaaaacccagatgagttggacctttcagcaggagatatcctggaggtgatactggagggtgaggatggatggtggaccgtagaacggaacggacagcgggggttcgtgcctgggtcttatttagagaagctctag

SEQ ID NO: 130087 - DNA, 1251 bp, Artificial Sequence
  Description of Artificial Sequence: Synthetic coding sequence
atgatgccccagctgcagttcaaagacgccttttggtgtagagatttcacggctcatacaggctatgaggtgttgttgcagcgcttgctcgacgggcgcaaaatgtgcaaagatatggaggagctgctgaggcagcgtgctcaggcggaagagcgctacggaaaggagctggtccaaattgctcgcaaggctggcggccagacggaaatcaactccctacgcgcctctttcgattcccttaaacagcagatggagaacgtcggttcaagtcatatccagctggccctgacccttcgcgaagaactccgtagtctggaggagttcagagaaagacagaaggaacagagaaagaagtacgaggctgtgatggatagagtacagaagagtaaactttctttgtataagaaagcaatggagagcaaaaagacctatgagcagaaatgcagagatgccgacgacgcagaacaagcctttgagagaatcagcgccaatggccatcagaagcaagtcgagaagtcccaaaacaaggccagacagtgtaaagactctgcaacagaagctgagagggtatatcgtcagtccatagcacagctggagaaggttagggctgagtgggaacaggagcatcgcactacatgtgaggcctttcagctgcaggagttcgatagactgacaatccttcgtaacgctttgtgggtccatagtaaccagctgtcaatgcaatgcgttaaggacgacgagctatacgaagaggttagactcactctggagggctgctcaatcgatgcagatattgatagctttatacaagccaagtcaaccggcacagaaccccctgctccggttccttatcagaactactacgacagggaggtcacacctctcacatcaagtcccggtattcaaccgtcctgtggcatgataaagagattttccggactgttgcacgggagtcctaagactaccagcttggctgcgtctgccgccagcacagaaacattgacgccaacacctgagcggaacgagggcgtctatactgctattgccgtgcaggagatccaaggaaacccagcatcgccagcgcaggaataccgcgcactctacgattacaccgcccaaaacccagacgagcttgatctgagtgccggggatatactggaagttatcctggaaggtgaagatggctggtggaccgtcgagcggaatggacagaggggattcgtacccggttcatatctcgagaagttgtag

SEQ ID NO: 130088 - DNA, 1605 bp, Artificial Sequence
  Description of Artificial Sequence: Synthetic coding sequence
atgatttggtatattctgatcatcggcatcctcctacctcaaagcctggcacatcctggatttttcaccagcattggccagatgaccgatctaattcatactgagaaggaccttgtgacctccctaaaagactatataaaagctgaagaggataagctcgaacagatcaagaagtgggctgagaagctcgacagactaacctctactgcaactaaagatccagaaggattcgtggggcacccggttaatgcatttaaattgatgaagaggctgaatacggaatggtcagagctggaaaatctggtgcttaaggatatgagcgatgggttcatatcaaatctaacaatccaaaggcagtactttcccaatgacgaggatcaggttggcgccgcaaaggctctcctgcggctgcaggacacctataacctggacaccgatacaatcagtaagggcaacctcccaggggttaagcataagagttttcttactgccgaagactgctttgagctgggaaaagtggcctataccgaggctgactattatcacaccgaattgtggatggaacaggccctgcggcagttggacgagggggaaattagtaccattgataaagtcagtgtgttggactacctctcgtacgccgtctaccagcagggagatttggacaaggccctgctgcttacgaaaaaactgcttgaacttgatcctgaacatcagagagctaacggaaatcttaaatattttgagtatatcatggctaaagaaaaagacgtgaacaagagcgcatcagatgatcagtcagatcaaaaaaccactcctaaaaaaaaaggggtcgctgttgattatctacctgagcgccaaaagtacgaaatgctgtgccgaggggaaggtattaagatgacgccccggcgccaaaagaagctgttctgccgataccatgatggcaaccggaatcctaagtttattctcgccccagccaagcaggaggatgaatgggacaaaccgcgcatcattcgctttcatgacattatttcggacgcagaaatagaaattgtgaaggatcttgctaagcctcgattgtccagggccaccgttcatgatcctgaaactgggaagttgaccactgcgcagtatcgggtctctaaatcagcatggctctccggctacgagaaccctgttgtctctaggattaacatgaggatccaagatctgaccggtctggacgtctctacggctgaggagctccaggtggctaattatggagtgggcgggcagtatgagccgcactttgattttgcccgcaaggacgagcctgatgcattcaaagaacttggaacagggaacagaattgcaacgtggctgttttacatgtcagacgttagcgcgggaggagcaactgttttccccgaagtgggcgcttccgtgtggccaaagaagggcaccgctgtgttttggtataacctctttgcaagtggtgagggagactacagcactcggcatgcggcttgccccgtcctggtgggaaacaagtgggtctctaacaaatggctgcacgaacggggtcaggaattccggagaccctgcactctcagcgagctggaatag

SEQ ID NO: 130089 - DNA, 1605 bp, Artificial Sequence
  Description of Artificial Sequence: Synthetic coding sequence
atgatttggtacatcctcattatcgggattcttcttccacaatctctggcccatccaggctttttcacttcaatagggcagatgactgatcttattcataccgaaaaggatctggtgacatcactgaaggactatataaaggctgaagaagacaaactagagcaaattaaaaagtgggccgagaagctcgataggctcacctccactgctactaaagaccctgagggttttgttgggcacccggtgaatgcttttaaattgatgaagcggcttaacacagaatggagcgagcttgaaaatcttgtgttaaaagacatgtctgacggattcattagcaatctgactatccagcgacaatactttccgaatgacgaggatcaggtcggcgccgctaaggccttactgcggttacaggacacttacaacttagacacagacactatttccaagggcaacctgcctggggtgaagcacaagagcttcttaactgcagaggactgctttgaactcgggaaagtggcttataccgaggcagactactatcatactgagctgtggatggagcaggcgttgcggcaactagacgagggggaaatcagtacgattgacaaggtgtctgtgctggactatctgtcctacgccgtgtatcaacagggcgacttagacaaagcactcttgctaaccaagaagctgcttgaactcgatcctgagcaccaacgcgctaacggtaacctgaagtatttcgaatatatcatggctaaggagaaagatgtaaataagtcggctagcgatgatcagagtgaccaaaagactaccccaaagaagaagggcgtggctgtcgactaccttcccgagcgacagaaatatgaaatgctgtgccgcggagagggaatcaaaatgacccccaggcggcagaaaaaattattctgtagataccacgatggcaaccgcaatcccaagtttatcctggcgccagctaagcaggaagacgaatgggataaaccccgcatcattcggttccacgatattatcagtgacgcggaaatagagattgtcaaggatctggcaaagccccgtttgcgccgtgctacgatctctaacccgatcactggtgacttggagactgtccactaccgcataagcaagagcgcatggctatcagggtatgagaatcccgtcgtgtcaagaatcaacatgcgcattcaagacctcactgggttggacgtgtctaccgccgaagagctgcaagtcgccaattatggggtggggggacagtatgagccgcacttcgattttgctcgcaaggacgaacccgacgcttttaaagagcttggcacggggaatcgaatcgccacatggttgttctacatgtccgacgtgagcgcaggcggcgcaactgtgttcccagaagtcggagctagcgtttggcccaaaaagggaactgcagtgttctggtataatttgttcgcaagcggcgaaggggattactcaactaggcacgcagcctgccctgtattagtgggcaacaaatgggtgagcaacaaatggctgcatgagaggggccaagagttccgacgaccctgcacacttagtgaactggaatag

SEQ ID NO: 130090 - DNA, 1605 bp, Artificial Sequence
  Description of Artificial Sequence: Synthetic coding sequence
atgatctggtatatcctcatcatcggaatactccttcctcagtctttagctcatccaggattttttacctccatcggtcagatgactgacttaattcatactgagaaggacctcgtgacctccctcaaagattatattaaggctgaggaggataagctggagcaaattaaaaaatgggctgaaaagttagatagacttacttctaccgcgacaaaggatcccgaaggatttgtcggccaccctgtgaatgcttttaagctaatgaaaagactcaatacagagtggtctgagctggagaacctcgtcctcaaggatatgagcgacggttttatcagcaatcttaccattcagagacaatacttccctaacgacgaagatcaggtaggcgcggccaaagccctactgagactgcaagacacctacaatctcgacaccgacactatctccaagggtaatctccctggtgtgaagcacaaatcgttccttaccgccgaggactgctttgagttgggtaaagtggcttataccgaggctgactactatcatactgagctgtggatggagcaggccctgagacagctggatgagggtgagatcagtaccattgataaggtttctgttcttgattatttatcctacgccgtttaccagcagggcgacttggataaggcacttctgctcactaagaaacttctggaactggaccctgagcatcagagagctaatggaaatctcaaatacttcgagtacattatggcaaaagaaaaggatgtgaataaatcagcctcagacgatcagagcgaccagaagacaaccccaaaaaaaaaaggtgtggctgtggactacctccccgaaagacagaaatatgagatgctgtgccgtggcgaaggcataaagatgacccctcgcaggcagaaaaaattgttctgcagatatcacgacggaaacagaaatccgaagttcattttagcccccgcaaaacaggaagatgaatgggataagccgcgaataattagattccatgacatcataagcgacgccgagatagaaattgtgaaagacctcgctaagcctaggttgtcccgagcgacggtgcatgacccggagacgggaaagctcaccaccgcccagtatcgggtttcgaagagcgcttggctgtctggttatgaaaacccagtcgttagcagaatcaatatgagaatacaggatctgactgggctggatgtgagcacagccgaagagcttcaagtggctaactacggggtgggcggccagtatgagcctcatttcgacttcgctaggaaagatgaaccagacgcgttcaaggagcttggtacagggaatcgtatcgccacttggctgttctatatgagcgacgtgtccgctggaggcgctaccgttttcccagaagtgggcgcctcagtctggcctaaaaaaggcacagccgtcttctggtataatctttttgcgtccggcgagggcgattacagtacccgccatgccgcctgccctgtgctggttggcaataaatgggtgtccaacaaatggctgcatgaacggggccaagagttccgacgcccctgtaccttatccgaactggaatag

SEQ ID NO: 130091 - DNA, 1605 bp, Artificial Sequence
  Description of Artificial Sequence: Synthetic coding sequence
atgatctggtacattttgatcattgggatcctgctaccccagtctctggctcacccaggcttcttcacatccatcggacagatgactgatttaatccacaccgaaaaggatttggtgacctctctgaaggattacattaaagccgaggaagataaactcgagcagatcaagaagtgggccgagaagctggacaggctgacctccaccgctactaaagaccccgaaggatttgtgggccaccccgtcaacgcctttaagctaatgaagcggctgaatacagagtggtccgaacttgagaatttggtactgaaggacatgtccgacggattcatatcaaacttaacaattcagcggcagtacttcccgaacgacgaagatcaggtgggcgccgccaaagctttgctcagactgcaggacacatacaatctggacaccgataccatcagtaaaggtaatctgccaggagtgaagcacaaatccttcctgacagccgaggactgttttgagctagggaaagtcgcgtatactgaagctgactactatcatacagaactttggatggagcaggcgttaagacaattagatgagggcgagatcagcacaatagataaggtgtctgtcctggattatctgtcctatgccgtataccagcagggagatctcgacaaggctcttttgctgacaaagaagctgcttgaactcgaccccgagcaccagcgagccaacggtaatctgaagtactttgagtatattatggccaaagaaaaggacgtaaacaaatctgccagtgacgaccagagcgaccagaaaacgactcccaaaaagaagggcgtcgccgtcgactatctgcccgaaaggcagaagtacgagatgctctgtcgtggggagggcatcaagatgactccacgccgccagaaaaagctgttctgtagatatcacgacggcaataggaatcctaaattcatattggccccagctaaacaagaagacgagtgggataagccaagaattatccggtttcatgatatcatcagcgatgcagaaattgaaattgtaaaggatctggctaagccccgattgcggcgcgcaacgatatcaaacccaatcactggtgatcttgagactgtgcactaccgcatttcaaagtccgcctggttaagcggctacgagaatcccgttgtgagccggatcaatatgcgtattcaagacctgaccggcctggatgtgtcaacagctgaggagctgcaggtagcgaattatggtgttggagggcaatacgaaccccacttcgatttcgctaggaaggatgaacccgacgctttcaaagagctgggcaccggtaaccgtatcgccacctggctgttctacatgagcgatgttagcgctggcggcgccactgtgttccccgaggttggcgcttctgtttggcctaaaaaaggtacggccgtcttttggtataatctttttgcctctggcgaaggggactactctacccgccatgccgcttgccccgtgctggtcgggaacaaatgggtgtcaaataaatggttacacgagcgagggcaagaattcagacgcccctgtacgctatctgaactcgagtag

SEQ ID NO: 130092 - DNA, 1605 bp, Artificial Sequence
  Description of Artificial Sequence: Synthetic coding sequence
atgatatggtacatccttatcataggaattttactgccacaatctcttgcacatccaggcttttttacaagcattgggcagatgaccgacctgattcacactgagaaggacttggttacgtcactgaaagactatatcaaggcagaagaagataagctcgagcagataaaaaagtgggctgaaaagctggatcggctgacgtccaccgccaccaaagatcctgaagggtttgttggacacccagtaaacgctttcaaactgatgaagagattgaatacagagtggagtgaactggaaaatctcgtgctcaaggatatgagtgatggctttataagtaatctgaccatccaaagacaatactttcccaacgatgaggatcaagtgggtgctgcaaaggcactgctgcgtctgcaagatacctacaatctggacactgatactatctccaaagggaacctacccggggtaaagcacaagagctttctaactgcagaggattgctttgagctgggaaaggtagcatacaccgaggcggactactaccataccgaactttggatggaacaggccctgagacaactggatgagggcgaaatttccacgattgataaagtgtcagttctggactatttgtcctacgcggtgtaccagcagggagatctggacaaagcactgctcttaacgaagaaactcctcgaactggaccctgagcatcagagggctaatggcaatctcaagtatttcgaatacatcatggccaaggagaaggatgtgaataagagcgctagcgacgaccaaagtgatcagaagaccacccccaagaagaaaggagtcgctgtagattacctccctgagcggcagaaatacgaaatgctttgccggggagagggcattaagatgacaccacgccggcagaaaaagcttttttgtaggtaccacgatggcaataggaatcctaaattcatcctggcacctgctaaacaggaggacgaatgggacaaaccccggattatccgattccatgatatcatctccgatgctgagatcgaaatagtgaaggaccttgccaagccccggttgcgccgggccacaattagcaatcccatcacaggggacctagaaactgtgcattatagaatttcaaaatctgcttggttaagtggttatgaaaaccctgtggtctcgagaatcaatatgaggattcaggacctcaccgggctcgacgtgtctaccgcagaggagcttcaagtcgccaactacggcgttgggggacagtacgaaccacattttgattttgcgagaaaggatgaacccgacgccttcaaagagctcgggaccgggaatcgaattgctacgtggcttttttacatgtcagacgtcagcgctggcggcgccactgtgtttccagaggtgggtgccagtgtctggcctaagaagggcaccgctgtcttttggtataatctgttcgcttctggcgagggtgactacagcacaaggcacgctgcttgcccagtgttagttggtaataaatgggtctccaacaagtggcttcacgagagaggccaagagttccgcaggccttgcaccctgagtgaactggagtag

SEQ ID NO: 130093 - DNA, 1551 bp, Artificial Sequence
  Description of Artificial Sequence: Synthetic coding sequence
atgatttggtatatccttatcataggaattctcctaccacagagcctagcccacccaggcttcttcacttccatcggccagatgacagatctcatccatacagaaaaagacctggtgacctccctaaaggactacattaaggccgaggaagacaaactggaacagatcaagaaatgggctgaaaaactcgataggctgacctcgacagcaacaaaagatccagaaggctttgtcggccaccctgtgaacgcctttaagcttatgaagcggctaaataccgaatggtccgagctggagaacctggtgctgaaggatatgtctgacgggttcatttctaatcttactatacagagacagtattttcccaatgacgaggaccaggtgggcgctgccaaagccctactaagactccaggatacgtacaatctagacacagatactataagcaaggggaatcttcctggggtgaaacataagagctttctgaccgccgaggactgttttgaactcggcaaggtagcttacaccgaagccgactattaccacactgagctctggatggagcaggccctgaggcagctcgatgaaggcgagatctccaccattgacaaggtgagcgtgctggattacctaagttatgccgtgtatcagcaaggcgatctagacaaagcactgctgctgaccaagaagctgctggagctggaccctgagcaccagcgtgctaatggcaatcttaaatactttgagtacatcatggcaaaggagaaggatgtgaacaagtcagcgtccgatgaccagagcgaccaaaagaccaccccgaagaaaaagggcgtagccgtggattacctacccgagcggcaaaaatacgagatgctgtgtagaggcgaaggaattaaaatgacaccccggcggcagaaaaaacttttctgccgataccacgacggcaaccgaaaccctaagtttattttggcccccgcaaaacaggaggatgagtgggacaaacctcgcattattcggtttcacgacatcatttctgacgctgaaattgaaattgttaaggacctggccaaaccacgcctttcacgagccaccgttcacgatccagaaaccggcaaacttacgaccgcacagtaccgggttagtaagtccgcatggctgtcggggtacgaaaatcccgttgtctcaagaattaacatgaggatacaagacctcaccgggttggacgtgtccactgccgaggaacttcagaaagatgaacccgacgcattcaaggagcttggaaccgggaacaggatagccacctggctgttctacatgtccgatgtttcagccggaggggccaccgtgttcccagaagtgggtgcttctgtttggccaaagaagggtacggccgtgttctggtataacctattcgcatctggagaaggtgactactccacccggcacgcagcatgtccagtattagtgggtaacaagtgggtgtcgaacaagtggctccacgaaagagggcaggagttcagaagaccatgtactctcagcgaacttgagtag

SEQ ID NO: 130094 - DNA, 1608 bp, Artificial Sequence
  Description of Artificial Sequence: Synthetic coding sequence
atgaaactatgggtgagcgcgttgctaatggcatggttcggcgtgttgagctgtgttcaggctgagttttttaccagcataggtcacatgaccgacctgatttatgccgaaaaggagctggttcaaagcctcaaggaatacatcctcgtagaggaagccaaactgtctaaaattaaaagttgggcaaacaagatggaagctctgacaagcaagagcgccgccgatgcagaggggtatctggctcatcctgtcaatgcatacaagctggtaaagcgcctaaataccgactggccggcactcgaggacctggtactgcaagatagcgctgccggcttcatcgctaacctcagcgtgcagcggcaattttttcccactgacgaggatgagataggagctgcaaaagccttgatgcggctccaagacacctatagactggatcccggcaccatcagccggggggagctgcccgggacgaagtatcaagccatgctctcggtagatgactgctttgggatgggacgctccgcctataatgagggggattactatcacacagtgttgtggatggagcaggtgttgaaacaattggacgcaggcgaggaagccaccactaccaagtcgcaggttctggactacctgtcctatgccgtgttccaattgggcgaccttcaccgcgcacttgaactgactagaaggctgttatctctcgacccctcccacgagagagcaggtggcaatctccggtactttgagcaactgctggaggaggagcgagagaagactctgaccaaccaaactgaagctgaactagctactcctgaagggatttatgagcgtcccgtcgattacctgccagaacgagacgtttatgagtctctgtgtcgcggcgagggcgtgaaactcacgccaagacgccagaaacgccttttttgccgctaccatcacgggaatagggcaccacaactcctgatagcacctttcaaagaagaagatgagtgggatagccctcacatcgttaggtactacgatgtgatgtccgatgaagagatcgagaggatcaaagagatcgccaagcccaaactggccagggccacagtccgggacccaaaaactggcgttctgacagtggcatcctacagagttagcaaatcgtcctggttggaggaggacgatgatcctgtcgttgcaagagttaaccgacggatgcagcatattacaggtctgactgtgaagacggcggagctactgcaggtggccaattatggggttggcggtcaatatgagcctcacttcgactttagcagaaatgatgagagggacacattcaagcacttaggcactgggaacagagtagctaccttcctgaactacatgtcggatgtggaggcgggcggcgcaaccgtgttccccgatcttggcgccgccatttggccaaaaaaggggactgctgttttctggtacaacttactccgctccggtgaaggtgattaccgtactaggcacgctgcctgcccagttctggttggctgcaagtgggtgagtaacaagtggtttcacgaacgcggacaagagttcctcagaccatgtggaagtactgaggtggactag

SEQ ID NO: 130095 - DNA, 1602 bp, Artificial Sequence
  Description of Artificial Sequence: Synthetic coding sequence
atgaagctgtgggtgtctgctctcctcatggcctggtttggagtgctgtcctgcgttcaggctgagttctttacatctatcggtcacatgaccgacctaatatacgctgagaaggagctggttcagtcactcaaggagtacattctcgtggaggaagcaaaactgtcaaaaatcaaaagttgggccaataaaatggaggccctgacttcgaagtccgctgcggatgccgagggctacctcgctcaccctgttaacgcatataaactcgtgaagcgtttgaatacagattggcctgccttggaagacctggtgctgcaagattccgctgcaggattcatcgcgaatctcagcgtacaaagacagttctttcctaccgatgaagacgagattggcgcagccaaggctcttatgcgtttacaggacacctaccgcttggacccggggactatcagcagaggtgaactccccgggaccaagtaccaggctatgctgagcgtcgatgattgcttcggtatgggccgatccgcatacaacgagggtgactactatcacaccgtgttgtggatggagcaggtgttgaaacaactagatgccggcgaggaggcaacgaccactaagtcacaagtgctcgactatctgagttacgctgtgttccagttgggagatctccatagggcattggaactgacacggaggctgctgtctcttgatccaagccacgaaagggcggggggcaatctccgttattttgagcagctactggaggaggaaagggagaaaaccctcacaaatcagaccgaagcggaactcgcaaccccggaggggatttatgaaaggcccgtggactatctcccagagcgcgacgtctacgagagcctgtgtcggggagaaggtgtgaagctgaccccaaggaggcagaaacgactgttttgccggtaccaccatgggaatcgagcgccccagctgttgatcgctcctttcaaagaagaggatgaatgggactctccgcacatcgttaggtattacgacgttatgtcggacgaagagattgagcgaattaaagagattgccaaacccaagctcgcgcgcgccactgtgcgggaccctaaaacgggggtactgacggtggcctcttaccgcgtgagcaagagttcatggttagaagaagacgatgatcccgtggtggctcgggtgaatcgccggatgcagcatatcaccgggctgaccgtcaaaaccgcagaactgttgcaggtggccaactatggcgtggggggccagtatgagccccatttcgacttctcacgacgcccatttgattccggcttaaagaccgagggaaatcgactggctacatttttaaattacatgagcgacgtcgaagcaggcggagctactgtcttccccgacctcggcgccgcgatttggcctaaaaaaggcacagcagttttctggtataacttgctccgatccggcgagggtgattataggacacgccacgctgcttgccccgtgctcgtaggatgcaaatgggtctctaataagtggttccacgaacgagggcaagagtttctacggccatgtgggtcaacagaggtggactag

SEQ ID NO: 130096 - DNA, 1602 bp, Artificial Sequence
  Description of Artificial Sequence: Synthetic coding sequence
atgaagctgtgggtgtctgccctgctgatggcatggttcggtgtgctttcatgtgtgcaggccgaattttttacctcaatcggacatatgacagatctgatctacgcagaaaaagagctggttcagtctctgaaggaatacatcctggtggaggaagccaagctcagcaagatcaagagctgggcaaacaagatggaggcccttacaagtaaaagtgcagccgacgcagagggatatctggctcaccctgtgaatgcctacaaacttgtaaagagattgaatacggactggcctgctctcgaggacctagttttgcaggactcagcagcaggtttcattgctaacctgtccgtgcagcgccagttctttcctaccgacgaggacgagattggtgctgcaaaagctctgatgcggctccaggatacatatagacttgacccaggaactataagccgcggggagctacctggtacaaagtatcaggctatgttaagtgtggatgattgttttgggatgggccgatccgcttacaatgagggcgactactaccacactgtgctgtggatggagcaagtcctgaagcagctcgacgctggcgaagaggcaactaccaccaaatcgcaggtactggattatctgagctatgctgtgttccagctgggtgacctccaccgggcattagagctgacacgccgtcttctgagtttggatcccagccatgagcgagcgggtggcaatctgagatactttgaacagctcctggaggaagagagggaaaagaccctgacaaatcagaccgaagccgagcttgccacccccgagggcatatacgaacgccctgtcgactatctgccggagcgggatgtctacgagtcactgtgccggggggagggcgttaaactgacccccaggagacagaaaaggctgttctgtaggtaccaccatggtaacagggccccacagcttttaattgcaccctttaaagaagaagacgaatgggacagtccacacattgtccgctattacgatgtgatgagcgacgaagagatcgagcgaataaaagagatcgccaaacctaagctagcaagagccacagtccgggatcccaaaaccggcgtgttgacagtggcaagctacagagtgagtaagagtagctggttagaggaggacgatgatcctgtcgtggcccgagtgaaccgccgaatgcaacacatcactggtctgacagtgaaaacggccgaacttcttcaggtggctaattatggagttggtggccagtatgaaccccatttcgatttttcacggaggccctttgatagcggcctgaagacagaaggcaatcgcctggccaccttcctgaactacatgtcagacgttgaggctggcggtgccacagtctttcctgacctcggggccgccatctggcccaagaaagggaccgccgttttttggtacaacctactgcggtcaggagaaggggactaccgaacgcggcatgctgcctgccccgttttggtgggttgtaagtgggtctcaaataaatggtttcatgaaaggggccaggagttcctgaggccatgcggcagtacagaggtagattag

SEQ ID NO: 130097 - DNA, 1602 bp, Artificial Sequence
  Description of Artificial Sequence: Synthetic coding sequence
atgaagctctgggttagtgccttgcttatggcctggttcggtgtattatcttgtgttcaggccgagttcttcacgtcaatcgggcatatgacggacctgatatacgctgagaaggaactggtacaaagcttgaaagagtatatattggtggaagaagccaagctcagcaagatcaaaagctgggccaacaaaatggaggcgctgacatccaaatccgcagccgatgccgaggggtacctagcacaccccgtgaacgcatataagctggttaagaggctgaataccgattggcctgctcttgaagacctggtgctccaggactccgcagctggatttatcgctaatctcagtgtccagaggcagtttttcccaaccgatgaagacgagatcggagctgcaaaagccctaatgagactccaggacacttatcgcctcgacccagggacaattagcaggggagagctgcctgggacaaaataccaggcgatgttatccgttgacgactgtttcggaatgggtcggagcgcctacaacgaaggggattactaccataccgtgctctggatggaacaggtgttgaaacagctggacgctggcgaagaagctacaactaccaagagccaggtcttagactacctgtcttatgctgtctttcagctaggcgatcttcaccgtgcgcttgagttgacacgtcgactcttatcactggaccccagccacgaacgtgctggagggaatctgaggtacttcgaacagctgctggaagaagaacgtgaaaagacactcaccaatcaaacagaagctgagctggctacacccgagggcatctatgaaaggcccgtggactacctccctgagagggacgtgtatgaatctctatgtcgcggagagggggtgaagttgacaccccgcagacagaaaaggcttttttgcagatatcaccacggaaatcgggccccccagctgttgatagctccttttaaagaggaggacgagtgggattctcctcatattgttcgctattatgacgtgatgtccgacgaggaaatcgagcgtatcaaagaaatcgcaaaaccaaagctggccagagctacagtacgggaccctaagacaggggtcctgacggtggccagttatcgggtaagcaagtcctcgtggctggaagaggatgatgacccagttgtggcacgcgtgaaccggcgaatgcagcatattactggactgaccgtcaaaaccgcagagctgcttcaggttgccaattatggagtgggcggtcaatacgagcctcacttcgacttttcacggagaccattcgattctgggctgaaaacagaaggcaaccggctggccacatttctgaattatatgtctgacgtagaagcaggcggggctacagtgttcccagacttgggcgccgcaatttggcctaagaagggcacagccgtcttttggtacaacctcctgcggagcggggagggagactataggacacgacacgccgcctgtccagttctcgttggctgtaaatgggttagcaacaagtggtttcatgaaaggggccaggagttcctgagaccatgcggttctactgaggtggattag

SEQ ID NO: 130098 - DNA, 1608 bp, Artificial Sequence
  Description of Artificial Sequence: Synthetic coding sequence
atgaagctgtgggttagcgccttgctcatggcatggtttggagtgctgtcttgtgtgcaggctgagttttttacctctatcggtcatatgacagatctcatctatgccgagaaggagctggttcaaagccttaaggaatacatcctggttgaagaggctaaactgtctaagatcaaatcttgggccaacaaaatggaggcactgacatccaaatctgcagctgatgccgagggctatctagcgcacccagtcaatgcctataagctcgtgaagaggcttaatacagactggccagcccttgaggatttagtgttgcaggacagcgccgcaggattcattgccaatttgtctgtccagaggcagttttttccaaccgatgaagatgagataggtgcagccaaggcactgatgcgcctgcaggatacatatcgactggaccctggaactatctcccgcggagagctcccaggtactaaataccaggccatgctcagtgtcgacgattgctttggaatgggaaggtcagcttacaacgaaggagattattaccataccgtcctgtggatggagcaagtcctgaaacagctagacgcaggcgaggaagccactacgactaaatcccaggtgctggactatctctcgtacgcagtgttccagttaggcgacctacaccgtgccctggagttgactaggcggctgctgagtctcgatccaagccacgaaagggctggcggcaatctccggtacttcgagcagctgttagaagaggaaagagaaaagaccctgaccaatcagactgaggccgagcttgcaacgccagaaggcatctacgagcgccccgtcgactatctgcctgagagggatgtgtacgaatccctatgccgaggagagggggttaagctgacccctcggcgacagaagcgtttgttttgtcggtaccatcacggtaatagagcgccacagttactcattgctccatttaaggaggaggatgagtgggacagtcctcacatcgtgcgctactacgatgtgatgtccgacgaagagattgagaggatcaaagagattgccaaacccaagctggcgcgggccacggttagggaccctaagaccggagtcctaacagtggcgtcttatcgtgtctctaaaagcagctggctggaagaggacgacgatcctgtggtggcacgggtcaaccgaagaatgcagcatataactgggttaactgtgaaaacagcggaactcttgcaggtggcgaattatggagtgggaggacagtacgaaccacactttgacttttccaggaacgacgaaagagataccttcaagcacctgggcactgggaatcgcgttgccacatttcttaactatatgtcggacgtcgaagccggaggcgctacagtttttccagatttgggggcagccatctggccaaagaagggaacagctgtgttttggtacaatctgctacgcagtggggaaggggactatcgcacacgtcatgctgcctgcccagtgctggtcggctgtaaatgggtgagcaacaagtggttccatgagcggggacaggagttcctgcgaccgtgtggcagcaccgaggtagactag

SEQ ID NO: 130099 - DNA, 504 bp, Artificial Sequence
  Description of Artificial Sequence: Synthetic coding sequence
atgaagctgtgggtaagtgcactgctaatggcttggttcggagtgcttagttgcgtccaggccgaattttttacctcaattggtcacatgaccgacctaatctacgcggagaaggagctggtgcaaagcctgaaggagtatatccttgtcgaggaggctaagctcagcaagattaagagctgggccaataaaatggaagcactgacctcaaagtctgcagccgatgccgaaggttacttggcccatccagtgaatgcatataagctggtgaaacgcctgaatacggattggcccgccctggaagatctggtgctacaggattccgctgccggattcatagcaaatctgtctgttcagagacagttcttccctaccgacgaagacgagatcggggctgccaaggccttaatgagactacaagatacctaccgtctcgaccccgggaccatatctcgtggcgaactaccaggaaccaagtatcaggccatgctcagcgtggactag

SEQ ID NO: 130100 - DNA, 1608 bp, Artificial Sequence
  Description of Artificial Sequence: Synthetic coding sequence
atgaaactttgggtctcggcattgctgatggcgtggttcggggtgctgagctgcgtccaagcagagtttttcactagcatcggccatatgaccgaccttatctacgcagagaaggagctagtgcagtccttgaaagagtatatcctcgtggaggaagctaagttgagcaaaatcaagtcctgggcgaacaagatggaagcactaacttccaagagtgcggcagacgccgagggatatttggcccaccctgtaaatgcttataaacttgtcaagcggctgaacaccgattggcccgccttggaagacttggttttgcaggactcagctgccggatttattgctaacctgtcagtgcagaggcagttttttcctaccgatgaagacgagatcggggcagccaaggcgctcatgaggttgcaggacacttaccgcctggatcctggcactatatcgagaggagagttgccaggtaccaaataccaggccatgctttctgtcgatgattgtttcggtatggggagatccgcctacaatgagggggattactatcacaccgtactgtggatggagcaggtgctgaaacagctcgatgccggcgaagaagccacgacgaccaaaagccaggtgctcgactacttatcttacgctgtttttcagttaggcgaccttcaccgggctctggagctgactagacggctcctttcattggaccctagtcatgaaagggccgggggtaacctgcggtattttgaacagctattggaagaagaaagagagaaaactctgaccaatcaaacggaggctgaactagccacccccgaaggaatttacgaacgacctgtcgactatttgcccgagagagacgtctatgagagtctttgccgtggggagggggtcaaactgaccccccgccgtcagaaacgcctcttttgtcgatatcaccatgggaatagagcacctcagttattgattgccccctttaaggaggaggatgaatgggactccccgcatattgtccggtactacgacgtgatgtctgatgaagaaatcgaacgaatcaaggagattgccaagccaaagctcgcacgggcaacagttcgagatccgaaaaccggtgttttgacggttgccagctacagggtcagcaaatcaagctggcttgaagaagacgatgatcctgtggttgcccgtgtcaaccgccggatgcaacacataactgggctcactgttaagaccgcagagttgttgcaggtggccaactacggcgttggcggccagtatgaaccacactttgattttagccggaacgacgaacgtgacacgtttaagcacctgggtaccggcaacagggtggccactttcctgaactacatgagtgacgtggaggccggcggcgcaacagtgtttcccgacctaggagccgcaatctggcctaagaaagggactgctgtcttctggtacaacctgctccgatctggggagggggattaccgcactcgccacgcagcttgcccagtcttagtgggttgcaaatgggtgtctaacaaatggttccacgaacggggtcaggaatttctgcgaccatgtggatccactgaagtggactag

SEQ ID NO: 130101 - DNA, 306 bp, Artificial Sequence
  Description of Artificial Sequence: Synthetic coding sequence
atgaagctatgggtgagtgccctactgatggcttggtttggagtgttgtcatgtgttcaggcggagttttttacatcaattgggcatatgacagatctcatatacgcagaaaaagagcttgtgcaaagcctgaaagaatatatcctggtcgaggaggccaaacttagcaaaatcaagtcttgggccaataagatggaggctttgacctcaaagagtgcagccgacgccgaagggtacctggctcaccccgtcaatgcttacaagctggtcaagagacttaacacagactggcccgcactggaatag

SEQ ID NO: 130102 - DNA, 615 bp, Artificial Sequence
  Description of Artificial Sequence: Synthetic coding sequence
atgaaactgtgggtgagcgccctcctcatggcctggttcggcgtgttatcatgtgtccaggctgaattttttacaagcatcgggcatatgacagacctgatctacgctgaaaaggagcttgtgcagtcacttaaggaatatatactggtggaggaggccaaactcagtaagatcaaatcctgggccaacaagatggaggcactgacaagtaaatccgctgccgacgcagaaggatacttggcacatcccgtgaatgcatataagctagttaagcggctgaacaccgattggcccgctcttgaggacctggtgctccaagacagtgctgctggcttcattgcaaacctctccgtgcagcgtcagttttttccgacagacgaagatgagatcggagcagccaaagctttgatgagactgcaggacacgtaccgcctggaccctggcaccatctcacggggcgaactgcccggtactaaataccaggctatgttgagcgtggacgactgtttcgggatgggccgaagcgcatacaatgagggggactattatcacacagtcctctggatggaacaagttctgaaacaattagatgccggggaagaggctacaacctag

SEQ ID NO: 130103 - DNA, 345 bp, Artificial Sequence
  Description of Artificial Sequence: Synthetic coding sequence
atgaagctctgggtaagcgcgctgctgatggcctggtttggagtgctgagttgtgttcaagcagagtttttcacctcaatcgggcacatgacggatcttatctacgccgagaaagagttagtccagagcctcaaggagtatatcttagtggaagaggctaagcttagtaaaatcaagtcctgggctaataaaatggaggccctaaccagtaagtctgccgctgacgccgaaggttacctggctcaccctgtcaatgcctacaagttggtcaaacgcctgaataccgactggccagctctcgaggatctggtgttacaggacagtgctgctgggttcatcgcatag

SEQ ID NO: 130104 - DNA, 444 bp, Artificial Sequence
  Description of Artificial Sequence: Synthetic coding sequence
atgaagctctgggtctctgcattgctaatggcctggtttggggtgctcagctgtgtacaggcagagttctttacgagcattggccacatgactgacctgatatacgctgagaaggaactcgttcagtcgctgaaggaatatatcctggtcgaggaggccaaactttcaaagattaaaagctgggcaaataaaatggaggcactcacttccaaatcagcggctgatgcggaaggctacctcgcacatcctgttaatgcctataaactggtcaagcgcctgaacacagattggccagccctggaagacctggtcctgcaggactccgcggccgggtttattgccaaccttagcgtgcaacggcaattcttcccaacagacgaggacgaaattggcgcagcgaaggccctgatgaggctccaggacacttataggctggacccctag

SEQ ID NO: 130105 - DNA, 153 bp, Artificial Sequence
  Description of Artificial Sequence: Synthetic coding sequence
atgaagttgtgggtgtccgccttattaatggcctggtttggagtgttatcatgcgtgcaggctgagttttttacatccattggccatatgaccgacttaatctatgcggagaaggagctagttcagagcctgaaggagtatattctggtctag

SEQ ID NO: 130106 - DNA, 555 bp, Artificial Sequence
  Description of Artificial Sequence: Synthetic coding sequence
atgaagttatgggtctcggctctgctgatggcttggtttggagtgttgtcgtgcgtacaggccgagtttttcacctccatcgggcacatgacagatctgatctacgctgagaaggagctggttcagagcctcaaggaatatattctggtggaggaggccaaactctctaaaataaagtcatgggccaacaagatggaggcccttacctccaagagcgccgccgacgcagagggctacttagcccatccagtcaatgcttataagctggtgaagcgtctgaacactgactggccagcgctagaggatcttgttctccaggattccgctgctggtttcattgccaatctatcagtgcagcggcagttctttccgacagacgaggatgaaatcggagccgccaaagccttgatgaggctgcaagacacctaccgcctggatcccggcaccatttctcgaggcgaactgccaggtactaaatatcaggctatgctgtctgtcgacgattgtttcggcatgggcagatcagcatataacgagggggactattatcactag

SEQ ID NO: 130107 - DNA, 462 bp, Artificial Sequence
  Description of Artificial Sequence: Synthetic coding sequence
atgaaattatgggtgtccgcactcctcatggcctggtttggggtgctgtcatgcgttcaggctgaattctttactagcattgggcacatgactgatttaatctatgcagaaaaggagctggtgcagtctctaaaagagtatattcttgttgaggaggctaaactctcgaagatcaaaagttgggctaacaagatggaagcactgacctcgaagagcgccgccgatgccgagggatatttggcccaccccgtcaatgcctataaattggtgaagcgcctaaacactgactggcccgccttggaagacctcgtactccaggatagcgccgcgggattcatcgccaacctgtccgtccagcgtcagttttttccaacagatgaagacgaaattggagcagccaaggctctgatgagactgcaggacacatatcggttagaccccggaaccatttcccggggatag

SEQ ID NO: 130108 - DNA, 1635 bp, Artificial Sequence
  Description of Artificial Sequence: Synthetic coding sequence
atgggtcctggggccaggctagccgccctgctagccgtgctcgccctcggaacaggggacccagagagggccgctgccaggggcgataccttttccgctctgacatccgtggcacgcgcacttgcccccgaacggaggctgctgggcttactccgacggtaccttagaggtgaggaggcgcggctccgcgacctgacccgattttatgataaggtgctatctctccatgaggatagcaccacgcctgtggccaatcctttgcttgccttcacattaataaagcggctccagtccgactggcggaacgtggtgcactccctcgaagcctctgagaacataagggcattgaaggacggctatgaaaaagtggagcaggacctgcctgcattcgaagacttggagggggccgcacgggccctcatgaggttgcaggacgtgtatatgctgaatgtcaaaggactggcccggggggtcttccaaagagtgacaggttccgcgattactgacctttacagccctaagagactctttagcctgactggcgacgattgcttccaggtgggtaaagtggcatacgatatgggcgattattatcacgccattccctggctggaggaagccgtgagtctgttcaggggcagctacggtgaatggaagacagaagacgaggcctctcttgaagatgctttggatcacctcgcttttgcctattttcgtgcagggaatgtctcttgcgcactcagcctgtcacgcgagttcctgctctactctcccgacaacaagaggatggctaggaatgtgctcaaatatgagagactgctggctgagtcacccaaccacgttgtggcggaggcagtgatccagagacctaatatcccccacttgcagacacgagacacatacgagggtctatgccagacactaggtagccagcctacactttatcagattccatccctctactgctcttacgagaccaatagcaacgcatacctgctgctccagccaatccggaaggaggtgatccacctggagccctatatcgcactttatcatgactttgtctctgactccgaagcccagaaaatccgagagctggcagaaccatggcttcagcgctcagtcgtggcctcaggtgaaaagcagcttcaagtcgaataccgaatcagcaagtccgcctggctgaaagatacagtagatcctaagcttgtgactctgaaccatcggatcgctgcgttgacaggcttggacgtgcgccccccttatgcggagtacctgcaggtcgtgaattatgggatcggtggtcattatgaacctcattttgaccatgccacatccccatcatctcctctttacaggatgaagtccggcaaccgagtggctacctttatgatctacctttccagcgtggaggcagggggcgcaaccgcttttatatacgcgaatctgtctgtacccgtggtgcgcaacgctgcgctgttttggtggaacctccatcggagcggcgagggtgattccgatacactgcatgctggttgccctgtgctcgtcggagataaatgggtggccaacaagtggatacacgagtacggacaggaatttcgcaggccatgttcttcatcgcctgaggactag

SEQ ID NO: 130109 - DNA, 1815 bp, Artificial Sequence
  Description of Artificial Sequence: Synthetic coding sequence
atgggacctggcgcccgcctggctgcactcctggccgttcttgccctcggaacaggagacccggagcgggccgccgctcgtggggacaccttctctgcactcacgagtgtggctcgtgccctggcccccgaacgtcgcctcttaggactgcttcgccgataccttcgtggtgaagaagcacgcctgcgggatctgacccgattttacgataaagttctgagcttgcacgaggattcaaccacaccagtggcgaacccactcctggcgtttacattaatcaagaggctacaaagcgactggcgcaatgtggtgcattctttggaagcaagcgagaacatccgtgctctcaaagacggatatgaaaaggtcgagcaagacttgccagcatttgaagatttggaaggggcagccagggccctgatgcgcctgcaggacgtgtacatgctgaacgttaaaggattggctcgcggggtcttccaaagggtcactggctccgcgatcacagacctttactccccgaagcgcctcttttccctgacgggagatgactgttttcaggtgggtaaggtcgcttacgacatgggagactactaccacgccattccgtggttggaagaagctgtgtctctgttcagagggtcgtacggcgagtggaagacagaagacgaggcaagcctggaagacgccctggaccatctggccttcgcttatttccgagcaggaaacgtgtcctgcgccctgtccctttcccgggaatttcttctgtattctcctgacaacaaaagaatggctcgcaacgtgttgaagtatgaaaggctcctcgcggaaagtcccaaccacgtcgtggcggaagctgtgattcagcgacccaatattccccacctgcagacgagagatacatacgaaggcctgtgccagactttgggctcccagccaaccttgtatcagatcccttccctgtattgctcatacgagactaactctaacgcgtacctgttgcttcagcccattaggaaggaggtgatccacctggagccttacattgccctgtaccacgatttcgtgagtgatagcgaagcacagaagatccgtgagcttgcagagccctggctgcaaagaagtgtggttgccagtggtgaaaagcagctgcaggtcgagtacagaatttccaagtccgcttggctcaaggacacagtggacccgaagctggttaccctgaaccacaggattgctgcactcactggactcgatgtgagacccccctatgccgagtacctacaagtggtcaactacgggattggtgggcattacgaacctcatttcgaccacgcaacctctccatcttccccgctgtataggatgaaatcgggaaaccgcgttgccacttttatgatatacctcagttcagtcgaagccggaggggcaacagcgtttatctacgccaacctgtcagtaccagttgtcagacactgctttggcggcacatgcacaggcgttgttaaaggtaccgtcacccacttcatgctggctgttctgtcgtggtgggaaatctcagggtggccgacatctggttacatgtccatggacaggaattcagcagatcctgccgcgcccgctttaaaaaccgagcttcttgctgagcgttcgtggtggtctcccgtggcatttcagcggtctcaggagcccaaggcgggagtgggagaagaaaaagctgagcaacctccgggccgccggccttgtcagctctgcttgtgtctggctaatcagaggcagggacgggggtgttaccagggaactcttcgaatgtacatctag

SEQ ID NO: 130110 - DNA, 1527 bp, Artificial Sequence
  Description of Artificial Sequence: Synthetic coding sequence
atgctgaggcgtgcactgttgtgtttggccgtggcagccctcgttcgagcagacgcaccagaggaggaggaccacgtgctggtgctgcgcaagtccaatttcgccgaggctcttgccgcacacaagtatctcctggtcgaattttacgctccgtggtgcgggcactgtaaggccctcgcccccgaatacgctaaggccgcagggaaactgaaggctgagggaagcgaaatcaggctcgctaaagtggatgctacagaggagtcagatctggcccagcaatatggagtaaggggctatcccactataaaattctttcgaaacggggacaccgcttcccctaaggagtacaccgctggacgcgaagctgacgacatcgtgaactggctgaagaagcgaaccggaccagccgctaccacactgccagatggagctgcagcagagtcactggtggaaagctcggaagttgcagttatcggattctttaaggacgtcgagagcgattccgcaaaacagtttttacaggccgcagaagcaatcgacgacattccttttggaattactagcaacagcgacgtttttagtaaataccagctggacaaggatggagtggtacttttcaagaaatttgacgagggccgcaacaatttcgaaggagaggtgactaaggaaaacctactggactttataaagcacaaccaacttccactggtgatcgagtttaccgagcaaactgcaccaaagatcttcgggggagagatcaaaacacacattctcctgttcctgccgaaatccgtctccgactacgatggtaagttgagcaattttaaaaccgctgctgaatcatttaagggtaagatcctttttatatttattgacagtgaccacaccgataatcagagaatattagagtttttcgggctcaagaaggaagagtgtccagccgttcgcctgataacattggaggaagagatgactaaatacaaaccagaatcagaagaactgaccgcagaacgaatcacagagttctgccaccgatttctggaggggaagatcaaacctcacctgatgagtcaggaacttccagaggattgggacaagcagccagtgaaggtgcttgttgggaagaatttcgaggatgtcgccttcgatgaaaagaagaatgtgttcgtggagttctatgcaccatggtgcgggcattgtaaacagctagcgcctatatgggataagctgggcgagacatacaaggaccacgagaacatcgtgattgctaaaatggattcaactgccaatgaagtggaagcggtgaaagtccatagcttccccaccttaaagttcttccccgcctctgcagacagaactgtgattgactacaacggtgagaggactttggatggatttaaaaagtttctcgaatctgggggccaggacggtgccggggatgacgacgacttggaggaccttgaggaagctgaagaacctgacatggaggaggacgacgatcagaaggcagtcaaagatgagctttag

SEQ ID NO: 130111 - DNA, 1479 bp, Artificial Sequence
  Description of Artificial Sequence: Synthetic coding sequence
atgcttcggcgggccctgttatgtctggccgtcgcagccctggtaagggccgatgcccccgaagaggaggatcataaatacctcttagttgagttttatgccccgtggtgtggtcattgcaaagcactggccccagaatacgctaaggcggcaggtaagctaaaggctgagggcagcgaaatcaggctggccaaagttgacgctacggaggagtctgatctagctcaacagtacggagttcgcggataccccacgattaagttctttaggaatggggacaccgcttccccaaaagagtataccgcaggccgagaggccgatgatatcgtcaactggctaaagaagcggaccggccccgccgccaccaccctccccgacggggctgctgccgagtctctggtcgaatcttctgaagtggccgtcattgggttcttcaaagatgtagagtccgacagcgccaaacaatttctgcaagctgcagaggcgatcgatgatattccttttgggatcacgagtaattcagacgtgttttcaaagtatcaacttgataaggatggagtggtgctttttaaaaagtttgatgagggccgcaacaactttgagggtgaggtgaccaaggagaaccttctggatttcataaagcacaaccagctacccctggtgattgaatttactgagcagacagctcccaaaattttcggaggggaaattaaaacgcacattcttctctttctgccaaaatctgtaagcgactacgatggcaagctgtccaatttcaaaaccgcagcagaatctttcaaggggaagatcctctttatcttcatagacagcgaccatacagacaatcaacggatactggagtttttcggcctgaagaaagaggagtgccctgctgttcggctgatcaccttagaggaagagatgacaaaatataagcctgagtcagaagagctcaccgcagagcggatcactgagttctgccaccggtttcttgagggcaagatcaaaccacatctaatgtctcaggagctgcccgaagactgggacaaacaacccgtgaaagtgctagttggcaagaacttcgaggacgtggcatttgacgagaagaagaacgtgtttgttgagttttacgcaccttggtgtgggcactgtaaacagcttgcccccatctgggacaagctcggtgagacatataaggatcatgaaaacattgtgattgcgaaaatggattctacagccaatgaagtagaagctgtgaaggttcactcattcccaaccctgaagtttttccctgcgagtgccgataggaccgtcatcgactataatggagaacgtaccctggatggctttaagaagttccttgagagcggtggacaggacggagccggtgatgatgacgatctagaggacctggaggaagccgaggaaccagacatggaagaggatgatgaccagaaggccgtgaaggatgaactctag

SEQ ID NO: 130112 - DNA, 1356 bp, Artificial Sequence
  Description of Artificial Sequence: Synthetic coding sequence
atgctgcggcgagccctcctctgcctggcagtggctgccctagtgcgagctgacgcgcccgaagaggaagaccacgttctggtgcttcggaaaagcaatttcgctgaagctttagctgctcataagtacttgctagtggagttttacgcaccctggtgcggccactgtaaagctctcgccccggaatacgcaaaggcagccggcaaactaaaagcagaagggtctgaaatccgcttagcaaaagtggatgcgacagaagaatcggacctggctcagcagtacggcgtgcgtggttaccctacaatcaaattctttagaaacggcgacaccgcaagccccaaggaatatactgcggggagagaagcagacgacatcccttttgggatcaccagcaattccgatgttttttcgaaataccaactggacaaagacggggtggttctcttcaagaagttcgacgagggcaggaataactttgaaggtgaagtgacaaaggaaaacctgctggactttatcaaacataaccaactcccactggttattgagtttacagagcagactgcacccaaaatcttcggtggcgaaatcaagacgcacatcctcttatttctgcctaagagcgtttccgactatgacgggaagctgtctaatttcaagactgcagccgaatcctttaagggcaaaattctgttcatctttatagactcagatcacactgacaatcagaggatattagagttttttggattgaaaaaagaagagtgccctgcagtacgcctgatcacccttgaggaagagatgactaagtacaaacccgagagcgaggaactgaccgcagaaaggatcaccgagttctgccaccggtttctggagggaaagattaaacctcacttgatgagccaggagctcccggaggactgggataagcagcccgtgaaagttttggttggcaaaaactttgaggacgtagcttttgatgaaaagaagaatgtgttcgttgagttttacgccccctggtgcggccattgtaagcagttggctcccatttgggataagctcggggaaacctataaggaccatgaaaatatcgtgatagccaaaatggattccactgcgaacgaagttgaagcagttaaagttcattctttccccacattgaaatttttccccgcaagtgcggaccgcactgtgattgactataacggcgaacggacactggatggctttaagaagttcctcgaaagcggcgggcaggacggggctggtgacgacgatgacttggaggaccttgaggaagcagaggagccggacatggaggaagatgacgaccaaaaggcagtcaaggatgagctgtag

SEQ ID NO: 130113 - DNA, 2133 bp, Artificial Sequence
  Description of Artificial Sequence: Synthetic coding sequence
atgctctctttgcaatatccagacgtttacagagatgagactgcagtgcaggactatcacggccacaaaatatgtgacccatatgcttggctcgaagaccctgacagtgagcaaactaaggcttttgtcgaagctcagaataagatcactgtgccatttctggaacagtgtcctatccggggtctttataaagagcggatgaccgaactgtatgactatccgaagtactcatgtcacttcaagaagggcaaaaggtacttctatttttataacaccggtctgcagaatcaacgcgtactgtacgtacaggactcactcgagggggaggcaagggtgttcctagatccaaatattctgagcgacgatggcacagtcgccctcaggggctacgctttctcggaagatggagagtatttcgcttatggcttgtctgcctcaggcagcgactgggtgactatcaagtttatgaaagtggacggggcaaaggaactgcccgacgtgctggagagggtaaaattttcctgtatggcttggacacatgatgggaaaggcatgttttacaactcatatccccagcaggacgggaagtcagatggtacagagacctccacaaacttgcaccagaagctgtattaccatgtcctgggcactgatcagtcagaagacatactgtgcgctgaatttccagacgagccgaaatggatgggaggcgccgaattatcagatgatggaagatatgtgctgctgtcgattcgggaggggtgtgatccagtaaaccgcctatggtactgtgatttgcagcaggagagttcaggcatcgctggcatcctcaagtgggttaagctcatcgataacttcgaaggtgagtacgactatgtcacaaacgagggtaccgtcttcacctttaaaaccaaccggcaaagtccaaactacagagtcatcaatattgactttcgcgaccccgaggagtctaaatggaaggtgctggtccccgaacacgaaaaggacgtgctcgaatggattgcctgcgtgaggagcaactttctggtcctgtgctacctgcatgacgtcaagaacattctacagctgcacgatctgacaacgggagccctcctaaagaccttccctctggatgtgggctccatcgtggggtattcaggccagaaaaaagacacagagatcttttaccagttcacatcctttctgtcccccggtattatctaccactgcgatctgactaaggaggagctggaacccagagttttccgcgaagtcaccgtcaaaggcatcgacgcatccgactaccagacggtgcagattttttacccctctaaggacgggacaaagatccctatgttcattgtgcacaaaaagggcatcaaactggacggaagccaccctgcattcttatacgggtatggcgggttcaacattagcattaccccaaattattcagttagccgattgatctttgtcagacacatgggaggtatcctggccgtcgcaaacattcggggaggaggcgaatatggagagacatggcacaagggaggaattctagctaataaacagaactgcttcgatgacttccagtgcgccgccgagtacctgatcaaggagggatacaccagccccaaacgactgactatcaacggtgggtcgaatggtgggttgcttgtcgctgcctgcgccaaccagcgacccgatctgtttgggtgcgtgattgcacaggtcggcgttatggacatgctcaaattccacaagtatacaattggacatgcttggacaaccgattacggatgctccgatagcaagcagcactttgaatggcttgtgaagtacagccctttgcacaacgtgaagctgccagaagctgacgacatacagtatcctagcatgctactcctgacagcagatcacgacgaccgggtcgtacctcttcattccctaaagtttattgcaactttgcaatacatcgttgggcgctctagaaagcagagtaacccactccttatccatgtggacaccaaggccggacacggagccggaaagcccaccgctaaggtcatcgaggaggtgagtgatatgttcgcgtttatcgctagatgtttaaacgtagactggatcccttag

SEQ ID NO: 130114 - DNA, 138 bp, Artificial Sequence
  Description of Artificial Sequence: Synthetic coding sequence
taaatcatctaccactgcgatcttactaaagaggagttagaacctcgagtctttagagaggtgaccgtcaagggtattgacgccagcgactaccagacagtccaactgcccaaagggacggagtcttcacgtaactag

SEQ ID NO: 130115 - DNA, 135 bp, Artificial Sequence
  Description of Artificial Sequence: Synthetic coding sequence
atcatctaccattgtgacttgaccaaagaggagcttgaacccagagtgtttagggaggtgacagtaaaagggattgacgcctcagactaccaaactgtccagctccccaagggcacagaatcatccagaaactag

SEQ ID NO: 130116 - DNA, 2184 bp, Artificial Sequence
  Description of Artificial Sequence: Synthetic coding sequence
atgcagcagaaaactaaactattcctgcaggctttgaagtactccataccccacctggggaaatgtatgcagaaacagcaccttaaccattacaattttgccgatcactgctacaaccgaatcaagctgaagaaatatcacctcactaaatgcctccagaataagcccaaaatatctgagctcgccaggaacataccgagccgcagcttctcatgcaaagatctgcagccagtgaaacaagagaacgaaaaaccccttccagagaacatggacgcctttgagaaggtgcgtacaaagctggaaacccaacctcaggaggagtacgaaatcatcaacgtggaagtaaaacacgggggattcgtctattatcaggagggctgctgtctagttagatctaaggacgaggaggccgacaatgacaattacgaggttttgttcaacctggaggagctaaaattagaccagccattcatcgactgcattagagtagcgcccgatgagaagtacgtggccgccaagatccgaaccgaagatagcgaagcatccacctgtgtgatcatcaagctcagcgatcagccagtgatggaggctagcttccctaatgtatcctcctttgagtgggtcaaggatgaagaggatgaagatgtgctcttttatacttttcaacgcaatctccggtgtcatgacgtgtatagagccacgttcggagacaacaagaggaatgaacgattctacactgagaaggatcctagctattttgtgttcctgtacttgactaaggattccagattcctgaccatcaacattatgaataaaactacctctgaggtgtggctgatcgacggactaagtccatgggatcctccagttctgattcagaagagaatccacggggtgctgtactacgtggagcatagagatgacgagctgtacatcctgacgaacgtgggagagcccacagaatttaagttgatgagaacagctgctgatactcccgctatcatgaactgggatctgtttttcacaatgaaaaggaataccaaggtgatcgaccttgacatgtttaaggatcattgtgtgctgtttctgaagcactctaatctgctgtatgttaatgtgattggcttggcagacgactcagtccggagcctgaagcttccaccctgggcttgtggcttcatcatggacaccaatagcgatcccaaaaactgtccattccagctgtgttctccaattaggcctcccaagtactacacatataaattcgccgaaggaaagctattcgaggaaaccggccatgaggaccccatcactaaaacaagtcgcgtgctgcggcttgaagcaaagtccaaggacgggaagctagtgccaatgaccgtgttccacaaaaccgactccgaggatctgcagaaaaaacccctgctcgtccatgtatacggcgcatatggcatggacttgaaaatgaactttcggcctgagaggagggttctggttgacgatggatggatcctggcatattgtcatgttaggggcgggggcgagcttgggttacagtggcacgcagacgggaggctgacaaagaagctcaatgggctggctgacctcgaggcttgcattaagacactgcatggccaaggattctctcagccctctcttaccacactgaccgccttctctgccgggggggttttagctggcgccctttgtaattcaaatccagagttagtcagagcagtaacattagaggcgccatttttggatgtcctgaacaccatgatggacacaacattgcctctgacgctggaggagttggaggaatgggggaacccaagcagcgacgaaaagcataaaaattatatcaagagatattgcccataccagaatattaaacctcagcactatcccagcatacacatcacagcttacgagaatgacgagcgcgtgcccttaaaggggatcgtatcctacaccgagaagctgaaggaggcgatcgctgagcatgcaaaagatacaggcgagggctatcagacacccaacataatcctcgatatacagccaggcgggaaccacgtgatcgaagacagtcataagaagatcactgctcaaatcaagttcctatatgaggagctggggctggactctacctctgtctttgaggatctaaagaagtatcttaagttctag

SEQ ID NO: 130117 - DNA, 1998 bp, Artificial Sequence
  Description of Artificial Sequence: Synthetic coding sequence
atgcaacagaaaacaaaacttttcctgcaggccttaaagtattctattcctcacctgggaaagtgcatgcagaagcagcatctgaatcattacaatttcgccgatcattgttacaatcgcatcaaactcaaaaagtatcatctgactaagtgtctgcagaataaacccaagatctctgaactggcccgaaatattcccagcaggagctttagctgcaaggatctgcagcccgtgaaacaagaaaatgagaaacccttacccgagaacatggatgccttcgagaaggtcagaacaaagctggagacccaaccacaggaagaatatgagattataaacgtggaagtgaagcatggcgggtttgtgtattatcaggaggggtgctgcttagtgcgatcaaaggacgaggaggccgacaatgataactatgaagtcctcttcaacttggaggaactcaagttagaccagcccttcattgactgtatcagagtggctcctgatgagaaatatgtggctgcaaaaattcggactgaagatagcgaggcctctacttgcgtgattatcaagttgagtgaccagcccgtgatggaggcttccttcccaaatgtctcatcattcgaatgggttaaggatgaagaagacgaagacgtactcttctataccttccagagaaatctgcgttgccatgacgtgtacagagccacattcggagacaacaaacggaacgaaaggttttataccgagaaagacccttcatacttcgtatttctctatttaacaaaggatagtagatttctgaccatcaacattatgaataagactaccagtgaggtgtggttaatagacggcctgagcccctgggaccctccagtgctgattcagaagcgcatacacggcgtgctttactatgtggagcatcgggacgatgagctttacattctcaccaacgtgggtgagcccactgaatttaagctccctccatgggcttgtggatttataatggacaccaacagcgatcctaagaactgtccatttcagctgtgctctcccattcgcccccccaaatattatacgtataaatttgccgaaggcaagctttttgaagaaactggccacgaggaccccatcaccaagacaagtcgggtgcttaggctagaggccaaatctaaagatggcaagcttgtgcctatgactgtttttcacaagacggattcggaggatctacaaaaaaaaccgttgctggtgcatgtgtacggagcctatggaatggatctgaaaatgaacttcaggccagagcgcagggtccttgttgatgatggctggatattggcatactgccacgtgaggggcggtggcgagctgggcctgcaatggcacgctgatggacggctgactaaaaagctgaacggcttagcagacttagaggcatgtataaaaacattgcacggccaggggtttagccagccaagcctgacgactcttacagctttcagtgccggcggagtcctggcaggagctctatgcaattccaatcccgaactcgttcgagctgtgaccctggaggcacccttccttgacgttctgaacaccatgatggacaccaccctgccattgaccctggaggagttagaggagtggggaaatcctagcagcgatgaaaaacacaaaaattacattaagcggtactgcccctaccagaatattaagccccaacattacccaagtatccacattactgcatacgagaatgatgaaagggtcccgcttaaaggcatagtatcctacaccgagaagctgaaagaagcgatcgctgaacacgctaaggatactggcgaaggataccagacaccaaacatcatcctcgacatccagcctggggggaatcatgtgatcgaagacagccacaaaaagatcacagcacaaatcaagttcttgtacgaggaactggggctagattcaacctccgtgttcgaagacttgaagaagtacctgaaattctag

SEQ ID NO: 130118 - DNA, 1986 bp, Artificial Sequence
  Description of Artificial Sequence: Synthetic coding sequence
atgcaacaaaagactaaactcttcctgcaggctctgaaatatagcatcccccatctgggtaaatgtatgcagaagcagcacctgaatcactataactttgctgatcattgctacaatcgcatcaagttgaaaaagtatcaccttactaaatgcctgcagaataagcctaaaatttcggaattagcaaggaacatcccaagtcgctcgttcagctgcaaagacctacaaccagttaaacaggagaatgagaaaccgctgcctgaaaatatggatgcattcgaaaaagttcgcacgaagctggaaacacagccccaggaggagtatgagattataaatgtggaagtgaagcacggtggttttgtgtattaccaggagggatgctgcctcgtgaggagcaaggacgaggaagcggacaacgacaattacgaagtgctgttcaatctggaagaactgaagcttgatcagccattcatcgactgcatccgcgtagctccagacgagaagtacgtggcagccaaaatcagaacagaggactctgaggcaagcacatgtgtaataatcaagctgtcggaccaaccagtgatggaggcctcatttcccaatgtcagctccttcgagtgggtgaaagatgaggaggatgaagatgtcctgttctacacattccagcgcaatctgagatgccatgatgtatatagagctacgtttggtgataacaagcgcaacgaaaggttctacactgagaaagacccaagttactttgtgttcctatacctcactaaggactctaggtttcttaccatcaatatcatgaataagactacaagtgaagtgtggctgattgacgggcttagcccttgggatccaccagtgcttattcagaagcgcatacacggcgtgctttactacgtggagcaccgagatgacgagctgtacatacttacaaacgtgggggaacccaccgagtttaaactcatgagaacagcggcagacacccccgctatcatgaattgggatctcttttttaccatgaagcggaacacaaaagtcatagatctagacatgttcaaggaccactgcgtgctcttcctgaaacacagcaatctcctgtacgtcaatgttatcggcctagcagacgattctgtgaggagcctcaaggacgggaagctggtgcctatgactgttttccacaaaactgattcagaagatcttcagaagaagcctttgcttgtgcatgtgtatggtgcttacgggatggaccttaaaatgaactttcgacctgagcgaagggtgctggttgatgatgggtggatcctggcatactgccatgttcggggcggaggggagcttgggctacagtggcacgcagacggccgccttactaaaaagctcaacggtctggccgacctcgaagcctgtatcaagacattacatggccaagggttcagccaacccagcctcacgacactgaccgccttctcagccggcggcgtgctcgccggggcgctatgtaactctaaccccgagttggtccgcgcagtgacccttgaggcacccttccttgatgtcttgaatacaatgatggatactacactgccactgaccctcgaagagctggaggaatggggaaaccccagtagcgacgaaaaacacaaaaactacatcaagcggtattgcccatatcagaacataaagccccagcattatcccagtatccatatcactgcctacgaaaacgatgagagggttccgctgaagggcatcgtttcttacacagagaaactgaaagaggcgatcgctgagcatgctaaagacacaggtgagggctatcagaccccaaatattattctagatatacaaccaggaggtaaccacgtgattgaagattcccataaaaagattaccgcccagattaagtttctctacgaagagctcggactggattccacttccgtatttgaggatctgaagaaatacctgaaattttag

SEQ ID NO: 130119 - DNA, 2184 bp, Artificial Sequence
  Description of Artificial Sequence: Synthetic coding sequence
atgcagcagaaaaccaagctatttctccaagctctcaaatactccatcccccacctggggaagtgtatgcaaaagcagcacttgaatcattacaacttcgccgaccactgctacaaccggataaaactcaagaaataccatcttacgaaatgccttcaaaacaagccaaaaatctccgagctggctcgcaacatcccgagccggagcttctcgtgcaaagacctgcagccggtcaaacaggagaacgagaagccactgcctgaaaacatggatgctttcgaaaaggttaggacaaaactggaaacccaaccacaggaggagtacgaaatcatcaacgtcgaggtcaaacacgggggcttcgtgtattaccaggaaggttgctgtctggtgcgatccaaggatgaagaggcggataacgataactatgaggtactgtttaaccttgaagagttgaagctcgaccaaccttttattgactgcatccgcgtagcgccagatgagaagtacgtcgccgccaagataagaactgaggattctgaagcttcgacttgtgtcataatcaagctcagtgaccagcccgtgatggaggcctccttccccaacgtctctagtttcgaatgggtgaaagatgaagaggatgaagacgtactcttttatactttccaaagaaacctgcgttgccacgacgtctaccgggccactttcggggataacaaacgtaatgagcggttttacacagagaaggacccctcttacttcgtatttttatacttaaccaaggacagcaggttcttgacaattaatataatgaataagaccacgagtgaggtgtggctcatagatggactatccccttgggatcctcccgtattgatccagaagcgaattcatggtgtgttgtactacgtggaacatcgtgacgacgagttgtacatcctgactaatgtaggagagcccaccgaattcaagctgatgaggactgctgccgatacccccgccataatgaactgggatctcttctttaccatgaagcgtaacaccaaagtcatagacttagatatgttcaaggaccattgcgttctgtttttaaaacactcaaatttactctacgtgaacgttatagggcttgccgacgactctgtccggtcactgaaattacctccctgggcttgtggcttcatcatggatacaaacagtgatccaaaaaattgcccattccagttatgcagcccaattcggcctccgaaatattatacctataagtttgctgagggcaagctgtttgaagagactggacacgaggatccgattaccaagacctctcgggtgcttcggctcgaggcaaagagtaaggacggaaaattggttccaatgacagttttccacaaaacagattcagaggatttacaaaagaaaccgcttctggttcatgtctacggggcatacgggatggatctgaagatgaattttcggcccgagcgcagagtgcttgtggatgacggatggatcctcgcgtactgccacgttcggggaggaggtgaattgggcctgcaatggcatgctgatggtaggttgacaaaaaaattaaacggactggcggatcttgaggcatgcattaaaactctgcacggccaggggtttagccagccaagcttgacgaccttgacagccttttcagcagggggagtcttggccggcgctctgtgtaactctaaccctgagctggtgcgagcagtgacactggaggcaccctttctagatgttctgaacaccatgatggataccactctgcctttgacactcgaggagttagaggagtgggggaatccctcctctgatgaaaaacacaagaactacatcaaaaggtattgcccataccagaatatcaagccacagcactacccatccatccacatcacagcttatgagaatgatgaacgtgtgcccctcaagggcatagtctcttacaccgaaaaactgaaagaagccatagcagagcatgcaaaggacacgggggaaggttatcagacgcccaacatcattctggacattcagcccggcgggaatcacgtgatcgaagacagccacaagaaaatcactgcacagatcaaattcctctacgaggaactgggcctagactctactagcgtgtttgaagatctcaaaaaatatcttaagttttag

SEQ ID NO: 130120 - DNA, 2184 bp, Artificial Sequence
  Description of Artificial Sequence: Synthetic coding sequence
atgcagcagaaaaccaagctcttcctgcaggccttgaaatacagtatccctcacttgggtaagtgtatgcagaaacagcacttaaatcattacaactttgccgatcactgctacaacagaatcaagctgaaaaagtaccatctgacaaagtgcctgcagaataagccgaagatttccgaactcgctcgaaatatcccgtcaagaagctttagctgtaaggacctccaaccagtaaagcaagagaatgagaagcccctacctgagaacatggacgcttttgaaaaggtccggaccaaacttgagacacaaccccaggaggaatatgaaatcatcaatgtagaggtaaaacacggaggtttcgtgtattatcaggaaggctgctgcctagtaaggtccaaagacgaggaggccgacaacgacaactacgaggtactgttcaacctcgaggagctgaaactggaccagccatttatagactgcattagggttgccccagacgagaagtacgtggcagccaagatacgcacagaggatagcgaggcgagtacttgtgttattataaaactatcggaccaacctgtaatggaggcgagtttccccaacgtgtcctcgttcgaatgggttaaagacgaggaggatgaggatgtcttgttctacacttttcaaagaaatctgcggtgccacgatgtctatcgcgccaccttcggagataacaagaggaacgaacgcttctacacagagaaagatccctcatactttgtgttcctttacttgacgaaggactcccggttcttaacaatcaacataatgaataaaacaacaagcgaagtgtggttgatcgacggtctaagcccttgggacccacccgttctgatacagaaaaggatccatggcgtcttatattacgtggagcatagagacgatgagctgtatattctcaccaacgttggcgagcccacagagttcaagctcatgaggactgccgccgatacacccgccataatgaattgggatctgttctttacaatgaagaggaatactaaagtcattgacctcgacatgttcaaggatcattgtgtcttatttctgaagcatagtaacctactgtacgtcaatgttattgggctggccgatgatagcgtgcgcagcctgaagctgcccccctgggcatgcgggtttatcatggatacaaattctgaccccaaaaattgtccttttcagctatgctcccccataaggccccccaaatactatacctacaagttcgccgaagggaaactgtttgaagaaacaggccacgaggatcccataactaagacctcccgcgtcctgcgcctggaagccaagagcaaggacgggaagcttgtgccaatgactgtttttcacaaaaccgacagcgaggacctgcagaaaaagcctttactagtgcacgtgtatggagcttatgggatggacttgaaaatgaattttagaccagaacgaagggtgctggtagacgatggctggatcctggcctattgtcacgtgcggggcgggggagaattagggctgcaatggcatgcggacggccgtctgacaaaaaagttgaacggactggcagatctcgaggcctgtataaaaaccctgcacggccaaggatttagtcagccctcccttaccactttgacagccttttcagccggcggagttttggcgggtgccctctgtaactccaaccccgagctcgtgcgcgccgttacactagaggccccattcctagacgttttaaacactatgatggacacaaccctgcctttgacattggaggagctcgaggagtggggcaatccttccagtgatgagaaacataagaactacatcaaacgctactgtccctatcagaacattaaacctcagcattacccctccattcacatcacagcctatgagaacgatgaacgggttccactgaaggggatcgttagttacacagagaaactaaaggaggctattgcagaacacgcaaaggataccggggaggggtaccagacaccgaatattatcctggacatccagccagggggcaatcacgtgattgaggattcccacaagaagattaccgcgcagataaaatttttatatgaggaactcggtctggacagcaccagtgtctttgaggatttgaagaagtatctgaagttctag

SEQ ID NO: 130121 - DNA, 2184 bp, Artificial Sequence
  Description of Artificial Sequence: Synthetic coding sequence
atgcaacagaagaccaagttattcctgcaggccctaaagtactcaattcctcacctgggaaaatgtatgcagaaacagcacctcaaccattacaatttcgccgatcattgttataatcgtattaagctaaaaaaataccatctgacaaaatgtttacaaaacaagcctaaaattagtgaattggcccggaacatcccttcccgttcatttagctgtaaggatctgcagccagttaagcaggaaaacgagaagccactccctgagaacatggacgctttcgagaaagtgcgtaccaaactggagacacagcctcaggaagaatatgagattattaatgtagaggtgaagcatggcgggttcgtttattaccaagagggctgttgtctcgtgagatccaaagacgaggaggccgacaatgataactatgaggttctctttaacctggaggagctgaagctggaccagccttttatcgattgtatcagagttgcacctgatgagaagtatgtggcggccaagatccggactgaggactccgaagctagtacgtgcgtaatcatcaagttgagtgaccagcctgtgatggaagcgagcttcccaaatgtcagctcatttgaatgggtcaaggacgaggaggatgaagacgtgctattctatacgttccaacgcaatctgcggtgtcacgacgtttacagggccacctttggggacaacaagcgcaatgaacgattttacacagagaaagacccttcttacttcgtctttctgtacttgaccaaagacagcagattcctgaccattaatatcatgaataagactacttcagaggtctggcttatcgacggccttagcccttgggatccaccagtccttattcaaaagagaattcatggagtgctctactacgtggaacatagggacgacgagctatatatccttactaatgttggtgaaccaacagaatttaagttaatgcgaacggcagccgatacccctgccatcatgaattgggatctcttttttacaatgaagcgaaacacaaaggtcatcgacttggatatgttcaaagaccactgtgttctgttcctgaagcacagtaacctgctctatgtcaacgtgattggcctggccgatgacagtgtgaggagcctcaagctcccaccttgggcatgcggcttcattatggacactaactctgacccaaagaactgtccattccagctgtgtagccctattaggcctcctaaatattatacttataaattcgctgagggtaagctctttgaggagaccggacacgaggaccccataactaaaacatccagggtcctacggctggaagctaagtcgaaggacggcaaattggttccaatgactgtgtttcataagactgattccgaggatttacagaaaaagcccctgctcgtgcatgtgtatggcgcatatggaatggacctgaaaatgaatttccgaccggagagaagggtgctggtggatgacggatggatattggcttactgtcacgtgaggggcggcggtgagctgggcctgcaatggcacgctgatggcagactgactaagaagttgaatgggctagcagacctggaagcctgcataaagacacttcatgggcaaggcttcagccagcccagtcttaccaccttaactgctttttcagctggaggcgtgctggccggggctctttgcaattccaatccagaattagtgcgcgctgtcacactagaagcccccttcctcgatgtactaaataccatgatggacactaccctgcctcttaccttagaggaattagaagaatggggcaacccttcatccgatgaaaagcacaagaactatatcaaaaggtactgcccctatcagaatataaaaccacaacactacccctcaatccatattactgcgtacgaaaacgatgaacgcgttccattgaaaggcatcgtctcctatacagagaagctcaaagaggccatcgcggagcatgcaaaggacacgggagaaggatatcagaccccgaatataatattggacatccaaccaggcggtaatcacgtgattgaagactcgcataagaagatcacagctcaaattaaatttctgtacgaagaactcggcctggactccacttccgtattcgaggatctcaagaaatatcttaagttttag

SEQ ID NO: 130122 - DNA, 2184 bp, Artificial Sequence
  Description of Artificial Sequence: Synthetic coding sequence
atgcaacagaaaacgaagttgttcttgcaggcactgaagtattccatccctcatttgggcaagtgtatgcagaaacaacatttgaatcactataactttgcggatcattgctataataggatcaagctcaaaaagtatcatttaactaaatgtctccaaaataagcctaaaatttcagagttggcgcggaacattccttcacgaagcttctcatgtaaggatcttcagccagtgaagcaggaaaacgagaagcccctgccagagaatatggatgccttcgaaaaagtcaggactaagctggagacacaacctcaagaagagtacgagattatcaacgttgaagtaaaacatggtggctttgtctactatcaggagggctgttgtcttgtgagatctaaagatgaagaggccgacaacgataactacgaggtgctcttcaaccttgaagagctcaagcttgatcagccgtttattgactgcatacgggtcgcgcctgacgagaaatatgtcgccgctaagattcggacggaggactccgaagcctccacttgcgttatcattaaactgagcgaccaacccgtcatggaagcctcttttccaaacgtgtcgtctttcgagtgggtgaaggatgaagaggacgaagacgtgcttttctataccttccagcgcaatctgcgctgccacgacgtgtatagagcaacattcggagacaacaaaagaaacgagaggttctacactgaaaaggacccctcctactttgtcttcctctatctgaccaaggactccagatttctgacaattaatataatgaacaagaccacaagcgaagtgtggctcatagacgggctgagtccatgggacccaccagtgctgatccagaagcgaatccacggagtattatattacgtggagcaccgcgatgacgaactctatatactcaccaatgtgggtgagcctaccgaattcaagctgatgcgcactgctgccgacacccctgccatcatgaactgggatctcttttttactatgaagcggaacacaaaggtgattgacctggacatgttcaaagaccattgtgtgttgtttctgaagcattcgaatctgctatatgttaatgtaataggtctcgctgatgatagcgttcgatcattaaaacttcctccctgggcctgtggcttcattatggataccaactctgaccctaagaactgccccttccagctttgctcacccattagaccgcccaaatactacacctacaagtttgcagagggcaagctttttgaagaaacgggccacgaggatcccataacgaagacatccagggtgttgcgtctggaggccaagtctaaagacggtaagcttgtgcccatgactgtttttcataagacagacagcgaggacttgcagaagaaaccactcctagtgcacgtctacggagcttatggcatggatctgaaaatgaacttccggccggaacggagggtcctcgttgacgatggctggattttagcatactgccacgttagggggggcggcgagttggggctacagtggcatgccgacggaaggttgactaagaaactcaatggtctggccgatttggaggcttgcataaaaacattgcatggccaggggttctcacagccatctctgaccaccctcactgctttctcggctggcggtgtgctagcaggagcactgtgtaacagcaacccagaactggtgcgtgccgtgacactcgaggcccctttcttggatgtgctgaatacgatgatggacactactctccctctgactcttgaggagctggaggaatgggggaatccatcttctgacgaaaagcataagaactatataaaacgctattgtccctatcaaaatataaaaccgcagcattacccatcaattcacatcaccgcatatgagaacgatgaaagagtaccacttaagggcatcgtctcgtacacagaaaagcttaaggaggctattgccgagcacgccaaagacaccggggagggttaccagactcctaatattattctcgacattcaacccggcggaaaccacgtgatcgaggatagtcacaaaaaaatcactgcccagatcaagttcctgtatgaagagctcggattagattctaccagtgtctttgaggacctcaaaaagtacctcaaattctag

SEQ ID NO: 130123 - DNA, 2184 bp, Artificial Sequence
  Description of Artificial Sequence: Synthetic coding sequence
atgcagcagaagaccaagctgttcctccaggcccttaaatattctattccacatctcgggaaatgtatgcagaagcagcacttaaaccattataacttcgcagaccactgttacaataggatcaagctaaagaagtaccatctgacaaaatgtctgcagaacaaacccaaaatttcagagctggcccggaacatcccttctcgatctttcagttgtaaagacctgcaacctgtgaagcaagaaaacgaaaaacctcttcccgagaacatggacgcatttgagaaggtccggactaagctggaaacacaaccacaagaagagtatgaaattatcaatgtggaagtcaaacacggtggcttcgtctactaccaggagggctgctgcttggtacgatcaaaagacgaggaggcagataatgataactacgaggtgctgttcaaccttgaggaactgaaactggatcagccttttatagattgtatccgagtagcaccagatgagaaatatgtcgccgccaagataagaaccgaggattcggaggcctctacctgcgttataataaagctgtccgaccagcccgtaatggaggcttcttttcccaacgtttcaagctttgagtgggttaaggacgaggaagatgaggatgtcctgttttatacctttcaaaggaatctgcgctgccacgacgtttatagagctaccttcggtgacaataaacggaatgagaggttttacacagagaaagatccctcttacttcgttttcctatacctcacaaaagactccagattcctcactatcaacataatgaacaagactacatctgaggtatggctgatcgacggtctgtccccatgggacccccctgtactcattcagaagaggattcacggggtgctgtactatgtcgagcaccgagatgatgagctgtacattctgaccaatgtgggcgagcccactgagttcaaactcatgcgcaccgctgccgatacaccggcaatcatgaactgggatctgttcttcacaatgaaacgcaatacaaaagttattgatctcgatatgtttaaggatcactgtgtgttgttcctgaaacacagtaatctcctgtacgtgaatgtaatcgggctcgcagacgatagcgttcgctctctaaagcttcctccttgggcgtgtggattcatcatggacactaacagcgaccctaaaaattgcccgtttcagctatgtagtcctatacggccccccaaatactacacctacaagtttgcagagggtaaactgttcgaagagactggccatgaagaccctattactaagacatcccgagtgctccgacttgaggctaagtccaaggatggcaaattggtccccatgactgtgttccacaaaacagattctgaggacctgcaaaagaaacctttgttggttcacgtttatggcgcctatgggatggatctgaagatgaactttcgcccagaacggcgcgttctcgtggacgatggctggatcctagcatattgtcacgtcagagggggtggcgagctgggactgcagtggcatgcagacggtcgcctgacaaaaaaactgaacggccttgccgatctggaagcctgtataaagaccctgcacggacagggcttctcgcaacccagccttacaaccctgaccgcttttagcgcggggggggtattggcaggcgcactgtgtaacagcaaccccgaattggttcgcgccgtgactctggaagcacccttcctagatgtgcttaatacaatgatggacaccaccctgcctctgaccttggaggagcttgaggagtggggcaacccttcatcagatgaaaaacacaaaaattatatcaaaaggtattgtccataccaaaatattaaaccccagcattatcccagcatacacattactgcttacgagaacgacgaacgcgtgcctttgaaaggaatagtctcttacacagaaaagctcaaggaggctattgccgagcacgctaaggacacaggagaggggtaccagacccccaatataatactcgacattcagcctggagggaatcacgtgatcgaggattcccataagaagataactgctcaaataaaatttctgtacgaagaactaggcctcgacagtacctcggtgtttgaagaccttaagaaatacctaaagttttag

SEQ ID NO: 130124 - DNA, 456 bp, Artificial Sequence
  Description of Artificial Sequence: Synthetic coding sequence
atgcagcaaaagacaaagttattcttgcaagcacttaaatatagtattcctcacttgggaaaatgtatgcagaaacagcacctgaaccactataatttcgcagatcactgttataacagaatcaagctgaagaagtaccatctgactaagtgccttcagaataaacctaaaatttcggaactggcccgtaatattccgagtaggagtttctcctgcaaagacctgcagccagtaaaacaggaaaacgagaaaccgctccctgagaatatggacgcatttgagaaggtgaggaccaagttagagacgcaaccacaagaggagtacgagatcattaacgttgaagttaaacacggagggtttgtgtactaccaggaagggtgctgcctagtccgctcaaaggacgaggaagccgacaatgataactatgaggtactcttcaacctggaagagctgtag

SEQ ID NO: 130125 - DNA, 1917 bp, Artificial Sequence
  Description of Artificial Sequence: Synthetic coding sequence
atggatgcctttgagaaagtgcgcactaagttagagactcagccccaggaggagtatgaaattattaacgtggaggtgaaacatgggggcttcgtgtattatcaggagggatgctgcctagtgcgttccaaggatgaggaagccgataacgataactatgaggtcctgtttaatctggaagagctaaaactggaccagcccttcatcgattgcataagagtggcccctgacgagaagtatgtcgccgccaagattcggacagaagatagtgaggccagcacgtgtgtgattatcaagctatcagaccagccagtcatggaagcctcctttcccaatgtgagcagcttcgagtgggtgaaggacgaggaagatgaagacgtgctgttttatacgtttcaacgtaacctgcgctgccacgacgtgtatagagctacttttggggacaacaaaaggaacgagcgcttctacacagaaaaagacccttcctactttgtcttcttgtacctgactaaagatagcagattccttaccataaacattatgaataagacgacctctgaagtctggctgattgacgggctgtccccgtgggatccacccgttctcatccaaaaaaggatccacggcgtcctgtactacgtcgagcatcgggatgatgaactctacatcctgacgaatgtgggcgagccgactgagttcaagctcatgcggaccgccgcagatacgcccgctattatgaattgggatctcttcttcacgatgaagagaaacactaaagtgatcgatctggatatgttcaaagatcattgcgtgttgttcctgaagcacagcaacctgctatacgtcaatgttatcggtctggctgatgatagtgtaaggagcctcaagctgcctccgtgggcttgtggcttcatcatggataccaacagcgaccccaaaaactgtccatttcaactgtgtagccctattagaccgcccaagtattatacatataagttcgcagaaggcaaactgttcgaggagactggccatgaggacccaattacaaaaacctccagagtgctccggttggaggcaaagagtaaagacggaaagctggtgcctatgacagtctttcataaaaccgacagcgaggatctgcagaagaagccgttattagtgcacgtgtacggtgcgtatggcatggatcttaagatgaactttaggccggaaagaagagtgctcgtggacgacgggtggattttggcttattgccatgtgcgcggcgggggtgagctaggcctgcaatggcacgctgacgggcgactgacgaagaagctcaacggtcttgctgatttagaggcttgtattaaaacccttcacgggcaggggttctctcagccctccctgaccaccctgaccgccttcagcgcgggaggggtgctggcaggggccctctgcaactcgaaccctgaattggtgcgggctgtaactctcgaggcacctttccttgatgttctgaacaccatgatggacacgacactacctctcaccctggaggagctggaagagtggggtaatccatcaagtgacgagaaacacaagaactatatcaagaggtactgtccttatcagaatataaaaccacagcattatcctagcatccatatcacggcctatgagaatgatgaaagggttcccctgaaagggatcgtcagttataccgagaagcttaaggaggccattgcagaacatgctaaggacaccggggaggggtaccaaactccgaatatcattctggatatccagcctggagggaaccatgtgattgaagatagtcataaaaagattactgcacagatcaagtttctatacgaggagctgggcctggactctacttcagtattcgaagaccttaagaaatacctgaagttttag

SEQ ID NO: 130126 - DNA, 1491 bp, Artificial Sequence
  Description of Artificial Sequence: Synthetic coding sequence
atgggtcgcagagctttgctgcttctgctgctgtccttcctggctccctgggcaaccatcgcactgcgccctgctctacgggctctggggtctttacacctgcctacgaaccccacaagtctgcccgctgtggccaagaactatagcgtcttgtactttcaacagaaagttgatcactttggattcaatactgttaaaaccttcaatcaaagatatttggtcgcagacaaatattggaagaaaaacggcgggtccattcttttttacactggaaacgaaggggacataatatggttctgtaataataccggcttcatgtgggatgtcgccgaggagctgaaggcgatgttggttttcgccgagcatcggtactacggggagtcattacccttcggggataactcttttaaagattcccggcacctgaacttcctgacaagtgagcaggccctggccgacttcgcagaattgattaagcacctgaagcgcaccatacctggcgcagagaaccagccagtgattgcaatcggcggttcctatgggggcatgcttgctgcatggtttagaatgaagtaccctcatatggtggtcggtgcactggcggcctctgctcctatttggcagttcgaggatttagtgccatgtggggtgtttatgaagatcgtcactaccgacttccggaaaagcggaccgcattgttctgaaagcatccatcgtagttgggacgctattaatcggctgagcaataccgggtcagggttacagtggctgaccggggccctccacctgtgttctcccctcactagccaggatatacagcatctaaaagattggatctcggagacatgggtaaatctggccatggtggactacccttacgcatcgaatttcctgcagccgcttccggcatggcccatcaaagtggtgtgccagtatctcaaaaatcccaacgtaagtgatagcctcttacttcagaatatctttcaagccctgaacgtgtactacaactacagcggacaggtgaaatgcctgaacatttccgagacagctaccagctcactcgggacactgggatggtcgtatcaggcttgtactgaggtggtgatgcctttctgtacgaatggggtagatgatatgttcgagccccactcttggaacctgaaagagctgtccgatgactgctttcagcaatggggcgttaggccacgaccctcatggattacaacaatgtatggcggaaagaatatttcatctcatactaacatcgtgttttcaaacggcgaactggatccttggagcggcggcggtgtgacaaaggatattacagataccctggtcgcggtgactataagcgagggagcgcaccacttggacttgagaactaaaaacgcactggacccaatgtctgtcctgctggcccggtcactggaggtcaggcatatgaagaactggatcagggatttctacgatagcgccggtaaacagcattag

SEQ ID NO: 130127 - DNA, 1554 bp, Artificial Sequence
  Description of Artificial Sequence: Synthetic coding sequence
atgggaaggcgggccctgctgctgttgctgctgtccttcctcgccccatgggccacaatcgccctcagacctgcacttcgcgccttgggatctctccatctccccactaatcccactagcttgcctgcggtggccaaaaactactcagttttgtattttcagcagaaagctctcgccgccggccagttgcacatttgcatcatccagttgaatcattacaagacacctctggtggatcacttcggatttaatacagtgaagacattcaaccagagatatttagtggcggacaagtactggaagaagaatggaggatcaatcctgttttacaccgggaatgaaggtgatatcatttggttttgcaataataccggctttatgtgggatgtggccgaggaactcaaagcgatgctcgtgttcgccgagcaccgctactatggcgagagtctgccctttggggacaatagctttaaggactccaggcatctcaattttctgacgtccgagcaagctcttgctgacttcgcggaactcataaagcatctcaaaaggaccatccccggcgctgaaaaccaacctgtcatcgccatcggtggttcctacggtggcatgttggctgcttggttcagaatgaagtacccccatatggtggttggcgccctggcggcctccgctcctatctggcaatttgaagacctagtgccatgcggcgtgtttatgaagatagtgacgacggactttcgcaaatcagggccacattgttccgagtctattcaccgaagttgggatgcaataaataggctatctaacactggatccggactgcaatggctgacaggcgccctgcatctgtgcagtcctctgacttcacaggacatccagcacctaaaagattggattagcgagacttgggtcaacctcgccatggtagattacccctacgcctctaattttttgcaacctctacctgcttggcccattaaagtggtttgtcaatacctcaagaaccccaatgtgtctgattcactgctgctccaaaatattttccaggctctcaacgtttattacaactattcaggccaggtgaaatgcctcaatatctccgagacagccacctcatccctgggaacccttggatggtcctatcaggcatgcactgaagtggtcatgccgttctgtaccaatggcgtcgatgacatgtttgagccccactcatggaaccttaaggagctcagtgatgactgttttcagcaatggggggttaggccacgcccctcatggatcaccaccatgtacggcggaaagaacatctcatcacatacgaacatcgtgttttcaaatggggagctcgatccctggtctggaggcggggtcaccaaagacatcactgacactctggtggcagtgacaatttctgaaggcgcccaccatttagatctgcgcacaaagaatgccttggatcccatgtctgtcctcctggcacggagcctggaggtgcgccacatgaaaaactggatccgtgatttttatgactcggcaggtaaacagcattag

SEQ ID NO: 130128 - DNA, 1176 bp, Artificial Sequence
  Description of Artificial Sequence: Synthetic coding sequence
atgtgggatgtggctgaggagctgaaggcaatgttggtgttcgccgaacataggtactatggcgaaagtctacctttcggggacaactcttttaaagacagccgccatcttaatttcctgaccagcgagcaggcactcgcagattttgcggagttgattaaacatctgaagagaacaattcctggggccgagaaccagccggtcatcgcaatcggcgggtcatacggtgggatgttggcagcctggttccggatgaagtacccccacatggtggtgggcgcactggctgcaagtgcgccgatttggcaatttgaggatttagtgccatgcggtgtgttcatgaagatcgtgactacagatttcaggaaaagtgggccgcattgctcagagagtattcaccggtcctgggacgcaatcaatcgcttgtcaaacaccggcagtgggttacagtggcttactggcgccctgcatctttgttcccccctgacgtcacaagacatccagcacttgaaagactggatctctgaaacatgggtgaacctggctatggtggattatccgtatgcaagcaattttctgcagccactccccgcatggcccatcaaagtggtctgccagtacctaaagaaccccaacgtgagtgattctctgttgcttcaaaatattttccaggctcttaatgtgtattataattatagcggccaggttaaatgcttaaacatctctgagactgcaacctctagcctggggaccctgggttggtcatatcaggcttgtacagaagttgtgatgcccttctgcactaacggggtggacgatatgttcgagcctcatagctggaacctaaaggagctatcagatgactgctttcagcagtggggggtacggccacgaccgtcgtggatcactactatgtatggcgggaaaaacatcagcagccacaccaacatcgtgttctccaatggagaacttgacccctggtcggggggaggggtgacgaaagacatcactgataccttggtcgcagtcacaatttctgagggggcccaccaccttgatctgcgcactaagaacgcccttgaccccatgtctgttttgcttgcgcgttctctggaagtgcgccatatgaagaactggatacgtgacttctacgacagcgcaggaaagcagcactag

SEQ ID NO: 130129 - DNA, 1428 bp, Artificial Sequence
  Description of Artificial Sequence: Synthetic coding sequence
atggagggtctcttaacccgttgtcgcgcactccctgctttggcaacctgttcacgccaactctccggatatgtgccctgccgttttcaccactgtgcccccaggcgcggcagacgcttgctcttatctagagtgttccagccacagaaccttcgggaggatcgagtgttatctctgcaggacaaaagcgatgatcttacatgcaagagccaacgcctgatgctgcaggtgggtctcatttacccagcttcccccggctgctaccacctgttgccatacacagtacgtgctatggagaagctcgtccgcgtaatagatcaagaaatgcaggcaatcggcgggcagaaggttaatatgccctcactgtctcccgctgaactgtggcaggctacgaataggtgggatttaatgggaaaggaattacttagactgagagatcggcatggcaaagaatactgcttagggccaacccacgaggaagcaattacagcccttatcgcatcacaaaagaagctcagctacaagcagctgcccttcctgctgtatcaggtgacacgtaaatttagggacgaacctcggcccagattcgggcttctcaggggtcgggagttttacatgaaggatatgtacaccttcgattcgtcccctgaagctgcgcagcaaacctactcactagtttgcgatgcttattgctccctttttaacaaacttggactcccctttgtcaaggtccaagctgatgtgggcactatcgggggaacagtgtcccatgagtttcaactgccagtcgacattggggaggatcgacttgccatttgccctcgctgcagctttagcgcgaacatggagacactcgatttgtcacagatgaactgccctgcctgccaagggccattgaccaagactaagggaatagaggttggacacactttctatttgggcacaaagtacagcagtatatttaatgcccagttcactaatgtttgtgggaagcctaccctggcagaaatgggttgctacgggctgggtgtgacgcgtatccttgccgctgcgatcgaggttctgtccaccgaagattgtgtgcgctggccttcccttttggccccataccaggcatgtctaatacctccaaagaaagggtccaaggagcaagcggcttccgaattaattggtcagctgtatgatcatattacggaagcagtaccgcaattgcacggggaagtgctactggatgaccggacgcatcttacaatcggcaacaggctaaaggacgctaacaaatttgggtacccctttgtgatcatcgccggcaaacgggcgctggaggaccctgctcacttcgaggtgtggtgccagaatactggcgaggtcgcatttctaaccaaggacggcgtgatggacctccttacaccggtgcagacagtttag

SEQ ID NO: 130130 - DNA, 498 bp, Artificial Sequence
  Description of Artificial Sequence: Synthetic coding sequence
atggcgaagatgaatcttagctcctacatcttgatcctgacctttagtctgttctcacaaggaattctcctgtccgcttccaagagcatcaggaacctcgacgatgatatggttttcaacaccttccgtctcgggaaaggcttccagaaggaggatacagcggagaaatcagttattgcacctagcctggaacaatacaaaaatgacgagtcgagcttcatgaacgaggaagaaaacaaggtgtccaaaaataccggctccaagcacaatttcctgaatcatggcctgcccctgaacctggcaattaagccttacctggccttgaagggatcggtagcatttcctgctgagaacggcgtccagaacacagaatccacccaagagaagcgcgaaataggcgatgaagaaaacagcgccaagtttccaatcgggcgcagggattttgacatgttgcggtgtatgctgggacgcgtatacaggccttgctggcaggtgtag

SEQ ID NO: 130131 - DNA, 2598 bp, Artificial Sequence
  Description of Artificial Sequence: Synthetic coding sequence
atggccttggtgctgggctctctactgctcttaggattgtgcgggaattccttcagcggagggcaacccagcagtaccgacgcgccaaaagcttggaattatgagctgcctgcaacgaattacgagactcaggattcccataaggcgggaccaatcggaatcttgttcgagctggtgcacatcttcctctatgttgtacagccccgggatttcccggaggatacactccggaagttcttgcagaaggcttacgagagcaagatcgactatgacaagccagagaccgtgattctcgggctgaaaatcgtctattacgaagctgggatcattctctgctgcgtgctaggtctgcttttcataatactcatgcccctcgttggctatttcttctgcatgtgtcgctgctgtaacaagtgtggtggcgagatgcaccagagacagaaggagaacggtccctttttgcgcaagtgctttgcgattagcttactcgtcatttgcattattattagcataggcattttctacggctttgttgctaatcaccaggtaaggacacggatcaaaagaagcagaaagctcgccgattctaactttaaagatctgcgcacacttttgaatgagacgccagagcaaattaagtacatcctggctcagtacaataccacaaaggacaaggcattcactgacctcaactctataaattccgtattgggaggcggcatcctagacaggttgcgccccaacatcatccccgttctggacgaaattaagagcatggctaccgccatcaaggaaaccaaggaggccttggagaatatgaattctaccctaaagtcacttcatcagcagtcgacccagctgtcctcctcgttgacgagcgtcaagactagtttacgttccagccttaacgacccactttgtttggtccaccccagctcagaaacttgcaacagcattcggcttagtctctctcaactgaactcaaaccctgagctccgccagctacctcctgtagacgccgaactggacaatgttaacaatgttcttcggactgatctcgacggcctagtacagcaagggtaccagtcactgaacgatatcccagacagagtgcagaggcagacaacgaccgtggttgccgggattaaaagggtgctcaattctattggctccgatatcgacaatgtaactcagaggctgcctatccaagatattctgtcagccttcagcgtgtatgttaacaatactgagagttacattcaccgcaatttacctactttagaggaatatgactcatattggtggttagggggactggtgatttgctccctactaacactgattgtcatattctactatctggggctgctatgtggcgtgtgcggatatgacagacatgccacacccacaactcggggatgcgtttcaaataccggcggagttttccttatggttggtgtgggcctctcatttctcttctgctggattctgatgattattgttgtactcacctttgtgttcggagccaatgtggagaagcttatctgcgaaccctacacttctaaggaattgttcagggtgttggataccccgtatctgctgaatgaggactgggaatattatttatcaggcaaactgtttaataaatcaaaaatgaaattaacctttgaacaggtctactcagattgcaagaaaaaccgcggtacttacggaaccttacatctgcagaatagcttcaatattagcgagcatctgaacattaacgaacatacaggcagcatcagttctgaattagagtctttgaaggtcaatctcaatatcttcctgctgggggcagcaggtaggaaaaacctacaggatttcgcagcttgcgggatcgaccgcatgaactacgacagctacctggcgcagaccgggaaaagcccagctggtgtgaatctgctgagcttcgcctatgacctggaggccaaagccaatagcctgccccctggcaatctcagaaatagcttaaagagggatgctcagaccatcaagacaatccatcagcagcgtgtcctacctatagaacaatctctgagcactctctatcagagcgtgaaaatcttacagaggaccggcaatggtctcttggaacgcgtcactagaattctggcatccctggacttcgcgcagaatttcatcacaaataatacgtcctccgtgatcattgaagagactaaaaagtacgggaggactatcattggatactttgaacactatctacagtggatcgaattcagtatttccgagaaggtagcctcctgcaaacccgtggcaacagcccttgacactgccgtcgacgtttttttgtgtagctacataatagacccactaaatctgttctggtttggcatcgggaaagccaccgtcttcctgttacctgcactgatcttcgcagtgaaactggcaaagtattaccgaagaatggactcagaggacgtatatgatgatgtggaaacaattccaatgaaaaacatggaaaacggaaacaatggctaccacaaagaccacgtgtacggcatacataatcctgtgatgacttcacctagccaacactag

SEQ ID NO: 130132 - DNA, 2571 bp, Artificial Sequence
  Description of Artificial Sequence: Synthetic coding sequence
atggctctggttctgggctctctcctgctgctcggcctctgtgggaattcctttagcgggggacagccttcaagcacagatgccccgaaggcctggaattatgaactcccagcgaccaactacgagactcaagatagccataaggctggccccattgggattttgtttgagctggtccacatttttctgtacgttgtgcagccgcgggacttccccgaagacactcttagaaagttcctgcagaaagcatatgaatcaaaaatcgactatgataagattgtctactacgaagccggaattattctatgctgcgtgttaggcctcctatttatcattcttatgcctctggtgggctattttttctgcatgtgtagatgctgtaacaagtgtggtggcgagatgcatcagcgccagaaagagaatggaccatttctcagaaagtgcttcgccatcagtcttctggtgatttgcattattatctccatcgggattttttacggcttcgtggcaaaccaccaggtccgcactcgaatcaagagatccaggaagcttgccgacagcaatttcaaagacctgaggacccttctcaatgagactccagaacagattaagtatatcctggcacagtataacacaactaaggacaaggcattcaccgacctcaactccatcaatagcgtgctgggcggcgggattctggataggctaaggccaaacataattcccgtccttgacgagattaaaagcatggctacagccatcaaagaaaccaaagaggccttggaaaatatgaactccactctgaaatcgctccaccagcagtctacccaactatcgtcttcattaacatcagtgaaaaccagtcttagatctagcttaaacgatcctctttgtctggttcacccttcttctgaaacatgcaacagcattcgcctcagcctctcccagcttaacagcaatcccgaacttcggcagctgccccccgtcgatgctgagctagacaatgtgaataatgtattgcgcacagatctagacgggcttgttcaacagggatatcagtctttgaatgacatccctgatcgcgtgcaaagacaaaccactactgtggtcgctggcatcaaacgggtgctcaacagtatcggaagcgatatcgacaacgtaactcagcggctcccgatacaggacatcctttcagcttttagtgtgtacgtgaacaacaccgagtcttatatccatcggaacctacccaccttagaagagtacgactcttattggtggcttggcggattggttatttgcagtttacttactttgatcgtcatcttctattatttaggcctgctgtgtggagtatgtggttacgaccgccatgcaactccaaccactcgggggtgtgttagtaacacgggaggagtgtttctgatggtcggtgtgggcctttctttcctgttttgctggattcttatgataatcgtggtcctaacttttgtgtttggtgctaatgtggaaaagctcatttgtgaaccctacacttccaaggaactgtttcgtgtcttggacacaccatatctcttgaacgaggactgggagtactacctgtcagggaaactgtttaataagagtaaaatgaaactcacctttgagcaggtatactccgattgcaaaaagaaccgtggaacctatggaactctgcatctgcagaattccttcaacatctccgagcacttaaacataaatgagcacaccggtagtatctcctccgagctggaatccctgaaggtgaacctgaatatcttcctgttgggcgccgctggacgtaaaaacctgcaagattttgccgcttgcggtatcgacagaatgaattacgatagttacctcgctcagacaggcaagagccctgccggtgtgaatctgctcagttttgcctatgatctggaggccaaggccaattcattaccccctggaaatctgcgcaacagcctaaagagggatgcccagaccatcaagacaattcatcagcaacgggtgttacctattgagcagtcactgagtacactgtatcaatcagtaaagatcctgcagcgtaccgggaacgggctgctggaaagggtgacacggattctagcaagtctcgactttgcgcaaaacttcataacaaataacacttccagcgtaatcattgaggaaactaagaaatacggtcgcaccattattggttattttgaacattatctgcaatggatcgaattctccatcagtgaaaaagtggccagctgtaagcctgttgccacagctctcgataccgcggtcgacgttttcttgtgtagctacatcatcgatcctctgaatcttttctggtttggaatagggaaggccactgtcttcctcttacccgccctaatctttgccgttaaactggccaagtattaccgaaggatggactccgaagatgtctacgacgatgtcgaaaccattcctatgaagaacatggagaacggaaacaacggctatcataaggaccatgtatacggaatccataaccccgtgatgacaagcccatcacaacattag

SEQ ID NO: 130133 - DNA, 2571 bp, Artificial Sequence
  Description of Artificial Sequence: Synthetic coding sequence
atggccctggtgttaggaagcctgctcttgctggggctgtgtggaaactctttttctggtgggcagccaagtagcacggacgctccgaaggcctggaattatgaacttcctgccactaattatgagacacaagactcacataaggccgggccaatagggatcctctttgagctggtacatatattcctttacgtggtgcagcctagggatttccctgaagacactctgaggaagtttctacaaaaggcttatgaaagcaagatcgattatgacaagatcgtctattacgaagctggcatcatcctctgttgtgtactcggcctccttttcattatcttgatgcccctggttgggtatttcttttgcatgtgccgttgctgcaataagtgcggcggagagatgcatcagcggcagaaagagaacggcccatttctgcgtaaatgcttcgccatcagcctcctggtgatttgcatcattatttcaatcggcattttctacgggttcgtcgctaaccaccaagttcggacaaggatcaaaagatcccggaagctcgctgatagtaatttcaaggacctgcgcaccctgctgaacgaaactcccgagcagattaagtacatcctcgcgcaatataacactaccaaagataaggctttcactgacctgaactcaattaacagtgttctagggggaggtattttagatcgtttgcgtcccaacatcattccagtcctggacgagattaaaagcatggccacagcgatcaaagagaccaaagaggccctggagaatatgaactccaccctgaagtctctacatcagcagagcacccagttgagtagctctcttacctccgtaaaaacttctctgaggtccagcctcaacgatccactttgcttggttcatcctagcagcgaaacctgtaattctatcaggttgtccctctctcagctcaacagcaaccctgagctgaggcagttgcctcccgtggacgcagagttggataatgtgaataatgtgttacgaaccgacctagatggcctggttcagcagggttatcagtctttgaatgatatcccggaccgcgtgcagagacagacaacaacagtggttgctggaattaagagagtgctgaactcaattggaagcgacattgataatgtcacacagagacttccgatacaggatatactcagtgccttcagtgtgtacgtgaacaacactgagagctacatccaccggaatctccccactctggaggaatacgactcttattggtggttaggcggactggtgatctgtagtctgctgacgctgattgttatcttttactacctgggccttctgtgtggagtttgcggttacgataggcatgcaacccccaccacaagaggctgtgtaagtaacactgggggcgtgttcctgatggtcggcgtgggccttagtttcttgttttgctggatactgatgatcattgtggttctgacctttgtctttggtgccaacgtggaaaagctgatttgtgaaccttataccagtaaggagttgttcagggtcctggataccccttatctgttgaacgaagattgggagtactaccttagcgggaaattgtttaataaaagcaaaatgaaattgaccttcgaacaggtttatagcgattgcaagaagaatcgcgggacttacggtactctgcacctgcagaacagctttaatattagtgagcacctgaacattaacgaacatacaggctccatttcatcggaactggaaagtttaaaagtaaacttgaacatttttcttcttggcgctgccggcaggaagaatcttcaggattttgcggcctgtgggattgaccgtatgaattacgattcatacctggcgcagactggtaagtcccccgcgggggtcaatctgctgtctttcgcctacgacctagaagctaaggcaaattcactcccacccggtaatctgagaaattccttgaagcgagacgctcagacaataaaaaccatccaccagcagcgggttcttcccatcgaacagagtcttagtactctgtatcagtccgtgaaaatcttacaacggactggaaatggattactcgagcgtgtcacgcggattcttgcgagtctcgattttgctcaaaactttataaccaataacacttcatccgtgatcattgaggagaccaaaaaatatggtcggacgatcattgggtatttcgaacattatttgcaatggatcgaattctctatctctgaaaaggttgcttcctgcaaacccgtggctactgctttggatactgctgtggacgttttcctctgctcttacattatcgaccctttaaatcttttctggtttgggattggcaaggcgactgttttccttctgccagctctgatcttcgccgtgaagctggccaagtattaccggcgcatggacagtgaggacgtgtatgacgatgtggaaaccatcccaatgaagaatatggagaatggcaataacggctatcataaagaccacgtgtacggaatccacaaccctgttatgacaagccctagccagcactag

SEQ ID NO: 130134 - DNA, 177 bp, Artificial Sequence
  Description of Artificial Sequence: Synthetic coding sequence
atggccctggtcctgggaagcttgctgttgctgggcctgtgcggcaattccttttccggaggccaacctagttccaccgatgctcctaaagcatggaactacgagctccccgccacaaattacgaaacgcaagacagccacaaagctggccctattgggatcttgttcgagctttag

SEQ ID NO: 130135 - DNA, 123 bp, Artificial Sequence
  Description of Artificial Sequence: Synthetic coding sequence
atggccctcgttctgggcagcctactcctgctgggactgtgcggcaattctttcagcgggggtcagccatcttccacagacgctccaaaagcttggaactatgagctgccagctacgaattag

SEQ ID NO: 130136 - DNA, 2598 bp, Artificial Sequence
  Description of Artificial Sequence: Synthetic coding sequence
atggccctcgtcctcgggtccctcctgctgcttgggctgtgtgggaactcattttctggtgggcaacctagttccactgacgcacctaaggcctggaattatgagctgccggccactaactacgagacacaggactcgcataaggccggacccatcggaatcctgttcgaactcgtccacatcttcctatacgttgtgcagccccgagatttccccgaggacactcttcgcaaatttctgcagaaggcttatgagtcaaaaattgactatgataagcccgaaactgtgatcctcggtcttaagatcgtttattacgaagctggaattatactatgttgcgttctgggccttctcttcatcatcctcatgccgctggttggctattttttctgcatgtgtcgctgctgtaataagtgtggcggggaaatgcaccagcggcaaaaggagaatggtcccttccttcgtaagtgctttgccatctccctgcttgtgatctgtattattattagcattggcattttctacggcttcgtagcaaaccatcaggtgcgaacacgaattaaaaggtcacggaaactggcagacagtaatttcaaagatctgagaacactgctcaacgagactcctgagcaaatcaagtacatacttgctcagtacaatactaccaaggacaaagcatttacagacctaaactccattaacagcgttttgggagggggcatcctggatcggttgagacctaatattattccagtgctcgatgagattaaatcaatggctacggctattaaagaaaccaaagaggcacttgagaacatgaattcaacgctgaaatccctgcatcagcaaagcacccagctctcaagttcactgactagcgtcaaaacaagcctgagatcatctcttaacgaccccctctgtttggtgcatccatcttccgaaacctgtaattctatacgcttaagcttatcccagttaaactcgaaccccgaactgcgccagctacccccggtcgacgccgagctggataatgttaacaatgtgttgagaactgaccttgacggactagtgcagcaggggtaccagtctctcaatgatattcccgatcgcgtgcagcgccagactacaactgttgtagccggcatcaagagagtgctcaattccatcggcagcgacatcgacaacgtcacgcagcgtctacccattcaggatatcttaagcgccttttcagtctatgtcaacaacactgaatcctacattcacagaaatttgccgacactcgaggagtacgattcctactggtggctgggtggactggtcatttgctccctgttaaccctaattgtaatcttttactatctaggactgttatgcggcgtatgcgggtatgaccgccacgccacccccaccacccgcgggtgtgtcagcaataccggtggcgtttttctgatggtgggagtgggcttaagcttcctgttttgctggattctgatgattattgtcgttctgacctttgtattcggggcaaatgtggaaaaactgatttgcgagccatatacctcaaaagagctgttccgtgtgctcgataccccctatctcctcaacgaagactgggagtattatttgagtggaaagctattcaacaaatctaaaatgaaactgactttcgaacaggtttactcagactgtaagaaaaacagagggacatatggaaccctccacctgcaaaactccttcaatataagtgagcacttaaacataaatgagcatactggctctatctcttctgagttggagagcttgaaagtaaatctgaatatttttctattgggcgctgccggtcgtaaaaacctccaggatttcgccgcttgcggcatcgacagaatgaactacgatagctatcttgcgcaaacggggaaatctccagccggtgtcaacctgttaagtttcgcctatgacctagaggcaaaggcgaacagtctaccccccggaaatctgagaaattccttgaagagagacgcgcagacgataaagactatccaccagcaacgcgtgttacctattgagcagtcactgtcaaccttataccagtcagtgaagattttgcagcggacggggaatggactcctcgaaagagtcaccagaattctcgctagcctggactttgcccagaactttataacaaacaacacctcatctgtgatcatcgaggaaacaaagaagtatggccggactataatcgggtatttcgagcactacctacagtggatcgaatttagcatcagtgaaaaagtcgcctcatgcaaaccggtcgccacggccctggatacggccgtggatgtctttctgtgttcctacattatagacccactaaacctgttttggttcggcatcggaaaggcgacagtgttcttattacctgcactcatatttgcggtaaaactggcaaagtattatcggaggatggattcagaagatgtgtacgacgacgtcgaaaccataccaatgaaaaatatggaaaatggcaataatggctaccacaaggatcatgtgtatggcatccacaatcccgtcatgacctctcctagccagcattag

SEQ ID NO: 130137 - DNA, 45 bp, Artificial Sequence
  Description of Artificial Sequence: Synthetic coding sequence
atggccttggtattagggagtttgcttttgctgggcctctgctag

SEQ ID NO: 130138 - DNA, 2505 bp, Artificial Sequence
  Description of Artificial Sequence: Synthetic coding sequence
atggccttggtcctgggtagcctgttactgctcggtctctgtggtaattcttttagcggagggcagcccagctcaaccgatgccccaaaggcctggaactacgagctccccgccacgaactatgagactcaggactcacataaggcaggcccaatcggaattctgttcgaactggtgcacatcttcctgtacgtcgtgcaaccacgagacttcccagaggatacccttcgcaagttcctgcagaaggcctacgaatccaagattgattacgataaacccgaaaccgtgatcctcggcctgaaaattgtctactatgaagctggaattattctgtgctgcgttctgggtctgctgttcatcattctgatgcctcttgtggggtatttcttttgcatgtgccgatgctgtaataagtgcggcggagagatgcaccagaggcagaaggagaacggcccgttcctgagaaagtgttttgccatatctttgctggtcatttgtattatcatttccatcgggatcttctatggtttcgtggccaaccaccaagtcaggactaggataaaacgctcccggaaactggccgattcaaatttcaaggacctgcggactttattaaatgagacacccgaacagattaagtacatattggcccagtacaacactaccaaagataaggcgtttactgacctaaattcaattaacagcgtgctaggtggagggatcttggaccgtcttaggcccaacattatcccagtgctggacgaaattaagtctatggccacagcaatcaaggagacaaaagaggcccttgagaacatgaacagcacactcaagagcctccaccagcagagtacacaactgtctagtagcctcacttccgtgaaaacaagcctcaggtcttcactgaatgaccccttgtgcctcgtgcatccttcttcggagacttgtaattccatacgcctaagtctatcgcagctgaactctaaccccgaactccggcagttaccccctgtcgacgccgaactagacaatgtcaacaacgtgctgcggacggatcttgatggcttagtgcagcagggctatcaatctttgaacgacatccctgatcgggtgcagagacagacaactacagtcgtggccgggattaaaagagttctgaacagcattggtagtgatattgacaatgtcacccagagactccccattcaggatatcttatcggcgttctccgtgtacgtgaacaatactgaaagttacattcataggaacctgccaacgctggaggagtatgatagctactggtggctaggagggctcgtcatttgcagtcttctaactctgattgtgatcttctactacctaggcctcctgtgcggagtatgcggttacgaccgacatgctacgccaactactagaggctgtgtttctaatacgggtggcgtatttttgatggttggcgtcggtctaagcttcctgttctgctggatccttatgattattgttgtgctgacatttgtgttcggagcaaacgtcgagaaacttatctgcgaaccttatacaagcaaggaacttttccgagtgctagatacaccctatctactaaatgaggactgggaatattacctgagtgggaagctgttcaacaaaagtaaaatgaaactaacctttgagcaggtctatagtgactgcaaaaagaatcggggtacgtacgggaccctgcatttacagaactccttcaacatcagtgagcacctgaatattaatgagcacacgggttcaatttcctccgagctggaatcgcttaaggtgaacctcaacatcttcttactcggtgctgccgggcgcaaaaacctgcaagacttcgcagcctgcggcattgacagaatgaattatgactcttacctagctcagactggaaagtcgcccgccggagtaaacctcctgtccttcgcctatgatttagaggccaaagcgaattctttgccacctggaaatcttcggaacagcttgaaaagggatgcccagaccataaaaacgatccaccagcaacgggtgctcccgatcgagcagagcctgtccacactttaccaatctgtcaagatactacagcggacagggaatggtctgttggagcgagtaacccgcatactagcttcccttgactttgcacagaacttcataacaaacaataccagctctgtaatcattgaggagactaagaaatacgggagaaccattattggatatttcgagcactatctccagtggattgagtttagtatctctgagaaggtggccagttgcaaaccagtcgcaacagcactggacacagcagttgatgtcttcctgtgctcttatatcatcgaccccttgaacctgttctggttcgggatagggaaagcaactgtgttcctcttgccggccctgatcttcgctgtgaagctggcgaaatactatcgacggatggacagtgaggacgtctacgacgatccctcacagcactag

SEQ ID NO: 130139 - DNA, 2529 bp, Artificial Sequence
  Description of Artificial Sequence: Synthetic coding sequence
atggcgctagtgctgggcagcctcctgctcttggggctctgcggcaatagtttctcgggaggacagccgagtagtactgatgcaccaaaagcctggaactacgagctcccagcgaccaactacgaaacacaggactcgcataaggcaggtcctatcggaatactcttcgagctggtccacatattcctctatgtggtacagccaagggattttcctgaagacaccctgcggaagttcctacagaaagcatatgagtctaaaatcgattatgataagccagaaacggtgattctcggcctgaagatcgtgtactatgaagcgggaattatcctatgctgcgtgctgggcctcctcttcatcatcttgatgcctcttgtgggatacttcttctgcatgtgtagatgctgcaacaaatgcggcggggaaatgcaccagcggcaaaaggaaaatggaccatttttaagaaagtgttttgctatctccttgttggttatctgcatcataatttcaattggaatcttctatggattcgtggcgaaccaccaggtacgcacccgtataaaaagaagcagaaagctcgcagatagtaacttcaaagacttgcgaactctactcaacgagacacctgagcagatcaaatatattttagcacagtacaacacaacgaaggataaagcctttacagacctgaatagcatcaattcagttctggggggcggtattcttgaccgcctgcggcctaacatcattccagtgctggacgagatcaagtccatggccacagccatcaaagagactaaggaggccctcgagaacatgaacagtactttgaagtccctgcaccagcagagtacccaactctcttcttcactgacatcagtgaaaacttcactaaggtcctcactaaatgatcctttgtgcctcgtccatccttcctctgagacctgtaattctattagactgtctcttagccagctgaattccaaccccgagttacgacaattgccccccgtcgacgccgaactcgataacgtcaataatgtgctgcgcactgaccttgacgggcttgtccaacagggctatcagtccctcaacgacattccggacagggtccagaggcagaccaccactgtcgtggcaggcatcaaaagagtgctcaactctattggttcagacatcgataacgtgacccagagactgccaatacaagacatactaagtgccttctcagtatatgtgaacaacacagaaagctacattcaccggaacctcccaactctggaggagtacgactcctattggtggctgggaggccttgtaatttgtagtttgctgaccttaatagttatcttttattacctcggtctcctttgcggagtatgtggctacgatcgccatgccaccccgacaactcggggatgcgtaagtaacaccggaggggtgttcctgatggtgggagtgggactcagttttttgttctgctggatcttgatgattatcgttgtgttaacctttgtgttcggagccaatgtagaaaagttaatatgtgaaccctacacttccaaagaactgttccgggtcctggataccccatatctgctcaatgaggattgggaatattatctgagcggcaagctattcaacaagtctaagatgaaactaacattcgagcaagtctactccgactgcaagaagaacaggggcacatatggtacactccaccttcagaatagtttcaatatttctgaacatctcaacatcaacgagcacactgggagcatctcctctgagctcgagtccctgaaagtcaacctcaatatcttccttttgggagcagcagggcggaaaaatctgcaagatttcgccgcctgcggtattgaccggatgaactacgactcctatctcgcccagacaggaaagagccctgcaggggttaatctccttagtttcgcttatgacctggaggcgaaggctaatagcctgccgccgggtaacctgcggaattctctaaaaagagatgcgcaaaccataaagaccattcatcagcagagagtgttaccaatcgagcagagcctgtctacgctgtatcagagcgtgaagatcctgcagcgcacaggtaacgggcttttggaacgcgtcacaagaattctggccagcctggattttgcacaaaattttatcacgaacaatacttcctccgtaattattgaagagaccaagaagtatggcagaaccataatagggtattttgagcactacctgcaatggatcgagttcagtatctctgagaaggtcgcctcttgcaaaccagttgctaccgccctggatacggccgttgacgttttcctgtgctcatatattatcgatcctctgaacttgttttggtttggaattggaaaagctaccgtcttccttctgcctgcactcatatttgcggtgaagctagcaaaatattatagacggatggatagtgaagatgtgtatgacgacgtcgagactattcctatgaagaacccatctcagcactag

SEQ ID NO: 130140 - DNA, 2493 bp, Artificial Sequence
  Description of Artificial Sequence: Synthetic coding sequence
atggctctcgtcctcggatccctcctgctgttggggctgtgtggtaacagcttcagcggaggtcagccctcctcaactgatgcgcctaaagcatggaattacgaacttccagcaacaaactacgagacccaggactcccataaggccggccccatcggcattctctttgagctcgtccacatctttctgtacgtggtgcagccacgcgattttcctgaagacacactgcgaaagttcttgcagaaagcatatgagtccaagatagactatgacaagatcgtttattacgaggccggtatcatactgtgttgtgtcctcgggctgttattcattatcctgatgcccctggttgggtacttcttttgcatgtgccgttgttgcaataaatgcggtggtgaaatgcaccagcgtcagaaggagaatggcccctttctgcgaaaatgctttgctatatcccttctggtgatttgcatcatcatttcaattgggatcttttacgggttcgtcgctaatcatcaagtccggacacgcatcaaacgcagcagaaagttggctgactctaactttaaagatcttcgtacccttctgaatgagacccccgagcagatcaagtacattctggcccagtataacacaactaaagacaaagctttcaccgacttgaactccattaattctgtgcttgggggcggcatactggaccggctccgccccaatatcatccccgtgcttgatgaaatcaagagtatggctacagccatcaaggagactaaggaggcactggaaaatatgaacagcacactcaaaagcttacaccagcagagcacccagcttagtagttctctgacgtccgtgaagacatctctgagatcaagcctgaatgaccccttgtgccttgtgcatcccagctcagagacttgtaactctatccgactgagcttgtctcagctgaacagtaatccagaactgcggcagctgccgccagtagacgctgaactggataacgtaaataatgtcttgcgtaccgatctagacgggctcgttcagcagggataccagtccctaaacgacattcccgaccgggtgcagcggcagactacgactgttgtggctggaattaagagggtgctaaacagcatcggcagcgacatcgataatgttacccagaggttgccgatccaggatattttatctgctttctctgtgtatgtcaacaataccgagagttacatccacagaaatctccctacattggaggaatatgactcctactggtggctgggaggccttgtaatttgtagtttgctgaccctgattgtgattttttactatttgggattgctctgcggggtctgtggctacgatcgccacgccacgcccacgaccaggggctgcgtctctaatacaggcggagtgtttctcatggttggggtgggcttatcatttctgttttgttggatactcatgatcatcgttgttttgacttttgtgttcggtgccaatgtagagaagcttatatgtgagccatacacaagcaaagagttatttcgggtactggacacaccctatttactaaatgaggattgggagtattatctgtccggcaaactgtttaataaaagcaagatgaagctcacgttcgagcaggtgtattccgattgtaaaaagaaccgtggtacatacggtaccttacacctgcaaaacagttttaacatctcggagcacttgaatatcaatgagcataccggtagtattagctctgagctggaatcactgaaggttaatctgaacatcttcctgctcggggcggcagggaggaaaaacctgcaggattttgcagcttgcggtatcgatcgcatgaactacgattcttatctggcccagaccggtaagtccccagcaggagtgaacctgttatcgttcgcctacgatctcgaggccaaggccaattcactgcctcctggcaaccttagaaacagtctgaagcgcgatgcacagactattaagacaatccatcagcaacgtgtgctgcctatcgagcagtccttgtctactctctatcaatctgtgaagattcttcagcgcacaggcaatggtctcctggaacgggttacgaggattcttgcatcactggacttcgcacaaaacttcattaccaataacacttctagtgtgataattgaggaaacgaagaagtacggccggacaatcatcggatatttcgagcactatttgcagtggatcgagttcagcataagcgagaaggtcgcttcttgcaagcccgtagcaacagcactcgatacagcggtagatgttttcctgtgtagctacattatcgatccgctaaatctgttctggttcggcatcggtaaggcaaccgtgttcctgctgcccgcactgatctttgctgtgaaactggcaaaatactaccgtagaatggacagcgaggacgtgtacgatgatagttcctgggtaacatccgtacagtgctag

SEQ ID NO: 130141 - DNA, 681 bp, Artificial Sequence
  Description of Artificial Sequence: Synthetic coding sequence
atggaggctgaacgcagaaggcaggctgagaagcccaagaagggtagggtgggcagcaacctccttccggaacgccatcctgctaccgggactcctactactacagttgactcctcagcgccaccttgccgtaggctgcctggagctggaggcgggcgaagccgtttctccccccagggcgggcagagagggagaccccactcccggaggagacatagaactacgttttctcccgtccagctggaacaactcgaaagcgccttcggcagaaatcagtatccggatatttgggcccgagagagcctggcccgggacactggcctctctgaggcccgtatccaggtgtggttccagaacaggcgagctaagcaacgaaaacaggaaagatctttgttacagcctctagcccacctctcacccgccgccttttctagctttctgccagagagcaccgcctgtccttactcctacgccgccccccctccccccgtcacctgctttccacatccctactcacatgcactgcccagccagccctcaactggcggcgcgttcgccctatctcaccagtctgaggactggtaccccacattacacccggccccggccgggcacctcccatgcccaccccccccccctatgctgccactcagtctcgagcccagcaagagctggaactag

SEQ ID NO: 130142 - DNA, 417 bp, Artificial Sequence
  Description of Artificial Sequence: Synthetic coding sequence
aatatctcactgtgcccagaaatctgctttcagaagattgaatctcaggtgtactttgtccgggtcgattccggaatccagccaggatcagatatcagtatctattacgatcctatgatttcgaaactcatcacatacggatcagaccgcactgaagctctcaaacggatggccgacgcactcgataattacgtaattcggggggtgactcacaacattgccctgttgagagaggttatcattaattccaggttcgtcaaaggcgatatttctaccaagttcttgagtgatgtttacccggacggttttaaaggccacatgctcacgaaatctgaaaagaaccagctgctcgcgattgcctcctcactgttcgtcgcattccaattgcgcgcgcagcattttcaggagaatagttag

SEQ ID NO: 130143 - DNA, 363 bp, Artificial Sequence
  Description of Artificial Sequence: Synthetic coding sequence
atgagcatccagtttctcggaactgtgtacaaagtgaacattctgacaagactcgcagcagaactgaataagtttatgcttgagaaggtaactgaagataccagttccgtgctgcggtcccctatgcctggggttgtagtcgccgtttccgtgaaaccaggcgacgccgcgacgtctagtctgtccgttgagatttgtctgttctggacgtttcaagtcgcagagggacaggagatatgcgtcatcgaggcgatgaagatgcaaaactcaatgactgccggcaagaccgggactgtaaaaagtgtgcactgtcaggcaggcgataccgtaggcgaaggcgatctgctcgtcgaactggagtag

SEQ ID NO: 130144 - DNA, 2046 bp, Artificial Sequence
  Description of Artificial Sequence: Synthetic coding sequence
atggccgggttctgggttgggacagcgcctctggtagcagccggtagacgaggtagatggccgcctcaacaattaatgctgtccgctgccttacgaacgcttaaacacgtcctgtactatagcagacagtgtctgatggtgtcccggaacctcggttctgtgggttatgacccgaatgagaaaactttcgacaagattctggtagctaatcgcggcgaaatcgcatgcagagttatccggacctgtaagaaaatgggcattaagacggttgcaatccactccgacgtggatgcaagtagcgtgcacgtgaagatggccgacgaggccgtttgtgtgggccccgcgcctacgtctaagtcatacctgaatatggacgcgatcatggaggccataaagaaaaccagagcacaggccgtgcatcctggctatggctttctgtctgaaaataaggagtttgccaggtgccttgccgccgaagacgtcgtgttcatagggcctgacacacatgctatccaggccatgggcgacaaaatcgaaagcaaattgctcgccaagaaggcggaagtgaatactatcccaggcttcgatggcgttgtgaaggacgcagaggaagctgttcgcattgcgagagagatcggatatcccgtcatgatcaaggcaagtgctggcggcggggggaaaggtatgcgtatagcctgggatgatgaagaaacccgggatggtttccgactttcctcacaggaggctgcttcgagctttggagatgaccgccttttgatcgaaaagttcatcgacaaccccagacacatcgaaatccaggtacttggagacaaacatggtaacgcgttgtggcttaacgaacgggagtgttcgattcagcggagaaatcagaaggtggtggaagaagctccttccatattcctcgacgccgagacccgtagagccatgggcgaacaagcagtcgcactggcgagagcggtcaaatatagttcagctgggaccgttgagttcctggtggatagtaagaagaacttctacttcctcgagatgaatactcggcttcaggtcgagcatcccgtgaccgagtgcatcaccggactggatctcgtccaagaaatgatccgtgttgccaagggctatccactgcgccacaaacaagcagatatccgcatcaatgggtgggccgtagagtgtcgagtctacgccgaggatccctataagtccttcgggctgccaagtatcggacgcctgagccagtaccaggagcccctgcacctccctggcgtgcgcgttgactctgggatccagcccggatcggacatctccatctactatgaccccatgatttcgaagctcatcacatacggctcagatcggaccgaagcgctcaaaagaatggccgacgcactggacaactacgtgattcgcggcgtgacccacaacattgcactactccgagaggtgataattaactcccgctttgtgaagggtgacattagtacgaaattcttgagtgacgtttacccggatggattcaaggggcatatgctgacaaaatcagagaaaaaccagttgcttgccattgcctcttccttattcgtcgcttttcagctgagggctcagcattttcaggagaactccaggatgccagtgataaagcccgacattgccaactgggagctgtcagtcaagctccacgacaaggtccatacagtggtcgcaagcaacaatggcagtgtattctcagtagaggtggatgggtcgaagctcaatgtgacgtcaacctggaacctggccagcccgcttctgagcgtctcggttgacggtacccagcgaactgttcagtgtttgagccgtgaggctggcggtaatatgtccatccaatttcttggaactgtggttgctgaaggacaggagatctgcgtaatcgaggcaatgaagatgcagaatagcatgactgcggggaaaaccggcaccgttaaaagcgtacactgccaggcaggggatactgtaggcgagggtgacctgcttgtcgagttagaatag

SEQ ID NO: 130145 - DNA, 2187 bp, Artificial Sequence
  Description of Artificial Sequence: Synthetic coding sequence
atggccggtttttgggtgggaacagctcctcttgtggccgccggtaggcgaggccgttggccaccccagcagctcatgttatctgctgccctcagaactcttaagcacgtcctctattatagcaggcaatgcctgatggtgtccaggaacttggggtctgtgggctacgaccctaatgaaaagactttcgataagattctggtggcaaacaggggcgaaatcgcctgtcgggtcatcagaacctgcaagaagatggggatcaaaaccgtagccattcactctgacgtggacgcatcctcggtacacgttaagatggccgacgaggctgtctgcgtgggcccagcaccaacctctaaaagctacctgaacatggatgccatcatggaggccatcaaaaagacccgcgcacaggccgttcatccagggtatggttttctctccgagaataaggaatttgccaggtgtttagctgcagaagacgtcgtatttatcgggccagacactcacgctattcaagccatgggagataagatcgagtccaaactgctggcaaagaaggctgaagtgaacacaattccggggttcgacggagtggtaaaggacgcagaggaggcggttcgcatagctagggagatcgggtatcccgtgatgattaaggcctcagcaggaggaggaggcaaaggaatgcggattgcctgggacgatgaggaaactcgggatggattccggttgtcctcacaggaggccgctagtagtttcggtgatgaccgtctgctgatcgagaaattcattgataatccacgccatattgagatccaagttcttggtgacaagcacggaaacgcactgtggctcaacgagagagagtgctccatccagcgaaggaaccaaaaggtcgtggaagaggctcctagtatattcctagatgccgaaacacgtcgggcaatgggtgagcaggctgtcgctttagcccgagctgttaagtactccagcgcagggacggtggaattcctggtagactcgaaaaagaatttttactttttggagatgaacacacgcttgcaggttgagcaccccgtgaccgaatgcataaccggcttggatctggtgcaggaaatgataagggtagccaagggctatcctctgcgacacaaacaggctgacatcaggattaacggttgggccgtagagtgtcgtgtctacgccgaagatccatataagagctttgggttgccatctattggacgcctatcccagtatcaggagccccttcacctaccaggggttcgcgtcgactccggaatacagcccgggagtgatatatcaatttattacgaccctatgatctcaaagcttatcacgtacggctccgatcgcacagaagctctcaagcgaatggcagacgccctggacaactatgtgatcagaggagtcacacataatatcgcactacttagggaggtgatcataaatagtagattcgtgaaaggtgacattagcaccaaattcctcagcgatgtctaccctgatggatttaagggccacatgttgaccaagtctgagaaaaatcagctgctcgcaatagcaagctctctctttgtcgcattccagctgagagcacagcactttcaggagaattcacgcatgcctgttatcaagcccgatattgccaactgggaattgagcgtcaaacttcatgataaggttcataccgtcgtggccagcaataatggctccgtgttctctgtggaagtggatggatctaaactcaatgtcaccagtacatggaacctcgccagccccctcctctcagtgtccgtggatgggacgcagaggaccgttcagtgcctgtcacgggaggccggaggtaatatgtctatccaatttttaggtaccgtttataaagtgaatatcctcacccgcctggcagcggagctgaataagttcatgcttgagaaggtcactgaggatactagttccgttttgaggtcccccatgccgggggtggttgtggccgtctctgtgaaaccgggggatgctgtcgcagagggccaagagatctgtgttatcgaggccatgaagatgcaaaattcaatgacagccgggaaaaccgggacagtgaagagtgtgcactgccaggcaggcgacacagtcggcgagggagacttactggtggagctggagtag

SEQ ID NO: 130146 - DNA, 2109 bp, Artificial Sequence
  Description of Artificial Sequence: Synthetic coding sequence
atggcgggtttttgggtaggcaccgccccattggtggcagcaggccgtcgggggcggtggccgccccagcagttaatgctgagtgcggctctcaggactctcaagaccttcgataagatcctggtcgccaataggggagagatagcgtgcagggtgattaggacatgcaagaagatgggcattaagactgtggccatccactccgatgtcgatgctagctccgtgcacgtcaagatggcagatgaggctgtttgcgttggtcccgcccctacttccaaatcctatctcaatatggacgctattatggaagctatcaagaaaacccgcgctcaagccgtgcatccagggtatggtttcctttccgaaaacaaagagttcgctcgctgcctggccgcagaggacgttgtgttcattggtccagacacccacgctatacaggctatgggcgacaagatcgaatccaagctcctggccaagaaggccgaggttaataccatcccaggctttgacggggtggttaaagatgcggaagaggccgtacggattgcacgcgaaatcggatatcctgtcatgatcaaagctagcgccggaggaggagggaagggcatgcgtatcgcctgggacgacgaggagacaagagacgggtttaggcttagtagccaagaggccgcctcctcctttggggatgacaggctgctcatcgaaaagttcattgacaaccctcgccacatcgagatacaagtgctgggtgacaagcacggcaacgccctgtggctgaatgagagagagtgttccatacaaagaagaaaccagaaggtggttgaggaggcgcccagcattttccttgacgccgagactaggcgcgcaatgggtgagcaagccgtagctttagctagagctgtgaaatactcatccgctgggaccgtggagtttctcgtggattcgaaaaaaaacttttactttctcgaaatgaataccagactgcaagtcgaacacccggtgacagagtgcatcaccggcctggatctggtgcaggagatgattagagtggcaaaaggataccccctgaggcacaagcaggcagatatccgaatcaacggatgggcggttgagtgtcgggtgtacgccgaggacccatataagtctttcgggcttccctccatcggaaggctgagccagtaccaagaacctctgcatctccctggcgtgcgcgtggactcgggaatacaacctggttcggatatctctatttactacgatcctatgatcagcaagctgatcacatacgggagtgaccgtacagaagccctaaagagaatggccgatgcgctggacaattacgtgattagaggcgtgacccataacattgcccttcttagggaggtaatcattaacagcaggttcgtgaaaggggacatctcaaccaaatttctcagcgacgtgtatcctgacggtttcaaaggccacatgttgactaagagcgagaagaatcaattactggccatcgctagctctcttttcgtcgcatttcagttgcgtgcccagcacttccaggagaactcacggatgcccgtaattaaaccagatattgccaactgggagttgagcgtgaagctccacgacaaggtccacaccgtggtggcttctaacaacgggagtgtgttttccgtggaggtcgatggctcaaagctgaacgtgactagcacgtggaatttggcctctccattgctgtccgtgtcagttgatggcacacaaaggacggttcagtgcctctccagagaagctggggggaatatgtccattcagtttctcggcacagtttacaaagtgaatatcctgacccgcttggccgccgagctgaacaagtttatgctggagaaagtaacggaagatacttcctccgtgctacgtagtcccatgcccggggtggtggttgctgtctctgtgaagcctggagacgcagtggctgagggacaggagatctgcgtcatcgaagccatgaaaatgcagaactctatgacagctggaaaaacgggaactgtaaaaagcgtccactgtcaggccggagacacagtgggcgagggagatctgctggtcgagctggagtag

SEQ ID NO: 130147 - DNA, 255 bp, Artificial Sequence
  Description of Artificial Sequence: Synthetic coding sequence
taaaactgggagctgagcgtgaagcttcatgacaaggtgcatacggtggttgccagtaacaatgggagcgtgttctcagttgaggtggatgggtctaaactaaacgtaacctcaacgtggaacttagcatctcctcttctgtctgtcagtgtggacgggacacagagaactgtgcagtgtctatctagagaagcggggggcaacatgagtatccaattcttagggacagtcccatggagaaagctgctcgactag

SEQ ID NO: 130148 - DNA, 336 bp, Artificial Sequence
  Description of Artificial Sequence: Synthetic coding sequence
tataaagtaaatattctgacgagactcgccgccgaactaaacaaatttatgctagagaaagtgactgaagatacatcttccgtgttacgtagtccgatgcctggtgtcgtagtggcagtgtccgttaagcctggggacgctgccacttcctctctctcagttgaaatctgtctgttctggacattccaggttgctgagggccaggaaatttgcgtgattgaggccatgaagatgcaaaattcgatgacagcaggtaagaccggcactgtaaaaagtgttcactgccaggccggcgacaccgtcggggaaggggatttgctggtggaattggagtag

SEQ ID NO: 130149 - DNA, 405 bp, Artificial Sequence
  Description of Artificial Sequence: Synthetic coding sequence
tagatgcctgtaatcaaaccggacatagcgaactgggagctctccgtgaaattgcacgataaagttcacaccgtggtcgcttccaacaacggcagtgtcttctcggttgaggtggacggatctaagctgaatgtgacctctacgtggaacctagcgagccctctactctctgtgtctgtagacggcacccagcgcactgtgcagtgcctgagtcgcgaagctggcggtaatatgtccatccaattcttggggaccgtcgtggcggaaggtcaggaaatctgtgtcatcgaggccatgaagatgcagaactcgatgactgccggaaaaacgggaacggtaaaatcagtccattgtcaggcaggggataccgtcggcgaaggagatttgctggttgaactggagtag

SEQ ID NO: 130150 - DNA, 309 bp, Artificial Sequence
  Description of Artificial Sequence: Synthetic coding sequence
agcgatgtataccctgacgggttcaaagggcacatgctcaccaaatcagaaaaaaatcagttgttggctatcgctagttccctgtttgtcgctttccagctccgagcgcaacactttcaagaaaacagccgaatgcccgttatcaaaccagatattgcaaactgggaactctcggtcaagctgcacgacaaagtgcatacagttgtggcatcaaacaacgggagcgtttttagcgtggaggtggatggatcaaagttgaatgtcacctccacctggaatttgttcgccctgattgtctgtcagaggtag

SEQ ID NO: 130151 - DNA, 1620 bp, Artificial Sequence
  Description of Artificial Sequence: Synthetic coding sequence
atggctgccgccctccgagtcgccgccgttggagcaagactcagcgtcctcgccagcggcctccgcgcggctgtgcgaagtctgtgtagccaagcgacttccgtgaatgaacggattgagaacaagaggaggacggccttgttggggggcggacagcggagaattgatgcacagcacaaaaggggaaagctgacagctcgggagcgcattagtctattgttagaccctggaagtttcgtggaatctgacatgttcgtagagcaccgctgcgctgatttcggaatggctgctgacaagaataagtttccgggcgatagtgtcgtgaccggaaggggaagaataaatggaaggttggtttacgttttctctcaggactttaccgtgttcgggggatcgctatccggcgcccatgctcagaagatctgcaagataatggatcaagctatcactgtgggagctcccgttattggcctgaatgacagtggaggggctcgaatacaggaaggggttgaatctctcgcaggatatgccgatattttcctgaggaacgtcaccgctagcggggtgataccccagatctccctcatcatgggaccttgtgctgggggggctgtgtatagcccggcactgaccgattttactttcatggtgaaagatacttcatacctttttatcaccggaccagacgtcgtgaagtcagtgacaaacgaggacgtgacacaggaggagctgggaggcgctaagacccacaccacaatgagtggggttgctcatcgggctttcgagaatgatgtggacgctctctgtaatctccgtgattttttcaattacctcccgttaagtagccaggaccctgcccccgtccgagaatgtcacgaccccagcgaccggttggttccagagctcgacacaattgtgccgctggagtccactaaggcatataacatggtcgatatcattcattcggtcgtcgatgaaagagagttcttcgaaattatgccaaactacgctaaaaatattatcgtcggattcgctcggatgaacggcaggactgtgggtattgttggaaaccagcctaaagtggctagcggctgccttgatatcaacagcagtgttaagggagcacgtttcgtccgcttttgtgacgcctttaatattcccctgatcacctttgtggatgtgcctggcttcctgcccggaacagcccaagaatatggcggcattatccgccacggcgccaaattgctttatgcgttcgctgaagccaccgtcccaaaggtgaccgtgataacacgaaaggcatacggcggcgcttacgatgtgatgtcctccaaacacctgtgcggggacacgaactacgcttggcctaccgccgagattgccgtcatgggggccaaaggcgctgtagagatcatcttcaagggccacgagaatgtggaggccgctcaggctgagtatattgaaaaattcgccaatccctttcctgctgctgttagaggattcgtcgacgatatcatccagccgagttccacacgcgcaagaatttgctgcgacctggatgttctcgcctccaagaaagtccagcgtccctggaggaagcatgccaacatcccattatag

SEQ ID NO: 130152 - DNA, 1680 bp, Artificial Sequence
  Description of Artificial Sequence: Synthetic coding sequence
atggcagccgccttaagagtcgcagccgttggagccaggctgagtgtgctcgctagtgggcttagggcggcggttaggtccctgtgttcccaagctacatccgttaatgagcgcatagagaataagagaaggactgccttgttgggtggaggtcaacgcagaatcgacgcacaacataagagaggtaagctcacggcgagagaaaggatctctctgctgcttgatcctggatcttttgttgaaagcgacatgttcgtcgaacatagatgcgcggatttcggcatggcagctgataagaacaaattccccggcgattctgtggttaccggccggggacgtatcaatggcagactggtctacgtgttcagccagcagatcattggatgggcacaatggctgcctctggtcatctcagccttatgggaagctgaagactttacggtattcgggggcagtctctctggcgcccacgcccagaagatatgtaagatcatggaccaggcgatcacggtgggcgcccccgtgataggtctcaatgactctggaggagccagaattcaggagggcgtggagagcctcgctggctacgctgatatcttcctccgaaatgtgacagccagcggggtgatcccacagatttcactgatcatgggcccctgcgctggcggtgcagtctactcaccagctctgaccgatttcacattcatggtgaaggacactagttacctgtttataaccggccctgacgtggtgaagtcggtcaccaacgaagatgtgacgcaagaagaactcggcggggccaaaacccacacaaccatgtctggcgtggcgcaccgggctttcgaaaatgacgttgacgccctgtgtaatctgcgcgacttttttaattacctgccactatccagccaagacccggcgcccgtgagagagtgccatgatccatccgaccgactggtgccagaacttgataccatcgtccccttggagtccacaaaagcctataatatggtcgacatcatccactcggttgtcgatgagagggaattttttgaaatcatgccaaactacgccaaaaatattatcgtggggtttgctcggatgaacggccgcacagtcggcattgttgggaatcagcccaaagtggcgagcggatgcctggatattaatagtagtgtgaaaggcgcccgctttgttagattctgcgacgcctttaacattcctttgatcaccttcgtggatgtccctggatttttgcccggaacagcccaggagtacggcggaattatccggcacggtgcaaagctcttatatgcctttgcagaagccacagtgccaaaagtgaccgtgataactcgtaaagcttacggcggcgcttacgacgtgatgagttccaaacacctgtgtggagacacaaattacgcttggccaacggcagaaatcgccgttatgggcgccaagggagccgtggagataatctttaagggacatgagaatgttgaggccgctcaggccgaatacattgaaaagttcgctaacccatttcctgctgccgtgagaggattcgtggacgatataatccagcctagctcaacaagagcacgcatctgttgcgacctggacgttctcgcttccaagaaggttcaacggccctggcggaagcacgcgaatattcctctgtag

SEQ ID NO: 130153 - DNA, 1653 bp, Artificial Sequence
  Description of Artificial Sequence: Synthetic coding sequence
atggccgctgccctgcgcgtggcagcggttggcgcacggctgtcagttctggcgtctggcctgagggctgccgttcggagcctgtgttctcaggcaacatccgtgaacgaacgcatagagaacaaacgtagaaccgccctattaggtggcggccaacgccgcatcgacgcgcagcataagaggggcaagctgacggcgcgagagaggatttccctcctgctcgatcccggatctttcgtggaaagcgacatgttcgtggagcacaggtgcgctgactttggtatggccgcagacaaaaataagttcccaggcgactctgttgtgaccgggcgcggccgaatcaacggtcgcctagtttatgtatttagccaggacttcaccgtgtttggcggaagtctgagtggagcacacgcccagaaaatctgcaaaattatggaccaagccatcactgtcggagcaccggtgatagggctgaatgatagcggcggagcgaggatccaggaaggggtggagtctctggcaggctacgctgacattttccttcgcaatgttactgcatcaggagtcatccctcagataagccttattatgggtccatgcgcagggggggccgtgtactcgcctgccttgaccgattttacctttatggtgaaagatacaagctacctgttcataaccggacccgacgtcgtcaaaagcgtgaccaacgaggacgttacccaggaagaattgggcggggccaaaacacataccacaatgagcggtgtggcccacagggcattcgagaacgatgtggatgccctgtgcaacctgcgtgacttttttaattatctccccctgtcctcgcaggatcctgcccccgtgagagaatgtcatgatccctccgaccgtctggttccagaactggatactatcgtgcccctcgaaagtaccaaagcctataacatggtggatatcattcactccgttgtagacgagcgcgaattttttgagatcatgcctaactatgccaagaatatcattgtcggctttgccagaatgaatggcaggaccgtcggaatcgtgggaaaccagcccaaggtagcttcagggtgcctggacattaacagctctgttaaaggtgcccggttcgtgcgattttgcgacgctttcaatatacccctcatcaccttcgtggacgtgcctgggttcctgcccggcactgcgcaggagtatggtggcattattaggcatggcgccaaactcttgtacgccttcgccgaagccaccgttcccaaagtgactgttatcacaagaaaagcatatggcggcgcgtatgatgtgatgtcctcaaaacatctgtgcggcgatactaattatgcgtggcccacagctgagatcgcagtcatgggtgccaagggcgccgtcgagattattttcaaaggccatgagaacgtagaggccgcccaggccgaatacattgaaaagttcgcgaatccctttccggcagcagttaggggcttcgtggacgacattatacagccctcatccacaagggctcggatctgctgtgacttggacgtgctggctagcaagaaggtaagggtgcaggaggtgtttcaccaagtggtgcagtccgggcatagagatggaagaggtgcagtcaggtggtag

SEQ ID NO: 130154 - DNA, 387 bp, Artificial Sequence
  Description of Artificial Sequence: Synthetic coding sequence
atgagtctccgattggacactaccccttcttgtaactccgcacgaccgctgcacgcccttcaggtcctcctcctgctatctcttctgctcaccgcactagccagcagcacaaaaggccagaccaagaggaatttggccaaaggaaaggaggagtcactcgattccgacctgtacgcagaacttcgctgtatgtgtatcaagaccacaagcggaattcacccaaagaatatacagagcctggaagtgatcggcaagggaacccactgtaaccaggtggaagtcatcgctactcttaaggacgggagaaaaatttgcctggatcctgacgcccctcggattaaaaagatcgtgcagaagaagctggccggagatgaatcagccgactag

SEQ ID NO: 130155 - DNA, 2262 bp, Artificial Sequence
  Description of Artificial Sequence: Synthetic coding sequence
atggagcgcagagcgtggtccttgcagtgtacggcattcgtactcttctgtgcttggtgtgccctgaactccgccaaggcaaaacgccaatttgtgaacgagtgggctgcagagatccccggaggtcctgaggccgccagcgctatcgccgaggagctcggctacgacttgctagggcaaatcggttcactggaaaatcactacctgttcaagcacaagaatcaccctcggaggtcacgtcgtagcgccttccacataactaagcgcctgtcagacgatgacagagtaatttgggcagagcagcagtatgaaaaggagaggtcaaagcgatctgccctgagagactccgccctgaatttgtttaacgaccctatgtggaaccaacagtggtacctgcaggatacccgtatgaccgcggcgcttccaaaactggatctccacgttatacccgtgtggcagaaaggaattacaggcaaaggagtggtgatcaccgtgctggacgacgggcttgagtggaaccatacggacatctacgcaaattacgacccagaggcatcttatgactttaatgataacgaccatgatccgttcccacggtatgacccaaccaacgaaaataaacatgggacccgttgcgccggtgagatcgcgatgcaggccaacaaccacaaatgtggggtgggtgtcgcctataattctaaggtgggcggaatccgcatgctcgatgggattgtgactgatgccatcgaggcttcaagtattggattcaaccctgggcacgtggatatctacagcgccagctggggaccaaatgacgacggtaagacagtggaggggcccgggcgactggctcagaaggcctttgagtacggggtgaagcagggaaggcagggcaaaggatccatcttcgtttgggccagtgggaacggagggcggcagggagataattgtgactgcgatgggtacacagactccatctacaccatttcaatctcatccgcatcccagcaggggctctccccctggtatgccgagaagtgctcttcaacgttggccactagttattcttctggggattatacagatcagagaatcacttcggctgacctgcacaatgactgcaccgagacacacaccgggacctccgctagcgccccgctagccgcagggatttttgcgctggctctggaagccaatccgaatctgacctggcgggatatgcaacatctggttgtctggactagcgaatacgaccccctggctaacaaccccggttggaagaagaatggggccggtctgatggtgaattcccgattcggattcggtctactgaatgctaaagcattagtcgacctggccgatcctcgcacgtggcgcagcgtcccagagaaaaaagaatgtgtcgtgaaggacaacgacttcgaaccgagagccctgaaagccaacggtgaggtgataattgaaatacccacacgcgcctgtgagggtcaggagaatgcgattaagtctctggagcatgtccagttcgaagcaacaatcgagtactcaagaagaggagatttgcacgtaacccttacctcggcagccggaacttctaccgtgctgcttgctgagagagagagggacacttctccaaacggtttcaagaactgggattttatgagtgtgcacacatggggagagaatccgattggtacgtggactttgagaattacagacatgagcggtaggattcagaacgaaggaaggattgtcaactggaagttaattcttcacggcacctcctcccaacctgagcacatgaaacagcccagggtctatacctcatacaacacagtgcaaaacgatcggcggggcgtggagaaaatggtcgaccctggagaggaacaacccacgcaggaaaatccaaaagagaacaccctggtaagcaagagcccaagtagcagtagtgtgggcggacgccgggatgagctcgaggagggcgctccatcacaggctatgctgagactcctgcagtctgctttttccaaaaacagtccacccaagcagtcacccaaaaagtcaccaagcgctaaactgaatattccatacgagaacttttatgaagcgctcgagaagctgaacaaaccctcacagctgaaggactccgaagacagtctttacaatgattatgtcgatgtgttctataacacaaagccttataaacaccgcgatgacaggctgttgcaggcgctggtagacatcctcaatgaggagaattag

SEQ ID NO: 130156 - DNA, 477 bp, Artificial Sequence
  Description of Artificial Sequence: Synthetic coding sequence
atggagaggagagcatggagtctgcagtgtaccgcatttgtgttgttttgcgcttggtgcgccctgaactccgcgaaggcaaagaggcagttcgtgaacgagtgggccgcagagatacccgggggtcctgaggccgcaagcgcgatcgccgaggaactgggatacgacctccttggtcaaatcggctcactggagaaccactatctgttcaaacataagaaccatcctagaaggagcagaagatccgcttttcatattacgaaacggttgtctgatgacgaccgggtgatctgggccgagcagcaatacgaaaaggaaaggagcaagcgcagtgcactgcgagacagcgccctgaacctgttcaatgaccccatgtggaatcagcagtggtatcttcaggatacccggatgaccgctgcacttccaaagctggatttgcatgtgattcctgtctggcaaaaggggatcacaggatag

SEQ ID NO: 130157 - DNA, 2121 bp, Artificial Sequence
  Description of Artificial Sequence: Synthetic coding sequence
atgggcaaaggttctatcagctttctctttttcagtcaaataggatccctcgagaaccactatctttttaaacataaaaaccatccccggagaagtcgacgtagtgcttttcacataactaaaagactgagtgatgacgatcgcgtcatctgggctgagcaacaatatgagaaagagcgtagtaaaaggtctgccctgcgtgatagcgcacttaacctttttaatgacccaatgtggaaccagcagtggtacctgcaagacacacgtatgactgctgctcttccaaagctcgacttacatgtgattcccgtgtggcagaagggaattactggcaaaggagtggtgatcaccgtcttggacgacgggctcgagtggaaccacaccgacatctacgcaaactacgaccccgaggcttcttatgattttaatgataacgatcatgaccctttccctaggtatgaccctactaacgaaaacaaacacggcacccggtgtgccggcgagatcgccatgcaggccaacaaccataagtgcggagtgggcgtcgcatataattctaaagttggaggcattcggatgctggacggcatagtcactgatgccatagaggcatcttccatcggattcaaccctggtcacgtcgacatttattccgccagttgggggcccaacgacgacggcaagacagttgaaggtcccggacggctggctcagaaggcatttgagtacggggtgaagcaggggagacaggggaaggggagcatttttgtctgggctagtggtaacggcggacgccagggcgacaattgcgattgcgacggctacacagattctatttataccatctccattagttccgcaagccaacagggtctgagcccatggtatgctgagaaatgctcttcaacgttagccacatcctactcttctggcgactatacggaccaacgcatcaccagcgcagatttacacaatgattgcacagaaacccatactggtacatccgcttccgcgccgttggcagcaggaatttttgcacttgcactggaggcaaaccctaacctgacgtggcgagacatgcagcatctggtcgtttggacctcggaatacgatcccttggccaacaaccctggctggaagaaaaacggggctggcctgatggtgaactccagattcggtttcgggctcctcaacgccaaggctcttgtcgatctcgcggacccccgaacgtggcgctcagtgcctgaaaaaaaggaatgcgtagttaaggataacgactttgagccccgcgctctgaaagctaacggagaagtcatcatcgagatcccaacgcgcgcctgtgaaggacaagaaaatgccattaagtctctcgaacatgtccagttcgaggcaaccatcgagtacagtagacgcggggatctccacgtcacactcacttctgcggctggcacttcaactgtcctgttggcggagcgggagcgtgataccagtccgaacggattcaaaaattgggactttatgagcgtacatacatggggcgagaacccgatcggcacatggacgttaagaattaccgacatgtcggggagaatccagaatgaaggcaggatagtaaactggaagctcatcctccatgggacttcgagccagcctgagcatatgaaacagcctcgagtgtacacttcttataatacagtccaaaatgatagaagaggagttgaaaaaatggtcgaccctggagaagagcagcctacccaggagaatccgaaggaaaacactctcgtgagcaagagtccatctagcagtagtgttggaggccgacgagacgaactggaagaaggggccccatcccaggctatgctccgactcctgcagtccgctttctcgaagaacagtccacctaagcagtctcccaagaaatcccccagcgccaagttgaacattccctatgagaatttttatgaggcactggagaaactgaacaagccatcgcagctgaaggacagcgaagactctctctataatgactatgtggatgttttctacaatacgaagccctataagcatagagacgacaggctgctgcaggcgctggtggacattttgaatgaggagaactag

SEQ ID NO: 130158 - DNA, 798 bp, Artificial Sequence
  Description of Artificial Sequence: Synthetic coding sequence
atgcctctgcctgtggctttacagacgaggctggcgaagagaggcatcttaaagcatttggaacctgagcctgaggaggagattattgcggaggattacgacgatgatcctgtggattacgaggctactcgcctggaaggcctccccccatcttggtataaagtgtttgacccgagctgtggtttgccgtattactggaatgccgacacggatctggtaagctggctatcaccacacgacccaaattctgtagtgacgaagagcgctaagaaacttcggtccagcaacgcggatgcagaggagaaactggaccggagccatgacaaatctgatagagggcatgacaagagcgacaggtctcatgagaagttggaccgcggacacgacaagagcgacaggggccatgacaaaagcgatcgtgatagagaacggggctacgacaaggtcgaccgtgagagagagcgcgaccgcgagagagatcgagacaggggttatgacaaggccgatcgtgaggaaggaaaagagcgccggcatcaccgcagggaggagcttgccccctatccgaagagcaagaaggcagtctctcgtaaggacgaagagctggaccccatggatccaagttcctattccgacgctcctagagggacttggagtacaggcctgccaaaaagaaacgaagccaagacaggtgctgacaccacagcagccggccctcttttccagcaacgaccctatccgtcacctggcgctgtcctccgcgccaacgctgaagcctctcgtaccaaacaacaggactag

SEQ ID NO: 130159 - DNA, 1917 bp, Artificial Sequence
  Description of Artificial Sequence: Synthetic coding sequence
atgaaggggggttgcgtgtctcagtggaaagcagccgcaggctttctgttctgcgtgatggttttcgcttctgctgagcggcctgtcttcaccaatcacttcctcgttgagctccataaagggggagaagataaagcccgccaggtcgcggctgagcacggcttcggggtacgaaagctgcccttcgccgagggtctgtatcacttctaccacaacggtctcgctaaggctaaacgcagacgctctctccaccacaagcagcaacttgagcgggacccacgggtgaagatggccctgcagcaggaaggcttcgaccgcaagaagcgtggttatcgtgatatcaacgaaattgatatcaatatgaacgacccgctgttcacaaaacagtggtacctcattaatacgggacaggcagatggtactcccggtctagacctgaacgtggctgaggcatgggagctaggctatactgggaagggcgttactattgggattatggacgacgggatcgactacttacaccctgacctcgcgagtaactataacgccgaggccagttacgatttttcatccaacgacccatatccctatcctcggtatactgatgactggtttaattcccacggaacacggtgtgctggcgaagtgtccgccgcggccaataacaatatatgtggtgtgggcgttgcttataactctaaagtggccggtatacgtatgttagaccagccgtttatgactgatataatcgaggccagctccattagtcatatgccccaacttatagacatttacagcgcatcatggggccccacagataacggaaagaccgtcgatgggccaagagaactcaccctgcaggcgatggccgacggcgttaacaagggtcgcggcgggaaaggctctatctacgtgtgggcttccggggacggcggcagctacgatgattgcaactgcgatggatacgcttcaagcatgtggaccatctccataaactcggcaattaatgatgggcggaccgccctttatgacgagtcttgcagtagtactctagcttccacatttagcaacggacggaaacgaaatcctgaagccggtgtcgccacaacagacttgtatggtaactgcacccttaggcattcaggtacctctgccgcagcaccagaagccgccggcgtgttcgccctggcgctcgaggcaaacctcggacttacttggagggatatgcagcatcttacagtattaacttccaagcgcaaccagctgcacgatgaggtccaccagtggagaaggaacggggtcgggctggaatttaatcacttgtttggatatggtgtgctggatgctggggccatggtgaagatggctaaagattggaaaaccgtacccgaacgcttccattgcgtgggtggctccgtgcaggacccagaaaagatcccctccaccggcaagctcgttctgactctgactactgacgcttgtgaagggaaggagaacttcgtcagatatctagagcacgtccaggccgttataacagtaaacgcaacaagacgaggggatttgaacatcaacatgacttcacctatgggaacaaagtccattttactctcgagaagaccacgagatgacgactccaaagtcggattcgacaaatggcctttcatgacaacacacacctggggtgaggatgccagagggacgtggacactggaactgggattcgtgggatctgcgccccagaaaggcgttctcaaagaatggacactcatgctgcacggtacccagagcgcaccgtatattgaccaggtggtgagagattatcagtccaagttggccatgtctaagaaagaggagttagaggaagaattggatgaggccgtggaacgaagtttaaagtctattctgaacaaaaactag

SEQ ID NO: 130160 - DNA, 1860 bp, Artificial Sequence
  Description of Artificial Sequence: Synthetic coding sequence
atggtttttgcctccgccgagcggccagtgtttacaaaccattttctcgtcgagctacacaaaggcggggaggacaaggcacgacaggttgctgcagagcatggattcggagtgcgcaagctgccctttgcagaaggcctgtatcacttttatcacaatggcctggccaaggcaaagaggagacggtcactgcatcataagcagcagttggagcgcgaccctcgggttaagatggcactgcagcaagagggctttgaccgaaaaaagcgaggatacagagatattaacgaaattgacatcaacatgaatgaccctctgtttacaaagcaatggtatttgatcaacacgggacaggccgatggcacgcctggcctagacctgaacgtggcggaggcttgggagttaggctacacagggaaaggagtcacaatcgggataatggatgatggaattgactacctccatcctgatctggcttccaactacaatgcagaagctagttacgatttctcctcaaatgatccatacccctaccctaggtacaccgatgattggttcaattctcatggtacaagatgtgcaggcgaagtctcagctgcggccaacaacaacatctgtggcgttggcgtagcatataatagcaaagtagcagggatccgcatgttagaccagccctttatgactgatattatagaagcaagttccatttctcacatgccccagctgattgatatatattccgccagttggggcccaaccgacaatggcaagaccgtggacgggcctagagaactgacactccaggctatggccgatggtgtgaataaaggacgcggcgggaagggcagcatctacgtgtgggccagcggggatggaggaagttacgacgattgtaactgcgatggctacgcttcatcaatgtggactatctcgattaactccgccatcaacgatggcagaactgccctgtatgacgaaagctgctcaagtacactggcaagcactttttcgaacggccgcaaaaggaatcccgaggcaggagtagccacaactgacctctacggtaactgtacccttcgacattccggtacctcagcagctgctccggaagctgctggggtcttcgctctggccttagaggccaatctcggcctcacttggagagatatgcagcaccttaccgtgctgacaagcaaaaggaatcagctgcacgacgaggtgcatcagtggagaagaaatggcgtcggcctagagtttaatcatctgttcggttacggtgtcctggatgcaggagccatggttaagatggctaaggactggaaaaccgtccctgagcgatttcactgtgtgggcgggtctgttcaggatcctgagaaaattccatccaccggtaaactggtcttgactctgaccacggacgcttgcgaggggaaggagaatttcgtccggtatctcgagcatgtgcaagctgttattactgtcaatgcgactagaaggggagacctcaatatcaacatgacctctccaatggggacaaagtctattctgctctctaggcgcccccgtgatgacgactccaaggtcggctttgacaagtggccctttatgaccacccatacctggggtgaggatgctaggggaacatggactctggagctcggattcgttggatcggcgccccagaaaggcgtgctaaaagaatggactctgatgctgcatggcacccagagtgccccatatattgaccaggtcgtcagggattatcagtcaaaactggcgatgagtaaaaaggaggaactggaggaggagctggacgaagccgtcgaacgctcattgaaatccatccttaacaagaactag

SEQ ID NO: 130161 - DNA, 1812 bp, Artificial Sequence
  Description of Artificial Sequence: Synthetic coding sequence
atgaaaggcgggtgtgtctcgcagtggaaggctgcggctgggtttctcttctgtgtcatggtgttcgcttccgctgagcgaccggtgtttactaaccatttcttagtcgagctccacaaggggggtgaggacaaagctcgccaggttgctgctgagcatgggttcggtgtgcggaaagttaagatggcactgcaacaagagggattcgatcgcaaaaagaggggttatcgagacataaacgaaatcgatatcaacatgaacgaccctctttttacgaaacagtggtatctgattaataccggccaggccgacgggacacccggattggacctcaacgtggccgaggcatgggagctgggctacaccggcaaaggtgtaactattggaatcatggatgatggcatcgactaccttcacccagatttagctagcaactataatgctgaggcatcatacgatttctcgtctaacgatccctatccgtatccaaggtacactgacgattggtttaatagtcatggaacgcgctgcgccggggaggtaagcgcagctgccaataacaatatctgtggcgtgggagttgcttacaattccaaagtggcaggtattcgaatgttggaccagccattcatgactgatataatcgaagcctcctccatctctcacatgccacaactgatagacatctattctgcctcatggggccccaccgataatgggaaaactgtggacggcccacgagagttgaccttacaagccatggcagacggagttaacaaaggacgcggggggaagggatctatttacgtctgggcttctggcgatgggggctcatatgatgattgcaactgtgacggctatgcaagctctatgtggacaatatcaatcaattctgcaatcaatgacgggcggaccgctctctacgacgagagttgctccagtacactcgcttccacttttagcaatgggagaaaacgcaatccagaggccggggtcgcaactaccgatctgtatgggaactgcactctccgacatagtggcacctccgccgctgctccagaggccgccggcgtgtttgcattggcactggaggcaaacctcggactgacttggagagacatgcaacacctgacagtgctcacatccaagagaaaccagctgcacgacgaagttcatcagtggcgacgcaacggggttggcctcgaatttaaccacctcttcggttatggagttcttgacgctggcgccatggtcaagatggcaaaagattggaaaacagtcccagaacgcttccactgcgtgggtggaagcgtgcaggacccggaaaagatcccctctactgggaagctggttttaacccttacaacagacgcatgcgaggggaaagaaaatttcgttcgatacctcgagcacgtgcaggccgtgattactgtcaatgcaacacggcgcggcgatctgaatataaatatgaccagtcccatgggaaccaaatccatccttctttccagacgacctcgcgacgacgactccaaggtcggcttcgacaaatggccctttatgactacccacacctggggcgaagatgcacggggcacatggaccctcgagcttgggtttgtcggaagcgcacctcagaagggcgtgctcaaagagtggaccctgatgctacacggcacccagagcgcgccctacatcgatcaagttgtgagagactaccagagcaagttggcaatgagcaagaaagaggagcttgaagaagaactcgatgaagcagtcgagcggtcacttaagagtattttgaataaaaactag

SEQ ID NO: 130162 - DNA, 2268 bp, Artificial Sequence
  Description of Artificial Sequence: Synthetic coding sequence
atgcgcccagcaccaattgccctgtggctgcgactcgtcctggctctggccctggttcgccctagggccgtgggttgggcacccgtacgcgctcccatctacgtctcctcgtgggccgtccaggtctctcagggcaatcgggaggtcgaacgacttgcccgcaagtttggctttgtcaatctaggccctatttttccagacgggcaatatttccatctgcgacatagaggcgtggtacagcagtcactaaccccccactggggacatcgcctgcatttaaaaaaaaaccctaaggttcagtggttccagcagcaaaccctgcagaggcgtgtgaagaggtccgtggttgttcctaccgacccgtggttttctaaacagtggtatatgaactcagaggcccagcccgatttatccatcctccaggcctggtctcaaggccttagtgggcagggcatagttgtgtcagtgctcgatgacggcatcgaaaaagaccatcccgatctctgggctaactacgacccactggcaagctatgactttaatgattatgaccctgacccccagcccagatacaccccctcgaaggaaaatcgtcatgggaccaggtgtgccggagaagtagcagccatggccaacaatggattctgtggtgtaggagtcgcctttaatgcaaggatcggcggagtgcgaatgttagatggcacaattaccgacgtgattgaggcccagtccctgagcctgcagccgcagcacatacatatctattcagcttcttggggccccgaggacgatggtaggacagttgacgggccagggatcctgacacgggaggcatttcgccgcggggtgacaaaggggagagggggcctcggaactttattcatctgggcaagcgggaatggtggtctccattacgacaattgtaattgtgatggttacaccaattccatacacactctttccgtgggctccactacacaacagggacgcgtaccttggtacagtgaggcttgcgctagtactctgaccacaacatattccagcggagtggccactgaccctcaaattgttactactgacttgcaccacgggtgcacggaccagcatacgggcaccagcgcgagcgcgcctttggccgccgggatgatcgcactcgcgctagaggccaatccatttttgacatggagagatatgcagcatcttgtggtccgggcgtcaaaaccagcccaccttcaggcagaggactggcgcacaaatggggtgggacgccaggtgtcccaccactatggctatggcctgctggacgccgggctgctcgtggatactgccagaacctggctgccaactcagcctcagcgtaaatgcgccgtccgcgtgcaatcccgtcccacaccaatccttccgttgatctacatccgagagaacgtcagcgcctgcgcaggacttcacaacagcattcgatcgctcgaacacgtacaggctcagctgacactatcttacagcaggcggggcgaccttgaaatctctctgacctcaccgatgggtaccaggagcacactggttgcaattcggcctttggacgtttcaactgaggggtacaacaattgggtctttatgtcgacccacttctgggacgagaacccgcagggcgtttggacactgggtctggagaacaaaggttattatttcaacacgggcaccctctaccgctatactctattgctgtacgggaccgctgaagacatgaccgcgcgtcccacgggcccccaagtgacttcatccgcctgcgtgcagagggataccgaaggcctatgtcaggcatgtgatggtccggcttatatcctaggacaattatgtctggcctactgccctccacgattttttaaccacacaagactcgtgacggccgggcctggacatactgctgcgcccgcgctgcgcgtttgcagttcatgccacgcctcatgttacacatgtagaggcggtagcccccgggactgcacgtcttgtccaccatcttcaacgctcgatcagcagcagggctcatgtatgggacccacgacacctgactcacggccacgcctgagggcagccgcttgccctcaccatcgatgccctgcgagcgctatggtgctctccctccttgctgtgacactggggggaccggtgctctgcggaatgtctatggacttaccgctgtacgcttggttgagtagagccagggcaacccctacgaaacctcaggtgtggctgcctgctgggacttag

SEQ ID NO: 130163 - DNA, 1137 bp, Artificial Sequence
  Description of Artificial Sequence: Synthetic coding sequence
atggcctctcggaggactacacggacgagcggaccaaccaccactccgtggcccgcgatgacctccatgaccaccactcgcacaccttccccggccacccctcccgctaagagaacgggggtcaggatgcttgatggcaccatcaccgatgtcatcgaagctcagagcctgtctctgcaacctcagcatatccatatctactctgcttcttggggacccgaggacgatggacgcactgtggatggccctggaatcctgactcgggaagcattcagacgaggagtgactaagggtagaggcggattgggcaccctgttcatatgggcctcaggtaacgggggcttacactatgacaactgtaactgtgatggttacacaaactccattcatacgctcagtgtagggtctactacccagcaggggcgggtgccatggtactcagaagcctgcgcaagtacgctgaccactacatattcctctggtgtggctacggacccacagatcgtcaccaccgaccttcatcacggttgtacagatcagcatacgggcacatccgccagcgcccctctggccgcaggtatgattgctttagcattagaagctaatccgtttctcacttggcgtgacatgcaacaccttgtggtgagagcatccaaaccagcccacttgcaagcggaggattggcgaactaacggagttggtaggcaggtttcccaccactacgggtatgggttgctcgatgcaggccttttggttgacactgcccgtacctggctccctactcaaccacagaggaagtgtgccgtcagggtgcagtcccgtcctacaccgattctgccgttaatttacatcagggagaatgtgtcggcatgcgccggccttcacaacagcatccgttccctcgagcacgtgcaagcccagcttacattatcttatagtagaaggggagatttggagattagcttgaccagtcctatgggcacgcgaagcactttagtggcaatcagagacgtggtcccccttcacgccgcagctctgtgggacgggcgggggcatgactctgctgcctatcgaccgcctggcgatcagcagcgcgtttgcgccgctgggcacagaggcgctgtccccggcgtttag

SEQ ID NO: 130164 - DNA, 2742 bp, Artificial Sequence
  Description of Artificial Sequence: Synthetic coding sequence
atggggtggggttcgcggtgctgttgccctgggcgtctggacttgctttgtgtcttagccctacttggaggctgtctgcttccagtttgtaggacaagggtttacaccaaccactgggccgtgaaaatagccggcggcttcccagaagccaaccgcattgcctccaagtatggtttcatcaatatcggacagatcggagccctaaaggattactatcacttctatcacagtcgaacaataaagcgcagcgtaattagctcccgcggtacccatagcttcatttccatggagccgaaagtggagtggatccagcagcaggttgttaaaaaaagaactaagcgggactacgacttctccagagctcagtccacctatttcaacgatcccaaatggcctagtatgtggtatatgcattgttcagataacactcatccctgccaatctgacatgaacattgagggcgcttggaagcggggctataccggtaagaatatcgtggtcaccatcctggatgacggaattgagcggacccatcccgatctcatgcagaattacgatgctttagcaagctgcgatgtgaatggcaacgatctggatccaatgccacggtacgacgcttctaacgagaacaagcacggaaccagatgtgccggcgaggtcgcagccgccgcaaataactcccattgcacagtgggcatagccttcaacgctaaaattggaggagttcgaatgttggacggggatgtcactgatatggtggaagccaagtcagtctctttcaatccccaacacgtccacatttacagcgctagctgggggcctgacgatgatggaaagaccgtcgacggaccagccccattgaccagacaggctttcgaaaacggcgtgcggatggggcgaagaggccttggcagcgtcttcgtgtgggctagcgggaatggcggtcgttctaaggaccactgcagctgtgatggttacacaaattcaatttacaccatctccatttccagtacagccgagtcaggtaagaaaccttggtatcttgaggagtgctcatccacccttgccacgacgtacagttcgggcgagtcgtatgacaagaagatcatcacgactgacttgaggcaacgctgtaccgataaccacaccggaaccagcgccagcgcccctatggcggccgggattattgctctggcccttgaggccaatccttttttaacatggagagatgtacagcatgtcattgtcagaacatccagggctggccacttaaacgctaatgattggaagactaatgctgctggcttcaaagtgtctcacttgtatggtttcggattaatggatgcagaggccatggtgatggaagccgaaaagtggactaccgtacccaggcaacacgtgtgcgtagaaagcacggatcggcagatcaaaacaatcaggcccaattccgctgtgcgaagtatttacaaggcctccggctgctcagacaatccaaatcgtcatgtcaactatttggaacacgtggtggtaaggatcactattacccacccccggcgcggtgacctggcaatctacctcacatccccaagcgggaccagaagtcagttattggccaacagactctttgatcatagcatggagggtttcaaaaactgggagttcatgacgatccactgttggggcgagagagcagccggcgattgggtgctggaagtttacgatacaccgagtcaactgcggaatttcaaaactcccggaaagttgaaagagtggtcactggtgctctatggtactagcgttcaaccttattccccgaccaacgagtttcccaaggttgagcgattcaggtatagtcgtgtcgaggaccccaccgacgattatggaacagaggactatgcgggtccgtgcgatcctgagtgctcagaggtgggatgtgacggcccaggcccggaccactgcaacgattgtttgcactactactacaaactgaaaaacaacactcggatttgtgtttcttcctgtccaccaggacactaccacgctgacaagaagaggtgtaggaagtgcgcgcctaattgtgagtcttgcttcggcagccacggtgatcagtgcatgtcttgtaagtacggatattttctcaatgaagagacgaactcttgtgtaacccactgccctgatgggtcttaccaggacaccaagaagaacctgtgccggaaatgctctgaaaattgcaagacgtgcacggagttccataactgcaccgagtgtcgagacggcctctccctgcagggatcccggtgttccgtctcctgcgaggatggaaggtatttcaatgggcaggactgccagccctgccacagattttgtgccacctgcgcgggtgctggagccgatggttgtatcaattgcaccgagggttactttatggaagacggccggtgcgtgcagtcctgctccatctcctactactttgatcactccagcgagaacggatataagagctgtaagaaatgtgatatctcctgcctcacttgcaatggtcccggttttaagaactgcacatcatgccccagcggatacctgctcgatctcggcatgtgtcagatgggagccatctgcaaggatgctaccgaagagtcttgggcagagggaggattctgcatgctggtgaaaaaaaacaacctgtgtcagcggaaggtgcttcaacagctttgctgcaagacctgcacattccagggctag

SEQ ID NO: 130165 - DNA, 4773 bp, Artificial Sequence
  Description of Artificial Sequence: Synthetic coding sequence
atgggaaggcggggcctgggcagcgtttttgtttgggcctccgggaatggaggacggtccaaagaccactgttcttgtgacgggtacacaaacagtatatatacaatatcaatatccagcacagccgaaagcggcaagaagccgtggtaccttgaggagtgctcaagcaccctcgctacaacttactcatccggagaaagctacgacaagaaaatcattactaccgatctgcggcaacgttgtactgataatcacacgggcactagtgcttccgccccaatggccgcaggaatcatcgcactcgccctcgaagcaaatccctttttgacctggcgtgatgtgcagcacgtaatcgtacggacatcccgagccggtcacctgaacgccaacgattggaagacaaacgccgcaggattcaaagtttctcatctttacggatttggcttaatggacgcggaagccatggtgatggaggccgagaagtggaccaccgtgcccaggcagcacgtttgtgtcgagagcaccgatcggcagattaaaacaattaggccaaattctgcggtgcggtccatctacaaggcatcaggttgcagtgataaccccaacagacatgtcaattacttggaacatgttgttgtgcggattacgataacccacccaagaaggggtgacctcgccatctatctgacctctccgtccggcacaaggagtcagctcctggctaacagattgtttgaccactcaatggagggctttaagaactgggagttcatgaccattcactgctggggtgagagagcagccggggactgggtgctggaagtatatgacaccccgtcccaactgaggaacttcaaaacgcctggtaagttaaaagagtggagtctggtgctttacgggacgagcgtccagccctacagcccaactaacgagtttcctaaagtcgaacggttccgttattcaagggttgaggatcctacagacgattatggcactgaggactatgccgggccatgtgaccctgagtgttctgaggtcggctgtgatgggccaggcccagaccattgcaatgattgtcttcattattattataagcttaagaacaacaccaggatttgcgtgtcaagttgcccccctggccactatcacgctgacaagaaacggtgccgcaaatgcgccccaaactgcgaatcttgcttcggcagccatggggaccagtgcatgagttgcaaatatggctacttcctcaatgaggaaaccaatagttgcgttacccactgtccggatgggagctaccaggacactaagaaaaacctgtgcagaaagtgctccgagaattgtaaaacatgtactgagttccataactgcacggagtgtcgggatggactgagtctgcaggggagtcgatgctctgtctcctgcgaagatggcaggtactttaacgggcaggactgtcaaccctgccacaggttctgtgccacctgcgccggggcaggggctgacgggtgtattaactgtactgagggctatttcatggaagacggcagatgcgtgcaaagctgcagcatttcctactatttcgatcactctagcgaaaacggctacaaatcctgcaaaaaatgcgatatcagctgcttaacatgcaatggcccagggtttaagaactgtactagctgtccaagcggttacctacttgaccttggaatgtgccagatgggagctatttgtaaagacggcgagtacgtggatgaacacggacattgccagacctgtgaggcatcttgcgccaaatgtcagggtccaacccaggaagactgcacaacctgccccatgacaaggatattcgatgacgggagatgtgtgtccaattgtccctcgtggaaatttgagttcgagaatcagtgtcacccatgtcaccacacgtgccagagatgccagggctctggccccacccattgcacttcctgtggcgccgataactatggaagggagcacttcctctaccagggggagtgcggagactcctgccctgaaggccactatgctaccgaaggcaacacttgcttgccatgtcccgacaactgcgaactgtgccactccgtacatgtctgcactcgatgtatgaagggatatttcatcgctcccacgaaccatacctgtcaaaaactggagtgcggtcagggcgaagttcaggatccagactatgaagagtgcgtgccatgtgaagagggatgtctgggctgcagtcttgatgatccaggcacctgcacctcgtgtgctatgggctattaccgatttgaccatcattgctacaagacttgtcctgagaaaacttattctgaggaggttgaatgcaaggcttgtgactctaattgcgggagctgcgaccagaacggttgttactggtgcgaagaggggttcttcttgctggggggatcatgtgttcggaagtgcggtcctgggttttacggcgaccaagagatgggcgagtgtgagagctgccaccgtgcgtgcgagacctgtaccggcccaggccacgatgagtgcagttcctgtcaagaaggactgcagcttctgcggggcatgtgcgtgcacgcgacaaaaacccaggaggaggggaagttctggaatgaggctgttagcacagccaacctgtctgtggtgaagtccctgcttcaggagcgccggcgctggaaggttcaaattaaaagagacatcctgcggaaactccagccgtgccactcttcttgtaagacatgcaatggttcggccaccctctgcacttcttgcccaaagggcgcttatctcctagcacaggcatgcgtgagttcctgtccccaaggtacttggccaagtgtgagatctggctcttgtgagaactgcacggaggcatgtgccatatgttccggcgccgacctgtgtaaaaagtgccagatgcagcctggacatccactgtttctccacgagggccgctgctattctaaatgccctgaagggtcttatgccgaagatggtatatgtgaacgttgcagttctccttgtcgtacatgcgagggcaatgctacaaactgtcattcctgcgaaggtggtcatgttctccaccatggtgtgtgtcaggaaaattgtcccgaaaggcacgtggcagtgaaaggggtctgtaagcattgccccgagatgtgccaggactgcattcacgagaaaacttgtaaagaatgcacaccggagtttttcctccacgacgatatgtgccatcaatcatgcccccggggtttttatgccgactcacgccattgcgtaccctgtcacaaagactgtcttgaatgctccggccccaaggccgacgattgcgagctctgtctggagtcttcctgggtgctgtacgatggtctatgcctggaagaatgccccgcgggcacttattacgagaaggaaaccaaagagtgtcgcgactgtcataagagttgtcttacgtgctcgagcagcggtacctgtacgacctgccagaagggtctgattatgaacccgcggggctcttgtatggctaatgaaaaatgctcgccatcagaatactgggatgaggatgcgcccggctgtaaaccctgtcacgttaaatgttttcactgtatgggccccgccgaagatcagtgccaaacttgtccaatgaatagcctattattaaatacaacatgcgtgaaagactgccccgaagggtattacgccgatgaggactccaatcgttgtgcgcattgccactctagctgcaggacatgtgaaggcaggcactccagacagtgccactcctgtaggcctggctggttccagctgggcaaggagtgcctgttgcagtgtagagaggggtattatgccgacaactccactggccggtgcgagcggtgcaatcgctcgtgcaaaggttgtcagggacctcggcccacggactgcctcagctgcgaccggttcttcttccttttaagatccaaaggggagtgccatcgctcctgcccagaccactattatgtagagcagtcaacgcagacctgtgagagatgtcaccctacttgcgaccagtgcaaagggaaaggcgcactcaactgtctgtcatgtgtttggtcataccatctcatgggcgggatctgtacctctgattgcttagttggcgaatatagagtaggggaaggcgaaaaatttaattgcgaaaagtgtcatgagtcatgcatggagtgtaaaggaccgggggccaaaaactgcaccctgtgccccgcaaatctcgttctccatatggatgactctcactgtctacattgctgcaacactagcgaccctccatcagcacaagagtgctgcgactgtcaggacacaactgacgaatgtattcttaggaccagcaaagtgagacccgcaacagagcattttaaaaccgctctgtttattactagttccatgatgctggtactccttttgggtgctgcagtagtggtttggaagaaatctagggggagggtgcaaccagcggcaaaggccggatacgaaaaactcgccgatcctaataagtcatactcttcatacaaatcctcctatagagagtccacctcctttgaagaagaccaggtgatagagtatagggaccgggattatgatgaagacgacgacgacgatattgtgtacatggggcaggatggaactgtttaccgcaaattcaaatatggcttgctcgacgacgatgatatcgacgagctggaatacgacgatgagagctactcttattatcagtag

SEQ ID NO: 130166 - DNA, 2073 bp, Artificial Sequence
  Description of Artificial Sequence: Synthetic coding sequence
atgggctgggggtccagatgttgctgccctggcaggttagatttgctctgtgttctcgctcttctcggcggctgtctcttacctgtgtgcagaactcgggtatacactaaccactgggcagtgaagattgccggaggcttccccgaggctaatcgtatcgcctctaaatacggctttatcaatataggacagattggtgctttaaaagactactaccacttttatcattcccggacaattaaaagatccgtgattagttcacgtgggacgcactctttcatctctatggagccaaaggtggagtggattcaacaacaggtggtcaagaaaagaacaaagcgagactatgacttctcccgggcgcagtcaacttattttaatgatcccaagtggccatctatgtggtatatgcactgtagcgataatacacacccttgccaatccgatatgaatatagaaggagcctggaagagaggatatacgggcaaaaacatcgtggtgaccattctggatgatggcatagagcggacccatccagacttaatgcagaactatgatgccctggcttcctgcgatgtcaacggaaacgatctcgaccctatgcctcggtacgacgccagcaatgagaacaagcatggcactagatgcgccggagaagtggctgccgccgccaacaactcccactgtacagtgggtatcgccttcaacgcaaaaatcggtggagtgcggatgctggacggggatgtgaccgacatggtcgaggctaaatcagtttccttcaatccgcagcacgtgcatatatatagcgccagctggggaccagatgacgacgggaagacggtagatggaccagcgcctctgaccaggcaagctttcgagaatggcgtgcggatggggagacgcggcctgggaagcgtatttgtgtgggccagcggaaatggagggcgctcaaaggatcattgttcatgcgacggatacacaaattctatatacacgatttcaatctccagtaccgctgaatccggaaaaaagccgtggtatctggaggagtgcagctccacactcgccaccacttacagcagtggtgaatcttacgacaagaaaatcatcaccacggatctgcgacagaggtgcacggacaatcatactggcacatccgcttccgctcctatggctgccggcatcatcgccttggccctggaagcaaatccttttctgacttggagagatgtccagcacgtcatcgtgagaacatcccgggccggccatctgaatgccaatgattggaagactaacgccgccggtttcaaggtgtcacacctgtacggtttcggcttgatggatgccgaggccatggtgatggaggccgagaaatggacgacggtcccccgtcagcacgtgtgcgttgaatccactgaccggcagatcaagacaattaggccgaacagtgctgtccgatcaatatacaaagcttcaggctgctcagacaaccctaacaggcacgtaaactatctcgaacacgtggtggtgcgcatcacaatcactcacccccggcggggtgacctggccatttatttgactagcccaagcggcactcgaagccagcttttggctaacaggttgttcgatcattctatggaagggtttaaaaattgggaattcatgacaattcactgctggggtgagcgggccgccggagactgggttctggaagtgtacgacacaccaagtcaactgagaaactttaagacgccaggaaaactgaaagaatggagcttagtgctctacggtacatcagtgcagccgtactctccgaccaacgaattcccaaaagtcgaaagatttcggtactcaagggtcgaagatccaacagacgactatggtacagaagattacgcaggagaacttgcctcatccggtacccaggcgaaaaaacgacagctaatgcaccaccctactacttgggagaatcgaatggagtggaacggcatgaagtggaatggaatgaaatggaacggcatggagtggaacggaatggaatggaataggattgaatcgaaccgcatcgaatag

SEQ ID NO: 130167 - DNA, 2073 bp, Artificial Sequence
  Description of Artificial Sequence: Synthetic coding sequence
atgggctggggttctcgttgctgttgcccgggacggctcgatcttctgtgcgtgttggcattactcggtggctgtttgctccccgtctgcagaacaagggtgtacactaaccactgggcagtgaaaatcgccggcggatttcctgaggccaatcgcattgcttctaagtatggattcatcaatattgggcaaatcggtgcccttaaagactattaccatttttaccattctaggaccatcaagaggtcggtcatctctagcaggggtacacattctttcatcagtatggaacccaaggtggaatggattcaacagcaggtagtcaagaagcgcacaaaaagggactacgatttcagtagagctcaaagcacttacttcaatgatccaaaatggccatctatgtggtacatgcactgctccgacaacacccacccttgccagtccgacatgaacatagaaggggcgtggaagcgcggatatacaggaaaaaacattgtggtgacgatcctcgatgatggtattgaacgcacccaccccgacctcatgcagaattatgatgcactggcctcctgcgatgtgaatggcaatgacttggacccgatgcctcggtacgacgcctcaaatgagaacaaacacggaacgaggtgcgcaggcgaggtggccgctgccgccaataactctcactgcactgttggaatcgccttcaatgctaagatcggcggcgtcagaatgctggatggcgatgtaactgatatggtagaggccaaatcagtgagcttcaatccccagcatgtgcatatctattccgcctcttgggggccggacgacgatggtaagacagtcgacggcccagccccgcttacaaggcaagctttcgagaacggggtgcggatgggtcgaagaggattaggctccgtcttcgtgtgggcttcggggaacggcggaaggtctaaggaccattgcagttgcgatggctacactaatagtatctatactatcagtataagtagcacggccgagtccggaaagaagccgtggtaccttgaagaatgtagctctaccctggctacaacttactccagtggcgagagctatgacaagaaaatcattaccactgatctgagacaacgatgcactgacaaccacaccgggacttctgccagtgcccctatggctgctggcattatcgccttggcacttgaggcaaatccattcttgacctggagagatgtgcagcacgtgattgtgcggacctctagagccgggcatctgaatgccaatgactggaagacaaacgcagccggatttaaggtgtctcatctgtacggcttcggacttatggatgccgaggccatggtgatggaggcagaaaagtggaccactgtcccgaggcaacatgtctgtgtggaatctacagaccgccaaataaaaacaataaggccgaactctgcggtgaggtcgatctacaaagcctctgggtgtagtgataatccaaaccggcatgtcaactacctcgagcacgtggttgttcggatcacaatcacgcaccctagacggggagatctcgccatctaccttactagcccgagtgggacacgctcccagcttttggctaaccggctcttcgaccacagcatggagggcttcaagaattgggagtttatgactattcactgctggggggaacgagctgcaggtgattgggtgctcgaggtgtatgacacgcctagccaactccgcaatttcaagactcccggcaagttaaaggagtggtcactcgtcctgtatggaacatctgtccaaccttactcgccaaccaatgaattccccaaagttgagcgattcaggtattcaagggttgaggacccaacagacgattatgggaccgaggactacgccggcgagttggccagttccggcacgcaggctaagaagcggcaactgatgcatcaccctaccacctgggagaaccggatggagtggaacggcatgaagtggaatggcatggagtggaatgggatggagtggaatgggatggagagtaatcggatagaaagtaatcgcatagaatag

SEQ ID NO: 130168 - DNA, 4683 bp, Artificial Sequence
  Description of Artificial Sequence: Synthetic coding sequence
aactctatttacaccataagtatttctagcactgctgagagtggcaagaagccttggtatctggaggaatgctcttcaacgcttgcgactacatattccagcggagagtcgtatgacaaaaaaatcatcacaactgaccttaggcaacgatgtaccgacaaccatacagggacctcggccagcgctcctatggccgcgggcattattgccctggccttggaggctaacccatttttgacttggcgggacgtccagcacgttattgttagaacatcaagggccgggcacctgaatgctaacgattggaaaaccaatgcggccgggttcaaggtgtcccatttatacggcttcggactgatggacgcggaggctatggtgatggaggctgagaaatggaccaccgtccccagacagcatgtctgcgtggaatccacagaccggcagatcaagaccatccgccctaactctgctgtccgcagtatttacaaggcatcgggttgttccgataatcccaatagacatgtaaattatctcgaacacgttgtagtgcgcatcacaatcacccatccaaggcgtggcgatctggccatttacctgaccagtccaagcggcacgaggtctcagctcctggccaacaggctgttcgatcacagcatggaggggttcaaaaactgggaattcatgactattcactgctggggcgaacgcgcggccggggattgggtcttggaggtatacgacacaccctcacagctgcgcaatttcaaaacccctgggaagctgaaagaatggtcactggtgctgtacgggaccagtgtgcaaccgtattcgccaacaaacgaatttcccaaagtggaacgatttcgctatagtagagtcgaggatccaacggatgattatgggaccgaagattacgctggtccatgtgatccagagtgttccgaagtggggtgcgatgggccggggccagaccattgcaacgactgcctgcactattactacaagttaaagaacaacactagaatttgtgtgtcttcttgtcctcccggccactaccacgccgataagaaaaggtgccgaaagtgtgctcccaactgcgagtcttgtttcgggagccatggggaccaatgcatgtcctgcaaatatggatacttcttaaacgaagaaaccaacagctgcgttacgcactgtcctgatgggtcttatcaggacacaaaaaaaaacttgtgtaggaaatgcagcgaaaactgcaagacctgcactgagttccacaactgtactgagtgtcgggacggtctctccctgcagggttcccggtgcagcgtctcttgtgaggacggcagatactttaatggtcaagactgtcagccctgccatcggttctgcgctacctgtgctggcgcgggggccgatggctgcataaactgtactgagggctactttatggaagacggacgctgcgtgcagtcttgcagtatcagctattactttgatcatagctctgaaaatggatataagtcttgcaagaaatgcgacatcagctgcctaacatgcaacggtcctggattcaaaaattgcacaagttgcccttccggatacctgctggatctgggaatgtgccaaatgggcgccatctgtaaggatggggaatatgtagatgagcatggacattgtcagacttgcgaagccagctgtgccaagtgccaggggcctacccaggaggattgcactacatgccccatgacccgaatcttcgacgatggcagatgcgttagtaattgcccctcgtggaaattcgagtttgagaatcagtgccacccttgtcatcacacatgccagcgatgccaggggagcggcccaactcattgtactagttgcggagccgacaattatggcagggagcactttctgtaccagggagagtgcggggactcctgtcctgaaggacactacgccacggagggaaacacgtgtttgccgtgccctgacaactgcgaactctgccactcagtgcacgtgtgcacaagatgtatgaagggctatttcatagccccgacaaatcacacatgccagaaactggaatgcggccaaggcgaagtgcaggatccagattatgaagagtgcgtgccatgcgaggaagggtgcctgggatgctccctggacgaccctgggacgtgtacctcatgcgccatgggttactaccggttcgatcatcactgctacaagacttgtcctgagaaaacatactccgaggaagtggaatgcaaagcttgcgacagcaactgcggttcatgcgatcagaatggatgttactggtgcgaagagggctttttcctgttgggaggaagctgcgtaaggaaatgcggacccggcttctatggagaccaggagatgggggaatgtgagagctgtcaccgagcttgcgagacttgcacaggcccaggacacgacgaatgttccagttgccaggagggccttcagctcctgcgaggcatgtgtgttcatgcgaccaagacccaggaagagggaaagttctggaacgaggctgtctcaactgctaatttgagtgttgtgaaaagtttgcttcaagagcggcggaggtggaaagtccaaattaagagagacatcttgagaaagcttcaaccctgccacagctcatgtaagacttgcaacggcagcgccacactgtgcacttcatgccctaagggggcttatctactcgcgcaagcttgtgttagctcctgcccccagggtacttggccaagcgtgcgatccgggtcttgtgaaaactgtaccgaagcatgtgccatctgctccggagcagatctctgtaaaaagtgccagatgcagccaggacatcccctgttcctgcacgagggaagatgctactcaaagtgccccgagggcagctatgccgaggacggcatttgtgaacgctgctcaagcccctgtcggacatgtgagggcaatgccaccaactgtcatagctgtgaaggcggccacgtgctgcatcatggagtgtgtcaggaaaattgtcccgagagacatgtcgccgttaaaggtgtgtgcaagcactgccccgaaatgtgccaggattgtattcacgaaaaaacatgtaaagagtgtacccctgaattctttctgcacgacgacatgtgccatcagtcctgccccagagggttctacgccgactctaggcattgtgtcccgtgccataaagactgtcttgagtgttctggacctaaggctgatgactgtgagctttgtctggagtcttcatgggtgctgtatgatggcctgtgcctggaggagtgccccgctgggacatactacgagaaagagacaaaggagtgccgcgattgccataaatcttgtctgacatgctccagttcagggacctgcaccacttgccagaaaggcctgatcatgaacccgcgcggcagctgcatggctaatgagaagtgcagcccgtctgagtactgggacgaagacgccccaggctgcaagccatgtcacgtaaaatgcttccattgcatggggcccgctgaagatcagtgccaaacctgcccgatgaattcactactcttgaatacgacttgcgtcaaggattgcccggagggttattatgctgatgaggattccaacaggtgcgcacattgccactccagttgtcggacatgcgaaggacgccacagccggcagtgtcactcgtgcagacccgggtggtttcagctgggtaaggagtgcctcctacagtgccgggagggttactacgctgataattccaccggacgctgcgaacggtgcaaccgctcttgtaagggctgtcagggccccaggcctacagattgcctgtcatgcgatagatttttctttctactgaggagcaaaggggaatgtcataggtcctgccccgatcactactatgtagagcagtcgacacagacgtgcgaaaggtgtcatccaacttgcgaccagtgtaaaggcaagggcgccttgaattgtctgagttgtgtctggagctaccatttgatgggtggtatttgtaccagtgattgcttggtcggtgaataccgtgtaggtgagggtgagaaattcaattgcgaaaaatgccatgagtcgtgcatggaatgtaagggccccggagccaagaattgcacactgtgcccagccaatctggtgctacatatggacgactcacactgcctacactgctgcaatacttcagaccctccctcagcccaggaatgctgtgactgtcaggacaccacagacgagtgcattctgagaacctccaaggtccgacctgccactgagcattttaaaaccgctcttttcatcactagtagcatgatgttggtgctcctcctgggtgcagccgtagtagtatggaaaaagagtcggggacgggtccaaccagccgctaaagcgggctatgagaaattagcggacccaaataagtcatattctagctataagtcttcttatcgggaatccacgtcatttgaggaggaccaggttattgaatatcgagaccgcgattatgacgaagatgacgatgacgatatcgtgtatatggggcaggacggcacagtgtataggaaatttaagtacggccttttggatgacgatgatattgacgagctggagtacgacgatgaaagttattcttattaccagtag

SEQ ID NO: 130169 - DNA, 306 bp, Artificial Sequence
  Description of Artificial Sequence: Synthetic coding sequence
tgccagccatgtcacaggttctgcgctacctgtgccggtgccggtgcagatggctgtatcaactgtaccgagggctatttcatggaagatggccggtgtgtgcagagctgttcaatatcctattacttcgatcacagcagtgagaacgggtacaagtcctgcaagaagtgtgatatttcatgcttaacatgcaatggtcccggattcaagaattgcacatcgtgcccaagtggctacctgctggatctcggcatgtgccagatgggcgctatttgtaaggacgtgtcattgtttaggggagcctag

SEQ ID NO: 130170 - DNA, 5583 bp, Artificial Sequence
  Description of Artificial Sequence: Synthetic coding sequence
atgggatgggggtctcggtgttgctgtcccggaaggttagaccttctgtgcgtactggccttactcggcggctgcctcctcccagtctgtcgtacacgggtatacacaaatcactgggccgtgaagattgctggcggctttcccgaggccaatcggatcgcaagtaagtacggctttattaatatagggcagataggagctctaaaagactattatcatttctatcattctcggacaataaagcggtccgtgatctcctcaagaggcacacacagcttcatctcaatggagccaaaggtggaatggattcaacagcaggtcgtgaagaagcgcactaagagagactacgatttcagtagggctcagagtacttattttaacgaccctaagtggccctccatgtggtacatgcactgcagtgataacacccatccttgccagagcgacatgaatatcgaaggggcttggaaacggggctacacaggcaaaaatatcgtcgtgacaattctcgatgacgggattgaaaggacccaccctgacctgatgcaaaactacgacgcactggccagctgcgacgtcaacggcaatgatctagatccgatgcctcgctacgatgctagtaacgaaaacaaacatggaacccgctgtgctggagaagtggccgcagccgcaaacaatagtcactgcacagtgggcatcgcgttcaacgccaaaatcggtggcgtgcggatgctcgatggggacgttacagatatggtggaagcaaagtctgtgtcttttaatccccaacacgttcatatttatagtgcatcatggggccccgatgatgacgggaagacagtcgatgggcctgctcctctcactcggcaggcattcgagaacggtgtgcggatgggcaggcggggattaggatccgtctttgtgtgggcatcaggcaacggtggccgttccaaggatcactgttcgtgcgatggatacaccaactcaatttatactatttcaattagtagcacagcggagtccgggaagaagccatggtatttggaggagtgtagtagcacgcttgcaacgacttactcctccggcgaatcatacgataagaaaatcatcactacggatttaagacaaaggtgcacggacaaccacacaggcacatccgcgagtgccccgatggccgctggaattatcgcccttgccctggaggctaatccgtttttgacttggagagatgtccagcatgttattgtgagaacctcgagggcgggccatctgaatgctaacgattggaagacaaatgcagcaggcttcaaggttagccatctgtacggcttcggactcatggatgcagaagctatggtgatggaggcggagaagtggacgacagtgccccggcagcacgtctgcgtggaatcaactgatcgccagattaaaaccataaggcctaatagcgcagtaaggtctatctacaaagcatctggttgctctgataaccccaatcgacacgtgaactacctcgaacacgtggtggtgcgcatcactataacccaccctcgtcgcggcgatctagctatctatctgaccagtccgtctggtactcggtcccagctgctggccaatcgattgtttgatcattccatggagggctttaaaaactgggaattcatgactattcattgttggggagaacgagcagcaggcgactgggtgctcgaggtgtacgacaccccctcccagctgcgcaactttaagacaccagggaaacttaaggaatggtctctggtgctctatggcacctccgttcagccttactctccgaccaatgaatttccaaaggtcgagcgtttccggtacagccgagtagaagaccctactgatgactacgggactgaggattacgccggaccatgtgatccagagtgttctgaggtgggttgcgatgggcccggcccagaccattgtaatgactgcctacattactactataagcttaagaataatactcgaatctgtgtgtccagttgtccacccggccactaccacgccgataaaaaacggtgtcgcaagtgtgcccccaactgtgagtcatgtttcggatcgcatggagaccagtgtatgagttgcaaatacggttacttcctaaatgaagaaactaatagctgcgttacacactgcccagacggctcgtaccaggacaccaagaaaaatttgtgcagaaagtgcagcgagaattgcaaaacctgtacggagttccacaattgtactgaatgcagggatgggctcagtctgcagggctcacggtgctcagtaagctgtgaggatgggcgctactttaacggccaggactgtcagccctgtcaccggttctgcgcgacatgcgcgggagctggagccgatggctgtatcaattgcacagaaggttattttatggaggacgggagatgtgtgcagtcctgttctatctcctattattttgaccattctagcgagaatgggtataaatcttgcaaaaagtgcgatattagttgtctcacttgcaacggtcctggcttcaaaaactgtacctcctgtccttctggatacttgctggacctgggcatgtgtcagatgggcgctatctgtaaagacggagagtacgtagacgagcacggacattgtcagacatgtgaggcctcatgtgccaagtgccagggccctacccaggaggattgcaccacatgccctatgactagaatcttcgacgacggccggtgcgttagtaactgccctagctggaagttcgaattcgagaaccaatgccacccatgccatcacacctgtcagcgatgtcaggggtcagggccgactcactgtaccagctgtggggcggataactacggtcgggaacacttcctgtaccaaggcgaatgcggcgatagttgccctgagggccactatgccactgagggcaacacatgcctcccatgccccgacaactgtgaattgtgccattccgtgcacgtgtgtactcgatgtatgaaaggctacttcatcgcacccactaatcacacctgccagaaattggagtgtggccagggtgaagtccaggaccccgactacgaggagtgcgtcccttgcgaggaaggctgtctggggtgctccttggatgacccagggacatgcactagctgtgcaatggggtactacaggtttgaccatcactgctacaagacttgccccgagaaaacatacagtgaggaggtggagtgcaaggcttgtgactcaaattgtggctcatgcgatcaaaacggttgttactggtgcgaagagggtttctttctcctgggtggatcgtgtgtgaggaagtgcgggcccggattctatggcgatcaggagatgggagagtgcgagagttgccaccgggcctgcgaaacatgcaccgggcctggacatgacgaatgcagtagttgtcaggaagggctgcagctgctgcggggtatgtgcgtgcacgccactaagacccaggaagaaggcaagttctggaacgatatactcagaaagcttcaaccttgtcactccagttgcaagacctgtaatgggtccgccacactatgtacatcgtgccccaagggtgcataccttctcgcccaagcttgcgtgagcagctgtcctcagggaacatggccctctgtacggagtgggagttgcgaaaactgtaccgaggcgtgtgccatctgttcaggggctgacctttgcaagaagtgccagatgcaaccaggtcaccccctcttcctccacgagggcagatgttattcgaaatgtccagaggggtcctatgctgaggacggaatctgcgagagatgctcctcaccatgtagaacctgtgagggtaatgcaaccaactgccacagctgtgaaggggggcatgtattgcatcatggcgtgtgtcaggaaaattgtcccgagcggcacgtagcggttaaaggcgtgtgtaagcactgtcccgagatgtgtcaagactgcatacatgagaaaacctgtaaagaatgcacacccgagttctttctgcacgacgatatgtgtcatcagtcatgccctagaggcttttacgccgattccagacactgtgtgccatgccacaaagactgtctagagtgcagtggccccaaagctgatgattgcgagctctgtctggagtcatcttgggtcctctatgacggtctgtgtttggaggagtgtccagccggaacctactacgagaaagagacaaaggaatgccgggattgtcacaagtcatgtttaacttgctcaagcagcggcacctgtactacatgccagaagggacttatcatgaaccccagggggtcctgtatggcaaatgagaagtgttcgccaagcgaatattgggacgaggacgcccccggttgtaaaccctgccacgttaagtgctttcactgcatgggtcctgccgaggaccaatgtcagacctgtcctatgaattccctcctgttgaacaccacctgcgtgaaggactgccctgaggggtactacgctgacgaagattccaaccgatgtgcccactgccatagctcctgtaggacctgcgagggtagacattccaggcagtgtcacagctgcaggcccgggtggttccagttgggtaaggaatgcctcttacaatgtagggaggggtactatgccgacaactccacgggcaggtgtgaaagatgcaaccggtcctgcaagggatgtcaagggccccggcctacagattgtttgtcttgcgacagattttttttcctcttgagatcaaaaggtgaatgtcatcgctcatgtccagaccactattacgtggagcagtccactcagacttgcgagcgctgtcatcccacatgcgatcagtgcaaaggcaagggcgcgttgaattgcctttcttgcgtgtggtcgtaccatctcatgggaggcatctgcacgtccgattgccttgtcggagaatatagagtgggcgagggagaaaagttcaactgcgaaaaatgtcacgagagctgcatggagtgcaagggaccaggagctaagaattgcaccctgtgtccggcaaatctggtgctgcacatggacgattctcattgtctgcattgttgcaatacaagcgatcccccgagcgcccaggagtgctgcgactgccaagacactacagacgaatgcatactgcgtaccagcaaagtgcgcccagcaaccgagcacttcaagactgctctttttatcacctcttcaatgatgctggtgctcctcctgggcgctgccgtggtggtttggaaaaagtctcgcgggagggtgcagcctgccgccaaagcaggttacgagaaacttgccgatccaaataagtcctactcctcttacaaaagctcctatagggaaagcactagtttcgaagaagatcaggtaattgagtaccgggacagggactatgacgaagacgacgacgatgacatcgtttacatgggacaggatggcacggtctatagaaaattcaaatatggcctccttgacgatgacgatatcgacgaactggagtatgatgatgagtcgtactcctactaccagtag

SEQ ID NO: 130171 - DNA, 1497 bp, Artificial Sequence
  Description of Artificial Sequence: Synthetic coding sequence
atttggaatgtccaccattgcggtgacaaaaattcgagatgtcgtagcgagatgaacgtccaggctgcatggaagcgcggatataccggtaagaacgtcgtcgtgacgatcctcgacgacggaatcgagagaaaccatcctgacctggctccaaattatgacagctatgcctcctacgatgtcaacgggaatgattacgaccccagtccccggtatgacgcatcgaacgagaataaacatgggacccgttgcgccggcgaggtggccgcctccgccaataacagctattgcattgtgggaatagcctacaacgcaaaaatcggcggcatccgcatgttggatggggacgtcacggacgtggtcgaagccaagtctcttgggatccggcccaattatattgatatctactctgctagttggggccctgatgatgatggcaagactgtagacggcccaggcaggttggctaaacaggcattcgagtacggcataaaaaagggaagacagggcttaggctctatcttcgtctgggcctcaggaaacggcggacgagaaggtgactattgttcttgtgacggttatacaaactctatatatacaataagcgtctccagcgccaccgagaatggttacaagccatggtacctcgaagaatgcgcctccacattagcgaccacctactcttctggggccttttatgaacggaaaatagtgaccaccgacttgcgtcagcgctgcaccgatggtcatacaggcaccagcgtgtcagcgcctatggttgccggcatcattgctctggccctcgaagccaacagccagcttacatggcgggacgttcaacacttgctagtgaaaacgagtcgacctgcacacctgaaagcgtcggattggaaggtgaacggggccggacacaaggtgtcacatttttatgggtttgggctggttgacgcggaggctctcgtcgttgaagcgaagaaatggacggcggtcccttcccagcacatgtgtgttgcagcatccgacaagcggccacggagtataccacttgtacaagtactgaggaccaccgccctgaccagtgcctgcgccgagcactccgaccaaagagtagtgtacctcgagcatgtggtggttagaacaagcatcagtcatccacgtagaggagatttgcaaatctatcttgtgtctccgtccggcactaaatcacagctgcttgcaaaaagattactggacctgagcaatgaagggtttacaaattgggagttcatgaccgttcactgttggggagaaaaagccgagggacagtggacgctggagatccaggaccttccgagccaggtgagaaaccccgagaaacagggagacctggagacgccagtagccaaccaattaaccactgaggagcgattcgtctcaaccctgtccattctttttcactggagtgtgtacttgagctggtcacaataccacatagttctgattactgtagccctatag

SEQ ID NO: 130172 - DNA, 1956 bp, Artificial Sequence
  Description of Artificial Sequence: Synthetic coding sequence
atgcctcccagagccccacctgcaccaggacctcgaccgcccccccgtgccgcagcagctaccgacactgcggccggtgctggcggtgcgggcggtgcgggtggcgctggaggccctgggttcagacccctggccccgcgcccctggcggtggttgctcctgctggctctgccggccgcctgcagcccacccccacgacccgtgtacacaaaccattgggccgtgcaagtgctgggaggccccgccgaggccgacagagttgccgctgctcatggttacctgaacctaggccaaattggcaacctggaggactactaccacttttatcactcgaaaactttcaagcggtccacactctcctccaggggccctcacacatttctaagaatggatcctcaagtcaagtggctgcagcagcaggaggtgaaacgtcgcgtcaagagacaggttcggtcggatccccaggccttgtactttaatgacccgatctggagcaacatgtggtatcttcactgcggagacaaaaattcgcggtgcagatcagagatgaacgttcaggctgcatggaaacgaggctatacagggaaaaacgtcgtggtgacaatactggacgacggaattgagagaaaccatcctgacttggcccctaattacgacagctatgcctcctacgacgtgaacggaaacgactacgacccatctccccgatacgacgcctcaaacgagaataaacatggaacacgatgcgccggcgaagttgcagcttcagcaaacaattcgtactgtatcgtgggcattgcctacaacgcgaagattgggggaattaggatgttggatggcgacgtgacggacgtggtggaggccaaatccctgggaatacggcctaattatattgacatttactccgctagctgggggccagatgatgatggcaagacagtagatggtcccggccgcctggctaaacaggctttcgagtacggtatcaagaagggcaggcagggcttaggttctatttttgtgtgggcctctggcaatggaggaagggagggcgactactgctcctgtgatggatataccaactctatctatacaatttccgtgagcagcgcaacagagaacggatacaagccatggtaccttgaggagtgcgcctccacgttggcaactacttatagctctggtgctttctacgaaaggaagatcgtgaccaccgacctgagacaaagatgtaccgacggccacaccgggactagcgtgtccgctcctatggtcgctggaatcattgcattggccctggaagcaaactctcagctcacctggcgcgacgtacagcacctgttagtgaagacttccagacctgctcatctgaaagctagtgattggaaggtcaacggtgccggacataaagttagccacttttacggcttcggactggttgatgcggaagcccttgttgtggaggccaagaaatggaccgcagtgccttcccagcacatgtgcgtggctgcgtctgataagagacctaggtccatccctctcgtacaggtgctccgcacaacagctctgacaagcgcttgtgcagaacacagcgaccagcgggtcgtctacctcgagcacgtggtagtaagaaccagcatatcccatcccagacgcggtgatctacagatatacctcgtgtctccgtccggaacgaagtctcagctgcttgcgaaaaggcttttggatttaagtaacgaaggatttactaattgggagtttatgacagtgcattgttggggcgaaaaagctgaaggacaatggacccttgaaatccaagatctgccatcccaagtgcgtaatcctgagaaacagggggatctagaaactcctgttgctaaccaactcaccactgaggaaagggagccaggtctaaagcacgttttccggtggcaaatcgagcaggaattgtggtag

SEQ ID NO: 130173 - DNA, 2907 bp, Artificial Sequence
  Description of Artificial Sequence: Synthetic coding sequence
atgccacctcgagccccaccagcccccgggccccgtcccccaccaagggccgccgccgcgaccgacaccgcagcgggcgccggcggtgccggcggggccggaggggccggaggaccagggtttcggcctcttgcaccacgtccatggcgttggttacttctgctggcactcccagccgcctgttcacctcctcccagacctgtgtatacaaatcattgggctgtccaagtactgggcggacctgccgaggctgaccgggtggcagctgctcatgggtacctcaaccttgggcaaataggcaatctcgaagactactaccacttttaccattctaagacctttaaacggagcacccttagcagcaggggccctcatacgtttctgagaatggacccacaggtgaaatggctgcagcagcaggaagtgaagaggcgggtaaaacgacaagtccgttctgatccacaggcgctctacttcaacgaccctatttggtctaatatgtggtacctgcattgtggcgataaaaacagcagatgcagaagcgagatgaacgtccaggccgcctggaaaaggggctacacaggaaagaatgtggtggtcacaatcttagatgatggcattgagagaaaccatcccgatctggcaccaaattacgacagttatgcctcttacgacgtgaacgggaacgattacgacccaagcccccggtacgacgcctctaacgaaaacaagcatgggacccgctgcgctggggaagtcgcagcaagcgctaataacagctactgcatcgttggcattgcatataacgccaaaatcggcggaatcagaatgttggatggtgatgtgaccgatgtcgtggaagccaagtccttgggaatcagaccaaactacattgacatctactccgcgtcttggggccctgatgatgacgggaagaccgttgacgggcctggacgattggctaagcaagcatttgagtatggcatcaagaagggccgccaggggctgggtagtatcttcgtgtgggccagcggcaacggagggagagagggggactattgtagctgcgacggatacaccaattcgatctacactataagtgttagtagcgcgacagagaatgggtataagccctggtacctagaggaatgcgcttccaccttggccactacctactcttcgggcgctttttacgagcgcaaaattgtcactacagacctgcgccagagatgcacagacggtcacacggggacctcggtgagcgcccctatggtcgcgggaatcatcgcccttgctctcgaagcgaatagccagctgacttggcgggacgttcagcacctgttggtaaagactagtcggccagcacacctcaaggcctccgactggaaagtcaatggtgcagggcacaaggttagtcatttctacgggttcggcttggttgacgctgaggccctggtggtggaagcaaaaaaatggaccgctgttccatcccaacacatgtgcgtggccgctagcgacaagcgccctcggtccattcccctggtgcaggtgctccggaccaccgcattaacctcggcatgcgccgagcattcagatcagagagtcgtgtatttggaacatgtggttgtgagaacatctattagtcaccctaggaggggggaccttcagatatatcttgtcagtccctcagggacaaaaagccaactgcttgccaagagattactggacctgagcaatgaaggctttacaaattgggagttcatgaccgtgcattgctggggagagaaggctgagggacaatggaccctcgagattcaggatcttccttctcaggttagaaaccctgaaaagcagggtaagttgaaggaatggagtctgattctgtatggaactgccgaacacccttatcacaccttctccgcacatcagtctcggtctaggatgctcgagttgtccgctcccgagctcgagccccccaaggccgccctgtctccttctcaggtggaggtgcccgaggacgaagaagattatacggcccagtctaccccgggctccgccaatattctccagacctctgtgtgccacccagaatgcggtgacaaggggtgcgacgggcccaatgcagaccagtgcttgaattgtgtgcacttcagcctcggatccgtgaaaacgtcacgaaaatgcgtctccgtgtgccctctcggttactttggagacacagcggctcgccgatgtagacggtgccacaaaggatgcgagacctgctcctccagagcagccacccagtgcctttcgtgtcggcgtggtttttaccaccatcaggagatgaacacatgtgttacactgtgcccggcaggcttctatgctgacgagagtcagaaaaactgtctgaagtgtcatccatcctgtaaaaagtgtgtggatgagcctgagaaatgcacggtatgcaaggaaggattttccctcgccaggggaagctgcataccagactgcgagcccggaacatactttgactctgaattaatcaggtgtggcgagtgccatcacacttgtggcacttgcgtcggtcctggtcgagaggaatgcatccactgcgctaaaaattttcacttccatgactggaagtgtgtccctgcatgcggggagggattttaccccgaagagatgcctgggctgccgcataaggtatgcagacgttgtgatgagaattgcttatcctgcgcaggttcctccaggaattgtagccgctgcaagacgggatttactcagttgggaaccagttgcatcacaaatcatacttgtagtaatgctgatgagaccttctgcgagatggtaaaatcaaatcgcttgtgcgaaaggaaactctttatccagttctgctgtagaacttgtctgctcgccggctag

SEQ ID NO: 130174 - DNA, 2868 bp, Artificial Sequence
  Description of Artificial Sequence: Synthetic coding sequence
atgccgcccagagccccaccagctcctggcccgagaccccccccgagagctgctgccgccacagacaccgccgcaggcgcgggtggcgcaggtggggccgggggagctgggggcccggggttccgacctctcgcgcccaggccctggcgatggctgctgctccttgccctgcctgctgcttgcagtcccccgccgcgccctgtatatactaaccactgggcggttcaggtgctgggtggcccggcagaagccgatagagtcgctgcagcgcatgggtacctcaatctgggtcagattggaaatctggaggactactatcacttctaccacagcaaaaccttcaagagatccaccctctcttcccgcggaccccacaccttcctgaggatggacccacaggtgaaatggctgcagcaacaagaggtcaagcggagggtcaagaggcaggtgcggtctgaccctcaggccctttattttaacgatcccatctggagtaacatgtggtatctccactgtggagacaagaactcgagatgccggagtgagatgaacgttcaggccgcctggaagcggggatacacgggcaagaacgtcgtggttacgatcctggatgacggtattgaaagaaaccatcccgatttggcgccaaattacgatagttatgcaagctatgatgtgaatggaaatgactacgatccttcgcctcgctatgatgcatctaacgagaataaacacggcacccgctgtgccggcgaggttgctgcatcagctaacaatagctattgcatagtgggaatcgcctataacgccaaaattggcgggatccgcatgctggatggcgacgtgacagatgtcgtcgaggccaagagtcttggcatcagacccaattatattgatatctactcagccagttgggggcccgacgacgacggaaagaccgtggatggtcctgggcgattggccaaacaagccttcgagtatgggatcaaaaaaggcaggcaggggctgggctctatcttcgtgtgggctagtgggaacgggggaagggaaggcgactattgtagttgcgatggctatacaaacagcatttatacaataagtgtgagttctgccactgagaacggctataagccgtggtacctggaagaatgtgcctctactctggccactacatacagctcaggggccttctacgaacggaaaatcgtcactaccgacctgagacagcgttgcacagatggtcatacaggcacttccgtctcggccccaatggtagccgggattatcgccttagcactagaagccaattctcagctgacgtggagggatgtgcaacatctcctggtgaagacctccagacccgcgcatctcaaagccagcgattggaaggtgaacggggcagggcacaaggtctcacatttttacggatttgggctagttgacgcagaagccctggtggtcgaagctaagaagtggactgcagtcccgtcccagcacatgtgtgtggccgcaagtgacaagcgcccgagaagtatccctctagtacaggtcctccgcacgaccgcattgacctccgcatgcgcagaacactctgaccagagggttgtgtatctagagcatgtggttgtgcgcacctcaatctcgcaccctcggaggggtgacctccagatctacttggtttctccatcagggacaaagtcccagctcctcgccaaacggctcctcgacttaagtaatgaaggatttacaaactgggagttcatgacagtccactgttggggtgagaaagccgagggccagtggacgctcgaaatccaggatctcccaagccaggttcggaaccctgaaaaacagggaaagctgaaagagtggtcacttatattgtacggaaccgctgagcacccttatcacacattctccgcacaccaaagcaggtctaggatgttggaactgtctgcacctgagttggagccccccaaagctgcgctcagtccttctcaagtcgaagtaccggaagatgaagaagattacacaggggtttgccaccccgagtgcggggacaagggttgcgatggacctaatgcagatcagtgcctgaactgcgtacatttttctctgggatccgtaaaaacatcccgtaaatgtgtgtccgtttgccctctggggtacttcggcgacactgccgccagaagatgcagaaggtgccataagggctgcgagacctgttcttctcgggctgctacacagtgcctgtcctgccggcggggattctaccatcaccaggagatgaatacctgtgttaccctttgccccgcaggcttctatgcagatgaatctcagaagaactgtctcaaatgtcacccatcttgtaaaaaatgcgttgatgaacccgaaaaatgcaccgtctgcaaagaaggcttctctctcgccagagggtcctgtatcccagattgcgagcccgggacatatttcgacagcgagttaatccggtgcggggaatgccaccatacatgcggcacctgcgtgggcccaggccgcgaggagtgcatccattgtgccaaaaatttccattttcacgactggaagtgtgtgcctgcgtgtggcgaagggttttatcccgaggagatgcctgggctgccccataaagtttgtcgaaggtgcgacgagaactgccttagttgtgctggttcctcccggaattgttcccggtgtaagacaggattcacgcagcttggcacctcttgcatcactaaccacacctgttctaacgccgatgagacattttgcgaaatggtgaagagtaacagattatgcgagcgcaaactatttatacagttctgttgcaggacatgtctcctcgccgggtag

SEQ ID NO: 130175 - DNA, 1869 bp, Artificial Sequence
  Description of Artificial Sequence: Synthetic coding sequence
atgccacccagagctcctcctgcccccggccctcgtcctcctccgagagcagctgccgccacagacacggctgcaggggcggggggggctgggggggcaggtggtgctggcgggcccgggttccgaccactggcacccaggccttggaggtggctcttgttacttgctctgccagccgcttgttccgcccccccgagacctgtctatacaaaccactgggctgtgcaggtgctgggtgggccggccgaagcagacagagtggctgcagcccacggctacctaaatctgggccaaattgggaatcttgaagactattaccacttttaccacagtaaaacctttaagcggtccactctgtctagccgggggcctcatacctttctgcggatggacccgcaagtgaagtggttacaacagcaagaagtcaaaaggagagtgaaaagacaggtacggagcgatccacaagccctctatttcaacgaccctatttggtcaaacatgtggtacctgcactgtggggataagaattcaagatgtagatccgaaatgaatgtgcaggctgcctggaagagaggttataccggaaagaatgtggtagtgacgattttagatgacggcatagaacgcaatcaccccgatctggcaccaaactatgactcatatgctagctatgacgtcaacgggaacgactatgacccttcacctcgctacgacgcatccaacgagaataaacacggcactcggtgtgcgggagaggtcgcagcatcggctaacaactcatactgtatcgtgggtatcgcatacaatgccaagatcgggggaattagaatgctggacggtgacgtaacagatgttgtagaggctaagagtctgggcatccgccctaactacattgatatttactcggctagttgggggccggacgacgatgggaaaaccgtggacgggcctggaagactcgcaaagcaggcgttcgagtacggtataaaaaagggaagacaagggctcgggtcaattttcgtgtgggcctccgggaacggggggcgggagggggactattgttcctgcgatggctataccaactccatatacactatcagtgtgagtagcgctacagaaaatggctacaagccctggtacttggaagagtgcgcctccactttggctactacctactcctcgggcgcgttctacgagcggaagatcgtgactactgacctgagacagaggtgtactgatggtcacaccggcacttccgtgtcggcgcccatggtggctggaatcatcgcgcttgccctggaggccaattcccagctgacatggagggacgtgcagcaccttctggtaaaaactagccggcccgcacatttaaaggcctcagactggaaggtcaacggcgccgggcataaggtgtcccacttttacgggtttggcctcgtcgacgcggaggccctcgtagttgaggccaaaaagtggactgctgtcccatcacagcatatgtgtgtggcggcctccgataagaggccacgatccatacccctcgtccaagtgttgaggaccacagcgctgacatcggcctgtgcagagcacagcgaccagcgagtggtgtacttggagcatgttgtcgtgaggactagtatttcacacccacggagaggcgatctccagatttacttagtatctccaagtggcaccaaaagccagctgctggcaaagcggcttctcgatctgtcaaatgaaggttttacgaactgggagtttatgactgttcactgttggggcgagaaggccgaggggcaatggaccctggagatacaggacctgccatcccaggtaaggaatccagaaaaacagggaaacctggactag

SEQ ID NO: 130176 - DNA, 1584 bp, Artificial Sequence
  Description of Artificial Sequence: Synthetic coding sequence
atgtatgcactcttcttattggcatctctgctgggggccgcgcttgcaggaccagttttgggactgaaggagtgtacccgcgggtctgcagtgtggtgccagaacgtgaaaaccgcgagtgactgcggggccgtgaagcactgcctgcagacggtctggaacaagccaacggtgaagtcattgccctgcgacatctgtaaagacgtggtgactgccgcaggagatatgctaaaggataacgcaacggaagaggagatacttgtgtatctggaaaaaacctgcgattggctgcccaaacccaacatgagtgccagttgtaaggagatcgtggactcatacctgccggtaatcctggacatcataaagggcgaaatgtcacgtcctggcgaggtgtgtagcgctctgaacctgtgtgagtcgctgcagaagcatttggccgagcttaatcatcagaagcagctggaatctaacaagattcccgagctcgacatgacggaagtagtagcccccttcatggccaatataccactgctgctctacccacaggatggacctcgtagcaaaccacaaccgaaggataatggtgatgtttgtcaggactgcatccagatggtcaccgacattcagaccgccgtgcgcaccaattctacctttgtccaggctttggtggagcacgttaaagaggagtgcgatagactaggtcccgggatggccgacatttgcaagaactacatcagtcagtacagcgagatcgccatccagatgatgatgcacatgtcagctgaacagccaaaagagatctgcgctctcgtggggttctgcgatgaagttaaagagatgcccatgcaaaccctcgtgcccgccaaggttgcaagtaaaaacgtgatcccagctctcgaattagtggagccaatcaagaagcatgaggtgccagcgaagtccgatgtttactgtgaggtctgcgaattcttggttaaggaagttacaaagctcattgataacaataaaacggagaaggaaatacttgacgcatttgataaaatgtgtagcaagttacccaagtctctgagcgaggagtgtcaggaagtggtagatacctatggttcatctatcttgagtatcctcctcgaagaggtgtcccccgagcttgtttgcagtatgctgcacctctgctccggaacacgcttgccagccctgaccgtccacgttacacagcccaaagacggcgggttctgtgaagtctgtaagaaactagtcggatatctcgaccgtaacctcgaaaaaaacagtactaaacaggaaattctggcagcactagaaaaaggttgctcctttctccctgacccctatcaaaaacagtgtgaccaattcgtcgccgaatatgagcccgtgctcatagagatcctggtcgaggtgatggacccctcattcgtatgcctgaagataggggcctgtccatctgcccacaagcccctgctggggactgagaaatgcatttggggaccctcttactggtgccaaaacactgaaaccgctgctcagtgcaacgccgtcgaacattgcaaacgacatgtctggaactag

SEQ ID NO: 130177 - DNA, 1680 bp, Artificial Sequence
  Description of Artificial Sequence: Synthetic coding sequence
atgtacgctctgttcctgctggccagtctgctgggggccgccctggcgggacccgttcttggcctaaaagaatgcacaaggggcagcgctgtttggtgtcagaacgtaaagaccgccagcgactgtggagcggttaagcattgcctgcaaaccgtctggaataaacccaccgtgaagagtcttccatgcgatatttgcaaagacgtcgttaccgcagccggcgatatgttgaaagataatgccactgaagaggagattctggtgtatttggagaagacctgtgattggctcccaaaaccaaatatgagcgcctcctgtaaagaaatcgtcgattcgtatttaccggtgattcttgacataatcaagggggaaatgtcgcgccctggcgaggtgtgttcagccctcaatctttgtgaatctctgcagaagcacctcgctgaattgaaccaccagaagcagcttgagtcaaacaagattcctgaactggatatgacagaggtcgtggcaccattcatggcaaacatcccactgctcctgtacccacaggatggcccccggtctaagccccagccaaaagataatggggacgtctgtcaggactgcatacagatggtcaccgacattcagaccgctgtgcgcactaactcaactttcgtacaagctctggttgagcacgttaaggaggaatgcgaccgcctgggccctggcatggccgacatatgtaagaactatataagccagtattcagagatagcaatccagatgatgatgcacatgcagcctaaagagatctgcgccttggttggcttttgcgatgaggtaaaagaaatgccaatgcagaccctcgttcctgccaaagtggccagtaagaacgtgattcctgccctggagctcgtagagcccatcaaaaagcacgaggtccccgcgaagtctgatgtctactgcgaggtctgcgagttcttagttaaggaggtgacaaagctaatcgataataataagacagaaaaggagatcctcgatgcctttgacaaaatgtgctctaagttgcccaagtccctctccgaggaatgccaagaggtggtggacacatacgggagtagcatcctgagcattcttctcgaggaagttagtcccgagcttgtgtgcagcatgctccatctttgctccggcactaggctgccagcactgacagtgcatgtgacccagcccaaagacggaggcttctgtgaggtgtgcaaaaagctcgtcgggtacctggaccggaacctagaaaagaattccacaaaacaagagattctggcagccctagaaaaaggatgtagcttcctgcccgacccctatcaaaagcagtgtgatcagtttgtggcagagtatgagcctgtgctgattgagattctcgttgaagtgatggacccgagtttcgtctgcctgaagatcggcgcctgcccatccgcacacaagcctcttctgggtacagaaaaatgtatatggggtccctcatactggtgtcagaatactgaaacagccgcacagtgtaatgccgtggagcactgtaagaggcatgtgtggatcgggtgttggggagtaggcgtgggatcctgcctgtggcctacctgggctccaacattactgtcgacctcaggttgccaggagaccgcaagcaaggcctccaggacctag

SEQ ID NO: 130178 - DNA, 723 bp, Artificial Sequence
  Description of Artificial Sequence: Synthetic coding sequence
atgtacgccctgttcctgttggcatcccttcttggcgcagcgctagcgggacccgtcctgggcctcaaggagtgcacacggggatcagcagtgtggtgccaaaatgttaagacagcgtctgactgtggggccgtcaagcactgtcttcaaacggtctggaataagcctacagttaagtcactgccgtgtgacatctgcaaagatgtggtgaccgcggccggtgatatgttgaaagataacgccaccgaggaggagatccttgtgtatctcgaggtgtcacctgagttagtctgcagcatgttgcatctttgctctggcactcggcttcctgctttgaccgtgcacgttacacaacccaaagacggaggcttctgcgaggtgtgcaagaagctggtgggataccttgacagaaacctcgagaagaattctaccaagcaggagatcctggccgctttggagaaagggtgcagtttcctacctgacccatatcagaagcagtgcgaccagtttgtggcagagtatgagcctgtgttgattgagatccttgtagaggttatggatccaagctttgtgtgcttaaaaatcggagcttgcccatctgcgcataaacccttattgggaactgagaaatgcatttggggaccctcttattggtgtcagaatactgagacggccgcccagtgcaatgccgtggaacactgtaagcggcacgtgtggaattag

SEQ ID NO: 130179 - DNA, 1581 bp, Artificial Sequence
  Description of Artificial Sequence: Synthetic coding sequence
atgtacgctctatttttgcttgcctctctgctaggtgctgcacttgcgggtcccgtgctggggctgaaggaatgtacccggggcagcgctgtttggtgccagaacgttaagaccgcctcagactgtggcgcagtcaagcattgccttcaaactgtatggaacaagccaaccgtcaaaagccttccttgtgatatatgtaaagacgttgtgactgccgctggggatatgttgaaggataatgctacagaggaggagatcctagtttacttagaaaaaacatgcgattggctgccaaagccaaacatgtccgcgtcttgcaaggagattgtggatagttacttaccagtgattctcgatattatcaagggtgaaatgagcagacctggtgaggtctgcagcgcacttaatctgtgcgagtcactccagaaacacttggctgaactgaaccatcagaagcagcttgagtcaaataaaattcctgagctggacatgactgaagtggtagcaccctttatggccaacatccctcttctgctgtatccccaggatggtcctaggagtaaaccccaaccgaaggacaatggggacgtgtgtcaagactgcatccaaatggtgacagacattcaaactgcagtgagaactaactctacattcgtccaagccctggttgagcatgtgaaggaggagtgcgacagacttgggcccgggatggcggacatctgtaagaactacatcagccagtacagtgagattgccatacagatgatgatgcacatgttacagcaacccaaggagatctgtgccctggtcggattctgcgatgaagttaaggagatgcccatgcaaacactggtgccggcaaaggtggcttccaagaacgtaatcccagcgctggagttggtggaacccatcaagaagcatgaagtgccagccaaatccgacgtgtactgtgaagtgtgcgagttccttgtcaaagaggttaccaagctcatagacaataataaaacagagaaagagattcttgacgccttcgacaagatgtgctcaaagctccctaaaagcctgagcgaggagtgccaggaagtcgttgacacgtacgggtccagcatcctgtccatcctgctggaagaagtgtctcctgagctcgtttgttctatgctgcacctctgttccggtacccggctcccagctttaaccgtgcatgttacccaacctaaagacggggggttttgtgaagtatgtaagaagctggtagggtatctggaccgcaatttagaaaaaaactcaaccaagcaggagatcctggccgccttagaaaaggggtgctcttttttgcctgatccttaccagaaacagtgtgatcagtttgtggccgaatatgagcctgtgttgattgagattttggtggaagtaatggatccatcgttcgtctgtctcaagatcggagcatgcccaagtgcccataaaccgctccttggaaccgaaaagtgtatctgggggccgagctattggtgtcagaacaccgaaactgccgctcagtgtaatgccgtggaacactgcaagagacacgtgtggaactag

SEQ ID NO: 130180 - DNA, 1575 bp, Artificial Sequence
  Description of Artificial Sequence: Synthetic coding sequence
atgtatgccctgtttctcctggcttcactgctgggggccgctctcgcaggacctgtgcttggtctgaaagagtgcacaagggggagcgctgtatggtgtcagaacgttaagacagccagcgattgtggagccgtgaagcattgcctccagactgtgtggaataagccaacagtgaagtcattgccctgtgacatttgcaaagacgttgtcacggcagccggcgatatgctcaaagacaatgcaacagaggaggagattctggtctacttagaaaaaacgtgcgattggctgccaaagcccaacatgagtgcctcctgtaaagagattgtggactcctacctgcccgtcattctagacattatcaagggagagatgagccggcccggtgaagtgtgttccgcattaaacttatgtgaaagtcttcaaaagcatttggccgagctcaaccatcagaaacagctggagtcaaacaaaatacccgaactagacatgactgaagtagtggcgcctttcatggcaaatatcccacttctgttataccctcaggatggccctcgcagcaaaccccagcctaaggataacggtgacgtttgccaggattgcattcagatggtgactgacatccagacggcagttagaactaacagcacctttgtgcaggcactggtagaacacgtgaaggaagagtgcgatagactaggccccggcatggccgacatctgcaagaactatatctcgcagtactctgaaatcgctatccagatgatgatgcacatgcaacccaaggagatatgcgctctggtgggcttctgtgatgaggtgaaagagatgccaatgcagacgttggtgccggcgaaggtcgcctcaaagaatgtgattcctgccctggaacttgtggagcctataaagaaacacgaggtgccagccaagtctgatgtctactgtgaagtgtgtgagtttctggtgaaagaggtgaccaagctgatcgacaacaacaagacggagaaagaaattctcgatgctttcgataaaatgtgctctaagctccccaagtcactcagtgaagagtgtcaggaggtggtggacacctacggctctagtatcctatccattctcctggaggaagttagcccggaactggtgtgtagtatgctgcatctgtgctctggcactaggctcccagctctgaccgtgcacgtgactcagcccaaggatggggggttttgcgaggtgtgtaagaaactcgttggctatctggatcggaacctggagaagaacagcaccaagcaggagatcttggctgcactcgaaaagggctgttcgtttctgccagacccttatcagaagcagtgcgaccaattcgtcgcagagtacgaaccagtcctgatagagatattggtcgaggttatggacccctcttttgtgtgtctcaaaattggtgcttgtccttccgctcataagcccctgctggggactgagaaatgcatatggggccctagctattggtgtcaaaatacggagaccgcagcgcagtgcaatgcagtggagcattgtaaaagacatgtctggaattag

SEQ ID NO: 130181 - DNA, 1353 bp, Artificial Sequence
  Description of Artificial Sequence: Synthetic coding sequence
atgctgaaagataatgccaccgaagaggaaatactggtgtatttggaaaagacctgtgattggcttcctaaacctaacatgagcgcaagctgtaaggagatcgtggactcctatttaccagtgatccttgatatcatcaaaggcgaaatgtctaggcccggcgaggtgtgttcggctctaaatttgtgcgagtccctgcagaaacacttggcagaactgaatcatcagaaacagctagagtccaataagataccagagttggatatgaccgaggtggtggcaccgtttatggccaacatccccctcttgctgtacccccaggacggcccacggagcaaacctcagccaaaagataatggcgacgtatgtcaggactgtattcagatggtgacggacatccaaacggcagtgcggaccaatagtactttcgttcaagccttagtcgagcacgtgaaggaggagtgcgatagactgggtcctgggatggcagacatttgtaagaactacatctcccaatattcagagattgccatacagatgatgatgcatatgcagcagcccaaggaaatttgtgccctggtggggttttgcgatgaggtcaaggagatgcctatgcaaacactggtgcccgccaaagttgcgagtaagaatgtgatacctgctcttgagttagtcgaaccaatcaaaaagcacgaggttcctgccaaatccgacgtctattgtgaggtctgcgagttcctcgtaaaagaggtaactaagctgattgataacaataaaacagaaaaagagattttagatgcattcgacaagatgtgctctaagctccctaagtctctctcagaagaatgccaagaagtagtcgacacatacggcagcagcatactcagcattcttttagaggaggtgagccccgagcttgtttgttctatgttacacctatgttccgggacacgactgcccgcactgacagtgcatgtaacacagcctaaggatggtgggttctgcgaggtgtgtaaaaagctcgtcgggtacctagacagaaatctggagaagaattccaccaaacaggagatcctcgctgctctcgagaaaggatgttcatttctgcctgacccttaccagaagcagtgtgatcagtttgttgccgaatatgagccggtcttaatcgagatcctggtggaagtgatggacccttcatttgtgtgcctcaagattggagcatgccctagtgcccataagcctttgctgggcacagagaagtgcatttggggccccagctactggtgtcagaacaccgagaccgccgcgcaatgcaacgctgtcgagcactgtaagcggcatgtctggaactag

SEQ ID NO: 130182 - DNA, 1593 bp, Artificial Sequence
  Description of Artificial Sequence: Synthetic coding sequence
gacggagctatgtatgcattatttttgcttgcctctttgctgggtgctgcattagctggccccgttctaggtctcaaagagtgcacccgcgggtcggccgtatggtgccagaacgtaaaaacagcctcagactgcggggcagtcaagcattgcttacaaactgtgtggaacaaacccacagtcaagtcccttccttgcgatatttgtaaggatgtcgtcacagccgccggcgatatgctgaaggacaacgctaccgaggaggaaatcctcgtatatttggaaaaaacgtgcgattggctgccaaagcctaatatgagtgcaagttgtaaagagattgtggacagttatctgcctgttatactagatatcattaagggagagatgtctcgccccggtgaggtatgctcagcgctcaacctttgtgagtcgttacagaaacatctggccgagctaaatcaccaaaagcagctcgagtccaataagatcccagaactggacatgacggaggtagtggcaccttttatggctaatatcccactcctgctgtacccccaagacggtccccgtagcaagccccagcccaaggataacggagacgtgtgccaagattgcatacagatggtgacagacatccagaccgccgtaaggactaactccacattcgtgcaggccctggtcgaacacgtgaaggaggagtgcgaccgattaggccccggtatggctgacatctgcaaaaactatatcagccagtactccgagatcgcaattcagatgatgatgcacatgtcagctgagcagcctaaagagatctgcgccttggtcgggttctgcgacgaagtgaaggagatgcctatgcagaccctggtcccggccaaggtggccagtaaaaacgtgattcccgctttggaactggttgagcccatcaaaaagcacgaggtacctgctaagagcgatgtgtattgtgaagtttgcgagtttcttgtcaaggaagtcactaaactcattgacaataataaaaccgaaaaggaaatattagatgcctttgataagatgtgtagtaagcttccaaaatccctaagtgaggaatgccaagaagtggtggacacctatggatctagcatactgagcatcctgctggaggaggtgagccctgaactggtgtgttcgatgctgcatttatgctccggaacacggctacctgccctgactgttcacgtcacccagcccaaagatgggggcttttgtgaggtatgcaaaaaactggtgggttacctggatcggaatctcgagaagaatagtactaaacaggaaattctggcagcattagaaaaaggctgcagcttcttgcctgatccctatcagaagcagtgcgatcagtttgtggcagagtacgaacccgtgctcattgaaatcctggtcgaggtcatggacccatccttcgtgtgtctgaaaatcggcgcttgtccatcagctcataaaccactcttaggcactgaaaagtgtatctggggtccgagctattggtgtcaaaacactgagacggcagcccagtgtaacgccgtggagcactgtaaacgccatgtatggaattag

SEQ ID NO: 130183 - DNA, 2214 bp, Artificial Sequence
  Description of Artificial Sequence: Synthetic coding sequence
atgccggatcacgatagtacagcgctgctgtccaggcaaacaaagcgccgaagagtcgatatcggggtgaagcgcaccgtgggaaccgccagcgcattcttcgctaaagctcgcgctacattcttctcagccatgaatccacaaggatccgagcaggacgtggagtactctgttgttcagcatgcagacggcgaaaagagcaacgtactgaggaaattacttaaacgcgcaaactcctatgaggacgctatgatgcctttcccaggcgccactattatttcacagctgctgaagaacaacatgaacaaaaacggcggcaccgagccgagcttccaagcttccggcctgagctccactgggtctgaagtgcaccaggaagacatttgcagcaactcatctagagacagcccccccgagtgtctgtccccctttggacgacccacaatgtcacagttcgacatggatcgattatgtgacgaacatctgcgggctaagcgcgctcgagtggagaacatcatcagagggatgagtcattccccctctgtagccctaagagggaatgaaaatgagagggagatggctccgcagtcagttagcccgcgcgaaagctatcgcgagaataaaagaaagcagaaactacctcagcagcagcagcagtcttttcagcaattggtgtccgctcggaaagaacagaaacgggaggagcgcaggcagctgaaacagcagctcgaggatatgcagaaacaactgcgccaactgcaagaaaagttctaccagatttatgattcaaccgactcagagaatgatgaggatggtaatctaagtgaagatagcatgcggagcgagattttggatgcgcgagcccaggattctgtggggcgatcggacaacgaaatgtgcgaactagatccgggccagtttatcgatagagcccgcgccttaatccgtgagcaggaaatggccgagaacaagccaaaacgggaaggaaataataaggaacgcgaccacggtccaaactcccttcagcccgaaggcaagcacctggctgaaacacttaagcaggaactgaataccgctatgagccaagtggtggacacagtagttaaggttttttccgctaagccgagtaggcaggtccctcaggtgtttccacccctccagataccacaggccagatttgctgtcaatggagaaaaccacaactttcacaccgcaaatcagcgcttacagtgctttggcgatgtgatcattcccaaccctctggatacgtttggcaacgtccagatggcctctagcacagaccagaccgaagccttgcctttggtcgtgcgaaaaaacagcagcgatcagagtgcatcaggcccagccgcaggtggacaccatcagcccttgcatcagtcccccctgtccgctaccaccggtttcaccactagtaccttcagacatccatttccgctcccccttatggcctatccttttcaatctcccctgggagccccaagtggatcgttttccggtaaagatagggccagtcctgagtccctggatcttacccgggacacaaccagtctgcggaccaagatgagctcccatcacttgagccaccatccttgtagcccggcccaccccccatccaccgccgagggattaagtttaagtctaataaaaagcgaatgtggcgacctccaggacatgtctgagatcagcccttacagtgggtcagccatgcaggaaggactctcacctaatcacctgaaaaaggccaagctgatgtttttttacactagatatccatccagcaacatgctcaagacctatttctctgatgtgaaattcaaccgatgtattacctctcagctcatcaagtggttttctaactttagagaattctactacatccaaatggagaaatacgcacggcaggccataaatgacggcgtgacaagcactgaagagctttccatcaccagagactgtgaactgtaccgcgcccttaatatgcactataataaagctaacgatttcgaggtgcctgagcgctttctggaggtcgcacagatcactctgagagagttttttaacgccattattgcaggtaaagatgtggacccctcttggaagaaagccatctataaggtgatttgtaagctcgattccgaggttcctgagatcttcaaatcgccgaattgcttgcaagaattgttgcacgaatag

SEQ ID NO: 130184 - DNA, 2031 bp, Artificial Sequence
  Description of Artificial Sequence: Synthetic coding sequence
atgccagaccacgatagtactgccctgctttcaaggcagaccaaacgtaggcgggttgatatcggagttaaacggaccgtgggcacggccagcgcatttttcgcgaaggcccgggcaacctttttttccgccatgaatcctcaaggcagcgagcaggatgtcgagtacagcgtagtacagcacgctgatggagagaaaagtaacgtgcttaggaagctgctgaagagggcaaacagctacgaggatgcaatgatgccttttccaggggcaactatcattagtcagctgctgaagaacaatatgaataaaaacgggggcaccgagcccagctttcaagcaagcgggctctcgtctaccggctccgaggtccatcaggaagatatttgtagtaattcatcacgcgacagtccacccgaatgcctttctccttttgggaggcccacaatgtcacagtttgacatggaccgtctctgtgacgagcacctgagggcaaagcgcgcaagggtcgaaaacataatcagaggcatgtcccattcacccagtgtggcgcttcggggcaacgagaacgagagagaaatggccccacagagtgtgtctccacgcgagagttaccgggagaataagcgcaaacagaagctgccgcagcagcagcagcagagcttccagcagcttgtgtccgccaggaaggagcagaagcgggaagagaggcgccaattaaagcagcagcttgaagatatgcagaaacagctaagacaactccaggagaagttctatcaaatctacgactcgaccgacagcgagaatgatgaagatggaaatttatccgaagattccatgcggagcgaaattttggacgcaagggcacaggactcggtcgggcggtccgacaatgagatgtgtgagctggacccaggtcaattcatagaccgagcccgcgcgctgatccgggagcaggagatggccgagaacaagccaaaacgagagggaaacaacaaagagcgcgaccacggtcctaacagtttgcagccagagggaaaacacttggccgaaacactgaagcaggagctgaataccgccatgtcacaggtcgtggacactgttgtcaaggtgttcagcgccaagcccagccgccaggtccctcaggtctttccccctttgcagatccctcaggctcgatttgcagtcaatggagagaatcataacttccataccgccaatcagagactgcagtgctttggcgatgttatcatcccaaatccactagataccttcggaaacgttcaaatggcatcttccacggaccagacagaggcactgcccctggtggtacggaaaaacagtagcgatcagagcgctagcggtcccgcagcaggggggcatcatcaaccgttgcatcagtcaccacttagtgccacgactggttttactacctccacatttagacacccctttccgctgccactgatggcctaccctttccagtctccccttggcgctccctctggctcctttagtgggaaggaccgggccagcccggaaagcctggacctgacacgtgatacgacaagcctaagaacaaagatgagttcccaccatctttcacaccatccatgttctccagcgcacccgccttccacggccgagggcctttctctctctttaattaaatcagaatgtggagatttacaggacatgagcgagatctcaccatattcaggctctgctatgcaggaggggctgtcccccaatcatctgaaaaaggccaaacttatgtttttctatactaggtatccaagcagcaatatgctgaagacttacttctcggatgtaaaatttaaccggtgcatcacatctcagctgatcaagtggttcagtaatttcagagagttttattatatccagatggagaaatatgcccgccaggctattaatgacggagtgaccagcactgaggagttgtctattacgcgcgactgtgaattgtaccgtgctttaaacatgcattataacaaggctaacgacttcgagtag

SEQ ID NO: 130185 - DNA, 2214 bp, Artificial Sequence
  Description of Artificial Sequence: Synthetic coding sequence
atgcccgatcacgactccacagcactgctgtcccgacaaacaaaaagacggcgagtggacattggagtgaagaggactgtcggaacagcttcagctttctttgcgaaggcgcgagctacgttcttctcagccatgaacccccagggcagcgaacaggacgtcgagtactctgtggtgcagcacgccgatggcgaaaagagcaatgttctgagaaagctgttgaaaagagcaaactcatacgaggacgcaatgatgccatttccaggggccaccataatatcacagctgctgaaaaataatatgaacaaaaatggcggcactgaaccgagcttccaggcaagtggtttaagctccaccggaagcgaggtccatcaggaggacatctgctctaattctagtagagattccccacctgagtgtctgagtccattcggtagacccaccatgtcgcagtttgacatggacagattgtgtgatgagcatcttagggctaaacgagctcgcgttgagaatatcatcagagggatgtctcactcaccctccgtggcgctcagggggaacgagaacgagcgcgaaatggcacctcagagtgtctccccccgtgagagctatcgcgaaaataagagaaaacagaagctccctcaacagcagcagcaatcttttcagcagctggtgtccgctcggaaagaacagaagagggaagagagacgtcagctcaagcagcagctggaagacatgcagaagcagctgaggcaattgcaagaaaaattctaccagatatacgatagtaccgattctgaaaatgatgaggacggaaatctttcagaagatagtatgagaagcgaaatcctcgacgctagagctcaggacagtgttggcaggagcgacaacgaaatgtgcgaattagatcctggccaattcatagatagagccagggcgctgatcagagagcaagagatggctgagaacaaacccaagagagagggcaataataaggagcgagaccacggacccaacagcttgcagccagagggcaagcacttagctgagaccctgaagcaggaactgaacacagccatgagccaagtcgtagatacggtggtcaaagtcttctcggcaaagcccagccggcaggtgccgcaggtgttccctccactccagataccacaagcccgcttcgccgtgaatggcgagaaccacaatttccataccgctaaccagaggctccaatgcttcggggatgtgatcattcctaatcctcttgatacattcggtaacgtgcagatggcatcttctaccgaccagaccgaggctctgcccctggtcgtccgcaagaatagttctgaccagagtgcctcggggcccgctgcgggaggtcaccaccagcccctccaccagagtcctctgtcagcgacgaccgggtttaccacatcaacgttccgacatccctttccactgccattaatggcctaccccttccagtcaccgcttggcgccccatctggttctttttctggtaaggatagggcctcacctgaaagtctggatttgacacgcgatacaacctccctgagaactaaaatgagctctcaccaccttagtcatcacccttgcagtccagcacatcctccgtctacagcagagggactgtcactttctctgatcaagtctgaatgtggggacctccaggatatgagtgaaatcagcccctatagcgggtccgcaatgcaggaaggactgtcacctaatcatttgaagaaggccaagctgatgttcttctatactcggtacccttcctccaacatgttaaagacttatttctccgatgtaaagttcaaccgctgtattacctcgcagctcattaagtggttttcaaacttccgcgaattctactatatacagatggaaaaatatgcccggcaggcgatcaatgacggggttacctctacagaggagttaagtattacccgcgattgtgagctgtatcgcgctctcaatatgcattataataaagcaaacgattttgaagtccctgaaaggttcctggaggtagcacagataactctgcgagagttttttaatgccattatcgcagggaaggatgtcgatccgagctggaaaaaggccatttataaagtgatctgtaaactggacagcgaagtgcccgaaatttttaaatcaccaaattgcctgcaggaacttctgcacgagtag

SEQ ID NO: 130186 - DNA, 693 bp, Artificial Sequence
  Description of Artificial Sequence: Synthetic coding sequence
atgcccgaccacgattcaaccgcattactgagccgccagactaagcgcagacgggtagacatcggtgtgaaacgcaccgtcggcaccgctagcgctttttttgccaaggcccgtgccacattcttctcagcgatgaacccacaaggctcagagcaagacgttgaatatagtgtggttcagcacgctgatggagaaaagtccaacgtgctccgcaagctgttgaaacgcgcaaattcatatgaggatgcaatgatgccctttcccggagcaaccatcatctcccagctgctgaaaaacaatatgaacaaaaacggaggaactgagccttccttccaggcaagcgggctctcttcgacagggtccgaagtgcatcaggaggatatctgtagtaatagctcgagagattctccaccagagtgcctgtctccattcggacggcccaccatgtcgcagttcgacatggacaggctctgtgatgagcatctaagggcgaagagagcccgggtcgagaacatcattcggggcatgtctcattcaccttcggtcgccctcaggggcaacgagaacgagcgagaaatggcaccacagtcagtgtccccaagggaatcttaccgggagaataagaggaaacagaaacttcctcagcagcagcagcagtccttccagcagttggtgtcagccaggaaggaatag

SEQ ID NO: 130187 - DNA, 2214 bp, Artificial Sequence
  Description of Artificial Sequence: Synthetic coding sequence
atgcccgatcacgacagcactgcattgctgtctcggcagactaaacggcgcagggttgatatcggagtgaaacgaactgtcggaactgcctctgcattttttgccaaagctagggccacattcttcagcgccatgaacccccagggatctgagcaagacgtggagtattcagtggttcagcatgcggacggtgagaagtcaaatgtgcttagaaagttactcaaaagggcgaattcgtacgaagatgctatgatgccattccccggcgctactatcatcagccagctgctcaagaacaatatgaataaaaatggcggtaccgagccttcctttcaggcttcaggactgtctagcacaggaagcgaggtccatcaggaagatatctgctctaattcctctcgggacagcccaccagaatgtctttctccctttgggcgccctaccatgagccagttcgacatggacagactttgcgatgaacacctgcgggccaaacgagctcgggtggagaacattatcagggggatgtcacactcacctagcgtcgccctgcgcggaaatgaaaacgagagagagatggcaccacagtccgtgtccccacgagagagttatcgcgaaaacaaacggaaacagaagttaccccaacagcagcagcagtccttccaacaattagtttccgctagaaaagagcaaaagagagaagagcgccgtcagctcaagcagcagttggaggacatgcagaagcagcttcgacagttgcaggaaaagttttaccaaatctatgactctaccgactccgaaaatgatgaggacggcaatctgtcggaggattcaatgagaagtgaaatcctagacgctagagcccaggattccgttggaaggtcagataacgagatgtgtgaactggaccctgggcagttcatcgaccgtgcgagagcgctcattagggaacaggagatggccgagaacaagccaaaacgtgagggaaataataaggaacgcgaccatgggcccaattctttgcagccagaggggaagcatcttgccgagacactgaaacaggaactgaacacagcgatgtcccaggttgtggatactgtggttaaagtgttttcagcaaagccgagccgacaggtgcctcaggtgttccccccgctgcaaattccccaggctcgattcgccgtgaacggagaaaatcacaattttcacacagctaatcaaaggctgcaatgctttggcgacgtgatcattcccaatccactggatacctttggaaacgtgcagatggcgtccagcaccgatcagacagaagcccttcctttagtggtgagaaagaatagttcagatcagagcgcatcgggacctgccgcaggtgggcaccaccagccacttcaccagagcccactaagcgccaccaccggtttcacaacttccacgtttaggcacccctttcccctccccctgatggcctacccattccaatcccctctcggcgcaccatccgggtccttctccggcaaggatagggcttcccctgaatcactggatttgacacgggacacgacctctttaaggaccaagatgagctcacatcacctcagccatcacccttgtagcccagcccatccaccgagcaccgcagaagggctgagtctcagcctcattaaatcagagtgtggcgatttgcaagacatgagtgagatctctccgtactctggttctgccatgcaggagggcctatcaccaaatcacctgaaaaaagccaaactcatgtttttttacacaaggtacccctcatctaatatgctgaaaacatacttctccgacgtcaaattcaatcgttgtatcaccagtcagctcatcaaatggtttagcaatttcagggagttctactacatacagatggagaagtacgcccgccaggccattaacgatggcgtgacctcaactgaagaactctccatcaccagggattgcgagctgtacagggctctgaacatgcattacaataaagcaaatgacttcgaagtgccggaaagatttctcgaagtcgcccagatcaccctgagagagttctttaacgccattattgcaggcaaggacgtcgacccctcctggaaaaaagctatttacaaggtgatctgcaaactcgattcagaggttcccgaaatattcaagagccctaactgcctccaggagctgttacacgagtag

SEQ ID NO: 130188 - DNA, 930 bp, Artificial Sequence
  Description of Artificial Sequence: Synthetic coding sequence
atggccagctctacagaccaaacagaggctcttccacttgttgtgcgaaaaaacagtagtgaccagtctgcctccggtccagccgccgggggacatcatcagcccctccaccagagccctctatccgcaacgaccggttttactacaagtacctttagacaccccttccctctaccgctaatggcatacccatttcagagtccgctgggtgccccatctggatctttctctggaaaggatagagcctcacccgaatccctagaccttacccgagacaccacttctctccgcacaaaaatgagttcacaccatttatcccatcacccttgttcacccgctcacccccctagtacagccgaaggactttccctaagtctgattaaatcggagtgcggcgacctccaggacatgtctgaaatctccccttattcaggctctgctatgcaagagggcttatcccccaatcacctcaaaaaggccaagctgatgttcttctacactcgatatccctcctctaatatgctgaaaacctatttctcggacgtgaagttcaatcgctgtattacaagccaactgattaagtggttttccaactttagggagttctattatatccaaatggaaaagtatgcaagacaggccatcaacgatggcgttactagtactgaagaactaagcattaccagggactgcgaactttatagagccttaaatatgcattataataaggccaacgacttcgaggtaccagaacggttcctcgaagtggcacagatcacattacgggagttttttaacgcgataattgctggtaaagatgtcgatccttcatggaagaaagcaatttacaaggtgatctgtaagcttgacagcgaagtgcctgaaattttcaagtcacccaattgtttgcaggaactgttgcacgaatag

SEQ ID NO: 130189 - DNA, 1080 bp, Artificial Sequence
  Description of Artificial Sequence: Synthetic coding sequence
atgaagtcacccttctatcgatgccaaaataccacatctgtggaaaaaggtaactcagcggtgatgggaggagtgcttttcagtaccgggctgttgggcaatctcctggcccttggactgctagcaagatccgggctgggttggtgcagtagaaggccactaaggccactgccttctgtgttttacatgcttgtctgtgggctaacggtaacagatcttttagggaagtgtctcctgtcgcctgtggtgctcgcagcctacgcacaaaaccgctctctccgcgtcctagcgcccgcactggacaatagcctatgtcaggctttcgcctttttcatgagtttcttcggcctgagttcaaccctgcagcttctggctatggctctagaatgctggttgtctctgggccaccctttcttctatcgacgacacattacacttcggctgggcgccctggtagcacctgtggtgagtgcattctctctggctttttgcgcgctccctttcatgggcttcggcaagttcgtgcagtactgccctgggacttggtgtttcattcagatggtgcacgaggaaggctccctgtccgttctgggatatagtgtactctacagtagtctcatggcccttttagtgctggccacagtactctgcaacctaggggcaatgaggaacctctatgcaatgcatcgcaggttgcagcgccacccacggtcttgtacacgcgactgtgccgaacctcgagccgatggtagggaagcgtccccacaaccactcgaggaacttgaccacctccttctgctagccctgatgaccgttttattcactatgtgcagcctacctgtcatatacagagcctattatggcgcattcaaggatgtgaaggaaaaaaatagaacttcagaagaggccgaggatttacgtgccctgagattcctgtccgtcattagtattgtcgatccgtggatctttattatttttagatcacctgtgtttcgcatattctttcacaagattttcatcagacccctgagatatcgttctaggtgttccaactctacaaacatggagagctcattatag

SEQ ID NO: 130190 - DNA, 8034 bp, Artificial Sequence
  Description of Artificial Sequence: Synthetic coding sequence
atgagcacatgctgttggtgtactccaggaggggcgagcaccattgacttcctcaaacgctacgccagcaacacgcctagtggtgaatttcagaccgccgacgaagacttgtgctattgccttgagtgtgttgcagaataccacaaggctcgagatgagctccccttcttacacgaggtcttgtgggagcttgagactctgcgtctgatcaatcatttcgaaaagagcatgaaagcagaaattggcgacgacgacgagctctacattgtggataataacggggaaatgccactgtttgacatcaccgggcaggacttcgagaataaactgcgcgtgcccctgctagagatcctaaagtatccttacttactgcttcatgagcgggtgaacgagctgtgtgtagaagcgctgtgccgtatggagcaggcgaattgcagcttccaggtatttgataagcacccaggtatttacctgtttctggttcatcccaacgagatggttagaaggtgggctattcttaccgctcgaaatctcggaaaggtggacagggacgattactatgacttacaggaagtcctcctgtgcctgttcaaagtgattgagctggggttgcttgagtccccggacatttacacttcttccgtgctcgaaaaaggcaagctgatccttcttccctcccacatgtatgacacaaccaattataaatcctactggttgggtatttgcatgctcctgaccattctcgaagagcaggctatggactccctgctactcggttctgacaaacagaatgactttatgcagtctatcctgcataccatggaacgcgaggccgatgacgactcagtggatcccttttggccagcgctccactgttttatggtgatccttgatcgcctgggcagtaaggtgtggggccagctcatggaccctatcgtggcctttcagactatcattaacaatgcctcatataacagggaaataaggcatattagaaactcctctgtcagaactaagctggagccagagagttaccttgatgatatggtaacatgctcccagatcgtctataactacaatcccgaaaagactaagaaagattctggttggagaacagccatctgtccggattactgtcctaacatgtacgaggaaatggaaactctcgctagtgtcctgcaaagtgacatcgggcaggacatgagagtccacaatagtacttttctgtggtttattcccttcgtacagtcactgatggatctcaaagatctgggcgtcgcttacattgcacaagtcgtgaatcacctgtacagtgaggttaaagaggtgttaaatcagacagatgcagtctgtgataaagtaacagaattttttctgctgatactcgtgagtgtcatagaactccaccggaataagaagtgtctccatctactgtgggttagcagtcagcagtgggtggaagccgtggtgaagtgtgctaagttgcccacaacagcatttacccgaagttctgaaaagagcagtgggaactgttccaagggcaccgcaatgatttccagccttagtctgcatagcatgccaagcaactctgtgcagctggcctatgtgcaactgatcagaagcctgctcaaggaaggctatcagctcggtcaacagtccctgtgtaagaggttttgggacaaacttaacctgtttctgcgcggtaaccttagcctcggttggcaattgacttcgcaggagactcatgaactccagtcctgtctgaagcagattatcagaaacataaagttcaaggcaccgccctgcaacaccttcgtggatctgacttctgcctgcaaaatctcaccagcatcttacaacaaagaggaaagcgaacaaatgggaaagacgtctcgtaaggacatgcactgcctagaggcatcatccccaactttcagcaaggagccaatgaaagtgcaagatagtgtgttaatcaaggctgataacactattgagggcgataataatgaacaaaactatatcaaggatgtgaaactggaggaccatctgctggccggatcttgcctcaagcagtcatcaaagaacatcttcacagagcgcgcagaagaccagatcaagatatcaactagaaaacagaagagcgtaaaggaaatctcatcctatacacctaaagactgcactagcaggaatggtccggagcgtgggtgtgataggggtataatcgtgtccacccggttgctcacagattccagcacagatgcactggaaaaagtcagtacatccaacgaggactttagcctgaaagacgacgctttagccaagacatcaaagaggaaaactaaggtgcaaaaagacgaaatatgtgctaaattgtctcacgtcattaagaaacaacacaggaagtctactttggtagataatactatcaacttggacgagaacctgaccgtttctaatattgaatctttttattcgcggaaggacaccggcgttcagaagggggatggttttattcacaacctgagcttggatccttccggggtactcgatgataaaaacggggaacagaagtcccagaataacgtgctaccaaaagaaaaacagcttaagaacgaagaacttgtgatcttcagttttcacgaaaataattgcaaaatacaggagttccacgtggatggaaaggagctgatcccgtttacagagatgacaaacgcctctgagaagaagtccagccctttcaaagatctgatgaccgtacctgagtctcgggacgaggagatgtctaacagcacctcagtcatctactctaatctgacacgcgaacaggctcctgacatttcccccaagagcgacaccttgacggattcacaaatcgatcgcgaccttcacaaactcagcctgcttgctcaagcttccgttattacctttccaagcgattcaccacaaaactccagtcagctgcagagaaaggtgaaggaggacaagcggtgttttacagcaaatcagaataatgttggtgatacttcgcgcggacaggtgatcatcatctccgactctgacgacgatgatgatgagaggatcttgagtcttgagaaactcacgaagcaggataagatctgcctggagcgggaacaccctgaacaacacgtgagcacagtgaatagtaaagaggagaaaaaccccgtgaaagaagaaaaaaccgaaaccttgtttcagttcgaggagtccgattcacagtgtttcgaattcgagtcgtccagtgaagtcttctctgtatggcaggaccaccccgacgataataattctgtccaggacggggaaaaaaagtgtttggcccccatagccaacactacgaatggccaggggtgcaccgactacgtctcggaggtggtgaaaaagggtgcagagggcattgaggaacacaccaggcctcggagtatatcagtggaggaattctgcgagatcgaggttaaaaaacccaagcggaaaaggtcggaaaaacctatggccgaagaccctgttaggccctcatcaagcgtaaggaacgagggccagtccgacacaaacaaacgcgacctcgtgggaaacgactttaagtcaatagaccgtaggacaagtacaccaaatagccggatacagcgggcgactactgtatcgcagaagaaaagcagcaagctttgtacatgcacagagcccattcggaaggtgcccgtaagcaagacaccaaagaaaacccactccgatgctaagaaaggccagaatcgatctagcaactatctgagctgccggacgacacctgctatcgtacctcctaagaagtttaggcaatgcccagagcctactagtacggcagagaagctcggactgaagaagggcccccgcaaagcctacgaactctctcagcggagccttgattacgttgcacagctacgggatcatgggaagacagttggagttgtcgatactagaaaaaagaccaagctcatttccccccagaacctttccgtccgcaataataaaaaactactcacctcccaggagctgcagatgcagagacagatccgacctaaaagccagaaaaatcgtagaagacttagtgactgtgagagcacagacgtgaaacgcgctggcagccataccgctcagaattctgacatatttgtgccggaaagcgaccggtccgattacaattgtacagggggcaccgaggtccttgccaactccaacagaaagcaactaatcaagtgcatgccgagtgagcctgagaccattaaagcaaagcacggatctcccgctacagatgacgcctgccccttgaatcagtgcgactctgtcgtgctgaatggcacagtacctacgaatgaggtcatcgttagtaccagcgaagacccactcggagggggggaccccacagcacggcatatcgaaatggctgccctgaaagaaggggaacccgactctagcagcgacgcagaagaagacaatctgttcctgactcagaacgatccagaagacatggatctgtgctcccaaatggagaacgacaactacaagctaattgagcttatccatggaaaagataccgtcgaggtagaggaagattctgtgtcaaggcctcagctagaatccctaagcgggaccaagtgtaaatacaaggattgtttagagactacgaagaaccaaggcgagtactgtccaaaacattccgaggtgaaggccgcagatgaggacgtcttccggaagcctgggcttcccccgcctgcgtccaaaccactgcgacccactactaaaatattttctagtaagtctactagtcgtatcgccggattgagtaagtctctggagacctccagcgccctgtccccctctttgaagaacaaaagtaaggggattcagagcattctcaaagtgccccagccagttcccctcatcgctcagaaaccagtgggagagatgaagaattcctgcaatgtgctgcacccacagtcccctaacaattctaaccggcagggttgcaaggttcctttcggggagagcaagtatttcccctccagtagccctgtgaacattctgctgtcttcgcagagcgtatccgatacattcgtgaaagaagtgctgaaatggaaatatgagatgtttttaaatttcgggcagtgcggccctccggcatctctttgccaatccatttctcgccccgttccagtcaggtttcacaattacggagattattttaatgtcttcttccctttgatggtgctcaatactttcgagaccgtagcacaagaatggctaaattctccgaaccgcgaaaatttctatcagctgcaggttaggaaatttccggcggattacattaagtactgggagtttgccgtatacctcgaggagtgcgagcttgccaagcaactttatcccaaggagaacgacttagtctttctggcgccggagcgcataaacgaggaaaaaaaggacaccgagaggaacgatattcaggatctgcatgagtaccatagcgggtacgtgcacaagttcagacgcacgtctgttatgcgaaatggcaaaaccgagtgctatctgtccattcaaacgcaagagaacttccctgctaatctgaacgagttggtaaattgtatagtgatttcaagcttagttaccacacagcggaaattgaaggcgatgtcgctgctgggcagtcggaaccaactggcgcgagcggtcctcaatccaaatccgatggacttctgcaccaaggacctgctgacgaccaccagcgagcgaattatcgcatacctgcgagattttaacgaggatcagaaaaaagcaatagaaacagcctacgcaatggtgaagcattcccctagcgtagctaaaatctgcttgatccacggaccgccgggcacagggaagtctaagacaatagtcggtctcctgtatagattactcacagaaaatcagcgcaaaggacactccgacgaaaattccaatgcaaagatcaagcagaaccgcgtcttagtgtgtgcccccagtaacgcagcagtggatgagttgatgaagaaaattatcctagagtttaaggagaaatgtaaagacaagaagaacccacttggtaactgtggcgatatcaaccttgtacgtctgggtcccgagaagtctatcaactctgaagtgttaaagttctctttggacagtcaggtgaaccacaggatgaaaaaagaactcccctcccacgtacaggccatgcataagcggaaagagttcctggactatcagctcgacgagttgagccgtcaaagggctctgtgtcggggcggaagagagatccagaggcaagagttagatgagaacatttcaaaggtaagtaaggagcgccaggagttggcgtccaaaatcaaggaggtgcaaggtagacctcaaaagacgcagagcatcattatactcgagtctcatataatctgttgtacgttgtccacttctggtggcctactgctagaatctgcattccgcggccagggcggggtgccatttagctgtgtgattgtggacgaagctggccagagctgtgagattgaaacacttaccccactcattcaccggtgcaataaactgattcttgtgggggaccctaagcaacttccacctacggtcatctctatgaaagctcaggagtacggctacgatcagtccatgatggcaagattctgtagattactggaggagaatgtagagcacaacatgataagtcgccttcccatcttacagctgactgtgcagtacaggatgcaccctgacatctgtctctttcctagtaattatgtctacaacagaaacttaaagaccaatcgacaaaccgaggctatcagatgtagttccgactggccattccaaccatatctggtgttcgacgttggtgacggatcagaaagaagggacaacgacagctacatcaacgtccaggagataaagcttgtgatggagattatcaagctcataaaagacaagaggaaggatgtatcattccgaaatattggcatcatcactcactacaaggcacagaagaccatgatccagaaggatctggacaaggaattcgatcgtaaaggtccagcagaggttgacactgtcgacgcgttccagggaaggcaaaaggactgcgttatcgtgacatgcgtgagagccaacagcattcagggctctatcggctttttggcatccctgcaaagattgaacgtaacaatcacgagggctaagtacagcctctttatcttgggtcatctgagaaccctgatggagaaccagcactggaatcagcttatccaggatgctcagaaaaggggtgccatcattaagacctgtgacaagaactatcggcacgatgcagtgaaaatcctgaagttgaagcctgtcttacagcgatccctcactcatccaccaaccatcgccccagagggctctcgccctcaggggggtctccctagctcgaaactggatagcgggttcgcaaaaaccagcgtggctgccagcttgtatcatacaccctcagatagcaaggagattacactgacagtgacatcaaaagatcctgaacgacccccggtgcacgatcagctgcaggatcccaggctccttaagcgaatgggtatcgaagtcaaaggggggatttttctgtgggacccccagcccagctccccccagcacccaggagccacccctcctaccggagagcctggttttcccgtcgtgcatcaggatctctctcatattcaacagcccgcagccgtagtagcagcactttcaagccacaaacctccagttcgcggggagcctcccgcagcctcgcctgaggcaagtacctgccagagcaagtgtgatgaccccgaagaagagctgtgccaccggcgtgaggccagggcctttagtgagggggaacaagaaaagtgtggctccgaaacccatcacaccagacgcaatagtaggtgggacaaaaggacattggaacaggaagactcttcctccaaaaagcgcaaattactctag

SEQ ID NO: 130191 - DNA, 483 bp, Artificial Sequence
  Description of Artificial Sequence: Synthetic coding sequence
atggccacccaccacaccctatggatgggcctagcactgctgggcgtccttggtgacctccaggccgcacctgaagcacaggtgtcagtgcaaccaaatttccaacaagacaagttcctcggcagatggttttctgccggcctggcatccaactctagttggttgagggaaaagaaggcagccctttctatgtgtaagagcgtagttgcacccgcgaccgacgggggtctgaacctgacctcaacttttctcaggaaaaatcagtgtgagaccaggaccatgctccttcaaccagccgggagtcttgggagctattcctaccggagcccccgggaatggggccttcatcgccctccgggaccatcactgggtgccaccctagctggcaccactttggggcagcccccagccgccgagattcacggcgtaggcggagacggttgtcccacgtctgtgaggggtaagggtcaagcttgggcgtag

SEQ ID NO: 130192 - DNA, 573 bp, Artificial Sequence
  Description of Artificial Sequence: Synthetic coding sequence
atggctacacaccatacactgtggatgggactggccctgctcggggtgttaggagaccttcaagcggcaccggaggcgcaggtcagcgtccagcctaacttccagcaggataaatttctgggacggtggtttagcgcgggactcgcttcaaactcttcttggctgcgcgagaagaaggccgcactgtccatgtgcaagtctgttgttgcaccagcaacggatggtggtctgaatctcacgagtaccttcctccggaagaaccagtgtgagaccagaaccatgcttctacagcctgcaggttctttaggctcttatagctacagatcaccccattggggctccacctactccgtctccgtcgtggaaactgattacgatcagtatgctctgctgtatagccaggggagcaagggccccggcgaggactttcgtatggcgactctttactcgaggacacagacgccccgagcggaactaaaagaaaagtttacggctttctgcaaggcccagggcttcaccgaggacaccatcgtgtttctgcctcaaactgataaatgcatgactgaacaatag

SEQ ID NO: 130193 - DNA, 189 bp, Artificial Sequence
  Description of Artificial Sequence: Synthetic coding sequence
tagggttatcattgtctgccggcgcccaaccgggcccagggagaagttggcggtgatggtgggtccgttcaattcggtggcagtgtcaaaacctcttcagcactgagggaggagcaggaagcgcagtgggagaattggccaaaatccggggttctgactactgcaccaggcttcttcttgggacgatag

SEQ ID NO: 130194 - DNA, 642 bp, Artificial Sequence
  Description of Artificial Sequence: Synthetic coding sequence
taactgcgcggcggcggacagttcttgggacgcggcgtccgtggcgtcgccgctagggggatcggacggggcgggggcgccggtttggagacgggaggcgtagacggcagaggggcacctgctggcagacggcgatgggttcgccgcgtactggcagacgctggcggcggaaggtcacctcagttcctgggcaggtggttttctgctggcttagccagcaatagcagctggttgcgtgagaagaaggcagcactgagcatgtgtaagtccgtggtcgctccagccacagatggggggctgaatctcacttccacctttctacggaagaatcaatgtgaaacacggacgatgctgttgcaacctgcaggttccctgggctcatatagttatcgctctcctcactggggttctacatattcagtaagcgtagttgagacagactatgatcagtatgcactgttgtactcccagggaagcaaaggccccggggaagatttccgaatggccaccttgtacagccgcacccagacccctcgggcggagctgaaggaaaagttcacggccttttgcaaagcccagggtttcacagaagacaccatcgtttttttaccccaaactgataagtgcatgactgagcagtag

SEQ ID NO: 130195 - DNA, 588 bp, Artificial Sequence
  Description of Artificial Sequence: Synthetic coding sequence
atggccactcaccacacgctctggatgggcctcgccctgttgggagtccttggcgacctacaagctgcccccgaagcacaggtgtctgtgcagcctaactttcagcaggacaagttcttgggaaggtggttttccgcaggcctggcctccaactcgagttggcttcgggaaaagaaggccgctctgtctatgtgcaaaagtgtcgtggcccctgccaccgacggtggactgaaccttacctctacatttcttcggaagaaccaatgcgagacccgaacaatgttgttacagcccgccggctctcttggtagctacagttatcgcagccctcgggaatggggcttgcatcggcccccggggccttccctgggagccaccttggccgggactacactcggtcagcctcctgccgcagagattcatggcgtcggagattgggggtctacatactcagtttccgttgtggaaacggattacgaccagtacgctctcttatattcccagggaagcaagggccccggcgaggacttccgaatggcaactctctatagcagaactcaaacaccgcgcgcagagttaaaggagtag

SEQ ID NO: 130196 - DNA, 573 bp, Artificial Sequence
  Description of Artificial Sequence: Synthetic coding sequence
atggccacccatcatactctgtggatgggactggccctgctgggagtgctcggagacttgcaggccgccccagaggcacaagtgtcagttcaaccgaattttcagcaagataaatttctgggccggtggttttctgccggactagcatcaaactccagttggctgagggagaagaaggcagctctctccatgtgtaaaagcgtggtggccccagctaccgatggtgggttaaacttaactagcacctttctaagaaaaaatcaatgtgaaacgaggactatgctcctccagcctgctggcagcctgggttcttattcttacaggtccccccactggggctctacctactcggtctcagtggtggaaacagactacgaccagtacgcgctactgtatagccaaggcagtaagggccccggcgaggacttcagaatggctaccttgtactccagaacccagacgccccgtgcagaattaaaagaaaagttcactgctttttgtaaggcacaggggtttactgaggacaccatcgtgtttttaccgcagacagataagtgcatgacagagcagtag

SEQ ID NO: 130197 - DNA, 1209 bp, Artificial Sequence
  Description of Artificial Sequence: Synthetic coding sequence
atgtccccatgcggacctctcaatttaagtctcgcaggtgaagccaccacttgcgcagctccgtgggtccccaacacctccgcagtccctccgtccggagcttctcccgctctcccaatcttctccatgacactgggtgctgtaagtaatctcttggctttagcgctgttagcccaggccgctggccgtctcaggaggaggagatcagccgccacctttctattgttcgtggcgtccttactggctaccgatctggcagggcacgtcatcccaggagctttggtgctgcgactgtatactgcaggacgggcccccgccgggggcgcttgccattttttgggaggatgtatggtgttcttcggactgtgccctctactgctggggtgcgggatggccgtagagcggtgtgtgggggtgacaaggcccctactccacgcggcccgtgtatcggtggcccgagcccgcctcgcactggcagccgtggccgcggtcgccttggccgtcgcactgcttccattggcccgtgtgggaagatatgaactacagtaccccggtacttggtgctttatcgggctagggcctccaggtgggtggcggcaggccctcctcgctggtctatttgctagcctgggcctggtggcgcttttggctgccctggtgtgcaataccctgagcggtctcgcgttgctgagagcgcggtggagaaggcgcagcagaagaccgccccccgcaagcgggcccgattcgaggcgaagatggggcgcgcatgggcccaggtcagccagtgcatcttctgccagctcaatcgcttcagcaagcacattttttgggggttctaggagttcgggcagcgctcgtcgcgcacgagctcatgacgtggagatggtgggtcaactggtgggtatcatggttgtcagttgcatatgttggtcccccatgttggtgctggttgcattagcagtagggggctggagttccaccagcctacaaaggcctctcttccttgccgtaagacttgcatcctggaatcagatcctagatccctgggtttacatcctgctccggcaagcagttctgcggcaacttctcaggttactccctcctcgagctggggcgaaaggagggcccgctgggttggggctgacaccatcagcctgggaggcatccagtctgcgcagctcccgacatagcggccttagccacttttag

SEQ ID NO: 130198 - DNA, 1077 bp, Artificial Sequence
  Description of Artificial Sequence: Synthetic coding sequence
atgggtaacgccagtaacgattcgcaaagtgaagactgcgagacacggcagtggctcccacctggagagtccccagcaattagctcagtgatgttctccgctggggtactggggaatctgatcgctttggctctcctggctcgtaggtggcgcggagatgttggttgttctgctggccggagatcgagtttgagtctgttccacgttctcgtgacggaactggtgttcacagacctgctcgggacatgccttattagccccgtggtgctggcctcatatgcaagaaatcagactctcgtagctttggcgcccgaaagccgtgcatgcacgtattttgcgttcgcaatgacatttttctccctagccaccatgctgatgctgtttgcaatggccctggagcgctacttgtctatcggacacccctacttctaccagcgtagggtttccaggagtggaggactggctgtgctccccgtaatttatgcagtttctctgcttttttgctcgcttccactgcttgattacggacaatacgtgcagtattgccctgggacctggtgtttcattcgtcacggtcggaccgcatatctgcagctgtatgcaaccttgctcctgctgttgatcgtttccgtgctcgcttgtaacttctccgtcatactgaatctgatcagaatgcatcgtcgctctcgccgatccagatgcggcccaagcctcggaagcgggcgcggaggacccggagctcggcgtcgtggggaacgtgtatccatggcggaggaaaccgaccacctaatactgcttgccatcatgactattacattcgccgtgtgttccctcccctttacaatttttgcctatatgaatgagacctcttcgcggaaggagaagtgggaccttcaagcccttcgcttcctctccatcaattctatcatcgatccttgggtttttgccattctgaggccgccagttctgaggctaatgcgatcagtactgtgttgtcgtatttctctccggacacaggacgcaacccaaacctcctgttccactcaaagcgatgcgtccaagcaagcggatttatag

SEQ ID NO: 130199 - DNA, 1173 bp, Artificial Sequence
  Description of Artificial Sequence: Synthetic coding sequence
atgaaggaaaccagaggttatggtggcgatgccccattctgtactcgcctgaaccatagctatacaggaatgtgggcaccagagagaagcgcagaagcgcggggtaatctaaccaggccgcctgggagtggtgaagattgcgggagcgtaagtgtcgcttttcctattaccatgcttctgaccggctttgtcggcaacgcgctggcaatgttactggttagccggagctacagaaggcgggagtccaagcggaagaaaagctttctcctctgtattggatggttagccctcacagatcttgtcggtcagcttctcaccacgcccgtggtaatcgtggtttacctgtctaaacagaggtgggagcacatcgacccatccggccgactttgtaccttcttcggactgaccatgacagtcttcggactgtcaagcctgttcatcgctagtgctatggccgtagagcgcgcacttgctattcgcgctccacactggtatgccagtcacatgaaaacccgcgctacgagagccgttctcctcggagtgtggctggcagtcttggcgtttgctcttctcccagtgttgggagtgggacagtatactgtgcagtggcccggcacttggtgttttatctcaaccggtagaggtggcaatgggaccagcagctcccataactggggcaatctattcttcgccagtgcttttgcatttctcggtctgctggcattgactgtgacgttctcgtgcaacctagcgaccatcaaggcactcgtgtcaagatgtagggctaaggccacagctagccaatctagcgcacagtggggcaggattacaacagaaacagccatccaactaatgggcatcatgtgtgtcctgtccgtgtgctggtcccccctccttatcatgatgctcaaaatgatttttaaccaaaccagtgtggaacactgtaagacccacacggaaaagcagaaagaatgcaattttttcctgatcgcagttagactggcaagcttaaaccagatcctcgatccctgggtgtatctgctgcttaggaagattttgttgcgcaaattctgccagatccgttaccacactaacaattatgcttctagctcaacttccctaccttgtcagtgctctagcacattgatgtggagcgaccacctcgagcgctag

SEQ ID NO: 130200 - DNA, 1260 bp, Artificial Sequence
  Description of Artificial Sequence: Synthetic coding sequence
atgaaggagacgcggggctacggaggggatgcccctttctgcacccgcctaaaccacagctataccggcatgtgggcccccgaacggtccgcggaagcaagaggcaatctgaccaggcctccgggatccggcgaagactgcggcagtgtcagcgttgcgtttcctatcactatgctactcaccggtttcgtcggaaatgcattggccatgctcctggtgagcagatcttaccggcgccgggaatcaaagaggaaaaagagctttctactctgcatcgggtggctggccctgactgacctggtcggtcaacttctgaccactccggtagttattgtagtctatctgagtaagcaacggtgggaacacatcgacccctctggcaggctttgtaccttctttggcctgaccatgacggtcttcgggctgtcgtctctgtttatcgcttcggctatggcagtcgagcgggctctggccatcagggccccccattggtacgcatcccatatgaaaactcgagcgacaagagctgtgctcttaggcgtgtggctggcagttctggcctttgccctccttcccgtccttggcgtcggacaatatacggtgcaatggccagggacatggtgctttattagcactggtcgggggggaaatggcacaagcagttcgcataactggggcaacttattctttgcttccgcttttgcatttctcgggctgctcgctctgaccgtgacttttagttgcaacttggcgactatcaaagcccttgtgagtcggtgccgggcaaaagctaccgcatcgcaatctagcgcacagtggggcagaataacgactgagacggctatccaattgatggggattatgtgtgttttgtctgtgtgttggtctcctttactgatcatgatgttgaaaatgatctttaaccagaccagtgtggaacattgtaaaacccacacggaaaagcaaaaagagtgcaacttcttcctgatagctgttcgtttggcgtcgctgaaccagatactcgacccttgggtatatctgttactccgtaagattttgctgagaaaattctgccaggttgccaatgccgtgagcagctgcagtaacgacggccagaagggccagcccataagcctttccaatgaaattatccagaccgaagcaatcagataccatacaaataactacgcttccagcagcacatcgcttccatgtcagtgtagtagtactcttatgtggagcgatcacctagaacgttag

SEQ ID NO: 130201 - DNA, 1290 bp, Artificial Sequence
  Description of Artificial Sequence: Synthetic coding sequence
atgaaagagacaagaggttacgggggcgatgcaccattctgtaccagactgaaccactcctacacggggatgtgggctccagaacgctccgcggaggcccgcggtaatcttactcggccacctggctctggtgaagattgcggatccgtttccgtggccttccccatcacaatgctgctgacggggttcgttggcaacgccttagctatgctgctggtctcgagatcctacaggagacgcgagtcaaaacgcaaaaaatctttcctgctgtgcatcggctggctcgccctgaccgatttggtcgggcagctactcactacccccgtagtgatcgtggtttacctgtccaagcagagatgggaacacatcgatccttcagggagactgtgtaccttttttggcctaactatgacagtattcgggctgtcttccctgttcatcgcttctgccatggccgtggaacgggcgctggcaatcagggctcctcactggtacgcttctcacatgaaaaccagggctacaagagcagttctgctgggggtgtggttggctgttctagctttcgccctactgcccgtgttaggcgttggccagtacacggtccagtggcctgggacctggtgtttcatttccacgggccggggcggtaatgggacctcctccagccacaactgggggaatttgttctttgcttctgcctttgcattcttgggactccttgcccttactgtaactttcagttgcaatcttgcgacgatcaaagccctcgtatcaaggtgtagagccaaagccacagcaagccagtccagcgctcagtggggacgcatcacgaccgagactgccattcagctaatgggcatcatgtgtgttctcagcgtgtgttggtctccactgctgataatgatgctgaagatgatttttaatcagacctccgttgaacactgtaagacacatacagagaagcaaaaggagtgcaatttctttctcatcgccgtgcgcctcgcaagcttgaatcagatattggatccctgggtctatcttctgttgcgcaagatccttctgcgtaagttctgtcagatgaggaagcgtcggttgcgggagcagttctggaggcccgcgtctagcggttcgggatgccaacagataaggtgtctcatggagagttgctcactcacccagactggagtccagtggagtgacttccggagtctccagccgtccccaccgccattaaccgcaatattcgcttcctgggttcaggtcattctcctcccccagcccccaaagtag

SEQ ID NO: 130202 - DNA, 1257 bp, Artificial Sequence
  Description of Artificial Sequence: Synthetic coding sequence
atgaaagagacgagaggatacggcggagatgcaccattttgtactaggctgaatcatagctacacagggatgtgggcgcctgaaagaagcgcagaagcccgcggaaacttgacccgaccgccaggatcaggggaggactgcggctctgtatccgtcgctttccctataaccatgctcttaacagggtttgtcggtaatgcactggccatgttgctggtttctcgatcttataggagaagggagtctaaacggaaaaagtccttcttattgtgcatcgggtggctggcactgactgaccttgtgggacagctgttgaccacaccagtggtgatcgtcgtgtacttgagtaagcaacggtgggaacacatagacccctcaggaaggctgtgcactttttttggcctaacaatgaccgttttcggtctgtctagcctatttatagcctctgctatggcagtggaaagggcgctcgccatccgtgcaccgcattggtatgctagccatatgaaaacacgagcgactcgagcagtgctgctgggggtgtggctagccgtactggcgttcgctctcctacccgtcctgggtgtggggcaatataccgtccaatggcccggaacatggtgcttcatctccacaggcagagggggaaatgggacctcctcctcccacaactggggaaaccttttcttcgcgagcgcctttgctttccttggactgcttgcccttaccgtgactttcagctgtaatctggcgacaattaaggcgttggtctcgcggtgtcgggccaaggctaccgcttctcaatcttccgcgcagtgggggcggatcaccactgaaacggctatacaactgatgggtatcatgtgtgtactttctgtttgctggtctcccttgcttatcatgatgctgaagatgattttcaatcagacaagcgtcgagcattgcaaaacacacacggaaaagcagaaagagtgtaatttctttctcattgccgtgagattggcttcactgaaccagatcctcgacccctgggtctatctgctcctgagaaagatcctgttgcgcaaattttgccagatgcgcaaacgccgtctgagggaacaactgatctgttctctgcagaatagccagattcaacgagctaccgcacattgtggccaagtgcagacataccgtgtgctcaatcgagaggaaatggaggttctggttagtagcattaacgtgtatacccgcatttctaccgtcaagacagaatag

SEQ ID NO: 130203 - DNA, 1209 bp, Artificial Sequence
  Description of Artificial Sequence: Synthetic coding sequence
atgaaggaaactcgcggctacggaggggatgcaccattctgcacacgactaaatcattcatacaccggaatgtgggcaccggagaggtcagccgaggcccgcgggaatctgacccggcccccaggaagcggggaggactgcggaagcgtctccgtcgctttccccatcactatgcttctgacagggttcgttgggaatgctctcgctatgctgctagtgtcaagaagttatagaagacgcgagtcgaagcgaaagaaatcatttttactttgtatcggatggttggccctgacggacctggttgggcagctgttgacaactcccgttgttattgtggtctaccttagcaagcaacggtgggaacacatagacccgagcggcaggctttgcactttcttcggactaacaatgacagtatttggactgagcagtctctttattgcatccgctatggcagttgagagagctttggccatccgcgccccacattggtacgccagccacatgaagacacgcgcaactcgtgccgttctcctgggggtatggttagcggtgctggcatttgcactgctacccgtgttgggcgtgggccaatatacggtccaatggcccggcacttggtgttttatctccacaggccgggggggtaatggcacatcaagtagccataattggggcaacctgttttttgcaagcgcattcgcttttttaggactcctggcacttaccgttacatttagctgtaacctggccactatcaaggccttagttagcagatgtcgtgccaaggccaccgcctcgcaaagctctgcccaatggggcagaattacaaccgaaacggccattcagcttatggggatcatgtgcgtgctttcagtttgttggtccccgttgctgattatgatgttgaagatgatattcaatcagaccagtgtcgaacactgcaaaacacacactgagaaacagaaggagtgtaacttctttcttattgccgtcaggctggcctctctaaatcagatcctagatccatgggtgtatctcttgctgagaaaaattctgctacgaaagttttgccagatgaggaaaaggagacttcgtgagcaagagatgggccccgatggacgatgtttttgccatgcctggaggcaagtgccacgcacttggtgtagctctcacgatcgggagccatgctcagtgcagcttagttag

SEQ ID NO: 130204 - DNA, 1167 bp, Artificial Sequence
  Description of Artificial Sequence: Synthetic coding sequence
atgaaggagactagaggatacggtggcgacgctccattctgtacgcggttgaaccatagttatactggcatgtgggctccagagcgatccgcggaggcgcggggcaatctgaccagacctcctggcagcggggaggattgtggctctgtctccgtggccttcccaattacaatgctattgaccggatttgtgggtaatgcactggctatgcttctggtatccaggtcatacagacgccgtgagagtaagagaaagaagtcgttcctcctttgtatagggtggcttgcgttaactgatctcgtcggccagctgttgaccacccctgtcgtcattgttgtctacctgagtaaacaaaggtgggaacatatcgacccttccggccggttgtgtacgttttttgggctgaccatgaccgtgtttgggttatcctctctttttattgctagcgctatggccgttgaacgagcactcgctattcgtgccccacactggtacgcttcccacatgaaaacccgggccacgagggccgttttgttgggtgtctggctggccgtgctggcatttgcattactacctgtgctcggcgtgggtcagtatacagtgcaatggcctggaacttggtgctttatatcgaccggccgtggagggaacggaacctcctcatcccacaactggggcaatctatttttcgcaagcgcctttgcatttttgggattgctggcgcttaccgtcacattttcttgcaacttggcgaccatcaaggcccttgtgagccgctgtagagccaaggccactgcctcacagtcttccgcacagtggggcagaattacaacagagacagccatccagctgatgggcataatgtgtgtgctctctgtatgctggagcccccttttaatcatgatgctcaagatgatattcaatcagacctcagtggagcattgtaaaacacatacagagaaacaaaaagagtgcaattttttcctgattgccgtgcgcctagcgtctctcaatcagatccttgatccttgggtgtacctgttgcttaggaagatactcttgcgcaagttctgccaggttgccaatgccgttagctcttgcagcaatgatgggcagaaggggcaacccatctctctttcaaacgaaatcatccaaactgaggcgtag

SEQ ID NO: 130205 - DNA, 1173 bp, Artificial Sequence
  Description of Artificial Sequence: Synthetic coding sequence
atgaaggaaacacgtggatatggtggcgatgctcccttctgcactcggctgaaccactcttacacagggatgtgggccccagagaggtcagcagaagctagaggtaatctgacccggccccccggttcaggagaggactgcggatctgtctccgtggccttcccgatcaccatgcttctaactggtttcgttggcaacgcgctagccatgctcttggtgagccgttcttatcggcgcagggaatccaagcgcaagaaatcctttctactgtgtatcggttggctggccctgaccgatctggtgggacagcttctaacaacaccagtggttatcgtggtgtacctcagcaagcagagatgggagcatatagatccctccggacgtctgtgcaccttttttggattgactatgactgtgttcggcttgtctagcctttttattgccagcgcaatggccgtggaaagagccctggccatccgagctccacattggtatgcctctcacatgaagactagggctacccgggcagtgctgcttggagtgtggctggccgtgttggctttcgctctgttgcctgttcttggtgtgggccagtacactgtccagtggcccggaacctggtgctttatctccacagggcggggcggaaacgggacttccagctcgcacaattgggggaatctgttctttgcttctgcatttgcattcctaggactgctcgctctaacagtcactttctcctgcaacctggcaactattaaagctctggtcagtaggtgccgcgcaaaagccactgcaagccaaagttccgcacaatggggcaggattaccaccgaaacggccatccaactgatgggaatcatgtgtgtgctgtcagtgtgttggtcccctctgttgataatgatgctgaaaatgatattcaatcagacaagcgtggagcattgcaagacgcataccgagaaacagaaagaatgcaatttctttttaatagctgtgagattagcatccctgaatcagatcctggatccttgggtgtacctgctgttgagaaagatcctcctgagaaagttttgtcagattcggtatcatacaaacaattatgcttcctcctctacatctcttccttgccagtgtagctcaaccctgatgtggagcgaccacctggagcggtag

SEQ ID NO: 130206 - DNA, 1098 bp, Artificial Sequence
  Description of Artificial Sequence: Synthetic coding sequence
atgaaggagactcgcgggtatgggggggacgcccccttctgtacccgtcttaatcacagttacactggcatgtgggcaccagaacgctctgccgaggctaggggcaaccttactagacccccggggtctggagaagactgcggatccgtgtctgttgccttccctataactatgctgttgacagggttcgtgggaaatgctctcgcaatgctgctggtgagtcgttcttatagaaggagggagagcaaacggaagaagagctttctgttgtgcatcggctggctagccctgactgacctggtcgggcagctgctcaccaccccggtagttatcgtggtgtatctcagtaagcaacgttgggaacacattgacccatccgggcggctgtgtactttcttcggcctgacaatgaccgtgtttggattgagcagcctctttatcgcaagtgccatggccgtcgagagagccctggctatcagggccccccactggtatgcgagccatatgaaaacccgggcaacaagagccgttctcctgggggtatggctcgccgtacttgcctttgctctcctgcctgtgttgggggttggccagtatacagtgcagtggcctggaacctggtgttttatcagtaccggtaggggaggcaacgggactagctcttctcacaactggggtaatctcttttttgcctccgcatttgcctttctaggcctgctggctctgaccgtgaccttctcctgcaacctggccactattaaggcattggtgagccggtgccgtgctaaagcaaccgccagccagagtagcgcccaatggggacgcattacaacagagacagcgattcagctcatgggcataatgtgcgtgctgtcagtatgttggtcacccttgctgattatgatgctgaagatgatctttaaccagacatcagtggaacattgcaaaacacacactgagaagcagaaggagtgtaatttcttcttgatcgctgtgaggctggcctctctgaatcaaatcttggacccttgggtctacctgttgctacgcaagatcctcctaagaaaattttgccaggaggaattttggggtaattag

SEQ ID NO: 130207 - DNA, 1365 bp, Artificial Sequence
  Description of Artificial Sequence: Synthetic coding sequence
atgaaagagactcgcggatacggaggtgatgcacctttttgcactcggcttaatcactcttacactggcatgtgggcccctgaacgttctgccgaggctagaggaaacctgacgaggcccccaggctctggagaagactgcggcagtgtgtcagttgctttccctataaccatgcttctgacaggattcgtggggaatgcactcgctatgctcctggttagccgcagttacagacggcgcgaatcgaaaaggaagaaatctttcctgttgtgcatcggatggctggcgctgaccgatctcgtcggccagctcctaacaactcctgtggtgatcgtggtgtacttgagcaagcagcggtgggagcacattgacccaagtgggagactgtgcacgttctttggactgaccatgacggtgttcggcctgtccagcctctttattgctagcgcaatggccgttgaacgggctctagctatacgggcgccacattggtacgcaagccatatgaaaactagggctacaagagcggtcctgctgggtgtttggttagccgtgctggcattcgccctactgccagtgttaggggtgggtcagtataccgtgcagtggcccggaacctggtgttttatttccaccggccggggcgggaacggtacgtcatctagtcacaactggggcaacttgttcttcgcatctgcctttgcatttctggggctcctcgcgctgacagtaaccttctcttgtaacttagccactatcaaggcactagtatcgagatgcagagccaaagccaccgccagccagtcttctgcccagtggggaaggatcacaactgagacggcaatacaactgatgggaatcatgtgcgtgctgtccgtgtgctggtcccctctgctcatcatgatgcttaaaatgatctttaatcagacaagcgtggagcactgtaagactcacacagagaagcagaaagagtgcaactttttcttgattgccgttaggttagcttcactcaatcagattctcgacccctgggtctacctactgttgcgtaagattcttttgagaaaattttgtcaagtggctaacgccgtgtcaagctgtagcaatgatggacaaaaaggacagccaatcagcctgtctaatgaaatcattcagacagaagctatgcgcaagcgacgccttcgcgaacaggctcccctgctccctactagtaccgtgattgacccatcccgcttctgtgcccaaccattccggtggtttcttgatctctcctttcccgccatgagtagtagtcacccacagctgcctctgaccctagcttcatttaaactgctgcgggaaccttgcagcgttcaattgtcttag

SEQ ID NO: 130208 - DNA, 1173 bp, Artificial Sequence
  Description of Artificial Sequence: Synthetic coding sequence
atgaaggagacacgtgggtacggaggcgacgcgccattttgtacgcgtcttaaccattcgtacacaggcatgtgggctccggaaagatccgctgaagcaaggggcaatctgacccgcccacccggatctggtgaagattgcggatcagtgagcgttgcctttcctatcactatgttacttaccggatttgtaggcaatgctctggccatgctgctagtctctcgttcctatagacggcgggagagtaagcggaagaaaagtttcctgctgtgcatagggtggctggcattaactgacctagtgggccagctgttgaccacgccagtggttatcgtcgtgtacctgagtaagcaaagatgggagcacattgatccgtccggccgcctgtgtaccttcttcggcttgactatgaccgtttttggactctcatctttgttcatagcgtcagccatggccgttgagcgcgctcttgctatacgggctccacactggtacgcatcacacatgaaaaccagagccaccagggccgtccttctgggagtgtggttggcagtgctcgcattcgccttactccctgtccttggcgtcggacagtatacggtccagtggcccggtacctggtgttttatctctaccgggaggggtgggaacggaacttctagctcacacaactggggaaatttgttcttcgcttcagctttcgccttcctgggcctcctggccctgaccgtgacttttagttgtaacctggctaccattaaggctctggtttcccggtgtcgagccaaggcaacggcctctcaatcttccgcccagtggggacggatcaccacagagacggccatacagctgatgggcataatgtgcgtgctctcagtctgctggtccccattgctcattatgatgcttaagatgatatttaaccaaacaagcgtagaacattgcaagacacacacggagaagcaaaaagaatgtaacttcttcctgattgccgtcagacttgcttccctgaaccagatcttggatccatgggtttatcttttgttgcggaagatcctcctgaggaagttctgtcagatcaggtaccacacgaacaattacgcttctagcagtacatctctaccttgccagtgttcctccacacttatgtggagcgaccatctggaacgctag

SEQ ID NO: 130209 - DNA, 1125 bp, Artificial Sequence
  Description of Artificial Sequence: Synthetic coding sequence
atgaaggagacccggggctacgggggcgacgctccattttgcacacgtctcaaccacagctatacagggatgtgggctcccgagcgaagcgccgaagccagaggcaatttgacccgccctccaggaagcggcgaagactgcggaagtgtgtcggtggctttcccaataactatgctcctgactggcttcgtcggcaacgccctggccatgctgctggtatctcgcagctatcgtcgcagggagtccaaaagaaagaaaagcttcctgttatgcatcggatggttggctctcaccgacctggtcggacagctgttaacgacccccgtagtcatagtggtttacctttccaaacagcgatgggagcatattgatccgagcggccgcctttgtaccttttttggactaacaatgaccgtatttggtctcagttctctgttcatagcttccgcaatggctgtggagagagctctggctatcagagctcctcattggtacgcctcacacatgaagaccagagccacacgagcagtgttgctcggcgtctggttggctgtcctggcgttcgcactattgccggtgttgggcgtcggtcaatacaccgtacaatggcctggcacctggtgttttattagcacgggcaggggggggaacggaacttcttcaagtcacaattggggcaacctgttttttgcctcagccttcgccttccttgggctgctggctcttaccgtgactttctcttgtaatctggcgacaatcaaggccctagtgagtcgttgtagggctaaggccacggctagtcaaagttccgctcagtggggccgcatcaccacagaaaccgccattcagctcatgggaattatgtgcgtcctcagtgtgtgctggagtcccctcttgattatgatgctcaaaatgattttcaaccagaccagcgtcgaacattgtaagactcatacagagaaacagaaggagtgcaatttttttcttatcgccgtacgcctggcatctttgaatcagatcctcgatccctgggtctatctgttgcttcgtaagatattgttaagaaagttctgccaaatgaggaaaaggcgtctgagagaacaggaggagttttggggaaattag

SEQ ID NO: 130210 - DNA, 1467 bp, Artificial Sequence
  Description of Artificial Sequence: Synthetic coding sequence
atgtctacacctggagtgaacagttccgctagtctgtcccccgaccgcttaaactcgccggtcactatacctgcagtgatgttcattttcggcgttgttggcaatctagtcgcaattgtggttctgtgcaaatcccggaaggaacagaaggagacaacgttctacacgctggtgtgcgggctggcagtgaccgatctgctcggcaccctgctggtatcacccgtaacaatcgcaacctatatgaaggggcagtggccaggcggacagccactctgtgagtatagcacctttattctgctgtttttctcgttgagcgggctctccatcatttgtgcgatgagtgtcgagcggtacttggccatcaaccacgcttatttttactcccactacgtggataaacgcctggctggattgactctctttgctgtgtacgcctccaatgtgctcttctgtgctttgcctaacatgggactgggcagcagcaggttgcaataccccgatacctggtgcttcatcgactggactacaaacgtaaccgcacatgctgcttattcatacatgtacgcaggcttttccagctttctgatcttggctaccgtcttgtgtaatgtcttggtgtgcggcgccctgctcaggatgcaccgacaattcatgaggcgcactagtttgggcaccgagcagcatcacgccgccgctgctgcttcagttgctagtagggggcacccggcagcctctcctgcgctcccaagattgtccgacttcagacgccgccgttctttccgacggatagctggtgccgaaattcaaatggtgatcttactgatagccacttcactcgtggtgctgatctgtagtatacctctggttgttcgcgtatttgtgaatcagttataccagcctagcctcgagcgagaggtctcaaaaaatccagatctgcaggctatccgtatcgcttcagtcaatccaattttggatccgtggatatacattctgttgcgtaagacagtgttgagcaaggctatcgagaagataaagtgccttttctgcaggattggcggctcacggagagaacgttcaggacagcattgctcagattcacagaggactagttcagccatgagtggacattctaggagcttcatttctcgcgagttgaaggagatttcaagtacctcccagacactcctccctgacctgagtctgcccgacctgtcagaaaatgggctgggtgggagaaaccttctacctggcgtgcctggcatggggctggctcaagaagacaccacgtcattacgcacgctgaggatcagcgaaacatcggatagctctcagggtcaagactctgaaagcgtgctattggtggatgaggctggcggaagcggtagggccgggccggctcccaagggttccagtttgcaagttacattcccttcagaaacgctgaatttatcagagaagtgtatttag

SEQ ID NO: 130211 - DNA, 459 bp, Artificial Sequence
  Description of Artificial Sequence: Synthetic coding sequence
atgcccgctcattcattggtcatgagtagcccggcactgccggcctttttgttatgctctacactgcttgtcatcaagatgtacgttgttgcgattataacaggacaggtccggctgaggaagaaagccttcgccaatccagaggacgctctgcgacatggcggaccacagtattgccgttcagaccccgacgttgaaagatgtctgagagcccaccgtaacgacatggaaacaatctatccatttctctttctgggattcgtgtattcgtttctagggccgaacccatttgtcgcatggatgcacttcctggttttcctggtaggaagagttgcacacacagtagcctacctaggcaaactcagagcgccgatacggtctgtgacatatacacttgcacaactcccctgcgcctccatggccctgcagatcctttgggaggcagctcggcacctctag

SEQ ID NO: 130212 - DNA, 561 bp, Artificial Sequence
  Description of Artificial Sequence: Synthetic coding sequence
atgaaggctgtaaacgagcagggaaaggaagtgactgaatttggcaataagtactggttgatgttaaacgaaaaagaagctcagcaggtctatggcggcaaggaagcccggaccgaggagatgaagtggcggcaatgggctgatgactggctggtgcacctaatctctcctaatgtttatcgcactcctacggaagcgctggcttcctttgactacatcgttagggaggggaagtttggtgccgtggaaggagccgtggcaaagtatatgggagctgctgccatgtatctcatctctaagcgtctcaaatcccgccatcgcttgcaggataacgtgcgcgaggatctttacgaggccgcggacaaatgggtcgcggctgtggggaaagaccgcccatttatgggtggacagaaacctaatttggccgatctggccgtctacggcgtcttacgcgttatggagggtctggacgccttcgatgacctcatgcagcacacacatatccaaccatggtacttaagggtagagagagccatcaccgaagcgtctcctgcacattag

SEQ ID NO: 130213 - DNA, 1134 bp, Artificial Sequence
  Description of Artificial Sequence: Synthetic coding sequence
atggatcctgccgcacgcgttgtcagagcattgtggcctggcggctgtgctctggcctggcggctaggcgggaggccgcagccactactcccaactcagagccgcgccggctttgccggggccgccggaggcccctctcctgttgccgccgcgcggaaaggatctccccgtctgctgggtgctgcagccctcgccttgggcggcgccctggggctctaccacactgctcggtggcacctccgggcccaggacctacacgccgaaaggagcgctgcccagctgagcctcagcagcagactgcaattgaccctgtatcagtacaaaacgtgccctttttgctccaaggtgagggcattcctggattttcacgccttgccctatcaggtcgtcgaggtgaacccagtgcgaagggcagaaattaaatttagctcctaccgaaaagtgcctatattagtggcacaggagggcgaatcaagccagcaactgaatgatagcagtgtaattatatcagccctgaagacctaccttgtcagtggtcagcctcttgaagaaattatcacctactatcccgccatgaaggctgtgaatgaacaagggaaggaggttaccgagtttggtaataagtactggctcatgcttaatgagaaggaggcacagcaggtctatggggggaaagaggcccgtaccgaagaaatgaaatggcgccaatgggcagatgactggctggttcacttgatcagccccaacgtttacagaacccccaccgaggccctggcatcgttcgactatattgtgagagaaggcaaattcggcgcggtggagggagccgttgccaaatatatgggtgcggctgcaatgtacctgatttcaaagaggctgaaaagccggcatagactgcaagacaacgtgagggaggacttatacgaagcagccgacaaatgggtggcagccgtggggaaagacaggccctttatgggtgggcagaagcccaatctggctgatctagcagtctacggcgtcctcagggttatggagggacttgatgcattcgacgacttaatgcagcatactcacatccagccctggtacctccgggtcgagcgggccataaccgaggcgtctccagcgcactag

SEQ ID NO: 130214 - DNA, 894 bp, Artificial Sequence
  Description of Artificial Sequence: Synthetic coding sequence
atgtcgatgaacaactcgaagcagctggtttcccctgccgccgcattactctctaacacaacttgtcagaccgagaatcgcctcagtgtcttcttctccgttatctttatgactgttggtatcctttccaacagtctggctattgccatcctcatgaaagcatatcagaggtttcggcaaaagagtaaagcctccttcctgcttcttgcctccggcctagtaattacagacttcttcggccatttgataaacggcgctatcgcagtgtttgtctatgccagtgataaggaatggattcggttcgatcagtctaacgtgctctgtagtatctttggcatttgtatggttttctcaggattatgcccattgctgctggggtcggtgatggccatcgagcggtgcataggagttaccaagccaatcttccactcaacaaaaatcacttctaagcacgtgaaaatgatgctaagcggcgtgtgcctgttcgcagttttcatcgctctcctaccaatcctgggccatagggattacaaaatccaggcatcgagaacatggtgcttctataatacagaagatattaaggactgggaggaccgtttctacttattattgttttcgtttctgggcttactagcactcggcgtgtccttattatgcaatgcaatcacaggaatcacactgctgcgtgtgaagttcaaatctcaacagcacagacaaggcaggtctcaccacctggaaatggtaatccagctcctcgcaatcatgtgcgtctcttgtatttgctggtccccatttctcggctaccgcattatcttgaacggcaaggagaagtataaggtgtatgaggaacaatccgattttttgcacaggttgcaatggcctaccctggaatag

SEQ ID NO: 130215 - DNA, 1080 bp, Artificial Sequence
  Description of Artificial Sequence: Synthetic coding sequence
atgtccatgaacaattctaaacagctggtatcgccggccgccgctctgctttccaacacaacatgtcagaccgagaatcgtctgtccgtgtttttttctgtcatcttcatgaccgtcggcattttatccaactctttagctattgccatactcatgaaggcatatcagcgttttcgccaaaagtcaaaggcatcttttctcctgctggctagtggcctggtgattacagatttctttgggcatctgatcaacggcgctattgctgtttttgtgtatgccagcgataaagagtggatccggtttgaccaaagtaatgtgctgtgcagcattttcggcatctgtatggtgtttagtgggctatgccctttgttgctggggagcgttatggctattgagcgctgcatcggtgttaccaagcccatctttcattctaccaagataacttccaaacatgtaaagatgatgctgagcggagtatgtttgttcgcagtgttcattgcactcctgccaattctcggccaccgggattacaagattcaggcatctcgaacttggtgtttctataacacggaggacatcaaggactgggaggaccgcttctatcttttgcttttttccttcctcggtctccttgccctgggagtgtcactcctttgcaacgccataactggcatcacattgctgcgggtcaagttcaaatcccaacagcacaggcagggacgctctcaccacttggaaatggttatccagctgctagcaatcatgtgtgtgtcctgcatctgttggagcccatttttggtcacaatggctaatattggaattaatggaaatcactcgcttgagacatgtgaaacgaccctgttcgcccttcggatggccacttggaaccagattctggacccttgggtctacattcttctgcgtaaagccgtcctcaagaatctctataaactggcgtcgcagtgctgtggcgtacatgtgatatcactgcacatatgggaactctcaagcattaagaactctttgaaggttgcagcaatctctgagtctccggtcgctgaaaagtcagctagcacatag

SEQ ID NO: 130216 - DNA, 1080 bp, Artificial Sequence
  Description of Artificial Sequence: Synthetic coding sequence
atgtccatgaataatagcaaacagctagtgagcccggccgcagccctgctgtcaaatactacgtgccagactgaaaatcgattgtctgtgtttttctcagttattttcatgactgtggggatcttaagtaacagcctggcaatcgccatcctgatgaaggcttatcagcgatttcgacaaaagtctaaagcctcgtttttactccttgcctccggattagtcatcaccgacttcttcggtcacctcatcaacggcgctatcgccgtgttcgtgtacgcctctgacaaggaatggatccggtttgaccagtcaaatgtgctctgttctattttcggtatttgcatggtcttctcgggcctgtgtccgctgctgctaggatccgtgatggccatagagcgatgcattggggtgaccaaacccatcttccattcaacaaaaattacgagcaaacacgttaaaatgatgttgtctggagtttgcctgttcgcagtttttattgcccttctgcccatcctgggacatagagattataaaattcaggcgtccagaacttggtgcttctacaataccgaggatatcaaggactgggaggaccgtttttacctactgctattttcttttttgggccttttggctttgggcgtgagccttctttgtaacgcaatcaccgggattacactgctgcgggtgaaattcaagagccagcagcacagacaggggcggtcccatcacctggaaatggtgattcagttgctggccattatgtgcgtttcctgtatctgttggtcccctttcttagtgacgatggccaacatcgggattaacggcaatcatagcctcgaaacatgcgagactacactgtttgctctcaggatggctacctggaatcagattcttgacccttgggtgtacatacttctgcgcaaagccgttctgaagaatctctacaaactggccagccagtgctgcggagtgcacgtgattagtctgcacatttgggaactttcttccatcaaaaattcgttgaaggtggcagcaatttccgaatcgccggtggccgaaaaaagcgcaagcacgtag

SEQ ID NO: 130217 - DNA, 2640 bp, Artificial Sequence
  Description of Artificial Sequence: Synthetic coding sequence
atgggccggctcgcatcaaggcccctcctgctggcacttctctctctggcactgtgcagaggaagagtggtgcgggtgcctactgcaactctggtgcgcgtcgttgggactgagctggtgatcccctgtaacgttagcgattatgatgggccttctgagcagaacttcgactggtctttcagctcacttggctcctccttcgtcgagctggccagcacttgggaagttggattccctgctcagctgtatcaagagagactacagcggggggaaatcctgctcaggagaacagccaatgacgccgtggaactgcatattaagaatgtgcagccaagcgaccagggtcactacaagtgctctaccccctccacagatgctaccgtgcaggggaactacgaagataccgtgcaggtaaaggtgttagctgatagcctgcacgtaggacctagcgctagacccccccctagtctatccctcagagaaggagaaccctttgaattgcgctgtacagctgctagcgcttcccccctccacacccatttagccctcctttgggaggtccatagaggtccggctcgcagatcggtgctggcattaacccacgaaggcaggtttcatcccggcctaggctatgaacagcggtatcactctggagacgtgaggctcgacactgtcggctcagatgcttacaggctgtctgtatcacgagctctgagcgcagaccaaggaagctacaggtgcatcgtctccgagtggatcgcagagcaaggaaattggcaggagatacaagagaaagcagtcgaagttgcaacagtggtcattcagccaagcgtcctgcgagctgccgtgcccaagaacgtatctgtggccgaaggaaaagagctggatcttacatgtaacatcactacagacagggcagatgacgtgcgtcctgaggttacctggtcattctccagaatgccagattctactctcccagggtctagggttttggctcgcctggatagagactccctcgtccattcaagtcctcacgttgcactctcacacgtcgatgccagatcctatcacctgcttgtgcgggacgtgtcaaaggagaacagcggttactactattgccacgtttccctgtgggcacctggccataaccgatcttggcataaggtggctgaagcggtgagtagtcccgccggggttggagtcacctggctcgagccagattatcaggtgtaccttaatgccagtaaagtccccggattcgctgacgatcccacggagctagcttgccgggtagttgacaccaaatctggcgaggcgaacgtgcgtttcaccgtgtcctggtattaccgaatgaacaggcgctccgataatgtggtcacgtccgaactcctggcagtgatggacggggactggacgctcaagtacggggaacgctcgaagcaacgagctcaggatggcgactttatatttagcaaggagcataccgatacctttaattttcgaattcagagaacgactgaagaagatcgggggaactattattgcgttgtcagcgcttggaccaaacagcgcaataactcgtgggtgaagtccaaggacgtgttttcaaagcccgtgaatatcttttgggccttagaagattccgtccttgtcgtgaaagctcgccaacctaagccattctttgctgccgggaacactttcgagatgacatgcaaggtcagcagtaaaaatatcaagagccctcggtattccgtcttaatcatggctgagaagccagtaggagatctctctagccccaatgaaaccaaatacatcatctctctggaccaggatagtgtggttaagcttgaaaattggaccgatgctagccgcgtggatggtgtagttctggaaaaagtgcaggaggatgaattcaggtatcgcatgtatcagacacaggtgagcgatgcaggcctgtacagatgcatggttactgcttggtcgcctgttcgaggtagcttatggcgcgaagccgccacaagcctctcaaatcccatcgagattgatttccagacgagcggacccatcttcaatgcaagtgtgcacagcgatacacctagcgtaatccgcggcgacttaatcaaactgttctgcattattaccgtggaaggagctgccctggatcctgacgatatggcatttgatgtttcttggtttgctgtgcattcgtttggtctggacaaggcgcccgtgcttctgtcctctctggatcggaagggcatagttactacctcaagacgtgactggaaaagcgatttaagcctcgagcgagtgtctgtactcgagtttcttctgcaggtgcacgggtctgaagaccaggactttggcaactattactgctcggtgactccttgggtcaagtcgccaacaggtagctggcagaaagaagccgagatccactccaagcccgtgttcattaccgtaaaaatggacgtgttgaatgcctttaaatacccccttctcatcggggtgggcctgtcgacagtcatagggctcctttcctgtctaattggatactgctctagccattggtgctgtaaaaaagaggtgcaagagacccggcgagaacgaagaagattaatgagcatggagatggactag

SEQ ID NO: 130218 - DNA, 2217 bp, Artificial Sequence
  Description of Artificial Sequence: Synthetic coding sequence
tccggagctgccggcgccggtcgaggaggaggaggcgaggccgccgggaaagaggaagaaggggagccctttgaattgagatgcaccgcagcatcagcctctccgttgcatacacacctggcactgctgtgggaggttcatcgcgggccggctaggcggtctgtgttagctctgacccacgaaggacggtttcatccgggcctcggctatgaacagcgataccacagtggagacgtccgccttgatacagtggggagcgacgcctatcggttgtctgtttccagggcactgtcagctgatcagggctcctacagatgtatcgtcagtgaatggatcgctgaacagggcaactggcaggaaatccaggagaaggctgtcgaggtggccacagttgtaatccagccgtcagtactaagggccgcagtgccaaagaacgtcagtgtcgccgagggtaaggagttagatctaacctgtaatataaccactgatagggctgatgacgttaggcccgaggttacttggagttttagccgaatgcccgattccaccctgccgggaagcagggtgctggcgcgcctggacagagactccctggtccacagcagtcctcacgttgcactcagccacgtggatgctagaagttaccacttacttgtgcgggacgtgtcgaaagagaacagtggatattactactgccacgtgtcactctgggccccggggcacaatcgttcctggcataaggtcgcggaggccgtgtcctcgcccgccggcgttggcgtcacttggctggagccggattaccaagtgtacttaaatgccagtaaagtgccgggattcgctgatgatcccaccgaattagcctgtagagtggtggatactaaatccggggaggctaatgtacggtttacggtgtcctggtattacagaatgaaccgccgatccgataacgtcgtgactagtgagctgctggcggtgatggacggagactggacattaaaatatggggaacggtccaaacagagggcccaagacggcgacttcattttctcaaaagagcataccgatacatttaatttccgtatacagagaacaaccgaagaggacaggggaaactattattgcgttgtgagcgcatggacaaagcagagaaacaacagctgggtgaaatccaaagatgtgttttctaagccagttaacatcttctgggccctggaagacagtgtcctggtggtgaaagccagacagcccaagccattctttgccgctggaaatacatttgaaatgacctgcaaagtgagttccaaaaacatcaagtcaccacgctactcagtcttgatcatggccgagaagccagttggtgacctatctagtcccaacgaaacaaagtatatcatttccctcgatcaggactccgtagtgaagctggagaactggaccgatgctagtagggttgacggggtggtgttggagaaggtacaggaggacgagtttcggtatagaatgtatcagacccaggtcagcgacgcaggtttataccggtgtatggtgaccgcttggagccctgtccgcggctcactgtggagagaggccgcgaccagcctctcaaaccccattgaaatcgatttccagacctccggacccattttcaatgcaagcgtgcattctgacacacccagcgtcatacgaggggacctgattaagttgttttgcattattacagtcgaaggggcggcactggatcctgatgatatggccttcgacgtgagctggttcgcggtgcatagcttcggactggacaaggcccctgtactgctttcatccctcgatcgcaaggggatcgtgaccacatctaggagggattggaagagcgacctcagcttggaaagagtgagcgtgttagagtttctcctccaggtccatggaagcgaggaccaggatttcggcaactactattgctcagttaccccctgggttaaatcacccacaggctcatggcagaaagaggccgaaattcatagtaagccggtcttcattacggtaaaaatggacgtgctgaacgcttttaaatacccattattaattggggtgggcctgtccacagtgattgggttactgagctgcttgatcggatactgcagctcacattggtgctgcaagaaggaggttcaggagacccgaagagaacgacggcgcttgatgagtatggagatggattag

SEQ ID NO: 130219 - DNA, 1161 bp, Artificial Sequence
  Description of Artificial Sequence: Synthetic coding sequence
atggccgactcctgcaggaatctcacctacgtgagaggcagtgtgggacccgccacaagcacgctcatgttcgtggctggcgtggtcggcaacggcctggcattggggattctgtccgcaagacgtcccgccaggccatcagcattcgcagttttggtcaccggtctggctgccaccgacctcctgggtaccagcttcctgagtccagctgtctttgtagcctatgcccggaactcgtccctgctcgggctagctcgcgggggaccagctctgtgtgacgcttttgcattcgcaatgactttttttggactcgccagtatgctcattctgtttgctatggccgtggaaagatgtctggccctctcacacccctatttatacgcccagttggatgggccccgctgtgctaggttggccttgcccgccatttatgcattttgcgtgctcttttgcgcactccccctgctgggactaggtcagcaccagcagtattgccctgggagctggtgtttccttagaatgcgctgggcgcagcctgggggtgcagccttctcattagcctatgccggactagtggcactgctggtcgccgctatctttctgtgtaatggatctgtgactttatctctctgtaggatgtacagacagcagaaaagacatcaaggatctctcggtccccgccctaggaccggtgaagatgaggtggatcatctgatcctgctggctctgatgactgtggtgatggccgtctgctctctcccactaacgatcagatgtttcacacaggccgtcgcccctgactcgagcagcgagatgggagacctgctagctttccgcttctacgccttcaaccccatccttgacccctgggtgtttattttattcagaaaggctgtgtttcagcgcctgaagctgtgggtttgttgtttgtgtttagggcccgcacacggggactctcagacgccactgagccaactcgccagtgggagaagagatcctcgagctccatcagctcccgtcggaaaggagggaagttgcgtgcctctgagcgcttggggcgaagggcaggtagaaccactccctcctacacagcagtcctcaggctccgccgtgggaacttcttctaaagcagaagcgagcgttgcttgctccctctgttag

SEQ ID NO: 130220 - DNA, 1503 bp, Artificial Sequence
  Description of Artificial Sequence: Synthetic coding sequence
atggcatgggccgcactcctgggcctcctcgcagcactgctgcttctgctcctgctgtctcggaggcgaacccgcaggccaggagagccccccctggatctgggaagcattccctggctgggttatgcattggattttgggaaggatgcggcgtcatttctgactagaatgaaagaaaagcatggtgacatcttcacaatcctggtggggggtagatatgttacagtgctgctggatccccactcatatgatgccgtggtgtgggagccccggacaaggctggattttcacgcctacgcaattttcctaatggagcgaatctttgatgtgcagcttccacattacagccccagcgacgagaaggcaaggatgaaactgacactgttgcaccgagaactgcaggctctcacagaagctatgtatactaacctgcatgccgtgttgcttggcgatgctaccgaggcaggaagcggctggcatgaaatggggttacttgacttttcgtactcttttctgttaagagccggctatctcacactctacggaattgaggctctcccgagaacacatgaatctcaggcgcaggatagggtccactccgccgatgtctttcacacctttcgacagttggatagactgctccctaaacttgcccgaggaagcttgtcagtgggggataaagatcacatgtgtagcgttaagagtaggctttggaagctgctttcaccagcacgtctggcccgacgcgcacatcgcagcaaatggctggagtcctaccttttgcatctcgaagagatgggggtgtccgaagaaatgcaggcgcgtgccctcgtgcttcaattatgggcaactcaaggaaatatgggcccagctgcattttggctgctgctgtttctcttgaagaatcccgaggccttagccgccgtgcggggagagctggaaagtatactctggcaggccgagcaacctgtgagccagacaactaccctgccacagaaagttctggattcaaccccggtgcttgattccgtgctaagcgaatctttgagactgaccgccgctccttttattacaagggaagtggtcgtagatttagctatgcctatggctgacggtcgggagttcaacctaagacgcggagacagattgctcctgtttccgttcctgtccccccagagggaccctgagatctatacggatcctgaggtcttcaagtacaatcgctttcttaatcctgacggtagcgaaaagaaggacttctataaagacgggaagcgattaaaaaactacaatatgccttggggtgccgggcacaaccactgtctcggacgcagctacgccgtgaacagcattaagcaattcgtgtttttggtcctcgtccatctagatctcgagctgattaacgccgatgtggagatacccgagttcgacctgtctcgttatggctttggcttgatgcagcccgagcatgacgtacctgtcaggtacagaattagaccctag

SEQ ID NO: 130221 - DNA, 408 bp, Artificial Sequence
  Description of Artificial Sequence: Synthetic coding sequence
atgcgcgcgttcctccggaaccagaagtacgaagacatgcacaatattatccacatattacagatcagaaagcttcgccacagactgagtaactttcccaggttgccgggcatcctggcccctgagacagtcctgctgccattctgttataaagtcttcaggaaaaaggaaaaggtgaaaagatctcagaaagccacagagtttatagactacagtattgaacagtcccatcatgcaatactcacacctcttcaaactcatttgacaatgaaaggctcctcaatgaagtgcagcagcttgagttcagaggccatcctgttcacactgaccctacaactgacgcagaccctgggcctagagtgttgcctgttgtacctgagtaagacgatacatccgcaaattatctag

SEQ ID NO: 130222 - DNA, 345 bp, Artificial Sequence
  Description of Artificial Sequence: Synthetic coding sequence
atggccggcctggcactccaacctgggaccgccctgttatgctatagctgcaaagcccaggtctcaaacgaagattgcctacaggtggaaaactgcactcagttgggtgaacagtgctggaccgctcggatacgggcagtgggcttactcactgtgatctcaaagggctgttccctgaactgcgtggatgatagccaggattattacgtaggcaaaaagaacatcacgtgttgcgacaccgacctgtgtaacgcctcaggtgcacatgctttgcagcccgcagccgcaatactcgccctactgcctgccttaggcttgctgctctgggggcctggccagttatag

SEQ ID NO: 130223 - DNA, 714 bp, Artificial Sequence
  Description of Artificial Sequence: Synthetic coding sequence
atgatggtgatggtcgtggtaattacatgcctgttatcccactacaaattatctgctagatcattcatatccagacactcccagggccggcgtcgcgaggatgccctgtccagcgagggatgcctgtggccgtccgagtccactgtgtccgggaatggaataccagaaccgcaggtctatgcacccccccgccctacagacagactggcagttcctcctttcgcacagagagagaggtttcaccgcttccagcccacctatccctacctgcagcatgaaatagacctcccaccaactatctcactgtctgacggcgaagagcctcctccttaccagggcccctgtactctgcagctccgagacccagaacaacagctggagctgaatagggagtcagttcgggctcccccaaaccgaaccattttcgacagtgaccttatggattctgccagactgggaggaccttgtccaccaagttccaactccggaatcagcgctacatgctacggaagcggagggcgtatggaaggtcctcctcccacatatagcgaagtcatcggacactatcctgggtcatctttccagcaccaacagagctcaggacctccatccttgttagaagggactcgccttcaccatacccatatagcgccactcgagtctgccgctatctggtctaaagaaaaggataagcagaaaggacacccactgtag

SEQ ID NO: 130224 - DNA, 864 bp, Artificial Sequence
  Description of Artificial Sequence: Synthetic coding sequence
atgcaccgcctgatgggggtcaacagcacagcagctgcagccgctgggcaaccaaatgtctcctgtacctgcaattgtaaaaggtcgctttttcagagtatggagatcactgagttagaatttgtgcaaatcatcatcattgtggtggtaatgatggtcatggttgtcgttatcacctgccttctcagtcattacaagttgagcgctcggtcctttattagccggcactcccagggacgcaggcgcgaggacgctctcagttcagaaggctgcctgtggccttcagagtctaccgtaagcgggaacggcatacccgagccccaagtgtatgctcctcctaggccgaccgatcggctggcggtcccaccattcgctcagcgcgagcgcttccacagatttcagcctacctacccttacctgcaacacgaaattgatttgccaccaacgatctccctaagcgacggcgaggagccccctccttatcagggcccgtgcaccttgcaacttagggacccggagcagcagctggagctaaatcgagagtctgtaagagctcccccaaacaggaccatctttgacagtgatctcatggattccgccaggttgggcgggccctgcccaccatcatccaacagcgggatatcagccacctgctatggctcaggcgggcgaatggaaggccccccacctacgtactcagaggtcattggccactaccccggctccagttttcagcaccagcagtcttccggacctcccagcctgttggaggggactagactccatcacacccacattgcccctctagaatcagctgccatctggagtaaggaaaaggataagcagaaggggcaccccctatag

SEQ ID NO: 130225 - DNA, 759 bp, Artificial Sequence
  Description of Artificial Sequence: Synthetic coding sequence
atggcagagttggaattcgtccagattataatcatagttgtggtgatgatggttatggtggttgtgatcacttgcctactgtcccactataagctgtctgcgcgaagtttcatttctaggcatagccaaggtcgccgccgtgaagacgctttatcaagtgagggttgcttgtggccctccgaatcgactgtctccggtaacggtatcccggagccccaggtgtatgcacctccacgacccacggaccgcttggccgtgcctcctttcgcgcagcgggaacggtttcatagatttcagcctacttatccctaccttcagcacgaaattgacttgccccccacaataagcttatccgatggcgaagaacctcccccataccagggaccttgcacgctacaattgcgcgacccggagcagcagctggagctcaatagagagtccgtgcgtgcgccgccaaaccgcaccatcttcgattccgatcttatggactccgctaggctcggaggcccgtgccccccgagtagcaacagtgggatttccgctacctgctatggctcaggcggcaggatggagggccctccgcccacgtacagcgaagtgattgggcattacccgggtagttccttccagcaccaacaatcatcgggtcccccgtctttgctagagggcacccggttacatcatacccatatcgcccccctcgaaagcgcggctatttggtccaaggaaaaagataagcagaagggacatcccctgtag

SEQ ID NO: 130226 - DNA, 714 bp, Artificial Sequence
  Description of Artificial Sequence: Synthetic coding sequence
atgatggttatggtggtagtgatcacgtgtctgctctctcattataaactatcagcgagaagttttatttccaggcatagccagggccgccgaagggaggacgccctgtctagtgaagggtgcctgtggccgagcgagtcaaccgtttctgggaatggcattcctgaaccacaggtctatgcccctccaaggccaaccgatagacttgcagtaccaccttttgcacaaagagagcggtttcatcgatttcagcccacgtatccttacctccaacacgaaatagatctgccacctactatttctctgtccgacggggaggagcccccaccatatcaaggcccatgtactctgcagctgagggatccagagcagcagctggaattgaatcgcgagtctgtgcgagcccctcctaatcgtaccatatttgactcagatctcatggattccgctcgcctaggtggcccatgccctccaagctccaatagcggcattagcgcaacatgctacgggagcggtggcaggatggagggaccaccaccgacctactccgaggtcataggacattatccaggcagcagctttcagcaccaacaaagctctgggccaccatctctgttggaagggactcggctgcaccacacgcacatcgcaccactcgagtcagccgctatctggagtaaagagaaagacaagcaaaaaggacaccctctgtag

SEQ ID NO: 130227 - DNA, 714 bp, Artificial Sequence
  Description of Artificial Sequence: Synthetic coding sequence
atgatggtgatggttgtcgttattacctgtcttctttctcattacaaactgtccgcgcgctctttcatctctcgccattcccagggcaggcggagggaggacgctttatcttcagagggctgtctgtggcctagcgagtctaccgtgtctggcaatgggatcccagagcctcaggtgtatgcaccccctcgccccacagacagactggcagtgccgcccttcgctcaaagggagcggttccataggttccaacccacctatccttaccttcagcacgaaattgatctgcctcccacgatttccctttcagatggggaagagccacccccctaccagggcccttgcactctgcagcttagagatccagagcagcagctggagctaaacagggaaagcgtaagagctccgcccaacagaacaatcttcgacagtgatctgatggattctgcgcggcttggcggcccatgcccaccaagcagcaattctgggatatctgccacttgctacggttccggcggtaggatggaaggtcctccaccaacctattccgaggtgatcggccattacccgggctcgtctttccagcaccagcaatctagcggacctccaagcctgctcgaaggtacaaggcttcatcacacgcatatagcccctctggagagcgccgctatatggagtaaggagaaagacaagcagaaaggacaccccttgtag

SEQ ID NO: 130228 - DNA, 684 bp, Artificial Sequence
  Description of Artificial Sequence: Synthetic coding sequence
atgcacaggctcatgggggtgaactctactgccgctgccgctgcgggccaacccaacgtgtcatgtacctgcaattgcaagcgcagccttttccagagcatggagatctcctgccacggtttcccagtgtgcaaaagccatcagcaccaggagtggaagagtttatgttggagcttgaggtcccctggcggggcctcttccatcaccgggttcgggagtatgaaagtgacgaatcccgctatgaacctcccagagtgccagtggctgcgtatccagaaggctgagctcgaattcgttcaaattatcatcattgtcgtcgtaatgatggttatggtcgtggttatcacgtgtctgctctctcactacaaactttcggccaggagttttatttcgaggcactctcaagggcgcagacgggaggacgccctgagtagcgaggggtgcctctggccttctgagagcacagtctcaggcaacggcattcctgaacctcaggtgtatgcaccacccaggcccacagataggcttgcagtgcccccatttgcacagcgggagaggtttcacaggttccagcctacatatccctatctgcaacacgaaatagacctgccccctactattagcctcagtgatggcgaggagcctcctccgtaccagggtccatgtactctgcagctgaggtag

SEQ ID NO: 130229 - DNA, 627 bp, Artificial Sequence
  Description of Artificial Sequence: Synthetic coding sequence
atgccagcaatcccagctcacggagctgaactcgagtttgtccagatcattattatcgtggtggtgatgatggtaatggtcgtcgtcattacatgtctgctgtcccactataaattgagtgctcggtctttcatttccaggcactctcagggacggaggagggaggacgccctgtcttccgagggatgcctgtggcccagtgaatcgactgtttcagggaacggtatcccagagcctcaggtatatgcaccaccccgaccaaccgaccgtctggccgtgccaccttttgcccagcgagaaagattccacaggtttcagccaacatatccttatctgcagcatgaaattgaccttccccctaccatatctttgtctgacggagaagaaccaccgccataccaaggcccatgcaccttgcagttgagagacccagaacagcagcttgagctcaacagggaatcagtgcgtgcccccccaaatcgcactatttttgactctgatcttatggatagcgctcgcttgggcggaccctgccccccctcaagcaattccggaatctcggccacgtgctatgggagtggaggccgaatggaaggtccgccccccacatattcagaagtgatctag

SEQ ID NO: 130230 - DNA, 156 bp, Artificial Sequence
  Description of Artificial Sequence: Synthetic coding sequence
atggctaggtaccggtgctgcagaagtcagtcccgcagtcggtactaccgtcagaggcagcgaagtcgtagaaggagaaggcgctcatgccagacaagaaggcgggcgatgcgttgctgtaggcctcgctaccgccccaggtgtcggagacactag

SEQ ID NO: 130231 - DNA, 309 bp, Artificial Sequence
  Description of Artificial Sequence: Synthetic coding sequence
atggtacgttaccgagtaagaagtctgtcagagcggagccatgaagtgtatcgccagcaactacacggacaagagcagggtcatcacgggcaagaggaacagggactgtctcctgagcacgtggaagtctacgaaaggacccacggccaaagtcattaccggagacgtcactgttctcggcgcaggttgcatcggatccataggaggcagcacaggagctgccgtaggaggaagcggcggagctgtaggcacagaaggagacaccgcagaggctgcagaaccagaaagagaacatgtagacgccactag

SEQ ID NO: 130232 - DNA, 423 bp, Artificial Sequence
  Description of Artificial Sequence: Synthetic coding sequence
atggttcgatatcgggtgcggagcctttccgaacgctcacacgaggtatacaggcaacagcttcatggacaagagcagggccatcacggacaggaagaacaagggctgtccccagaacacgtcgaagtttacgaaagaacccacgggcagtcacattatcggcgccgccattgtagtagaaggaggttgcacaggattcatagacggcaacaccgcagctgtcgaaggaggaagagaaggagttgtaggcatcgcagaagacaccggcgggagtccctgggggaccctctcaaccagaacttcttgtctcagaaagctgctgaacccggccgcgagcatgccgaaggtactaagctccccgggcctctaacgcccagctggaagctacgaaaaagtaggccaaagcatcaggttcgcccttag

SEQ ID NO: 130233 - DNA, 657 bp, Artificial Sequence
  Description of Artificial Sequence: Synthetic coding sequence
taacttgcactgctactggccagagccggactgaggaagcctgagtcacaggaggccgcccccctgagcggaccatgcgggaggagggtgatcacatctcgaattgtcgggggtgaggacgctgaactgggaagatggccttggcagggttcactgcgtctctgggacagtcacgtctgtggtgtgtctttgttaagtcatcggtgggctctcacagccgcccactgcttcgagaccgacttgagcgacccgtctggatggatggtgcagttcggacaactcaccagcatgccctctttttggagccttcaggcttactacactagatacttcgtgagtaatatctacctgagtcctagataccttggcaattccccttacgacattgcacttgtgaagttgagcgcgcccgtgacctacaccaaacacatccagcctatttgcctgcaggccagcaccttcgaatttgagaatcgaactgattgctgggtgaccggctggggatacatcaaggaagatgaaggaagctccggtaggcatcataagcagctctacgtgcagcccccactgcctcaggtgcagtttcctcagggccacctctggcgtcatggattgtgctggcagtgcccacgcagggagggctgtctgctgcgctag

SEQ ID NO: 130234 - DNA, 744 bp, Artificial Sequence
  Description of Artificial Sequence: Synthetic coding sequence
atgaacccacttctcatactaacatttgtcgcagccgccctagcggctccattcgatgatgatgacaaaatcgtcggaggttataattgcgaagaaaacagcgtgccataccaagtgagccttaattcgggatatcacttctgtgggggatctctcattaatgagcagtgggtggtgtccgccggccactgctacaaaagccgcattcaggtgcgcctgggcgagcataacattgaagtactcgaggggaatgaacagttcatcaacgctgctaaaataataagacatccacagtatgatcgcaagacgctgaataatgacatcatgcttatcaaactgtctagcagagctgttattaacgccagggtgagtactatttccctgcctaccgctccaccggcaacaggaactaagtgcctgattagcggctggggtaacaccgcctcctccggggcagactaccctgatgagctccagtgtttggacgcaccagtgctctcccaggcgaagtgtgaggcctcatatccaggaaagatcactagtaatatgttctgcgtcggcttccttgaggggggtaaagatagctgccaaggggactcagggggacccgtagtgtgcaacgggcaactccagggcgtggtgtcctggggagatggctgtgctcagaaaaacaagcctggggtttacaccaaagtgtacaattatgtgaaatggattaaaaacacgatcgccgccaacagctag

SEQ ID NO: 130235 - DNA, 714 bp, Artificial Sequence
  Description of Artificial Sequence: Synthetic coding sequence
atgaaccccctgttgattctcacctttgtcgcagctgcgttggccgcgccatttgatgatgatgacaagatcgtgggggggtacaattgtgaagaaaattcagtgccttaccaggtatccctgaatagtgggtaccatttctgtggggggagcctgataaatgaacagtgggttgtgtccgccgggcactgctacaaaagcaggatccaggttagattgggcgaacataacatcaacgctgctaaaataatccgtcacccgcagtacgacaggaagacattgaacaacgacataatgctcatcaaactctcgagcagggctgtgatcaatgcgagagtgagtaccattagcttgcctactgcccctcctgcaaccggaacaaaatgcctaatcagcggctggggaaacaccgctagcagtggtgccgactacccggacgagctacagtgtctcgacgcacctgtcctttctcaggcaaagtgcgaagcctcttatccaggcaagatcaccagtaatatgttctgtgtgggatttctggaaggtgggaaggacagctgtcagggcgattctggaggtcccgtggtatgcaacggacagctccagggagtcgtgagctggggcgacgggtgcgctcagaagaacaaaccgggagtctacacaaaagtttacaactatgtcaagtggattaagaacacaatcgctgccaactcctag

SEQ ID NO: 130236 - DNA, 2628 bp, Artificial Sequence
  Description of Artificial Sequence: Synthetic coding sequence
atgactctggcacggttcgtgttagccctgatgctcggcgccctgcctgaagttgtgggcttcgacagcgtcctcaatgattctctccatcactcacatcgacacagcccacctgccgggcctcactatccttattacctacctacgcagcaaaggcccccacgcacacggcctcctccacccctgcccaggttcccccggccccctcgggcacttcctgcccagagaccacacgctcttcaggctgggcacaccccgcgaccacatccatgggggtgcccagcgggtgagccctgggtctctgttacagatttcggggctccttgtctgagatgggcggaagttccgccttttttagagcggtccccccctgccagttgggcccaactacggggccagcggcataatttttgtcggtctccagacggggcaggtcgtccttggtgtttctacggcgacgccagaggaaaggttgattggggctactgcgattgcagacacggctccgttcgcctgcgaggtgggaagaatgagtttgagggaacggttgaagtatacgcttcaggagtttggggcaccgtgtgttccagtcactgggacgacagtgacgcgtcagttatctgccaccagttgcagcttggcgggaaggggatcgccaagcagacccccttctctgggttgggcctaattcccatatactggtccaacgtcaggtgtagaggtgatgaggagaacatcctgctgtgtgagaaggatatctggcaggggggtgtatgcccccagaagatggctgccgccgtgacatgctctttctctcatggacctacttttccaattatccggctggctgggggcagtagcgtacacgagggcagggttgagctttatcacgcaggccagtggggtaccgtatgcgacgaccagtgggacgacgctgatgctgaggttatctgtagacagctaggcctctcaggaattgccaaggcttggcaccaagcatattttggcgagggttcgggacccgttatgctggatgaagtgcgctgtacaggtaatgagttgagcatcgaacaatgccctaagtcgtcttggggggagcataattgtggtcacaaagaggacgccggcgtgtcatgcaccccacttacagacggggtgatcagacttgccgggggcaagggctcccacgagggtagactggaggtatattaccgcgggcaatggggaacagtgtgtgacgacggttggacagaactgaacacatatgtcgtgtgcagacagttgggttttaagtatggcaagcaggcaagtgccaatcactttgaggaaagcaccggacctatctggctcgatgatgtaagttgctccggtaaggagacaagattcttgcagtgctctaggcggcagtgggggcggcatgattgcagtcaccgggaagacgtcagcattgcctgttacccaggcggcgaaggtcacaggctgtccctaggcttcccagttagattaatggacggcgagaataagaaggagggtcgagtagaggtcttcatcaacggacagtgggggacaatatgtgacgatggttggaccgataaggatgctgctgtcatttgccggcagctcgggtataaaggaccagcccgggcccggaccatggcgtattttggagaaggcaaagggcccatccatgtggataacgtgaaatgcactgggaacgaaaggagcctggccgattgcataaaacaagacattggccggcacaactgtagacatagtgaggacgcgggggtgatttgcgattactttggcaaaaaggccagcggtaactcaaataaagagtctttgagctctgtatgcggactgaggctgctccacaggcgccagaagagaatcattggagggaagaattccctgcgagggggttggccttggcaagtgtccctccgcctgaaatcctctcacggggacggacgtctcctttgtggagctacgcttctctcaagttgttgggtgttgactgcagctcactgctttaagagatatggaaattccacacggagctacgcagttagggtgggggactaccatactctggtccccgaagagtttgaagaggagatcggagtgcaacagattgtaattcacagggagtacagacctgacagaagcgattatgatatcgccctggtacgacttcagggacctgaggagcagtgcgcccgcttttcgagccatgtgctacctgcatgtctccctttgtggagagaacgtccacagaagacagcatccaattgttacatcactggttggggcgataccggaagggcttacagccgcaccctccagcaggcagccatacctctcctacctaaaaggttctgcgaagaacgctacaagggtcggtttactggaagaatgttgtgtgccggcaacttgcacgaacacaagcgagtggacagttgccagggtgacagcggcggaccactgatgtgtgagcgtccaggcgagtcatgggttgtctacggcgtaacgagctgggggtacggctgtggtgtgaaagacagcccaggtgtctacacaaaggtgagcgccttcgtgccttggataaaatcagtcacaaaactatag

SEQ ID NO: 130237 - DNA, 489 bp, Artificial Sequence
  Description of Artificial Sequence: Synthetic coding sequence
atgaaggggtttactgctaccttgtttctgtggacattaatctttcctagctgttcgggaggaggtggcggcaaggcatggcccacccatgtagtatgctctgacagcggcctggaagtgctttaccagtcctgtgacccactccaggacttcggattttccgtcgagaagtgttccaagcaattgaaatctaacatcaacattcggtttggcatcattttacgagaggacatcaaggagctgtttctcgatctggctctgatgagtcaaggatcctccgtgctgaacttctcttaccccatatgtgaggcagctctgcctaagtttagcttctgtggacggagaaagggtgagcagatttactacgcagggcctgttaataaccccgagttcaccatcccgcagggagaataccaagtactgctggagctctatacagagaagcgttctacagtggcctgtgccaatgccacaattatgtgttcttag

SEQ ID NO: 130238 - DNA, 822 bp, Artificial Sequence
  Description of Artificial Sequence: Synthetic coding sequence
atggccgtgtggttggcacaatggctgggcccactccttctggtgtctctgtggggcctcttggcacctgcctcactgctcaggaggctgggggagcacatccagcaattccaggagtccagtgctcagggcctggggctgagtttaggccctggggcagccgcgttgccaaaggtcgggtggctcgaacagctcctagacccgtttaacgtgtctgacaggaggagcttcctgcagcgctactgggtgaatgatcagcattgggtagggcaggatgggcccattttccttcatttgggcggtgaaggatcgttaggacccggcagcgtcatgagaggacatcctgctgccctggcaccagcatggggggcgctggtgatctcactagaacataggttttatgggctgagtatccccgctgggggccttgaaatggcacagctaaggttcctgagcagccgactggctctggcagacgtagtgtccgcccgtctggccctgtcccggcttttcaatatttcatccagctccccttggatttgctttggcgggtcttatgcgggatccctggcagcctgggcgagactgaaatttccccatctcatcttcgcatccgttgcctcttccgctcccgtccgtgctgtccttgacttctcggagtataacgacatagtcctccacagtctgggacagaaatgtctttccttctctagggcggaaactgttgcccagcttcggtcaaccgaacctcaactaagcggagtgggcgacaggcagtggctataccagacctgcaccgagtttggattttacatcacctag

SEQ ID NO: 130239 - DNA, 501 bp, Artificial Sequence
  Description of Artificial Sequence: Synthetic coding sequence
atggcagtctggctggcccagtggctaggccctctcctgttggtttctctgtgggggctcctggcccccgcttcactgctccgtaggctgggtgaacacatacagcagttccaggaaagcagtgcacaagggttgggtttgtctttgggccctggggccgcggcattaccaaaggtgggttggttggagcaactgctcgacccttttaacgtgtccgaccgacgttccttccttcaacggtattgggtcaatgatcagcactgggttggccaggacggacccatctttctccatctcgggggagagggatccctgggcccagggagcgtgatgaggggccatccagcagcccttgctcctgcctggggagccctcgtgatctctttagagcacagattctacggcctgtccatcccggccggcggcctggagatggcccagctaagatttctgtcaagcaggctggctctttcctgcaccgcctgggcgaggagcgtctag

SEQ ID NO: 130240 - DNA, 498 bp, Artificial Sequence
  Description of Artificial Sequence: Synthetic coding sequence
taggtcatgaggggacacccagccgcgctcgcccccgcttggggcgctctggttatatctctcgagcaccgtttctacggcctcagcattcccgcagggggccttgaaatggcccagttgcgcttcctgtcatcccgcctcgccctggccgatgtggtttctgcaaggctcgcgctaagccgcttattcaatatctctagcagttccccctggatatgttttggaggttcatacgccggtagcttggctgcctgggctcgtttgaagttcccccacctcattttcgcatccgtagcatcgtccgctcctgttagggcagtattggatttcagcgagtacaacgacatcgtcttgcattccctcgggcaaaagtgtttgtctttctctcgggctgaaactgttgcacagcttcggagtactgagcctcaattaagtggggtcggcgataggcagtggctttatcaaacctgtaccgagttcgggttttatgtcacctag

SEQ ID NO: 130241 - DNA, 945 bp, Artificial Sequence
  Description of Artificial Sequence: Synthetic coding sequence
atgggggcaagaggcgccctgttgctcgctctgctcctggctcgagcagggctcagaaaacctgagtcacaggaggcggctccgctatccggcccgtgtggacgtcgggtgatcacctccagaatagtaggaggagaagacgccgagctcggcaggtggccatggcaggggagcttaaggctctgggatagccatgtgtgcggggtatccctgctaagtcatagatgggctctgacagcagcacactgttttgaaacctactccgatctgtcagatccctccggatggatggtccaatttgggcagctgacatccatgccttcattttggtcactccaagcttattatacaaggtatttcgtatcaaacatctacttgagccctcgatatctgggaaattctccctatgatattgccctggtgaagctgagcgccccagtgacctacactaagcacatccagccaatttgtctacaagcctcaacctttgagttcgaaaacaggactgattgttgggtgactggatgggggtatatcaaggaagacgaggccctgccatcgccgcacacactgcaagaggtgcaggtggctatcatcaataatagcatgtgtaaccacctgtttcttaagtacagcttccgaaaagacatctttggggacatggtgtgcgcgggaaacgcccaagggggcaaggacgcgtgttttggagattctggtgggccattggcctgcaacaagaacggactctggtatcagatcggggttgttagctggggagtcggctgcgggagaccaaacagacccggggtgtatactaatatcagccaccattttgaatggatccagaagctgatggcacagtctggcatgagtcagccagaccccagctggccactcctgttcttccctctcttgtgggccctacctttactaggccctgtttag

SEQ ID NO: 130242 - DNA, 903 bp, Artificial Sequence
  Description of Artificial Sequence: Synthetic coding sequence
atgggtgcccggggagccttgttgctggctctgctgctggcccgcgctggtctccgaaagcccgagtcacaggaagctgcacctttgtctggaccatgcggtagacgggtgatcacctctcggatagtggggggcgaggacgcggagttgggaaggtggccttggcagggctctctgagactgtgggacagccacgtatgcggagtgtctctactttctcataggtgggctctgaccgccgcgcactgttttgaaacctattctgatttgagtgatccttccggatggatggtgcagttcggccagctcacgtctatgcctagcttctggtctctgcaggcctactatacacggtatttcgtgagcaatatttacctgtcaccacgatatctgggaaacagcccctacgacattgccctcgtgaaactttcagcaccagtcacttataccaagcatattcagcctatctgtttgcaggccagtaccttcgaatttgagaaccgcacggactgctgggttacaggctgggggtatatcaaagaggacgaggccctgccaagtccccacactcttcaggaggtgcaggtggcaataattaacaacagtatgtgcaatcacttatttttgaagtatagcttccggaaggacatttttggcgatatgggggatagcggcgggccactagcatgcaataagaatggcttgtggtatcagatcggcgtggtgtcgtggggcgtaggctgtgggaggcccaaccgccccggggtatataccaacattagccatcatttcgagtggatccagaagctaatggcccagagtgggatgtcacagcctgacccatcttggcccttgctgtttttccctctgctgtgggccttgcccctgttgggccctgtgtag

SEQ ID NO: 130243 - DNA, 939 bp, Artificial Sequence
  Description of Artificial Sequence: Synthetic coding sequence
atgggagctcgaggtgcccttctactggcactgctcctggcacgcgccggactcaggaaacctgagtctcaggaagccgcccccctgtctggaccttgtggccggcgagtcatcacgtcacgcatcgtgggaggcgaggacgcagagctcgggagatggccctggcaaggatccctccggctgtgggacagtcatgtctgtggtgtaagcctcctcagtcataggtgggccctgacagcggcacattgcttcgaaactgacttaagtgacccttcaggttggatggtgcaatttggtcagctgacaagcatgccttccttctggtctctgcaggcttattatacccggtactttgtcagtaacatctacctgtcacccagatatcttggaaacagcccctacgacatcgccctggtgaagctctccgcaccggtgacctatacgaaacacatccagccaatctgtttgcaggcatccacctttgagtttgaaaatcggaccgactgttgggtgaccggatggggctatatcaaggaagacgaggcactgccatctccacacacactgcaggaagtgcaggtggcaatcatcaataattccatgtgcaaccaccttttcctcaagtattccttcaggaaggatattttcggcgatatggtatgcgccggtaacgctcagggggggaaggatgcatgttttggagatagcggcgggccactcgcctgtaataaaaacgggctatggtaccaaattggtgtcgtgtcttggggggtgggctgcggacggcccaacaggcccggcgtttataccaacatatcacatcatttcgagtggatccagaagcttatggcacagtcgggcatgtcacaaccagatcctagttggcctctcttattctttccccttctatgggctctgcccctcttggggccagtttag

SEQ ID NO: 130244 - DNA, 954 bp, Artificial Sequence
  Description of Artificial Sequence: Synthetic coding sequence
atggtggtgtcaggcgctccgcctgctctcggaggcggctgcctcgggacatttacatcactcctattgcttgccagtactgccattctgaacgctgccagaatcccagtaccccccgcatgtggaaaaccacagcaacttaatcgggtggtgggcggagaagacagtaccgactctgaatggccatggatcgtttcgatccagaaaaatgggacacatcactgtgcaggctcactcctgacgtcccggtgggtgatcacagccgcccactgttttaaggataatctcaacaaaccctacctgtttagcgtgctgctgggagcatggcagctcggaaatcctggctcccgtagtcagaaagtgggagtggcctgggtggaacctcatccagtgtactcttggaaagaaggcgcttgtgccgacatcgcccttgtgcgactcgagcggagcatccagttctcagagcgggtgctccccatttgcttacctgatgcctctattcacttaccacctaacactcactgctggatcagtgggtgggggagtatccaggatggcgtgcctctcccgcatcctcagaccctgcagaagctaaaggtgccaatcatagactctgaggtctgttcgcacctgtattggcgaggggctggtcaagggcctattacagaggacatgctgtgcgccggataccttgaaggagaacgcgacgcttgcctgggggatagtggaggtccgctcatgtgccaggtcgacggggcctggctactggccggaatcatctcctggggcgagggctgtgctgagagaaacagacctggggtatacataagcctatctgcccaccgttcatgggtggagaagattgttcagggggtgcaactaaggggtagagcacaaggcgggggcgccctgagagcgccaagccagggctcgggtgcagccgcaaggtcctag

SEQ ID NO: 130245 - DNA, 786 bp, Artificial Sequence
  Description of Artificial Sequence: Synthetic coding sequence
atgcacatgagagagacctctggctttactttaaagaaaggaaggtccgcgccccttgtttttcaccccccagatgccctcatagccgtccccttcgacgacgacgacaagatagtgggaggctacacatgcgaagaaaactcactgccatatcaagtttcattaaattccggcagccacttctgtggagggagcctcatatctgaacagtgggtggtgagcgcggcccactgctacaaaaccaggatccaggtccgtctcggtgagcataatattaaagtgctggagggtaatgaacagttcattaacgctgccaaaatcatcagacaccctaagtacaaccgggatacgttggataacgatattatgttgataaaactgtcctcacccgctgtgataaatgctcgcgtctcaactatttctcttccgaccaccccacccgccgctggaaccgagtgcctgatctctggatggggaaatacccttagtttcggcgcagattatcccgacgagttgaaatgtctcgacgcccctgtactcacccaggcagagtgcaaggcttcttatcctggcaagatcaccaattccatgttttgtgtgggattcctggaaggcggcaaggattcatgccaaagggattctggcggcccggtggtgtgtaatggccagcttcagggcgtcgtgtcctggggccatgggtgcgcatggaaaaatagacctggagtttacaccaaagtctacaactatgtcgattggattaaggacaccatcgccgcaaacagctag

SEQ ID NO: 130246 - DNA, 915 bp, Artificial Sequence
  Description of Artificial Sequence: Synthetic coding sequence
atgtgtgggccagacgatcggtgccccgcacgttggcctggaccagggcgggctgttaaatgcggcaagggattggcagcagcgcgcccaggccgcgtggagagagggggggcacaacgcggtggagccggtctagaactacaccccctgctgggcgggcggacgtggcgcgccgctagggatgctgacggatgcgaagctctgggcacggtggccgtgccttttgatgacgatgataagatcgtgggaggttacacatgtgaagagaacagcctgccgtatcaagtgtccctgaattccggcagccacttttgtgggggctctctgatctccgagcagtgggtggtttcagccgcacattgctataaaactaggatccaggttaggctcggtgaacacaacattaaggtccttgagggcaacgagcagtttatcaatgccgccaagattatcaggcatccgaaatataatagggatacgctcgacaatgatattatgcttatcaaactgagtagcccggcagtcattaatgcccgcgtcagcaccatttcccttccaacaacacctccggcagctggcacagaatgtctgattagtggctggggcaacactctctctttcggagcggattacccggacgagctaaagtgcctggatgcacctgtacttacgcaggccgagtgcaaggccagctaccctggcaagataactaactcgatgttctgtgttgggtttctggaaggcggcaaagactcttgtcagcgcgactctggtgggccagtggtctgtaacgggcaattacagggtgtggtatcttggggacatggatgcgcctggaagaatagacccggtgtctacaccaaggtttacaattacgtggattggataaaagataccatcgccgccaattcctag

SEQ ID NO: 130247 - DNA, 744 bp, Artificial Sequence
  Description of Artificial Sequence: Synthetic coding sequence
atgaatccttttttaatactcgcatttgttggtgccgcggtcgccgtgccgtttgacgacgatgacaagattgtgggtggttacacctgcgaggagaactctctcccctatcaggtctccctgaattcaggtagtcatttctgcggaggatcattgatatcggaacaatgggtggtgtctgctgcacattgttacaaaacccggattcaagtccggctaggggaacacaatatcaaggtgctcgaaggaaacgagcagttcattaacgccgccaagattatccgacacccaaagtataatcgagatactctcgataacgatatcatgttgatcaaattaagctcccctgctgttatcaacgccagagtgtccactatcagcctgcccaccacccctcccgccgcaggcaccgagtgtctgatctcaggctggggtaataccctcagtttcggagccgactaccccgacgaattgaaatgcctggatgcccccgtcttgacacaggccgaatgcaaggcatcttatccaggcaaaatcaccaattccatgttttgcgttggctttttggagggcggtaaggatagttgtcagagagactcagggggaccagtggtctgcaatggtcaactgcaaggggtggtgtcttggggtcatgggtgcgcctggaaaaatcggcccggggtatacacaaaagtgtataactacgtcgactggattaaggataccatcgcagccaacagctag

SEQ ID NO: 130248 - DNA, 723 bp, Artificial Sequence
  Description of Artificial Sequence: Synthetic coding sequence
atgggcccagctggcgaagtggccgtgccctttgatgatgacgacaaaattgtcggaggctacacttgtgaagaaaattctctcccctaccaagtgagcttaaactcaggctcacacttctgcggtggctccctgattagtgaacagtgggtcgtgagcgctgcgcattgctacaagacgagaatccaggtgcggctcggcgaacacaatatcaaagtactggaaggcaatgaacagttcattaacgcggcgaaaataatacggcaccctaagtacaatagggacacactcgacaatgacataatgctcattaaactcagtagcccagcagtgatcaacgcaagagtgtccaccattagtctgcctacaaccccacccgccgcaggtactgagtgtctaatctccggatggggcaatacactttcattcggggcagattatccagacgagctgaagtgccttgatgctcctgtgttgacccaggctgaatgtaaagcttcctacccaggaaagatcactaactctatgttttgtgtgggattcctggaagggggaaaggacagttgccagcgggattccggcggcccagtagtctgtaatgggcaacttcagggtgtcgtcagctggggacatgggtgcgcgtggaagaaccgacctggggtgtataccaaggtgtacaactacgtagattggatcaaggatacaattgccgcgaactcctag

SEQ ID NO: 130249 - DNA, 537 bp, Artificial Sequence
  Description of Artificial Sequence: Synthetic coding sequence
atgagggagacaagtggctttaccttgaagaagggacgatcagccccactggtcttccacccccctgatgcacttattgccgttcccttcgatgatgatgataagattgtggggggttatacatgtgaagaaaattccctaccttaccaggtgtccctgaacagcggctcacacttttgtggaggaagcctgatctcagagcaatgggttgtgtcagctgcccactgttacaaaactaggattcaggttagactgggggagcacaacatcaaggtgctcgaggggaatgaacagttcattaacgccgccaaaatcatccggcaccccaagtacaatcgggataccctagacaatgatatcatgcttatcaagctgagtagtccagcagtgattaacgcgagggtatccactattagtctacctacaacaccacccgccgctgggaccgagtgtctcatttcaggctggggaaataccttgtcgtttggagccgactacccggatgagcttaaatgtctcgacgcccctgttctgtag

SEQ ID NO: 130250 - DNA, 843 bp, Artificial Sequence
  Description of Artificial Sequence: Synthetic coding sequence
atgcgaggggtgtcgtgcttgcaggtcctcttactgctggttcttggggcggcaggtacgcaggggcggaagagcgccgcatgcggacagccacgcatgtcctctcggatcgtaggcggtagggatggacgtgacggtgagtggccttggcaggctagtatacaacatagaggtgcccatgtgtgtggaggaagcctgattgcccctcagtgggtgctcacggcagctcattgcttcccacgcagagccctgcccgccgagtatagggtaaggttgggggccctgcggcttggtagcacttcacctaggactctctccgtgcctgttcgcagggttctgctcccacctgattactctgaagacggtgctagaggagatttggcactgctgcaactgcgaaggccagttcccctgtccgctcgagtccagcccgtctgtctgcctgtgccgggtgccaggccaccacctggtaccccgtgtcgcgttacaggctggggctcgctgcgccccggtgtgcccttacctgaatggcgcccactccagggcgtgcgcgtacccctcctggattcacggacctgcgatggcctataccatgttggcgccgacgttccgcaagctgagcggatcgttcttcctggctccctctgcgctggttacccacagggacataaagatgcttgccagggcgattcaggtggacctctgacctgtctgcaatcggggagttgggttctagtcggagtggtgagctgggggaaggggtgcgccctccccaaccgcccaggagtatacacctccgtggccacctactcgccatggatccaggcccgcgtcagcttctag

SEQ ID NO: 130251 - DNA, 1032 bp, Artificial Sequence
  Description of Artificial Sequence: Synthetic coding sequence
atggcacaaaagggcgtactcggtcccggtcagcttggggccgtagcaatcctgctgtacctgggactgctgcgttcgggcacaggtgcggagggggccgaagctccttgtggcgttgccccccaagcgaggattaccggtggaagcagtgctgtcgccggacagtggccatggcaagtgtccattacctacgagggggtccacgtctgcgggggctccctcgtgtcagagcagtgggtgttgagcgccgctcactgttttcccagcgaacatcacaaggaagcgtacgaggttaagcttggcgctcatcagttggacagctatagtgaggacgccaaagtttccacacttaaggacatcattccacacccctcctatcttcaggaagggtcccagggagatatagcactgctgcagttgagtagacccatcacattttccaggtatatccggcccatctgcttacctgccgcaaacgcatctttccccaatggtctgcactgtaccgtgacagggtggggccacgtggctcccagcgtctcgcttctgactcctaagcccctgcaacagctcgaagtccctttgatctcgcgcgaaacgtgtaattgcctgtacaacatagatgccaagcctgaggagccccacttcgtccaggaagatatggtctgtgctggctatgtcgaaggggggaaggacgcatgccaaggcgattcagggggcccactgtcttgtccagtcgaggggttgtggtatctaacgggcattgtgtcgtggggggatgcttgcggggctaggaacagacccggggtttataccttggcgtcctcgtatgcctcttggattcagtcaaaggtgaccgaactgcagcctagggtcgtccctcagacccaggaaagccagcctgactctaatctctgtggcagccaccttgccttttcttccgcgcccgcacaaggcctgctccgccctatattattcctgcctcttggactcgctcttggccttctgagtccatggctcagcgaacactag

SEQ ID NO: 130252 - DNA, 504 bp, Artificial Sequence
  Description of Artificial Sequence: Synthetic coding sequence
atggcccagaaaggggtgttagggcccggacaacttggggccgtggccatccttctgtacctgggcctcctgagatccggtaccggcaaggaaggagcagccgcgccctgtggcgtcgcaccccaagcccgcattactgggggctcatctgcagttgcaggtcagtggccttggcaagtttccataacttttagtaggtacatacggccaatctgcctccccgccgctaacgcatcattccctaatggcctgcactgtactgtgactgggtgggggcacgtggctccaagcgtttcacttttaacccctaaacctctgcagcaactggaggtgccactgatcagcagggaaacctgcaattgtctgtacaacatcgacgctaagccggaggagccccatttcgtccaggaggacatggtttgtgccgggtacgtcgagggggcccttctgagggttaccctgggcgcccacagccccgctctctggagggtgtctgggacctag

SEQ ID NO: 130253 - DNA, 1197 bp, Artificial Sequence
  Description of Artificial Sequence: Synthetic coding sequence
atggagttggaggagggcaaggccgggtcagggctgaggcagtattacctgtccaagattgaagagttacagctaatagttaatgacaaaagtcaaaatcttcgtcgcctgcaagcgcagcgtaatgaactgaatgccaaggttaggttgcttagggaggagctccagctgttgcaagagcagggctcctacgtgggcgaggtggtgcgagcgatggataaaaagaaagttctcgtaaaagtgcaccccgaggggaaattcgtcgtggatgtggacaagaacattgacatcaatgacgtcaccccgaattgccgggtggccctgcgcaacgatagctacaccctacacaaaatactgcctaataaggttgaccctttggtcagtttgatgatggttgaaaaggtgccagacagcacctacgagatgattggcggcttagataaacaaataaaggaaattaaggaggttatagagctccccgttaagcaccccgagctgtttgaggccttaggtattgcacaacccaaaggagttctgctttacggcccaccaggcaccgggaagaccctccttgcaagggccgttgcacatcacaccgattgtaccttcatccgggtgtctggcagcgagctggtccagaagttcattggcgaaggagcgaggatggtccgtgagctgtttgttatggcacgggaacacgccccaagcattattttcatggacgagatagatagcataggctccagtcgtctggagggcggatctggcggggacagcgaggtccagcggacaatgctagagctgctgaaccagctcgacggtttcgaagccacaaagaatatcaaagttattatggccactaacaggatagatatcctcgattcagcgctgctgcgcccaggcagaattgaccgaaaaattgagttccccccccctaatgaagaagcccggctcgatatcttaaaaatccatagcaggaagatgaatctgacccggggaatcaacttaaggaaaatagccgagctgatgccgggcgcctcaggtgccgaggtgaaaggggtctgtactgaagctgggatgtatgccctcagggaaagacgagtgcacgtcactcaagaagactttgaaatggctgtagctaaagtcatgcagaaagacagcgagaagaatatgagcatcaaaaaactttggaaatag

SEQ ID NO: 130254 - DNA, 765 bp, Artificial Sequence
  Description of Artificial Sequence: Synthetic coding sequence
atggcctcgcttttgaaagtcgaccaggaggtgaaacttaaagttgatagcttcagggaacgtatcactagcgaagctgaggatctggtggcaaactttttccctaaaaagcttctagagttagacagcttcctcaaggaacccatcctcaacattcatgatcttacccagattcactctgacatgaatctgcctgtgcctgacccaatccttctgacaaacagccatgatgggttggatggccccacttacaagaagcgacgacttgacgaatgcgaagaagcatttcaggggactaaagtgttcgtcatgccaaacggcatgctgaagtctaaccagcagctggtggatatcatagagaaagttaaacccgagatacggctcctgatagaaaaatgcaacaccgtgaagatgtgggtgcagctcctaattccaagaatcgaggacgggaacaactttggcgtttccatccaagaggagaccgtggcggaactgaggaccgtggagagcgaagctgcctcgtacctggaccagatcagtaggtactacatcacaagagctaaattagttagtaaaatagcaaagtacccccacgtggaagattatcgtaggactgtgaccgagatcgacgagaaggagtatataagtctgaggcttattatcagcgaattacgaaaccagtatgtgactttacacgacatgatcctgaagaatattgagaagataaagaggcccagatcatctaacgccgagacactctattag

SEQ ID NO: 130255 - DNA, 1323 bp, Artificial Sequence
  Description of Artificial Sequence: Synthetic coding sequence
atgggtcagtctcaaagcgggggccatggcccaggaggtgggaagaaggacgataaggacaagaagaaaaaatacgagcccccagttccgaccagggttgggaagaagaaaaagaagaccaaggggccagacgccgcctccaagctccctctggtgacacctcatacccagtgcaggctgaagctcctgaagttggaacggataaaggactatttgctcatggaagaagaatttatcagaaaccaggagcagatgaaacctctggaggagaaacaagaggaggagaggtctaaggtggatgatctgaggggcacaccaatgagcgttggtactttggaagaaatcattgacgacaatcatgcgatcgtgtcaaccagcgtgggcagcgagcactacgtttccatcctgtcatttgtggataaagacctgctggagccagggtgtagtgttctgctgaaccacaaagtacatgccgttatcggtgtgctaatggatgatacggatcctctcgtgacagttatgaaggtggagaaggccccccaggaaacttacgcggatattggagggctggacaatcagatccaggagatcaaagagagcgtagaattgccactgactcaccctgagtattacgaagagatggggattaaacctcctaagggcgtaatcctctacgggcctcccggtactggaaaaacgctcctagcaaaagccgttgccaaccagactagcgcaacattccttagggtggtggggtccgagctgatacagaagtacttaggggacggacctaaacttgtccgagaactgtttagagtggcagaggaacatgccccaagtatagtctttattgacgagattgatgctataggcaccaagcgctacgattctaacagtgggggcgaaagggaaattcagaggaccatgcttgaactgttgaatcagctggacggcttcgattcacgtggggatgtgaaggtgatcatggcaaccaatcggatcgaaactctagatccggctctgatcaggccgggcaggatcgatcgaaagattgagttcccgttacccgatgaaaagacaaaaaagaggatattccagatccacacgagtaggatgactttagccgacgacgtgaccctagacgacctgataatggctaaagatgacctctcgggtgctgacattaaggcaatttgtacagaggcaggcctcatggctctgagggaacgcaggatgaaggtgactaatgaggattttaagaagtctaaggaaaatgtgctgtacaaaaaacaagaaggtacacctgaggggctgtatctttag

SEQ ID NO: 130256 - DNA, 1104 bp, Artificial Sequence
  Description of Artificial Sequence: Synthetic coding sequence
atggaggaggagttcatcaggaaccaggaacagatgaagcccctcgaggagaagcaagaagaggaaagaagcaaagtagatgacctcagagggaccccaatgtctgtcggaactctcgaggaaattatcgacgacaatcacgccatcgttagcacctccgtgggatcagaacattatgtttcaatactgagttttgtggacaaggacctgcttgagcctggctgcagcgtgctcttaaatcacaaagtacatgcggtgatcggcgtattgatggacgacacagaccccctggtaaccgtgatgaaggtagagaaggcaccccaagagacttacgcagacatagggggattagacaatcagatccaggagataaaagaatctgtggagctgccactgactcaccctgagtactatgaagaaatgggcattaagccccctaaaggcgtcatcctgtatggtccgcccgggaccggtaagactttactggccaaggccgtggccaaccaaactagcgccacctttctgagggttgtcggctctgaattaatacagaaatacctaggagatgggcctaagctcgtgcgcgagcttttcagggtggcagaagagcacgccccaagcatcgtctttatagacgaaatcgatgctattgggaccaaaaggtatgatagtaatagtggcggcgagagagaaatccaacggaccatgttggagctgctgaatcagctcgatggatttgactcccggggagacgtcaaggtcatcatggccaccaacagaattgagactctggaccccgccctgatccgaccggggaggatcgacaggaaaatagaatttccactgcctgatgagaagacaaagaaaaggattttccaaattcatacttctaggatgaccctggctgacgacgtaaccctggacgacctgatcatggctaaggacgacttgagcggggcagacattaaggcaatctgtaccgaagccggactgatggcgctgcgcgagcggaggatgaaagtgaccaacgaggatttcaaaaaatcgaaggaaaatgtgttatataagaagcaggagggaacccccgagggtctttacctgtag

SEQ ID NO: 130257 - DNA, 1302 bp, Artificial Sequence
  Description of Artificial Sequence: Synthetic coding sequence
atgcctgattacctaggggctgatcaacgaaaaactaaagaggacgagaaggatgataagcctatcagggccctggacgagggggacatcgcacttctgaagacttacggacagagcacttactctcggcagattaaacaggtggaggatgacattcagcagctacttaaaaagattaacgagttgaccggtattaaggaaagtgacactggactcgccccacccgccttgtgggaccttgctgccgacaaacaaactttgcagtctgaacagccgctgcaggtcgctagatgcacaaaaataatcaacgctgactcggaggaccccaaatatatcattaacgtcaagcagttcgctaagtttgtggttgacctctctgatcaggtagctccaactgatatagaggagggaatgcgggtgggcgtggacagaaataagtatcaaattcacataccactcccccctaagatagatccaacagtcacaatgatgcaggtggaagagaaaccggatgtcacctacagtgacgtgggagggtgcaaagagcagatcgagaaactgcgggaggtggtggagacgcccctcctgcaccccgagcggtttgtgaacttgggcatcgagccacctaaaggagtgctgctatttgggccccccggcacgggaaaaaccctatgcgcccgtgcggttgctaaccgcacagacgcctgcttcatcagggtgattggctcagaactggttcagaagtatgtgggggaaggtgcacgtatggtgcgggagctgtttgaaatggcacggaccaaaaaggcctgcttgatttttttcgatgagatagacgccattggcggcgctcgcttcgacgatggcgcaggtggagacaacgaagtccagcggacaatgctggagctcataaaccagctggatggattcgatccaagagggaacattaaggtgctaatggccactaacaggcccgacacactagatcccgcactgatgaggcccgggcgcctggaccgaaagattgaattctccctgcctgatctagaggggaggacgcacatcttcaagatacacgcacgctctatgagtgtggaacgtgacatcaggtttgaactactggcgcgcctgtgtcctaatagtacgggggcagaaattaggtctgtgtgcactgaggctggcatgttcgccattcgcgccagacgcaagatcgcaaccgaaaaggactttctcgaggccgtcaataaggtcatcaaatcttatgctaagtttagcgcgacacctaggtacatgacctataattag

SEQ ID NO: 130258 - DNA, 393 bp, Artificial Sequence
  Description of Artificial Sequence: Synthetic coding sequence
atgccagactatctgggtgcagaccagagaaaaacgaaagaagatgagaaagatgacaaaccaatccgagctcttgatgagggggacatcgcactgctaaagacttacggtcagtctacatactctagacagatcaagcaagtcgaagacgacattcagcagcttctaaagaaaatcaacgaactcacaggcattaaagagtccgacacagggctggcacccccggcactgtgggacttggccgccgacaaacagactttgcaaagcgagcagcctctccaggttgcaaggtgtacaaaaatcatcaatgcagatagcgaagatcctaagtacattatcaatgtaaagcagttcgcaaaattcgtggtagatttgagcgaccaggtggcttag

SEQ ID NO: 130259 - DNA, 1302 bp, Artificial Sequence
  Description of Artificial Sequence: Synthetic coding sequence
atgccggactacctgggtgcagatcagcggaaaacgaaagaggacgaaaaggatgacaaaccgattcgcgcactggacgaaggcgacatcgccctgctgaaaacctatggccagtctacctatagtcgtcagattaagcaggtagaggacgacattcagcagttacttaagaaaatcaacgaactcacggggatcaaagagagtgacactggtttggcccctccagcactgtgggatctagccgcggataagcagacattacaaagcgagcagccccttcaggtcgctaggtgtacaaaaataatcaacgctgattccgaggaccccaagtatatcattaatgttaagcaatttgcaaagtttgtggtcgacctcagcgatcaggtggcacccaccgacattgaggagggcatgcgggttggggtggatcgcaataagtaccaaatacacatcccacttccgcctaaaattgaccctaccgtgaccatgatgcaggtcgaggaaaagccagatgtaacctacagcgacgtgggcggttgtaaggagcaaatcgagaaacttagagaagtcgttgaaacccctctgctccatccagaaagatttgtgaacttgggtatcgagccacccaagggagttctcctctttgggccacccggcaccggcaaaacactctgtgctcgagcagttgcaaaccgcacagacgcctgtttcattcgggtgatcggatctgaacttgtgcagaagtatgtgggtgaaggagcccgaatggtgagagagctgtttgagatggccaggacaaaaaaagcctgcctgatttttttcgacgagattgatgccatcggaggcgccaggttcgacgatggagccggaggagataatgaagtgcaaaggacaatgctggagctcatcaatcaactcgatggcttcgacccaagaggtaatataaaggtcctgatggccactaaccggcctgacaccctggatcctgccttgatgagacccggacggctggaccgaaagatagaattttctctcccagacctcgagggtcgaacccacatcttcaaaattcacgctcgctctatgtcagtcgaacgagatattagatttgagctgctggccaggttgtgtcctaacagcacaggcgccgaaatccgatctgtctgcacagaggctggcatgttcgctattcgggctaggagaaagatagcgaccgaaaaggatttcctagaagcagtgaataaagtgattaagtcttacgccaagttctctgctaccccgcgttacatgacttataattag

SEQ ID NO: 130260 - DNA, 393 bp, Artificial Sequence
  Description of Artificial Sequence: Synthetic coding sequence
atgcctgactacctgggggccgaccaaagaaaaacgaaagaggacgaaaaggacgacaaacccattcgggccctcgacgagggggatatagcccttctgaagacctatggccagtccacatattctagacagattaaacaggttgaggacgacatccagcaacttcttaaaaagattaacgaactgacaggcatcaaagagtcggacactggccttgcaccaccagctctgtgggatctggcggcagacaagcaaacactgcagtctgagcagccactccaagtggcccggtgtactaagattattaacgcagattcagaggacccaaaatacatcatcaacgtcaaacagttcgctaaattcgttgtagacctgagcgaccaggtggcatag

SEQ ID NO: 130261 - DNA, 891 bp, Artificial Sequence
  Description of Artificial Sequence: Synthetic coding sequence
atgcgggttggcgtggatcgcaacaagtatcagatccacataccccttccacccaagatcgatccaaccgttactatgatgcaggtggaggaaaagcctgacgttacgtattcagacgtcggtgggtgtaaggagcagatcgagaagctgagggaggttgtagagacacccttgctacaccccgaacgttttgtaaacctcggaatcgaaccccctaagggggtgctcctcttcggccccccggggaccggcaagacactgtgcgcgagagccgtggcaaacaggactgatgcctgcttcatccgcgtaatcgggtcggagctcgtacagaaatacgttggtgaaggcgcccgcatggtgagagaattgttcgagatggcaagaactaagaaggcttgtctgatcttttttgacgaaatcgatgctatcggtggtgcccgctttgacgatggggccgggggcgacaatgaagtgcaaagaaccatgctggagctcattaaccaactcgatgggtttgatccgagaggaaacatcaaggtgttgatggctacaaacaggccggatacactagaccccgccctaatgcgtccgggtaggctggatcgaaagatcgagttcagccttcctgacctggaggggaggacacatatcttcaagattcatgcgcgatccatgtcagtcgaacgcgacatacgcttcgagctactggcgcggctgtgtccaaactctacaggggctgagattcgctccgtttgtacggaggccggcatgtttgccattagggcccggagaaaaatagccacagagaaggacttcctagaggcagtaaacaaggtaattaagagttacgctaagttttcggcaacaccccgctatatgacctacaactag

SEQ ID NO: 130262 - DNA, 1320 bp, Artificial Sequence
  Description of Artificial Sequence: Synthetic coding sequence
atgaatctgcttccaaacatcgagtcgccagtaacccgacaagagaaaatggccaccgtgtgggatgaagccgagcaggatggcataggggaagaggtgctcaaaatgtccacggaggagatcatccaaaggacacgcttgctggactcagagattaagatcatgaagtcagaggtgttgcgggtgactcatgagttgcaagctatgaaggacaaaataaaggagaattctgagaaaattaaggttaataaaaccctgccttacttggtttccaatgttatcgagctcctggacgttgacccgaacgatcaggaagaggatggcgctaatattgatctggattcccagagaaagggcaagtgtgcagttataaagactagtaccaggcaaacctattttttaccggtcatcggcttggtggatgccgagaagctgaaaccaggcgacctcgtcggagtcaataaggactcctatctgatcctggaaactcttcctaccgagtatgatagtcgtgtgaaagctatggaggtggacgagcgccccacagagcagtattcagacatcggcggacttgacaagcaaatccaggaactggtcgaggctatcgtgctgcctatgaaccacaaagagaaattcgagaaccttggtatccagccccctaaaggtgtgcttatgtacggcccgcctggcacaggaaagacccttctggctcgagcctgtgcagctcagaccaaggccacgtttctcaagctcgctggcccccagctcgtgcagatgttcattggggatggtgccaaacttgttagagacgcctttgctctagcaaaagaaaaagcaccttctatcattttcattgatgaacttgacgcaatcggaactaagaggttcgatagtgagaaggcaggcgacagggaagttcagagaaccatgttggagttgctcaaccagttagatggtttccagcccaacactcaagtgaaagtcattgcagccaccaatcgtgtcgacatcctcgatccagcactccttagatctggccgtctcgataggaaaattgaattcccaatgccaaacgaggaggctagagcacgtattatgcagattcactctcggaagatgaacgtgtcaccggatgtcaactacgaggaactcgctcgttgcaccgatgacttcaacggagctcaatgtaaggcagtgtgtgtcgaggccgggatgattgcgcttcgtaggggcgccactgagctcacgcacgaagactatatggagggaatattggaggtgcaagcgaagaaaaaagctaacctgcagtactacgcctag

SEQ ID NO: 130263 - DNA, 1257 bp, Artificial Sequence
  Description of Artificial Sequence: Synthetic coding sequence
atggaagaaataggcatcctagtcgagaaggcccaagatgaaatccccgcactctccgtgtctcgacctcagaccggcctgtctttccttgggccagaaccagaggacctggaagacctttactctaggtacaagaagctccagcaggagctcgaattcctagaagtccaggaggaatacatcaaggacgagcagaaaaatctgaaaaaggagttcctgcatgcccaagaggaggtgaagcgtatccaaagcatccctctggtgatagggcagtttctcgaagctgtcgaccaaaacacagccattgttggttcaaccacgggttccaactactacgtcagaattttatccaccatcgacagggaactgctgaagcccaacgcaagtgtagctctacacaagcattctaatgccctggtcgacgtcttgcctcccgaggctgattccagtatcatgatgttgactagcgatcagaaaccggacgtgatgtatgctgacataggcggaatggatatccaaaagcaggaggttagggaggccgtggagctacccctgacacatttcgagctgtacaaacaaatcggcattgacccaccgcgaggggtccttatgtatgggcccccggggtgtggcaagaccatgttagccaaggccgtggcacatcatactacagccgctttcatccgtgtggtaggctccgaatttgtgcagaagtatttgggggagggtcctcggatggtaagagatgtttttcggctggcgaaggaaaacgcaccggccatcatttttatcgacgaaatcgacgccattgccactaagaggtttgatgcgcagaccggcgcagatagggaagtgcagcgaatcttactggagttactgaaccagatggatggtttcgatcagaacgtaaacgtgaaggtaataatggctactaaccgcgctgacaccctggacccggcgctattgcgacccggccgattagaccggaagatagagtttcctctgcctgaccgtcgacaaaagcgactgattttctccacgataacctcaaaaatgaatctgtcagaagaggttgacctggaggattatgtcgcaagacccgacaagatatcgggggccgatatcaatagcatttgtcaggaatccggaatgcttgcagtcagggagaatagatacatagtgcttgccaaggattttgaaaaagcctacaaaacggtaatcaagaaggatgagcaggaacacgagttctataagtag

SEQ ID NO: 130264 - DNA, 1164 bp, Artificial Sequence
  Description of Artificial Sequence: Synthetic coding sequence
atggaggagattggaatactagtagagaaggctcaggacgagatcccagctctcagcgtttcgcggcctcagacgggtctgtcttttctgggtcctgaaccggaggatctggaagatctctacagcaggtataaagaggaggtgaagaggatacagtccatcccactggtcattggtcagttccttgaggccgtggatcagaataccgcaatcgtgggctccactaccggctcaaattattatgtgagaatactgtctactatcgaccgagaattacttaaaccaaacgcaagcgtagcactacataaacattctaatgctctcgtcgatgtgctgcctcctgaggctgactcatcaatcatgatgctgacctcagaccagaagcccgatgttatgtacgctgacattggcggaatggatatccagaagcaggaagttagagaagccgtggagctgcccctcacgcattttgaactgtataagcagatcgggattgatccccctaggggagttctgatgtacggtccacctggatgcggaaaaaccatgcttgccaaagcggtcgcccatcataccacagccgcctttatccgagttgtcgggtctgagtttgtgcagaaatacctcggggaaggcccccgaatggttagggatgtgttcaggctagcaaaagagaacgcgcctgcaataatctttatagacgagattgatgccattgccactaagaggtttgatgcacaaacaggagccgacagggaggtccagagaatacttctagaactcttgaaccagatggacggctttgatcagaatgtcaatgttaaggtgatcatggccaccaatcgcgccgacactctggaccctgctctcctcagaccgggccgcctagatcggaagatcgaattccctctgcctgataggcgccagaaacggctgatatttagtacaataactagcaagatgaatctgtccgaagaggtagatctggaggactatgtggcccgacccgataaaatttctggggctgacattaacagtatctgtcaagagtctggtatgctcgcagtcagggagaatcggtatatcgtgctggctaaggatttcgagaaggcctataaaactgtgatcaaaaaggacgaacaagagcacgagttctacaagtag

SEQ ID NO: 130265 - DNA, 1221 bp, Artificial Sequence
  Description of Artificial Sequence: Synthetic coding sequence
atggccctcgacgggccagagcaaatggagcttgaagagggcaaggcaggctcaggcctgagacagtactacctctctaagatagaggagctccaactgatcgtgaacgataagtcccagaacctgcgaaggctccaggctcaaaggaatgagctgaacgccaaggtgaggctgctgagggaagaactgcagctgctgcaggaacaaggctcttacgtgggagaagttgtgagagccatggacaaaaaaaaggtgctcgtgaaagtgcaccccgaaggcaagtttgttgtggacgtggacaaaaatattgatattaacgatgtgacccctaattgtagggtcgctctgaggaacgactcctataccctgcacaagatcctgcctaataaagttgatccactggtctcactgatgatggttgagaaggtgcccgattctacttatgaaatgattgggggcttggataaacagatcaaggagatcaaggaggtaatcgagctacctgtgaagcaccccgaactgttcgaggctctgggcattgcgcagccaaagggggtcttactgtacggcccaccaggcactggtaaaactctgctggctcgcgccgtggctcaccacacggactgcacgttcataagggtatccggatccgagcttgtgcagaagttcatcggggagggtgcgcgaatggtgcgagagctattcgtgatggccagggagcatgccccaagcataatcttcatggatgagattgactcaattggaagcagtcgtctggaggggggctctggaggagactccgaagtgcaacgcacgatgttggagttacttaaccagctggacggcttcgaagctaccaaaaatataaaagttattatggccaccaataggatcgacatactcgattcagcacttctaaggcctggaagaattgacaggaagattgagttcccacctcctaatgaggaagcaagactggacatcctgaaaatccattctcggaaaatgaacttgacgcgggggataaacttgcgcaagatagcagagctgatgcccggcgccagtggtgctgaagtcaagggagtttgcactgaggccgggatgtatgccttgcgagagaggagggtccacgttacccaggaggactttgaaatggccgtcgctaaagtgatgcagaaagacagtgagaaaaacatgagcatcaaaaaattgtggaaatag

SEQ ID NO: 130266 - DNA, 1197 bp, Artificial Sequence
  Description of Artificial Sequence: Synthetic coding sequence
atggaactggaggaaggaaaggcagggagcggactgagacaatattacctgtccaaaatcgaagaactgcaactgatagtgaacgataaatctcaaaatttgaggcggctgcaggcccagcgcaatgagctcaacgcaaaggtgaggctgctgagggaagaactgcagctgcttcaggaacaggggagttacgtcggcgaggtagtcagggcgatggacaaaaagaaagtcctggtcaaggtgcaccctgagggcaagttcgtggtggacgtcgacaagaatattgacattaacgatgtgactcctaactgtagagtagcgttacgcaacgactcttatactttgcataaaattcttcccaataaggtggaccccctcgtgtccctcatgatggtggagaaagtgcctgattccacatacgagatgattggtggcctagataaacaaatcaaggagatcaaagaggtgatcgaacttcctgtgaagcatccggagctgttcgaagccctcggtatagcacaaccgaagggcgtccttttgtatggtccgccaggcacaggcaagacattgctcgccagggcggtggcacaccatacggactgtacttttattcgggtctctggctccgaacttgtccagaaattcatcggcgaaggggccaggatggtgcgcgaactcttcgtgatggcaagggagcatgcaccgagcattatcttcatggacgagatcgactctatcggttcctcacgcttggaaggtgggtctggcggcgacagcgaagttcagcgcacgatgctcgagctcttaaaccaactcgacgggttcgaggccaccaagaacatcaaagtcatcatggccaccaaccgcattgacatactcgatagcgctttactcaggccgggccggattgaccgaaagatcgaatttccacctcccaatgaggaggccaggctcgacattctcaagattcactccaggaaaatgaatcttacacgcggcattaatctgcgtaaaatcgcagaattgatgcctggcgcatcaggagcagaagtaaaaggagtttgtactgaagccggcatgtacgccctaagagagcggcgtgtgcatgttactcaggaagacttcgagatggccgttgccaaagtgatgcagaaggattcagagaaaaatatgagtattaaaaaactctggaaatag

SEQ ID NO: 130267 - DNA, 1212 bp, Artificial Sequence
  Description of Artificial Sequence: Synthetic coding sequence
atggcaattcctggaattccttatgagcgaaggttattgataatggccgacccaagggataaagcattacaggactatagaaaaaaactactggagcacaaggagattgatggcagattaaaggagctaagggaacaattaaaagagctaaccaaacagtacgagaagagtgaaaatgatctgaaagccttacaatcagtgggacaaatagtgggcgaagtactgaaacagctgacagaggagaagtttatcgtgaaagccaccaacggccctcgttatgtggtaggatgtagaagacagctggataagtctaagctgaagcctggaaccagggtcgccctcgacatgaccacactgacaattatgaggtacttgccccgcgaggtggacccccttgtgtacaacatgagtcacgaagaccctggtaacgtctcctactccgagattggagggctgtcagaacagattcgggagctcagagaggtcattgagctgccactgactaaccctgaactgtttcaacgcgtggggattatccctccaaaaggctgtctgctctatggcccgcctgggaccggaaaaacattacttgcaagagcagttgcgtctcagttagactgcaactttctgaaagttgtttcctccagcattgtagataagtatattggggagtctgcaagactgattcgcgagatgttcaactatgctagggatcatcaaccttgcatcatttttatggatgagattgatgccatcggtggacgaaggttctcagaaggtacctcagcagatagggaaatacaaagaacactcatggaactgctgaaccagatggacggctttgatactcttcacagggtgaagatgattatggccacgaaccgtcccgacactctggatcctgccctactaagacccggccgactggacagaaagatccatattgacctgccaaatgagcaggcgcgactcgacattcttaagattcatgctggccctatcaccaagcatggggaaatcgactacgaagctatagtcaaactgtccgatggcttcaacggtgctgatctccggaacgtctgtacggaggctgggatgttcgcaatccgggcggatcacgacttcgtggttcaagaagatttcatgaaagcagtccgaaaggtcgccgactccaagaaactggagtccaagctcgattacaaacctgtgtag

SEQ ID NO: 130268 - DNA, 933 bp, Artificial Sequence
  Description of Artificial Sequence: Synthetic coding sequence
atggaccgactcctcaggctcggcggagggatgcccggtctaggacagggcccaccgacagatgctccagccgtggatacagcagagcaagtgtacattagttccctggccttattgaagatgctgaaacacggtagggccggggttccaatggaggtgatgggcttaatgctgggagagtttgtggacgattatacagtcagggtcatcgacgtcttcgccatgccccagtcgggcacaggggtatcggtggaggcggtcgacccagtgttccaggcaaaaatgctggacatgctgaagcagacaggcagacccgaaatggtggttggctggtaccactcccaccccggatttggatgctggctttccggggtcgatattaatacacagcagtctttcgaagccctttctgaaagggcagtggctgttgttgtggaccctattcaaagtgtcaaaggaaaggtggtcatcgatgcctttagactgatcaatgccaacatgatggtattaggacatgaacctagacagacgacatccaatctgggccacctcaataaaccctccatacaggctcttatacacgggcttaataggcattactactctataactatcaactatcggaaaaacgaactagagcagaaaatgttgctgaatttgcacaagaaaagctggatggagggtttgaccctccaggattacagcgagcactgtaaacacaacgaatccgtggtgaaggagatgctcgagctggccaagaattacaataaagctgttgaagaggaggataaaatgacccccgagcagctggctatcaaaaacgttggaaagcaggacccgaaaaggcatctggaggagcatgtggatgtcctgatgacctcaaacattgtccagtgtctcgccgcgatgctggacaccgttgtgttcaaatag

SEQ ID NO: 130269 - DNA, 255 bp, Artificial Sequence
  Description of Artificial Sequence: Synthetic coding sequence
atggatcgcctgcttagactcggaggaggcatgccaggactcggccaaggccctcctaccgacgcacctgccgtggatactgccgagcaggtgtatatcagctccctggctctgttgaagatgttgaaacacggacgtgcgggcgttcccatggaagttatgggcctcatgttgggagagtttgtggatgattatactgtgcgcgttatcgacgttttcgccatgccacagtccggcacaggcgtgtccgtgtag

SEQ ID NO: 130270 - DNA, 2727 bp, Artificial Sequence
  Description of Artificial Sequence: Synthetic coding sequence
atggaggagggtgggcgggataaagcgcccgtccagccccaacagtctccagccgccgcaccaggcggtaccgatgaaaagcctagtggcaaggagcgcagagacgctggcgataaggataaggaacaggaactctcagaggaggataaacagctgcaggatgagctggaaatgctggtggaacggctcggagagaaggatacctcactgtaccgaccagcactggaggagctgcggcgccaaatccgctcttccactacgtctatgacatctgtccccaagcccctgaagttcctgaggcctcattatggcaagttaaaggagatctacgagaatatggctcccggggaaaacaaacggtttgctgccgacattataagcgttttagccatgaccatgtctggcgaaagagaatgtcttaagtaccggctagtcgggagtcaggaggagctggcctcctggggacacgagtatgtccgccacctagcaggagaggttgccaaagagtggcaggagttagacgatgcggagaaggtgcagagagagccactgcttaccttagtgaaggagatcgtgccctacaacatggcccataatgccgagcacgaagcctgcgatctacttatggagatcgagcaagtggatatgcttgagaaagacatcgatgaaaatgcttatgcaaaagtttgcctatacctgacttcttgtgtgaactacgtgcccgaaccagaaaacagtgctctcttgcgctgcgccttgggagtttttcggaagttttctagattcccagaggcactgcggctagcactgatgctgaatgatatggagttagtggaggatattttcacatcgtgcaaggatgtggttgtccagaagcagatggcctttatgctggggcgacacggtgtctttctggagctttcggaagacgtcgaagaatacgaggacctcacagagattatgtctaacgtccagctgaatagtaacttccttgcgctggcccgggaactggatatcatggagcccaaggtaccagacgacatctataagacacatctggagaacaacagattcgggggctcaggaagtcaggttgattctgccagaatgaacctggcatcaagcttcgtgaatggcttcgtcaatgccgcattcggccaagacaagctgcttacagacgacggaaacaagtggctgtacaaaaacaaggaccacgggatgctgtctgcagctgcatccctcggtatgatcctgctgtgggacgtcgacggcgggttgacccaaatcgataaatatctatactctagcgaagactatatcaagtctggcgccttgctcgcatgtgggatcgttaatagcggcgtgcgcaacgaatgcgatcctgcactcgccctgcttagtgactacgtgctccacaactctaacaccatgcggctaggttccatatttggcctggggctggcctacgcaggctctaatcgcgaggatgtcctaactctgctcctgcccgtgatgggggatagcaaatcttctatggaagtggccggcgtcacagccctggcctgtggcatgatcgcggtcgggagctgcaatggagatgttacatccacgattctccaaactatcatggagaaaagtgagacggaactgaaggacacctatgcaaggtggttaccgctcggccttggtctgaatcacctcggcaaaggtgaagccattgaagcgattctggctgcgctggaggtggttagtgagccctttcgcagcttcgccaatacattggtggacgtatgtgcctacgcgggctcaggcaatgtcctgaaggtgcagcagctgttacatatatgcagtgaacactttgacagcaaagagaaggaggaagataaggataaaaaagagaaaaaagacaaggacaagaaggaagcaccggcagacatgggcgctcatcagggagtggccgtgttaggcatcgccctcattgccatgggtgaggagattggcgccgaaatggcactgcgcacctttggtcacctactgcgttacggggaacccaccttgaggcgcgccgtaccccttgcgttggcattaataagcgtatccaacccccggttgaatatcttggacaccctgtcaaagttttctcatgatgctgatccagaggtgtcgtacaattcaatattcgccatggggatggttggctcaggcacaaacaacgcccggcttgccgcaatgctgcgacagcttgcccagtaccatgcaaaagaccccaataatcttttcatggtgcgactcgctcaaggcctgactcacttaggcaaaggcactttgactctctgtccataccacagtgatcgtcaactgatgtcacaggtcgccgtagctggactgctcaccgtccttgtgagcttcctggacgtgcggaacatcattcttggcaaaagccactacgtgctgtatggtttggtggccgccatgcaacccaggatgctcgtgacctttgacgaagagctgcgtccactccccgtgagcgtaagggtggggcaggcagttgacgtggttggccaggcgggtaaaccaaaaaccataaccgggtttcagacgcacaccacaccggtgctcttagcccatggggaaagggctgagctggctaccgaagaattcctgcccgttaccccgattctggaaggcttcgtgatcttacgcaaaaaccctaactacgacctctag

SEQ ID NO: 130271 - DNA, 1743 bp, Artificial Sequence
  Description of Artificial Sequence: Synthetic coding sequence
caatgtactgcccagcagcagctgttaggtctatcatcaggagcaggacatcatggagcgcagttaatgctccagaatcccccaagagagcagcaagtgtgggggcagtggctttccggagggctgtgcccccacgaaccgggactgctcttctgcgaatggctgtgcgagtgctccttttgggataagttactcaccgatgatggcaacaaatggttgtataagaacaaagaccacggaatgctgtcagcggcagcctctttgggcatgatcctgctctgggatgtggatggaggacttacacagatcgataagtacctctattctagcgaggattacatcaaaagtggagcactgctggcttgtggcattgttaactcaggggtgcgaaatgagtgtgatccggcattagctctcctgagcgattacgttctacacaactcaaacacaatgcgactcggatccatcttcggactgggacttgcctacgccgggtcaaaccgagaagacgtactgactttactgctgcccgtcatgggagatagcaaaagcagcatggaggtggccggggtcaccgccctggcttgtggtatgatagccgtagggtcttgtaacggtgacgtgacctcaactattctccagactattatggagaaaagtgaaactgagttaaaagacacgtacgcgagatggctgccactcggcctcggccttaaccatcttggaaaaggcgaagcaattgaggccattctggccgccctggaggtggtctccgaaccattccgcagctttgctaacacgttagtagacgtctgcgcatatgctggcagcgggaacgtcctgaaagttcaacagcttctgcatatctgcagcgaacactttgacagcaaggaaaaagaggaggacaaggacaagaaggagaagaaggacaaggataaaaaggaagctcccgccgacatgggagctcaccagggcgtggccgtccttggccccttactactgtgggggcgccgactggtgcagaggtggcactacgagccttaccatcagctgaggtacggcgagccgactctgaggagggccgtgcctttggccttggctttgatcagcgtaagcaatccaaggctcaatatcctggatacacttagcaaattctcacacgacgctgatcctgaagtctcgtacaactccatttttgccatggggatggtgggctcgggaacaaataacgcacgactcgccgccatgctccgtcaactggcgcaataccacgcgaaggatcccaacaacctgttcatggtccggttagcacagggtctcactcatctggggaaggggaccctcaccctgtgcccctatcactctgatcgtcagctgatgagccaagtcgccgtggccggattactcacagtgcttgtatcattcctggacgtcagaaacatcattctggggaagtctcattacgtactctacggcttggtagccgccatgcaaccccgaatgttagtgactttcgacgaggagctaagacctctgccagtgtcagtgcgggtagggcaggctgtggacgttgtagggcaggcaggtaaaccaaagactatcactgggtttcagacacacactactccggtgctcctggctcatggtgaaagggccgagttagcaacggaagaattcctaccagtgacaccaatcctggaagggtttgtttttggaaggacacctatcatgatctcaaagtag

SEQ ID NO: 130272 - DNA, 2703 bp, Artificial Sequence
  Description of Artificial Sequence: Synthetic coding sequence
atggaggagggcgggagagacaaggctcccgtacagccacagcagtccccagcggccgccccggggggtacagacgaaaagccatcggggaaggacaaggaacaggagctgtcagaagaggacaaacagcttcaggatgagctggagatgctagtcgagcggctaggagagaaggatacctccctgtatcgtcctgccctcgaggagctgcgtagacagatcagaagttccactacttctatgacctccgtgcctaagcccctgaaattcctccgcccccattacgggaaactaaaagaaatctacgaaaacatggcccccggagagaacaaacggtttgctgccgatatcatttcagtgttggcaatgaccatgagcggtgagcgcgagtgcctaaaatatcgcctggttgggtctcaggaagaattggcatcatggggacacgagtatgtgcgccatctggctggtgaagtcgccaaggagtggcaggaactagacgacgccgagaaagtgcagcgcgaacctttgttaactttggtgaaggagatagttccttacaatatggcacataacgctgaacacgaggcctgtgatctcctgatggagatagagcaagtcgacatgcttgagaaggatatagacgaaaatgcatacgccaaagtgtgtctctatttgacctcttgcgtcaactatgtgcctgagccagaaaactctgccctcctgaggtgtgccttgggcgtttttcgcaaattctcgcgttttccagaggccctccgcctggctctaatgctaaatgacatggagctggttgaagacatctttacaagttgcaaggacgtggttgtccagaagcagatggccttcatgctgggcagacacggagtttttttagaactgtcagaggacgtggaagaatacgaggacttaaccgagattatgtctaacgtacagctaaactcaaatttcctagcccttgctcgggaactcgatataatggaacccaaagtacctgacgacatttacaaaacccacttggagaacaatcggttcggcggctctggttcgcaggtggacagcgcccgtatgaatctggcaagctcgttcgtgaacggcttcgtaaacgcagcatttggccaggacaagctccttacagacgatggaaacaagtggctttataagaataaggaccacggtatgttgtctgccgcagccagcctaggcatgattctgctgtgggatgtcgacgggggcttgacgcagatagataaatatctttactcgtcggaagattatatcaaatccggggctctgctggcgtgtggaatagtgaactccggcgtccggaatgagtgtgaccccgcgctcgcactgctctcggattacgttctacataatagtaatactatgaggttgggctcgatctttgggctcggacttgcctatgccggtagtaatcgcgaggatgtgctgacactccttctgcctgttatgggagactctaaatccagcatggaggtggctggcgtgacagccttagcctgcggaatgatagcagtgggcagctgcaatggagacgtgacttcgaccatcttgcaaacaattatggaaaaaagtgagaccgagctgaaggacacgtacgcacgctggcttccattgggcctgggactgaatcaccttgggaagggagaagcaatcgaggccattttagccgcactcgaggtggtgagcgaacccttccgatcattcgccaataccctcgtagacgtgtgtgcatacgctggaagtgggaatgtacttaaagtccagcagctgctgcacatttgctcggagcacttcgatagtaaagagaaagaggaagataaagacaaaaaggagaagaaggacaaggacaaaaaagaggcacctgccgatatgggagcacaccagggtgtggccgttctcggaattgctctgatcgcgatgggtgaggaaatcggggcggagatggccttacgcacgttcgggcatttgttgagatacggcgagccaaccttgcggcgcgccgtgcctctggcactggcccttatcagcgtgagtaacccacgcctgaatattctcgataccctctccaagttttcacacgatgctgaccccgaggtcagttacaatagcatctttgccatgggcatggtgggctccgggacaaacaatgcgcggttggctgccatgttgcgccagttagcacagtaccacgctaaagaccctaataacttatttatggtgcggttggcacagggactgacacacctggggaagggtaccttaaccttgtgcccctaccattctgatcgccagctgatgtcgcaggtggctgtcgcaggtcttctgacagtgctggtgtcatttctcgacgtccgtaatatcatcttgggtaaaagtcactacgtattgtatggcttagtggctgccatgcagccccggatgctggtgaccttcgatgaagaactgaggcctctacctgttagcgtgcgcgtggggcaggctgtcgacgtcgtgggacaggccggcaaacccaagactatcacaggcttccagactcacaccactcccgttctgttggcacatggagaacgagccgaattggctaccgaagagttcctccccgtgacccccattttagaaggatttgtcattttacggaagaatcctaactacgacctgtag

SEQ ID NO: 130273 - DNA, 552 bp, Artificial Sequence
  Description of Artificial Sequence: Synthetic coding sequence
atggacgcgagccctagtccattctcactccccaaaaaactcaacgagctgtcggccagacgtggctcagatgagcttctgagctccgggattataaacggtcctttcactatgaatagttcaacacctagcacagccaacggcaacgattccaaaaagttcaagagagatagacccccctgctcccctagcagggtgctgcatctgaggaaaatcccctgcgacgtcactgaagctgagattatttctctgggcctaccctttggcaaggtgacaaacctgctgatgcttaagggcaagtcccaagcctttctggagatggcttctgaggaggccgcagtgaccatggttaactattacacacctatcacacctcatctgagaagccagccagtgtatatacaatattccaaccaccgcgagctcaagacggacaacctgcctaaccaggcacgtgctcaggcagcattgcaggccgtttccgcagtgcagtccggaagcttggccctgtctgggggcccaagtaatgaaggaactgttctccccggttag

SEQ ID NO: 130274 - DNA, 474 bp, Artificial Sequence
  Description of Artificial Sequence: Synthetic coding sequence
atggttacaagcctggcctacacacaccacggcaggcagtatctggcacaagaaggcgtgattgaccagatatccaacatcattgtgggtgcggatagtgacccatttagtagtttctatttgcccggcttcgtcaaattcttcggcaacctggcggtgatggactctccacagcagatctgtgagcgatatccgatttttgtggagaaagtgtttgagatgatcgaatctcaggatcctacgatgatcggagtggccgtggatacagtcgggattctcggttcaaacgtggaaggtaaacaagttttacagaagaccggatggtacgatcttgcgctgttcagggacattcttattttcgacagaggctctatctgtaagttcatatgctggtgggtcaattatatcgtggagaccatcctgtgggttgccgtgctactcacaatgactctgtacagctgtttgaagatttag

SEQ ID NO: 130275 - DNA, 1386 bp, Artificial Sequence
  Description of Artificial Sequence: Synthetic coding sequence
atggccgcccaggcactggctcttttacgcgaggtggcccgacttgaagcaccactagaggagctaagagcgttgcactctgtcctccaggcggtgccactgaacgaactgcggcagcaggctgcagagttgcggttggggcccctattcagccttctcaatgaaaatcaccgcgagaagacaacactgtgtgtatccatcttggaacggttacttcaggccatggagcctgtgcacgttgctcgaaacctcagggtagacctgcagcgaggtctcatccacccagatgatagcgttaagatattaactcttagtcagatcggccgaattgtggagaactcggacgccgtcacagagattctgaataacgcagaactgctgaagcagatcgtttattgcatcggaggcgagaatttgagcgtggctaaggcactcatcattgagatcagttctgtgagccctgaaagtctgaattattgcacaacttctggactggtcacacagctgctgcgcgagttgactggggaggatgtccttgtgcgggctacctgcattgagatggtcacatctctggcctatacacatcacggacggcagtatttggcacaggagggtgtgatagaccagatatctaacattattgtgggtgccgattctgatcctttttcatcattctatttacccggattcgttaagtttttcggcaatcttgctgtgatggatagcccacagcagatctgcgaaagatatcccatctttgtagaaaaagtgtttgaaatgatcgaatcacaggacccaacgatgatcggcgttgcagtagacacagtgggaatccttggctctaacgtcgaaggcaaacaggtactccagaagacaggcacccgatttgagcggcttctgatgcggattggacaccagtctaagaatgcccctgtcgagctcaaaatcagatgcctggacgcaatatcatccctcctttaccttcccccggaacagcagactgacgatctcctgcgaatgaccgagtcgtggtttagctcgctctccagagatcccttagaactgttccggggcatttcttcccagccattccccgagctccactgtgctgcccttaaagtctttactgccattgctaaccagccttgggcccaaaagctgatgttcaactccccgggatttgtagaatatgtggtcgatagaagtgtcgaacatgacaaagcctctaaggacgccaagtacgaattagtaaaagctctcgcaaactcgaaaactattgccgaaatcttcggaaatccaaactacctccggctgaggacctatctctctgaaggaccctactacgtgaagccagtgagcactacagcagttgaaggggcagaatag

SEQ ID NO: 130276 - DNA, 294 bp, Artificial Sequence
  Description of Artificial Sequence: Synthetic coding sequence
atgcgcatcgggcaccaaagcaagaacgcccctgttgagttaaagatcagatgtttggacgccataagctccctcttatatctgcctccagagcagcagaccgatgatctgcttagaatgacagaatcatggttctcgagcctctctagggatcccctggagttgttccggggcatttccagccagccttttccggagctgcactgtgcagctttaaaggtgtttacagggcggaaacatttgcatctggaggagctggtgggaggcaaccaagtcaagaataccgtggagtag

SEQ ID NO: 130277 - DNA, 510 bp, Artificial Sequence
  Description of Artificial Sequence: Synthetic coding sequence
atgatttgccttgttttgacaatctttgccaatctttttccagctgcgtgcacgggggcccacgaacgaactttcttggccgtcaaaccagacggagtacagcggcgcttggtgggagagatcgtgaggaggttcgaacgaaagggttttaaactcgtggcgttgaagctcgtgcaggcgagtgaggaactgttgcgcgagcactatgcagaactgagagagcggcctttttacggtcgcctggtcaaatacatggcttcaggacccgtagtggcgatggtctggcagggcctggatgtggtgcgcacgtccagggcactgatcggcgccacaaatcctgccgacgctcccccgggaacaattagaggcgacttctgtattgaagtgggcaagaacctcattcacgggagcgacagcgtcgaaagtgctaggagggaaatcgctctgtggtttcgcgcagacgagctgctgtgttgggaggattctgccggacactggctgtatgagtag

SEQ ID NO: 130278 - DNA, 744 bp, Artificial Sequence
  Description of Artificial Sequence: Synthetic coding sequence
atgtacggcatgtttaagaaggtgaacgctagagaacgcattgtcgggtggtaccacactgggcctaagctccacaagaatgacatagcgattaacgagctcatgaaacgctattgcccaaactccgtcctcgtgattattgacgtaaagccaaaggatcttggtctccccaccgaagcctatatttccgtggaggaagtccacgatgacggaacgcctactagtaagaccttcgagcacgtcacatccgaaattggggcggaagaggccgaagaagtgggcgtggagcatctgctcagagatattaaagacaccacagttggaactctctcacagcgcataactaaccaggtccatggactaaagggcctcaactctaagctcctggacatccggtcttacttagagaaagtcgccactggaaagctacccatcaaccaccagatcatataccagttacaagacgtttttaacttattgccagatgtgtctctgcaggaatttgtgaaggccttctacttgaagaccaatgatcaaatggtcgtggtatatctggcttctctgatccgctccgtagtggcactgcataatctcatcaacaacaagattgcaaaccgggatgcagagaagaaggaagggcaagaaaaggaagagagcaaaaaggaccgaaaagaggataaggaaaaagacaaggacaaagagaagtctgacgttaaaaaagaggagaagaaggagaaaaagtag

SEQ ID NO: 130279 - DNA, 624 bp, Artificial Sequence
  Description of Artificial Sequence: Synthetic coding sequence
atgtctgatgaagaggccagacaatctggcggaagtagccaggctggggtggtaacagtcagcgacgtgcaggaactgatgcgaaggaaagaagaaatcgaggcacagatcaaggcgaactacgatgtgttggaatcccagaagggaatcggtatgaatgaaccactggtggattgtgaaggataccctagaagcgatgttgatctgtaccaggtgagaacggctaggcataacatcatctgcctgcagaacgaccataaagccgtcatgaagcaggtggaggaagcgttgcaccagctgcatgccagggataaggaaaagcaagcccgcgacatggcggaagctcataaggaggcgatgagtagaaaattgggccagagcgagagccaagggccaccacgcgcctttgcgaaagtcaatagcattagcccaggctcccccgcctccattgcaggcttgcaggtcgatgacgagattgtggagtttgggtccgtcaatacacagaacttccagtctttacacaatataggttcggtcgtgcagcactctgagggagccctggctccgaccatactgctcagcgtctcaatgaacctgacaaccccgggaacaagctccagatag

SEQ ID NO: 130280 - DNA, 672 bp, Artificial Sequence
  Description of Artificial Sequence: Synthetic coding sequence
atgagtgacgaagaggctaggcagagcgggggttcttcacaagcaggagtagtgaccgtttctgacgtacaggaactgatgcgccggaaagaagagattgaggcgcagatcaaagccaactacgacgtcctggagtcacaaaagggtattggaatgaatgagcctcttgtggattgcgaagggtaccctaggtccgatgtagacctctatcaggtacggaccgctcgacataatatcatttgcctgcagaacgaccataaagctgtcatgaagcaggtggaggaggccttacatcagttacatgcccgggacaaagaaaagcaggccagggacatggctgaagctcacaaagaagccatgtccagaaagttgggacagtcagagagtcagggaccacctcgggcatttgccaaagttaacagcatcagcccagggtctccagcatccattgctggcctacaggttgatgatgaaatcgtcgaattcggatcagtgaacactcagaatttccaatccctccacaacattgggtccgtagtgcaacactctgaaggcaagccccttaacgtgacagtaatccggagaggggagaaacatcaattgcggctggtgccaacaaggtgggcaggtaaagggctccttggatgtaacattataccactacagaggtag

SEQ ID NO: 130281 - DNA, 411 bp, Artificial Sequence
  Description of Artificial Sequence: Synthetic coding sequence
atgctgctcaaacttaaagagaaagcaagcctcactttggctgtgggaaccctgcccttcccaagtcagtttaacttcgtccctccgggtcgcatgtgcagggtagccggctgggggcgcacaggggtgctcaagcccggtagcgacaccctgcaagaggtgaagttacggctcatggaccctcaagcctgtagtcactttcgtgattttgaccacaacttgcagttgtgtgtgggtaaccccaggaaaacaaagtctgcctttaagggcgattccggaggaccccttctgtgtgcaggagtcgcccaaggcatcgtgtcatacggcaggtcagatgcaaaaccaccagctgtgtttacaaggattagccattataggccctggatcaaccagatcctgcaagctaactag

SEQ ID NO: 130282 - DNA, 753 bp, Artificial Sequence
  Description of Artificial Sequence: Synthetic coding sequence
atggctatgctgagggtccagcccgaggctcaggcaaaagtagacgtgttccgtgaggatctgtgcaccaagactgaaaaccttctggggagctattttccgaaaaaaatctctgagctcgacgcctttttgaaggaaccagcccttaatgaagctaatttaagtaacctgaaagcacctctggatatccccgtacctgaccctgtaaaggaaaaggaaaaggaagaaagaaagaaacaacaggagaaagaagataaggacgagaaaaagaagggcgaagatgaagacaaggggcctccctgtggcccagtcaactgcaatgaaaagattgtggtgttgctgcagagactgaaacctgagataaaggacgttattgaacagctgaacctggtaactacatggctacagcttcaaatccccagaatcgaagacggaaataatttcggcgtcgccgtccaggagaaggtgtttgaactgatgactagcttacacacgaagctggaaggttttcatacccagatttcaaagtactttagtgaaaggggagacgccgtgactaaggcggccaagcaacctcacgtcggcgattatcgccagttggtgcacgagcttgacgaggcggagtatcgcgacatccgacttatggtaatggaaattagaaacgcctacgtgagacgccagggccagggtcgcggcggccagagacagctgagccaagcaacccattctcttacactgcaggccagagggtag

SEQ ID NO: 130283 - DNA, 627 bp, Artificial Sequence
  Description of Artificial Sequence: Synthetic coding sequence
atgggtgaagtggagatcagtgctttggcttacgtcaagatgtgcctccacgcagcacgataccctcacgctgccgtcaatgggctctttctggctcctgcaccaaggagcggagagtgtctgtgcctgacagattgcgtgccactgttccatagccatctggccctaagcgtcatgctcgaggtggccctgaaccaggttgatgtatggggagcacaggcaggtttagtcgtcgccggctactatcacgcgaacgccgccgtaaacgatcagtcacctggcccactggctctgaagatcgctggtcggatagcggaatttttcccagacgctgttcttatcatgttggacaatcagaaactcgtgccacaaccacgtgtcccccccgtcattgtcctagagaaccaaggacttcgttgggtccccaaagacaagaacctcgtgatgtggcgggattgggaggagagcaggcaaatggtgggagccttgctggaggatagggcgcaccagcacttagttgattttgactgtcacctagatgacatccgacaagactggacgaatcaacggctcaacacacagatcactcagtgggtcgggccaacaaatggtaacgggaatgcatag

SEQ ID NO: 130284 - DNA, 804 bp, Artificial Sequence
  Description of Artificial Sequence: Synthetic coding sequence
atggcctctctcttgaaggtggatcaagaggtgaagctgaaagtagattccttccgtgagagaatcacaagtgaagcagaagaccttgttgcaaacttctttccgaagaaactgctggaactggactcttttcttaaagagcccatcttgaacatccatgacctgacgcagattcattccgacatgaatctgcctgtgcccgatccaatccttctgacaaatagccatgatggccttgatggacctacttacaagaaaaggaggttagatgaatgtgaggaggccttccaaggcacaaaagtgtttgtgatgccgaacggtatgttgaaaagcaaccagcaactggtggatattatcgagaaagtgaaacctgaaatcagactgctgatagagaagtgcaacacccccagcggaaaggggccacacatctgttttgacctgcaggtgaagatgtgggtgcagcttctaataccacgaatcgaagatggaaacaacttcggcgtatctatccaggaagaaaccgttgccgaactgcgcaccgtcgagtctgaggcagcctcctatctggatcagatatccagatattatataacccgcgcgaaactggtttccaagatcgccaaatacccacacgtcgaggattacaggaggactgtaaccgagattgacgaaaaagaatatatcagtcttcggctgattatcagcgaacttaggaaccagtacgtcaccctacacgatatgatcctaaaaaacatagaaaaaattaagaggcctagatcatctaacgcagaaaccttgtattag

SEQ ID NO: 130285 - DNA, 765 bp, Artificial Sequence
  Description of Artificial Sequence: Synthetic coding sequence
atggcctcacttctgaaagtcgaccaggaggtgaagctaaaggttgattcctttcgggaaagaatcacatctgaggccgaagatctagtggccaacttctttcctaagaagctgctcgaacttgatagctttctcaaggagccaattctaaatattcatgatctgacccagatccactcggacatgaatctgcccgtacccgatccaattcttttgaccaactctcatgatgggttagatggccctacatataagaagagaagattagatgagtgcgaagaggcatttcagggtacgaaagtgtttgtgatgcccaacgggatgttaaagagtaaccaacaactcgtcgacatcatcgagaaggtcaagcccgaaatccggctactcatcgaaaaatgcaacactgtcaaaatgtgggtacagctcttgattccccggattgaggatggcaataatttcggagtttccatccaggaggaaacagtggcagaactcaggacagttgagtccgaggccgcaagctatctcgaccagatatctagatactatatcacacgggcgaaattggtgagtaagattgccaaatatccacacgtcgaagactaccgtagaactgtcaccgagatcgatgaaaaggagtatatctcattacggctgatcatctcggagctccggaatcagtatgtcacactgcacgacatgatcttgaagaatattgagaaaatcaagcgacccagatcgagtaatgctgaaactctgtattag

SEQ ID NO: 130286 - DNA, 48 bp, Artificial Sequence
  Description of Artificial Sequence: Synthetic coding sequence
atggccagccttctgaaggtggatcaggaagtcaaattgaagctctag

SEQ ID NO: 130287 - DNA, 393 bp, Artificial Sequence
  Description of Artificial Sequence: Synthetic coding sequence
atggccagcctgttgaaagtggatcaagaggtgaaactgaaggtggactcattccgagaaagaattactagcgaagccgaagacttagtcgccaatttcttcccaaaaaagctgcttgagctggacagttttttgaaagagcccatcctgaacatacacgaccttacccagattcacagtgatatgaatctaccagttccagacccaatcttgctgaccaactctcatgatggtctggatgggcccacatataaaaaaagacgactggacgaatgcgaggaagctttccaaggccagaacgttggcacagcccccgactcccaggatcgtaggtggaaacagctctggggggtgcactccggcggcaatagttgccgtgccaaaaactgttag

SEQ ID NO: 130288 - DNA, 582 bp, Artificial Sequence
  Description of Artificial Sequence: Synthetic coding sequence
atgaatctcccggtgccagacccaattctcttgactaacagccacgatggcctggatggccctacatacaaaaaacgaagactggatgaatgcgaggaggcgttccaggggaccaaagtctttgtgatgcctaatgggatgctcaagtccaaccaacagctagtagatatcatcgagaaggtaaagcccgagatccggcttctcatcgagaagtgcaatactgtgaagatgtgggtccagctgctgattccccgaattgaggacggtaacaatttcggggtttctatccaggaggagacagttgcggaactcaggaccgtggagtctgaggccgcttcctatctagaccagatttctcggtattatataacccgcgccaaactggtgtcgaagatcgccaagtacccccacgtcgaggattaccgcaggaccgtcaccgagatcgacgaaaaggaatacatttctctgaggcttattatcagcgaactcaggaatcagtatgttactctccacgacatgattctcaagaacatcgagaaaattaagagaccgaggagcagtaacgctgagaccttgtattag

SEQ ID NO: 130289 - DNA, 5532 bp, Artificial Sequence
  Description of Artificial Sequence: Synthetic coding sequence
atggagcccgccgagcgcgcaggggttggagagccaccagaaccaggcggacgccctgaacccgggccacgcggatttgtcccacagaaggaaatagtttacaataaactgctcccttacgctgagagactcgacgccgagtccgatcttcagcttgcacagattaagtgcaatctgggccgagctgtccaacttcaagaactctggcccggtgggttgttctggactcgaaagctgagcacttatatcaggctttatggcaggaaattttccaaggaggatcacgtgctcttcataaaactcttgtacgagctggtctcgattcctaagctggagatctctatgatgcagggctttgctcggttgctgatcaacctgttaaaaaagaaggagctgctcagccgagcagaccttgaactgccttggcggcccctatatgacatggtcgagaggattctgtattccaaaaccgaacacctcggcttaaactggttccctaattcagtggagaatattctaaagacactcgttaaatcttgtcgaccatacttcccagccgatgctacggcagagatgctcgaagaatggcgaccactaatgtgtccatttgatgtgacaatgcagaaggctataacctacttcgaaattttcctgcccacctctttgcctcccgaactccaccataaggggttcaagctgtggttcgatgagctgattggcctgtgggtctccgtccaaaacttgccacagtgggaaggtcagctggttaacctgttcgcccgtttagccactgataatataggatacattgattgggacccgtacgtgcctaagatattcacgcgaattttgcggtcccttaatctgcccgtggggagtagccaggtcttggtgccacgtttcctaacaaacgcatacgacataggccacgctgtcatctggatcacggccatgatgggcggcccgagcaagttggtgcagaaacacctcgctggacttttcaattcaatcacctcattttaccatccctctaataacgggaggtggctaaataagctcatgaaattgctgcagcgactgccaaacagcgtggtgcggcgtttacacagggaacggtataaaaaaccctcctggctaacaccagtgcccgattcacacaagctgactgaccaggatgtgactgatttcgtgcagtgtattattcagccagtactcttggctatgttctccaagactggaagtctggaggcagcccaagccctgcagaacttggcactgatgagaccggaactggtgattcctcccgtgctcgagcgtacttatcccgccctcgagaccctgacagagcctcatcagctgaccgctaccttgtcctgcgtgataggggtggccaggagcctggtgtcaggcggacgctggtttcctgagggaccgacgcacatgctcccgctgcttatgagggccctaccaggagttgatccaaatgacttcagcaagtgtatgatcacttttcagtttatagctacatttagcactctcgtccctcttgttgattgtagcagcgtgctccaagagcggaatgatttaactgaggtggaacgagaactttgtagtgctaccgctgagttcgaagactttgtgttgcagttcatggacaggtgctttggacttattgagagcagtacactggaacaaaccagggaggaaacagagaccgagaagatgacccatctggagtctttagtcgagttagggctgagcagtacattctccactatcctcacgcaatgttctaaggaaatttttatggtcgccctgcagaaggtgtttaatttttctacgagccacatctttgaaactcgggtcgccgggcggatggtcgcggatatgtgccgggctgctgtaaagtgctgtccagaggagtcactgaagcttttcgtaccacattgttgtagtgttattacccagctaacaatgaacgacgatgttttaaatgatgaggaacttgataaagagctcttatggaacctccagctgctgtcagagattactcgtgtggacggtcgcaagctgctgctctaccgggaacagctggtgaagattctgcagcggacacttcacctgacatgcaagcagggctatacactatcatgcaatcttttgcatcatctgctcagaagtaccactctaatctatcctaccgagtactgtagcgtgcccggcgggtttgacaagcctccctcagagtattttcccataaaggattggggcaaaccgggcgatctttggaatcttggaatacaatggcacgtgcccagttctgaagaagtttcttttgctttttacctgctcgactctttcctgcagcccgaactcgtcaaactgcaacactgtggggacggcaagttggagatgagccgagatgacatcctgcagtccctcaccatcgtccataactgcttgatcgggtcaggaaaccttctgccaccactaaaaggagagcctgtgaccaacctggtcccaagtatggtcagcctcgaggagacaaagctctatacaggattggaatacgacctctccagggagaaccacagagaagtgatcgctaccgtaattcgaaaattactgaatcatatactggacaatagcgaggacgacaccaaatcactgtttttgattattaaaatcattggtgacctactgcaatttcagggaagtcacaaacacgaattcgattccaggtggaaatccttcaatctggtcaagaagtctatggagaaccggctgcatgggaagaaacagcacattcgtgcacttttgattgatcgggtgatgctacagcatgagcttagaaccctcacagtcgaaggctgtgaatacaagaaaatccaccaggatatgattcgcgacctcctgcgcctgagcactagtagttactcacaggttcggaacaaggctcagcagaccttcttcgcagccctgggtgcatataatttctgctgccgggacatcatacccttggtgttagaatttctgaggcctgaccgccaaggagtgacgcaacagcagtttaagggcgccctgtactgtctcctgggaaaccacagtggcgtatgcttagcgaatctccatgactgggactgtattgtacaaacgtggcccgccatcgtgagttcgggcctgtcccaagccatgagccttgagaaaccctccatcgtgcgactctttgacgacctggctgagaaaatccaccgccagtacgaaacaattgggctcgacttcactatcccaaagagttgcgttgagatcgccgagcttctgcaacagtccaagaaccctagtataaatcagattctcctctcccctgagaaaatcaaggaaggcatcaaacggcagcaggagaagaatgccgacgccttaagaaattacgaaaacctcgtggataccctgttggatggggtggaacagaggaatctgccctggaagttcgagcatataggaattgggctcctctcactcctcctgcgggacgatagggtactcccactaagggccattagattctttgtggaaaatttgaaccacgacgccattgtggtgcgcaaaatggccatttccgcagtggctggaattctaaagcaacttaaacgtacgcacaaaaaactgactataaatccttgtgagatatctggatgcccaaagcccacccagatcatcgcgggagatcgacccgacaaccactggctgcattacgattccaaaacaatcccccgaaccaagaaagagtgggagtcctcttgttttgtggagaagacgcactggggctattatacatggcccaaaaacatggtggtgtatgccggcgtggaagaacagcccaagctggggcgatctcgagaggacatgaccgaggcagaacagatcatcttcgaccacttttctgatcctaagttcgtcgagcagcttataaccttcctctccctggaggaccgcaagggcaaggacaaatttaatcccaggaggttctgtttgttcaaaggtatttttcgcaactttgatgatgcttttctccccgtgcttaagcctcacctggagcacctcgttgctgatagccacgagtccacacagcggtgtgttgcagagataattgccggccttattcgcgggtctaagcactggacatttgagaaagtcgagaaactctgggagctactatgccccctgctccgcactgctttgtccaatattactgtggagacatataacgactggggtgcctgcatagcaacttcttgcgaatcccgggatcccagaaaactgcattggctgttcgaactactgctggaatcacccctctcgggcgaagggggctcgttcgtggatgcatgtcgcctgtacgtgttgcagggggggctggcccagcaggaatggcgtgtgcccgaacttctgcatcggctcctgaaatatttggaacccaagctaactcaggtgtacaagaacgtgcgcgagcggattgggtcagtcctgacttatatctttatgattgacgtctccttgcccaacactaccccgactatttctcctcacgtcccggagttcacagcaaggatattggagaagctgaagccactgatggatgtggatgaagaaatacagaaccacgtgatggaggaaaatgggattggagaagaggatgagcgtactcaaggcattaagctgttgaagactatcttaaagtggctcatggcctccgccggaagaagtttttctactgctgtgactgagcaactccagcttctgcccctgttcttcaaaatcgcacctgttgaaaacgacaactcatacgacgagttaaagcgtgatgccaagctttgcttaagcctcatgagccagggactgctgtacccccatcaggttccgctggttctgcaggtgctgaaacaaacagctagaagttccagttggcatgctcgctacacggtgttaacgtaccttcagaccatggtattttataatctgtttatctttcttaacaatgaggacgctgttaaagacatccgctggcttgtaatatccctgctggaggatgaacagctagaggtcagggaaatggcagcgacaacgctgtctgggcttttgcagtgcaacttccttactatggacagcccgatgcaaatccactttgagcagctgtgcaagaccaaactcccaaaaaaacgcaaacgggatcctggctctgtgggtgacactatcccttcagccgagctcgtgaagcgacatgcgggggtgctgggcctgggagcctgtgtacttagcagcccctacgacgtcccaacgtggatgccccagcttttgatgaatttatcagctcaccttaatgatccacagccaatcgagatgacagtaaagaaaacattgtccaacttcaggagaacacaccatgacaactggcaggaacataagcagcaattcaccgacgaccaacttcttgtcttaaccgatcttctggttagtccctgctattatgcttag

SEQ ID NO: 130290 - DNA, 2964 bp, Artificial Sequence
  Description of Artificial Sequence: Synthetic coding sequence
atgggcgagaatttagcaaaaaaaatcatgttttttctgttgaccattaagctcatcctgaatcatatcctggataattctgaggacgatacgaagtctctttttctgatcattaaaatcatcggagatcttctgcaattccagggctcacacaagcacgaatttgactcccggtggaaatcttttaatctggtgaaaaaatccatggagaatagactgcatggcaagaagcaacacatccgcgcattactaattgaccgagtgatgctgcaacacgagcttcgcacgctgacagtagagggatgtgagtataaaaaaattcaccaggacatgataagagatctgcttcgcctgagtacttctagttacagtcaagtgcgtaataaggcccagcagactttctttgcagccttgggcgcatacaacttttgctgtagggatataattccactcgtcctcgaatttctgaggcctgatcggcagggtgtgacccagcaacagttcaagggtgctctgtattgtttgttaggtaatcacagcggagtatgcctggctaatctgcatgattgggattgtattgtccaaacttggccagccatcgtgtctagcggattgtcacaagcgatgtccttggagaaaccatctatcgttaggctcttcgatgacctcgcagaaaagatccaccggcagtacgagaccatcggcctagatttcacaattcccaaatcttgcgtagaaatcgccgagctgctgcagcagtctaagaatccttcaatcaaccagatcctgctatcccctgagaagatcaaggagggcataaagagacagcaggagaagaatgcagatgctcttcggaattacgagaacctggtggacacattactggacggtgtggaacagagaaatctgccatggaagtttgagcacatcgggatcggtctgctctcactgctcctgagagacgaccgcgttttaccactgagggctattaggtttttcgtggagaatctaaaccacgatgcaatcgttgtgcgcaagatggctatctcagccgttgccggcatcctgaaacagcttaaaaggacacacaagaagttgacgattaatccctgtgaaatctctgggtgccccaagcctactcagattatcgctggggaccgtcctgataaccactggctgcattatgacagcaagacaattcccagaacgaagaaggaatgggagagctcatgctttgtggaaaagacccactggggctattacacttggcctaagaacatggtggtgtacgcaggcgttgaagagcagccaaagctgggacgttcccgggaggatatgaccgaggcagagcagataatctttgaccacttctctgaccctaagtttgtggagcagctcatcacattcctctccctggaagatcgcaaaggaaaagataagtttaacccacggagattttgcctgtttaaagggatctttcgcaacttcgatgacgctttcctgccagtgctgaaaccccatctggagcatctggtggctgactcccatgagtccacccagaggtgcgtggccgagattatagccggcttgataaggggttcaaagcattggacttttgaaaaggtggagaagctgtgggagttactctgtcccctgctgcgcaccgctctctcgaacattaccgtcgagacctacaatgattggggggcatgtattgctacgtcctgtgagagtagagaccctagaaaactccactggttattcgaactgctgctggagtcacccttgtctggggagggcgggagcttcgtggatgcgtgtcgcttatacgtgctgcaaggtgggctggctcagcaagagtggagagttcccgaactcctgcacaggctcttaaaatatctggaacccaagctcacccaggtgtacaagaacgtacgcgagaggatcggcagtgtactgacctacatctttatgattgacgtatccctccctaataccacccccacgatctccccccacgtgccggagttcacggcccgaatcctggaaaagctcaaacccttaatggatgtggacgaggagattcagaatcatgtcatggaagagaatggtataggggaggaagacgaaaggacacagggcataaagctgctgaaaaccattctaaaatggctgatggccagtgcaggccgaagcttttcaaccgccgtcactgagcagctccaattgctgccgctgttttttaaaatagccccagttgagaacgataacagttacgacgagctcaagagggatgctaaactctgtctcagtttgatgtcccaggggctcctgtatccacatcaggttcccttagttctgcaggtgctgaagcagaccgcccgctccagtagctggcacgctaggtacacggtattgacttaccttcagacgatggtgttctacaatctgtttatcttcctcaataatgaggacgccgtaaaggatatccggtggcttgtcatttcactgctggaagatgaacagttggaagtcagggagatggcggccactactctttccggactattgcagtgtaactttctgaccatggacagcccaatgcaaatccacttcgaacagctatgtaagaccaaattgcctaagaagaggaagcgtgatcctgggagtgtgggggacacgataccttctgctgaattagtgaaaaggcatgccggagtgctgggactgggagcttgtgtcctttctagcccctacgatgtgcctacatggatgccacagctgttgatgaacttgtcagcccatctaaatgacccccagccaattgagatgactgtgaagaaaacactgagcaactttaggcgcacccatcatgataattggcaagagcacaagcagcagtttacagacgatcaactgctagtgcttactgatctactggtctcaccatgttactatgcctag

SEQ ID NO: 130291 - DNA, 867 bp, Artificial Sequence
  Description of Artificial Sequence: Synthetic coding sequence
atggcagcaaccttctttggcgaggttgtgaaagccccgtgcagagctggaacggaggatgaagaagaggaggaggaagggcgccgagagaccccagaggaccgtgaagtgcggctgcaactcgctagaaaacgcgaggtccgtctacttaggaggcagacgaaaacttccctcgaggtgtctctgctggagaaatacccctgcagcaagttcattatcgccattggcaacaacgctgtggcatttctgagcagcttcgtgatgaattcaggagtgtgggaggaagtaggttgcgccaaactctggaacgagtggtgtagaactacagataccacgcacctgtcctctacagaagccttctgtgtcttctaccatctgaagagtaatccttcagtgtttctgtgccaatgttcatgttacgtggccgaggaccagcagtatcagtggttagagaaggtttttggaagttgtccgagaaagaacatgcaaatcaccattctgacatgccggcacgtcacagattataaaacctcggaaagcacagggtctctgccaagccccttcctgcgtgccctgaagacccaaaattttaaggactctgcctgctgtccattgcttgaacagcccaacatcgtgcacgacctgcccgccgccgtactgtcatattgtcaagtgtggaaaatccccgctattctctacctatgctacaccgacgttatgaaattagacctcataactgtggaagcgtttaagcctattctctcaacgcgctcactgaaaggactagtaaagaacattccccagagcacggaaatcctcaaaaagctgatgactacgaatgagattcagagcaacatctacacttag

SEQ ID NO: 130292 - DNA, 804 bp, Artificial Sequence
  Description of Artificial Sequence: Synthetic coding sequence
atggctgctactttcttcggggaggtggtgaaagccccttgccgggctggcaccgaagacgaagaggaagaagaggagggaaggcgggaaacacccgaggaccgagaagtgcggctgcagttagcccgcaaaagagaggtcaggctgttaaggcgccagaccaagacttccctggaggttagcctgctggagaagtatccttgtagcaaattcatcatcgccattggcaataatgctgtcgccttcctgagcagtttcgtaatgaattcaggagtgtgggaggaggttggttgtgccaagctctggaatgaatggtgtcgcaccaccgacactactcatctgtcctccaccgaggccttttgtgtattctaccacttgaagagtaacccaagtgtgttcgggtcatgccctagaaagaacatgcagattaccatactgacctgtcggcacgtgactgattacaagaccagcgaatcaacagggagtcttcccagtcccttcctgagagcgctgaagacccagaatttcaaggactccgcatgttgcccgttactggagcaaccaaatatcgtgcacgacctcccggcggctgttctctcctattgtcaggtttggaaaatccccgccatcctttatctctgttacactgacgtgatgaagctggacctcattaccgtcgaggcctttaagcctatccttagtacacgctccctgaagggccttgtaaaaaatatcccacaatcaaccgagattcttaaaaaactcatgaccacaaatgaaatccaatcgaacatttacacctag

SEQ ID NO: 130293 - DNA, 795 bp, Artificial Sequence
  Description of Artificial Sequence: Synthetic coding sequence
atgttcgtgccctgcggcgaaagcgccccagatcttgcaggctttacactgttgatgcctgctgttagcgtgggcaatgttggccagctcgcaatggatcttataatatccaccctgaatatgtctaagatcgggtacttctatactgattgtctggtgccaatggttgggaacaatccttacgctactacggagggaaacagcacagagctgagcatcaatgccgaggtttattccttgccctcccgaaagctcgtcgccctacagctcagatctatctttataaaatataaaagcaagcctttctgcgaaaaactcctttcttgggtgaagtcttcaggctgtgcccgagttatagttctctccagtagccattcttatcaaaggaacgatttacagcttcgttccactcccttccggtaccttctgacccccagtatgcagaagtctgtgcagaataagatcaagagccttaattgggaggaaatggagaagtcgagatgcataccagagatcgacgatagtgagttttgcatcaggatccctggcggagggatcacgaaaactctctatgacgagtcatgctcaaaggaaatacagatggccgtcctactgaagtttgtaagcgagggagataacatcccagacgccctgggtctggtcgaatatttaaatgaatggctgcaaattcttaaaccattgtcagatgatccgactgtgtcagccagtcgctggaagatcccctccagttggaggttattgtttggcagcggcttgccacccgccctgttttag

SEQ ID NO: 130294 - DNA, 459 bp, Artificial Sequence
  Description of Artificial Sequence: Synthetic coding sequence
atgccggccgtgtcagttggtaacgtgggacagcttgccatggatttaattattagcactctgaacatgtccaaaatcgggtatttttacaccgattgtctggttcccatggtggggaacaatccgtatgctacaacggaaggaaacagcacagaactgtctatcaacgccgaagtgtactccctcccgtctagaaaactagttgcactgcaactacgttccattttcataaaatataagagcaagccattttgtgagaaattattaagctgggtgaaaagttccggatgcgctcgggtgatcgtgctcagttcttcacattcttaccagcggaacgatctacagctacgctcgactccattccgatacttgctgaccccaagtatgcagaagagcgttcagaataaaataaagagcctgaactgggaagagatggaaaaaggtgcattcctgaaatag

SEQ ID NO: 130295 - DNA, 792 bp, Artificial Sequence
  Description of Artificial Sequence: Synthetic coding sequence
atgttcaggaaccagtacgataatgatgtcacagtatggtctcctcagggccgcatacaccaaatcgaatacgccatggaggcggttaaacaggggagtgcaaccgtcggactcaaaagcaaaacccacgcagttctggtagcactcaagagagcccagagtgaactagctgcccatcagaagaaaatcctgcacgtggataatcacatcggaatcagcatcgccggacttacagctgatgcccgattgctttgtaatttcatgcgccaggaatgcttagacagtagatttgtgttcgataggcccctgcctgtgagccgattagtgagcctgatcggcagcaaaacgcagattcccacacagagatacggcagaaggccatatggcgtcggactgctgatagccgggtatgacgatatgggcccccatatattccagacctgtccaagcgctaattattttgattgccgtgctatgtccattggcgctagatcacagagcgcgcggacctacctggaaagacatatgtctgagtttatggaatgcaatttgaatgagctggttaagcatgggctccgagcgctgcgcgaaactctccccgctgagcaagacctgacaaccaagaatgtgtctatcggcattgtgggcaaagacctcgagttcaccatctatgatgacgatgatgtctcccccttcttggagggcttggaagaaagaccacagcggaaggcccaacctgctcaaccggccgacgaacccgccgaaaaggccgatgagcccatggagcattag

SEQ ID NO: 130296 - DNA, 792 bp, Artificial Sequence
  Description of Artificial Sequence: Synthetic coding sequence
atgtttagaaatcagtacgataacgacgttactgtgtggagccctcaagggcggattcatcaaattgagtatgctatggaggcagtaaagcagggatccgcaactgttggactcaagtccaagacccacgcagtcctggttgccctgaaaagggctcagtctgagctggcagcacaccagaaaaaaatacttcacgtagacaaccatatcgggatcagcatagccggattgacagcagatgctcgcctgttatgtaattttatgcgccaggaatgtttagactctcgcttcgttttcgacaggcctcttcccgtgtctcgtctggtgtccctgatcggcagcaagactcagatcccaactcagaggtatggacgacgaccgtatggtgtaggcctgctgatagcgggttatgacgatatggggcctcacatttttcagacttgccctagcgcaaattacttcgattgtcgcgcgatgagtatcggagcccgaagccagtcagctcgcacctacctcgagcgacacatgagcgagtttatggagtgcaatctcaatgaattggttaaacatggattgcgcgcgttgagggaaaccttacctgctgagcaggatttgaccaccaaaaatgtgtccatcggcatagttgggaaggacctagaatttaccatctatgatgacgatgacgtatcgccattcttggaaggactagaagaaaggcctcaacgtaaggcccagcctgctcagcccgcggatgaaccagcagagaaggcagatgaaccaatggaacactag

SEQ ID NO: 130297 - DNA, 810 bp, Artificial Sequence
  Description of Artificial Sequence: Synthetic coding sequence
atgcagctgtctaaagtgaagttccgcaatcaatacgacaacgatgttacggtctggtcccctcagggtaggatccatcagattgaatacgcaatggaggcggtgaagcagggctccgccaccgtcggccttaagagcaagacccacgcagtgctcgtggctttgaagagagcccagtctgagctggccgcccaccaaaagaagatcctacacgtggataatcatatcggcatttcgattgccgggttgaccgcagacgcccgcctgctgtgcaattttatgcgtcaagagtgtctcgactcccgctttgtgtttgatcgaccccttcctgtctccaggctcgtgagtcttattggaagtaaaacccaaatcccaactcagaggtacggtagacgcccttatggcgtcgggctactcattgctggctacgatgacatggggcctcacattttccagacttgtccatctgcgaactactttgattgtagggccatgtcaatcggcgctcgatcacagtccgcgcgtacctatttggaaaggcatatgtctgagttcatggagtgtaatttgaatgaactggtcaaacatggccttagagccctgcgagagacactgccggcagagcaggatctgactaccaagaacgtctcgataggaattgtgggtaaggacctggagttcacaatctacgacgatgatgacgtaagccctttcctggagggcctggaggagcggccccaacggaaagctcagcccgctcagcctgcagatgagcccgcagagaaagctgatgaacccatggagcactag

SEQ ID NO: 130298 - DNA, 495 bp, Artificial Sequence
  Description of Artificial Sequence: Synthetic coding sequence
atgtttagaaatcaatacgacaacgatgtaaccgtgtggagcccccagggtcgcatccatcagattgagtatgccatggaagcggtcaagcaaggctccgccactgtgggactcaaaagcaagactcatgctgtgctggtggccttgaagagagcgcaatctgaactggctgcacaccagaagaaaatattgcacgtggacaatcatatcggaatctctatcgccggactcaccgcggacgctcgtttgttgtgtaatttcatgaggcaggaatgtctcgactcaagattcgtcttcgataggcctctccccgtgtctcgtctagtctccctgattgggtcatcaatcctgttcatgatctgggccttaactttcagcaagcctgtacacttgttaactatactgaccgccgagccttgccccctagagcccgtccccaatcagctagtgctaacctggcgggacatctgcctgaatctctggtcggttatttag

SEQ ID NO: 130299 - DNA, 1014 bp, Artificial Sequence
  Description of Artificial Sequence: Synthetic coding sequence
atggatcagaacgaacattctcactgggggccccacgcgaagggacaatgtgcatctcgtagtgagctgcggatcattttggtcggtaagaccggaactggcaagtccgcagcaggaaactcgatcctaaggaaacaagccttcgaatccaaacttggctctcagacactgaccaagacctgctcaaagagccagggaagttggggcaatagggagattgtcatcatagatactcctgatatgttttcgtggaaagatcactgcgaggcactctataaagaagtgcagaggtgttacctactatccgcgccaggtccacatgtgctcttactggtgacgcaacttggcaggtacacttcgcaggaccaacaggccgcccaaagggtaaaagagatcttcggggaggatgccatgggacatactatcgtgttgttcactcataaggaggaccttaacggaggctccctgatggactatatgcacgactctgacaacaaggctctgtcaaagctggtggctgcttgtggaggcagaatctgtgcatttaacaaccgagctgagggatccaaccaagatgaccaagtcaaagagctgatggattgcatcgaggatctgctcatggagaagaacggagatcactatactaacgggttgtatagcctgatccagagatcaaagtgtggccccgtgggttctgatgagagagttaaagaattcaaacagagcctcataaagtacatggagacacagaggtcctacactgctctagcggaggccaactgtctgaagggcgcactgatcaagacccagctctgcgttctgttctgtatacaactgtttctacggctaataatcctgtggctttgcatactgcacagcatgtgcaacctcttctgctgtctcctgttttcaatgtgcaacttgttttgctcactcctctttatcattccaaagaaactcatgatattcctgcgcacggttatacggttggaaagaaagaccccccgactttag

SEQ ID NO: 130300 - DNA, 300 bp, Artificial Sequence
  Description of Artificial Sequence: Synthetic coding sequence
atgggaccagattatagggtgctcgtacatagagcaagaaagttggcgcagcagtactatcttgtgtaccaggagcccattccgactgcacagttggtccagcgtgtggctagtgttatgcaggagtatactcagtctggcggagttaggccctttggtgtttcattgttgatctgcggatggaacgaagggcgcccgtacctattccagtccgatccgtccggcgcgtactttgcttggaaagccacagccatgggaaaaaactatgttaatggaaagacttttctggagaagaggtag

SEQ ID NO: 130301 - DNA, 465 bp, Artificial Sequence
  Description of Artificial Sequence: Synthetic coding sequence
atgctctactgcgaagcggagagtccgcctacggtggagaaggtgaagcctgcgagagagaacagcgaaaccgatctggaaattgaaggtgagcacggccaccttggagcagttagggcggcatcgccccagaaactcgagaagagcgggtttcaggaactctcgagtcattccttccctgagagcgcgctgcggatggcgtgcgggggcaacgtagcagaacgccctgctcgattctgcctggagtcaagcagcggactggcgggtgagagtagctgcagttttccacgtctatcccctgcctccggggcagtgccatctcgacgactcgtcaagagtggtataaacacccaaacacgcttttcaaatctgctgaacgtgagtacatgggggattctttgtaacctctgcaattctcctaggagcttccccaagaagggatccacagaaagagagcatctatag

SEQ ID NO: 130302 - DNA, 747 bp, Artificial Sequence
  Description of Artificial Sequence: Synthetic coding sequence
atgtctagtataggcactgggtacgatttgagcgcctctaccttttcccccgacggaagagtcttccaggttgagtacgctatgaaggcagttgagaattctagtaccgccataggaattaggtgtaaggacggcgtcgtgttcggagtcgaaaagctggtcttatctaaattgtatgaagaaggttctaacaaaaggttgtttaacgtggaccgacacgtcggcatggctgtggctggcctcttggcagacgctcgctctctggccgatatagcacgagaagaagcaagcaatttccgctccaacttcggttacaatatacccctcaagcatttagctgaccgagtcgccatgtacgttcacgcgtacaccctctatagtgccgtacggccattcggctgtagcgttaatgacggcgcacagttgtacatgatagatccttcaggggtgagctacggctactgggggtgcgcaattgggaaggcacggcaggccgctaaaacagagatcgaaaaattgcaaatgaaagagatgacttgtcgggacattgtcaaggaagtggctaagattatctacattgtgcacgatgaagtcaaggataaggctttcgagctcgagctcagttgggtgggcgagctcaccaacggtagacacgaaatcgtgcctaaggacatcagggaagaggccgaaaaatatgccaaggagtcgctcaaggaggaggatgaaagcgacgacgacaatatgtag

SEQ ID NO: 130303 - DNA, 786 bp, Artificial Sequence
  Description of Artificial Sequence: Synthetic coding sequence
atgtccagaagatacgactcccgcacaaccatattcagtcccgaagggcggctgtatcaggtcgagtacgccatggaggctattggacacgccggcacttgcctgggcattctcgcaaatgacggggtcttgctggccgccgaaagacgaaacattcacaagctccttgatgaggtctttttcagcgagaagatctacaaactaaacgaggatatggcatgctctgtggccggcattacatctgatgccaacgtgttgacaaatgagttgaggttgattgcacagagatacctgttacagtatcaggaacctatcccatgcgaacaattggttactgcactgtgtgacataaagcaggcctatacccaatttggcggaaagcgaccatttggggtctcattactgtatatcggctgggataaacactacggattccagctgtaccagagcgatccctccggcaactacgggggctggaaagcgacatgcatcgggaacaattcagcagctgcagtgagtatgctgaagcaagactataaagagggcgagatgaccctgaagtcggctctggctctggcgatcaaggtgctgaataaaactatggatgtatcaaaactgtctgccgagaaggtggagatcgcaacactgacaagagaaaacggcaaaacagtcattcgcgtgctgaagcaaaaggaggtggagcagcttatcaaaaagcacgaggaggaagaggccaaagctgaacgggaaaagaaggaaaaagaacagaaagagaaggataagtag

SEQ ID NO: 130304 - DNA, 573 bp, Artificial Sequence
  Description of Artificial Sequence: Synthetic coding sequence
atggcctgctccgtggccggcattacttctgacgcgaacgtcttgaccaatgaactacgactcatcgcccaacggtatcttttacagtatcaggagccaatcccatgcgaacagctagtgacagctctgtgtgacattaagcaggcatacacacagttcggtggtaagaggccattcggagtgtcgctactttatattggatgggataagcattatggtttccagctgtaccagtccgatcccagcggaaattacggaggctggaaagccacttgtataggaaacaatagtgctgccgccgtaagcatgctgaagcaggactacaaagaaggcgagatgacccttaagtcagcactagctctggccattaaggtccttaacaagaccatggatgtctcaaaactgagcgcagagaaggtcgaaattgctacactgacacgggaaaacggtaaaactgtgattcgtgttctcaagcagaaagaggtggagcagctcatcaaaaaacacgaggaggaagaagccaaggccgaacgcgaaaaaaaggaaaaggagcaaaaagagaaagataagtag

SEQ ID NO: 130305 - DNA, 786 bp, Artificial Sequence
  Description of Artificial Sequence: Synthetic coding sequence
atgtcccgaaggtatgactcccgaacaacaatcttcagcccagagggacgcctgtatcaggtggaatacgccatggaagctattggccacgcggggacttgtcttggcattctggcaaatgatggggtacttttagccgccgagaggcgcaacattcataaactcctcgacgaagtctttttttctgagaagatttataaactgaatgaagatatggcatgttcggttgcaggtataaccagtgacgcaaatgtgctgacaaacgagttgagactaattgcgcagaggtaccttctgcagtaccaggaaccaatcccctgcgagcagctcgtgacagccctttgtgacattaaacaagcgtatacacagtttggtgggaaacggccttttggtgtttcgctcctgtatatcggatgggacaaacactatggcttccagttataccaatcggatccctcgggcaattacggcggctggaaggcaacttgtatcggaaacaactcggcagcggccgtcagcatgttgaagcaggattataaagaaggagagatgaccctcaaatctgctctcgcccttgcaattaaggttttgaacaaaactatggacgtaagcaagttaagcgcagaaaaagtagagatagcaaccctgaccagggaaaacggtaagacggtcattcgcgtccttaagcagaaggaggtggagcagctcattaagaagcatgaggaagaagaggccaaagccgagcgggagaagaaagagaaggaacagaaagagaaggataaatag

SEQ ID NO: 130306 - DNA, 666 bp, Artificial Sequence
  Description of Artificial Sequence: Synthetic coding sequence
atgtctagacgatatgattcccgcactactatctttagtccggaaggtcggctgtatcaagtggagtacgccatggaagccataggtcacgccggcacatgcctgggcattctggccaatgacggagtgctattagcagcggagaggagaaatatccataaattactggacgaggtgttcttttccgaaaaaatttataagctgaacgaagatatggcctgtagcgtagcaggtatcactagcgacgccaatgttctgaccaatgagctgcgattgattgcacagcgctacctgctgcagtaccaggagccgatcccctgcgaacaacttgtaacagcattatgcgatattaagcaagcctatacacagtttggcggcaagcgcccgtttggcgtgtctctgctttacattgggtgggacaagcactatgggtttcagttataccagagcgacccttctgggaactatgggggctggaaggctacatgcattggcaacaactccgccgccgccgtgtcaatgttaaaacaggattataaagagggggagatgactttgaagtcggcgcttgcgttggccataaaggtgctcaacaagactatggatgtctcaaaattgtctgcggagaaagtcgagatagctacactcactcgggagaacggatag

SEQ ID NO: 130307 - DNA, 630 bp, Artificial Sequence
  Description of Artificial Sequence: Synthetic coding sequence
atgtcccgtcgctacgactctcggaccacgatcttcagcccagaaggccgcctgtatcaagtcgaatacgccatggaggctataggccatgctggtacatgcctgggtatactcgccaatgatggagtcctgctagctgccgaacgaagaaatatccacaaacttttggatgaagttttcttctcggagaagatctacaagcttaacgaggacatggcctgttcagtcgcaggcattacttccgacgcaaatgtgctgaccaatgaactgagattaattgcgcagcgctatctgctccagtatcaggaacctatcccctgcgagcaacttgtgacagctctttgtgacatcaaacaggcctatacacagtttggggggaaaagaccattcggggtatccctgctatacattgggtgggacaaacactatggttttcagctgtatcagagtgatccctccggaaactacggcggctggaaagctacttgtatagggaataatagcgcggcagcagtctccatgctgaagcaggattataaagagggagaaatgaccctgaagtccgctttggccctggcaatcaaggtactgaacaagaccatggacgtgtctaagctctctgccgaatag

SEQ ID NO: 130308 - DNA, 693 bp, Artificial Sequence
  Description of Artificial Sequence: Synthetic coding sequence
atgtcccggcggtatgactctagaacgacaatcttttcccccgaagccgaaagaaggaacatacacaaactgctcgacgaggtattcttttccgaaaaaatttataaattgaacgaagacatggcctgcagcgtggccggcatcaccagcgatgcaaacgtgctcaccaatgaactcagactgatcgcccagcgctaccttctccagtaccaggaaccaataccctgtgaacagctcgtgacggcactgtgtgacatcaaacaagcatatacacagttcggtgggaaacgccccttcggcgtttctctgctttacattggctgggataagcattatgggtttcagctctaccagtcggacccatctggcaattacggcggctggaaagcgacctgcataggcaacaattctgcggccgccgtgtcaatgctcaagcaagattataaggagggagaaatgaccttaaagagcgcgctggctctggcgattaaagtattgaacaaaaccatggacgtatcaaaactctctgccgagaaagttgaaattgcgaccctgacaagggaaaatgggaagactgttatcagggtactcaaacagaaagaggtcgagcagttgattaaaaaacacgaggaggaggaagccaaggcagagcgggagaagaaagaaaaagagcagaaagagaaggacaaatag

SEQ ID NO: 130309 - DNA, 711 bp, Artificial Sequence
  Description of Artificial Sequence: Synthetic coding sequence
atgtcacgtcgctatgattctcgaactaccatcttctcacctgaaggaaggctctaccaggttgagtacgcaatggaggctatcggacatgccggaacctgcctggggatcttagccaacgatggggtgctcttggcagctgagcgccgaaatatccacaaactgctcgacgaagtatttttctctgagaagatatataagctgaatgaggacatggcctgctctgttgccggaataacttccgatgccaatgtcttgactaacgaactccgacttatcgcacagagatacctcctgcagtatcaggagcctattccttgcgaacagttggttacagcattgtgcgacataaaacaagcgtatactcagtttgggggcaagcgaccattcggtgtgagcttgctgtatattggttgggacaaacactacgggtttcagctctaccagagcgacccctccgggaactacggaggatggaaggccacttgtatcggcaacaactctgcagcggcggtatccatgctgaagcaagactacaaagagggggaaatgaccctgaagtccgccctagccctggccataaaggtgctaaataaaactatggacgtgtctaagctgagcgccgaaaaggttgagattgcgactctcacgcgagagaacggaaagacagttattcgggttcttaagcagaaagaggttgagcagctgtag

SEQ ID NO: 130310 - DNA, 726 bp, Artificial Sequence
  Description of Artificial Sequence: Synthetic coding sequence
atgtttctgaccaggtcagagtacgacaggggagtgaatacattcagtccagaagggcggctgttccaggttgagtatgccatagaagctatcaaactggggtccacagctatagggatccagacatctgagggcgtgtgtctggccgttgaaaagcgcattacgtcccctctgatggagcctagctcgatcgaaaaaattgtcgagattgacgctcatatcggctgcgcaatgtcagggcttatcgccgatgccaaaacgctgatagacaaggccagggtcgagactcagaatcactggttcacgtacaacgagaccatgactgtcgagtctgtgacacaggcagtcagcaatcttgctctacagttcggcgaagaggacgccgatcccggggccatgtctcgccccttcggcgtcgctctgttattcggtggggtggatgagaaaggcccccaactcttccatatggaccccagtggaacttttgtgcaatgtgatgctagggccatcggctctgcctctgagggagcgcagtcaagtctccaagaggtgtaccataagtccatgactttgaaggaagcgattaaatccagtcttattatcctaaaacaagttatggaggagaaattgaacgcaacaaacattgaactggccacagtccaaccaggccagaatttccacatgttcaccaaggaggaactggaggaggtaataaaggatatttag

SEQ ID NO: 130311 - DNA, 552 bp, Artificial Sequence
  Description of Artificial Sequence: Synthetic coding sequence
atggaaccgagctctatcgagaagatcgtggaaattgatgctcacatcgggtgtgctatgtccggactgatcgcggacgccaaaaccctcatcgataaggcacgtgtggagactcagaaccattggtttacgtacaacgagacgatgacggtcgaatccgtcactcaggctgtaagtaacttggcgctgcaatttggggaggaggacgccgaccctggggctatgtctcgaccgtttggtgtcgctctgctgttcggaggtgtggatgaaaagggtccacaactgtttcacatggatccgtctgggaccttcgtccagtgtgatgccagagctatcggttcggctagcgagggcgcacagtccagtcttcaggaggtttaccacaaatccatgacccttaaggaggcaatcaaaagttccctgatcatccttaagcaagtgatggaagagaagctgaacgctacaaatatcgaactcgcaaccgtccagcccgggcagaactttcatatgttcactaaggaggagctggaggaagttatcaaagacatctag

SEQ ID NO: 130312 - DNA, 741 bp, Artificial Sequence
  Description of Artificial Sequence: Synthetic coding sequence
atgagcagaggatcttccgctggattcgatcggcatatcacgatattcagtccggaagggcgcttgtaccaggtcgaatacgcattcaaagccatcaatcagggaggtttgacatctgtggctgtgcggggtaaggattgtgccgtcatcgttactcagaagaaggtccctgataagttacttgactctagcacagtaactcacctgtttaagattactgaaaatatcggttgtgttatgactgggatgactgcagatagccgctcacaggttcagcgcgctcgatatgaggccgccaactggaaatacaaatatggatacgagattcccgttgatatgctctgcaagcgtatcgctgatattagccaagtttacacacagaatgcagagatgaggcctttaggatgctgtatgatcctaatcggaatcgacgaggaacaaggaccacaagtatacaagtgcgacccggccggctactattgtggattcaaagccaccgcagcaggagtgaaacagaccgaaagcacctccttcttggaaaagaaggtgaaaaagaagtttgactggaccttcgagcagaccgtggagaccgctatcacctgcctctccacagtgcttagtatcgattttaaaccctccgagattgaggtgggcgtggttaccgtggagaaccccaagttccgaattctgactgaagcagaaattgatgcacacctggtggcacttgccgaaagggactag

SEQ ID NO: 130313 - DNA, 684 bp, Artificial Sequence
  Description of Artificial Sequence: Synthetic coding sequence
atggctggcttaaggagagaatacgcttttaaagcgatcaaccagggcggcctgacatctgtagcagtgaggggcaaggattgcgcagtaatcgtgacacagaagaaggtgcctgacaagcttctcgactctagtactgtgactcacctgtttaagatcaccgaaaatatcgggtgcgtgatgaccggaatgacagctgatagccgcagccaagtgcagagagctcgctacgaagccgcgaattggaagtacaagtacggctatgaaatcccagtggacatgctctgtaagcgcatagctgatatctctcaagtgtacacccaaaacgctgagatgaggccactgggttgctgtatgattctcattgggatcgacgaagagcaaggcccacaagtctacaagtgcgatccagcaggttactactgcggattcaaagctactgctgccggggttaaacagaccgaatctactagtttcctggagaagaaggtaaaaaaaaagttcgactggacctttgagcagaccgttgagactgcaattacatgtctgagcacagtcctttccatcgactttaagcccagcgagattgaggtgggggtcgtgacagtcgaaaacccaaaattcagaattctgactgaggctgagattgacgcccacctcgtggcactggccgaacgggactag

SEQ ID NO: 130314 - DNA, 759 bp, Artificial Sequence
  Description of Artificial Sequence: Synthetic coding sequence
atgtctaggggaagttcagctggcttcgatcgacatattactattttctctcctgagggccgcttgtaccaagtcgaatacgctttcaaggccatcaaccagggcggcctgacgtccgtggccgtgcgcggcaaagactgcgcagtaatagtgacacagaagaaggttcccgataagctgctggacagcagcacagttacccatctattcaagatcaccgagaacattggatgtgtgatgaccggcatgaccgctgatagccggtctcaggtccagcgagctcgatatgaggccgccaactggaaatataagtatggatacgagatcccggtcgacatgctatgcaagcgcatcgctgacatttcccaggtgtatacccaaaacgcggaaatgagacctttaggctgctggtcattcctttttctaggcatgattcttatcggcatcgatgaggagcagggtccacaggtgtataaatgtgatcctgccgggtactactgtggatttaaggctaccgccgcgggggtgaagcagaccgaatctacttcttttctggagaaaaaagtgaagaaaaaattcgattggactttcgagcaaacagtggagactgccatcacctgtctctcgacagtactgtcgatcgacttcaagcccagtgagattgaggtcggagtggtaactgtggaaaaccctaagtttagaatcctgacagaagccgaaattgacgcccacttggtggccctggctgaacgcgattag

SEQ ID NO: 130315 - DNA, 324 bp, Artificial Sequence
  Description of Artificial Sequence: Synthetic coding sequence
atgagccgggggagctcagcagggtttgataggcacattaccatcttcagtcctgaaggccggctctatcaggttgagtacgctttcaaggcaatcaatcagggcggcctgaccagcgtcgctgtgcgcgggaaggattgtgctgtgatcgtcacccagaaaaaggtgcccgataaactactggacagcagtaccgtcactcaccttttcaagatcaccgagaacattggatgtgtaatgactggcatgacggtgtccttgtgccgtcccggttgctcggccagctgggtccaggcgatcctagtcccgcaaccccccagatag

SEQ ID NO: 130316 - DNA, 447 bp, Artificial Sequence
  Description of Artificial Sequence: Synthetic coding sequence
atgtctcgcggttcctccgctgggttcgaccggcacatcaccattttcagtcctgaagggaggctctaccaggttgagtacgctttcaaggccataaaccagggggggttgacaagcgtggccgtgaggggcaaagattgcgctgtgatagtgacccagaagaaagtcccagataaacttctcgattccagcactgtaacccatttatttaaaatcaccgaaaatattggttgtgtgatgaccggcatgaccgctgattctcgcagccaggttcagagagcacgctacgaagctgccaattggaaatacaaatatggctacgagatccccgtcgacatgctgtgtaagcggatcgctgacatctcacaggtctatacccagaacgctgagatgcggcccctgggttgctattgtaactatatgcctgtatactgctcgattaattag

SEQ ID NO: 130317 - DNA, 504 bp, Artificial Sequence
  Description of Artificial Sequence: Synthetic coding sequence
atgactggcatgaccgctgacagccgttcacaggtgcagagggctcgttacgaggcagccaactggaagtataagtatggttacgagatccctgtggacatgctgtgcaaaaggatagccgatatctcacaggtgtacacccagaacgcagagatgcgccctctgggatgttgcatgatccttattgggattgatgaggaacagggcccccaagtgtacaagtgtgaccctgctggttactattgtgggtttaaggcaactgccgctggcgtgaagcagacagagtccacatcctttcttgaaaagaaggtgaagaaaaaattcgattggacgtttgagcagacagtggagacagccataacctgtcttagcacagtgctgagcattgactttaagccatccgagatcgaagtgggtgttgtcactgtggagaaccctaagtttcggatcctcaccgaagctgagatcgacgcccacctggttgccctggccgagagagattag

SEQ ID NO: 130318 - DNA, 612 bp, Artificial Sequence
  Description of Artificial Sequence: Synthetic coding sequence
atgagtcgtggaagctccgctgggtttgacaggcatattaccattttttcacccgaagggcggctgtaccaggttgagtacgccttcaaggccatcaatcaggggggcctgacgagtgtcgctgtgcggggtaaggattgcgccgttattgttacccagaaaaaagtacccgataaactgctcgactcgtccacagtgacgcacctgtttaaaattacagaaaacataggctgtgtaatgactggtatgaccgctgattcacggagccaggtacagcgtgctcggtacgaagctgcaaactggaagtacaaatatggatatgagattccggtggatatgctttgcaagcgcatcgccgacatctcccaagtctacacccagaacgccgaaatgcggccgcttggttgttgtatgatactcattggaattgacgaggagcaaggtccgcaggtctacaagtgcgatccggcaggatattactgtgggtttaaagctacggccgcaggtgtgaaacagactgagagtacctccttcctcgagaagaaagtaaaaaaaaaatttgattggaccttcgagcagacagttgaggactcttacaggagtagggactag

SEQ ID NO: 130319 - DNA, 450 bp, Artificial Sequence
  Description of Artificial Sequence: Synthetic coding sequence
atgagctacgaccgcgcaataaccgtgtttagccccgatggacacctgtttcaagtagagtatgcccaggaagcagtcaagaagggatcaacagctgtgggtgttcgcggacgcgatatcgtggtcttgggcgttgagaagaaaagcgtcgctaaactgcaggatgagcgtacggttagaaaaatctgtgctttagacgacaatgtctgcatggcatttgccggactgactgcagacgccagaatcgtcatcaaccgggcccgtgtagaatgtcaatcacataggttaacagtggaagatcccgtgactgtcgaatatataaccagatatattgcctcattgaagcaagtcggagcctgccctctagcatgtagcccactcgctgccggccaatccaggctgcggcacggcggttcttgtcacgtgacgtctggcgagtcggaaaactag

SEQ ID NO: 130320 - DNA, 537 bp, Artificial Sequence
  Description of Artificial Sequence: Synthetic coding sequence
atggccttcgctggcctgaccgcagatgccagaatcgtgatcaaccgcgctcgcgttgaatgccagtctcaccggctgaccgttgaagatcccgtcactgtcgagtacattacacgatacatcgcatccctgaagcagaggtatacccaatcgaacggccggagaccatttgggatatccgctctgatcgtggggttcgattttgacggaacccctaggctttaccagaccgaccccagcgggacctaccacgcatggaaggctaacgccatcggccggggcgccaagagcgtgcgggagtttctcgaaaagaactacactgacgaagcaatagaaactgatgacctgaccatcaagctcgtcatcaaagccctgctcgaagttgtgcagtccggaggtaagaacatcgaattagccgtgatgaggcgggaccaatcgctgaagattctcaatcccgaggagattgagaagtacgtcgctgagattgaaaaggagaaggaggaaaacgaaaagaaaaaacagaaaaaagcctcgtag

SEQ ID NO: 130321 - DNA, 747 bp, Artificial Sequence
  Description of Artificial Sequence: Synthetic coding sequence
atgagttatgacagagccattactgtattttccccagatggccacttattccaggtcgagtatgcccaggaggccgtgaagaagggctccactgctgtcggggtccgggggagagatattgtcgtcctcggggtggagaagaagtcggtggctaaactgcaggacgagcggacagtgcgcaagatctgcgcgctggatgataatgtctgcatggcctttgcagggctgaccgccgatgcccggatagttatcaatcgcgcacgggtagaatgccagtcgcaccggctgactgttgaggacccagtcactgttgagtacataacgcggtatatagcttcattgaagcagaggtatacccagagcaacggccggcgcccctttggtatctctgctctgattgtcggtttcgacttcgatggaacacccagactctatcaaaccgacccttccggcacttaccacgcatggaaggccaacgctataggccgaggcgccaagtccgtaagagaattcctggagaaaaattacacggatgaggcaatcgaaaccgacgatctgacaatcaaattagtcatcaaggccttattggaggtcgtgcagagcggggggaagaacatcgagctggcggtgatgcgaagagaccaatccctcaagattctaaaccccgaggaaatcgaaaagtacgttgctgaaatcgagaaagagaaggaagagaacgagaagaaaaaacagaaaaaagccagctag

SEQ ID NO: 130322 - DNA, 564 bp, Artificial Sequence
  Description of Artificial Sequence: Synthetic coding sequence
tagctcaccgctgacgccaggatcgtgattaatcgcgcccgggttgagtgccaaagccatcggctgacagtagaagaccctgtgactgtggaatacattacccgatacatcgcttcattaaaacaacggtatacacaatccaatgggcgaagaccattcggaatttcagccctgatcgttggctttgacttcgatggcacaccccggctttatcaaactgaccctagtggcacctaccacgcctggaaggctaacgcaataggacgcggcgctaaatccgtgagggagttcctggagaagaattataccgatgaggctatagaaactgatgacctgaccatcaagttggtgatcaaggccctgctggagggcaaggtagtgaatgctccagtcttttgtcctttcaaggtggtccagagcgggggcaaaaatatagagctcgccgtcatgcggcgcgaccagagcttgaaaattctcaaccccgaggaaattgaaaaatacgtggcggagattgagaaggagaaggaagagaacgaaaagaaaaagcagaagaaggcctcgtag

SEQ ID NO: 130323 - DNA, 726 bp, Artificial Sequence
  Description of Artificial Sequence: Synthetic coding sequence
atgctatccagcacagcaatgtatagcgctcccggtcgcgacctgggcatggagcctcatcgagctgctgggccacttcagttgcggttctccccatacgttttcaacggtgggacaatcttggctattgctggtgaggactttgccattgtggcctccgacacaaggctttccgaggggtttagtattcacacaagggactctcctaaatgctacaaattgacagataagacagttattggctgttctggctttcatggagactgcctaaccctcactaagatcatagaggctcggctgaagatgtataagcactctaacaataaagccatgacgacaggggctattgctgccatgctgtctacaatattgtactctcgccggttcttcccttattacgtgtataatattatcgggggcctagacgaggaagggaagggtgcagtgtactcctttgaccctgtgggatcttatcagcgggacagctttaaggcaggagggagtgcaagtgctatgctgcaacctctcctagacaaccaagtgggttttaagaatatgcagaatgtagagcatgtgcctctgtctctcgacagggcgatgcgactggtaaaagatgtgtttatcagcgctgccgagcgggacgtgtatacaggcgatgctttgaggatttgtattgttaccaaggaggggattcgagaggagactgtgtccctgcgtaaagactag

SEQ ID NO: 130324 - DNA, 591 bp, Artificial Sequence
  Description of Artificial Sequence: Synthetic coding sequence
aggagaagcagggccatgctgtcatccaccgccatgtactctgccccagggagagacctgggtatggagccccatcgtgctgccgggcccctgcagctcagattctctccctatgtttttaatggaggtactattttggccattgcaggtgaagattttgctattgttgcttcagacactagactctccgagggcttctccatccacactagggactctccaaagtgctataagctcactgataaaacagtaatcggctgtagcggtttccacggagattgcttgacattgacaaagatcatcgaagcgaggctgaagatgtacaaacactcaaataataaagccatgaccacaggcgcaatcgcagctatgctgtcaacgattctgtactctaggaggttctttccatattatgtctacaacattatcggcggtctggatgaggaagggaagggcgcagtgtattcatttgatcctgtgggaagttaccaaagggacagcttcaaagcaggcggttctgcctccgctatgctccagccgctcctagacaatcagtacatctcctctaactctgtgagcctgtgcgtatag

SEQ ID NO: 130325 - DNA, 822 bp, Artificial Sequence
  Description of Artificial Sequence: Synthetic coding sequence
atgctaaaacccgcactggaacctagagggggcttctcattcgaaaattgccagcgtaatgcaagcctcgaaagggtactgccgggcctgaaggtgccccacgcacggaagactggcaccacaattgctggactcgtctttcaggacggagtgatactgggtgcagatacgagagctaccaacgatagcgtcgtcgccgataaatcttgcgagaaaatccattttatcgcccctaagatatactgctgtggggctggtgtggcagcggacgcagagatgacaacacgcatggtagcctccaagatggagttacatgccctctcgaccggaagagagcctagggtggccactgtgacgcgcatcttgagacagactcttttccgctaccaggggcacgttggggcttccctaatcgtgggaggcgtggacctgaccggaccacagctgtacggggtgcatccacatggtagctactcgaggctgccatttaccgcactgggttccgggcaggatgctgcgctggctgtgctcgaggaccgcttccaacctaatatgaccctcgaagctgcacaggggctccttgtggaggccgtaacggcaggaattctaggagacttagggtcggggggcaatgtggatgcctgtgtgataaccaagactggcgccaagctgctgcgtaccttgagttcccctaccgagcctgtcaaaaggagcggtagatatcacttcgtgccgggcactacggctgttctgacgcagacagtaaaacccttgacgctcgaactggttgaagaaactgttcaagccatggaggtggagtag

SEQ ID NO: 130326 - DNA, 903 bp, Artificial Sequence
  Description of Artificial Sequence: Synthetic coding sequence
atggccttgcaagacgtgtgcaaatggcaatcccctgatacacagggcccatccccccacctgccaagagctggcgggtgggctgtcccacgcggttgcgaccctcagaccttcttgcagattcacggcccacggctagctcacggaactaccactctcgccttccgctttcggcatggcgtcatagccgcagcagacactaggtcgtcttgcggtagctacgttgcgtgcccagcatcatgtaaagtgatcccggtgcatcaacaccttctgggtaccacctcgggcacttctgcagactgcgctacatggtaccgcgtgttgcaaagggagctgcggctcagagaactgagagagggacagttgccctctgtagctagcgccgcaaaactgcttagcgcgatgatgagccagtacagggggctggacctgtgtgtggctactgctttgtgcggctgggaccggtccggcccagagctcttctatgtgtactcagacggcaccagactgcagggcgatattttttctgtggggagcggaagcccatacgcctacggagtgttggatcggggataccgatatgacatgtcaactcaagaggcatacgctcttgcccgttgcgcagtagcccacgcgacgcacagggatgcttattctggcgggagtgtcgacctgttccacgtgagagaatctgggtgggagcatgtgagcaggtctgacgcctgtgttctgtacgtggagctgcagaagcttttggaaccagaacctgaggaagacgccagtcatgcacatcctgagcctgctaccgcccaccgcgcagcagaggacagggagctgtctgttgggcctggcgaagtgacaccaggcgacagccggatgccggctggcacagaaaccgtttag

SEQ ID NO: 130327 - DNA, 606 bp, Artificial Sequence
  Description of Artificial Sequence: Synthetic coding sequence
atggagtatttgattggcatccagggacccgactatgttttggtggccagtgatagagtagctgcgagcaacattgtacagatgaaagacgatcacgataagatgtttaagatgagtgagaaaattctcttactgtgtgtgggggaggccggtgacaccgtccaattcgccgagtatatacaaaagaatgttcagctgtacaagatgagaaatggttacgagctctctcctaccgccgccgctaattttacgaggcgcaatttggccgactgccttcggtcccggaccccctatcacgtcaatctgttactggccgggtatgatgagcacgaagggccggccctgtactatatggactatctcgccgcccttgctaaggctcctttcgccgcacacggatacggcgctttcctcacactgtccatcctagatcgctactacaccccaaccatatcccgggagagagcagtggaactgctgcgcaagtgtttggaagaactgcagaaaagattcattctgaacctccctacctttagcgtgagaattatcgataagaatggcattcacgacctggacaatataagtttcccaaagcagggaagttag

SEQ ID NO: 130328 - DNA, 468 bp, Artificial Sequence
  Description of Artificial Sequence: Synthetic coding sequence
atggccagcctgaagtgctccactgtggtgtgcgtaatctgtttggagaagccgaaatatcgctgccctgcatgtagggtaccctactgcagcgtggtatgcttccgtaaacacaaggaacaatgcaaccccgagacaaggccagtggagaagaagatacgctctgctttgcccactaagactgttaaacctgtcgagaataaggacgatgatgattccatcgcagacttcttgaactcagacgaagaggaagatagagtatctctacagaacctgaagaacctgggggaaagcgccacattgagaagtttactgctgaacccacacttgagacaactgatggttaatcttgaccagggggaagataaggccaaactcatgcgggcttacatgcaggagccgctgtttgttgagttcgccgactgttgcctgggcatcgttgagcccagccagaacgaggaaagttag

SEQ ID NO: 130329 - DNA, 795 bp, Artificial Sequence
  Description of Artificial Sequence: Synthetic coding sequence
atggaagcctttctcggaagccgttcagggctgtgggctggagggccagcaccgggccagttctatcgaattccctcaacacctgacagctttatggatcctgctagcgcactatacagagggcccatcacacggacgcaaaatcccatggtgacaggtacgtctgtgctgggggttaaatttgaaggaggagttgtcatcgcagccgatatgctcggcagctacggatccctggctcgtttcagaaacatctctcgcattatgcgggtgaataacagcaccatgctgggcgctagcggtgactatgccgatttccagtaccttaaacaagtgctgggacaaatggtaatcgatgaggagttacttggggatggccactcatattcacccagagcgattcattcctggctgacaagggcgatgtactctcgacggtccaaaatgaaccccctgtggaacactatggttatcggaggttacgctgatggggaatcatttctcggctacgtagacatgttaggcgtcgcctatgaggccccttccctcgctaccggttacggggcttacctcgcccagcctctgctccgtgaggtcctcgagaagcagcctgtactgtcacagaccgaagccagggaccttgtggagagatgtatgagagttctgtattacagagacgccagaagctataataggttccaaatagctactgtcaccgagaagggagtcgagattgagggtcccctctctacagaaactaactgggatatcgctcatatgatctccgggtttgaatag

SEQ ID NO: 130330 - DNA, 792 bp, Artificial Sequence
  Description of Artificial Sequence: Synthetic coding sequence
atggccctggcttcagttctggaacgacccctgcctgtgaaccagagggggtttttcggtttggggggccgcgccgatctgctggatctcgggccaggcagtctcagtgatggattgagcctcgcagcaccaggctggggcgtccccgaggaaccaggaatcgaaatgttacacggtactactacactggcatttaagtttcgccacggggtaatcgttgcggcggactctagggccaccgccggagcctacattgcgagccagaccgttaagaaagtgatcgaaatcaacccatacctacttggtaccatggccggaggggccgccgattgctctttctgggaaagactcttggcacgtcagtgtcgtatctatgagctccggaacaaggagcgaatatctgtcgccgcggctagtaagctgctcgccaatatggtgtaccaatataaaggaatgggcctaagtatgggcactatgatttgcgggtgggataagcgcggcccaggactgtattacgttgacagcgagggcaacagaatctcaggggcgactttttccgtcggttctggaagtgtctacgcttatggcgtgatggaccgaggatattcttacgacctcgaggtggaacaagcctatgacctagcacgccgtgcgatttatcaggccacatacagagacgcctactctggcggtgcagtgaacttgtatcacgtgagggaagacggatggattagggtttccagcgacaatgtggccgacctgcatgagaaatatagcgggtcaacgccatag

SEQ ID NO: 130331 - DNA, 483 bp, Artificial Sequence
  Description of Artificial Sequence: Synthetic coding sequence
atggccgggggcgcagcagattgcagcttttgggaacggttgctggccaggcagtgccggatatatgagctccgaaacaaggaacggatttccgtagcggctgcttccaaacttctggcaaacatggtctatcagtataaaggtatgggactaagcatggggaccatgatttgcggctgggacaaacgcgggcctggcctgtattatgtggactcagagggaaacagaatttctggcgcaactttctcagtgggctccggatccgtttacgcctatggtgttatggatcgggggtactcttatgacctagaagtagagcaggcctatgatctcgcgagaagagccatctaccaggccacctacagggacgcatactcagggggagccgttaatctctaccacgtgcgcgaagatggatggataagggtgagctccgacaacgtggcagatctgcacgaaaagtactcaggttccacaccctag

SEQ ID NO: 130332 - DNA, 612 bp, Artificial Sequence
  Description of Artificial Sequence: Synthetic coding sequence
atggctctcgccagcgtgctggagcgcccattgcccgtaaatcagcgcgggtttttcggcctaggtggcagagccgaccttctagatctggggccaggcagtctttcagacggactatctttggcagcacctggatggggtgtgccagaagagcccggtatcgaaatgctgcatggaactaccactctggcctttaagtttcgtcacggggtaattgtagcggccgattctagagcgacggctggtgcatacatagcttcccagaccgttaagaaagtcatcgagattaacccgtacctattgggtacaatggcgggaggggctgcagattgtagcttttgggagcgccttttggccagacagtgtagaatctacgaactgaggaacaaggagcgcatttcagtggccgccgcgagcaaacttctggcgaatatggtgtatcagtacaagggaatgggcctctctatgggaactatgatctgcggatgggacaagagaggccctgtgtcagaagttctctgtctgaagcctaaatcattcggcatgtacctgttttgtgggtgtgccgaacgaatcggcaacatggctaggcctttactcagagggcagtag

SEQ ID NO: 130333 - DNA, 834 bp, Artificial Sequence
  Description of Artificial Sequence: Synthetic coding sequence
atggcggctgtcagtgtctacgccccccccgttggggggttctcctttgacaattgccggcggaacgccgtccttgaagccgattttgcgaagaggggctataaactccctaaggtcagaaagaccggcactacaattgcaggtgttgtctacaaggatgggattgtcttaggagccgacaccagggccacagaaggaatggtggttgcagataagaattgttctaagatccattttatctctccaaatatctactgttgtggcgctgggacggccgcggatacagatatgacaacacaacttatatcctcaaacctggagctccacagcttgtcaactgggcgactaccgcgagtcgtcactgcaaacagaatgctcaaacagatgctgtttcgatatcaggggtacatcggcgctgcacttgtgctcgggggcgttgacgtgacaggacctcatctgtattcaatttatccccacggaagcaccgacaaactcccgtacgtaaccatgggcagcggcagcctggctgccatggctgtgttcgaagataagtttcggcccgatatggaggaggaggaggcaaagaatcttgtgagcgaggctatcgcagcaggcattttcaatgatttggggtcagggtcaaacatcgatctgtgcgtgatcagcaagaacaagctggacttcctcagaccttacaccgttccaaataaaaaagggactagactcgggcgctaccggtgcgagaagggtactacagccgtcctgaccgaaaagattaccccgctggagattgaagttttggaggagaccgtgcaaaccatggacaccagctag

SEQ ID NO: 130334 - DNA, 633 bp, Artificial Sequence
  Description of Artificial Sequence: Synthetic coding sequence
atggccgctgtgtctgtttatgccccccctgtgggcggattctcctttgataattgcagacgcaatgccgtcctggaagcagacttcgcaaagagaggctataaactgcctaaagtccgaaagaccgggaccacgatcgccggcgtcgtttataaggatggaattgtattgggggcagacacccgtgccacagagggcatggttgttgccgataaaaattgcagcaagattcatttcatctcccccaacatctactgttgcggtgccggaacagccgcagataccgacatgactacacaattgatttcatctaacctcgaactgcattcgttaagtaccggaagactgccccgagtggtaaccgctaataggatgctcaagcagatgctcttccgataccaaggctatattggcgccgcactggtcctgggcggagtcgatgtgactggtcctcatctctattccatctatcctcacgggtctacagacaaactaccctacgttaccatggtacactgtgaggaagaactgttcacagagaatctattctttatccggcaggcagaggttgtgtctgaggaggcttggggaccatcctttgctattagtctggctgtctttttggtggcttag

SEQ ID NO: 130335 - DNA, 429 bp, Artificial Sequence
  Description of Artificial Sequence: Synthetic coding sequence
atggcagcagtaagcgtatacgctcctcctgtgggcggcttctcctttgataactgtaggaggaatgcagttctggaagcagacttcgccaaaagaggctataagctgccaaaagttcggaagactggcaccacaattgcgggcgtggtgtacaaagatgggatcgtgcttggggcagacactcgtgccaccgaaggcatggtggtcgctgacaagaactgttccaaaattcattttatatcccctaacatatattgttgtggggccggcactgctgccgacactgacatgactacgcagctgatatcttccaatctggagttacacagcctgtccacagggcggctgccgagggtagtgacagctaataggatgttgaaacagatgctctttaggttttggctcctcgggtcgaatggatgcatttag

SEQ ID NO: 130336 - DNA, 819 bp, Artificial Sequence
  Description of Artificial Sequence: Synthetic coding sequence
atgctaatcggaacccctacaccgagagatactactccttctagctggctgacatcttcactgctggttgaggccgctcccctcgacgatacaacactacccaccccagtgagcagcggatgtccaggtctggagcctacagagttctttcagagcctgggcggagacggggagcggaacgtgcagattgagatggcacacgggacgacaaccctcgctttcaagtttcagcacggggtcatcgctgcggtagattcaagggccagtgccggctcctacattagtgctctccgggtcaacaaggtgatcgagatcaacccatatctcttggggacgatgtccggctgcgcagctgactgccaatactgggaaaggttgctggctaaagagtgccgactgtactacctgagaaatggtgaacggatcagcgttagcgcagcctctaagctactgagtaacatgatgtgtcagtacaggggtatgggactgagcatgggaagtatgatctgcggctgggacaagaaagggcccggcctttactacgtcgatgagcacggaacaagactttctgggaatatgttctccacaggctccggcaatacttatgcttacggtgtgatggactcgggctatcggccaaatcttagtcccgaggaagcgtatgatctgggtcggcgagctatagcttatgctacacaccgggactcctactcggggggtgtggtcaacatgtaccacatgaaggaagatgggtgggtcaaggtggagtcgacagatgtcagcgacttgctgcatcaatatagggaagctaatcagtag

SEQ ID NO: 130337 - DNA, 831 bp, Artificial Sequence
  Description of Artificial Sequence: Synthetic coding sequence
atggctctcctggacgtgtgcggagccccacggggacagcgccccgagtccgctttgcccgtggctggcagcggccgaagatccgaccccgggcattactcttttagtatgcggtcaccggagctggccttgccaaggggaatgcagccaacagaattcttccagtctctgggaggagacggggaaaggaacgtacagatcgagatggctcatggtactaccacacttgccttcaagttccagcacggcgtcatagcggctgtggactccagggcttctgccgggagctatatcagcgcgctaagagtgaataaggtcatcgaaatcaatccctacctccttggtacaatgtctggttgtgccgcggactgtcagtattgggagcgcctgctggcaaaggagtgccggttgtattatttgcgcaatggagagcgaatcagtgtgagtgcagcctcaaagttgctcagcaacatgatgtgccagtaccgaggaatgggcctgtccatggggtcaatgatttgtggctgggataagaagggtcccggactttactacgtggacgaacacggtactagactttcaggaaacatgttttccactggttccggaaatacctatgcttacggagtgatggactctggctacagaccaaatctttcaccagaggaggcttacgatttggggagacgtgccatagcctatgcgacccaccgggactcttactcaggcggcgtggtaaacatgtatcatatgaaggaggacggttgggtgaaagtcgaatcaactgacgtgtcagatttgctccatcaatatcgggaggccaaccagtag

SEQ ID NO: 130338 - DNA, 831 bp, Artificial Sequence
  Description of Artificial Sequence: Synthetic coding sequence
atggcacttctggacgtctgcggagctccccgagggcagaggccagaatccgcactccccgtcgctggaagcggaaggagatcagaccccggccactacagctttagtatgaggtcgccagaactggcacttcctcgaggtatgcagcctacagagttctttcagtcgttaggaggcgatggggaaaggaatgttcagatcgaaatggcacatggaacaacaactctggctttcaaattccagcatggcgttatcgcagctgtggattctagagcttcagccggttcctacatctctgctttgcgggtgaataaagttatcgaaatcaacccatacctcctcggcactatgtccggatgcgcagccgattgccagtactgggagcggcttcttgccaaggagtgtaggctgtactatctgcggaacggagaaaggattagtgtttccgcggcctccaagctgctgagtaatatgatgtgccagtaccggggaatgggcctctctatgggttcaatgatttgcgggtgggacaagaaagggccagggctgtactacgtggatgagcacgggaccagactgtccggaaacatgttctccactggctcaggcaacacttatgcctacggagtgatggatagcggctacaggccgaatctgagtccagaagaagcgtatgatttaggcagacgggctatcgcctatgccacccatagagattcttactctggcggagtcgtaaatatgtatcacatgaaggaggacggctgggtcaaagtggagtccacagacgtgagtgacctattgcatcaatatcgcgaggccaaccagtag

SEQ ID NO: 130339 - DNA, 819 bp, Artificial Sequence
  Description of Artificial Sequence: Synthetic coding sequence
atgctgatcggaactccgacacctcgagatacgacgcctagcagttggctgacaagcagcttgttggtggaagctgcacctttggatgatacaaccctgcccacaccggttagcagcgggtgccccggactggaacctaccgaattctttcagtccctgggaggagacggagagcgaaatgtgcagattgagatggcccatggcactacaacgttggcttttaagttccagcacggtgtgatcgcggccgtagactcaagggcttccgccggtagttacatctctgcgttgagagtaaacaaagtgatcgagattaatccttaccttctgggtactatgtctggatgtgctgcagactgtcagtattgggaacgactgttagccaaggaatgccgattatattatctgcggaacggcgagaggattagcgtaagtgcggcatccaaattgctgtctaatatgatgtgccagtaccgtggcatggggttatccatgggatcaatgatttgtggctgggataagaagggaccgggcctgtactacgtggacgaacatggaacacggctgtctggaaacatgttctccactggatctggcaatacttacgcctacggggttatggattccggctaccgtccaaacctgtctcccgaagaggcctacgaccttggtcggagggctatcgcctacgctacacaccgcgactcttactcaggtggtgtggtgaacatgtatcacatgaaggaggatggctgggttaaggtggagtctaccgacgtatcggacttgctgcatcagtaccgcgaggcaaaccagtag

SEQ ID NO: 130340 - DNA, 759 bp, Artificial Sequence
  Description of Artificial Sequence: Synthetic coding sequence
atggccctcttagatgtgtgcggtgcccctaggggacagaggccagaatccgcgttaccagttgcaggatctggaaggcgttctgatcccggacattacagctttagtatgagaagtcctgagctggcccttcctagagggatgcaacccacggagttctttcaaagtctgggcggagacggcgagaggaatgtgcagatcgagatggcacatgggaccacaaccctagcttttaaatttcagcatggcgtgattgccgctgtggactctcgggcatctgccggctcctacattaactgccaatattgggagcgcctgcttgccaaagaatgtaggttgtactatcttcgaaatggcgagcggattagtgtctccgctgcttcaaagttactttctaacatgatgtgccagtatcgtggaatggggctgagcatgggatcaatgatctgcggctgggataaaaagggcccaggattatattatgtcgatgaacacggcacacggctcagcggcaatatgttctccaccggctccggcaacacatatgcatatggagtgatggatagcggctaccgcccaaatctgtcgccagaggaggcctacgacctggggcgtagagcaattgcttatgctacacatagggactcgtattcggggggggtcgttaacatgtaccatatgaaggaggatgggtgggtgaaagtggaatctaccgatgtgtctgatctgctccaccagtatcgggaagctaaccaatag

SEQ ID NO: 130341 - DNA, 759 bp, Artificial Sequence
  Description of Artificial Sequence: Synthetic coding sequence
atggcactgctggacgtgtgcggcgctcccagaggccagagacctgaaagcgccctgcctgttgccggctcaggacggcgaagtgatccaggccactactccttttccatgagatcccccgagctggctttgcccagaggcatgcagcccaccgagttctttcagagtttaggcggagacggtgagagaaacgtgcagattgagatggcgcacgggaccacgactctcgccttcaagtttcagcacggagtgatcgctgccgttgacagtagagcatctgccggtagctacatcaattgtcagtattgggagcggttactcgctaaggaatgccgtctgtattacctacgtaatggggagaggataagcgtgtcagccgcgtccaaactgttgtctaatatgatgtgccagtacaggggaatgggtttgtcaatgggatccatgatttgtggatgggataagaagggacccggtctatactacgttgatgaacacggtacccggctgtctggcaatatgttttcaacaggttccggtaatacatacgcatacggcgtgatggactccggataccgtcccaatctgtctccagaggaagcatacgacttaggccgccgggctatcgcgtacgctacacatagggattcatactctggcggcgttgtgaacatgtaccatatgaaggaggacggctgggttaaggtcgagagcacggatgtcagcgacctgttgcatcaatatcgagaagcaaatcagtag

SEQ ID NO: 130342 - DNA, 819 bp, Artificial Sequence
  Description of Artificial Sequence: Synthetic coding sequence
atgctgattggaacgcccacccccagagacactaccccatcatcctggttaacttccagtctcttggtagaagcagcacctctggacgacactaccttgcccaccccggttagctctggctgccctggactcgagcccactgaattcttccagtccctgggcggagatggcgagagaaacgttcagatcgagatggcccacgggaccactactctcgccttcaagttccagcacggtgtcatcgccgccgtcgattcccgcgccagcgccggctcctatatttcagcactgagggtaaacaaagtaatcgagataaacccatacttacttggaacaatgagtgggtgcgccgctgattgccaatactgggaacggttgctcgctaaagagtgccggctgtactatttaaggaatggcgagcgtatctcagtgtcagcagcatcaaagctattaagcaatatgatgtgccagtatagaggcatgggcctcagcatgggaagcatgatctgtggatgggacaagaagggtcctggattatattatgtagatgagcacggaacgcgcttgagcggaaacatgttcagcaccggttctggtaatacatacgcttatggcgtgatggactcaggttaccgtccaaacctgagccctgaggaagcatatgatctaggcagacgggccatagcctatgccacccatagggatagttactctggcggcgtcgttaacatgtatcatatgaaggaggatggttgggtcaaggtcgaaagcaccgatgttagcgatttactgcaccagtatagggaagcaaatcagtag

SEQ ID NO: 130343 - DNA, 819 bp, Artificial Sequence
  Description of Artificial Sequence: Synthetic coding sequence
atgcttatcggaacccctaccccacgcgatacaaccccctccagctggctgactagtagcctgctggtggaggctgcacccctcgacgacaccactctgccaactccggtctccagtggttgccccggcttagaacccacggagtttttccaatcgctcggaggggatggggaaagaaacgttcagattgaaatggcgcacggtacaacaacactggcatttaagtttcagcatggcgttatcgccgctgtggactcgcgggcgtcagcgggctcttacataagtgcactacgcgtaaataaagtgattgaaatcaatccatatttactgggtacaatgtccggctgtgctgcagactgccagtactgggagagacttctagccaaggagtgccggctctactaccttcggaacggggagcgcatctctgtatccgccgcttcaaaattactgtctaacatgatgtgccaatataggggtatgggattgagcatgggaagtatgatctgtggatgggataaaaaaggtccggggctctattacgtcgatgagcacggaacaagattatcgggcaatatgttctcaacaggctctggaaacacttatgcttatggagttatggattcaggctatcgccccaacctgtctcctgaggaggcgtatgatctcggtcggagggccattgcatacgctacacaccgggattcctactcgggaggcgttgtgaatatgtatcacatgaaggaagacggttgggtgaaagtagaaagcacagacgtctctgacttgctgcatcagtaccgagaggcaaaccaatag

SEQ ID NO: 130344 - DNA, 831 bp, Artificial Sequence
  Description of Artificial Sequence: Synthetic coding sequence
atggccttgctggatgtgtgtggggcaccacggggccagagacctgaaagcgccctacctgtggctggatctggcagaaggtccgatccaggacactattcattcagcatgagatcgcctgagctagccctcccaagaggtatgcagcccaccgaattcttccaatctctgggaggcgatggcgagcggaacgtacagattgaaatggcccatggcacaactaccctggccttcaagtttcagcacggcgtaatagctgcagttgatagccgcgcaagtgccgggtcctatattagcgcgcttcgcgtgaataaggtgatagagatcaatccgtacctgctcggtaccatgagcggctgcgccgccgactgccaatattgggagaggctcctggcaaaggagtgtaggctatactacctgcgtaacggagaaagaatttcagtaagcgctgcaagtaaattgctgagcaatatgatgtgtcaataccgcggtatgggactgagcatgggtagcatgatctgcggatgggacaagaagggacctgggctgtactacgtggacgagcacgggactcggttgagtggcaatatgtttagtaccggttctgggaacacttatgcgtatggggttatggattctgggtaccggccaaacctcagccccgaagaagcgtatgatcttggaagaagagccatcgcctacgccacacaccgcgacagttatagcggtggagtcgttaatatgtaccatatgaaggaggatggttgggtcaaggtggagtccaccgatgtgagcgacctgttgcaccagtatcgagaagctaaccagtag

SEQ ID NO: 130345 - DNA, 759 bp, Artificial Sequence
  Description of Artificial Sequence: Synthetic coding sequence
atggcgctattggacgtctgcggcgcccccagaggacagagacccgaatctgccctgcctgtagccggaagcggtcggaggtccgaccctgggcactatagtttctctatgaggtcccctgagctggcccttccaagaggaatgcagccaaccgaattttttcagagtctgggtggggacggggaacgaaatgttcaaattgaaatggcacacggaacgaccacacttgccttcaagtttcagcacggagtaatagctgccgtggactcccgcgcatctgcaggtagttatatcaactgtcagtactgggagcgtctcttggctaaggaatgccgactgtattatctcagaaatggtgaacgtatctcggttagcgccgccagcaaactgttatcaaatatgatgtgccaatatagaggaatgggcctaagcatgggatctatgatctgtggatgggacaagaaggggcctgggctgtattatgtcgatgaacatggcacaagactgtcggggaacatgttcagcaccggaagcgggaatacatacgcatatggggtgatggatagcggctaccgcccgaatctgagccccgaagaagcttacgacctgggccgacgagctatagcatatgccactcaccgtgatagctactcagggggcgtggtcaatatgtatcacatgaaggaggacggctgggtcaaagtggagtccaccgatgtgtctgacctgcttcaccagtatcgggaggcaaaccagtag

SEQ ID NO: 130346 - DNA, 759 bp, Artificial Sequence
  Description of Artificial Sequence: Synthetic coding sequence
atggctctgctggacgtgtgcggagcaccaaggggccagcgacctgagtccgccctgcctgttgctgggtctgggcggaggagcgacccgggccattactcattctccatgcggtcccccgaattggctctgccacggggaatgcaaccaaccgagttttttcagtccctgggaggggacggggaaaggaacgttcaaattgagatggcacacggaacaacaacgctggcatttaaattccagcatggggtcattgcagccgtggattccagggcatcagccggcagttacataaattgccagtattgggaaaggctcctggccaaagagtgtcggttatattaccttaggaatggcgagaggatcagcgtttccgcggcttcgaagctcctaagcaatatgatgtgtcaataccggggaatgggactgtctatgggtagcatgatatgtgggtgggataagaaaggtcctggcctgtattacgtagacgaacatggcacaaggttgagtgggaacatgttttccacgggcagcggaaacacctacgcttatggcgtgatggattccggatatagacccaatttaagtcccgaggaggcctatgaccttgggcgtcgggccatagcttatgcgacgcatcgcgactcctacagtggaggcgtagttaatatgtatcatatgaaggaggatggttgggtgaaagtcgagtctaccgatgtctctgacctgctgcaccagtaccgggaagcaaatcagtag

SEQ ID NO: 130347 - DNA, 831 bp, Artificial Sequence
  Description of Artificial Sequence: Synthetic coding sequence
atggcattgcttgacgtgtgtggcgcccctaggggccagagaccggaaagcgcgttacctgtggcagggtccgggcggcggtccgacccgggccactactcgttctccatgcgcagcccggagcttgcattgcccaggggcatgcaacctacggagttttttcagtccctgggaggggacggtgagcggaatgttcagattgagatggcccatggaacaaccaccttggcatttaaatttcagcacggcgtgatagccgctgtcgattccagagctagcgccgggtcttatatttcagctctgagagtgaataaggtcattgagatcaatccctacctgcttggaactatgtccggctgtgcggcagattgccagtactgggaaaggctgctcgccaaagagtgcaggctctattacctcagaaatggcgaacgcatcagcgtgtcggctgcttcaaaactgctttctaacatgatgtgccaatatcgcggcatgggcctgtcgatgggctccatgatctgtgggtgggacaagaaaggacccggactctattacgtcgatgaacacgggactcggttaagcggtaacatgttcagcaccggcagtggaaacacatatgcttatggtgtgatggatagcggatataggccaaatctgtccccggaagaagcgtatgatctgggtaggcgagctattgcttacgctacacaccgggattcctactccggcggtgtggtgaacatgtatcacatgaaggaggacggctgggtaaaggttgaaagcactgatgttagcgaccttctgcaccaatatagggaggccaaccagtag

SEQ ID NO: 130348 - DNA, 819 bp, Artificial Sequence
  Description of Artificial Sequence: Synthetic coding sequence
atgctgattggcactcctacccccagggatacaactccctctagttggttgacaagtagcctgctggttgaggccgcgcccttggacgataccacactgccgactccggtcagcagcggctgccctggccttgagccaaccgagttctttcagagcttggggggagacggagaacgaaatgtgcagatcgagatggcccacgggactacaacgctggcattcaagttccaacacggcgtgattgctgccgtggattcccgcgccagtgctggatcatacatatccgcactgagggtgaacaaggttattgagatcaacccatatttgctcggaacaatgagtggctgcgctgccgattgtcagtactgggagcgccttctcgcaaaagagtgcaggctgtattatttaagaaacggagagcgtatatctgtgagcgccgccagtaaattgctttcaaacatgatgtgtcagtaccggggtatgggactgagtatgggatcgatgatctgcggatgggataaaaaagggcctgggttatactacgtggatgagcacgggacccgcctaagcgggaacatgtttagcacaggcagcggcaacacttatgcatatggtgtcatggactccggatatagaccaaacctgtctcctgaagaagcatatgatctgggtcgtagggcaatcgcgtatgcgactcatcgggactcttattccggaggcgtggtcaacatgtatcacatgaaggaggacggatgggtgaaggttgagtccaccgacgtctcagatctgcttcatcagtaccgggaagccaaccaatag

SEQ ID NO: 130349 - DNA, 819 bp, Artificial Sequence
  Description of Artificial Sequence: Synthetic coding sequence
atgttgattggaactcccacacctagagacactacgccctccagttggctgacatcaagcctgctggtggaggccgcccctcttgacgacaccaccctgcctacccctgtgtccagcgggtgtccaggactggagcccacagaattcttccagtctctcggcggggacggtgagcgcaacgtgcagatcgagatggctcacggcaccaccaccctcgcctttaaattccagcacggtgtcatcgcagcggtggatagccgcgcaagtgctggaagctacatctctgcgttgcgagtaaataaggtcattgagatcaatccatacctcctgggcaccatgagcggctgcgcggccgattgccagtattgggagcggctgctagccaaagagtgtcggctatattatttgaggaacggcgagagaatctccgtgtcagcagcctcaaaacttctgtcgaacatgatgtgccagtaccggggaatggggttatccatgggcagcatgatctgtggatgggataagaagggaccagggctgtattacgtcgacgaacatgggacccgattgtccggcaatatgttcagcacagggagcggaaacacctacgcttacggggtgatggactcagggtaccgcccgaacctctcacctgaagaggcatacgacctgggacggcgtgccattgcctacgcaactcatcgggacagctactctggcggcgtggtgaatatgtaccacatgaaagaggatggatgggtgaaagtggagtcaacagacgtctctgatttgctgcaccagtatcgagaggctaaccagtag

SEQ ID NO: 130350 - DNA, 831 bp, Artificial Sequence
  Description of Artificial Sequence: Synthetic coding sequence
atggccctgctggacgtatgcggtgcacctcggggtcagaggcctgaatcggcattacctgtggctggctccgggcggagaagtgatcccggacactactcatttagtatgagatcacctgagctcgcgttgcccagaggcatgcagcccaccgaattctttcagtccctcggtggagacggagagagaaacgtgcagatcgagatggcgcacggcacaaccacccttgccttcaagtttcagcatggtgtcattgcagctgttgatagtcgggcctccgccgggagttacattagcgccctcagggttaataaggtgattgagattaatccatatctcctgggcaccatgagcggatgtgccgcagattgtcaatactgggagagactgctcgcaaaagaatgcagactgtattacttacggaacggagagcgcattagtgtctctgcggccagcaaactgctcagcaatatgatgtgtcagtatcgggggatgggcctgagcatgggaagtatgatttgcgggtgggacaagaaaggtcctggtctgtactacgtggatgagcatggcacaagactgtcggggaacatgtttagcaccggcagtggtaacacatacgcctacggcgtcatggacagcggttacagaccgaatctcagcccggaagaagcctatgacctgggacggagagcgatcgcatacgccactcatagagatagttacagcggaggcgtagtcaatatgtaccacatgaaggaagatggctgggttaaagtggaaagtacagatgtgtcagacttgttacaccagtatcgtgaagccaatcagtag

SEQ ID NO: 130351 - DNA, 819 bp, Artificial Sequence
  Description of Artificial Sequence: Synthetic coding sequence
atgctgatcggtacgcctacaccccgcgacaccacgcccagctcatggttgactagttccttgttggtagaggcggcccccctggacgacaccaccctgccaacccccgtgagtagtgggtgcccaggcttggaacccaccgaattctttcagagtctgggcggcgacggcgagcgaaacgtgcagatagaaatggctcacggcactacaacgctggctttcaagtttcagcacggcgtcatcgccgcagtggattcgcgggccagcgccggctcgtacattagtgcactgcgcgtcaacaaagtaatcgagatcaatccctatcttttgggcaccatgtcaggttgcgccgccgactgtcaatactgggagcgcctgctggccaaggaatgtagattatactatttgaggaatggggagcggatcagcgtgtctgcagctagcaagctgctgtccaatatgatgtgccaataccggggtatgggactgagcatggggagtatgatatgtgggtgggacaagaagggtcccggcctgtattatgtggacgagcatggcacacgcctgtctggtaatatgttctcgactggctcagggaacacctacgcatacggcgtgatggactcagggtatagacctaatctaagtcccgaagaggcatacgatctgggccgaagagccattgcttatgccacgcatcgggactcttatagtggaggggtagtaaacatgtaccacatgaaggaggacgggtgggtgaaggttgagtctacagatgttagcgatcttcttcaccaatacagggaagccaaccaatag

SEQ ID NO: 130352 - DNA, 831 bp, Artificial Sequence
  Description of Artificial Sequence: Synthetic coding sequence
atggcattgttagatgtctgcggagcacccagggggcagaggccagaaagcgcacttcccgtagctggcagtgggcgccgaagtgaccctggccactactccttttcaatgaggtcaccagaactggctttgcctcgtgggatgaagccaaccgagtttttccaaagccttggtggcgacggggaacgtaacgtgcagatcgagatggcgcacggcaccactaccctggcctttaagtttcagcacggagttattgccgctgtcgactcccgtgcttctgcagggtcatatattagtgctctgcgcgtgaataaggtcattgagattaacccatacctcctcggtacgatgtcaggctgtgctgccgactgccagtactgggagagattattggctaaagagtgtcgcctgtattacctgcggaacggggaacgcatttccgtgtcagcagcgtcaaagttgctatccaatatgatgtgccaatatcgcgggatggggctttcgatggggtctatgatctgcggttgggataagaaaggacctggactgtattatgtcgacgaacatggtactcgtctttccgggaacatgttctctactggttcgggcaacacctatgcgtacggtgtcatggattcaggctaccgcccaaacttgtcccccgaggaagcctatgacctggggagacgcgctattgcatatgctacccaccgagatagctactctggcggcgtcgttaatatgtaccacatgaaggaggacggctgggtgaaagttgagtccacagatgtgtccgatttgctgcaccagtatagagaagccaatcaatag

SEQ ID NO: 130353 - DNA, 759 bp, Artificial Sequence
  Description of Artificial Sequence: Synthetic coding sequence
atggctctgctggatgtgtgcggggcaccccgcggacaacggcctgaatctgccctccctgtggctggctccggccggaggtctgatcccggtcactattcgttcagcatgagatcccctgagcttgcccttcctcgaggaatgcagcctacagagttctttcaatcactgggaggagacggggaacgaaacgtccaaatcgagatggcccatggaacgaccaccctggcttttaagttccagcacggagtgatcgcagctgtggattcaagagcatccgcaggatcttatatcaactgtcagtattgggaaaggctgctagctaaggaatgcaggctatactatctcagaaatggagagcgcatcagcgtctcggcggcctccaagctgttatctaatatgatgtgccagtatcggggcatgggattgagcatggggagcatgatctgtggatgggacaaaaaaggtcccggtctgtattacgtcgatgagcatggtactcgtctatcaggcaacatgttttccactggatctggcaatacttatgcttatggcgtgatggatagtggatacagaccaaacctgtcaccggaggaagcctatgatctcgggcggcgggcaatcgcctatgcaacccaccgcgattcctactcaggtggggttgtgaacatgtatcatatgaaggaggatggttgggtcaaagttgagagtacagatgtttctgacttactgcatcaatacagggaggccaatcaatag

SEQ ID NO: 130354 - DNA, 759 bp, Artificial Sequence
  Description of Artificial Sequence: Synthetic coding sequence
atggcactactggacgtctgcggcgccccccgaggacagaggcctgagtctgctctgcccgtggctggctctggtaggcggtcagatcctggccactactccttcagcatgcggtctccagagcttgccctgcctcgcggaatgcagcctacagagttctttcagtcccttggcggcgacggggagcgcaacgtacagatcgagatggcccacgggacaactacgctggcttttaaatttcagcatggcgtgatcgctgctgtggactctagagccagtgctggttcctacatcaattgccagtattgggaacggttactcgcaaaagagtgccgtctttactatctacgcaatggcgaacgaatctccgtcagcgcagcttctaaactgctgagcaacatgatgtgccagtaccggggaatggggctgtcaatggggagcatgatctgcggttgggacaaaaaaggacccggactttactacgtggacgaacacggtactagactgtctggaaacatgttctcaacagggtctggaaacacctacgcttacggtgtgatggattctggttaccgaccaaacttgagtcctgaggaggcgtatgatctgggtcggagggctatcgcctatgcgacacaccgggattcctactctggtggagtagtgaacatgtaccacatgaaagaagatggctgggtgaaggtagaaagcactgatgtcagcgatttgctacatcagtatcgggaagccaaccagtag

SEQ ID NO: 130355 - DNA, 759 bp, Artificial Sequence
  Description of Artificial Sequence: Synthetic coding sequence
atggcattgctagacgtttgtggggcaccccgggggcaaagaccagagtctgcgttgcctgtggcaggctctggccgtcgctctgatcccgggcattacagcttttctatgcgatcacctgagctcgcacttccgaggggaatgaagcctactgagttctttcagtcgttaggaggcgacggggagaggaacgtgcagatagagatggctcacgggacgacaactttggccttcaagttccagcatggcgtgatcgcagccgttgattctcgtgcaagcgctggcagctacataaactgtcagtattgggagcgacttcttgccaaagaatgtcgattgtactacttgcgaaatggagaaaggatatccgtgtctgcggcctctaagctgctgagcaacatgatgtgtcaatacagaggaatgggactcagtatgggatcaatgatttgtggatgggataagaaagggccaggcctgtattatgtggatgagcacggcactcggctgtccggcaatatgttctctacagggtccggtaatacatacgcatacggcgtcatggactccggttacagacctaaccttagtcccgaggaggcttatgatctgggccgtagagctatagcgtatgccacgcaccgggactcctacagtggcggagtcgttaacatgtatcatatgaaagaagacggttgggtaaaggtcgaatctactgatgtctcagacctcctccaccaataccgtgaggccaaccaatag

SEQ ID NO: 130356 - DNA, 819 bp, Artificial Sequence
  Description of Artificial Sequence: Synthetic coding sequence
atgctgattggaactccgacaccccgggatacaaccccttcttcgtggctgacatcaagtttattggtggaggcagcacccctggatgacacaacactgcccacacctgtgtcgtctgggtgtccaggcctggagccaacggagttcttccagtcattgggcggcgatggagagcgcaacgtccagattgagatggctcacgggactacaaccctggccttcaagtttcagcacggagtcatcgcagcagttgacagcagggcaagtgctggtagctacatttcagctttgagagttaacaaggtaattgaaatcaatccttatctgcttggaaccatgtcgggctgtgcggcagattgtcagtactgggagagattgttggctaaggagtgtcgactgtattacctacggaatggagaaaggatctctgtgtcagctgcgagcaagctgctgtcaaatatgatgtgccagtaccgcggcatgggcctgagcatgggctcgatgatctgcggatgggacaaaaaaggtcccgggctttactacgtggatgaacacggcacaaggttgagcgggaacatgttttccacaggatctggcaacacctatgcctatggggtcatggactctggatatcgccccaatctcagtccggaggaggcttatgacctgggtaggcgagcgatcgcttacgctacccaccgcgattcgtacagtggtggcgttgtgaatatgtaccacatgaaggaggatggatgggtcaaagttgaatctactgatgtgtctgacctcctacaccagtatcgagaggcgaaccagtag

SEQ ID NO: 130357 - DNA, 831 bp, Artificial Sequence
  Description of Artificial Sequence: Synthetic coding sequence
atggctctactcgacgtctgtggcgcaccccgcggccaaagaccagaaagcgctctccccgtggcagggtcaggaagacgctccgaccccggacactactccttttccatgcggtctcccgagcttgccctgccacggggcatgcaaccaactgagttttttcaatccctcggcggcgacggtgagcgaaatgtacagattgagatggcccacggtaccactaccctagctttcaaattccagcatggagtgattgcggcagtggactctcgcgccagcgccggctcttatatttctgcacttagagtcaataaagtcatcgagattaacccttaccttctgggcaccatgtctggatgcgcagccgattgccagtattgggagcgactgcttgcgaaagaatgcagactgtattacctgaggaacggcgagcggattagcgttagcgcagcctccaagctgcttagcaatatgatgtgtcagtacagagggatggggttgtctatggggagcatgatatgcgggtgggataagaagggtcctggtttatattacgtagacgaacatggcacgcggctaagtgggaatatgttctcaacgggttccggtaatacgtatgcctacggcgtcatggactcaggatacaggccaaacttgagtcctgaggaagcgtatgatcttggacggcgcgccatagcctatgcaacccaccgggatagctacagtggcggtgtagtaaacatgtaccacatgaaagaagatggctgggttaaggtggaatctaccgacgtgagcgatcttctgcatcagtaccgggaagctaaccagtag

SEQ ID NO: 130358 - DNA, 831 bp, Artificial Sequence
  Description of Artificial Sequence: Synthetic coding sequence
atggctcttctggacgtgtgcggggcaccaagaggccagagacccgagtctgccctcccagtggctggtagcgggcgccgtagtgaccccggccactatagcttttctatgcgctcacccgaactggccttgcctcgtggtatgcaaccaaccgagttcttccaatctttgggaggggacggagagcgcaatgtccagatcgaaatggcccacgggaccaccaccctggcctttaagttccagcacggcgtgatcgcggctgttgacagcagggcctccgccggctcctacatctctgcactgcgcgttaacaaagttattgagatcaacccctatctcctcggcaccatgtcgggatgcgcagctgattgtcaatattgggagcgtctcctagccaaggagtgccgtctctattatctgcgaaatggcgagcggatcagtgtctctgctgccagcaagttgctgtctaacatgatgtgtcaatacagggggatgggactgtccatgggcagcatgatctgtggatgggataagaaggggccaggactctattatgttgatgaacatggtacaaggctttcaggtaatatgttctccacgggatccggcaacacgtacgcatatggagtaatggattccggataccgccccaacctttccccagaagaagcctatgatctaggcagaagagccatcgcatatgccacccatcgagacagctactccggcggcgtcgtcaacatgtaccatatgaaggaagatggctgggtgaaagtggaaagcaccgatgtgagcgatttgcttcatcagtacagggaggcaaaccaatag

SEQ ID NO: 130359 - DNA, 759 bp, Artificial Sequence
  Description of Artificial Sequence: Synthetic coding sequence
atggcgcttctagatgtgtgcggagctcctagggggcagagaccggagagcgctctgccagtggccggctcaggccgtaggtcagatcccggccattactccttttcgatgcggagcccagagctggccttgccccggggtatgcaacccacagagtttttccagagcctgggtggcgatggggagcggaatgtccagatcgagatggcccatggaactactacgttggccttcaagttccagcatggggtcatagctgcagttgatagtcgggcgtccgcaggctcttacattaattgtcagtactgggagcggttgcttgctaaagaatgcaggctctactaccttaggaatggggaacgaattagcgtgtctgccgcaagcaaactcctgtccaacatgatgtgccagtatagaggaatgggattgagtatgggatcaatgatctgcgggtgggataagaagggccccggcttgtactacgtagacgaacatggcacaaggttgtcaggcaacatgttctcgactggatccgggaacacctacgcctacggggtgatggactctggctacaggccaaacttatcgccggaagaagcctatgatctagggaggcgagcaatcgcgtacgccacccaccgggatagttacagcgggggcgtagtgaacatgtaccacatgaaagaggacggctgggttaaagtggaatccaccgacgtaagtgaccttctgcatcagtatagggaggcaaaccagtag

SEQ ID NO: 130360 - DNA, 831 bp, Artificial Sequence
  Description of Artificial Sequence: Synthetic coding sequence
atggcccttctagatgtttgcggggcaccccggggacagaggccagaatctgccctgcccgtcgctggaagtggtcggagatcagatccgggccactatagcttctccatgcggtctcccgaattagccctaccaagaggaatgcagcctacagaattttttcagtctttgggtggcgatggcgaacggaatgtgcagattgaaatggcccatggaactaccactctggcttttaaattccaacacggcgtgattgctgccgtggacagtagggcttccgcaggctcatacatctctgccctgcgcgttaacaaagtcatcgagatcaatccctatctgctagggacaatgtcaggctgcgcggctgattgtcaatactgggaacgtttgttagctaaagaatgcagactgtactatctgcgtaatggcgaaagaatttccgtctctgcggcaagtaaactgctatcaaacatgatgtgtcagtacaggggaatggggctgtctatgggatcaatgatttgtggctgggacaagaagggtccaggcctgtattacgtagacgagcacggcactcggctgagtgggaatatgttttctacgggatctgggaatacttacgcttacggagtaatggacagtggttaccgacccaatctgtcccctgaagaggcttacgacctgggcaggcgggccatcgcctacgccactcatagagatagttactcaggcggcgtggtgaacatgtatcatatgaaagaagatggatgggtgaaagtggagagcaccgatgtgtccgacctcctacatcagtacagagaagccaaccagtag

SEQ ID NO: 130361 - DNA, 660 bp, Artificial Sequence
  Description of Artificial Sequence: Synthetic coding sequence
atgttaagagccggcgccccaaccggtgatttgcctcgcgccggggaagttcacacaggcactacgatcatggctgtcgaatttgatggcggggtggttatgggctcagattctagagtttcggcgggtgaagccgtcgttaaccgcgtttttgataagttatctccactgcatgagagaatctattgtgcgctgtctggaagcgccgcggacgctcaagccgtagctgatatggctgcataccagctcgagttacacgggatagaactggaagaaccacctttggttctggccgcggcaaacgtggttcgcaacatatcttacaagtatcgcgaagatctctcggctcatcttatggtcgccggatgggaccaaagagaaggagggcaggtgtatggaactctgggaggtatgcttacaagacagccatttgcaataggaggttctggttccacatttatctacgggtatgtggatgctgcttacaagccaggaatgtccccagaagagtgtcgtaggttcactactgatgccatcgcccttgcaatgagccgtgacggtagtagcgggggtgttatttacctggtgacaatcaccgccgctggggtggaccatcgcgtgatactcgggaatgagcttccaaaattctatgacgaatag

SEQ ID NO: 130362 - DNA, 660 bp, Artificial Sequence
  Description of Artificial Sequence: Synthetic coding sequence
atgcttcgggctggggctcccacaggtgacctgcccagagctggcgaagtgcacaccgggaccactatcatggccgtggaatttgatggtggggtggtaatgggctctgacagcagagtgtctgccggtgaagctgtggtgaatcgcgtcttcgataaactttctccccttcacgagcggatctattgcgcactgtccgggtctgctgcagacgcacaggccgtcgccgatatggctgcctaccagttagaactccatggcatcgagcttgaggaaccaccattggtgctggccgcagccaatgtggtgcgtaacatctcctacaagtaccgggaagatctgagtgcgcatctcatggttgccggctgggatcagcgggagggcgggcaagtgtacgggacactgggcggcatgttgaccagacaacccttcgccatcgggggcagcggaagcactttcatttacggatatgtggacgccgcatataagcctggaatgtcacccgaggagtgtcgccgcttcactaccgacgccatcgcgctagccatgagtcgcgacggctcatccgggggcgtcatatacctggtgaccatcaccgctgccggtgtggaccaccgggtaatcttgggcaacgaactgcctaaattctacgacgagtag

SEQ ID NO: 130363 - DNA, 660 bp, Artificial Sequence
  Description of Artificial Sequence: Synthetic coding sequence
atgctacgagcgggtgcccctactggtgacctgcctagagcgggcgaggttcatacaggcactacaattatggccgtggagtttgatgggggagtcgtgatgggtagcgactcgcgggtgtctgcaggggaggcagttgttaacagagtgtttgacaagctttctccactgcacgagcgaatctattgcgcactgtcaggcagcgctgctgacgcacaggccgtggccgacatggcagcctaccagctggagttacacggtatcgaactagaagagccccccttagtgctggctgctgctaatgtggtcagaaacatttcctacaaatatcgcgaggatctctccgctcacttgatggtggctggctgggatcaacgtgaggggggccaagtctacggcaccctgggggggatgctcacacgccaaccattcgcaatcggaggcagcggttccacttttatctatggatacgtggatgccgcctataaacccggtatgtcccctgaggaatgccgccggttcaccactgatgctattgccttagccatgtcacgcgacgggagttccgggggagtgatctacctagtaactatcacagctgctggggtagatcacagggttatactgggcaacgaattacctaagttctatgacgagtag

SEQ ID NO: 130364 - DNA, 591 bp, Artificial Sequence
  Description of Artificial Sequence: Synthetic coding sequence
atggcggtagaattcgatggcggcgtggttatgggatccgactctagggtgtctgcgggggaggccgtggtcaaccgcgtgttcgataaactcagtcctttacatgaacggatatattgcgcactgtcaggatcagcagctgacgctcaggcagtcgcggacatggctgcttaccagcttgagctgcacggaattgagctcgaggagcctcccttagttcttgccgcagccaatgttgttaggaacatttcgtacaagtaccgcgaagatctgagcgcccatctcatggtggccggttgggaccagcgcgaggggggacaggtgtacggcacgctcgggggcatgctgacccgacagcccttcgccattggtggcagcgggtcgacattcatttacggctatgttgatgctgcgtacaaacccggcatgagtcccgaggagtgcagacgttttaccacagatgctatagcgctcgcaatgtctcgggacggtagttccggaggcgttatctacctggtgaccatcaccgccgcgggcgttgaccatagggtcatcctggggaatgagctgcctaagttctatgatgagtag

SEQ ID NO: 130365 - DNA, 537 bp, Artificial Sequence
  Description of Artificial Sequence: Synthetic coding sequence
atgctgagggcaggcgccccgaccggggatctgcctagggccggagaggtgcacaccggcacgactatcatggccgtcgagttcgatggcggtgtcgtgatgggaagcgattctcgcgtcagcgcagggatcgaactcgaagagcctccactggtgctggcagcggccaacgtcgtgaggaacatcagctataagtaccgtgaagacctgtctgctcacctaatggtagccgggtgggatcagcgcgaggggggacaggtatatggaacactcgggggcatgcttaccagacaaccatttgccattgggggaagcggttcgacatttatctatggctacgtggacgctgcttacaagcccgggatgagtccagaggaatgcaggcggtttaccaccgatgccacttcgaccaaacgcagggtatgcggctactttctgcgcacacagaaaagagagaatcaaaatcagcgggtgcatgagtacatgtgcacgggtgagaggagtctcagtagctcacccctgttgagttgttcatag

SEQ ID NO: 130366 - DNA, 591 bp, Artificial Sequence
  Description of Artificial Sequence: Synthetic coding sequence
atggccgtcgagtttgacggtggagtagttatgggttctgactccagagtatcagcgggtgaggcggtagtcaatagagtgttcgacaagctctcaccacttcacgaaagaatttactgcgccctgtcaggctccgccgctgatgcccaggctgtagcagatatggccgcctaccaactcgaacttcacggcatcgaactggaggagcccccacttgttctggcggccgcaaacgtcgttagaaacatctcttacaagtatcgcgaagacctgagcgcgcacctcatggttgccggttgggatcagagggaaggcgggcaggtctacggcaccttgggaggtatgctaacacgtcaacctttcgctatcggaggaagtggcagtacttttatctacggttatgtagatgctgcctataagcccgggatgagtccagaagagtgtcgaagattcaccaccgatgctattgcgctagccatgagcagggatggctcgtctggcggggtgatatatcttgtgacaatcaccgctgccggggtggaccaccgcgtgatcctgggcaatgaactcccaaagttctatgacgaatag

SEQ ID NO: 130367 - DNA, 537 bp, Artificial Sequence
  Description of Artificial Sequence: Synthetic coding sequence
atgctgagggctggcgcgcctaccggggatctgcctagggcaggggaagtccacactgggacaacaattatggctgttgagtttgatggcggtgtggtgatggggtcagattcgcgcgtttccgctgggattgaactggaagaaccccccctggtactggcagccgcaaatgtcgtccgaaacatttcctacaaatatcgggaagacctttccgcgcacctcatggtcgcagggtgggaccaaagggaaggaggtcaagtctacggaaccctgggaggtatgctaaccagacagccctttgctatcggcggctccggaagcactttcatatacggatatgttgacgccgcctataaaccaggaatgagcccagaggagtgtagacgattcaccaccgatgccacctccaccaagcgtagagtgtgcgggtactttctgcgtactcagaaaagggaaaaccagaatcagagggtccacgagtatatgtgcactggggaacgttccctatcatcgagcccactccttagctgttcatag

SEQ ID NO: 130368 - DNA, 591 bp, Artificial Sequence
  Description of Artificial Sequence: Synthetic coding sequence
atggccgtagagttcgatggcggtgtggtgatgggttccgactctagggtgtccgccggggaagcagtggtaaaccgcgtgttcgataagctgtcaccccttcacgagcggatatactgcgccctgagcggcagtgcagcagacgcacaggcagttgccgacatggccgcctatcagctggaactgcacgggatagaactcgaggagccgccgttggttctcgctgccgccaatgtggtgaggaacatttcctacaaatacagggaggacctgagcgctcacctgatggtcgctggctgggaccagagagaaggaggccaagtttatggaactctgggagggatgctgacacgacagccattcgctatcgggggatctggttcaacatttatctatggatacgtggatgccgcttataaaccagggatgtctcctgaagaatgcagacggttcactacagacgccatcgctcttgcaatgtcacgggacgggtcctcaggaggagtgatttacctggtgactatcaccgcggctggcgtcgatcatcgggtaattctcggcaatgaattacccaaattttatgatgaatag

SEQ ID NO: 130369 - DNA, 537 bp, Artificial Sequence
  Description of Artificial Sequence: Synthetic coding sequence
atgttgcgcgcaggcgcccccaccggcgacctcccccgcgccggcgaggtgcatacaggcactacaatcatggccgtagagtttgatggaggcgtcgtaatgggcagcgactcacgcgtttcagccggcattgaactcgaggaacccccgcttgtgctcgccgccgccaacgtagtgaggaacatttcctacaagtacagagaggacctcagcgcacacctgatggtagcagggtgggaccagagagaaggaggccaggtttatggtacgcttgggggtatgctaacaagacaaccttttgccattggcggaagcggctccacattcatctatggctacgttgacgccgcatataagcccggtatgtcaccggaagaatgtagaagattcaccacggacgccactagcacaaaaagaagagtgtgtggatattttctgaggacccagaagcgcgagaaccagaatcaaagggttcacgagtacatgtgtacaggcgagcggtctctcagctcttcaccgcttttgtcctgtagctag

SEQ ID NO: 130370 - DNA, 396 bp, Artificial Sequence
  Description of Artificial Sequence: Synthetic coding sequence
atggccgtcgagttcgacggaggggtcgtaatgggatccgattctagagtgtccgccggcgaggccgtggttaatagggtcttcgacaagctgtcccctctgcacgagcgtatctactgtgccctgtccggtagcgctgccgatgcccaagctgtggccgacatggctgcataccagctagagctccatggaatcgagttggaagaaccgccactggttcttgccgccgccaatgtggtccgcaacatatcttacaagtatagagaggacttgtcagctcatctgatggtggctgggtgggatcagagggaaggcggccaggtttatgggacactgggtggaatgctgactcgacagccattcgctatcggtggcagcggttccacattcatttag

SEQ ID NO: 130371 - DNA, 396 bp, Artificial Sequence
  Description of Artificial Sequence: Synthetic coding sequence
atggcagttgaattcgacggaggagttgttatgggtagcgattctcgcgtctctgcaggcgaggccgttgtgaacagagtgtttgacaagctctcaccactgcacgaaaggatctactgtgccctgagcgggtctgcggccgacgctcaggctgtggccgatatggccgcctatcagttagaactgcacggcatcgaattagaagaacctccactggtgctggctgcagcaaatgtggtgaggaatatatcctataaataccgggaagatctgtccgcacacctgatggttgcgggctgggatcaaagagagggaggccaggtttatgggaccctgggaggaatgttgacacgccagccatttgcaattggaggatctggtagcacctttatatag

SEQ ID NO: 130372 - DNA, 396 bp, Artificial Sequence
  Description of Artificial Sequence: Synthetic coding sequence
atggccgtcgagttcgacggaggggtggtcatgggatccgactcacgagtatcggcgggggaggcggtcgttaacagagttttcgataagctgtcaccgttgcacgagcggatatattgtgccctgtcaggcagtgctgcagacgcccaggccgtcgctgatatggctgcctaccagctcgaactgcatgggatcgaactggaggaaccccctctcgtgcttgctgcagccaatgtcgtccggaatattagttataagtatagagaagatctgtccgcccacttaatggtagctggctgggatcagagagagggcggtcaggtgtacggcaccctaggaggcatgcttacacggcagccattcgcaatcggagggagcggctctacttttatatag

SEQ ID NO: 130373 - DNA, 396 bp, Artificial Sequence
  Description of Artificial Sequence: Synthetic coding sequence
atggcagtcgaattcgatggaggcgttgttatgggcagtgactcgcgcgtgtctgctggagaggccgttgtgaacagggtttttgataagctgagccccttgcacgaacggatttattgcgcgctgtctggttctgccgcagacgctcaagccgttgccgacatggccgcataccagctggaactgcacggcatcgagcttgaagagcctcctctggtgttggccgccgcgaatgtggtgcgaaacatctcctataagtacagagaagatttgagcgcccatctgatggtggcaggttgggatcagcgggaggggggccaggtgtatggcacgctcggcggcatgctaactcgccagccatttgcaatcgggggatctgggtcaacatttatttag

SEQ ID NO: 130374 - DNA, 537 bp, Artificial Sequence
  Description of Artificial Sequence: Synthetic coding sequence
atgctccgcgcgggcgcacctacaggagatctgcctcgggcgggtgaggtgcatacaggaaccaccatcatggctgtggagttcgatggcggagtggtgatggggagcgattctcgggtctcagccggaatcgagctggaagagccccctctggtcttagcagcagcgaatgtggtgcgcaacatctcttataagtatcgggaggacctttcagcccatctcatggtggccggttgggaccagagagagggcggacaggtttacggcacccttgggggcatgctaaccaggcaacccttcgcaatcgggggcagcggcagtacattcatttacgggtacgtagacgcagcctataagccggggatgagcccagaagagtgcaggaggttcaccacagacgcaacctctacaaagcggcgagtgtgtggctattttctgcggacacagaagagagaaaaccagaaccagcgggtgcatgagtacatgtgtacttctgagcggtcactgtcctcctcgcctctcctgagctgctcctag

SEQ ID NO: 130375 - DNA, 396 bp, Artificial Sequence
  Description of Artificial Sequence: Synthetic coding sequence
atggccgtcgagtttgatggaggggtggttatgggcagtgattccagggtttccgccggcgaagcagtagtaaatcgtgtattcgacaagttgagccccttgcacgagcatatttactgcgctctctctggatcagccgccgacgcccaggcagtcgctgacatggctgcctatcaacttgagcttcacggaattgaactggaggagcctccactagttctcgcagctgccaacgtcgtgagaaacatctcgtacaagtatagagaagatctgtctgcccatctcatggttgccggctgggatcaaagggaggggggccaggtctacggtactttgggaggaatgctgacccggcagcccttcgcaatcggaggcagtggtagcacatttatctag

SEQ ID NO: 130376 - DNA, 591 bp, Artificial Sequence
  Description of Artificial Sequence: Synthetic coding sequence
atggcagtggagtttgatggcggcgtggtcatgggttctgacagtagggtgtctgcgggggaggccgtggtgaaccgcgtgttcgacaaactgtcaccccttcatgagagaatatattgtgcactaagcgggtcagccgcagacgcgcaggcagtcgcagacatggccgcctatcagctggaactgcacgggatcgaactggaggaaccccctctggttttagccgcagccaacgtggtacgaaatatctcctacaagtatagagaagatctgtccgcacatctaatggtcgctggatgggaccagagggagggcgggcaggtctacggcacgcttgggggcatgctgacaaggcaacctttcgccatcggcgggagtggatccaccttcatttatggatacgttgatgcggcctataaacccggcatgtcaccggaagagtgtagacgattcacgaccgatgctattgctcttgcgatgtctcgggatggttcttctggcggcgttatatatctcgtcaccattaccgcagcaggggtcgatcacagggtgatcctcggtaacgagttgccgaagttttacgacgagtag

SEQ ID NO: 130377 - DNA, 660 bp, Artificial Sequence
  Description of Artificial Sequence: Synthetic coding sequence
atgctgcgcgccggcgcaccaacaggagatctcccccgggccggcgaggttcataccggtactactatcatggctgtcgagttcgatgggggggtggtaatgggcagcgactccagggtttccgccggagaggccgtggtgaatagggtgtttgataaactcagtcctcttcatgaacgaatatactgcgctctttctggttcggcagctgatgcacaagcagtcgcagatatggccgcttatcaacttgaactgcacggaattgagctggaagagccacctctggtgcttgcggctgctaacgtggtgcgcaacatttcttataagtacagagaggatttaagcgcccacctcatggtcgctggctgggaccagcgtgagggaggccaagtctatgggacgctgggaggtatgttaacaagacaaccatttgccatcggcggttcgggttcaacgttcatatatggttacgtggatgcggcctacaagcctggtatgtctcccgaggagtgccggaggtttacgacagacgccatcgcactggctatgtctagagatggtagttcgggcggagtgatctacctggtgaccataactgcggctggggtcgatcatagagttattcttggaaacgaactgccgaagttctacgacgagtag

SEQ ID NO: 130378 - DNA, 591 bp, Artificial Sequence
  Description of Artificial Sequence: Synthetic coding sequence
atggcagtggaatttgatggcggagttgtgatggggagcgatagcagggtgtcagcaggtgaagccgttgtgaacagggtgttcgacaagctgtcacccctccacgagcacatctactgcgccctctctgggagcgccgccgacgcacaggctgtggctgacatggcagcctaccagctggagctgcacgggatcgaactcgaggagcctccattagtgctagcagcggctaatgttgtgaggaatatttcctacaagtacagagaagaccttagcgcccatcttatggttgcgggctgggaccagcgcgagggaggccaggtttacgggacattgggcggcatgcttacacggcaaccctttgccatcgggggctctggcagtacttttatttatggctacgttgatgccgcttataagccagggatgtctccagaggagtgccggcggtttacaactgacgcgatcgcgctagcaatgtcacgagatgggagctccggcggcgtcatttacctagtcaccatcaccgctgccggtgtcgatcaccgcgtgattctggggaacgagctccccaagttttacgacgagtag

SEQ ID NO: 130379 - DNA, 537 bp, Artificial Sequence
  Description of Artificial Sequence: Synthetic coding sequence
atgctccgcgccggcgcccccaccggagatttgccaagggccggcgaggtccatacgggcactaccattatggccgtcgagtttgatgggggtgtggttatgggcagcgattcgcgggtatcagcggggatagagctggaggagccacccttagtgctggcagcagccaatgtagtgaggaatataagttacaagtatcgtgaggatcttagtgctcaccttatggtagcaggctgggatcagagagaaggcgggcaggtatatgggacgctgggaggcatgctaactaggcagccatttgctatcggtggcagcggatcaaccttcatttacggatacgtggacgccgcttataaacccgggatgagtccagaggagtgtcggcgcttcaccaccgacgccacctccaccaagcgcagggtctgcggatacttcctcagaacacaaaagagggagaaccagaatcagcgcgttcatgagtacatgtgtactagcgaaagatcattgagcagttctcctctgctaagctgcagttag

SEQ ID NO: 130380 - DNA, 537 bp, Artificial Sequence
  Description of Artificial Sequence: Synthetic coding sequence
atgcttcgagcaggggcccccaccggtgatctgccacgcgccggcgaggtacacactgggacaacaatcatggctgtggaatttgacgggggagtggtgatgggtagcgattcacgagtgtccgccggcatcgagttagaagaacccccccttgtgctggctgccgctaacgtggttcgtaacattagctataagtacagagaggacctgtctgcacatctaatggtggctgggtgggatcaacgggaggggggccaggtctatggtacactgggggggatgttgacgaggcagccctttgccatcgggggatccggcagtacatttatttacggctatgttgacgctgcatataagcccgggatgtcccctgaagaatgtcggagatttactacagatgcgacgagtaccaagcgccgcgtgtgcggctacttcttaaggactcaaaagagggagaaccaaaatcagcgcgtgcacgagtatatgtgcacatcagaacgcagtctcagctccagtcctctgctgtcatgttcctag

SEQ ID NO: 130381 - DNA, 660 bp, Artificial Sequence
  Description of Artificial Sequence: Synthetic coding sequence
atgctccgcgctggtgcacctacgggagacctgccccgagctggcgaagttcataccggaaccaccatcatggctgtggagttcgacggaggcgtcgtaatggggagcgattcacgggtgtccgccggtgaagccgtggtgaatagagtgttcgacaagctgtccccactgcatgagcatatctactgtgccttgagcggttccgctgctgacgcccaggctgtggcggatatggctgcttatcagctggagctgcacggcatcgagctggaggaacctcccctcgtgttagctgccgcaaatgtagtgcggaacatttcatataagtatcgagaagacctgagcgcgcacttgatggtggccggctgggaccagcgggagggggggcaggtatacgggacattaggagggatgttgacccggcaaccgttcgccattgggggatcagggagcactttcatctacgggtacgtggacgctgcttacaagcctggcatgtcccccgaagagtgtagacgttttactactgacgcaatcgccctagctatgtctagagacggctcctccggaggcgtgatctacctggttaccattacagccgccggtgtggaccatcgcgtgatcctgggaaatgagctgccaaaattttacgatgaatag

SEQ ID NO: 130382 - DNA, 591 bp, Artificial Sequence
  Description of Artificial Sequence: Synthetic coding sequence
atggcagtggaatttgatgggggagtagtaatgggatctgactcacgggtgagcgctggtgaagccgtggtgaacagggtgtttgataaattgtcacccctccatgagcatatttattgcgcactgtccgggtcagctgctgacgctcaggctgtcgctgacatggcggcgtaccagcttgaactgcatggtatcgaactggaggagccccctctggtgctggcggcagctaatgtcgtgaggaatatttcctacaagtacagggaggatttgtccgcccatctgatggttgccggctgggaccagcgtgaggggggtcaagtttatggaactctcggtgggatgctgacccgacagcccttcgcgatcggagggtccggctctacctttatatatggttacgtcgacgcagcttacaaacccgggatgagtccagaagagtgccgcaggtttaccacagatgccattgctttggcaatgagcagagacggaagctctggcggtgttatatacctcgtgaccattactgcagccggtgtagaccaccgagtaattctgggcaacgagctgcctaaattctatgatgaatag

SEQ ID NO: 130383 - DNA, 660 bp, Artificial Sequence
  Description of Artificial Sequence: Synthetic coding sequence
atgctccgggccggtgccccaacaggtgacctcccgcgggcaggcgaggtgcacaccggaaccacaatcatggccgttgagttcgatgggggtgtggttatggggagtgacagtcgtgtatcagcaggggaggccgtggtgaaccgcgtctttgataagctgagcccactgcatgagcatatatactgcgccctctctggtagcgctgcagacgcacaggctgtagcagatatggcagcctatcagctggagctgcacggaatcgagctggaggagcctcctcttgtcctggctgccgcaaacgtcgtgcgcaacatctcttataaataccgcgaagatctttctgctcatttgatggtggctggttgggaccagcgggagggcggccaggtgtacgggacactgggtggaatgctgactagacaaccctttgctatagggggatcgggttcaacctttatttacggctacgtggatgccgcatacaagcccggtatgagcccagaagaatgcagaagatttaccacagacgccatcgctctcgccatgagccgcgacggctcaagcggtggtgtgatctacctggtcacaataacagctgcaggagtcgatcacagggtgatcctgggaaatgagctacctaaattttatgacgaatag

SEQ ID NO: 130384 - DNA, 396 bp, Artificial Sequence
  Description of Artificial Sequence: Synthetic coding sequence
atggccgtggagttcgacggaggggtggtgatggggtccgacagccgagtctctgcaggagaggctgttgtgaacagagtcttcgacaaactgtcccctctacacgagagaatctactgcgctttatcagggtccgctgcggacgcccaggctgtggcagatatggcggcctatcagctggaactacatgggattgagctcgaagaaccccccttggtgctggcggctgctaatgtcgtccgcaacatctcttacaagtatcgtgaagacctcagcgcccatctgatggtcgctggatgggatcagagggaagggggacaggtttacggaacactgggaggtatgttgactcggcaaccgtttgcaataggaggaagcggaagcacattcatttag

SEQ ID NO: 130385 - DNA, 396 bp, Artificial Sequence
  Description of Artificial Sequence: Synthetic coding sequence
atggccgtcgaattcgatggtggcgtggtgatggggtccgattcaagggtgtctgcgggcgaggccgtcgttaacagagtgtttgacaaactgtcgccactgcatgagcacatctactgcgccctgtcggggtccgccgccgacgcacaggcagtggccgacatggcagcctatcagctcgagcttcatggcatcgagcttgaagaaccaccattggtcctggccgcagcaaacgttgtgcgaaacatatcctacaaatatagggaggacctgagcgctcatctcatggtcgctggatgggatcagagagaaggcggtcaggtttacggaacacttggcgggatgctgaccaggcagccttttgcaatcggaggatcgggaagcacttttatttag

SEQ ID NO: 130386 - DNA, 591 bp, Artificial Sequence
  Description of Artificial Sequence: Synthetic coding sequence
atggctgtggagttcgacgggggcgtggtgatggggtccgattccagagtgagcgccggcgaagctgttgtgaacagggtgtttgacaagctatctcccctccacgagcacatttattgtgctctaagcggctctgctgccgacgcccaggctgtagccgatatggcagcctaccaattggagctgcatggaatcgaactggaggagcctccacttgtgctcgctgctgctaacgtcgtgagaaacatctcttacaagtaccgggaagatctcagcgcccacctgatggtcgccggatgggaccagcgagagggaggtcaagtttatggtactctgggcggaatgttgacccgccaacctttcgctatagggggctcaggctccacttttatttacgggtacgtggacgctgcatataagcccgggatgagtcctgaggaatgccgccgatttactacagatgccatcgcccttgccatgtcacgtgacggctctagcggcggtgtcatttaccttgtcacaataactgctgccggggttgatcacagagtgattctgggaaacgagttacccaaattttacgacgaatag

SEQ ID NO: 130387 - DNA, 660 bp, Artificial Sequence
  Description of Artificial Sequence: Synthetic coding sequence
atgttaagggcaggagccccaaccggtgacttgcccagggctggagaggttcacacaggcaccactatcatggctgtcgagttcgacggtggggtcgtgatgggctcggactccagggtaagcgccggggaagctgtggtcaatcgagtctttgacaaactgtcccctctgcacgagcgcatctattgcgctctgagcggatcggctgctgacgcccaggcagttgctgacatggctgcctatcaactggagttgcacggaatagagctggaagagcctccactggtgctcgcagcagcgaatgtggttcgtaacatttcctacaagtatcgggaagatctgagtgcccacctgatggttgcaggctgggatcagcgtgagggcgggcaggtctatggtaccctgggcggcatgctcacaaggcagccctttgcaatcggcggctcgggttctacattcatatacgggtacgtggatgccgcctacaagcctgggatgtctcctgaagagtgtcggcgatttacaacagacgctattgctcttgctatgtctagagacggtagttcagggggtgtcatctatctcgtgactattactgcagcaggtgtggatcacagggtcattctcggtaatgaactccctaagttctacgacgaatag

SEQ ID NO: 130388 - DNA, 537 bp, Artificial Sequence
  Description of Artificial Sequence: Synthetic coding sequence
atgcttcgggcaggagctcccactggagatttgccccgcgccggcgaggtgcacaccggcactacgataatggccgtcgaattcgatggcggagtggtaatgggtagcgattctcgggtgagcgcaggtatcgaactggaagaaccccccttggtccttgctgccgccaatgtcgtgagaaacatcagctataagtatagagaggacttgtccgcgcacctgatggtggcaggctgggatcagcgcgaggggggtcaggtgtacggcacactcggaggaatgttaactcgccagcccttcgctatcggcggatcaggctccacctttatctatggctacgtcgacgccgcctacaaacccggtatgtccccagaggagtgtagacgctttaccaccgacgctactagcaccaagcgtcgcgtctgcggatatttcctgcggacccagaagcgagaaaaccagaaccagcgcgtgcatgaatacatgtgtacgggagagcggtcactgtcaagtagcccactgctgtcttgtagttag

SEQ ID NO: 130389 - DNA, 537 bp, Artificial Sequence
  Description of Artificial Sequence: Synthetic coding sequence
atgctgcgggcaggggctcctactggcgaccttccacgcgccggcgaagtccacacaggcactaccatcatggctgtagagtttgatgggggtgtggtaatgggatccgattcccgggtgagcgccggaatagaactggaggagcctcctctcgtactggccgctgcaaatgtggtgcgcaatataagctataaatatcgtgaggatctctcggcacacctgatggtagccggctgggaccaacgggaagggggtcaggtgtacggcaccttaggagggatgctgacaagacagcccttcgctatcggcggcagtggtagcactttcatctatggatacgtcgatgctgcctataaacctggcatgagccccgaagagtgcaggcggtttacgactgacgccacatccaccaagaggcgtgtgtgcgggtactttcttcgtacacagaagagagagaatcaaaaccaaagagttcacgagtacatgtgtactggcgagagatctctgtcttccagccccctgctcagttgctcttag

SEQ ID NO: 130390 - DNA, 591 bp, Artificial Sequence
  Description of Artificial Sequence: Synthetic coding sequence
atggccgtggagttcgatggcggagttgtgatggggagcgacagtagagtgagtgcaggagaagctgtcgtgaacagggtgttcgacaaactttcgccacttcacgagcgaatttactgtgccttgtcaggttctgcagcagacgcccaggcagtcgccgatatggccgcctaccagctggagctgcacggcatcgaactcgaggaacctcctctggtattggccgctgcaaatgtggtgcgcaacatatcgtataaatatagagaagatttgagtgcacacttaatggttgcgggttgggaccagcgagaaggcggccaggtgtatggcacccttggcggcatgttgacccggcagccatttgctataggtgggtccggctccacatttatatacggctacgtcgacgcagcctacaagccgggaatgtctcccgaggagtgtaggcgcttcacaactgacgcaatagctcttgccatgagtagagacggctctagtggtggcgtcatctatttggtgaccatcaccgctgccggtgtggatcaccgggtcatactaggaaatgaacttccgaaattttacgatgaatag

SEQ ID NO: 130391 - DNA, 660 bp, Artificial Sequence
  Description of Artificial Sequence: Synthetic coding sequence
atgctgcgagccggagctccaacaggagatttaccccgggcaggagaagtccacaccgggactactatcatggccgtggagtttgacggtggagtcgttatgggctcagattcaagagtgtccgccggtgaggcagtggtgaacagggtattcgacaagctgagcccactccacgaacacatctactgtgctctcagcggtagcgccgcagacgcgcaggcggtggcagacatggccgcataccagctggagctccacgggattgaattagaagaaccacctctggttcttgcggccgccaatgtggtgaggaatatctcgtacaagtaccgcgaggatctgtcggctcatctgatggtggcaggatgggaccagagagaaggagggcaggtgtatggcactttgggtggaatgctgactcggcaaccttttgccatcggggggagtgggtcaacttttatctatggatacgtagacgctgcctataagccaggaatgagcccagaagagtgccggcgctttaccacagatgcaattgcactggcgatgagcagggacggtagtagtgggggggtgatctatctggttactattacagcagccggtgtcgaccatagggtgatcctgggtaatgaattgcctaaattttacgatgagtag

SEQ ID NO: 130392 - DNA, 465 bp, Artificial Sequence
  Description of Artificial Sequence: Synthetic coding sequence
atgctccgggctggagcccctacaggcgatctcccacgcgcgggagaagtgcatacagggacgactatcatggccgttgagttcgacggcggcgtggttatgggatccgatagccgagtcagtgcagggatagaactcgaggagcctccacttgtccttgctgctgcgaacgtggtacgaaacatcagttacaaatatcgagaggacctgtccgctcatcttatggtggccggatgggaccagcgggagggagggcaggtgtacggaactcttggcggtatgctgaccagacagccttttgccatcggcggcagcggctcgaccttcatctatgggtatgtggatgctgcatataagccagggatgtctcccgaggaatgccgccggttcacgactgacgggaatcagccatctgggcgcgttcccggtgagggcttcgagacatgggaggggagccgcttatag

SEQ ID NO: 130393 - DNA, 396 bp, Artificial Sequence
  Description of Artificial Sequence: Synthetic coding sequence
atggctgtggagttcgacggtggggttgttatgggcagtgacagccgcgtatccgctggcgaagcagttgtcaacagggtatttgacaaattgagcccattacatgagcatatctattgcgccctcagcgggtcagcagctgatgcccaagccgtcgccgacatggccgcctaccagctggaactccacggtatagaactggaagagccacccctggtcttggcggcagcgaacgtcgttcggaatatatcttataagtatcgcgaggacctttcggcgcacctgatggtggcaggatgggatcagagagaaggcggccaggtctatgggacactgggggggatgctgacaaggcagcccttcgccatcgggggttccggatctactttcatctag

SEQ ID NO: 130394 - DNA, 465 bp, Artificial Sequence
  Description of Artificial Sequence: Synthetic coding sequence
atgctgagagccggcgcccctactggagacttaccccgtgccggtgaggtccatacaggaactacaatcatggctgttgagttcgacggcggggtagttatgggtagtgatagtagggtcagcgctggtattgaattggaagagcctcccctcgttttagctgcagcaaatgtggtgagaaatatctcctataaatatcgtgaagatctgagcgctcacttaatggtggctgggtgggaccagagagagggtggtcaggtgtatggtacattgggtggcatgctcacaaggcagccttttgctatcggaggaagcgggtcgacattcatttacgggtatgttgatgccgcctataagcccggcatgtctcccgaggagtgccggcggtttacgaccgatgggaatcaaccctccggacgtgtgcccggtgaggggtttgagacgtgggaggggagcaggctgtag

SEQ ID NO: 130395 - DNA, 465 bp, Artificial Sequence
  Description of Artificial Sequence: Synthetic coding sequence
atgctgagagctggggccccaacaggcgatttaccgcgagctggggaagttcataccggaaccaccatcatggccgtagagtttgatggtggcgttgtcatgggctcagattccagagtgtctgcaggtattgaactcgaggaaccacctctcgtgctggcggccgcgaatgtcgtaaggaatattagctacaagtatagagaagatctatccgcccacctcatggtcgccgggtgggaccagagggaaggtggccaagtctatggcaccctaggcggtatgttgacgcgacagccatttgccatcggcgggagcgggagcacttttatctacggctatgtggatgccgcctataaacctggcatgtcgcccgaagaatgccgacgattcacaaccgacggtaaccagccatccggccgtgttccgggcgaggggttcgagacctgggagggatcccgcttatag

SEQ ID NO: 130396 - DNA, 465 bp, Artificial Sequence
  Description of Artificial Sequence: Synthetic coding sequence
atgctgagagccggcgcgcctactggagacctgccccgggccggcgaggtgcacaccggcactaccattatggctgtggagttcgacggtggcgtggtgatgggatccgactcccgagtgagtgcaggaatagagctcgaagagccaccactggtgctggccgccgcaaacgtcgtcagaaatatctcttacaaatatcgcgaagacctgtctgcacacttaatggtggccggatgggatcaacgcgaaggcgggcaggtctacggaaccctaggaggtatgcttacacgccaaccattcgcaattgggggaagcggctcaactttcatctatgggtacgtcgatgccgcctacaaacctggcatgtcgcctgaagagtgccggagattcactacagacgggaaccagccctccggccgcgtgcccggcgaaggcttcgaaacatgggaaggtagtaggctatag

SEQ ID NO: 130397 - DNA, 465 bp, Artificial Sequence
  Description of Artificial Sequence: Synthetic coding sequence
atgttgcgtgcaggtgcccccaccggggacttgccccgagcaggcgaagtgcacacaggcaccacgatcatggccgtggagttcgacggcggagtggtcatggggagcgacagccgggtaagcgctggaattgaactcgaggaacctcctttggtgctggccgcagccaacgtagtccgaaacatttcctataaataccgcgaagacctatccgcccatctgatggtggcagggtgggatcaacgtgagggcgggcaagtctatggcaccctgggcggtatgcttacccgacagccctttgccattggcgggtcgggatccaccttcatatacggctacgttgacgcagcctacaaacccgggatgtcgcctgaggaatgcagacgtttcacgacagacggaaatcagccgtccggcagagtgccaggggagggcttcgaaacctgggaggggtcccgtctctag

SEQ ID NO: 130398 - DNA, 465 bp, Artificial Sequence
  Description of Artificial Sequence: Synthetic coding sequence
atgcttcgcgccggtgctccaactggcgacctgccaagggccggagaggtgcacactgggaccacaatcatggctgtggagtttgatgggggagttgtcatgggaagtgacagccgggtgtccgccggcatagagctcgaggaaccgccccttgtgctggcagcagccaatgtagttaggaacatctcttacaaatatcgggaagacctttccgcccatcttatggtcgccggatgggatcagagagagggcggacaagtgtatgggactctcggcggtatgctgacacggcagcccttcgcgatcggtggatccgggagtacattcatttatggatatgtagacgcggcatacaagccaggtatgtcccctgaagaatgccggagatttactaccgacggtaaccaaccatccgggagagtgcccggggaggggttcgagacttgggagggcagccgattgtag

SEQ ID NO: 130399 - DNA, 465 bp, Artificial Sequence
  Description of Artificial Sequence: Synthetic coding sequence
atgctgcgggcaggcgcacctaccggcgatctccccagggctggagaagtgcatacgggtaccaccataatggccgtcgagtttgatggaggggttgtaatgggttcagattctcgtgtttcagctggaattgagctcgaagagcctcctctggttctggcagcagccaatgtggtccggaatatcagttacaaatatagggaagatctgtcggctcatttaatggttgccggttgggatcagagggagggaggtcaagtttacggcactctgggtgggatgctcactcggcagccttttgcaattgggggctcaggcagcacgtttatttacgggtacgtggacgccgcttacaaacccggcatgagtccagaggagtgtcggagatttacaaccgacggcaatcagccctcaggcagggtgccgggggagggcttcgaaacgtgggaagggtctaggctgtag

SEQ ID NO: 130400 - DNA, 465 bp, Artificial Sequence
  Description of Artificial Sequence: Synthetic coding sequence
atgcttcgagcaggcgctcccactggagatctccccagggccggggaggtacacaccggcacaactatcatggccgtggaattcgatggaggtgtggttatgggctctgatagcagggtctcagctgggattgagctcgaggagcctccactggtgctcgccgctgcaaacgtcgttcggaacatttcctataaataccgtgaggatctgagcgcacacctgatggttgccggatgggatcagagggaaggtgggcaagtgtacggcacactaggaggtatgctgactaggcagcctttcgccatcggcggcagtggtagcacttttatctacggctacgtagatgccgcttacaagcccggaatgtctcccgaggagtgccggcggtttaccaccgatggcaaccagccctctggacgcgtaccaggcgagggctttgaaacatgggaggggtcacgtctgtag

SEQ ID NO: 130401 - DNA, 426 bp, Artificial Sequence
  Description of Artificial Sequence: Synthetic coding sequence
atgaacgctaggggacttgggagtgagttaaaggattcaatccccgtgaccgaactgtctgctagcggtcccttcgaatcccacgatctgctgcgcaaggggttctcctgcgttaaaaatgagctactgccgtcccatccactcgagttaagtgaaaagaactttcagctcaatcaggataagatgaacttcagcaccttgcgcaatatccaaggtttgttcgccccgttgaaactgcagatggagttcaaagcagtacagcaggttcagcgactcccatttttgagcagtagcaatctcagtctcgatgtgctccgcggaaatgacgaaacaatcggctttgaagatattcttaatgacccttcacagagcgaagtcatgggtgagccgcatctcatggtggaatacaagcttgggctgctctag

SEQ ID NO: 130402 - DNA, 471 bp, Artificial Sequence
  Description of Artificial Sequence: Synthetic coding sequence
atgccaatggccgggctgctcaaaggccttgtgcgacagctggaaagattcagcgttcagcagcaggcctccaagatgccacctaaaggcaagtctggttctggaaaggcagggaaggggggagctgccagcggctccgactccgcagataagaaggcccagggcccaaaaggcggcggaaacgccgtgaaagtcagacacatcctttgtgagaaacacggaaaaatcatggaggctatggagaagctaaagagcggtatgagatttaacgaggttgccgcccaatattccgaggacaaggcgcggcaggggggagacctgggatggatgacaagaggcagcatggtgggccctttccaagaggcagcctttgccctgcccgtatccggtatggacaaacccgtctttacagacccacctgtgaagaccaagttcggatatcatatcattatggtggagggccgcaaatag

SEQ ID NO: 130403 - DNA, 402 bp, Artificial Sequence
  Description of Artificial Sequence: Synthetic coding sequence
atgccaatggctggcctacttaagggactggtgcgccagctggaacgcttttcagtgcagcaacaggcttcaaaaatgccccctaaaggaaaatccggatcgggtaaggccggaaaggggggggccgcctccggctcagactctgcagataagaaggcccaggggcccaaggggggaggcaacgcagttaaggtgagacatatactctgcgagaagcatggcaagataatggaggccatggaaaagctcaaatcagggatgcgatttaacgaagtggctgctcagtattccgaagataaagctaggcaggggatcccctcactccaacagcacgctggacatcatcgggatctgcggtccaccctaatctcgctggtatcctacctgcagaccacgccatag

SEQ ID NO: 130404 - DNA, 1062 bp, Artificial Sequence
  Description of Artificial Sequence: Synthetic coding sequence
atggcagctgcggaagcagccaactgcattatggaggtgagttgtggacaggcagagagctctgagaagcccaatgcagaagacatgacgagtaaagactattattttgactcttacgcacactttggcatccacgaggagatgctcaaggacgaggtccggaccctgacatatagaaactcaatgttccataacagacacctcttcaaggataaggtagtactggatgtgggctctggtacaggtattctctgtatgttcgctgcaaaggccggtgcgagaaaagtgatcggaatcgaatgttctagtattagcgattatgcagtgaaaatcgtaaaggccaataagctggatcacgtggtgactattatcaagggcaaagtggaagaggtggaactgccagtggaaaaagtggatatcatcatatccgaatggatgggctactgtctgttctacgaaagcatgcttaatacggttctgtatgcccgtgataagtggctggccccagacggactgatcttccctgaccgggctacattgtacgttaccgccattgaggatcgtcagtacaaggattacaagatccattggtgggaaaacgtctacggctttgacatgtcatgcatcaaggacgtagctataaaggaaccgctggtcgatgtggttgaccccaaacagctggtaaccaacgcctgcctgattaaagaggtggacatatacactgtcaaggtggaggatttaacctttaccagccccttctgccttcaggtgaagaggaacgattatgtgcatgccctcgtggcttacttcaacatcgaattcaccaggtgccataagcggacaggattttctactagtccagaatctccgtacactcattggaaacagaccgtattttacatggaagactacctgactgtcaaaaccggagaagagatcttcggcaccatcggtatgcgtcccaatgcaaagaataacagggatctggatttcaccattgacctggatttcaagggtcagctctgcgagctcagttgctccaccgattatcgaatgaggtag

SEQ ID NO: 130405 - DNA, 882 bp, Artificial Sequence
  Description of Artificial Sequence: Synthetic coding sequence
atggtgggggtcgcagaagtgagctgcgggcaagccgaatcctctgaaaaacccaacgccgaggatatgacatccaaggattattatttcgatagctatgcgcacttcgggatccacgaggagatgctgaaagatgaggtgagaaccctcacctaccgtaactcaatgtttcacaaccgtcacctgttcaaggataaggtcgtgctcgatgtgggttctggtaccggaatactgtgcatgtttgctgctaaggctggtgcgcggaaagttattggcattgagtgttcatctatctcggactacgccgtgaaaattgtgaaggccaataaactggaccacgtcgtgaccatcatcaagggaaaggtggaggaagttgagcttccggtggagaaggtggatattattatcagcgagtggatgggatactgcctgttttacgaatcaatgctgaacacggtactttacgcccgagacaaatggctggcacccgacggccttatatttcccgaccgggcaaccctgtatgtcaccgcaatcgaggatagacaatataaagattataagattcactggtgggaaaacgtatacggcttcgacatgtcatgtatcaaagacgtcgccataaaggaaccactggttgacgttgtcgaccctaagcagctcgtgaccaacgcctgtctgattaaggtccggggatgggcttggcccggagccccgtgggttgagactaaagaacgccccagccctggacccggaatggggctatggggccctgagtgctggccagaagtgagtgagccggacctacctgctcggggaggagccaggggaccagggaaaaccctcaggcccctgaacatattcgtgagtgctgctgtctag

SEQ ID NO: 130406 - DNA, 1116 bp, Artificial Sequence
  Description of Artificial Sequence: Synthetic coding sequence
atggcggcagcagaggcagctaactgtataatggagaacttcgtagccaccctggccaacgggatgtcgctccagcctccactggaggaagtatcatgtgggcaggctgagtcttccgaaaagcccaatgccgaggacatgacgtcaaaggactactatttcgacagctatgcacacttcggcatccatgaggagatgttgaaggacgaagttcgaactctgacataccgcaatagtatgttccacaatcgccacctattcaaagacaaggtcgttcttgacgtggggtccggcacaggaatactgtgcatgtttgcagcaaaggctggtgccaggaaagtgatcggcattgaatgttcatccatctctgattacgccgtgaaaattgtgaaagccaataaacttgaccatgtggtaacaattatcaagggaaaggtagaagaagtcgaattacctgtggagaaggtagacattattatttcagaatggatgggttactgtcttttttacgagtccatgttaaacactgtgttatacgctcgcgacaagtggctggcgcccgacggactgatctttcctgatcgggcaaccctatatgtgacggccattgaggacaggcagtataaggattataagatccattggtgggagaacgtgtatgggttcgatatgtcttgtattaaggacgtggcaattaaagagcccttggtcgatgtcgtagatccaaaacagctggtgactaacgcttgcctaataaaagaagtggacatctatacggtaaaggtagaagatctcactttcacctcgcccttttgtttgcaggtgaaaaggaacgactacgttcatgcattagtagcctatttcaatatagaatttaccagatgccacaagcgtacaggatttagcacttcaccagagtcaccctatacccactggaaacagaccgtcttttatatggaggactatctgaccgtgaaaacgggagaggagatcttcggaacaattggtatgcgcccaaatgccaagaacaatagagacctggattttaccatcgacctcgacttcaagggccagctttgcgagctaagctgctccacagactaccgtatgcggtag

SEQ ID NO: 130407 - DNA, 483 bp, Artificial Sequence
  Description of Artificial Sequence: Synthetic coding sequence
atgacctctaaagattattattttgattcctacgcccatttcggtattcatgaggagatgcttaaagatgaggtccgcacgttaacttaccggaattcaatgttccataatcggcacctctttaaggacaaggtggtcctagatgtgggctcggggactggtattctatgtatgttcgcagctaaagctggcgcccgcaaggtcattggaatcgagtgcagttctatttctgattatgcagttaaaatcgtaaaggcaaataagctggatcacgtggtgaccatcatcaagggtaaggtcgaagaggttgagttaccagtggagaaggtcgatatcattatctccgagtggatgggctattgcctgttctacgagagcatgctgaataccgtcctttatgccagggacaagtggctggccccagacggactcatcttccctgacagagcgacgctctatgtgactgcgattgaggatcgctag

SEQ ID NO: 130408 - DNA, 618 bp, Artificial Sequence
  Description of Artificial Sequence: Synthetic coding sequence
atgacgagcaaggattactactttgactcctatgcccatttcggcatccacgaggagatgttaaaagacgaagtccgcactctgacttacagaaattctatgtttcataaccgccatttgttcaaggataaagttgttctggatgtgggcagcggtacaggaatattatgtatgttcgccgccaaagctggtgcaaggaaggttattggaatcgagtgttcaagtataagtgattacgctgtcaaaattgtgaaggccaataaactggatcatgtggtcactattatcaaaggcaaggtggaagaggtagagctcccagttgaaaaggtcgacattatcatctccgagtggatgggttattgtcttttctatgagagcatgctgaatacggtgctttacgcaagagacaagtggcttgcgcccgacggtctgattttccccgatagagcaaccctttatgtcaccgcgatagaggaccgccaatacaaggactataaaatacattggtgggagaatgtctacggcttcgacatgagctgtattaaggatgttgctataaaagaacctctggtcgacgtagttgaccccaagcagctcgtaaccaacgcatgtctctag

SEQ ID NO: 130409 - DNA, 483 bp, Artificial Sequence
  Description of Artificial Sequence: Synthetic coding sequence
atgaccagtaaggattattactttgattcctacgcccatttcggaatacatgaagaaatgctcaaagacgaagtgcggactctgacgtaccgcaacagcatgttccacaatcgtcacttattcaaggacaaggtggtgttggacgttgggtcagggacagggatcctctgcatgtttgctgcgaaagccggagccagaaaggtgataggcattgaatgtagctccatcagtgactacgcagtgaaaatagttaaggccaacaaactggatcacgtcgtcacaattatcaagggcaaagtggaggaagtggaactccctgtggaaaaggttgatataatcatcagcgagtggatgggttattgcttgttctatgaaagtatgctcaacactgtgctgtatgcgagggataaatggctggcaccagacgggcttattttcccagaccgggcaactctctatgtgacagcaatcgaggacagatag

SEQ ID NO: 130410 - DNA, 630 bp, Artificial Sequence
  Description of Artificial Sequence: Synthetic coding sequence
atgacaagcaaagattactacttcgactcatacgcccattttggcatccatgaagagatgctgaaggacgaggtgaggacgttgacctaccgaaactccatgttccataatcgacacttgttcaaggacaaggtggtgctggacgtgggctctggcactggaattctgtgcatgttcgccgcaaaagccggtgcccgaaaggtgataggcatcgaatgctcatctataagcgattacgctgttaagatcgtgaaggcaaacaagctcgaccacgtcgtcacaatcatcaagggcaaagtcgaggaagtagaactgcccgtggaaaaagttgatatcattataagcgaatggatgggatattgtctgttctacgagagtatgctgaacaccgtactgtacgcgcgcgataagtggctcgctccggacggacttatctttccagatagagccacgttatacgtgaccgccattgaggatcgacaatacaaggactataaaatccactggtgggaaaatgtgtacggattcgatatgtcatgcattaaggatgtcgcgatcaaggagccactggtggatgtggtggatcccaagcagttagtaacaaatgcttgcctgatcaaggtgagatag

SEQ ID NO: 130411 - DNA, 687 bp, Artificial Sequence
  Description of Artificial Sequence: Synthetic coding sequence
atggctacatctggggattgtcctagaagcgagagccagggagaagagcctgctgagtgtagcgaagccggtctattgcaggagggggtgcagccagaagagttcgtggcaattgcagactacgccgctaccgatgagacacagcttagctttctgaggggtgagaagatcttgattttgcgtcaaaccactgctgactggtggtggggcgagagggccggatgctgcggctatattccagccaatcacgtaggtaagcacgtagatgagtacgatcctgaggacacttggcaagacgaagagtacttcgggagctacggcacgttaaagctccatttggaaatgcttgccgatcagcccagaactaccaaataccactctgtgatcctgcagaataaagagtctttgactgacaaagtgattcttgatgtcggctgcgggacaggaatcattagccttttctgtgcacattacgcgagacccagagccgtctatgccgttgaagccagcgagatggcgcagcacacagggcagctggtcctgcaaaatggctttgccgacatcattaccgtgtaccagcagaaggtcgaagacgttgtactccctgaaaaagtggatgttttagtttcagagtggatggggacatgcctgctcgtcggggaaaaagtgttccctatctggcggtag

SEQ ID NO: 130412 - DNA, 855 bp, Artificial Sequence
  Description of Artificial Sequence: Synthetic coding sequence
atggccacaagtggagattgcccacggtccgagagccagggcgaagaaccagctgagtgctccgaagcggggctgctccaggaaggagtgcagcccgaggagtttgtagctatagctgactacgcggcgaccgacgagacgcagctaagtttcctccgcggcgagaaaattttgatactccgccaaacaacggccgattggtggtggggcgagcgtgcaggatgttgtgggtatataccagccaaccatgtgggtaagcacgtggatgagtacgaccccgaggatacatggcaggatgaggagtattttggttcctatggaacactgaagttgcatctagaaatgctggccgatcagccgcgcacaactaaataccacagtgtgatcctgcagaacaaggaatccttaacggataaggtgatacttgacgttggatgcggcacagggatcatcagcttgttttgcgcccattacgccaggccacgagccgtctatgctgtggaagctagtgaaatggcccagcacaccggtcagctggtattacagaacgggtttgctgacattatcacggtttaccaacagaaggtggaggacgtagttctgcctgagaaggttgatgtgctggtgtctgaatggatggggacttgtctgctcgccgcacctcttttgtcttgtaggatactcccctgtacctgtgctagcggacccctgcatgtgctcttagcttgctgtcttccacttccttgtacatgcgcttcggttcctctgcacgtactgttagcttgctgcctgccggtactcagagctcctcaaccctccggattgcacctgagctggcctattttcttgctgtag

SEQ ID NO: 130413 - DNA, 1302 bp, Artificial Sequence
  Description of Artificial Sequence: Synthetic coding sequence
atggcgacttccggcgattgcccccgatctgagagccaaggggaagaacccgccgaatgttctgaggcgggacttttgcaagaaggcgttcaacccgaagaattcgtcgccattgccgattatgccgccacagatgaaacacaactatccttcctgaggggggagaagattctgatcctgagacagactaccgctgactggtggtggggtgagagagcaggctgctgcggatatatccccgcaaatcacgtagggaagcatgtagatgagtacgatcctgaggacacatggcaggatgaggaatattttggatcatacggcacgttaaagcttcacctggaaatgctggccgatcaaccaaggaccacaaagtatcattcggtaattctgcagaataaagaatctctcacggataaagtcatcttggatgttggttgcggaactggcataatcagtctcttttgcgctcactacgctcgaccccgtgcggtctacgcagtcgaggcctccgaaatggctcagcacaccggacagctggtcctccaaaacgggtttgcagatatcataactgtttaccagcagaaagtggaggatgttgtgctgcctgaaaaggttgacgttcttgtttctgaatggatgggaacctgcctgctctttgaatttatgatcgagtcaatactgtacgccagggatgcctggctgaaagaggatggcgtcatatggcctacaatggctgctctgcatctggtgccctgttcagctgataaagattacagaagtaaggtgctcttctgggacaatgcttatgagttcaatctctcagcattgaaaagtcttgccgtaaaggagttcttctccaagccaaaatataatcacatacttaagccagaagactgcctttcagagccttgcaccatactgcagttggacatgcgaactgtgcagatcagtgacttggagactttacggggtgaactcagattcgatattaggaaggccggcaccttacatggtttcactgcctggttctcagtgcattttcagagcctgcaggaggggcagcccccgcaggtgctgtcaactggcccgtttcatcccaccacgcactggaagcagaccttgttcatgatggatgatccagtgccagtccatacaggagacgtagtaactggttctgtagtgttacagagaaatcctgtctggcggcgacatatgtctgtggccctgtcctgggctgtgacctcaagacaagacccaactagccagaaggtgggagaaaaggtgtttccaatctggcgatag

SEQ ID NO: 130414 - DNA, 486 bp, Artificial Sequence
  Description of Artificial Sequence: Synthetic coding sequence
atgttggccgatcagcctcgaactacaaaataccatagtgtgatcttacagaacaaagaaagtctgagaatcaagtcctcctggacatgggccgttggcctcggttctagcgttagttcagttcatacgatgcgcggactagaacgtgtatacgctgtggaagccagcgagatggcccagcatacaggtcagctcgtactgcagaacggattcgctgatatcatcaccgtataccagcaaaaagtggaagatgtggtgctgcctgagaaagtggacgtgctggtgagtgaatggatgggaacttgcctgctatttgaatttatgatcgagagtatcttgtacgcccgggacgcctggttgaaggaaactgggtcttttggccctccatggctcaggtgtacgttgtgtcctgcagtcctcattcggatcattgtggccagatgttcttctggcacgaccagaacctcttctacttccgccttgtag

SEQ ID NO: 130415 - DNA, 1302 bp, Artificial Sequence
  Description of Artificial Sequence: Synthetic coding sequence
atggccacttccggggactgcccacgctcggagagccagggagaggaacccgcggagtgttccgaagcgggcctgctccaggagggggtccagcctgaggagttcgtagcgattgcggactacgccgccactgacgagacccagctgtccttcctgcggggcgagaagatattaatactgcgccagacaacagctgactggtggtggggcgaaagggctggctgctgcgggtatatacctgcaaaccacgtgggcaagcacgttgatgagtacgaccctgaagacacctggcaggacgaggaatatttcgggagctacggcactttgaagttgcaccttgaaatgctggccgatcagcctaggaccaccaagtaccacagtgtcattctacaaaataaagaatcgctgacagataaagtgatcctggatgtcggctgcggaaccggtattatttctctgttctgcgctcactatgcccgccccagagcagtttatgctgtcgaggcctctgaaatggcacagcatacaggacaacttgtgctccagaatggctttgcagatatcattaccgtgtatcaacaaaaggtggaagacgtggtgttgccagaaaaagtcgacgtactggtctctgagtggatgggaacatgcctgctgttcgaatttatgatcgagagcattctctatgccagggacgcttggttaaaggaggatggcgttatctggccaacaatggctgctctgcaccttgtgccatgttctgcagataaggattacaggagcaaagttctgttttgggacaatgcttatgagttcaacctgtctgctctaaagagtctggccgtaaaggagttcttctccaagcctaagtacaaccacatcctcaagcccgaggattgtctaagcgagccctgtaccattctacagcttgatatgcgaaccgtgcagatctcagaccttgaaacacttagaggagagctgaggtttgatatccgcaaagctggtaccctgcatggattcaccgcctggttcagtgtgcatttccagtcgctgcaggaaggacaacctccgcaggtgctctccactggaccatttcacccaacgacacattggaaacagacgctcttcatgatggatgatcctgttcccgtgcatacaggagacgtcgtgaccgggtctgtggtactccagaggaaccctgtgtggcgaagacacatgtctgtcgccttgagttgggccgttacatcacgccaggaccctacctctcaaaaggttggcgaaaaggtgttccctatctggaggtag

SEQ ID NO: 130416 - DNA, 1302 bp, Artificial Sequence
  Description of Artificial Sequence: Synthetic coding sequence
atggccacatcaggggattgcccaaggagtgaatcccagggcgaagagccggcggagtgttcggaggccggcctgttgcaggagggagttcagcctgaggagttcgtggctattgcagattatgccgccaccgacgaaacacagctctcatttttgagaggcgaaaaaattttgatactgcgccagaccaccgccgactggtggtggggagagagggctgggtgctgcggctacattccagccaaccatgtgggaaagcacgtagatgaatacgatcccgaggatacctggcaagacgaggagtatttcgggtcgtatgggactttaaagttgcacctcgaaatgctggccgatcagccgagaactaccaaatatcacagtgtcattctccagaacaaggagtctttgacagataaagtcattctcgacgtgggatgtggcactgggatcatctctctgttttgcgcacattacgctcgcccacgcgccgtctatgctgtggaggcatcggaaatggcccagcacactgggcagctggtgctgcaaaatgggtttgcggatattattacggtataccagcaaaaggttgaggatgtagtcttacctgagaaagttgatgttctggtcagtgagtggatgggcacctgcctgctgttcgaattcatgatcgagtcaattttgtatgcccgtgacgcgtggctgaaggaagatggggttatttggcctacgatggcagccttgcacctggtcccgtgctcagccgataaagattaccgctctaaggtcctcttttgggataatgcatatgaatttaatctgagtgcattaaaaagcttggcggtgaaggagttcttttctaagcccaagtataatcacattcttaaaccggaggactgcctgtccgagccgtgtactatcctgcaactcgatatgcgcaccgtgcagatcagcgatttggagaccctcaggggagagctgcgtttcgacattcgcaaggcaggcaccctccacggcttcacagcctggttcagcgtgcacttccagtccctccaggagggacagcctccacaggtgctgtccacggggccgttccacccaactactcattggaaacaaacgctgttcatgatggacgatccagtaccagtgcacaccggggacgtcgtgactgggtccgtagtcctgcagcggaatcctgtgtggcgtcggcacatgagcgtggcactgtcctgggctgtgacctctcggcaagatccgacaagccagaaagtcggggagaaggtgtttcctatttggcgctag

SEQ ID NO: 130417 - DNA, 996 bp, Artificial Sequence
  Description of Artificial Sequence: Synthetic coding sequence
atggccacctccggcgattgtcccagatccgaatcccaaggggaggagcccgcagaatgttctgaagcaggcctgctgcaagaaggcgtgcagccagaagagtttgtcgccatagctgactacgctgctaccgacgagacccagttgtccttccttcggggggagaaaatcttgatcctccggcagacgactgctgactggtggtggggcgagagggctggctgttgcggctatattcctgcaaaccacgtgggtaagcacgtggatgaatacgatcctgaggatacatggcaggatgaggaatattttggctcgtatggcactttgaagctccatcttgaaatgctggccgatcaaccacgtactactaagtaccatagtgtcatcttgcagaacaaggaatcattgactgataaagtcatcttagacgtcggatgtggaaccggcattatttcactcttctgcgctcattacgcacgccctcgggctgtgtatgcagttgaggccagtgagatggcacaacacactggccagctggtgctgcagaacggtttcgccgacatcataacagtgtaccagcagaaggttgaagacgtcgtcctgccagagaaagtggacgtcctggtgtcggaatggatgggcacttgtctccttaccctgaggggcgaattgagattcgacattagaaaggccggcacactgcatggcttcacagcctggttttcagtgcacttccagtccctgcaggaagggcagcccccccaagtgctttccacaggccctttccacccaacaacccactggaaacagacgctctttatgatggacgaccctgttcctgtgcacacgggggacgtggtcaccggctccgtcgtgttgcaacgcaacccggtttggagaagacatatgtcagttgctttaagttgggcagtgactagcagacaagatccaacttcacaaaaagtgggagaaaaagtgttccccatatggagatag

SEQ ID NO: 130418 - DNA, 870 bp, Artificial Sequence
  Description of Artificial Sequence: Synthetic coding sequence
atggcaaccagcggggattgtccacggtcagaatctcagggtgaggagccggcagagtgtagtgaagccggcctgctacaggaaggtgtgcagcccgaggagtttgtggcgatcgctgactatgcagccaccgatgagacccagttatccttcctgcggggtgaaaaaatcctcattctgcggcaaacgacggcggattggtggtggggggaaagagccggatgctgcggctatattccagcaaatcacgtggggaagcatgtcgatgagtacgatccggaagacacctggcaggacgaggagtatttcgggagttacgggactttgaagctacatctggagatgttagcagatcaaccccggaccaccaaataccacagcgtgatcctgcaaaataaggagtcactaacagataaggtgattctcgacgtgggatgcggcacagggatcatcagtctcttttgcgctcattatgcccgtccacgggcggtgtatgcagttgaggcttcggaaatggctcaacataccggacagttagtcctccagaacgggttcgccgacattatcaccgtttatcagcagaaagtggaggacgtggtgctacccgagaaagtagacgtgctcgtatccgaatggatgggaacatgtctactgttcgaatttatgatcgagtcaatcctttatgcgagagatgcctggctcaaagaggacggcgtgatttggcctaccatggccgccctccacttggtgccatgttcagcagacaaggactacaggagcaaggtgttattctgggacaacgcttatgagttcaatctgagcgctttgaagctggagaaaaaatcctcgcccagtggggatgactcgtag

SEQ ID NO: 130419 - DNA, 906 bp, Artificial Sequence
  Description of Artificial Sequence: Synthetic coding sequence
atggctacatccggcgattgtccgaggtcagaaagtcagggtgaggagccggccgagtgctctgaagcaggtttactccaagaaggcgtacagcccgaagaatttgtcgctattgcagactatgccgcaaccgatgaaacccagctgtctttcctgcgcggcgagaagattctcattctgcggcaaacaactgccgactggtggtggggagaacgagcaggatgttgcggttacatccccgccaaccacgtagggaagcacgtcgacgaatacgatcctgaggacacctggcaagatgaggagtacttcgggtcttacgggacactgaagctgcatctggaaatgttagctgatcagccacggacgacaaaatatcactcggtcatactgcagaacaaggaaagcctgacagataaggtgatcctcgatgtgggatgcggcaccggaatcatcagcctgttttgtgcacattatgccaggccgagagctgtttacgcggtcgaagcgagcgagatggcgcagcacaccggacaacttgttctgcagaacggatttgccgatatcattactgtatatcagcaaaaagtggaggatgttgttctccctgagaaagtggacgtactggtgtcagagtggatgggcacttgcctcttgcatcatacactggaagctgacgcagttcatgatggtaggcctagcccttgcccctatcgcaggcgcggccatggattttcctgcgtggcagagaagcctagcgtagagaaagcccatgtgtgtggtagtgagctaggctgtcactttcagacaagacctcacatctcgaagagctggaggaaaagtttaccgcatctggagatgacagtagatgcattatttggcaagcagtgcgcttatctggaggggtag

SEQ ID NO: 130420 - DNA, 951 bp, Artificial Sequence
  Description of Artificial Sequence: Synthetic coding sequence
atgatcgccgaccgggtgcgcaccgatgcatacaggctaggcattctgagaaactgggcagcacttcgtggcaaaactgtgctcgacgtgggggctggaaccggtattctgtcgatcttctgtgcacaagccggagccaggcgcgtttatgccgttgaggccagcgccatatggcagcaggctcgggaggtggtgaggttcaacgggttagaagatagagtgcacgttctccctggtcctgtggaaacggtggaactgccagagcaggttgatgcaatagtgtccgagtggatgggatacggcttgttgcatgaatccatgctttcatcagtgctgcacgcccggactaaatggctgaaagaagggggactgttgctacctgccagcgcagaactatttatagcgcccatttcagaccagatgttggaatggcggctcggcttctggtctcaggtgaaacaacactacggagtggacatgagttgccttgaaggatttgctaccagatgcctgatggggcattcggagattgtagtgcagggcttgtcgggagaagatgtcctcgcccgccctcagcgtttcgcacagctggagctctcaagggccggcctggaacaggaactagaggctggcgttggaggacgctttcgctgcagctgttacgggtcggcccctatgcatggctttgccatttggttccaggtgactttccccggcggcgagtccgagaaacctttagtgctctccacatcgcctttccatcctgccacccactggaagcaggcactgttatatctcaatgagccagtgcaggtggagcaggacaccgatgtgagcggagagattacccttctcccttcacgggataaccctcgtcgcctacgggtgctgctgcggtacaaggtgggagaccaggaggagaaaaccaaggacttcgctatggaggactag

SEQ ID NO: 130421 - DNA, 1128 bp, Artificial Sequence
  Description of Artificial Sequence: Synthetic coding sequence
atgtcacagcccaagaagaggaaattggaaagcggaggcgggggcgaagggggagagggcaccgaggaagaagacggggcagaaagggaggctgctctggagaggcctcgccgaaccaaacgtgagcgcgaccaactctattatgagtgttatagcgatgtctccgttcatgaagaaatgatcgccgacagagtccggactgacgcctatcgcttggggatactgcgtaattgggcagcactgcggggtaagactgtcctagatgtgggcgctggcaccggaatcctaagcattttttgcgcccaggcaggagctcggcgtgtgtacgccgtggaagctagtgccatttggcaacaggcaagagaggtcgtcaggttcaatgggctcgaggatcgagtccacgtgttgcccggccctgtcgagaccgtcgagctcccagagcaagtggatgccatagtgtcggaatggatgggttacggcctgctgcatgaatcgatgctgtccagtgtattacatgccaggacgaagtggctgaaagaaggaggcctgctgctccccgcgtccgcagagctttttattgcccctatctctgaccagatgctggaatggcgcctcggcttttggagccaggtcaagcagcactacggtgtggatatgtcctgcctcgagggcttcgcgaccagatgtctgatggggcatagcgagattgtcgtgcagggccttagcggagaagacgtgttggctcgtccacaacgtttcgctcaacttgagctcagcagagcggggttagaacaggagttggaggctggggtgggaggtcggtttagatgctcgtgttacggctcggcccctatgcatggattcgccatctggttccaggtgacgtttccggggggggagtcagagaaaccattggtacttagcactagcccgttccatcctgctacccattggaagcaggcccttctctacctgaacgaaccagttcaggtggagcaggatactgacgtcagcggcgaaatcactctgctcccttccagagataaccctcgccggttgcgagtccttctgcgctacaaagttggcgatcaggaggagaagaccaaggatttcgcgatggaagattag

SEQ ID NO: 130422 - DNA, 936 bp, Artificial Sequence
  Description of Artificial Sequence: Synthetic coding sequence
atggcccggtccggaaggcgaccctggtcagatccaggcgggctgtctggcgctgtgcaaagggcagggggtccgggcgcacggccggccggcacttcgggggactgtagagtggccggcactgggggatgccacagagaaagggtggatggactacggacgccagctcgggtgcacgctgaactgcgacctcccagggctaatcaggtggcagagggtgggcgctcatctcccgccgggctgaggagggcgctgcattctccacaccagagaccagacgcaggcatggctcccggcctgctggaacctggtgaggccgccttgtggtgcggtcatgagctccccggggggctgagacatgctctcagtcacgggccactgggcgaccgttgtgcaggcatagtgcgcagaggcagagccggccccgctgcagccttatgcagcgccagagctcttcccagacgactcggagccggtgcgggagggcgaagtggccgggcactgcctctgcagctcctttggcttggtgcccatgcttggctgtgccacttggtgcccggcgacctgccttggaggggagtgggtgaaacacccggggccgtgcatcttgcattctctcctgggcacagcttagaaaccggtgccccactcccagagcgcgcgggagcttccggggccagacatggccgctttcgtcgggatcacgccgccgccctgcccggacagccgccttcaccagctagggccgcggctctacagtctggaaggcctgggggagaggaccagaggttgtgtcatggagggttgtcagtagccttctctccatcctacctgccaaagcaacccgatctgcggggacgtggagtcgctcgcagcgaggggaaaggacggtcccacgttcaagtgggtggaatcagcccgccgtttccttcatag

SEQ ID NO: 130423 - DNA, 2532 bp, Artificial Sequence
  Description of Artificial Sequence: Synthetic coding sequence
atggccaagcccttgactgactcagagaaacgaaagcagattagtgtgaggggactggctggcctcggggacgtcgccgaagtgcggaagtcttttaacaggcatctgcattttaccctagttaaggatcgtaacgtagctactcctcgcgattatttcttcgcgctcgcacataccgtacgggatcacctcgttggtaggtggattcggactcagcagcattactatgagagagacccgaagagaatctattatcttagtctcgagttttatatgggacggacactgcagaacacgatggtgaacctgggccttcagaacgcttgcgacgaggccatctatcagcttgggcttgacctggaggagctcgaggaaatcgaagaggatgctggcctcggcaatggagggttggggaggctggcagcatgcttcctagattctatggccactttgggactcgccgcatacggctacggtattaggtacgaatttggcatctttaatcagaaaatagtgaacggctggcaagttgaggaggctgacgactggctcaggtatgggaatccgtgggaaaaagctaggcccgaatacatgctgcccgttcacttctatggccgggttgagcataccccagacggggttaaatggcttgatacccaggtcgtgctggctatgccttacgacacacctgtgcctgggtacaagaacaacactgtcaacaccatgcgcctttggtccgcaaaggctccaaatgactttaagctacaggacttcaatgtgggagattacatcgaggctgtgctcgaccgcaacctcgcggagaatatctcccgggtgctgtatcccaatgacaatttttttgaggggaaagagctacgcctgaagcaggaatatttcgtcgtcgccgcgactctgcaagatattatccgaaggtttaaaagctcaaagtttggctgccgagatccagtgcgaacctgctttgagactttccctgacaaggtagctatccagctaaatgatacccatccagccctatcaatccccgaactcatgcggatcctcgtggatgtagaaaaagttgattgggataaggcttgggagattactaaaaaaacatgcgcctacactaatcatacagtgctacccgaggccctggagcgatggcccgtgtccatgtttgagaaacttctgccacgacatctggaaataatctacgccatcaatcaacgacacttagatcatgtggccgctctgtttccaggagatgtcgaccggctgcgacgtatgagcgtgatagaggagggtgattgtaagcgaatcaatatggctcacctctgcgtgatcggctcccatgctgtcaatggcgttgcacggattcacagcgaaattgtgaagcagagcgttttcaaagacttctacgagctcgaacccgagaagttccagaataaaactaacggcatcacgcctcgacggtggctgctgctgtgtaaccctgggctggctgacacgattgtggaaaagatcggcgaagaatttctgactgacttgtcccagttaaagaaactcctgcccttggtgtcagacgaggtgttcattcgagatgtagccaaggttaagcaagagaataaattaaaattcagcgcttttctggagaaagagtataaggtgaaaatcaacccctcttccatgtttgacgtgcacgtgaagcggatccacgaatacaaaagacaactgttgaattgtttgcacgtggtgaccctttacaaccgcattaaaagagaccccgcaaaagcttttgtgccccgcacagtaatgatcggagggaaggccgcgcctgggtaccacatggctaagctaatcattaagctcgtgaccagtattggggatgtcgttaatcatgatcccgtggtgggcgaccgcctgaaggtcatttttttggagaattacagggtgagcctggccgagaaggttataccagccgctgatcttagtcaacagatatcaacggccgggaccgaggcatctggcaccgggaatatgaagtttatgctgaatggagcactgactatcgggacgatggacggcgcgaatgtcgaaatggcagaagaagctggagccgagaacctgtttatttttggtttgagagtggaagacgtggaggcattggatcggaagggatataatgcacgggaatattatgaccacctgccggagctgaagcaggcagtggaccagataagctcgggctttttctctccaaaggaaccagactgtttcaaagacattgttaacatgttaatgcaccacgaccgatttaaagtgtttgccgactatgaggcctacatgcaatgccaggctcaggtcgatcaactttacagaaaccctaaggaatggaccaaaaaagtaatacggaatattgcttgctcaggtaaatttagtagcgatagaaccattaccgaatacgcacgggagatctggggcgtggaaccttcggacctccagattccaccacctaatatccctagagattag

SEQ ID NO: 130424 - DNA, 717 bp, Artificial Sequence
  Description of Artificial Sequence: Synthetic coding sequence
atgctgaccaccctgctccctattttattattatctgggtgggcattctgctcccaagatgcctccgacggcttacagcgactgcatatgctgcagatttcatattttcgggacccttaccatgtgtggtatcaaggcaatgcatctctggggggacatctgacccatgttctcgagggccccgacaccaataccactataatccagttgcagccactgcaagaacctgagtcctgggccagaacacagtctgggctgcagagctacctgctgcaatttcatggattggtgcgactggtgcaccaggaacgaaccctagcctttccgctaacaataaggtgcttcctgggatgcgagttgcctcccgaaggttcgagggcccatgtgttcttcgaggtagcagtgaacggaagcagctttgtgtcattccgccccgagcgagccctctggcaggcggacactcaggttacctccggagttgttacctttaccctgcagcagctgaatgcatacaaccgcacgcggtatgagctgcgggagttcctcgaagacacttgtgtgcagtatgttcaaaaacatatcagtgccgaaaacaccaaaggttcacagactagcaggtcatatacctctttggtcctcggcgtgttagtcggcagctttattattgctggcgtggcggtgggcattttcctctgcacaggagggcgccggtgttag

SEQ ID NO: 130425 - DNA, 4551 bp, Artificial Sequence
  Description of Artificial Sequence: Synthetic coding sequence
atggacaatcagcaggataaggcgatcgttgcttcagcaaatggagagaacaccctgattaatggtgtgaaagaaaatgacagtgaggatcaggacgtcgccatgaaatcattcgcagcgctggaggctgccgccccgatacagcctacacctgtcgcccaaaaggagactctcatgtacccacgaggactgctgccattaccttctaagaagccctgtatgcagagccccccatccccactgggccttattgaggcaccggagcacgcagccaattccgcctcagtcaatgcgatctcacttacctcagggatcgcgaagggcctgaacacctggtcactgccaaacgaatgtgaaaaggcaccctttgcgataatggaaccggccgggatgtctgctctcaacggagattgcctgatgcagccaagtaggacatgtttgggctgcttcatggagtccaaggatgccgttgatcccgagccaggtatcagtctgaaggttggcgacctgaaccgtgattacgagacatgcgccgtgtcagacattggcattcagtgtatcaatgccggtgaaaatatgaaatacggagagcagctcttgtcagaccagctccttggctttccattacacaagtcaagagcaggagatcgtcgggaaaccgaaaagccagatattgatttggaggatcccgcacagaaaagctattacgaggccctgctcctggataaatgtaacaccgaggaggcgttactggccaactctaaccaagactgggggtattttgagactttcatcagcgaaagcaaaatagaactgcttgatctctgctctaaaaacgaattatcagtgaacctcttctctgaggaagacgtcgataactacatgtttgatgatgatgagtccacgctggggtccgatgtttgctctctcaagatcaggtatgaatccttccaggacaatgtgagggacaagacaaccttgctgatgcaggaagatgcccagttcaatttttttccctccgtgttcactacatgccctaaaagagaatctaagagcggtgccctcaagcagtcgtcagatttttcccagttcaaagtccctgacgtgtcaatcatttggggggaggaggacaagaacctggacaagaagaaaggcaaggaggaggggcaggaggacaagggagtcgaaaaaaaggatggaaaggacaacggtgaaaagcctgccttgaacaaaccatgctcggggaccgaggtggagcagttgaaaaatccgaaacagggccacctggccaactccctcgaaacctcaggttctttttccgatgattcgagcttcatcgaaatcagctatgatgccatgggggaaatcaaggattgttcaaggtacatggctagagatactaactctgggtcatcaagcagccagcaaaactatggactccgagcaaagcgtaaagtgcgctactctgaagactacctgtatgatgtggattccctggagggggagaaggtgaatgaacgcaaagaatggctgccagtcggctctaaggaggaggacgacgacgagtggtgcccaaagaaacgccgaaaggtgactcgaaaggagccccccgttataataaaatacataattattaaccgttttaagggcgagaaaaatatgttagtgaaacttggaaaggtggatgcatcagagaccactgtaaatctctctgaaaatcagctaaacaaatacgcaaagctggctcctttaaagggattctggcaaaaaaaaaagaaacagaggaacacaaacacggatagcatcaaaacacctttctcccagaaacagtcctttgagcccggcagttttgaggtgagctttctgccaccagctaggaaacggaaatcaaaactagggaaccgccatcgcattcagaggatcccgagcatcgagatctccgctagcagcaagcagatctctctgtgcaacgaccaacgccacgcatctaaccacaaggaggatggcggtctgaaaggaactctgaagtccgcaccgctaggcgccccctcatgcgcaaatggtagccacctgaatgacattaccggaccggatagtgtaaaggtcaaggctcaggatactgagttcaaagggcctgagagaaaggtcctcaataaaattaagtttaagtccgaagcaagactgaaatcgaagaaggtgaaggccgcaggccaagagtccaagcctattgtgcagatgtcgcccctgctcgagaatcagtcatctaaggcaaatctgaaaaatgaggtgattcctggaacaagcaattcatcacggctgtccgagttccacgaagcgaaggccgctaagagctcaacctttctgcccacgacctgcagttctgagatgccactgagcagcgccaatgtgaccacaaatattccagttatccccggaggttacctccagacattgttggacgcctcagatctgagcaataacacttcaatttcctatttcagccaccatagtcctgaacagaatgaggggtcacttactcagaccgaaaaatcattcgtgcctctgcaacccacacaggactgtgtccttacctctagctctgactccgagttgcagcaatccagccataacttcaagatggaatccagtaactacaggaacgtgtggcctaacaaagccacgtccgggacccaggaattcatggccgaagtgtcccgagagattgccccaactcagagcagcgaattcggagcctcacaggtcgtctccatggagaacaacctcactcctacaacctacaatccaatttgcctgaactccggaggcagcaattgtaacaaagtgctctacgattccatgcaggatacccagttgccttctgatgactcttatcagctgtgccacttcaacaatggcgaaatatgctttcccttccagcaaggacccgtgaatatggacgatggacggctcttcagctttgactctatggctcctctgtcagtttcttcatctaattactgttccctgtctctgaaatcctgcgaaaaggatggtgacgacgatatcacggacgacttcctggcgcattgcagccccaaactggtaattcaacaatctatcgatgagatcgctccgctgaaagaatcgactgacctattggacatttcaaatttcacacctgacaagtttcgtcattcctctctcagcgagatgtcaccacccgacaccccctccctgtcgccccagatcactaggtgcgagtctatgaaaaccctgggtacgcttaaaggctttcaggaaggagtaccgggtccgctcgatagcgttgagaagattaaatgggattgtagcacactgagccgccaggtccagatggaggacggctttacgttaaacaatcaccagtttcagtttcatatgttcaacgatgaagatagcgtgtctttattacagaagaacccttgcctcagcaccttcaacgacccctcgggtcagatctctaccaacaataaagtcagcaagagcaggaaaaagtcatctccgagtaagtcaggtgctatgaatcagtctagtagccagaagaataccagaaagaagtctctgaagggcaacaacaaaggcatcgaaaagcctccaggaaagaacagccggcaagttcccaaatccacaaagaaaggcaagtacatggctgctatcaacggggagaaaatgcaaattggaataggccgtgggggaagtcagactaacaccatttcatccacagggaagacgctggccgagtgtatccagcacggaggcccaatggcttctatgaagatgccaagccagaaggggctgagtggtgattgggctttgggtaaggagagtagcccgggctggtcagatatgtcgatggggactaatacaaatagtctgcttgatgacgaccagagggagttccaggagccctcatacatactaagtaacatcgcgtccgggatggcagatgtgcagaggtttatgatggcaagcatagaaccactgtgggagcctatggaacaccatggtgatcctaatattttctactcacctgaaagcaacagcctcaagttgaaaaccttgaagatccttgccggcaccccacaggagagtaagaagaaaatcaacagcggtagccagggtgcaaccaaaaaccacaggtctatcaagggcgtaagcaagagcaatggtaaaactgccattggggaccctgggagggcaaacatgcccggctacaatgaagattctcgctccactttcttcgacaagaagtacagcaatatgtccacacttggcaacaatggacctactcacaaaaaactttaccggcataagagttcttcaaaagcgctgcgggacgaaaaatgcaaaggcaagcatatggaacgggagcaagttcacaaggatgagagcgggactgcgtcatttgagaagctgcgggacagcgattataatctgctcaaggctgagactacattttgggtcctcccagttttcgaggaagagacgcgtattttccagaaggatatatag

SEQ ID NO: 130426 - DNA, 1008 bp, Artificial Sequence
  Description of Artificial Sequence: Synthetic coding sequence
atgtgggcaactctgccccttctgtgtgccggagcttggctgttaggcgtccctgtgtgtggagcagcggagctatgtgtaaactccctggaaaagttccattttaagagttggatgagcaagcaccgcaaaacatactccactgaggaataccatcaccgcttgcagactttcgcatccaattggcggaaaattaacgcccacaacaacggtaatcatacattcaagatggcgcttaaccagttttccgatatgtcctttgctgagatcaagcataagtatctttggtctgaacctcagaactgctccgctactaaatcgaactatctacgcggaaccggcccctatccgccctcagtcgactggaggaagaaggggaattttgtgtctccagtgaaaaatcaaggggcttgtgggagctgctggacattctcaacgaccggcgctctcgagagcgcgatcgctattgctactggtaagatgttgtctttggccgagcagcagctcgtagactgtgcgcaggacttcaataaccacggctgtcaaggcgggcttccgtcccaggcctttgagtatattttgtacaataaaggtatcatgggtgaggacacttatccctaccaaggtaaggacggttattgcaagttccagcctggtaaggcgattggttttgtcaaggacgtagcaaacatcaccatctacgacgaagaggctatggtggaggctgtcgcactgtataaccctgtatccttcgccttcgaggttacccaagatttcatgatgtacagaaccggcatttactcttctacaagttgtcataagacaccagataaagttaaccacgcggttcttgctgtcggatacggcgagaaaaacgggatcccctattggattgtaaagaacagctgggggcctcagtggggcatgaatgggtattttttgatcgaacggggtaagaacatgtgcggtctcgccgcatgcgcttcctatccaattcctcttgtctag

SEQ ID NO: 130427 - DNA, 5655 bp, Artificial Sequence
  Description of Artificial Sequence: Synthetic coding sequence
atgcactgtactaatccagctttgatctttctgatagatgagttaagtccagagcagcataacctatctctgtattctatggagctggtgctgaagaagagcaccggacattcagctgcacaagtcgctctcaccgagacggcccccggtagtcagcattccagcccactccatgtgactgcccccccatctgcaaccacatttgacactgccttcttcaaccaggggaaacaaactaaatccacggccgaccctagcattttcgtcgccacttacgtctcagttacgtcaaaggaagtcgccgtgaacgacgacgagatggacaactttctgccggatacgcactggacaacaccgaggatggtgtcaccaatccaatatatcactgtcagcccacccggcctgcctcgagaagcgctcgagccaatgctaaccccttctctgcccatggttagtttgcaagatgaggaagtcaccagtgggtggcagaacaccacacggcagccagccgcttatgccgagagcgcgtctcattttcacacatttcggagcgcatttcggactagcgaggggatcgtgcccacgccagggcggaacttagtgttgtacccgaccgacgcctatagtcacctatccagtaggacattgccagaaattgtggccagcctaacggagggcgtggagactaccctgttcctgagctctaggagcctcatgccacaacctttgggagatggaatcacgatccccctaccatcattaggagaagtgagccagccaccagaagaagtctgggccacatcggcagacaggtacaccgacgtcacgaccgtactatctcagagtctggaggagaccatatccccgaggacctaccctacagtgactgccagtcacgccgcgttggcttttagcaggacgcactcacccttattatcgacccccctggcatttgcaagctcagcatcgcctactgacgtgtcttcgaatcctttcctgcccagcgatagctccaagacttcagagctgcatagcaattccgcacttcccgggccagttgacaacacccacattttgtcccctgtcagcagtttcagaccatacacatggtgcgctgcctgcacagtacctagccctcaacaagtgttggccacttcgttaatggaaaaggacgtcggctcaggggacggagccgaaacactttgtatgaccgtgctggaggagtcttctattagcctgatgagcagtgttgtggccgatttcagtgagtttgaggaagacccacaagtattcaatacactttttccatctaggcctatcgtgcctctaagcagcagatctatggagatctctgagaccagcgtgggcatatccgcagaggttgacatgtcctcagtgacgaccactcaagtgccaccggcccacggaaggctctctgtgcccgcaagcctggatcctaccgcaggctcattgtcagtcgcagagactcaggtgactccctccagtgttaccaccgccttcttcagcgtcataacttctatcctattggacagctcgttttcagtgattgccaataagaacaccccaagcctggctgttcgggacccctcagtttttacaccttattccttagtcccctcagtagaatcttcactcttctctgatcaggaacgcagtagcttcagcgaacataagccacggggtgccctcgatttcgcttcatccttctttagtacgcctcccctggagctttctggatcaatctccagtccatctgaggcccctgctagcctctcattgatgccctctgacctaagccccttcacaagtcagtcattttcccccctggttgaaacgtttacactcttcgactcatctgatctgcagtcttcccaactctccttaccaagcagtactaatctagaattctcccagctgcagcccagcagcgaattacccttgaacactatcatgttattacccagtaggtccgaggtgagcccatggtcctcattcccatctgactctcttgagttcgtggaggccagcacagtttctctgaccgacagtgaggcccacttcacgtccgcctttatcgagacaacatcctacctggagtcttccttgatctctcacgagtccgctgttacagctctcgtgccgccagggtcggaatcttttgacattcttacagctggaatccaagcgacgagccctctcaccacggtgcatacaacccccatattaaccgagtcctctttattttccacgctgacccctcctgacgatcagatctcagcattagacggacatgtatctgtgctagctagcttcagcaaagcgatccccactgggactgtgctgatcaccgatgcctacctgccatctggtagctcttttgtgtctgaggccacccctttccccttacctaccgagctgacggttgtagggccttctctcacacccaccgaagttcccctgaacacaagtactgaggtaagcacaacatccaccggcgctgctaccgggggccccctcgactcaactctgatgggagacgccgcgtcccagagccctccagaatcctccgctgctccccccctgccttccctgcggcccgtgaccgcatttaccctggaggcaactgtcgatactcccaccctggcgacagcgaagcccccttacgtgtgtgacattaccgtccctgacgcctacctgattacaacagtgctggctcgacgggctgttcaagaatacattatcacagctatcaaggaagtccttaggatccatttcaaccgggcagttgaattgaaagtctatgagctgtttactgactttaccttccttgtcacaagcggcccttttgtgtatactgcgatctccgtaatcaatgttcttataaattctaagctggtacgtgatcagacaccgctgattctgagtgtcaaacccagcttcctggtgccagaaagccggttccaggtgcagaccgtcctgcagttcgttccccccagtgttgacacgggtttttgtaacttcacgcagaggattgaaaaggggctgatgaccgcgctctttgaagtgagaaagcatcaccagggaacatataacctaaccgtgcagattctgaatatcaccatcagctcttcccgcgtaacacccagacgtggccccgttaatatcattttcgccgtcaagtctacgcaggggttcctcaatgggtccgaagtctctgagctcctgaggaacctatcggtggtggaatttagtttctatctcggctaccccgtattacagatcgcagagcccttccagtatcctcagctgaacctctcgcagctcctcaaatcgagctgggttcgcacagttctgctgggggtgatggaaaagcaacttcaaaacgaggtgtttcaggctgagatggagcggaagttggcccagctgctgagcgaagtgtcgacgcgacgccgcatgtggagacgtgctacagtggcagctggaaactccgttgtacaggtcgtaaacgttagcagacttgagggggacgataaccctgtccagctgatttatttcgttgaagaccaggatggtgagcggctgtctgctgtgaaatctagtgatctgatcaataaaatggatttgcaacgcgccgccataatccttggctataggatccaaggtgtcattgcgcaacccgtcgaccgagtaaagagaccatcaccagagagccaatcaaataatctgtgggtgattgtgggcgtggtgattcctgtgcttgtcgtcatggtgatcgtggtgattctttactggaaactctgtcgaacagataaactggactttcaacccgacacagttgcaaatatccagcagagacagaagctccagatcccctccgtgaaagggtttgacttcgccaagcaacacctgggacaacataacaaagatgacatcctcataatccatgagccagcaccactgccagggccactgaaagaccataccactccatctgaaaacggggatgtgccatccccgaaatctaagattccttctaaaaacgtgaggcaccggggacgagtgagcccttcagacgcagactcaaccgtgagcgaggaaagctccgagcgcgatgctggagataaaacgccgggcgcggtcaacgatggaagaagtcacagagccccccagtcaggacctcccttgcctagctcaggcaatgagcagcattctagcgcatccatttttgagcacgtcgatagaataagcagacctccggaagcctccaggagagtgccgtccaaaatacaattgatcgccatgcagccaattccggcgcctcctgtccagcggccgtccccagctgatagagtggccgagtctaacaaaattaacaaggaaattcaaacagctcttcgtcacaaatctgagattgaacaccaccggaacaagatcagactcagagcgaaacgcagaggccattatgagtttcccgtggtagacgacctgagtagcggagacacgaaagagcgacatcgcgtttatcgcagagcccagatgcagattgacaagatcctagatcccacggcctctgtcccatctgtctttatcgaacccagaaaaagctcacgcatcaagcggagcccaaaaccacgcaggaagcaccaagtgaacggatgtcccgcggacgccgagaaagaccgactaatcaccactgacagcgacgggacttatcgcagacctccaggtgtacacaacagtgcatatattgggtgtccgagtgatccggacttgccagccgacgtacaaacaccgtcctctgtcgaacttgggaggtatccagcactgccgttccctgcatcccagtatatacctccacagcccagcattgaggaagctcgccagacaatgcattccctgctcgatgatgcctttgcgcttgtagccccatccagccagcccgcatcaacagccggcgtcgggcccggcgtgccacctggcctgccagctaattctaccccttcacaggaggagcgacgggctactcaatgggggagtttctattcgcccgcccaaactgctaataatccatgctccaggtacgaggattatggaatgacccctcccacgggccctctcccgagacctggcttcggcccaggcctactgcagtccaccgaactcgtaccgcccgatccacagcagccacaggcttctgccgaggcccccttcgcagcacgcggtatttatagcgaggaaatgccctccgttgcgagacctaggcctgtcggaggaacaacaggctctcaaatccagcatctgactcaagtcggaattgccagcaggattggggcccagccagtcgaaataccgcccagccgcggctctcagtatggcgggcctggctggccctcctatggagaggacgaggctgggcgaagggaggctgtaccccggactagtgggcgcgagccgtctgccccttcaggaaacctgccccatcgcggcctgcagggacccggcttggggtatcctacaagtagcactgaagacctgcagccagggcattcttcagcgagcttgattaaggctatcagggaagagcttctgcgcctgtcccagaagcagtccaccgtgcagaatttccattcatag

SEQ ID NO: 130428 - DNA, 1236 bp, Artificial Sequence
  Description of Artificial Sequence: Synthetic coding sequence
atggagaccccagaggtgcccgtaggatctcttatagattttggccctgaagctcccacatcgagccctctggaggctcctccacctgtgctccaagacggagacggctcccttggtgacggcgccagtgaatcagaaaccacagagtcggcagacagcgaaaatgacatgggtgaaagccctagccacccttcgtgggaccaggacagaaggagctccagcaacgaatccttctcaagcaatcagtcaacagaaagcactcaggatgaggaaactctggctcttagggattttatgagagggtatgtggaaaaaattttctctggaggggaagacctcgaccaggaggagaaggccaaatttggcgagtattgttctagtgaaaacggaaagggcagagagtggtttgctcgttacgttagcgcgcaaagatgcaattcaaagtgcgtgtctgaggccacgttttacagattggtgcagtcctttgcggtcgtccttttcgagtgccaccagatggatgatttcggtccggccaaaaacttgatgaccatgtgctttacctactatcacatcggcaagccgcagttgcttcccccagagtctagggagaagccggccggaagtatagattcatacctgaagtccgcgaatagctggctggccgagaagaaggacatagctgagcgtctgctgaagaatacttctgccaggacagaaaacgtgaaaggtttttttggtggattggaaaccaagttgaagggaccccttgctcgaagaaacgaggaggatgagaataaacctcaggagaagcgccctcgggccgtgaccgcctactccccggaggacgagaaaaagggagaaaaaatctatctgtacactcaccttaagcagcagccaatctggcacacactgaggttctggaacgcagccttcttcgacgcagtacattgtgagcggactaaaaggtctccaaccacccgcggtgatgcaggcgaagaggaggaaaaaagggagaaatggtgccatatgacccaggaagagcgggacgattccctgaggttcaatgagaatatcacctttggccagttgggcacctttacccacaatatgctagccttcggtttgaataagaagctgtgtaacgattttctcaaaaagcaggccgtcattggaaatctggatgaggagcagtataaattgctctccgatcatatcgaacagatggccacagagtag

SEQ ID NO: 130429 - DNA, 15018 bp, Artificial Sequence
  Description of Artificial Sequence: Synthetic coding sequence
atggaccagaggaagaatgagtcaattgtgccttccattacccagctggaggactttctaaccgagcacaattctaatgtcgtgtggctcttagtagctacgatactctcttgcggctggattatttacctgacatactacaacagcaggaacgttggacttatcctcactttagtgctgaacagactctataagcacggctacatccatataggatctttcagtttctccgtcctgtctgggaaagtaatggttagagagatttactatatcacggaagatatgtcaatccgcatacaggatggattcattatctttcggtggtggaagatgtacaaccccaaacagaaacagcatgatccgaaggctgaaacgagactgtacataaccgttaacgatttcgagttccacgtgtacaatcgttctgatttatatggacgccttcaagaactgttcgggctggaaccaacaataattccccctaaaaaagacgacgacaaaacccgggagataggcagaacaaggacgcagagtaagatagaacgcgtgaaggtgaagaccgaatctcaggacccaaccagcagctggcgcagccttatacccgtgattaaggtgaacgtgtctaccgggagactcgccttcggtaaccactatcagcctcagacgctttgtatcaacttcgatgacgccttcctcacctataccaccaagcctccatcgagtcatttagaccagtttatgcatattgtcaaaggcaaactggagaacgtcagagttatgctggtgccatctccaagatatgtggggctgcagaacgacgagcctcctcgccttatgggggaagggtttgtcgtcatgcagtccaatgacgtcgacatctactactatatggacgagcctggcctggtgccagaggagactgaagagaatattgagggcgaaatgtcttctgaagattgcaagctgcaagatctgccaccctgctggggactggatattgtatgtgggaaaggaacggattttaattatggtccttgggcagaccgacagcgcgactgtctgtggaaatttttcttccctcccgactaccaggttcttaaagtttcagaaatagcccagcctgggcgacccaggcagatcctggccttcgaactgaggatgaatattatcgccgacgccacgattgatctactgtttactaaaaacagagaaacgaatgccgtgcatgttaacgtcggggcaggtagctacctcgaaatcaacatccctatgaccgtggaggaaaacggatatacccccgccatcaagggacagctactccacgtggacgctactactagtatgcagtatcgcaccctgctggaggctgagatgcttgcatttcacatcaatgcctcctatcctcggatctggaacatgccacagacctggcaatgtgagctggaggtgtataaagccacctatcatttcatatttgcccagaagaacttctttaccgacctcatacaggactggtccagcgattccccccccgacatcttttcatttgtgccttatacatggaatttcaaaataatgtttcatcagttcgaaatgatttgggctgccaaccaacataattggattgattgcagtacgaagcaacaggaaaatgtgtatcttgccgcatgcggagaaactctgaacatcgatttcagtctccctttcaccgattttgtgcctgccacttgtaatactaaattttctctgcggggagaggacgtggatttacacctgtttctgccggactgtcatccgagtaaatattccctgtttatgttggtgaaaaattgtcatccgaataaaatgatccatgacactgggatccctgccgagtgccagtctggtcaaaaaaccgtgaagcccaagtggagaaatgtgactcaggagaagtcaggatgggttgaatgctggactgtacctagcgtgatgctgactatcgactacacgtggcacccaatctacccccagaaggccgatgagcagttgaagcagagtctctccgagatggaggagacgatgctgtccgtccttcgcccttctcagaagacctccgacagagtggtgtcttcaccaagcacttcctctagacctcccatcgacccatccgaactcccaccagacaagctgcacgtggagatggaactgagccctgattcacagatcacgttgtatgggcccctgttgaacgccttcttatgcattaaagaaaattattttggcgaagatgatatgtacatggacttcgaagaagtcattagctctcctgtgttgtcattgtcaacttcctcttcctccggctggaccgccgtggggatggaaaatgacaagaaggagaatgaaggcagcgccaagtctatccaccctctggcgttacgtccttgggacattacagtgcttgtgaacctatataaggttcatgggcggttacctgtgcatggaactactgacggacccgaatgccctacagcgttcctagagcggctgtgtttcgagatgaagaagggcttccgggaaactatgctacaactgattttgtcccccctgaacgtctttgtgagtgataactatcagcagcggcctccagtggatgaagtgctgcgcgaaggccacattaacctcagtggactgcagttgcgcgctcatgctatgttcagcgccgagggcctgcccctgggatctgactctcttgagtatgcttggttaatcgacgtgcaggctggaagcctaaccgcaaaggtaactgctccacagctcgcctgcctgttggagtggggtcagacatttgttttccacgtagtgtgcagggaatatgagctggagcgtccgaaatccgtcattatctgtcagcatggcattgataggcgattctgcgaatctaaactgtcttgtattcctggaccatgtcctacttccgacgacctgaaatatactatgatcagactcgccgttgacggcgctgacatctacatcgtggagcatggttgcgccacaaatattaaaatgggtgccatccgggtagcaaactgcaacctgcataaccagtctgtgggagaaggaatctcagctgccattcaggactttcaggtacgtcagtatatcgagcaactcaataattgtaggatagggcttcaaccagctgtgcttcggcgggcctattggctcgaggctggatccgcgaaccttggattaattactgtcgacatcgcgctggcagcagatcaccactcgaaacacgaggcccagcggcactttctggaaacacacgacgcacgcacaaagcggctctggttcttatggcccgatgacattctgaagaacaagcggtgtagaaataagtgtgggtgcctggggggttgcaggttttttggcggtacagttacaggcctggatttcttcaaattggaagagctgactccttcatcgagctcagccttttccagcacttccgccgagagtgacatgtattatgggcaatctcttctccagcccggtgaatggataatcaccaaggagatccctaaaataattgatggcaacgtcaacgggatgaagaggaaggagtgggaaaacaaatccgtgggcatagaagtggagcgcaagacccaacatctctcgctacaggtccccctgaggtcccacagctcgagctcctcatccgaggagaacagtagttcctcagcagctcagccactgttggccggagagaaggagagtcccagttcggttgcagatgatcacttggtgcagaaggaatttctgcacggcacaaaaagagatgatggacaggcctcaatccccaccgagatttcagggaactcccctgtgtccccgaatacgcaggacaagagtgtgggacagtctccactgagatcaccactcaagcgccaggccagtgtctgcagtacacggctcggttccactaagtccctcaccgcagctttttacggggacaaacaacctgttactgtgggcgtgcaattcagcagcgacgtgtcccgctctgacgagaatgtccttgacagccctaagcaaaggagaagttttggatcgttcccatacacccctagcgccgactcaaattccttccatcagtataggagcatggacagcagcatgtctatggcagattccgaagcttacttctccgccgctgaagagtttgagcccatatctagtgacgaggggccggggacttaccctggaaggaaaaaaaagaaaaagcagactcagcagatcgattactcccgtggctcaatctatcacagcgtcgaagggcctctcactggtcatggtgagtctatccaggattccagaacactacccttcaaaacccaccctagtcaagcatcattcgtgagcgcgttggggggagaggacgatgttatcgagcacctatatatcgtggagggtgaaaaaactgtcgagtctgagcagatcaccccccaacagcccgtgatgaactgctaccagacttatcttacccagtttcaggttataaactggtccgtcaagcacccgaccaataaacggacaagtaaaagctcacttcaccggcctctggacctggatacaccgacttctgaagaaagctcttcgagttttgagcagctttcggttcccacgttcaaagttatcaagcagggattgactgctaattccttgctggatcgtggcatgcagcttagcgggagcacctctaatacaccatacacacccctcgagaaaaagcttgctgacaatacagatgatgagacccttactgaggagtggaccttggatcagcccgtgtcccagacgcgtaccacggcaattgtggaggtgaagggcacagtggacattgtgctgaccccgcttgtggcagaggctctcgatcgctatatcgaggccatggtgcactgtgcttcaacccgccacccggccgcgatcgtggatgatctgcatgccaaagtgcttcgtgaagccgttcagaacagcaaaaccaccttttccgaaaatttatcatctaagcaggacataagaggtacaaaaaccgagcagtctaccatcggtacgacaaatcagggtcaggctcaaactaatttaaccatgaagcaggacaacgtaaccatcaagggactgcagaccaacgtctccatccccaaggtgaacttgtgcctgcttcaggcctccgtggaagaatctccgactacggcccctagccgatccgtgacgcacgtcagcctcgtggctctatgttttgataggatcgccacacaggtcagaatgaataggggagtagtggaagagaccagcaacaacgcggagccaggtaggacctccaactttgacaggtacgtgcatgctaccaagatgcagccacagtcctctggatctctaagaagcaatgccggggctgaaaaaggcaaagaaatcgctgctaaattgaacatccatcgtgtgcacggccagctgagggggcttgacactacagacataggcacgtgcgcgatcaccgccataccatttgagaaatctaaagtcctgtttacccttgaagagttggacgagttcactttcgttgatgagacggatcagcaggctgtgccagacgttacgcggattggtccgagtcaggagaaatggggctggattatgtttgaatgtggacttgagaacttgaccatcaagggaggccgacagtctggcgcagtcctctacaactcttttggaattatgggaaaggcctctgataccgagcgcggtggggtcctgacaagtaacaacagttccgacagtcccaccggcagcggttacaacaccgatgtatccgatgataacctgccatgtgaccgcaccagcccttcatccgacctgaacggtaactccgtgtcagatgagcaggacgaaggcgttgaaagcgacgacctgaaaaaggatttaccactcatgcctccccctcctgactcatgtagcatgaaactcaccatcaaggaaatttggttttccttcgcagcaccgacaaacgttagatcccatacccacgctttttcccgccagttgaacctcctgtctactgcaaccccagcagtcggcgcgtggctagtgcccattgaccagcttaagagcagcctcaacaagctcgagactgaaggcactctgcgtatttgtgccgtgatgggctgtataatgacagaagcgcttgagaacaagtctgtccatttcccgctcagatccaagtataaccggcttactaaagtggctcgattcttgcaggaaaacccttcatgtttgctgtgtaatatactccaccactacctccaccaggccaactatagtatcatcgacgatgctaccatgtccgatggattaccagccctggttactctaaaaaagggccttgtggccctggcaagacagtggatgaaattcattgtggtgacacctgccttcaagggcgtgtccctgcaccgtcccgctcagccactcaaacctcagatcgccatggatcatgagcatgaagatggattagggctcgataatggcggaggtctacagtccgacaccagtgctgacggggccgagttcgagtttgatgctgccacggtaagcgaacatacgatgctactggaagggaccgccaatagacctccaccgggatcgagcggcccggtgaccggcgccgagatcatgcggaaactgtcaaagacgcacacccactctgacagcgccctgaagatcaagggcatccacccctaccactccctttcctataccagcggcgatacagccacagactctccagtacatgtggggagggcaggtatgcccgtgaaagactctccacgcaaagaatctctcctgtcctacctcacggggtctttcccctctctccacaatttactggagggaaccccccagcggtcatccgctgccgtcaaatccagctcacttactcggaccggcaatacagtcgcaaccgacatgctttctgagcacccactgctctcggaacctagcagcgtcagcttctacaattggatgagcaacgctgtgggcaacagaggttccgtgctgcaagaatccccagtgacaaaatcgggccacaacagcttgcctaccggcgtggctcccaatctgcccactataccttccgcttcagactttaacacagtgctaagcagcgatcaaaatacactagatggaactcacagtcagcactctacatcgcaggatgatgtggctggagtcgaggaagccaatcaagggttcccggcagtgcaactggccgatgcacaggttgtgtttaaacccttgctgtcccatacgggtattcagtcgcaggatacaatgcctttctgctatcggatgtatttcggcgagcacctgagctttagcgggacacttgactgcctccgcgccgacatagttgatagcgatacagccaaggagcggaagggtaagcgtgcacgacggcaaggacacgtcaacctgccaccgcttgagtttaagcccgcactaatgttagggaccttcagcattagcgcggtagttatggagaagtccgtgtgcactccgcaaaacagcacatccgccttgagtttccacgatctgagcaaacgttactacaacacgttccattgtaatttcaccatatcttgtcagagcatctcccagcacgtcgatatggcccttgttcggctgatccatcagttctccaccatgattgacgatatcaaagcgacccagacggacattaaactgagtcgatatactgccggaagtgccagtcctacccctacctttaaaacccgaaagcatagagatttccggagcagtgatttctcgcgaagctctcgtggctcattgaatgggggaaaccgcgtgaataacgcaaagaacaagcgcacaaacaatgagaacaataaaaaagaatcaaggaataagaattctcttggtcgtagtgagagacggacaagcaaggtgtcgagaaagggcagtaaagacgtagtagatcatatgaccatccacatggacgacagtgacagcatcacggtctccgagcagagcgagccatccgccgagtgctggcagaacatgtataagcttctgaatttctactccttaatttcagacccgaccggaattctcgaaaagtcgtccgaaacctttggcccagcaggcgtcaggtccccaaccgaacctacctgcaaggtggtgttcgagaatgagcaggataactcttcattgacaaagacccagaggaagcgaagcctcgtgacttctgagccacagcacgtaacactaatagtgtttggtatcggcatggtgaatcgtacacacctggaggccgatattgggggcctaaccatggagagtgagctcaaaagaattcatggttctttcaccctgaaagaaaaaatgaaggatgtgctacaccagaaaatgaccgaaacctgcgccactgcccatattggtggcgtcaatatcgtgctattagagggcatcactcccaatatccagcttgaggatttccctacaagcccgaccagtacggctaagcaagaattcttgacagtggtgaagtgttctatcgcaaagtcacaggccttatacagcgcccagaggggcctgaaaacaaacaatgcggccgtgtttaaagttggcgcaatctctatcaacattccacagcaccctgctaccttgcattctatgatggtgcgctcttcacatcagctgtcaaaacaaatcagcgatctcatcagacaaccatctaccgcgcctcagcctgtgaaggaggatatcgccacaccattgccatccgaaaagacgcccacaagcgtgaaccaaacgcccgtcgaaaccaacgaattcccacagttgcccgaaggtctggaaaaaaagccaatagtgttgaagttttcagccatgctagacggcattgccattggcgccgcattgctgcccagtctcaaggcagagtacaaaatgggccggatgcgatcccacgggatgacaggcgcccagactcgatttacctttgaactgccaaaccacaggctaagattcacttctaaagtgtcagcaactgatatgtcaaccattcctccctcagcatcactcaacctgcctccggtgacaatgtctggcaaatatataatggaggagcacgatagctattctgatcaggtgtggtccatcgacgaactgccatctaaacaagggtactatttgcagggtaattacttgagatgcgtggccgaggtgggatcttttgagcacaatttaacaacagaccttctgaaccacttagttttcgtccagaaggtctttatgaaagaggtcaatgaagtaatccaaaaagttagtggcggagaacagcctatcccactctggaacgagcatgacggaactgccgatggagacaaacccaaaattcttctgtattctttaaacctgcagtttaaaggcatccaagtgactgcaaccacaccctccatgcgcgccgtgagattcgaaactggcctgattgaactcgagctgtcgaataggctacaaacaaaggccagcccaggtagtagctcttatctgaaactcttcgggaaatgtcaggtagatcttaatctggccctgggccagatcgtgaagcatcaggtttacgaagaggctggcagcgattttcatcaggtggcttactttaagactagaatagggctgcggaatgccctgcgtgaggagatctccggatcttctgacagagaggctgttttaatcacgcttaatcggcccattgtgtacgcccagcctgtggccttcgatcgggcggtacttttctggctgaattacaaagcagcatatgataactggaacgagcagaggatggccctgcataaggacatccatatggcaaccaaggaggtggtcgatatgctcccagggattcagcagaccagcgctcaggcattcggcaccctattcctgcagctcacagtcaatgatctggggatttgtcttcctatcaccaacaccgcacagtcaaaccacaccggggacctggatactgggtcagccttagtactgacaattgagagcaccctgatcaccgcttgctccagcgaaagcttggtgtcaaagggacattttaaaaacttctgcatcagatttgccgacggcttcgaaacaagctgggacgattggaaaccagagatccacggcgacctggtgatgaacgcctgtgtggtccccgatggaacgtacgaggtttgcagccggactactggtcaagcagccgctgaatcgtccagcgcaggcacatggaccctgaatgtgttgtggaaaatgtgtggcattgacgtgcacatggaccctaatattggcaaaagattaaatgctcttggcaataccttgacaacccttacaggagaggaagacatagacgacatagccgatctcaattcggtaaatattgcagacctgtcagacgaagacgaggtagatactatgtccccaaccatccataccgaggcaacagactacaggcgtcaagctgccagcgcgagtcagccaggcgagttgcgtggaagaaagatcatgaaacgaattgtggacatcagagagctgaacgaacaggcgaaggtcattgatgatttgaaaaagctgggggcttccgagggcacaattaaccaggaaatccagcggtaccagcaactggagagtgttgccgtaaatgatatcagaagggacgtgcgaaagaaacttcgcaggtcaagcatgcgagcggcatcactgaaggataagtgggggctcagttacaaaccaagctatagcaggtccaaatcgatcagcgcctcaggccggccgccacttaagagaatggaacgcgcgtcctcaagagtgggagaaacagaggaacttccggaaattcgcgtagacgccgccagtccaggcccaagagtgactttcaacatccaggacactttcccggaagagaccgagctggatctgctgtccgtaactatagaggggccttcacactattcctctaattcggagggctcatgttcagtgttctcaagtcctaagacccccggcggcttttccccggggattcccttccaaactgaggagggccgccgggatgactccttgtcctccacaagtgaagattcagaaaaggacgaaaaggacgaggaccatgagagggagcggttctatatttataggaagcccagccataccagtaggaagaaagctactggattcgcagcggttcaccagctgtttaccgagcggtggcccacaacccctgtgaacaggtctttgagtggcaccgccaccgagcggaacattgacttcgagcttgacattagagtggagatcgacagcggtaagtgcgtactgcaccctactaccctgctgcaggagcacgatgacataagcctgaggcgcagctatgataggagttcaagaagccttgatcaggactctccttcgaaaaagaaaaagttccagactaactacgcctcgactactcaccttatgacagggaaaaaagttccaagtagcttgcagacaaagccttccgatctcgagaccaccgtcttctacatacctggcgtggatgttaaactgcactataattctaagacactgaagacagaatctccaaatgcttctcgcggctcttccttgcccagaacactctctaaagagtctaagttgtacggcatgaaagattcagctaccagcccacccagcccccccctgccatccactgtccagtccaagacaaatacgctcctaccgccccagcctcccccaatcccggctgccaaaggtaaaggcagcggtggcgtgaagacagccaaactgtacgcctgggtcgctctgcagtccttgcccgaagaaatggtcatcagcccgtgcctcttggatttcctggagaaggcactggagacgatccctatcactcccgtggagcgaaactatacagcagtaagtagccaagacgaggacatgggccactttgagataccagatcctatggaggagtctactacttcacttgtgtcaagtagtacatccgcttatagtagtttcccggttgacgtcgtggtctacgtcagggtccaaccgagccagatcaagtttagctgtctcccagtttcacgggtcgagtgcatgctgaagctgccgagtttggacctggtgttttcttctaaccgcggcgaactggagacactcggcaccacataccccgccgagacactgagccctgggggaaacgctacccagagcggcacaaaaacatcagcttccaagacagggatacctggaagttccggattgggctcacctttgggaaggtcccgacattcgtcgtcacagtcagatttgaccagctccagctctagctcaagtggactgtcatttaccgcatgtatgtcagacttttccctgtatgttttccatccctatggggccggaaagcaaaagaccgcagtgagtgggctgactcctgggagcggcgggttgggcaacgtggacgaggaacctacaagcgtgaccgggcggaaagatagcctgtccatcaacttggaatttgtgaaagtcagtctgagccgcattagaaggagcggtggcgcttctttttttgaatcccaatctgtctcaaagtctgccagcaaaatggacacaactctgataaatatttccgcagtgtgtgatattgggtccgcaagcttcaaatacgacatgagaaggctctcggaaatcttggccttccccagggcttggtataggcggtccatagcacgtcgcttgtttctgggagatcagaccattaacttgccaacctctggacctgggacgcccgattccatcgagggagtgagccaacatctgagcccagagtcttcccgcaaagcctattgtaagacctgggagcagccatcacagtctgcgtcattcactcatatgccacaaagccccaacgtgtttaacgaacacatgacaaactctaccatgtcccccggtacggtgggccaatccctgaaatcgcccgccagcattcgtagtaggagtgtgtcagacagcagcgttccacggagagactccctatccaaaacttctacccctttcaacaagagcaataaagcggcgtctcaacaaggaacaccttgggagactctagtcgtattcgctattaatctcaaacagctcaatgtccaaatgaatatgagcaatgtaatgggcaataccacctggaccacctcaggcctgaagtcacaaggaaggctgtccgtcggcagtaatcgcgacagggaaatctcaatgtcagttggcctgggcaggtctcagctggactccaaagggggagtggtgggcggaacaattgatgtcaacgctctggagatggtggctcacataagcgagcacccaaatcagcagccaagtcacaaaattcagattacaatgggctcaaccgaggctcgggtggattacatgggttcctccatactgatgggtattttttctaacgcggatctcaaactgcaggacgaatggaaggtcaatctctataacactctggactcgagtattaccgataagtccgagatctttgttcatggcgatctcaaatgggacatcttccaagtaatgatttccaggtccacaacgccagatttaatcaaaattggcatgaagctacaagagttctttactcagcagttcgacacatccaagcgcgccctcagcacatgggggccagtgccctatctacccccgaaaacaatgacttcaaatcttgagaagtcatcccaagagcagttactggatgccgcacaccaccggcattggcccggagtgctgaaggtggtgtcaggctgtcatatcagcctgttccagattcccctgcctgaggatggtatgcagttcggtggctcaatgagcttgcatggaaaccatatgaccttagcatgcttccacggcccaaatttcagatccaagagctgggctttgtttcacttggaagagccaaacattgccttttggaccgaagcacagaaaatctgggaggacgggtcctctgatcattcaacctacattgtccagactctggacttccacctggggcacaacaccatggtaactaaaccctgcggagcactggagtctcccatggcaaccattacaaagattacaagaagacggcatgagaatccacctcatggtgtggcatcagttaaggagtggtttaactatgtgacagcgactcgcaatgaggagttgaacttgctgaggaatgtagacgccaacaacacggagaactcgactactgttaaaaactcgagcctgttgagcggtttcaggggcggatcaagctacaaccatgaaactgagaccatcttcgccctcccaaggatgcaactcgatttcaagtctattcacgtacaggagccacaggaaccaagtctccaggacgccagcttgaagccgaaggtcgaatgtagcgtcgtaaccgagtttactgatcatatatgcgtgacaatggatgcagagcttataatgtttctgcacgacctggtttctgcttacctgaaggaaaaagagaaagccatttttcctccaaggatactgtcgactcgacctggacagaagtcccccattatcatacacgatgataattccagtgacaaagacagagaggatagtattacctacaccaccgtcgactggagggatttcatgtgcaacacctggcacctggagcctacactacgactcatctcttggaccggcagaaagatcgatcctgtgggcgtcgactatattctgcagaaactaggctttcaccatgcccgaacaaccattccaaagtggctccagcgaggagtgatggatccccttgacaaagtgttgagcgtgctgatcaagaagcttggcactgctctacaggacgaaaaagagaagaagggcaaggacaaggaggaacactag

SEQ ID NO: 130430 - DNA, 1287 bp, Artificial Sequence
  Description of Artificial Sequence: Synthetic coding sequence
atggggggactgttctcccgctggagaactaagccaagcaccgtggaagtgttagagtcaatcgataaagagattcaggccttagaagaatttcgggagaagaaccagcgcctgcagaaactctgggtggggagactcattctctacagttcggtattgtatctttttacttgtttgattgtgtatctctggtaccttccagacgagttcacagcccgcctcgccatgacacttccttttttcgccttcccgttgatcatatggtccattagaacagtcatcatcttctttttttcaaaacggacagagaggaacaacgaggctctcgatgacttgaaatcacagcgtaagaaaattctcgaagaagtaatggagaaagagacttataagaccgccaagctcatactggagaggtttgatcctgacagtaaaaaggctaaagagtgcgaacctcccagcgccggggccgctgttacggcacgccctggtcaggagatcagacagcggactgccgctcaacggaatttgagcccaacaccggcctctcctaatcaggggccccccccacaggtccccgtcagtccagggccacctaaggactctagtgcacccggtggcccgccagagcggacggttacccctgcactgagttcaaatgtgctccctagacacctgggttccccagctacctctgttcccgggatgggtctccaccctcctggaccccccctggcccgtcccattttgcctcgcgaacgaggagcgctggatagaattgtggaatacttggtgggagacgggccacagaaccgctacgccctgatctgccaacaatgcttctctcacaatggtatggcgctcaaggaagagttcgagtacatagcatttcgctgtgcttactgcttttttctaaatcccgcgcggaaaacccggccccaggccccgcggctgcctgaatttagttttgagaaacgacaagtggtggaagggtcctccagtgtcggccctttaccctcggggagcgttttaagcagcgacaatcagttcaatgaggagtccctggaacacgatgtcctggatgacaacacggaacaaacagacgacaaaatccccgccacagagcaaacgaaccaggtgatagaaaaggcttctgacagtgaggaacctgaggaaaagcaggagacagagaatgaggaagccagtgttattgaaacgaattccaccgtccccggagccgacagcatccccgacccagaactctccggcgagtcactgacggcagaatag

SEQ ID NO: 130431 - DNA, 2718 bp, Artificial Sequence
  Description of Artificial Sequence: Synthetic coding sequence
atggatagtaccgcgtgtttaaaaagtttgctgcttactgtctctcagtataaggcagtgaagagcgaggccaacgccacccagctgctgcgccacttggaggtgatcagcggacagaagctaactaggctcttcacctcgaatcaaattctcaccagtgagtgtttgagctgtcttgtcgaacttctggaagatcccaacatctctgcatctttgatcctctctattatcgggcttctgtcccaattagccgtagacatcgaaaccagggattgcctacaaaatacatataatctcaactccgtccttgctggcgtcgtgtgcaggtcttctcataccgacagcgtgtttctacaatgcatccagctcttacagaaactcacttacaacgttaaaatcttttactccggagctaatattgatgagttgatcacatttctgattgatcatatccagagttccgaagatgaacttaagatgccctgcctgggcctgctggctaacctctgccgccacaatttgtctgtgcagacccacattaagacgctctctaatgttaaatcattttatcgcaccctaataaccctgttggcccattctagcttaacagtggtagtgttcgccctgagcattctgtcgtcacttaccctgaatgaagaggttggagaaaagttgttccacgcccggaacatacaccagacattccagctaatcttcaacatcctaatcaacggggatggaactcttaccagaaagtatagtgtcgatctgctgatggatttactgaaaaacccaaagattgccgactatctgacccgctatgaacacttcagtagctgcttacaccaggtcctgggtcttctgaatggaaaggacccagatagttctagcaaagtgctggagcttcttcttgccttttgcagtgttactcagctgaggcatatgctgactcagatgatgtttgagcagagtccacccgggtctgccaccttaggaagccatactaagtgcctggagcctactgtggcactccttagatggctgagccagccccttgatggcagcgaaaactgctccgtcctggctctggaactgtttaaggaaattttcgaggatgtgatcgatgccgccaactgctcctccgcggacagatttgtaacattactgctgccgacaattctcgaccagctgcagttcaccgaacagaatcttgacgaagctctgactcgcaagaaatgtgaacgcatcgctaaggcaattgaagtgctgctcaccttgtgcggagacgacactcttaaaatgcatatcgcaaaaatcttgacaacggtgaaatgcacaacacttatcgaacaacagtttacatatgggaagatcgacctgggtttcggaacaaaggtcgccgactctgaactgtgtaaattggccgctgacgtgattctgaaaacactggatttgattaataaactaaaaccgctcgtgccgggcatggaggtgagtttttacaagatcttgcaggatcctcgcctgattacccccttggcattcgctctgacttcagataatcgcgaacaggtgcaatccggcctgcggatccttttggaagccgcccctctgcctgatttccccgcattagtgctgggggagtctattgctgctaacaacgcctaccgccagcaggaaacagagcacattccacggaaaatgccatggcagagctcaaaccatagtttccctacctctatcaaatgtttaactccccatttaaaggacggcgttccaggccttaacattgaggaattaattgagaagttacagtcaggtatggtggtcaaagatcagatctgtgatgtccgcatatcggacatcatggatgtgtatgagatgaagttgagcactcttgctagcaaagagtcgagattgcaggacctgctggaaactaaggcgctggccctggcccaggctgatcggctgattgcccagcatagatgccagcgcacccaggccgagaccgaggcccgaacattggcttctatgctaagggaagtcgaacgcaagaatgaggaattatctgtcctcctgaaggctcagcaggtcgaaagcgagcgggcccagtctgatatcgaacacctgtttcaacacaaccggaagttggagagcgtcgcggaggaacatgagattttgactaagtcttacatggagcttctacagaggaacgaaagtacagaaaaaaagaataaggatctacaaataacatgtgactcattaaacaagcagattgaaaccgtgaaaaagctgaacgagtctctcaaggagcagaatgaaaaaagcattgcacaactcattgagaaagaggagcagcgtaaggaagtccagaaccagctggtggaccgcgaacacaagttagctaatctccaccagaaaactaaagttcaggaggagaaaattaagacactgcagaaggaacgagaagacaaggaagaaaccatcgacatcctcagaaaagagctctcaaggaccgaacagatacgcaaggagctgtcaattaaggcatccagccttgaggtccagaaggcacagctggagggacgtttggaggagaaagagtcactggtgaaactgcagcaagaggagctaaataagcattctcacatgattgcaatgatccactctctgtctgggggaaaaattaaccccgaaactgtgaacctgtcgatatag

SEQ ID NO: 130432 - DNA, 2370 bp, Artificial Sequence
  Description of Artificial Sequence: Synthetic coding sequence
atgttggaggggaactatcaggtgatgctcaagtctggtacgaatattctgtattggagaacaacggggatattaatgggatcaaaggccgtgaagcctgtattggtgaagaatattactatagaaggggtagcatacacctctgagtgtttcccgtgcaagcctgggaccttttcaaataagcccggcagcttcaactgccaggtatgtccccgcaacacctattctgaaaaaggggccaaagagtgcatacgttgcaaagatgatagccagtttagcgaggagggctcctctgagtgcactgagcgcccaccttgcactaccaaggattacttccagatccacaccccatgtgatgaagaaggcaagacccaaattatgtacaagtggatagaacctaaaatttgcagagaggatctgaccgacgccattagactgcctccgagcggggagaagaaagattgcccgccttgtaatcccggattctataacaacggctcgtcctcctgccatccctgtccaccaggcaccttctcagacggcacaaaggagtgccgtccatgcccggccgggacggaacccgccctcgggttcgaatataagtggtggaatgtactgcccggaaacatgaagactagctgctttaacgtcggcaactccaagtgcgacggcatgaatgggtgggaagtggcaggtgatcacatccagagtggcgcagggggttccgacaacgactacctgattctgaatctgcacatcccaggtttcaaaccgcctacatccatgaccggcgccaccgggtccgaacttggcagaattacattcgtcttcgaaacattatgttcagcggactgtgtactttatttcatggtggatattaataggaaaagtacgaacgttgtcgagagttgggggggcacgaaagaaaagcaggcatacacgcatattatattcaagaacgcgacatttactttcacttgggccttccaaagaaccaaccagggacaggataatagacgattcattaacgacatggtgaagatctattctattaccgccaccaacgcagtggacggcgtggcgtcgtcttgcagggcatgtgccctcggctcggagcagtctgggtcttcctgcgtgccatgcccacccgggcattatatcgagaaggagactaatcagtgcaaagaatgtccgccagatacttaccttagtatccatcaggtttatggcaaggaggcatgtataccctgtgggcccggctcaaagaataatcaagatcatagcgtgtgctatagtgattgtttcttctatcacgaaaaagagaaccagtctctacactacgacttttcaaatctgagttcggtcggatcattaatgaacggcccatcattcacttcgaagggtactaagtacttccattttttcaatataagcttatgtggacacgagggcaaaaagatggccctatgcacaaacaacatcacagacttcacagtgaaagaaatcgtggccggctccgacgattataccaatctagtcggagcttttgtttgccaaagcaccattatccctagcgagtctaaggggttcagggcggcacttagctctcagagcatcatcctcgctgatactttcatcggggttacagttgagaccaccctgaagaatatcaacattaaagaagatatgtttccagtaccaacatctcagatccctgacgtgcactttttctataaaagctccaccgccacaacatcttgcattaatgggaggtctacggccgtgaaaatgcgctgcaaccccaccaagtccggggctggcgtgatttctgtgccatcaaagtgtcctgccggcacatgcgatggatgcaccttctatttcctgtgggagagcgccgaggcatgtccactatgcactgagcacgatttccacgaaattgagggcgcctgcaaacggggctttcaggagactctgtatgtttggaatgagccgaagtggtgtataaaaggcatttcattaccagagaagaaactggcaacctgtgagacagtagacttttggttaaaggtcggagcaggggtaggcgctttcacggcagtgttgcttgtggctctcacctgttacttctggaagaaaaatcagaaactggaatataaatattccaagctggtgatgacaaccaacagcaaagagtgcgagctgccagctgccgacagttgcgctattatggaaggcgaagacaatgaggaggaagtggtatattctaacaaacagagcctgcttggaaagcttaaatcactggccactaaggagaaggaggatcatttcgagagtgtccagctgaagacgtcccggtcgccgaatatctag

SEQ ID NO: 130433 - DNA, 336 bp, Artificial Sequence
  Description of Artificial Sequence: Synthetic coding sequence
atggtccgcacaaaggcggactcagtgccaggcacttatcggaaggtcgtagccgcccgagcccctcgcaaagtacttggctcgagtacttctgctactaactctacctctgtgtcttcccggaaagcagaaaacaaatacgctggcggaaatccagtgtgtgttcgacctacccctaagtggcagaaaggaataggagagttcttccggctgtctcccaaggactcagagaaggagaatcagatccctgaggaggctggaagtagtggtctgggcaaggccaaacggaaggcctgtcctttacaacctgatcacactaatgacgaaaaggagtag

SEQ ID NO: 130434 - DNA, 2772 bp, Artificial Sequence
  Description of Artificial Sequence: Synthetic coding sequence
atgtctcagttcaagcgtcaacgaattaacccgctcccagggggccggaacttttccggaaccgctagcacatcattgctgggtcccccaccaggcttgctcactcctcctgtggccactgagctgtcgcagaacgcacgtcacctgcaggggggcgaaaagcagagagtcttcactggaattgtcacatccctgcacgattatttcggcgtggtagacgaggaagtgttcttccagctcagcgtggtgaaggggaggctacctcagctcggggaaaaggtgctggtgaaagctgcctacaaccctggtcaggccgtaccatggaacgccgtaaaggttcaaaccctctcaaatcagcctttactaaaatccccagccccacctctgctccacgtcgctgcccttgggcagaagcagggcatactgggagctcagcctcaactgatctttcagccgcatcggattccaccactcttcccccaaaagcccctctccctcttccaaacctcacacacactgcacctctcccacctgaacaggtttcctgcgcgggggccacacggcaggctggatcaaggaaggtccgatgactacgattcaaaaaagagaaaacagcgagctggcggagaaccttggggcgccaaaaagcctcgacacgatctccctccctatcgtgtccatcttaccccgtacaccgtcgattcgcccatctgtgactttctagagctgcaaaggaggtaccggtccctgctggttccctctgactttcttagcgtgcatttatcgtggctttcagctttccccctgtctcagcccttctcactccatcacccctcccgcatccaggtgtcttccgagaaggaagccgctccggatgcaggcgctgaacccatcaccgccgattccgaccccgcctactcatcaaaagtgctcctgcttagtagtcctgggctggaagaactttaccggtgttgtatgttgttcgtagatgacatggccgagcctcgagagactccagaacacccattgaaacagattaagttcttgttaggcagaaaagaagaggaggctgtgctagttggaggcgagtggtctccatctctggatggtctggacccacaggccgacccccaagtgctggtgaggacagctatcaggtgcgcccaggctcagactgggatcgatctatccgggtgcacaaagtggtggagattcgcggaatttcagtatttgcagccgggcccacctcgacggctgcagacggtcgtggtgtacctgcccgatgtgtggaccataatgcctactctagaggagtgggaagcattgtgtcagcagaaagctgcagaggcggcccctcctactcaggaggcgcagggagaaacagaacctacagagcaggctcctgacgccttagaacaggccgccgatacgagtaggcgaaacgcagagacaccagaggccaccactcagcaggagaccgacaccgatcttccggaagcccctcctcctcctttggagccagccgtgatcgctcggccgggctgcgtgaaccttagcttgcatggtattgtcgaggaccgtagacctaaagaaaggatctcgttcgaggtcatggtccttgcagagctgtttcttgagatgctgcagagagacttcgggtacagagtgtataagatgctcctttcactgcctgagaaagtcgtctcacctccagagcctgaaaaggaagaggctgctaaagaagaggctacaaaggaggaggaggctattaaagaggaagtagttaaggaacctaaggacgaagcccagaatgagggccctgctacagagtctgaggcgccgttgaaggaagatggcttgctccctaagccactgtcgtccggaggagaagaagaagagaagcctaggggagaggcctcggaagatctgtgtgagatggcactggacccagaactgctgcttttgcgtgatgatggcgaggaggaatttgccggcgccaagctcgaggactccgaagtccgatcagtggcaagcaaccagtcagagatggaatttagttcactgcaggacatgccaaaggagctggacccttccgcggtactccctctcgactgtttattagccttcgtgtttttcgacgcgaattggtgtggctatttgcatagacgagatcttgagaggatcttactgaccctcgggatacggctgtcagctgaacaggctaagcagctggtcagtagggtcgtgactcagaatatctgccaatataggtcattgcagtatagtcgacaagaaggcctggatggaggcttaccagaagaggttctcttcggaaatctagacttattgcctcctcctggcaagagtacaaagcctggagcagcccctactgagcacaaagccctggttagtcataatggatcattgattaatgttggctccctccttcagcgtgctgaacagcaggattccggcaggttatatctagaaaataagattcacaccctcgaacttaaactggaggaaagccacaacaggttttccgccaccgaagtgactaacaagacattggcagccgaaatgcaggagctgagggtacgacttgccgaggctgaggaaacggcacgcactgcggagagacagaagagccagctccagcggctgctccaggagctgcggcgacgtcttactccccttcaactggaaatccagagagttgtggagaaagccgattcatgggtagagaaagaggaaccagcgccatctaattag

SEQ ID NO: 130435 - DNA, 3480 bp, Artificial Sequence
  Description of Artificial Sequence: Synthetic coding sequence
atgctcgacttcttagccgaaaacaatctgtgcggacaggctattcttcggatcgtaagttgcggtaacgccattatagcggagttgttgaggctgtcagagtttattcctgccgtgttcagactaaaggatagggcggaccagcagaagtacggcgatatcatttttgatttctcttatttcaagggccctgagctgtgggagtcaaagttggacgcgaagccagagcttcaagacctcgacgaagagtttagagaaaacaacattgaaatcgtaaccagattttaccttgccttccagtctgtgcacaagtatattgtggatctgaatcgctaccttgacgacctgaatgagggggtgtacatccaacaaacattagaaaccgtgttattgaatgaggacggaaagcagcttctatgtgaggctctctatctgtatggagtcatgctcctggtcatagatcagaaaatagaaggagaggttcgagaacgtatgcttgtctcttactacagatacagcgcagcccggtcttcagctgatagtaacatggatgatatttgtaaactccttcgttccactggatatagttcacagcccggcgctaagagacccagcaactaccctgaatcctactttcagagggtgcccataaatgagagctttatatcaatggtgatcggtcggctgcgttccgatgacatctataaccaagtgagcgcctaccctcttcccgagcacagatccaccgccctggcaaaccaggcagccatgctgtatgtgatcttgtattttgagccaagcatcttgcacacccaccaagctaagatgcgggaaatcgtggataagtatttccccgacaactgggtaatatccatatatatgggtatcaccgtcaatctcgtggatgcttgggaaccttacaaagcggctaaaacagctttgaacaacacactggatctgagtaatgtccgcgaacaggccagcaggtacgccacggtcagtgaacgcgtacacgcccaggtccaacaatttctgaaggagggttatttgcgggaggagatggtgcttgacaacattcctaagctattaaactgtctgcgcgattgcaacgtagccatccgatggctcatgcttcacacagccgatagcgcatgtgatccaaacaacaagcggctacggcagattaaagaccagattctcacagattctcgctacaatccacgtatcctgttccaattgttgttggacacagcccaatttgaattcatcctgaaagagatgttcaaacagatgttgtctgaaaagcagacgaaatgggaacactataaaaaggaaggatccgaacgcatgactgaattggctgatgtgttctctggtgtaaagccgctgacccgcgtcgaaaaaaatgaaaatctgcaggcgtggtttcgggaaatctcaaaacagatcctcagtctgaactatgatgattccaccgcagccgggaggaaaaccgtccagctgatccaggctctggaagaggtgcaggagttccaccagctggagtctaatctacaagtctgccagttccttgccgatacccggaagtttctacatcaaatgatccgcacgattaacatcaaggaagaggtcctgattaccatgcagatagtgggcgacctgtcatttgcatggcagcttattgactccttcacttcgattatgcaggagtctatccgagtgaatcctagtatggtcaccaaactccgcgccactttcctcaagctggcctcggccctggatctcccactgctgcggatcaaccaagccaactctccagatctcctgtctgtgtcacagtactattcgggagagctggtgtcctatgtccggaaggtcctgcagattattccagaaagcatgttcactagccttctaaagattattaaactgcagacacatgatatcattgaggtgcccacgcggcttgataaagataaactccgcgattatgcgcagctcggacctcgctatgaagtggcgaagctgacccacgccatctcaattttcaccgaggggattctaatgatgaaaacgaccctggtagggatcataaaagtcgaccccaaacagctgctcgaggacggaattaggaaggaactcgtcaagagggttgccttcgccttgcacagggggctgatctttaaccctagagccaagcccagtgagctgatgccgaaactgaaggagctcggcgccactatggacggcttccataggtctttcgagtacatacaagactacgtaaatatctatggcttgaagatttggcaggaggaggtgagcagaatcatcaactacaacgtcgagcaggagtgtaataatttccttcgtactaagatacaggattggcagtccatgtaccagtccacccacatacctatcccaaagtttaccccagtagacgaatcagtgactttcatcgggcgcctgtgcagagaaatattgcgcatcaccgatcctaaaatgacttgtcacatcgatcagcttaacacctggtatgatatgaaaacacaccaagaggtgacctcctctaggctattttctgagattcagacaaccctcggcacatttggcctaaacggattagaccgtttattgtgcttcatgatcgtcaaagaactccagaacttccttagcatgtttcagaagatcattcttcgcgatagaacagtgcaggacacactgaaaaccctgatgaacgccgtcagcccccttaagtctattgtggccaacagcaataagatttacttcagcgcaatcgcgaaaactcaaaaaatctggactgcctatctcgaggccatcatgaaggtggggcagatgcagatacttcggcagcagatagccaacgaactgaactattcctgcagattcgatagcaagcatctcgcggccgccctggagaacttgaataaagcgcttctcgctgacatcgaggcacactaccaggatcccagcctgccctatccgaaagaggacaataccctgctgtatgaaatcaccgcatatcttgaagcagcaggcatccataatccactaaataaaatctacatcaccacaaaacgtctgccctacttccccattgtgaatttcctgttcctgatcgcccagctgcctaaattgcagtacaacaagaatcttgggatggtctgccgaaaaccaactgatcccgtggactggcctcctctggtgttgggcctgttaacattgctgaaacagttccacagtagatacactgagcaatttttagccttgatcggccagttcatctgctccactgtggaacaatgtactagccaaaagattccggaaatcccagccgacgtagtaggcgcattactgtttctggaagactacgttagatacacgaagctcccacgcagagtggccgaagcacacgtgccgaatttcatttttgacgagttcagaaccgtcttgtag

SEQ ID NO: 130436 - DNA, 2424 bp, Artificial Sequence
  Description of Artificial Sequence: Synthetic coding sequence
atgttctctgcgggtgccgaatccctgctccaccaggccagggaaatacaagacgaggagctgaaaaagttctgcagcagaatatgcaaattgctgcaagccgaggatctggggcccgacacccttgatagcttacagaggctgttcctgattatctcggccacaaagtactctcgaaggctggagaaaacctgtgtggaccttctgcaggccactctaggactgccggcttgccctgagcagttgcaagttttgtgcgctgcaatcctgagagagatgagcccatccgattctttatctttggcgtgggatcatactcaaaacagccgacagttgtctcttgttgccagtgttctgctggcacagggcgatcgcaatgaggaggttcgtgcagttgggcagggggtgctcagggccctggaatccaggcagcctgagggacccagcttgcggcacctccttcctgtgatggcaaaggtggtcgtcctcagccctggcactctgcaggaagaccaggctaccctgctaagcaagcggctggttgactggctacggtacgcgtccctgcagcagggcctccctcacagcggaggctttttttccacaccgagagctagacaaccggggcccgtaactgaggtggacggtgccgtagcaacggacttcttcaccgtcctatcttctggtcacagattcacggacgatcagtggctgaacgttcaggccttttcaatgctgagagcctggctcttgcactctggccctgaggggcccggcacattggataccgatgacaggtctgaacaagagggatccactcttagtgttatttccgcaactagctccgctggtagattattgcctccccgagaaaggctgcgtgaagtcgctttcgagtattgccagcgcttgatcgaacagtcaaatcggcgggcccttaggaaaggggacagcgatttacagaaggcttgccttgtcgaggctgtgctcgtgctggacgtcttatgtagacaggatccctcttttctgtatagatccctcagttgcctcaaagccctgcacggaagggttaggggggatcctgccagcgttagagtgctgctgcccctcgcccacttcttcctgtctcacggcgaggccgcagcagtggatagcgaagccgtgtaccagcacctcttcacacggatccctgttgagcagtttcactcacctatgctggccttcgaattcattcagttttgccgggacaacctccacctgttctctggacatttgtcaaccctcagactttctttcccaaacctgttcaagtttctggcctggaactctccgcctttgaccagcgaatttgtggcactactcccagccctggtcgacgccggaacagccttggaaatgctgcatgccctcctggatctgccctgcctgacagcagtcctcgatctgcagctgcggagcgctcctgctgcctccgaaagacctctatgggatacctcgctgagggcaccatcttgcctcgaagcctttcgcgatcctcagttccagggacttttccagtacctcctgcgccctaaagcctccggggccacggagagactcgcaccactccaccagctccttcagcctatggccggttgtgctcgcgtggcacaatgcgcccaagccgttccaacactgcttcaggccttcttctctgcggtgacccaggtggccgatggctcattgattaaccaactggctctgttgttactgggccgaagcgattcactctaccccgcccccggatacgctgctggggtgcactccgtcttgagtagtcaattcttggccctgtgtacgctcaagcctagtctggtggtggagctagccagggacctcctggagttcttgggatctgtgaacggcctctgctctagagcaagtcttgtgaccagtgtggtgtgggccatcggtgaatacctatctgtgacctatgaccggaggtgcactgtggagcagatcaacaaattttttgaagcattagaggcgctgctcttcgaggtaacccaatgccgtccatctgctgccctgcctcggtgtccgcctcaagttgtaacagtcctgatgacaactctaaccaagctggctagtaggtctcaggacctcatccctcgggccagcctgcttcttagcaaaatgcgaaccctggctcattcaccggccacatccagcacacactccgaagaaggagccgaggctatcaggacgagggctacagagttgctgacacttctgaagatgccctcggttgcccagtttgtgctcacaccttctaccgaagtgtgttcacctagataccaccgagacgctaataccgcgctcccactcgctctccggaccgtgtccaggctcgtggaaagagaggctggcctcatgcccgggtag

SEQ ID NO: 130437 - DNA, 4086 bp, Artificial Sequence
  Description of Artificial Sequence: Synthetic coding sequence
atgggtgccgcgggtaggcaggactttctgtttaaggctatgttgactatcagctggcttacactgacatgttttcccggtgcaacctctactgtcgccgcgggctgtcctgatcagagccctgaactccagccttggaacccgggacacgatcaagaccatcatgtgcacataggccagggaaagacactgttgctgacaagctctgccaccgtgtatagtatccacataagtgagggcggaaagctcgttatcaaagaccacgatgagccaattgtactccgtactagacacattctgattgacaacggcggggagttgcatgcagggagtgccctctgtccgttccaaggaaatttcaccattatcctttacggccgagccgatgagggcatacagccagatccttactacgggctgaagtatattggagtgggcaaaggcggagcactagaactgcatggacaaaagaaactctcgtggacattcctgaacaagacgctgcatccaggaggtatggctgagggtggatactttttcgagcgctcatggggccatagaggagttattgtgcacgtgatcgaccctaagtctggcaccgtgatccatagtgaccgattcgatacttacaggtcgaaaaaggaaagcgagcgactggtccagtacctcaatgccgtccccgacgggagaatcctgagcgtggctgtaaacgatgagggcagccggaacctggacgatatggcgaggaaggctatgactaaacttggaagcaagcatttccttcatcttgggtttaggcacccatggtcgttcctgaccgtcaagggaaatccttcctctagtgtcgaagatcacatcgagtaccacgggcaccgtggctcggcagcagcaagagtgtttaagttgttccaaactgagcacggcgaatatttcaacgtttcactaagctcagagtgggtgcaggacgtggaatggaccgagtggttcgaccatgataaggtgtcccagaccaagggcggggagaagatctctgatttgtggaaagctcacccagggaaaatttgcaatagacctatagatatccaagcaacaactatggatggagtaaatctttctaccgaggtggtgtacaaaaaaggacaggattatcgattcgcatgttatgaccggggacgagcgtgtcggagctacagagtccgcttcctttgcggtaaacccgttcgccctaagttgacggtaactattgatactaacgtcaacagtactatcttaaacctggaagacaatgtgcagtcatggaagcctggggatacattggtcatcgcaagcaccgactactctatgtatcaggcagaggagtttcaggtcttaccctgcaggagctgcgcacccaatcaggtgaaggtcgctggcaagcctatgtacctgcatataggagaagagattgacggtgtcgacatgagagcagaggtgggcctgttgtcgaggaacatcatagttatgggtgaaatggaggataagtgctatccatataggaaccacatatgcaactttttcgacttcgatacttttggcgggcatatcaagttcgccttgggcttcaaagccgcccatcttgaaggcaccgagctgaagcacatggggcagcagctcgtgggtcagtaccctatacatttccacctggcaggggacgttgatgaacgcggcggctacgaccccccaacttatatcagggatctgtcaatccaccatacgtttagccggtgcgtgactgttcacggatccaacggactactgatcaaagacgtcgttgggtataattctctgggccactgcttcttcaccgaagacggtcctgaggaaagaaatacatttgatcactgcctggggctcctagtgaaatcgggcaccctgctcccttctgaccgcgactcaaaaatgtgtaagatgattaccgaggattcgtaccccggctacatcccgaagcctcgccaggactgcaacgctgtatcaacattttggatggctaacccaaataataacctcataaattgcgcagccgccggaagtgaggagacaggattttggtttatctttcaccacgtaccaaccgggccttcagttgggatgtatagtccagggtactctgaacacatccccttgggtaagttttataacaatcgtgcccacagtaactatagagccggaatgatcatcgataacggcgttaagacgacggaagcttccgcaaaagacaagagacctttcctatccatcatttccgcgaggtacagcccgcaccaagacgccgatccactgaagcctcgggagccagcaattatccggcactttatagcatacaagaatcaggaccacggtgcctggttaaggggaggcgatgtttggctggattcttgtcggtttgctgataacgggattgggttgaccctcgcaagtggcggcacattcccgtatgacgacggttcaaagcaggagatcaagaattcgctgtttgtcggggaatctggcaacgtagggactgaaatgatggacaacaggatctggggcccggggggacttgatcactccggtaggaccctacctattggccagaacttcccgattagaggcattcagttgtatgacgggccaattaatattcagaattgtacttttcgcaagtttgtggctctcgaagggagacatacatctgctctagcgttccgcctgaataacgcttggcaatcttgcccacataataacgtgacgggtattgctttcgaagatgtgcctatcacttcccgggtgttttttggtgagccgggcccatggttcaatcaactcgacatggacggagacaagaccagcgtgttccacgatgttgacggcagtgtcagcgagtaccctggcagttacctgacaaaaaatgataactggctcgtgcgccatccagactgcattaatgtaccagactggcgtggcgcaatttgctccggctgctacgcacaaatgtatatacaggcctataagaccagcaatctgcgcatgaagatcattaagaacgattttccctcccatcctctttatctggaaggcgcactcaccagatctacccattaccagcagtaccagccagtggtcaccctgcaaaagggctatactattcattgggaccagactgcccctgctgaactagcaatatggctcatcaacttcaacaagggtgactggattcgagtcggattgtgctacccgcgagggacaaccttcagtattctctctgacgtgcacaacaggctgctgaagcaaacatctaaaaccggagtctttgtgcgcacattgcagatggacaaggtggaacagtcataccccggcaggagtcactattattgggacgaggattctggcctcttgttccttaaactgaaggcacagaatgaacgggagaaattcgccttttgcagcatgaaaggctgtgagaggatcaagatcaaagcactcattcctaagaacgccggggtgtccgactgcacagccacagcttaccccaagtttacggagcgcgctgtcgtggatgtgcctatgccaaaaaaactgttcggttcacagctgaaaaccaaagaccacttcctcgaagtaaagatggagtcaagtaagcagcacttctttcatctgtggaacgactttgcttacattgaggtggatggcaaaaagtatccatcaagtgaagatgggatccaagtcgtggttatagacggtaatcaagggagagtagtgagccacaccagctttcggaattccatcctccagggaatcccctggcagctttttaattacgtggcaacaattccagataacagcattgttctgatggcatctaaaggcaggtatgtgtcccggggaccgtggactagagtgttggagaagctgggcgcggacagaggactcaaactcaaggaacaaatggcattcgtcgggttcaaaggtagctttagacccatctgggtgacgctcgacaccgaggaccataaagccaagatattccaggtggttcccattcccgtggtgaaaaagaagaagctgtag

SEQ ID NO: 130438 - DNA, 1866 bp, Artificial Sequence
  Description of Artificial Sequence: Synthetic coding sequence
atggccaacgtgccttgggccgaggtgtgcgaaaagttccaggcagcactcgccctaagccgcgtcgagctccacaaaaatccggaaaaagagccctacaagtccaagtactctgcaagggcactgctggaagaggtcaaggctttgcttggtccagcacccgaggatgaagacgaaagaccagaggccgaggacggccccggtgccggtgaccatgccttaggcctgcccgccgaggtcgtggagccggagggtcccgtcgcccagcgggccgtacgccttgccgtgattgaatttcatttgggcgtgaaccatatcgatacggaggaactcagcgctggcgaagaacacttggttaaatgccttcggcttctgaggagatatcgactgagccacgattgtatcagtctgtgtattcaggctcaaaacaacttagggatcctttggtcggagcgcgaggagatagagaccgctcaggcatatctcgaaagcagtgaagctctctataatcagtatatgaaagaggtggggtctcctccgctcgaccctaccgagcggttccttcctgaagaggagaagttgacagagcaggagaggagtaagagattcgagaaggtttacacccacaacctgtactatctggcccaagtgtaccaacacttggagatgtttgaaaaagccgcacactactgtcactctactttgaaacgacagctggagcacaatgcctatcaccctattgagtgggccataaatgcggccactctgagccagttctacatcaacaagctatgtttcatggaagcccgccactgcctgagcgctgccaatgttattttcggccagacgggcaaaatctcagccaccgaagatactccagaggccgagggggaggtcccggaactttaccaccagcgtaagggggagatcgctaggtgttggatcaaatactgtttgaccctaatgcagaacgcccagttaagcatgcaggacaatatcggggagcttgacctagacaaacaatctgaattacgggctctacgtaaaaaagaattggacgaagaggaatccatacgtaaaaaagcggtgcagtttggcacgggcgagttatgtgatgcaatttccgcagtggaagaaaaggtcagctatctcagaccacttgactttgaggaggccagagagctgttcctactgggccaacattatgtgttcgaggcaaaggagttctttcagattgatggatatgtaaccgatcatatcgaggtcgtgcaggatcattcagccctttttaaggtcctggccttttttgaaacagatatggagcggcgatgtaaaatgcataagcgccgcattgctatgctggaacccctgactgtggacttaaacccacagtattacctcctggtgaaccgccagatacagttcgaaattgcacacgcctattacgacatgatggacttgaaagttgcaatcgcagatcgacttagagatcctgacagccacattgtgaagaaaatcaacaatcttaataaatcggcccttaagtactaccagttattcttagatagtctcagggaccccaataaagtcttccccgaacacattggggaagatgtcctaagaccagcaatgctggctaagttccgggttgcgaggctgtacggaaagatcatcaccgccgacccaaagaaagagctggaaaatctggcaacttcacttgaacattataaatttattgtcgactactgtgaaaagcatcccgaagccgcccaggaaattgaggttgaactggagctgtctaaggagatggtgagcctcctccccaccaaaatggaacggttcaggaccaaaatggctcttacatag

SEQ ID NO: 130439 - DNA, 4551 bp, Artificial Sequence
  Description of Artificial Sequence: Synthetic coding sequence
atggataaccagcaggacaaagcaatagtggcgtcagctaatggcgaaaacactctaattaacggagtcaaagagaacgactcagaagaccaagatgtcgccatgaaaagctttgccgcgctggaagcagccgccccgattcaacccacaccagtcgctcagaaagagacattgatgtacccgcgagggctgttgccgttgccaagcaaaaaaccctgtatgcagagccccccctcacctctgggactgatagaagcccctgagcatgctgccaacagtgcgagtgtgaatgcaatttcattaacatctgggatcgcaaaaggtttaaatacatggtcactccccaacgaatgcgagaaagccccctttgctataatggaacctgcgggcatgagtgcgctcaacggagactgtctcatgcaaccatccagaacgtgtctgggttgttttatggagtctaaggacgccgtggaccccgagcccgggatctctctgaaggttggagacttgaaccgggactacgaaacttgcgctgtatcagatatcggaatccagtgtattaatgctggtgaaaacatgaagtatggcgaacagctgctgagcgaccagctgctgggatttcctctgcacaagagccgggccggcgacagacgtgaaaccgaaaaacccgacatcgatctggaggatcctgcgcagaaaagctattatgaagccttactgctggataagtgtaacaccgaagaggctctgctggccaatagcaaccaggactgggggtactttgagaccttcatcagtgaaagcaagattgagttgctcgatctctgctcaaaaaacgaactctcagtcaaccttttcagcgaggaagacgttgacaattacatgttcgacgacgatgagtccacattgggctccgacgtctgtagccttaaaattcgctatgagtcattccaagacaacgtccgcgacaagactacattgctcatgcaagaagacgcgcagttcaacttcttcccatcagtttttacgacgtgtcccaagcgggaatccaagtcaggggccctgaagcagtcgagcgacttttcacagttcaaggtgcccgacgtgtccattatttggggcgaggaggacaaaaatttagacaaaaagaagggcaaggaggagggtcaggaggataagggcgtagaaaagaaggatggaaaggacaatggtgagaagcccgctttaaacaaaccttgctcaggaacagaggtcgagcagcttaaaaaccctaaacagggacaccttgccaattccctagagaccagcggcagtttttcagacgactcctcattcattgagattagctatgatgcaatgggagaaattaaagattgctctcggtatatggcacgagacacaaacagcggttcctccagttcgcaacagaattacggactaagagcaaaaaggaaggtacgatatagtgaagattatctctacgacgtggacagtttggaaggtgagaaggtcaacgaacggaaagagtggctccctgtcggtagtaaggaagaagacgacgacgaatggtgtcctaaaaagaggcggaaggtcacccgaaaagagccaccggtgatcataaagtatataatcattaaccggttcaaaggcgagaagaatatgctcgtgaagctcgggaaagtggacgccagcgagaccaccgtgaatctgtccgagaatcagctcaacaagtacgctaaactggctcctcttaagggtttttggcaaaagaaaaaaaagcagaggaatacgaacacagactctatcaagacacccttttcccagaaacagagcttcgagcctggctcttttgaggtgagcttccttcctcctgctaggaagcggaagtccaaactgggtaatcgccaccgcatccagcgtatccctagcattgagataagcgcctcttccaagcagatctctctttgcaacgaccagaggcacgccagcaatcataaggaagacggcgggctaaaaggcactttaaaatctgcgcctctgggggccccatcatgtgccaacggatcccacttaaatgatattacgggccccgatagcgttaaggtcaaggcacaggataccgagtttaaagggcctgagaggaaagtgctgaataagatcaagttcaagtccgaggctagattgaagagtaagaaggtgaaggcagcaggccaggaatcaaagcccattgtgcagatgagtccattgctggagaatcaatcgagtaaagctaacctgaagaacgaggtgatcccgggaacctcaaactcctcccgcctaagcgaatttcatgaggcgaaagccgccaaatcaagcacctttctgcctaccacctgttctagcgaaatgcccttgtcttccgctaatgtaacaaccaacatcccagtcatcccgggcggatatctacagacacttttagacgcttcagatctctccaacaatacttccatctcctacttctcccaccattcccctgagcagaatgaaggatcactgacacagacagagaagagctttgtcccgttacaacctacgcaggattgtgtgttgacgtcctcgtctgatagcgagcttcagcagtctagtcacaatttcaagatggaatcttccaattacagaaacgtgtggcctaacaaagccacatccgggacacaggagtttatggctgaggtgtcgcgagaaattgcccccacccagtccagcgagttcggtgcatcacaagtggtgtcaatggaaaataatctgactccgacaacctacaatcctatatgcctgaacagcggtggatcgaattgtaataaggtcctctacgattccatgcaggatacacagttacccagtgacgatagctatcagctgtgccactttaataacggcgagatttgctttccttttcaacagggccctgtgaacatggatgatggccggttattcagctttgactccatggctcccctttctgtgtcgtccagtaattactgttcccttagcttgaagtcttgtgagaaagacggggacgacgatattaccgatgacttccttgctcactgcagcccaaagcttgtgatccagcagtccatcgatgaaatcgcgccactgaaagagtcaacagatctgcttgatatctccaacttcaccccagacaaattccggcactcttcactgagcgaaatgtctcctcctgacaccccgtccctttccccccagatcaccagatgcgaatctatgaaaaccctcgggaccctgaaaggattccaggagggcgtgccagggccacttgactcagtggagaaaattaagtgggactgcagcacactttcccgccaagtccaaatggaagatggttttacacttaacaaccaccagttccagttccacatgttcaatgatgaggactctgtgtctcttctacagaaaaacccctgcctgtctaccttcaatgatccgagcgggcaaatttccacgaacaataaggtgtccaaaagcagaaaaaagtcctctccctcaaagtctggcgctatgaaccagtcttccagccagaagaacactagaaagaagtctcttaaaggcaacaataaagggatcgagaagccaccaggaaaaaactctcgtcaggtgccaaagtcgactaaaaaggggaaatacatggctgccataaacggcgagaagatgcagataggaataggtaggggcggttcgcaaaccaacactatctctagtacggggaagacccttgcggaatgcattcagcacgggggccccatggccagtatgaagatgcccagccagaaggggttgtcaggggactgggcacttggaaaggaatccagtcccggctggtccgacatgagcatggggactaacacgaacagcctactggatgacgaccagcgagagttccaggagcccagttatatcttgtcaaatattgcgtcggggatggccgacgtgcagcggtttatgatggcctccatcgagcccctgtgggagcctatggaacatcacggagacccgaacatattttattcccccgaaagcaacagtcttaagctcaaaacccttaaaatcctggcagggactccacaagagagtaagaaaaagattaacagcggaagtcagggagccaccaaaaaccaccggagcattaaaggggttagtaaaagtaatggcaaaacagctataggggatccggggcgagccaatatgcctggatataacgaagacagcaggtcaacgttcttcgacaagaagtattcaaatatgagtactcttggcaataacgggcctacccacaagaaactgtaccgtcataaaagctcatccaaagccctgcgagacgaaaaatgcaaagggaaacatatggaacgagaacaggtgcacaaggatgagtcaggaactgcttcatttgaaaaacttcgagactcagattacaatcttctcaaagctgagacaactttttgggtgcttccagttttcgaggaggaaacgcgaatctttcaaaaggatatctag

SEQ ID NO: 130440 - DNA, 4080 bp, Artificial Sequence
  Description of Artificial Sequence: Synthetic coding sequence
atgtactccgtggaggacctgcttatcagccacggctacaagctgtcgagggaccctcctgccagccgagaggataacccgaagggacgacaggccgcccggacaggtacccgggccgggcagggattacagaatgggcacgaagacggtccagcagcgcttgcccataggaagacaagtgctggaaagggacacgtatccgacagcgagtctcgcaggtctactcctcgaggccatggtgaacctcagtccacaagtgcgtcaagaaccagtgaggctggcttctgtaatcagccgccctcagcatggtcctcccaccccccaactgggaatgaccaggcctaccggaggcgggggcgtcaggaggcccggtcacagaagcctagagagcacgagaacctggaagcaagaggcatggcccaggcccactcgctgcccgtgcatgtcagggaaggcccctgggaagttggtgggaggtcggagcatgtgatgaagaaacctgtgtgggaggaggaactaagaatgtccggccctgctaagtggcagaatgtttcgctagagagctggaaccagccccggaagttgggaagacaaatgagtgatggcgacggtgagcgcctatttcaagatttatatcccttcatccagggcgagcatgttctcaatagccagaacaaaggtaagtctcgaagtctgcccagggtcctcagccctgagtctttaagctgcaccgagatcccgattcccctgaatgagagacactcaccgaaaatgcccccatatcctcctacctgtgcccccaatcttgatagtaccagaaactcagaaaaatcaggttgctccgccccttttccaagacctaaatttggacgtccactcaaacccccatcatatagcagtcaccagcagtccagaggcggtgccgacagtagcgactcccaggacagccagcaaatggacgcgtacgtgccacgacatgagctatgcctgtcagaccctgggctagaaccgcctgtctatgtgcctccccccagttatcgctctcctccgcagaatatacccaacccttacctggaggacacagtgcccataaatgtttgtggagggcattcacaacagcaatcccccacagaaaaggctggcgcatccgggcagcccccttcaggacctccgggcacaggcaatgagtatggagtttctcctaggctgccccagggattaccagcccacccccggccggtgacggcatacgacgggttcgtgcagtacattccctttgacgatccccgtctgcgacactttaagctagcacaaccccaggggttttgtgaagacatcaaactggacgacaagagctataactctagtccagtaaccgcccaagagccagctcatggaggaatgcagcccgatggggccatctggaatccgcagtccctcatacctcctagcggggatgaacgtggactcgtgttggctgacagctcaccacgttggctttgggggcaacccccgggagacggcgagaattcgggactgccgaatcagagggaccgctgtgtggcgcggggacagtggcccgacgtcaggggctcccagcatgggcacaccggccgacaggtctcctccccctactcacagggagagagtacatgtgaaacccagaccaagctgaagaaatttcagacagggactagaactaagaagagctccaagaagaagatgaacgagactatcttctgtttagtcagtatcccagttaagtcagagagtcaccttcccgacagggacatggacaacaatgatttaaagcccagtgccgatcaaaaaaatgggtccgacaagagtccagctttgcaagaacagtccctcctgtccatgtcatctactgacctggaactgcaggcgctaacaggtagcatgggcggccggacggaatttcagaagcaggacctcggcgagccagaggaggatcgtcagacgaatgatcttagcttcatccacttaaccaagcatcgcgaattgaagcatagcgggagctggccagggcataggtaccgggatcagcagacccaaacttcctttagcgaagagcctcagtcttcacagctgcttccaggagctaaactcggagggccctcacgggcggcattgtcacctaaatgctcagatccagcggcatcggaagctcaaacccataccgccttcccaactggcgaccacaagcagaggcccagcgctagaaacctgaaggggcaccgctcgctgtcaccttcgtctaacagtgccttttcgcgcacaagtctttcggtggatcaggctcctacacctaaggctggcaggtctcagccttgcgtggacgtgcacggcctcggcgcacaccccggacccaagcgcgaggtggtcaaaggcgaacctacaggtccctgtaattccaagcagctgttcggccaatttcttctgaagcctgtttcacgcagaccttgggacctgatttcccagctggagagcttcaataaggaactacaggaggaggaggagtcctcgagcagcagtagctcgtcttccagttcatctgaggaaagtgaagccgagccacaacaggagaatcgggcgcattgtcgccaggaggatgtggggttccgaggcaactcaccggaaatgagggtcgagccccagccaaggatgtgggttcctgagagtccggtgtgtaggtctggccgcggagagagtaagtctgaatcgtggagtgaggaacttcagcctggccatccccgggcctggcctccttctcccggacgatttagggtggaagaaggaggcggggctccattctgcagcgccgacggcagcacatcagccgagaagcgacatctggaagtgagcaacggcatggacgagctggctggctccccatttcctgtcactaggatgtcgagcagaagctccgatgcaaagcctttgccagcctcctatcccgccgagccacgcgagccccaggaatctcctaaaattacgtccgcattctctagtgttaaaccttctgaggctgtgccccggaagtttgatagtgggggggaaaggggggctggtctgcctctgtcactgtcaaacaaaaaccgcggcttgtccgcaccggatctgcgatcagtgggacttacacccggtcaggagcagggtgcatccgagctcgaggggtcactgggcgaggcttcgaccattgagataccaccaggtgagagcctgcaagctagagcagcccgtatactgggaatcgaggtagccgtggaaagtctcctgccagggatcaggcgggccggccagaatcagcctgccgagcccgacgcctcagcttgtacccccgaaagcccccaggaggagttgctctctaggcccgcgcctgcggatgtccctagagtcagtactgacgctttctatgggcgacgaaaatgcggctggaccaagagtcctctattcgttggagaccgggattcggccagaagagccccgcaggcttttgagcattctgacgtggacggtgttgtgaccagcaccgatcccgttcccgagccggagccgagccccctagagagtaaattctttgagcagaaggacgttgaaaccaaaccccccttccgcagcacgctcttccattttgtcgagcgcactccatccgtggctggatctgagaaaaggctgcgatcgccatcgaaggttattgaaagcctgcaagagaaactggcatctccgccaaggcgtgccgatccagatagactcatgcgaatgaaggaagtatcttccgtgtccagaatgcgcgtgctttcgttcagaaacgcggacagccaggaggacgctgaagaactcaaggccaccacccgcgggcaggcgggtcttcctggcggtctcgtgtctccaggctctggagaccgggcacaacgcctgggccacagcctcagcgtctcaaaggattcgatcagccgtgaagagaaggagcatccagctgctcagaaggagaaatccatggatcaggacttttggtgtccagacagctacgacccctcccgggttgagagagtatag

SEQ ID NO: 130441 - DNA, 3219 bp, Artificial Sequence
  Description of Artificial Sequence: Synthetic coding sequence
atggcccccccaacgggggttctgagttctcttctcctgctggtgaccatagcgggctgcgccaggaagcagtgttctgaagggaggacatacagcaacgccgtgatttcgccgaatctcgagactacgcgaattatgagagtctcacacactttccccgtggtggattgtacggcggcctgctgtgacctgagctcatgtgacctagcttggtggtttgaggggcgctgctacctcgtcagctgtccacataaggagaactgcgaaccaaagaagatgggccctatccgcagttacctgacatttgtgctgaggccggtgcagaggcccgcccagctgctggattatggcgatatgatgttaaacaggggttctccttcgggcatctggggagactccccggaggatattcgaaaggatctcacatttctgggaaaggattggggactggaggaaatgagcgagtacagcgacgactatagagaactggaaaaggatctgttgcagccttccggcaaacaggaacctcgcggttccgcagaatacactgattggggcctcttaccaggaagcgagggggcctttaactcaagtgtcggcgattctcctgccgttccggctgagactcagcaggaccctgaactccattacttgaatgagagtgcttcaacacctgctcccaagttgccagagaggtcagtattacttcctctgccaaccaccccaagctcaggcgaggttctggaaaaagagaaggcttcacaactccaggaacagtcatcaaacagcagtggcaaagaagtcctgatgccctcacattctttgccacccgcatcactggagctctcctcagtgaccgtcgaaaagtcacccgtactgaccgtcacaccaggctccaccgaacactctattccaaccccccctacctctgcggcgccaagcgagtctactccgagcgagttgcccatctccccaacaacggcacctcgaacagtcaaggaactcaccgtctcagctggggacaatttgatcatcacacttccggataacgaagtcgaactaaaagcttttgtagcccccgctccgcctgttgagaccacttataactacgagtggaacttgatctcacaccctaccgactatcagggcgagatcaagcagggccataagcagactctcaacttaagccagctatccgtcgggctgtacgtgttcaaagtgacagtgagctccgagaacgcattcggggaagggttcgtgaatgttactgtgaaaccggcacgccgagttaatctcccacctgtagctgtcgtctctcctcagctgcaggagctcaccctcccgctcacctcagcacttatcgatggatctcagagcacagacgacactgaaatcgtgagctaccactgggaagaaataaacggcccattcattgaagagaaaacatcagtggactcgccggtgctgaggctgagcaacctggacccaggtaattactcctttagacttactgttacagatagcgatggagcaacaaactcgactacggccgctcttatcgtcaataatgctgtggattacccacctgtggcaaatgccggacccaatcatactattacccttcctcaaaactccattacgctcaacggcaaccagtcaagtgatgaccaccagatcgtcttatacgaatggtcactgggacctggtagcgaagggaagcatgtcgtgatgcagggcgtgcagacaccttatctgcatctcagtgctatgcaggagggtgattacacctttcagttgaaggtcaccgattcttccagacagcagtccacagctgtagttacagtgatcgttcagccagagaacaatcgaccaccagtggccgtggcagggcctgacaaggagctaatattccccgtcgagagcgctaccttagacgggagctccagttccgacgaccatggcatagtgttttaccattgggaacacgtgcggggaccctccgctgtggaaatggaaaacattgacaaagccattgccacggtcacagggctccaggtgggaacctaccattttagactcacagtgaaagaccagcaaggactgtcatccacttcgacccttacggtcgctgtcaaaaaggagaacaacagtccgcctagagcaagagccggtgggagacacgtgctcgtcctccctaacaactctatcaccttagatggctctcgttccacagatgaccagagaattgtgagctacttgtggatacgggacggccaatctcccgccgctggcgacgttatagatggatccgaccactctgtggctctccagcttacgaatctagttgaaggcgtgtacacatttcacctccgtgttacggattcccaaggtgcctctgacacagatacggcgacggttgaagtgcagcctgacccacggaaatcaggattagtagaactgacactgcaggtgggggtgggccaactgaccgagcaacggaaggatactctcgtcagacaattggccgtacttctgaacgtactggactccgacattaaggtgcagaagatacgtgctcactcagacctctccaccgtgatagtcttctacgtgcagtccaggccaccattcaaagtgctgaaagcagcggaggtcgcccgaaatcttcatatgcgtctatctaaagaaaaggcagatttcctcctgttcaaagttctgagggttgataccgccggctgtctgctaaaatgctcggggcacggccactgtgatccactcaccaagcgctgcatttgctcccatctgtggatggaaaacttgatccaacgttacatctgggatggagagtcaaattgcgagtggagtattttctacgttacagtgctagccttcactttaatcgtgcttacaggaggctttacatggctctgcatctgctgctgcaagcggcaaaaaaggaccaagattcgcaagaaaacaaagtatacaatcttagataatatggacgagcaggagcgcatggagctgaggccgaagtatggcatcaagcaccggagcacagaacacaattcttccttaatggtctctgagtctgagttcgacagtgaccaggataccatcttctcacgggagaagatggagcgaggcaatccaaaggtgagcatgaatggctctattagaaatggcgccagcttctcatattgctccaaagataggtag

SEQ ID NO: 130442 - DNA, 918 bp, Artificial Sequence
  Description of Artificial Sequence: Synthetic coding sequence
tctcaactccccgttcgcgctgaggagcggactgaaagttgtctctggggctgctgggcttcgagccgagtgcggcgcacctctgacgcctgctcctcccctttggccaccagcagatccgcccggagctgcggtgtcctcaccgctcccgtcaaaggcgccagtagctccctagtggttaagctcgccgacacggaccgagaaagggcactccgtcgaatgcagcaaatggctggccatctgggggcgtttcatccggctccactgccattgggggcctgtggggcatataccactgctattctgcaacatcaagctgcacttctggcggcagcacaggggccgggtctggggccagtcgcggctgttgcagcccaaatgcagcacgtggcggctttttccttggtggcagcccctcttcttccggcagcagcagcaaactcacccccaggttccggccctggcacgttaccagggctgccagctcctattggtgtgaatgggttcggtcccttgacaccacaaacaaatggccagcccggaagtgacaccctgtacaataatgggctttctccctacccagcacagagccctggtgtggctgaccctctccagcaagcctatgctggtatgcaccactacgccggtccagagggctgcaatctcttcatctatcatctgccacaggagttcggggacgccgaactaattcaaaccttcctgccattcggtgctgtcgtctctgctaaagtatttgtggacagggctaccaaccagtctaaatgctttggctttgtttctttcgacaatcccacgtccgcccagaccgccattcaggctatgaatggctttcagatcgggatgaagaggttaaaggtccagctgaagaggccaaaggacgccaaccgcccttactag

SEQ ID NO: 130443 - DNA, 198 bp, Artificial Sequence
  Description of Artificial Sequence: Synthetic coding sequence
atggtaagaactaaagctgactccgttcccgggacttaccggaaggttgtcgccgctcgggcaccgaggaaggtcctgggatcttctacatctgcgacgaactctacctccgtgagcagtaggaaggaacatgtgttgtgcaatctgattacccagatgatgaaaaaaaatagaactttctccttcatcttcgagtag

SEQ ID NO: 130444 - DNA, 15018 bp, Artificial Sequence
  Description of Artificial Sequence: Synthetic coding sequence
atggaccagagaaagaacgagtctatagtgccaagcattactcagctggaggacttccttacggaacataacagcaacgtcgtgtggctactcgtggccactattttgagttgtggctggattatctatctgacctactataattcacgaaacgttggtctcatcttaactttggtactaaatcgcttgtataagcatgggtacatacacataggatcctttagcttcagcgtactctctggcaaggtgatggttagggagatctactacatcacggaggacatgtcaattcggattcaggacggatttattatttttcgctggtggaagatgtacaaccccaaacagaagcagcacgacccaaaggctgaaactaggctgtatattacagtgaatgactttgagtttcatgtttacaatagatctgatctgtacggccgcttacaggaactttttggcctggagccaactattattccccccaagaaagacgatgataaaacaagggaaatcggtaggaccaggactcagtctaagattgaaagagtgaaggtgaagacagaatctcaagatcccacctcctcatggaggagtcttatccccgtcattaaagtcaacgtgagcacaggtagactggcatttggaaatcattaccagcctcaaactttatgcataaacttcgatgatgcgttcctcacttacaccacaaagccccccagttctcatttagaccagttcatgcacatagtgaagggaaagctcgaaaacgtccgggtaatgttggtgccttccccacgttacgtgggcttacaaaatgatgaacctcccaggctgatgggtgaagggtttgttgttatgcaatcaaatgatgtggacatatattactatatggacgagcccggcctagtgcccgaagagaccgaggagaacatcgagggagagatgagctccgaggactgtaagctgcaagacctacccccatgctggggcctcgatattgtgtgtggtaagggaaccgacttcaactacggcccatgggccgatagacagcgtgattgcctgtggaaattctttttcccacctgactatcaagttctgaaggtcagtgagatagcacagcccgggaggcccaggcagattctcgccttcgaactgaggatgaacattatagcagatgctacaatagatctcttatttactaagaatagagagactaacgccgtgcacgtgaacgtgggggcaggctcatacctggaaatcaatattcccatgaccgtggaggagaacggttatactccagctattaaaggtcagctgcttcacgtggatgctaccacatcaatgcagtacaggacattactcgaggccgagatgctggcattccacatcaatgcgagctaccccagaatctggaatatgcctcagacttggcagtgcgagctagaggtttacaaagctacataccactttatatttgcacagaaaaatttcttcaccgacctgatacaggattggtcctctgattctccgcctgacattttttcctttgtgccttacacctggaatttcaagatcatgttccaccagtttgagatgatttgggccgccaaccagcacaattggatcgattgcagcactaaacagcaagagaacgtttacctggctgcttgcggcgaaaccctaaacatcgacttttccctcccctttacggacttcgtgcccgccacgtgcaacaccaagtttagcctgcggggcgaggacgtcgatctgcacttgttcctgccagattgccacccttccaaatacagtctgttcatgctcgttaaaaactgtcaccccaataaaatgatccacgatacagggatccctgctgaatgccagagtggacagaagaccgttaaaccaaaatggcgcaatgtcactcaggaaaaatccggttgggtggaatgctggacggttccaagcgtgatgctgactatcgactacacctggcatccaatctatccccagaaggccgacgagcagctcaaacaatctttgtcagaaatggaggagacaatgctaagcgttctgaggccatcacaaaagacgagtgatcgggtcgtgtcttcccctagcacaagctcccgtcccccgatcgatccttctgaactcccccccgataagctgcatgtggagatggaactgagccctgattctcagattacattatacggtcccctgcttaatgcctttctttgcattaaagagaattatttcggggaagatgacatgtacatggattttgaggaagtcatctcaagccctgtgcttagcctcagcacatcatcatcatccgggtggaccgccgtgggaatggagaacgataaaaaggaaaacgaaggcagtgccaaatcaattcacccactggccctacggccctgggacatcaccgtactggtgaacttgtacaaggtgcatgggcgactgcctgtccatggcacaacagacgggcccgagtgtcccactgctttcctggaacgcctgtgcttcgagatgaagaagggatttagagaaactatgctgcagctgattctgagtcccttaaacgtgtttgtgtccgacaattaccagcagcgacctcctgttgatgaggtgctcagagaaggccatataaatctgagtggactccagctgagggctcacgcaatgtttagcgcggagggactccccctcggctctgactccctggagtatgcttggctcattgacgtacaagctggatccttaacagccaaggtaacagccccacaactcgcatgtttacttgagtggggtcagactttcgtgtttcatgtggtttgtagggagtatgaactggaaagaccaaaatccgtgatcatctgtcaacatgggatcgatcgcaggttttgcgagagcaagctgtcctgcatccccggtccctgtcccacctccgatgatctcaagtataccatgattagactcgcagttgatggggcagacatttacatagttgagcacggctgcgctacgaacatcaagatgggcgctatccgcgtcgccaattgcaacctgcacaaccagtcagtgggggaggggatctcggccgcaattcaggactttcaagtgagacagtacatcgagcagttaaataactgtaggatcgggttacagcccgccgtgctgcgacgagcgtactggctggaagccgggagcgcgaacctggggttgataaccgtcgatatagctctggctgcagaccaccactcaaagcacgaagctcagaggcacttccttgaaacccatgatgcccgtacaaagcgtctgtggttcctgtggcccgacgatatcctgaaaaacaagcggtgcaggaataaatgcggatgcctgggcgggtgtagattcttcgggggaaccgtgactggactggatttcttcaagctcgaggagttgactccgtccagcagcagtgcgttttctagcactagcgccgagagtgacatgtactatggccagagtttattacaaccgggagaatggataatcacgaaagagatccctaaaattatcgacggcaacgtcaatggcatgaagagaaaagagtgggaaaacaaatctgtcggcatcgaggtggaacggaagactcagcacctctctctgcaggtgccactgcgtagccattcttcatccagcagttccgaagaaaacagctccagttccgcagcccaacctctgctggcaggtgagaaggaatcacctagttcagtcgccgatgaccatctcgtgcagaaagagttcttgcacgggaccaagagggacgacggacaggcttctatccctacggaaatctccgggaactctcccgtgagccctaatacacaggataagtcagtgggccagtcacccctaaggtcacccctaaagcggcaggcttccgtgtgttctaccagactaggctcaacaaaatccctcacagcagccttctatggcgataagcaacccgttacggtgggggtgcaattctcgtcagatgtgtcacgcagtgatgagaacgtactggactcccccaagcaaagacgctcctttggtagctttccatacaccccgtctgccgattccaactcttttcaccagtataggagtatggactcatccatgagtatggctgactccgaagcctacttttccgcggctgaggaattcgagccaatcagctcagacgaaggcccaggcacctacccaggacgcaagaaaaaaaagaaacagactcagcagatcgactactcccggggctccatttaccacagcgtggagggcccgttgacaggacatggagagtccatccaagacagccgtaccttgcccttcaagacgcaccccagtcaagcttcctttgtcagcgctctcggtggggaagacgatgtgatcgagcacctctacatcgttgagggggaaaagactgtggaaagcgaacagattacaccccagcaacctgtgatgaactgttatcagacgtatctcactcagtttcaagttatcaattggtccgtcaagcaccccacgaataagcggacatcaaagtcgagccttcatcgccctctggacctggatacgccgacctctgaggaaagctccagtagctttgaacagctctccgtgcctacgttcaaggtgatcaagcaaggtctgacagctaacagtctgctagatcggggcatgcaactgtccgggagcacaagtaataccccatatacacctttagaaaaaaagttggccgataacaccgatgacgaaaccttgacggaggaatggactttggaccagccggttagccaaactagaacgactgcgatagtcgaagttaaaggtaccgtggacatagtgctgacgcctctggttgccgaagctctggaccggtacatcgaggccatggtgcactgtgcgtctacgaggcaccctgccgcaatcgtcgacgatttacacgccaaggtgctgcgggaggccgtgcagaattccaagacaaccttctcggaaaacttgtccagtaagcaggacattaggggtactaagacggaacagtctaccattggcactaccaaccagggccaggctcagaccaatctgacaatgaagcaggataacgtcaccatcaaaggcctccagacaaatgtgagtatccctaaagttaatctgtgcctgctgcaggcaagtgtcgaggaatccccaaccaccgccccttcacgatctgtcacccatgtgagcctggttgcactgtgctttgaccgaattgcaactcaagtccgaatgaacagaggtgtggtggaagaaacatctaataatgctgaacctggtagaacatcaaatttcgatcgatacgtccatgccacaaaaatgcagccacagagcagtggaagcttgcgaagcaatgcgggagccgagaagggaaaggagatcgcagcaaagctaaacatacatcgtgttcacggtcaactccgcgggctggatacaacagatatcggcacttgtgcgattaccgccattccctttgagaaatctaaggtcctgtttacgctcgaagaattagacgaattcaccttcgtcgatgagaccgaccagcaagctgtgcctgacgtaacccgcatcggcccttctcaggaaaagtgggggtggattatgtttgagtgtggactcgaaaatctgaccatcaagggaggaagacaatccggagctgtgctctacaattcatttggcattatgggtaaagctagcgatacggaaaggggaggagtcttaactagcaacaattcatctgattcccccaccggttcaggctataacacagacgtctcagacgataacctgccttgtgatcggacgagccccagcagtgacctgaatggcaactccgtctccgatgaacaagatgaaggtgtagaatcggacgatctaaaaaaagacctgcccctgatgccgcctccgcctgactcttgcagcatgaagttaaccatcaaggaaatctggttttccttcgctgcgcctactaacgtgagatctcacacccacgcattttcacggcagcttaacctgttaagcacagcaacaccagccgtgggtgcctggctggtgcccatagatcagctgaagagttccctgaataaactggaaactgagggcacactgagaatttgcgcggtgatggggtgtatcatgaccgaggcactagagaataaatccgtccattttcctctgagatccaagtataatcgcctcactaaggttgctaggtttttacaggaaaatccatcttgcttgctgtgcaatattctgcatcactaccttcatcaggcgaactattccatcatcgatgatgccacgatgtccgatggattgccggccctggtgactcttaaaaaggggctagtcgctttagctcgtcaatggatgaaatttatcgtggtcaccccagccttcaagggggtctccctgcataggccagcccaacccctgaagccacagatcgccatggaccatgaacacgaagacggcctagggctcgataatgggggtgggcttcaaagtgacacctcagccgacggagcagagttcgaattcgacgccgctaccgtctcggagcacacaatgctgctggaaggaaccgccaatagacctcctcctggcagttcagggccagttacaggagctgagatcatgagaaaattgtcaaaaactcatacacatagtgatagcgccctaaaaatcaaagggatccatccgtatcactccctgagttacacctctggtgacactgctactgattctcctgttcacgtcgggagggccggcatgcctgtaaaggattctcctcgaaaggagagcttactgtcttatctgactgggagcttcccatccctccataacctccttgaaggcactccgcagcggagttctgccgccgtcaagtcttcttcactcaccagaaccggcaacaccgtcgctacagacatgctgtctgaacatcccctactgagtgagccatcctcagtgtctttttataattggatgtccaatgccgtgggcaacagaggcagtgtccttcaggaatctcctgtcacgaaaagcggccacaatagcctgcccactggtgtggcacccaatctccccactatccccagcgccagcgactttaacactgtgctcagtagtgatcagaacaccttagacgggactcactcccagcattctacctcacaggacgacgtggccggagtggaagaggcgaatcaaggcttccccgccgttcagctggctgacgcccaggtcgtgttcaagcccctcctctctcataccggcattcaaagccaagatacaatgccattctgctacagaatgtacttcggagagcatcttagcttttcggggactctggattgtctccgcgccgacatagtggatagcgatactgcaaaggaaagaaaggggaagcgcgccagacgacagggccacgtaaacttacctccccttgaatttaagccggccctgatgctggggacattctctatctccgccgtcgtaatggaaaagagcgtctgtacgccgcaaaattcaactagcgcgttgagttttcacgacctgtcaaagagatactacaatactttccactgcaactttactatttcctgtcagtctatttcacagcacgttgacatggcgttggtcaggctaatccaccagtttagcaccatgatagacgatataaaagcaacccagacagacattaagctgtcccggtacaccgcaggcagtgcctctcctacccccacattcaagaccagaaaacacagggactttaggagctctgatttctcccgctcatcgcggggaagtctaaatggtggcaaccgggtgaataacgctaaaaacaagcgcaccaacaatgagaataataagaaggagtcacgcaacaaaaactcgctcggtcgcagcgaacgaagaactagtaaagtgtccaggaaaggttctaaggacgtggtggaccatatgaccattcacatggacgatagcgatagcatcactgtgagtgagcagagtgaaccttcagccgaatgttggcagaacatgtacaaactgctaaacttctatagcttaatcagcgatcccactggcatcttggagaaatccagtgagacctttggacccgctggagtgaggtcacctacagaacccacttgtaaggtagtcttcgagaacgaacaggataactcttcgctgaccaagacccagcggaaacggagcctggtgacctctgagccacaacacgtgactctgattgtgttcggtataggaatggtgaatcgcacacatcttgaggccgacataggcgggctgaccatggagtctgagttgaaacggattcatggctcatttacgctaaaggagaaaatgaaagatgtcctgcaccagaagatgaccgaaacctgtgccaccgctcacatcggcggagtgaatatcgtgctgctagaaggcattacccctaatatccagttggaagattttcctacctctcctacctctacagccaaacaggagtttttgacggtcgtgaagtgcagtatcgccaagtctcaagccttatattcagcccaaaggggactcaagactaataacgccgcagttttcaaagtgggtgccatatcaatcaatatccctcaacatcctgcaaccctgcatagtatgatggtgagatcgtctcatcagttgtccaaacagatatcagacctaattagacagccaagtaccgcccctcaacctgtgaaagaggatatcgctacccctctccctagcgagaaaacgcctacttcagtgaatcagacacctgtggagactaacgaatttccacagctccctgagggcctggagaaaaagcctatagtccttaaattctctgccatgctagatggcatcgcaattggcgccgcgctgctgccatcgctaaaggcagagtacaagatgggacggatgcgaagtcatggaatgaccggagcacagactcggtttaccttcgaactgcctaatcatcggctgaggttcacgtcaaaggtttcagccaccgacatgtccacaatcccgccaagcgcttccctgaacttacctccggtgacaatgtcaggcaagtatatcatggaagagcatgacagttactctgatcaggtgtggtcaattgacgagcttcctagcaaacagggctactatctgcaggggaattatctgcggtgtgtagcagaggtgggctccttcgaacataacttaaccactgaccttctcaaccacttggtgtttgttcagaaagtgtttatgaaggaggtgaacgaagtgatccagaaagtcagcgggggtgagcagcccattccactgtggaatgaacacgacggcactgcagatggcgacaagcctaaaatcttactatatagcctgaatctgcagttcaaagggattcaggtgacagctaccacaccgtccatgcgggccgtgcgattcgagacgggattaattgagttagagctgagtaaccggctgcagactaaggcaagccccgggagctcttcctacctgaagttgtttggcaaatgtcaggtggacctgaacttggccctcggccagatcgtgaagcaccaagtatacgaagaggctggaagtgattttcaccaggtcgcctacttcaagacacgcatagggctccgaaatgcactgcgcgaggaaatctccggctcaagcgatagggaggctgttctgatcacactaaataggccaattgtgtacgcacagccagtcgcctttgacagggccgttctgttttggcttaattataaggcagcatacgataattggaatgaacagcggatggccctgcataaggacatccacatggctactaaggaagttgtggacatgctgcctggtatccagcagacatcagcacaagcttttgggacgctgtttctccaattgaccgtcaatgatttagggatctgtttgccaattactaacactgcgcagagcaaccacaccggcgaccttgacaccggttcagctttggtcctcacgatcgagtcaacattgatcaccgcatgtagttccgaaagcttagtttctaaaggacacttcaagaacttctgcattcggtttgcagacggtttcgaaacctcctgggatgactggaagcccgagattcacggagatctcgtcatgaacgcctgcgtagtgcccgatggaacgtacgaggtgtgtagccgaacaacaggtcaggccgccgctgagtcgtcttccgctggcacctggacattgaatgtgttgtggaaaatgtgtggcattgacgtgcacatggatccaaatattgggaagcggctgaacgcccttgggaacacccttaccaccctgactggtgaggaagatattgacgacattgccgacctgaattcagttaacatcgctgatttgagcgacgaggatgaggtggacactatgtccccgacaatccacaccgaggctaccgattatcggagacaggcagcctctgcatctcaacccggggaactgagaggacgcaaaatcatgaagagaatagtagacatccgggaactgaatgagcaagcaaaagtgattgacgacctcaagaaacttggcgcctccgagggaaccatcaaccaggaaattcagagataccaacagctggaatctgttgctgtgaacgacataagacgcgacgtgagaaaaaagctgcgtcgctcgagcatgcgggctgcatccctgaaagataagtgggggctatcttataagccgagctacagtaggtccaagagcattagcgcatctggccgaccccctctgaaacgaatggaaagggcctcgagtagggtaggagagacagaggaacttccagaaatccgtgtcgacgccgctagtcctggccctcgtgtgacctttaacatacaggatacctttccagaggagacggagctagatttgctctcagtgaccatagagggtcctagtcattacagttcaaacagcgaaggttcatgctcggttttttcttctccaaaaacaccaggaggcttctctccaggcattccctttcagacggaggaaggccgacgcgatgactctctgtccagcacttccgaggacagcgagaaagacgagaaggacgaagatcacgagagggagcggttttatatctacaggaaaccttcacacacctctaggaagaaggcaactggattcgccgcagttcatcagctcttcacagagcgctggcctactacccctgtgaaccgctcattgtctggtacagccaccgagcggaacatagactttgagcttgatattcgggttgaaattgatagcggaaaatgtgtcctgcaccccactacactgctgcaggaacatgacgacatctctctgagaagatcatatgaccgaagtagtcgaagtttggatcaagattctccttctaagaagaaaaagtttcagaccaattacgcctccaccactcatcttatgaccgggaagaaggttccaagtagcctgcagacgaagccgagcgacctggagacaacagtgttttacatcccaggagttgacgtgaaactgcactacaacagcaaaaccctgaaaaccgagagccccaacgcatctagaggatcctcgctgcctagaactttgtcaaaggagagcaaactttacggtatgaaagactccgccacctctcccccatcccctccccttccaagtacagtccaatctaaaacaaataccctgctgccccctcaaccacctccgatcccagcagcaaaggggaaggggtctgggggggtcaaaacagctaagctgtatgcctgggttgctttacaatctctgcctgaagagatggtgatttctccctgtcttcttgattttctagaaaaagcccttgaaactatcccaataacgccggttgagcggaactatacggccgtcagttctcaggatgaggacatggggcattttgagatacctgaccccatggaggaatccacgacctccctcgtttcttccagcacatccgcttatagtagcttccccgtggacgtggttgtgtacgtgcgtgttcagcctagccagattaaattctcctgtttgcctgtctcaagagtagagtgcatgttaaaattacctagtctcgacttggtcttttcatccaacaggggtgagctcgagacgctgggaaccacttatcctgctgagaccctgtcccctgggggcaacgcaacacagagtgggaccaaaacgtcggccagcaagaccggtataccagggtcaagcggtctcggcagcccactgggcagatctcggcatagcagcagccagtccgatttgacgtcatcatcctcatctagctcggggctcagctttaccgcctgcatgtcagacttctctctctatgtttttcatccctacggtgcaggcaaacagaagactgcagtaagtggactcaccccaggttctggaggtttgggtaatgtcgatgaggaaccgacaagcgtgaccggacgtaaggattctttatcgatcaatttggagttcgtgaaagtctcacttagtaggattcggcgatcggggggggcctcctttttcgaatctcaatcagtctctaaatctgcaagcaagatggataccactctgatcaacattagcgctgtgtgtgacattgggtcagcaagcttcaagtacgatatgagaagactgagcgaaatactcgccttccctcgcgcctggtaccgcagatctatcgcccggagactatttctgggcgaccagacaataaatctccctacgtccggtcctggaaccccagattcgatcgagggcgtgtcccaacatctgtcccccgaatccagtaggaaggcttattgtaagacttgggagcagccttcccagagtgcctcatttacacatatgcctcaatcgcccaatgtgtttaatgagcatatgactaacagtactatgtcaccagggacagtcggacagtccctgaagagccccgccagtatccgcagcagaagtgtgtccgatagttctgtacctcggcgcgactctctttcaaagacaagtactccatttaataagtccaacaaggctgccagccaacagggcacgccttgggagactctagtcgtgtttgccatcaacctgaaacagttaaacgtccagatgaacatgtctaacgttatgggcaacaccacttggaccacatctggactcaagtctcagggaaggttgagcgtgggctcaaaccgggatagagagatctctatgtcagtcggtttgggtcggagccagcttgattcgaagggtggcgttgtcggtggcacaattgacgtgaacgccttggagatggtggctcatatctccgagcacccaaatcagcagccttcacacaagatccagatcactatggggtcgacggaagctcgggtggactacatggggagctccattctcatggggatattctccaacgcggacctgaaactgcaggacgagtggaaggtgaatttgtataacactctggattcttctattaccgataagagtgaaatttttgttcatggcgatctgaagtgggacatattccaggtaatgatctctcggtctacaaccccagatctgattaaaattgggatgaagctgcaggagttttttacccagcagttcgacacttcaaaacgggcactgtcaacatggggacctgtcccatatctccctccaaagactatgacttcaaatctcgagaaatcgagccaggagcagcttctcgacgccgcccatcaccgccattggccgggggttctcaaagttgtctccggctgccacattagtctctttcagatcccccttcccgaggacggtatgcagttcgggggaagcatgtcattgcatgggaatcacatgacattggcatgctttcacggacctaattttaggtccaagagctgggcacttttccacctggaagaaccgaacatcgccttttggacggaggcacaaaaaatatgggaggacgggtctagcgatcattcaacctatattgtacaaacactggatttccacttaggacacaacacaatggttaccaaaccctgcggcgcactcgagtcccctatggccacgattactaagatcacgaggcgcaggcatgagaatccgcctcatggggtcgcctctgtaaaagaatggttcaactacgtgaccgccactaggaacgaagaacttaacctgctgcggaacgtggatgcgaataataccgagaactcgacaaccgtgaagaacagttctctgctgtccggcttccgaggaggctcctcatataaccatgaaactgaaacgatcttcgctcttccacgcatgcagctagattttaagtcaatccacgtccaggaaccccaggagcccagcctccaagatgccagcctgaaacccaaggtggaatgctcagtcgtcaccgaattcacagaccacatctgtgttactatggacgccgagttgataatgttcctgcacgacctcgtatccgcttacctgaaagaaaaggagaaagccatattccctcccaggatccttagcacaaggccaggtcagaaaagtcctatcataatccacgatgacaactcctcagacaaggaccgggaagacagtataacttacacaacagtggactggcgggattttatgtgtaatacctggcatctcgagccaacattgagattaatctcttggaccggccgcaagatcgatcctgttggggtcgattacatccttcagaagttgggcttccaccatgccagaacaactattccaaaatggctccagcggggggtgatggatcctctggacaaggtcctgagtgtcttaattaaaaaactgggaaccgcacttcaagatgagaaagagaagaaagggaaggataaggaagagcactag

SEQ ID NO: 130445 - DNA, 2772 bp, Artificial Sequence
  Description of Artificial Sequence: Synthetic coding sequence
atgtcccagttcaagcgccagaggatcaatcctcttccaggcggcagaaacttctcagggacagccagtacatccctccttgggccgcctccgggactgctgactccaccggtcgcaaccgagctgtcccagaacgcaaggcatttgcagggaggagaaaagcagagagtattcacaggcatagttacatctctgcacgattactttggggtagttgacgaggaagtgttcttccagttaagcgtggtaaaggggcggttgccccagctgggtgaaaaagtgcttgtcaaagccgcctataaccccgggcaggccgtgccctggaatgcggttaaggttcagactctcagcaaccagcctctgctgaagagtcccgcccctccactcctgcatgtcgcggccctgggccagaaacagggcatcctgggggcccagccccaactgatcttccagcctcacaggattcccccactctttcctcagaagcccctctcgctatttcagacctctcatactttgcatctttcacatttgaacagattcccagctagggggcctcatggacgactcgaccagggcagatcagatgactacgactcaaaaaagcggaaacaaagagccggaggcgaaccatggggtgcaaagaaaccacggcacgatctcccaccctatcgcgtacatcttaccccctatacagtcgatagccctatctgcgattttctggaactgcagcggcgctatcggagcctgttggttccctccgatttcttatcagtgcatttgtcttggctgtctgctttccccctgagccagcccttcagcttgcaccaccccagcagaattcaggtgtcgtctgagaaagaggcggcaccagacgcaggcgcagagccaatcacagccgattcagatcccgcctattccagtaaagtgctgcttctgagcagcccaggactggaggagctctacagatgttgcatgctctttgtggatgacatggcggagcctagagagacgccagagcaccccctgaaacagattaaattcctccttgggaggaaggaggaggaggcagtgctggtcggcggcgaatggtcaccgtctctggatggtctggacccacaggctgatccacaggtgctagtgcgcacagccattcgctgcgcacaggcccagaccggcatagatctgagcgggtgtaccaaatggtggaggttcgctgagttccagtatctacagcccggccccccgcgtagactgcagaccgtggttgtctacctgccagatgtgtggactatcatgcctactttagaggaatgggaggcattatgtcagcagaaagccgctgaggccgccccaccaacacaagaggcgcagggggaaaccgagccaacagagcaggcaccggatgctctggaacaagcggccgataccagcagacgaaacgccgaaaccccggaagccaccacccagcaggagacagatacagatctgccagaggctccaccgcctcccctcgaacctgccgtgattgccaggcctgggtgcgtcaatctttccctgcacgggatcgtcgaggacaggcgtccaaaagaaaggatttcattcgaagtgatggtattggcagagctctttctggagatgctccagagggacttcggctatcgtgtctacaagatgctgcttagccttcccgagaaggtcgtgtccccccccgaacccgagaaagaagaggcggctaaggaagaggcaacaaaggaggaagaagccatcaaggaggaagtcgttaaagaacctaaggacgaagcacaaaacgaggggcccgccaccgagtccgaggcgcctctcaaagaggacggcctgcttcctaagcctctgagctccggaggcgaggaggaggaaaagcctagaggagaagcatctgaggacttgtgtgagatggcccttgaccctgaactgctgctgctgcgggacgacggggaagaagagtttgccggcgcgaagcttgaggacagcgaggtccggagtgtggcttcaaatcagtcagaaatggagttttcctccctccaggatatgccgaaggagctggacccctccgctgtgctccctctggactgtttgttggcttttgtcttttttgacgctaattggtgtggatacctgcatcggcgggatctggagaggatattactgaccctaggaatccggctgagcgctgaacaggccaagcagctagtctcccgcgtcgttacccagaatatctgccagtataggtctctgcaatattctaggcaagagggacttgatggcgggctcccagaggaggtcctctttggaaacctggatctcctgcccccacccggaaaaagtactaagcctggagctgcacctacagaacataaggcattagtgtcccataatgggagcctgataaacgttggctcactcctccagagagcagagcaacaggacagcggccgcctttacctcgaaaacaagatccacactttggaactaaaactggaagagtcacacaatcgatttagcgctactgaggtcaccaacaaaaccctggcagccgaaatgcaagaactacgtgtgaggcttgcggaagcagaagagactgccaggaccgcagagaggcagaagagtcaactgcagaggttgctgcaggagttaaggcgccgtctcactccgttacagctcgaaattcagcgggtcgtcgaaaaagcggactcttgggtggagaaggaggaaccggccccatctaactag

SEQ ID NO: 130446 - DNA, 2982 bp, Artificial Sequence
  Description of Artificial Sequence: Synthetic coding sequence
atgggagcagcaggtcggcaggactttctgtttaaggccatgcttacaatctcttggctgaccctgacatgcttccctggagcaaccagcacagtggccgcagggtgtccagaccagagcccggagctgcaaccttggaacccgggacacgaccaggaccaccacgttcacattggccaaggtaaaacattgctactaacctcctcggctactgtgtactccatacacatctcagaagggggcaagttggtgattaaggaccatgatgagccgattgtactcaggactcgacacatattaattgataatggaggcgagctgcacgccggaagcgccctctgtccttttcagggcaatttcaccatcatcctatatgggcgggctgatgagggcattcagccagacccctactacggtctcaaatacattggcgtggggaaaggtggagctctagaattgcacggacaaaaaaaattgagttggacattcctgaacaagactctgcatccaggcggaatggccgaaggaggctatttcttcgagagaagctgggggcataggggtgtgattgtgcatgtgatcgatcctaagtctggaaccgtcatccactccgaccgctttgatacttatcggtctaagaaggaatccgagagactagtccagtacttaaatgccgtcccagatggaagaattctcagcgtcgccgtgaatgacgaggggtctagaaacctagatgatatggccaggaaggctatgaccaaactcgggtctaaacacttcctccatctgggctttaggcacccttggagcttcctgaccgtgaagggcaatcccagcagctctgtggaggatcatattgaataccatggccaccggggttcagcagccgctagggttttcaagctctttcagacagagcacggcgagtattttaatgtgtcactgtcctctgagtgggtccaggacgtggagtggacagagtggttcgatcatgataaagtcagccagacaaaaggaggggagaaaatttccgacctctggaaagcccaccccgggaagatttgtaaccgccctatcgacatccaggccactacgatggacggtgtgaatttgtccacagaggtggtgtacaagaaaggccaggactatcgtttcgcctgctacgatcgcggacgggcctgtcggagctatcgcgtcagattcttgtgtgggaagccggtgaggccaaagcttacagttaccatcgacacaaacgtaaatagcaccattttaaacctggaagacaatgttcagagttggaagcctggggatactttagtgatcgcaagcactgattactcaatgtaccaggcagaggagttccaggtgcttccctgcagatcatgcgcacctaaccaggtaaaagtggcaggcaaaccgatgtatctgcatataggcgaggaaatcgacggcgttgatatgcgggccgaggtcgggctgctgtcaagaaatattatcgtcatgggagagatggaagataagtgctatccttatcggaatcatatttgtaatttcttcgacttcgatacatttgggggtcacattaagtttgcactcggatttaaagctgctcacctcgagggcactgagttgaagcatatggggcaacagttagtcggacagtaccccatccattttcacttggcaggagatgtggatgagcgtggaggctacgatccaccaacctacatccgcgatctgagcattcaccacaccttctcccggtgtgtgactgttcacggcagcaacggcctgttgattaaagacgtggtcggatacaatagcctgggacactgcttctttactgaggacggccctgaggagaggaatacattcgatcactgtcttggactgctcgtgaagtccggaactctgcttccctccgatagagactccaagatgtgcaagatgattactgaggactcataccccggatatataccaaagccgcggcaagactgcaatgctgtatcaactttttggatggccaacccaaacaacaacctaattaactgtgcagcagccgggagcgaagagactggcttttggttcatcttccaccacgtaccgactgggccatccgtcgggatgtattctccgggctatagcgagcacatcccattaggcaagttctataacaaccgggcacattcaaactaccgtgccgggatgatcattgacaacggcgtgaagacaacagaggcaagtgccaaagataaacggccctttctgtcaatcataagtgcccggtattcccctcatcaggacgccgatcccctcaaacccagagagccggctatcatcagacactttatcgcttacaaaaaccaggatcacggcgcgtggctgagaggtggggacgtgtggctcgactcgtgtaggttcgccgataatgggattgggctcaccctcgctagcggcggcacgtttccctacgacgacggcagcaagcaggaaataaagaattctctgttcgtgggtgaaagcgggaacgttggcacagagatgatggacaatagaatctggggtcctggcgggcttgatcactccgggaggacgctgccgatagggcagaatttccctattcgaggtatccagctgtacgatggtccaatcaatatccagaactgcacgttccgaaagtttgttgctctcgaagggagacacacctctgcattggcctttcgcctgaataacgcatggcagtcttgtccccacaataacgtgacaggcattgcattcgaagatgtgcctatcacctcaagagtgttcttcggtgagcctggcccatggttcaaccagctcgacatggacggtgacaagacttcagtgttccatgatgtagacggatcggtttcagaataccctggctcctatctgactaaaaacgataacaaatggcactcccttgccagcaaagcggcatcaggcccatcggggtag

SEQ ID NO: 130447 - DNA, 4086 bp, Artificial Sequence
  Description of Artificial Sequence: Synthetic coding sequence
atgggcgccgcagggagacaagacttcctcttcaaggccatgctgaccatttcctggctaactcttacctgttttcctggtgccacaagcacggtggccgccggctgtcctgatcaatctcccgaattacaaccatggaatccaggacacgatcaggaccaccacgtacatatcggccagggcaagactttgcttctgacttcatcagcaacggtgtatagtatccatattagcgaggggggtaagctggttattaaagaccatgatgaacccattgtgctacggacaagacatattctcatcgataacgggggtgagcttcacgccgggagtgcactgtgcccgttccagggaaactttactattatcctgtacggtagagccgacgagggcatacagccagatccgtattacgggttgaaatatattggtgtgggtaaaggcggcgcactcgaattacacggccagaagaagctttcatggaccttcctcaataagacattacaccccgggggtatggcagaggggggatatttttttgaacgctcttggggccaccgaggagtgatagtacatgtcatcgaccctaagtctggcaccgtgattcattctgaccggttcgatacatatcgctctaagaaagagtccgagagactcgtgcaatacttaaacgccgtcccggacggcaggattctctctgtcgccgttaacgacgaggggtcaaggaatcttgatgacatggctcggaaagccatgacgaaactaggatcaaagcacttcctgcacttagggttcagacacccttggagttttctgactgtgaaaggtaatccaagctccagcgtcgaggatcacattgagtaccacgggcatagagggagtgcagcggctagagtcttcaaactgtttcagaccgagcatggcgaatattttaatgtctctctttcctccgagtgggtgcaggacgtggaatggaccgaatggtttgaccacgacaaagtgtcgcagaccaaaggaggagaaaaaatttctgacctgtggaaagcccatcccggaaaaatctgcaatcggcctattgacattcaggcaacaacgatggatggcgtgaacctgagtaccgaagtagtgtataagaaagggcaagattacaggttcgcgtgctatgatagagggcgtgcttgccgctcctatcgcgtgagattcctctgcggcaagcctgtacggcctaagctcactgtgactatcgacactaatgtcaatagcaccatcctgaatctggaagacaacgtgcagagttggaagcccggcgacacactggtgattgccagcacagactacagcatgtatcaggccgaagagtttcaggtgctaccttgcaggagctgtgcacccaaccaggtcaaagtggctggaaaacccatgtatttgcatattggcgaggagatcgacggggtggacatgcgtgcagaggtcggcctgctcagccgcaacattattgtcatgggcgagatggaagacaaatgctatccataccgcaatcatatttgcaatttcttcgatttcgacaccttcggggggcacataaaattcgctctgggctttaaagcggcacatcttgaaggcaccgagctaaaacacatgggacagcagttagtcggtcagtatcctattcattttcatctcgcaggcgacgtggacgagcgtggagggtatgaccccccaacctatatcagggatctgtccattcatcatactttcagtcggtgcgtgactgttcacggcagcaacggactattgattaaagacgtggtcggctacaatagcctcgggcactgcttcttcacggaggacggaccagaggaacggaatacgtttgaccattgtctggggttattggttaagtccgggactttgctgcccagcgatagggatagcaagatgtgtaaaatgattactgaggattcatatccagggtatatacccaagcccagacaagactgtaacgccgtgtcaacattctggatggctaatcctaataacaacctgatcaactgcgccgctgctggatcggaagagaccggattctggttcatctttcaccatgtgcccaccggcccttccgtcgggatgtatagccccgggtactctgagcatattcccctgggtaaattttataataatcgggcacactctaactacagggctggtatgattattgataacggtgtgaagaccaccgaggcgtctgcgaaagacaagaggccttttctgtcaataattagcgcacggtactcaccccaccaagatgccgaccccctcaaaccaagggagccagccatcattaggcactttattgcctataaaaatcaagaccacggcgcttggctgcgcggcggcgatgtttggctggattcttgccggtttgccgacaacggcataggactgactcttgcatctggcggaacttttccttatgacgacggatctaagcaggagataaagaattctctgtttgtcggcgagtcagggaatgtagggactgaaatgatggacaataggatctggggccccggcgggttggaccattctgggaggacattgcctatcgggcagaatttcccgattcgggggatccaactgtacgatggcccaattaacatccaaaattgcacctttagaaaatttgtagcgcttgaagggcgtcatacctctgcattggctttccgtctgaataatgcctggcagtcctgtcctcacaacaatgtgaccggaatagcgtttgaagacgtacctattacaagccgcgtgttttttggagagccagggccctggttcaaccaactcgacatggacggggataagacctctgtgtttcacgatgtggacgggagcgtgtctgagtatccaggaagctacctcaccaaaaatgacaactggctagtgaggcatcccgactgcatcaacgtgccggattggcgcggtgccatatgttctggctgctatgcccagatgtatattcaggcatacaagaccagcaatctacgaatgaagatcatcaaaaacgacttcccatcacatccgttgtatttagagggcgctcttaccaggtcaactcactaccagcagtatcagcccgtcgtgacattgcaaaagggatataccattcattgggaccagaccgctcccgccgagctggccatctggctcatcaacttcaataagggcgactggatcagggtcgggctctgttacccccggggcactacatttagcatactaagcgacgtccacaacaggcttctgaaacagacctcgaaaaccggagtcttcgtgaggacactgcaaatggacaaagttgagcagtcatatcctggacgttcacactactattgggacgaggactctggtctactctttctgaagctcaaagcccaaaatgagagggaaaagtttgcattttgttcaatgaaaggctgtgaacggataaagattaaggctcttatacccaagaacgcaggagtgtcagattgtactgccacagcatacccaaagtttactgaacgggccgtagtggatgtgcctatgcctaaaaagctctttggaagccagctcaaaacgaaggaccatttcctcgaggtcaaaatggagtcatccaagcagcactttttccatctgtggaacgattttgcctatatcgaagttgacggtaagaagtatccatcctcagaggatgggatacaagtggttgtgatcgacgggaaccagggccgagtcgtgagccatacatctttcagaaactcaatcttgcagggcatcccatggcaactgttcaattatgtagcaacaatcccagacaatagcatagtgctgatggcctccaaggggcgatacgtctcccggggtccctggactcgagtgctggagaagctcggagcggacaggggcttgaaattgaaagaacagatggccttcgtgggttttaaaggttccttccgcccaatctgggtgaccctggatacagaggaccataaggcaaagatattccaggtagtccctattcctgtggtgaagaagaagaaactttag

SEQ ID NO: 130448 - DNA, 1947 bp, Artificial Sequence
  Description of Artificial Sequence: Synthetic coding sequence
atggaagtcaagggcaaaaaacagtttaccggcaagtccaccaaaacagcacaggagaaaaataggttccacaagaacagcgacagtgggagtagcaagacgtttcccacacggaaggtggctaaggaggggggcccaaaagtgaccagcagaaattttgaaaaatctatcacaaagttaggaaagaagggcgttaaacagtttaaaaataagcagcagggggataagtccccaaaaaataaattccagccggcaaataagttcaataaaaaacgcaaatttcagcccgacgggcgctcagatgagtcagctgccaagaagcccaaatgggatgatttcaagaagaagaagaaagaactgaaacagtctcgacaactgtctgacaaaaccaactatgacatcgtagtccgggcaaagcaaatgtgggaaatcctcaggcgtaaggactgtgacaaagaaaaaagggtcaagctcatgtctgatctacagaaactgatacaaggcaagatcaaaaccatcgctttcgcacacgattctactagagtaatacaatgctatattcaatacggcaacgaggaacaacgaaaacaggctttcgaggagctgagggatgacctcgtggagctctccaaggcaaaatattcacgaaatatcgttaaaaaatttctgatgtacgggtctaagcctcagattgctgaaatcattcgatcattcaaggggcatgtccgcaagatgctccgccacgccgaggcttccgcaatcgtggagtatgcatataatgacaaagccatactggaacagcggaatatgctgaccgaagaattgtatgggaatacctttcagctgtataagtccgccgaccacaggacactggacaaggttcttgaagttcagccagagaagctggagctgatcatggatgagatgaagcagattttaacccctatggcacagaaagaggccgtgatcaagcactcgctggttcacaaagtctttctggatttcttcacatatgcccccccaaagctgcgttctgagatgatagaggcaataagagaggcggtggtctatctggctcacacacacgacggcgctagggttgcaatgcactgcctttggcatgggacaccgaaggacagaaaagtgatcgtcaaaacaatgaaaacttatgttgaaaaagtggccaatggccaatattcgcacctggtactgctggccgctttcgattgcatcgacgacacgaaactggtcaagcaaataattatatccgaaataataagctctctaccgagcatagtgaatgacaagtacggcagaaaagtgcttttgtatctcctctccccaagggatccggcacacactgtacgcgaaatcattgaagtgctccagaaaggtgatggaaatgcccactctaagaaagacactgaagttagaaggagggagctgctggagtctatttctccagccctcctatcctacctacaggaacatgcccaagaggttgtgctcgacaaatctgcctgcgttctggtgagtgatatcctcggctccgctactggcgatgtccagcccactatgaatgccatcgcctctctggctgccactggactccacccaggcggcaaggatggtgaactccacatcgctgagcatccagccggacaccttgtcttaaagtggttgatcgagcaggataagaagatgaaggaaaacgggagagagggctgcttcgccaagactctggtcgagcatgtgggcatgaaaaacctgaagagctgggcgagcgtcaaccggggagccatcatactgagctcgttgcttcagagttgtgatctggaggtcgctaataaggtgaaggctgctctaaagagcctgattcctaccctcgagaaaaccaaatcaacatctaaagggatcgagatcctcttggaaaagctgagtacctag

SEQ ID NO: 130449 - DNA, 339 bp, Artificial Sequence
  Description of Artificial Sequence: Synthetic coding sequence
atgaaaaaccaggtttgcagcaagtgcggggaggggacatacagcctaggcagcggcatcaaattcgacgagtgggatgaactccccgccggattttccaacattgcaacttttatggacacggtggtgggcccatctgattctagacccgatggatgtaacaattctagttggatacctcggggcaactacatcgagtcaaaccgggatgattgtaccgttagccttatctacgcagtccatctgaaaaaatctgggtatgtgtttttcgaatatcagtatgtggataataacatcttcttcgagttttttatccagaacgatcaatgccaggagtag

SEQ ID NO: 130450 - DNA, 1842 bp, Artificial Sequence
  Description of Artificial Sequence: Synthetic coding sequence
atgttcagcgccggcgcagagagtctgctgcatcaggcccgtgagatccaagacgaagagctgaagaagttctgttctagaatttgtaagctgcttcaggccgaagacctgggaccagacacgctggatagtctgcagcgtcttttcctgattatctccgccaccaagtactctagacgtctggagaagacctgtgtagatctcctacaagcaaccttgggattgcccgcctgtccggaacaattacaggttctgtgcgccgccatactgcgggaaatgtcaccatcagactcactgtccctggcatgggaccacacgcaaaactcgaggcagctgagtctggtggcatccgtactgctggcacagggcgatcggaacgaagaggtccgtgccgtaggacagggggttctccgtgccctcgaatcaaggcagccggagggcccctctctgcggcacctgcttcctgtcatggctaaagtggtcgtgttgtcaccaggcacactacaggaagaccaggctacccttctgtccaaacgactggtggattggctgcgttacgcttctctccagcagggtctgcctcatagcggggggtttttctctacccccagggccagacagcccgggcccgtgaccgaggtggatggcgcagtagcaactgatttcttcaccgtactttcttctggccaccgcttcacagacgatcaatggttaaatgtccaggcattttcgatgctgcgcgcatggctgctccacagcggtcctgagggtcccggcaccttggataccgatgacaggtccgagcaggaaggatccactcttagcgtgatatccgccacaagttctgccggtcgtctgctcccgcctagggagcggctgagggaggtggcgttcgagtattgccagcgccttatcgaacaaagtaacagacgagccctgcgcaagggggatagcgatctccagaaagcgtgcctggtagaggctgtgctggtgctggatgtgctgtgccggcaggatccgtcattcctctaccggagcctctcgtgcttgaaggccctgcacgggagggtgcgcggggatccagcttcagtccgcgtactcctcccactcgcccactttttcctcagccacggagaggcggcggctgtggacagcgaggcagtctatcagcacctctttaccaggatacccgttgagcagttccattcgcccatgctcgcctttgaattcatccagttttgccgcgacaatctccatttgttctcagggcatctgtcgaccctccgcctctcatttcccaacctgttcaagttcctggcttggaatagccccccactgacgagtgaatttgtggcactcctcccagcactggtggatgccgggacagccttagaaatgctgcatgctctcttggatctgccatgcttgaccgcagtacttgatttgcagttacgatccgcccctgctgcctccgagaggcctttgtgggatacttccctgagagctccctcatgcctggaggcttttcgcgatccacaattccaggggctgttccagtacctgctgagaccaaaagctagcggggcaactgaaaggttggcccctctgcaccaactgctgcagcctatggctggttgtgcccgggtcgcccagtgtgctcaggcggtgcctactctgctgcaggctttcttctctgccgtgacccaagtggctgacggcagtctgataaatcagctggcccttctcctgctggggcggtccgactctctgtacccagcgccggggtacgcggctggagtgcataggcctgatgcttgccgccccatacttgtacccttatag

SEQ ID NO: 130451 - DNA, 918 bp, Artificial Sequence
  Description of Artificial Sequence: Synthetic coding sequence
atggagaaggagacatataaaaccgctaaattgattctagagcgattcgaccctgactcgaagaaagccaaagagtgtgagccgcccagcgccggggcagcggtgactgccaggccgggacaggagatacgccagagaacggccgcccagcgaaacctcagtcccactcctgcgtcgccaaatcaggggccaccacctcaggtaccagtcagccccggtccccccaaggactcatctgctccagggggacctcctgagcgaaccgttacccccgctctttcctctaatgtgctgccgcggcatttgggctccccggctacttcagtgcccggaatgggtctccaccctcctggaccacctctggctcgccctatccttcccagggaaagaggcgccctcgatcgcatcgtagagtaccttgtgggtgacgggccgcagaaccggtatgcactgatttgtcaacagtgcttcagccataatggaatggcactgaaggaagaatttgaatacattgccttccgctgcgcctactgcttttttctgaatcccgcaaggaagacccgaccgcaggctcctcgcctgcctgagttctcctttgagaaacgacaggtagtcgagggctcatccagcgtcggaccgctaccatcaggcagcgtgctgtcgtccgacaaccagttcaatgaagaatctttagaacacgacgtgctggacgataataccgaacagaccgacgataagattccagccactgaacagacgaatcaggtgattgagaaggcctcagactcagaagagcccgaggagaaacaggaaacagagaacgaggaggcctctgtcatcgagaccaactccactgtgcctggagctgattccattccggaccccgagctgagcggggagagcctgacagccgaatag

SEQ ID NO: 130452 - DNA, 2589 bp, Artificial Sequence
  Description of Artificial Sequence: Synthetic coding sequence
atgcattcaagttggattccaaggggaaattacatcgagtccaacagggacgactgcaccgtttccctgatctacgcagtgcacctcaagaaatctggctatgtattcttcgaatatcagtatgttgataacaatatttttttcgaattctttatccagaacgaccagtgccaggaaatggacacaactactgacaaatgggtgaagctaaccgacaacggcgaatggggctcccattcagtcatgctcaaaagcggaaccaatattttgtattggaggactacaggtattttaatgggatctaaggccgttaaacccgttttggtgaaaaatatcaccatcgagggggtggcatatacttctgaatgctttccctgcaagccaggcacattttcaaacaagcccggtagtttcaattgtcaggtgtgcccacgaaatacatactctgagaagggggcaaaggagtgtatccggtgtaaggacgatagccaattttccgaagaaggctcatccgagtgtaccgaacgccccccctgcacaacaaaggattattttcagatccataccccatgcgatgaggaagggaagactcaaatcatgtacaagtggattgagccaaagatctgtcgcgaggacctgacagacgctatacgactgcctccatccggtgagaagaaagactgcccaccttgtaatcccggtttctacaacaacggtagcagttcctgtcacccatgccccccgggcactttctcggatggtaccaaggagtgcagaccatgcccagccggaacagagccggctctaggcttcgaatataagtggtggaatgtgttacccggcaatatgaagactagctgctttaacgtgggcaactccaagtgtgacgggatgaacggttgggaagtggccggggatcacattcagagcggagcagggggatcggataatgattatctgatcctgaacttgcacattcccggttttaagcctccaacttccatgacaggcgcaacgggaagtgaactcggacggatcacctttgtatttgagaccctctgctctgcagactgcgtcctatatttcatggtggacattaaccgaaaatccaccaatgtggtagagtcctggggcgggaccaaggagaaacaggcttacacccatattatttttaagaacgctacattcacattcacgtgggccttccagagaaccaatcagggtcaggataatcgcagattcataaatgatatggtgaagatttatagcattaccgccaccaatgccgtggacggcgtagcgtccagctgccgcgcctgcgccttaggatccgagcagtccggatcatcatgtgtcccatgtccaccaggccactacattgagaaagaaacaaatcagtgcaaagaatgcccgcctgatacttacctgtccatacatcaagtctacgggaaagaggcgtgtatcccctgtggccccgggagcaagaataatcaagaccactccgtgtgctattccgactgctttttttatcatgaaaaagagaatcagtctctccattatgacttctctaacttatcttcagtagggtccctcatgaacggtcccagcttcacttccaaagggacaaagtacttccacttttttaatatctcactgtgtggccacgagggaaaaaagatggctctctgcacaaataatattacagactttactgttaaggagattgtggccggaagcgacgactacaccaaccttgtaggagcctttgtctgtcagagtacaattatcccttcagagagcaaaggctttagagcagccctctctagccaatctattatccttgccgacacctttatcggagtaactgtcgagacaacactcaagaatattaatatcaaggaggacatgtttccggtgcctacttcacagattcctgatgtgcatttcttttacaagtccagcaccgctaccacctcatgtattaatggtaggtccacggcagtcaagatgagatgcaaccccaccaaaagcggggccggcgtgatttcagttccatcgaagtgcccagcaggcacgtgcgacggctgtactttttatttcctgtgggaaagcgctgaagcgtgccccctttgcacagaacatgatttccacgagattgagggggcctgtaagcgcggctttcaagagaccctgtacgtttggaacgagcctaaatggtgcattaaaggcatcagcctgcccgagaaaaagctggctacatgtgagacagtcgacttctggcttaaagttggggccggagttggtgctttcaccgcagtcttgctcgttgctttgacctgctacttctggaagaagaatcagaagctcgaatataaatactccaaactagtaatgactactaactcaaaggaatgcgaattgcctgccgccgattcctgcgccattatggagggcgaggacaacgaagaggaagtggtgtattctaataagcagagcttattgggaaagcttaaatcgctagcaaccaaggaaaaagaggaccatttcgagtcagttcagcttaagacttcacggtcccccaacatatag

SEQ ID NO: 130453 - DNA, 5853 bp, Artificial Sequence
  Description of Artificial Sequence: Synthetic coding sequence
atgccgggggcacgcagacgccgccggggagcagcaatggagggcaaaccaagggcgggagtagctctggctcccggaccatccggcagacgcccctcagctagatgcgctagacgacgaaggccgggactattgctgcccggactgtggttgctcttactggcgaggccagccagctgtgctcctgacgagctgtccccagaacaacataatctgtccttgtacagtatggaactcgtacttaaaaaatcaacaggtcatagcgctgcccaggtggctctcacagaaacagcccccggttcacagcacagctcacccttacatgtgaccgcacctcctagcgctacaactttcgacaccgctttctttaatcaagggaagcagacaaaatccacggcggacccttccatctttgttgccacgtatgtaagcgttacatccaaggaagtggcagtgaatgacgatgagatggataactttttgcctgacacacactggaccacacctagaatggtgagccccattcaatacataaccgtgtccccccccggtctcccccgcgaggcacttgagccaatgctgaccccatccttgcccatggtgagtctgcaagacgaagaggtaacctcagggtggcaaaacacaacaagacagcccgctgcttacgcagagtccgcttcccacttccatacattccgctccgcttttcgtacttctgagggaatcgttccgaccccaggcagaaatctagtgctctaccccacagacgcgtattcccacctgtcgagccgtacgctcccggagatagtggcatcgctgaccgaaggagtggagacgacactgttcctgtctagccgctctctgatgcctcagccgctcggcgatggcatcactataccactccctagccttggagaggtgtctcagcctcccgaagaggtgtgggccaccagtgctgaccggtatactgatgtgacgaccgtcttgagccagtctctggaggaaacgatctcccctcgcacctatcctacagtgaccgcttcccatgctgccctggccttctcacgcacccatagccccctgttgtccacgccgttagcatttgcttctagcgcctctcccactgatgtttcgtctaacccgttcctgccctccgattcaagcaaaactagcgagctccactcaaactctgccctccccggcccggtggataacacccatatcctcagtccagtgtccagcttcaggccttacacatggtgtgctgcatgcacagtacccagtccacagcaagtattggccacaagtctgatggagaaagatgtgggctctggggatggggccgagaccctgtgcatgactgtgctggaggagagtagcatcagtctgatgtcaagcgtggttgccgatttcagcgaatttgaagaggacccgcaagtcttcaacaccttgttcccaagtaggcccatagtgcccctctctagcagatcaatggaaattagtgaaacaagcgtgggtatatcagcagaagtagacatgtccagtgtgaccacgacacaggtaccgccagcacacggccgtttaagtgtgcctgcatctctggacccaacagctggtagtcttagtgtcgcggaaactcaggtgaccccctcttctgtaacaaccgcgttttttagcgtaatcaccagtattctcctcgacagcagtttcagtgttatagccaataaaaacacaccgtcacttgccgtgcgagacccttcagtgttcacaccttacagtctcgtgccctctgtggagtcatcattatttagcgatcaggagaggtcctccttctccgagcataagcctaggggcgcccttgatttcgccagctcctttttttccacgccacccctcgagttgagcgggagcattagcagcccaagtgaagctccagctagtttatccctgatgccttcggatctgtccccttttaccagccaatcattttctccactcgtagaaacattcacattgtttgactctagcgatcttcaatctagtcaattgagcctgcctagcagtacaaatctagagttctctcagctccagccgtcttcagaactaccactgaatacaatcatgttgctacctagtagatcggaggtttctccgtggtcttcattcccttctgattccctcgagtttgtcgaagcttctaccgtttcactcactgactccgaagcccacttcacatctgcctttatcgaaaccacctcttacttagaatcaagcctcatctctcacgaaagcgcagtaaccgccctcgtaccgcccgggtctgagagcttcgatatcctcacagccggaattcaggccaccagtcccctaacaactgtccatactaccccaatcttaaccgagagctccctcttcagtacccttacacctcccgacgaccagatttcggcacttgatgggcacgtgagcgtccttgcgagtttctcaaaagccattcccacagggaccgtgcttatcactgatgcctatctaccttctggctctagcttcgtttctgaggcgaccccattccctctccccactgaactgaccgtggtgggcccgtccttaactcccacagaggtgccactcaacacctcgaccgaggtgagcacgaccagtaccggcgctgctacaggcggcccccttgattctactctgatgggagatgcagcgtcgcaatctcccccagaatcttctgccgctcctccactgccctcactgcgaccagtaactgcattcactctcgaggccaccgtggatactcctacactagccaccgcgaagccaccctatgtttgtgacattacagttcctgacgcgtacttaattaccaccgtgctcgctcgtagagctgtgcaggagtacatcataacagccataaaagaggttctccggattcactttaatagagcagtggaattgaaggtctacgagttatttaccgactttactttcctggtgactagcggcccattcgtctatacggctatatctgtaattaatgtgctgattaactcaaagttagtgagggaccagacccccctaatcctgtcggttaaaccttcttttctcgtccctgagtctaggttccaggttcagacggtcctgcagtttgttccgccgagcgtggacaccgggttctgcaactttactcaacggattgagaagggtcttatgaccgccctctttgaagtccgcaaacaccaccaagggacctataacttaacagtgcagatcttgaacatcaccattagctcctcccgagtgacaccccgccgaggtcctgttaatattatttttgctgtgaagtcaacacagggctttctcaatggttctgaggtgagtgagctgttaagaaacctgtcggtggtggaattttcattctacctggggtaccccgtcctgcagattgcagagccttttcagtatcctcaactgaatctaagtcaactgctaaagagttcctgggttagaacagtcctgttgggggtgatggaaaaacagcttcagaatgaagttttccaagccgagatggagcgcaagctggctcaactgctgtccgaggtaagtacgcggcgccgtatgtggaggcgcgctactgttgctgcaggaaattcagtggtgcaggtggtgaacgtttcaaggctggagggagacgacaatcccgtccagcttatttatttcgttgaagatcaggacggcgagcggctatctgccgtgaaatccagtgacttgattaacaaaatggacctgcagcgagctgcgatcatactaggataccggatccaaggggtgatcgcgcagccagtcgatagggttaagcgccccagtcccgagtcccaaagcaacaatttgtgggtcattgtcggagtggtgattcctgttctggtagttatggtcatcgtggtgattttgtattggaaactgtgcaggactgataagttagacttccagccagacacagtagccaacatccagcagagacagaagttgcaaattccaagtgtcaaaggcttcgacttcgctaaacaacaccttggtcagcacaacaaggacgacatactgatcatccacgagccagcccccctgccaggtcccttgaaggaccacacgaccccgagcgaaaatggggatgtaccctcacctaaaagcaaaataccaagcaagaacgtgcgacataggggacgagttagcccatcagatgccgattcaacagtgagcgaggaatcgagtgagcgagacgccggtgacaaaactcccggtgccgtaaacgatggcagaagccatcgcgccccgcaaagcggccccccactcccctcatccgggaacgagcaacattcatccgcctccatcttcgaacatgtggatagaattagtcggcctcccgaagcaagtaggagagtgccctcaaaaattcagctgattgctatgcagcctatcccagcgccgcctgtacagagaccatcccccgctgatcgggtggccgagagcaacaaaattaacaaggagatacagaccgccttgaggcataagtccgagatcgagcaccacaggaacaagattcgacttcgtgctaagcggagaggccattacgaattccctgtggtcgacgacttgtcgtcaggtgatacaaaggagaggcacagggtatataggcgtgcacagatgcagatagataaaattcttgacccgacagcgagcgttcccagtgtgttcattgagccaaggaagtcctccagaatcaagaggtcccccaagcctagacgcaaacaccaagttaatggttgccctgcagatgcagagaaggatcgtctgatcacaacggacagtgacgggacctaccgaagaccaccaggcgtacacaattctgcatatatcggatgcccctcagaccccgacctgcctgcagatgttcagactcccagcagcgtcgagctggggcgctatccagcgctacccttcccagcgtcacaatatatccctccacaacccagtatagaggaagcgcgccagaccatgcacagcctcctggacgacgcattcgctcttgtggccccttccagtcagcccgctagtaccgccggggttggacccggcgttccaccaggcctcccagcgaactccacacccagtcaagaagagaggagagcaacccaatggggcagcttttactctcctgctcaaacggcaaataatccctgctcgagatacgaagattacggcatgacgcccccaaccggcccactccctcggcctgggtttggccccgggcttcttcagtccaccgagctagtgccacctgatccccaacagccacaggcatctgcggaggcgccatttgcagcgcgaggcatctactcagaagagatgccaagtgtcgcccggcccaggccagtcgggggtacaacagggtcccagatccagcacctgactcaagtgggcattgcgtctagaatcggtgcccagcctgtggaaatccctccctcaaggggatctcagtacggcggtccaggatggccaagctacggagaggacgaggctggtaggcgagaggccactcatatgctcggccatcaggagtattcctcttcaccattatttcaagttcctcgaaccagcggacgggagcccagcgccccaagcggaaacctcccccacagagggttgcaaggtccaggcctgggctatcccaccagttccacggaggacctgcagcccggccattcttccgcctccctgattaaggcaattagagaagagctcctgcgactctcccaaaagcagagcacagtacagaatttccatagctag

SEQ ID NO: 130454 - DNA, 357 bp, Artificial Sequence
  Description of Artificial Sequence: Synthetic coding sequence
tgaaagagtaacggaaaaacagccatcggggatcctgggagagctaatatgcctggttataatgaagactctaggtcgacctttttcgacaaaaagtattctaacatgagtacattgggaaacaacggccctacacataagaagctctatagacataagagctcttctaaggcccttcgggatgagaagtgtaagggaaagcacatggaacgagagcaggtgcataaggatgagtcaggcacagcttccttcgagaaattgagagatagtgactacaacctcctgaaagccgaaaccaccttctgggtgctgcccgtgttcgaggaagaaaccagaatctttcagaaggatatctag

SEQ ID NO: 130455 - DNA, 3084 bp, Artificial Sequence
  Description of Artificial Sequence: Synthetic coding sequence
atgagggtatctcacacattccccgtcgtggattgtaccgccgcttgttgtgatctgagtagttgcgatttagcatggtggtttgaagggcgttgttatctggtttcttgtccacacaaagagaattgcgagcctaaaaagatgggccccatccgatcctatctaactttcgttctgcgacccgttcagagaccagcccagctgttggactacggggacatgatgctcaacaggggatcccccagcgggatctggggagattcaccagaggacatccgtaaagacctgacattcctaggcaaggactggggattggaggaaatgtcagaatacagcgatgattaccgggagctcgaaaaagatctgctgcagccttccggaaaacaggagccacgaggaagtgctgagtacaccgactggggcctgctgcccgggagtgagggcgcttttaacagctcagtgggcgactcacctgctgtgccagcagagacacaacaggacccagaattacactatcttaacgagtccgcttcaacccctgcacctaagctgcccgaaagaagtgtcctgctgcctctgccaaccaccccaagctctggcgaagttctggagaaagaaaaggccagccaactgcaggaacagagctccaactcttcagggaaggaagtcctgatgccttcccatagtcttccaccagcttctctggaactcagctcagtcaccgtggagaaatctccagtgctcaccgtgaccccgggttcaacggagcacagtatccccactcctcctacttctgccgcccccagtgagagcactccgagcgaactgccaataagtccgaccacagcccctaggaccgtgaaggaactgaccgtatcagctggtgataatctcatcatcaccttgccagacaacgaggtagaactgaaggcatttgtagctccagcgccccccgtcgaaaccacttacaattatgaatggaacctgatctcccaccctacagactaccagggagaaatcaaacaggggcacaaacagacacttaatctatcccagctgagtgtcggattgtacgtgtttaaggtcacagtgtcaagcgagaatgcttttggggaaggtttcgtgaacgtgactgtgaagccagcacggagggttaaccttccccctgtggccgttgtgtctccccagttgcaggaattgactctgcccctgaccagcgccctcattgacggttctcagagcactgatgataccgaaatagtcagctaccactgggaagaaatcaacggcccatttattgaggaaaaaacttctgtcgacagcccagtcctcaggctgtcaaatctcgacccaggtaattatagcttcaggttaacagtcacggattcggatggggctacgaattccacgaccgccgccttgattgtcaacaacgctgtcgactacccaccggtcgctaacgctggaccaaaccacacaatcactttgccacagaactccattaccctgaatggaaatcagagttccgatgaccatcaaatcgtactgtacgagtggtccctcggcccaggctctgaagggaagcatgttgtgatgcagggcgttcagactccctacctgcacctatctgctatgcaagagggagattacacatttcagctcaaggtcaccgactcatcaaggcagcagagtactgcggttgtcacagtcattgtccaaccagaaaacaaccggccccccgtagccgtcgcaggccccgataaagagctgatcttccctgtggagtccgctaccctcgatggctcctcatctagcgatgaccatgggatagtgttctaccattgggagcatgtgcggggcccctccgctgttgagatggagaacatagacaaagctatagccaccgtgactggccttcaggtcggcacttatcacttccgcctgacagtaaaagaccagcagggtttgtcctcaactagtactctcaccgtagccgtgaaaaaagaaaataactcccctccccgagcacgggccggcggtcgccacgtcttggtgctgcccaataacagcattactctggacggcagccggagcaccgatgatcagagaattgttagctatctgtggatccgcgacggtcaaagcccagccgctggggacgtgatagatggttcggaccattcagttgctctgcagctgacaaatttggttgagggagtttacaccttccatcttcgggttacagacagccagggcgccagtgatacagacactgcgacggttgaagtgcagcccgacccacggaagagtggactggtagagctcaccctgcaggtgggggttgggcagcttaccgaacagcgcaaggacactttagtgcggcaacttgcagtcctcctcaacgtattggattcagacataaaagtccaaaaaatacgcgctcacagcgacttaagcactgtgattgtcttctatgttcagagccgccccccttttaaggtgttgaaagctgcagaggtcgcccggaacctccacatgagactctctaaggagaaagcagacttcctgctgtttaaggtgttgcgggtggacaccgccgggtgcctgctaaagtgctcagggcacggccattgtgatcccctcacaaaacgttgcatctgttcgcacctgtggatggaaaatctgatccagcgttacatctgggatggagaaagtaattgcgaatggtccatcttctacgtcaccgtcctcgcctttaccctgattgtactaactggaggcttcacgtggctgtgtatttgctgctgtaaaagacaaaaacgcaccaagatccgcaaaaaaacgaaatacaccatcctcgacaacatggatgagcaggagaggatggagctgaggccaaagtatgggattaaacacagatctacggaacataatagctcgttgatggtgagtgagtcagagttcgattccgatcaggataccatattttcccgtgagaaaatggaacgaggcaacccaaaagtgagcatgaacggtagtatccggaacggcgcatccttttcatattgttctaaggatcgttag

SEQ ID NO: 130456 - DNA, 1821 bp, Artificial Sequence
  Description of Artificial Sequence: Synthetic coding sequence
atgggaaacacctgtagggtgtgctaccaactggaagccatcaagagaagtaacgaaatgtcaaacgtgatgggcaataccacctggacaacatctggcttaaaatctcagggcagacttagtgtcggatcaaacagagaccgagaaattagtatgagcgtgggtttgggccgaagccagctggatagcaaagggggcgtggtcggcggcaccatagatgtgaacgcactggaaatggtggcccacattagtgaacacccgaaccaacagccatctcacaagatccagatcaccatgggttccactgaggctcgcgtggattacatgggcagctctattctgatgggcatcttctctaacgccgaccttaagcttcaggacgagtggaaggtgaatctctataacactcttgatagctctattactgataagagtgaaatctttgtgcatggagatctgaagtgggacattttccaggtgatgatatcccgcagtacgacccccgaccttatcaagattggaatgaagctgcaggagttctttactcagcaatttgatacatccaagcgagctctatctacatggggccccgtgccctatctgccacctaaaacaatgacgagcaatctcgaaaagtcttcccaggagcagcttctggacgctgcccaccacaggcactggcctggggtattgaaggtcgtcagcggctgccatatctcactgttccagatcccacttcccgaggacgggatgcaatttggcgggtctatgagcctgcacggcaaccacatgacacttgcatgcttccatgggcccaattttcgtagtaaatcttgggctctttttcacctcgaagagcctaatatcgccttctggaccgaagcccagaaaatctgggaagacggaagcagtgatcacagtacgtacatcgtgcagacactagattttcatctggggcacaacacgatggtcactaaaccatgcggagctctggaaagtcctatggcaaccatcacaaaaataactcgccggcgccacgaaaatcccccacacggagtcgcctccgtgaaggagtggttcaattatgtaacagcgacacgcaacgaagaacttaatctcctgcggaatgtcgatgcaaataatactgagaactcaacaaccgtgaaaaattctagtctcctcagcgggtttcgaggcggtagctcttacaatcacgagactgagactatcttcgctcttcctcgaatgcaactggatttcaagagtattcacgttcaggagccacaggaaccttctctacaggacgcttccctcaagcccaaggtggagtgctccgtggtgacagagtttactgaccatatttgcgtgacaatggacgccgaactgattatgtttttgcacgacctggtttctgcctatttgaaagaaaaggagaaggcaatatttccgccaagaatcctcagcacacggcccggccaaaaatcgccaattattattcatgacgacaacagtagcgacaaggacagggaagacagtatcacatacacaactgtcgactggcgcgattttatgtgcaacacctggcacctcgaaccaacattgcgcctgatctcatggaccggaagaaagattgatccagtgggggttgattacatcttacagaaactcgggtttcatcacgctagaaccacaattcccaagtggctccagcgaggcgtcatggatcctctagacaaagtactgagcgttctaataaagaagctgggaaccgccttgcaggacgagaaagaaaaaaaaggaaaagacaaggaagagcactag

SEQ ID NO: 130457 - DNA, 5805 bp, Artificial Sequence
  Description of Artificial Sequence: Synthetic coding sequence
atgcctggtgccaggcgacgcagaagaggggcagccatggaaggaaaacctcgagccggggtggctctcgcgcccgggccctccggccgccgcccgagcgcacgctgtgcgcgccgcagaagacctggtctcctgttgcccggtctgtggctcctgctcttggcccgccccgcttcatgcgcaccagacgagctgagccccgagcaacataatcttagtttatacagtatggagcttgtgctcaagaagtctaccggccactccgccgcgcaggtggcccttacagaaacagcacccggctcccagcactcctcccctctgcacgttactgcacctccaagtgccacgacttttgacactgctttctttaaccagggaaagcagactaagtcaacagccgatccgtcaatcttcgtggccacttatgttagcgtgactagtaaggaggttgcagtgaacgacgacgagatggacaatttcctccccgacactcactggaccacacctagaatggtttcacctattcagtacatcaccgtcagtcctcccggactgcctagagaagcattagagccaatgctgaccccgtcactgccaatggtgtcccttcaagatgaggaagtgacaagcggctggcagaacaccacacgacagcctgccgcatacgccgagagcgctagtcatttccacacctttcgcagtgccttccggactagcgaggggattgttcctacgccaggcaggaacctggtactgtaccctacagatgcttattcacacttgtcttctagaaccttgccggagattgtggcctctcttactgaaggtgtggagaccacattgtttctgagctcaagatctctgatgcctcagcctctgggggatggtatcactatccctctgccgagtctgggggaggttagtcagcctcctgaggaggtatgggccactagtgccgaccggtatacggacgtgaccaccgtactgtcacagagcctggaagaaaccatatccccccgtacgtatcctactgtgaccgcgagccacgcagcactggcattttctaggacacattcccccctcttatctacgcctctcgccttcgcaagcagcgcctcgcccaccgacgttagcagcaatccgttcttaccgtcagactcttcaaaaacctctgagttacactcaaactctgcacttcctggaccagtagacaacacccacattttgtcccccgtcagtagctttcgaccatacacgtggtgcgccgcctgcaccgtcccatctcctcagcaagtgctggctacatcactgatggaaaaagatgttgggagcggagacggcgcggagacattgtgcatgacagtgctagaagaatcctctatctcactgatgagctcagttgttgctgacttcagcgagttcgaggaagatccccaagtgttcaacacgttattcccaagtcggcctattgtccccctgtctagcagaagcatggaaatttcagagacgagcgtgggcatcagcgccgaagtcgacatgtcaagtgtgaccactacacaagtccctcccgctcacggcaggttgtccgtaccggctagtcttgaccccactgctgggtctttgtccgtcgcggaaacacaagtcacccccagcagcgtgaccaccgcattcttctcagtgatcacttcaattctattggatagcagcttctccgtcatcgctaacaagaacacaccttctcttgctgttcgggacccatccgtttttacaccatatagcctcgtaccctctgttgagtcaagtttgtttagcgaccaggagcggtcctctttctcagaacataaaccccgcggggctctcgattttgcttcatctttcttctctactccaccattagagctgtctggcagcataagcagccctagtgaagccccagcttccctcagcttgatgccgtccgatctctctccgttcacctcacaatccttttcacccctggtagaaacatttacactgtttgactcttccgatctgcagagttcccagctttccctgccctccagcaccaacctcgaattctctcaactgcagccatcttctgaattgcctttgaacactattatgctgttaccttcccgcagcgaagtgagcccttggagctctttcccaagtgacagtctggagtttgttgaggcatccaccgtctccctcaccgatagcgaggcccacttcacaagtgcctttatcgagacaacttcatatctggaaagcagcctgatcagtcatgagtccgcagtcacagcgctggtgccccccgggtccgagtcttttgacattctcaccgccggtattcaggctactagtccgctcacaaccgtccatacaacccctattttgacagaaagcagcttattttcaaccctcacaccaccggatgaccagatcagtgccctggatgggcatgttagcgtactcgcctcctttagtaaagctatacccacaggaacggtgctcattactgacgcctacttgccatcgggaagctcctttgtcagtgaggccaccccgtttccattgcccactgagctgacagttgtggggccctcccttacacccactgaggtgcccctgaacacaagtaccgaggtatcaacaactagcactggcgccgccacggggggacccttggattctacactgatgggcgacgccgcctcacagtcccctccggaatccagtgcggccccacccttaccctcacttcgtccggtgacagcttttacccttgaggctacagtagatacaccaacgctcgctaccgccaagcctccatatgtatgtgatattactgtgcctgacgcctacctgataacaaccgtgcttgcgcgcagggcagtgcaggagtacattataactgctatcaaagaagtgctcaggattcactttaatagggcagtggagttgaaggtgtatgaactgtttactgatttcacttttctcgtaactagcgggcccttcgtgtacaccgcaatttctgtcattaacgtgctgatcaattccaagctagtacgggaccaaacccctttgatcctgtctgtgaagcctagcttcctggtgcccgagtcccggtttcaggtgcaaactgtgcttcagttcgtgcccccctcagtggacactggattctgtaatttcacccagcgtatcgaaaaagggctgatgacagccttatttgaggtccgcaagcaccatcagggaacctacaatttaacagttcaaatcctcaacatcacgatctcttcatctcgagtgacaccacgacgcgggccggtaaacatcatatttgctgtcaagtcaactcagggatttcttaacggatccgaggtgtctgagctcctgcgcaatctgtcagttgtggaatttagcttctatctgggatacccagtgcttcagatagctgagccttttcagtatccccagctgaacctgagccagctgctcaagagttcatgggtgaggacggttctgctgggcgttatggagaaacaactgcaaaatgaagtgttccaggctgagatggaacgcaaattggcccagctactgagcgaggtgagcacccgcaggaggatgtggcggcgagccacggtagctgccggcaattccgtggttcaagtggttaacgtgtcacgcctggagggggacgacaaccctgtgcagcttatctacttcgtggaagaccaggatggcgagagactgtcagccgtgaagtcgtcggacttaattaataaaatggatctgcagcgggctgccatcatcctgggatatcggattcaaggcgttatcgcacaacccgtggatagggtgaagcggccatctccagagtcgcagagcaacaatctgtgggtaatcgtaggcgttgtgatccccgtgcttgtggttatggtgatcgtcgtaatactgtattggaaactttgtcggactgacaagctcgattttcagccagacacagtcgccaatatccaacagcggcagaaactacagatccctagtgttaagggtttcgactttgccaagcaacatctaggacagcacaacaaggacgacatactgattatccatgagcccgcccccttgcctggaccgctcaaagaccatactactccctctgaaaatggagacgtaccaagtccaaaaagtaagattcctagtaagaatgtacggcaccgcgggagagtgagtccttctgacgctgactccactgtgtcagaggagagctcagaacgggacgccggggacaagacaccaggcgctgtaaacgatggacgctcacacagggccccacagtcaggccctcccttgccctcctcagggaacgagcagcactcaagcgccagtattttcgagcacgttgacagaattagtaggcctcctgaggcgtcgaggagagtgccttcaaagattcagctgatagctatgcagcccattcccgccccgccagtgcagcgaccatcacccgctgatcgtgtagcggagtcaaacaaaatcaataaggagatacagacagcactgcgccacaagtcagagatcgaacatcaccgtaataagatacgcctcagagccaagaggcgcggccattacgagtttccagtggtggacgatctctcctctggcgataccaaagagaggcatcgggtgtaccggcgagctcaaatgcagatcgataagattctcgaccctaccgcaagtgtaccttcagtgttcattgagccaagaaagtcgagccgtattaagaggtcaccaaagcctcggcgcaagcaccaagtaaatggttgccccgcggatgccgagaaagaccgcctcatcaccaccgattcagatggaacatacaggcgacctccaggtgttcacaacagtgcatatattggatgtccgtctgatcctgacttaccagcggacgtccagactccgtccagcgtggagctgggtcgttatcctgcccttcctttccccgcgagccagtacatcccccctcagccctctatagaagaggctcgccaaacaatgcacagcctgttagacgatgccttcgctttggtcgccccctccagccagccggcttccacagctggagtgggtcccggagttcccccgggcctccctgcaaattcaaccccgtcacaggaggagaggagggccacccagtggggatctttttacagccccgcgcagacagccaataacccttgcagccgatacgaggactatggaatgaccccacccacgggtccgctgcctcgccccggatttggccccgggttgctgcaaagcacagaactagtgccccctgacccccagcagccacaagcctctgccgaggccccctttgccgccaggggtatctattccgaggagatgcccagtgtggcacgccctaggcccgtgggaggaacgacaggcagccagatccagcatctgacccaggttggcatcgcatcacgtatcggggcgcagccagtggaaattcctcccagcaggggttcccaatacggcggaccagggtggccatcatacggagaagatgaagccggacgccgtgaggccgtgcccagaacatccggtcgagagccatccgccccatccggcaacttgccgcatagaggtctacaagggcccggcctggggtacccaacaagttctaccgaggatctgcagcctgggcacagctccgcttcactgattaaagccatccgcgaagagttactacgactgtcccagaagcagtcaacagtccagaatttccactcttag

SEQ ID NO: 130458 - DNA, 252 bp, Artificial Sequence
  Description of Artificial Sequence: Synthetic coding sequence
atggggggtcttttctctagatggcggactaagccatcaacagtcgaggtgctggaatcaattgataaagagatacaagctttagaagaatttagagagaaaaatcagcgactccagaagctttgggtgggccgcctcatcctctacagctccgtcctttatctgttcacatgtctgatcgtttacttatggtacctgcctgacgaattcacggcaagattggctatgactcttcccttcttcgctttctag

SEQ ID NO: 130459 - DNA, 3090 bp, Artificial Sequence
  Description of Artificial Sequence: Synthetic coding sequence
atgctcttccgcgccagaggcccagtgagaggtcgaggttgggggagacccgctgaagctcccaggaggggcaggtccccaccttggagtcccgcctggatctgttgctgggccctcgcaggatgccaagcagcttgggcaggcgacttaccaagtagttcaagccgacctctccctccctgtcaggagaaggactaccacttcgaatatacagaatgcgactcatccggttctaggtggcgggtggctatccctaattctgcggtggactgcagtggcttgcctgacccagtccggggtaaagagtgcaccttctcttgcgcctccggcgaatacctggagatgaaaaatcaggtctgttccaaatgtggcgagggcacctattctctgggcagcgggatcaagtttgacgagtgggacgagcttcctgctggttttagtaacatagccacttttatggacacagtcgtggggccatcggatagcaggcctgacggctgcaataattccagttggattccgcggggaaactacatcgaaagcaatagagatgactgtaccgtctccctcatctatgctgtgcacctgaaaaaatccggttacgtgttctttgagtatcaatatgtcgataataatatcttctttgagttttttatccagaacgaccagtgccaggaaatggatacaaccacagacaagtgggtgaaattgaccgacaatggtgaatggggtagccattccgtgatgctgaaatccggcacgaatatcctctattggaggactaccggcatcctcatgggcagcaaggctgtgaagccagtgctagttaagaacatcacaattgagggagtggcatacaccagcgaatgcttcccatgtaagcccgggaccttttcgaacaaaccgggcagctttaattgtcaggtctgtcccaggaacacctacagtgaaaaaggcgcaaaggagtgcattcgttgcaaagacgattcgcagttttctgaagaggggtcatctgagtgcactgagaggcccccctgtactaccaaggactacttccagatccacaccccctgcgatgaggaaggtaagacgcagattatgtacaaatggattgagccaaagatctgtagagaagatttgacggacgctataagattgccaccctccggcgagaagaaggattgtcctccttgtaatccaggcttttacaacaatggaagctcatcttgccacccctgcccccctggcacgttcagtgacgggactaaagaatgtaggccatgcccagccggcacggagcccgctttaggtttcgagtataagtggtggaacgttctgccgggtaacatgaagacgtcctgtttcaatgtggggaactcgaagtgcgatggcatgaacggttgggaggttgccggagaccacattcagtccggcgccggaggctcggataatgactatcttatcctaaacctgcacattcccgggttcaagccgcccaccagcatgaccggggcaacaggttccgaactcggccgaattaccttcgtgtttgagacattatgtagcgcagactgcgtgctctatttcatggtcgatattaataggaaatccaccaatgtcgttgagtcctgggggggcaccaaggaaaaacaggcatacacccacatcatttttaaaaatgctacgtttacgtttacctgggcattccagcgcactaatcagggtcaggacaatcggcggtttattaatgatatggtgaagatttactcaatcacagccacaaatgcagtggacggcgtggcaagttcctgccgagcctgtgcccttgggtctgaacagtcgggatcaagctgtgtgccctgcccccctggtcattacatcgaaaaggaaaccaatcagtgcaaagagtgtcccccggacacctacctctcgatccaccaggtttacggtaaggaagcctgcattccttgcggtcctggctccaaaaataatcaggaccacagtgtatgttacagtgactgctttttctatcatgagaaggagaatcaatcgctgcactacgacttttcaaacctgagttccgtaggtagccttatgaatgggccttctttcacttctaagggcactaaatatttccacttcttcaacattagcttatgtggacatgagggtaaaaagatggcattatgcacaaacaatatcaccgactttacggtcaaggagatagtagccgggtcagatgactatactaacttagtgggagcttttgtctgccaatctactattattccttctgagtcaaagggtttccgtgctgccctgtccagccagagcataattctggcggataccttcatcggagtaactgtcgagactactctgaaaaatattaacatcaaagaggatatgtttcccgttccgacttcccagattccagacgtacacttcttctataaatccagcaccgctactacttcatgtattaatggcaggtcaactgccgtgaaaatgcggtgcaatcccacaaaatctggtgcgggtgtcatcagtgtgccctcaaaatgtccagccgggacatgcgacggatgtactttctatttcttatgggaaagtgctgaggcctgtcctctgtgtacagaacatgacttccacgaaatcgaaggagcttgtaaacgcggttttcaggagacactctacgtatggaacgaaccaaaatggtgcatcaagggaatctctcttccggagaaaaaactcgccacttgcgagaccgtcgacttttggctaaaggtgggcgccggagtgggggcttttacagccgtcttgcttgtggcccttacatgctacttctggaaaaagaatcaaaagctcgaatataaatattctaaacttgtgatgacgacaaatagcaaggagtgtgaacttcccgccgccgactcttgcgctatcatggaaggtgaggacaacgaggaggaggtggtgtactcaaataaacagagcctcctcggcaagctgaagagccttgctaccaaagagaaagaggaccacttcgagtcggttcaactgaaaacgtctcgcagccccaacatatag

SEQ ID NO: 130460 - DNA, 11043 bp, Artificial Sequence
  Description of Artificial Sequence: Synthetic coding sequence
atggaccagcgaaagaatgagtccattgtaccgtctattactcaactcgaagacttccttaccgagcacaattctaacgtggtgtggctcctagtggcgacgatcctatcctgcggttggattatttacttgacatactacaattcacggaatgtcggcctgattttgacactcgttctcaacagactctataagcatggctacatccatataggatcattttcattctccgtcctgagcggaaaagtcatggtaagggaaatttactacattactgaggacatgtctataaggatccaggacgggtttattatcttcagatggtggaaaatgtataaccccaagcagaagcagcacgatccgaaagccgaaacccgcctgtacattactgtcaatgactttgaattccacgtttacaacagatcagatctgtacgggcggttgcaggagttattcgggcttgagcctaccatcattccacctaagaaagatgatgacaagacccgtgaaatcgggcgcacacgcactcagagtaaaatagaacgggtcaaggtcaaaactgaatcacaggatcccacctctagctggaggtccttaatcccggtcattaaggtgaacgtgtcaacaggaagactggcctttggcaatcattaccagccacagaccctgtgtatcaacttcgacgatgcatttctgacttacaccacgaagccaccatctagtcaccttgatcagttcatgcatatcgtgaaaggcaagctggaaaatgtcagagtgatgctcgtgccttcgcccagatacgtgggccttcagaacgatgaacctccaagattaatgggggaggggtttgtcgtgatgcagagtaacgacgtagacatctactactacatggacgagcccgggctggttcccgaagaaacagaagagaacattgaaggggaaatgtcctccgaggattgcaagcttcaggacctgccaccttgctggggactggatattgtgtgtgggaagggaacagatttcaattacggaccctgggctgataggcaacgcgactgcctgtggaagttctttttcccaccagattaccaggtcctcaaggtgtcagaaatcgcccagcctggacggccacggcaaatcctggccttcgagttacgtatgaatatcatagccgacgcaactatcgatctgctgttcactaagaatcgagagactaacgccgtgcacgttaacgtgggagccgggtcctatctggagataaatatccctatgaccgtagaagaaaatgggtatactccggcgataaaaggccagctgctgcacgtggatgctacgacctccatgcagtatcggacactactggaggccgagatgctcgcattccacatcaatgcctcctaccctcggatttggaacatgccccagacatggcagtgcgaacttgaagtctataaagccacttatcatttcatttttgcacagaagaattttttcacggatctgattcaagattggtccagcgatagtccaccagacattttctcgttcgtaccctacacctggaactttaagattatgttccaccagttcgagatgatttgggcagccaaccagcacaactggatagactgctcaaccaaacagcaggaaaacgtgtacctagctgcatgcggggaaacactcaacatcgatttcagtctgccttttaccgatttcgtacccgccacctgtaataccaagtttagtcttaggggcgaggacgttgacttacacctgttcctacctgactgtcatccaagtaaatattcattgttcatgctcgtcaagaattgtcatcccaataagatgatccatgatacaggcatccctgccgaatgccagtcagggcagaaaaccgtgaagcctaagtggagaaatgtcacccaggagaaaagcggctgggtggaatgttggacggtgccctccgttatgttaactatagattacacttggcatcctatttacccacagaaggcggacgaacagcttaagcagtccctgagcgaaatggaagaaaccatgctgtccgtgctccgacccagtcagaagacatccgacagggtggtgagctccccttccaccagttcccgacctcccatcgacccctctgaactgccccccgataagctgcatgtagaaatggagctgagccccgactctcaaattacactgtacggaccattgctcaatgccttcctgtgcattaaagaaaattactttggagaggacgacatgtacatggactttgaagaggtcataagcagcccggtcctgtctctgagcacctcttctagctccggatggactgccgtcgggatggagaatgataagaaagaaaatgagggctcggcaaagtctatccacccactagccttgcgaccctgggatattacagtgcttgttaatctctacaaagtgcatggcaggctgcctgtgcatgggacgaccgacggcccggaatgccctactgccttcttggaacggttgtgtttcgagatgaagaaaggcttcagagagacaatgctgcaactgattctgtccccacttaacgttttcgtgagtgacaactaccaacagcgcccacccgtggatgaagtgcttcgcgagggtcatataaacttgtctggtttgcagctgcgtgcccacgctatgttctctgcggagggcctcccactcgggtccgattctttggaatacgcttggttaatagacgttcaggccggttccctgacagcgaaggtcaccgctccacagctggcatgcctactcgagtggggtcagactttcgtgttccacgtggtctgtagagagtatgaactggaaagacccaaaagcgtgattatatgccagcacgggatagatcgccgcttctgcgaatcaaagctttcatgtataccagggccctgtccgacatcggacgacttaaagtacacaatgatccgtctggctgtggacggagccgatatatatattgtagagcacggctgcgcaaccaatatcaaaatgggggctataagggtggccaattgtaatttacataaccagtctgtgggtgaaggcatctctgcagctattcaggattttcaagtgcgtcagtacatcgaacagctgaataattgccgcattgggttgcagcctgctgtgctccggagggcttattggctcgaggcggggagcgctaatctgggcttaatcacagtggatatagcccttgcggctgaccaccacagtaaacatgaggcccagagacactttctggaaacccatgacgcgcgaaccaagcggttatggttcctgtggcccgacgacatacttaaaaacaaacgctgtagaaacaagtgcggatgtttaggcggctgcagattctttggaggaaccgttaccggtttggacttctttaagcttgaagagctcacaccatcttcatctagtgctttttcatctaccagtgccgaatctgatatgtactacgggcagtctttgctccagcccggtgaatggatcatcacgaaagagatacccaaaatcatcgacggtaacgtgaacggaatgaagaggaaagagtgggagaataagtccgtcggcatcgaggtggaaaggaagacacagcacttatccctccaagttcccctcaggtcacatagttcctcgagcagcagcgaagagaattcatcgtcatcagcagctcagccattgttggctggggagaaggaatcaccctcctccgtggcggatgaccacctcgttcaaaaggagtttctccacggcacgaaacgtgacgacggtcaggccagcatccctaccgaaataagcggcaattcccctgtatcgccaaatacacaagataagtctgtggggcagtccccactgcgcagccctcttaaacgccaggcttccgtatgttctactcggctcggctcaaccaagagccttactgcagcattctacggggacaaacaacccgtaactgttggagtgcagttcagttctgacgtgtccagatccgatgaaaacgtattggactcccctaagcagcggagatccttcggaagtttcccatatacgccttctgctgactctaatagctttcaccagtaccgaagtatggattcctccatgtccatggctgattcggaggcatatttcagtgctgctgaggaattcgaacctataagctcagacgagggccctggcacctatcccggacgaaagaaaaagaaaaaacagacccagcaaattgattattcccgaggcagcatataccactctgtcgagggcccactcacaggtcacggtgagtctattcaggatagccgcaccctcccattcaagacccacccctctcaagcctccttcgtgtccgccttggggggtgaggacgatgtgatagaacacctgtacatcgtggagggtgaaaaaaccgtcgagagtgagcagataacccctcagcaaccggtgatgaactgttaccagacttacctgacgcaatttcaggttattaattggagtgttaagcaccccacgaataagaggacttctaagagctccctgcatagaccccttgacctggatacccctacctctgaagaaagctcttcgagctttgagcagctgtcagtgcctaccttcaaagtgatcaagcaagggctgactgccaacagtctgctggataggggaatgcagctgtcaggatcaactagcaataccccatatacccccctggaaaagaagctggccgacaacacagacgatgagacattaaccgaggaatggaccctggaccagcctgtaagtcagacacgcacaaccgccatcgttgaggtgaagggtaccgtggacatcgtactcactcccctggtggctgaagccctggacagatatatcgaagcaatggtgcactgtgcttccacccgacatccggccgctattgtagatgatctgcatgccaaagttctgcgcgaggccgttcagaattccaagactacctttagcgaaaatctaagtagcaagcaagatattcggggtacaaaaactgaacagagcacaattggaactaccaaccagggtcaggcccaaacgaatctgacaatgaagcaggataatgttactattaagggccttcagacaaatgtgtctatccctaaagtcaacctgtgtctgctgcaggcttccgtggaggagtctcccactactgccccgagtcgcagtgtcacccacgtaagcctagtggccctgtgctttgataggatcgccacccaagtgcgcatgaatcggggggttgttgaagagacatctaataacgccgagccaggcaggacgagcaacttcgataggtatgtgcatgccactaagatgcagccccagtcaagtggatctctgagatctaacgctggcgcagagaagggtaaagagattgcagccaagctgaatattcaccgtgtgcacggccaactgcgcggtttagatacaaccgacatcggaacttgtgctatcaccgcaataccttttgaaaaatccaaggtcctgttcacgcttgaggagctggacgaatttacttttgtcgatgaaactgaccagcaggccgtacccgacgtcacgagaatcggcccctcgcaggaaaaatgggggtggatcatgtttgaatgtggcctggaaaaccttacaataaagggcgggcggcagagcggggcggtgctgtacaacagcttcggcattatgggtaaggcgtccgatactgaaagaggtggagtcctcaccagcaataatagtagtgacagcccaacggggtctggatacaataccgatgtctccgatgataacttaccctgtgaccggacctctccttctagcgacctgaatggaaactctgtctctgatgaacaggatgaaggggtcgagagcgacgacctcaagaaagacctaccacttatgcccccccctccagacagttgctctatgaaattaacgattaaggaaatttggttttcgttcgctgcccccacgaatgtacgtagccatacccacgcctttagtaggcagttaaaccttctctcgacggcgaccccagccgtgggcgcctggcttgtgcccatagaccaacttaagtcgagtctcaacaaactggagaccgagggcactctgcgtatctgcgcagtgatgggctgcattatgactgaagctctggaaaataagagcgttcatttccctctgcggtcaaaatacaacaggctgacaaaagtggcccggttcttgcaagagaatccatcctgtctcttgtgtaatatcctccaccattacttgcatcaggcaaattacagcatcattgacgacgctactatgtcagacggcctgcccgctctcgtgaccctgaagaagggactggtggcccttgctcggcaatggatgaaatttattgtggtgacgcctgcctttaaaggcgtctcccttcatcgacccgcccagcctctcaagccccaaattgccatggatcatgaacacgaggacggactcgggctcgacaacgggggcgggcttcagtctgacacttcagcggatggggccgagttcgagtttgacgcggcaactgtttctgaacacaccatgctcctggaaggaacagccaacagaccccccccgggctccagcggacccgtgactggcgcagaaatcatgcggaagctgtccaagacacatacacactcagatagtgcccttaaaatcaaaggaatccacccataccatagcttgtcctacacaagtggtgatactgcaaccgattctcccgtgcacgtgggccgtgccgggatgccagtcaaggacagcccccgaaaagagtcccttctctcgtatctgaccggatccttcccaagccttcataatctgttggaagggactccccaaagaagttcagccgccgtcaagtcctcgtcactgaccaggacaggcaacacagttgctaccgatatgctctctgagcatccacttttgagtgagcccagcagtgtcagtttttacaattggatgtccaatgctgtgggaaaccgcggtagcgtcctgcaggagtccccggtgacaaagtccggacataactctttgcccaccggcgtggcgcccaacctgcccaccatcccgtccgcctcggatttcaacaccgtcctgtcttctgaccagaatacactcgatggtactcacagccaacatagtacctcacaggacgatgtcgccggggtggaggaggcgaaccaagggttccccgccgtgcaactggccgacgctcaggtagtctttaaaccacttctgtcacatactgggatccagagtcaagacaccatgccattctgctatcggatgtatttcggcgagcacttaagtttttccggcacgcttgactgccttcgagcagatatcgtcgactccgatacagcaaaggagagaaaaggcaagcgggcaagacgccaggggcatgtaaatctgcctccgttagagtttaagcccgcactcatgctcgggaccttctcgatctccgcggtggtgatggagaaaagcgtgtgcactccccagaactctactagcgccctctcctttcatgacctcagtaaacgttattacaatactttccattgtaatttcactatatcgtgtcagtctatatcccagcacgtcgacatggcactggttagactgatccaccagttcagtaccatgatcgacgatatcaaagctacacaaacagacatcaagctctctagatataccgcgggcagcgctagccctactccgacattcaaaacaagaaagcatcgcgacttcaggtcttccgacttctcgcgctcctctcgggggtccctgaacggaggcaacagagtcaacaatgccaaaaacaaacgcaccaacaacgagaacaataagaaggaatccaggaacaaaaattctctcgggcgttcagaacgcagaacatccaaagtctcgagaaaagggagcaaagacgtggtcgaccatatgaccatacacatggacgattctgattcaataacggtaagcgaacagtccgagccaagtgccgagtgctggcaaaatatgtacaagctactgaacttttactcactgatctctgaccccactggcattctggaaaagagctccgaaacctttggtcctgcaggcgttaggagccctacggagcctacctgtaaagtggtcttcgaaaacgagcaggacaactccagtctgacaaagacacagaggaagcggtccctggtcacctcagaacctcagcacgtgacactgattgtcttcggaatcggaatggtgaaccgaacacacctggaggcggacatcggcggcttgacgatggagagtgagttgaagagaattcacggctcctttaccctgaaggaaaagatgaaagacgtgctgcatcagaagatgacagagacgtgcgcaactgcgcatattggcggcgtaaatattgttctccttgaaggcatcacacccaacatccagctcgaggacttcccaacgtcgcctacctctacagccaaacaagagtttttgactgttgtgaagtgttccatcgcaaaaagtcaggcactgtacagcgcgcagagaggtcttaagacaaataacgccgccgtgttcaaggtcggcgccatatccatcaacattccgcagcacccggccacgctgcattctatgatggtcagaagttcccaccagttaagtaaacagatctctgacctgattagacagccctccaccgctccccagccagtcaaagaagacatcgcaacccctctgccttccgagaagacacccacgagcgtaaaccagacaccagtggagacaaacgagtttccccagttaccagaaggactagagaagaagccaattgttctgaagttttcagcaatgcttgacggcattgccatcggtgccgcattgctgccaagcctaaaggcagaatacaagatgggccggatgcgctcacatgggatgaccggcgcccagacaaggttcactttcgagctgcctaatcacagactacggtttacttcaaaagtttcagctaccgatatgtcgactataccaccaagtgcaagtctcaatctgcccccagttacgatgtctggtaagtacattatggaagagcacgatagttactcagaccaggtgtggtccatcgatgagctgccgagcaaacagggttactacctgcagggcaattacttacggtgcgtggcagaggtgggcagctttgaacacaacctcacaactgacctgctaaatcatctggtattcgtgcaaaaggtgttcatgaaagaggtgaatgaggtgattcagaaggtttctggcggagaacaacctatcccgctctggaatgagcacgatggcaccgcagacggcgataagccgaaaattctgctgtattcacttaacctccagttcaaagggatccaggtgaccgccaccactccttcaatgcgagctgttaggttcgaaaccggactcattgaactcgagctgagtaaccgtctgcagaccaaggcgtcgccaggtagtagtagctatctaaagctgttcggtaaatgccaggtcgatttaaatttggctttgggccagatagttaagcaccaggtgtacgaggaggctggatctgacttccaccaggtcgcttactttaagactcgaatagggctgaggaacgccctgagagaagaaatttctgggtcttcagatcgggaagcggtgctgatcaccctaaaccgtccaatagtgtacgcacagccagttgccttcgaccgggcagtgctcttctggctgaattataaggctgcctacgacaactggaacgagcagaggatggcactgcataaggacatacatatggcaactaaggaggtggtcgatatgctcccgggcattcagcagaccagcgcacaggcctttggaactctattcctgcagctcactgtgaatgacctgggaatttgcctgccaatcactaataccgcccaatcaaaccataccggagatctagatacagggagcgctttggtccttactatagaatccacactcattacagcctgctctagtgagtccctggtaagcaagggtcacttcaaaaatttttgtatcaggttcgcagacggcttcgagaccagctgggacgattggaaaccagagatccacggcgatcttgttatgaatgcgtgcgttgtgcctgacggtacatatgaggtgtgcagccgtacgactggccaagcggcagcggaaagcagctccgcaggcacctggacgctgaatgtattatggaaaatgtgtgggatcgacgttcatatggatcctaatatcggaaagcgactgaacgccctagggaacaccctcaccactctgaccggtgaggaagacatcgacgacattgccgatctgaacagcgttaatattgccgatctgtccgatgaggacgaggttgatacgatgtcacctaccattcatacggaggctacggactacaggcgacaggctgcctccgccagccaaccaggggaactgaggggaagaaagatcatgaagcgcattgtggacattagggagctaaacgagcaggcaaaggtgattgatgacttaaaaaagttaggagcatccgaggggaccatcaaccaagagatacagcgctaccaacagctggagtctgtggctgtcaatgacatccggagggatgtccgcaagaaactgagaagatcttccatgagggccgcctccttaaaggacaaatggggcctatcatacaagccttcttactcacgctctaaatctatctccgcctcgggccggccaccactgaaaagaatggagcgcgcctccagccgggtcggcgagactgaggaacttccagagattcgcgtcgacgccgcctccccgggaccccgagtaactttcaatattcaggatacaatcgctgagatacgacggaaaaagatctcgttcaaagtggtattctag

SEQ ID NO: 130461 - DNA, 2241 bp, Artificial Sequence
  Description of Artificial Sequence: Synthetic coding sequence
atgccatgcctcggactgctcgcgaacctgtgccgccacaatctctctgttcagacgcatataaagaccctgtctaatgtaaagtccttctataggacattaattacattattggcccacagcagcctgacagtggtggtctttgctctgtcgattttatctagcctcaccctgaatgaagaagtcggagagaagttgttccacgcaaggaacatccatcagacattccagctcatttttaacatattaatcaacggggatggcacattaacccggaagtactctgtggatctccttatggacttattaaaaaaccctaaaatcgcggactacctgacgcgttacgagcacttctccagctgcctccaccaggtccttggtctcctgaacggtaaggaccctgatagtagcagtaaggtcctcgaattactcttagcattctgctccgtcacacagctccgccacatgctcacacagatgatgttcgaacagagtccgcccgggtcagccactctcgggtctcataccaagtgcctggagccaactgtagctctcctccggtggctgtcccagcccctggacggctccgagaactgctcggtgctggcattggagctatttaaagagatcttcgaagatgttattgatgctgccaactgctcgtcagccgatcgctttgttacgcttctgcttcccacgattctggaccaactgcagttcactgaacagaatctcgatgaagcgctcacccgcaaaaaatgtgagagaattgcaaaagccatcgaggttctgctgacgctctgtggggacgataccctcaagatgcacatcgcaaaaattctcacaaccgtcaagtgtaccaccctgatcgaacagcagttcacctacggaaaaatagatctgggcttcgggacaaaagttgcggacagcgagctatgtaagctggctgccgacgtaatcttaaaaacactggacttaatcaacaaactcaaaccacttgtgcccggcatggaagtctcattttacaaaatccttcaagatccccgccttatcacacccctagcattcgccctcacgtccgacaaccgggaacaagtgcagtctggactaagaatcttgctagaggctgcaccccttccagactttcccgcactcgtgctgggggaatcaatcgccgcaaataacgcttatcggcagcaggagaccgagcatattccgcggaaaatgccctggcagtcaagcaatcactcatttcctacatccatcaagtgcttaacaccgcaccttaaggacggagtgcccgggttgaacattgaggaactgatcgaaaaactccagtctggaatggtagtaaaggaccagatctgtgatgtgcgcatctccgacatcatggacgtgtacgagatgaagcttagcacactggctagcaaggagtcccgactgcaggacttactcgaaaccaaagccctcgccctcgcgcaggcggaccgcctaatcgcacagcaccgatgccagcggacccaggcagagacagaggcacggaccctcgcctcaatgctgagggaagtagaacggaaaaacgaggagcttagtgtactgctgaaggcacaacaagtggaaagcgagagggctcaatctgacatcgaacacctgttccaacacaatcggaaacttgagagtgtggctgaggagcacgaaattctgaccaaaagctacatggagctgctgcaacgcaacgagtctactgagaagaagaataaagacctgcagataacatgtgatagcttaaacaaacaaatagaaacagtaaagaagttaaatgaatcattgaaggagcagaatgagaagtccattgcacagcttatcgaaaaagaggagcaaaggaaggaggtgcagaaccagctggtggacagagaacacaagctcgccaacctgcaccaaaaaaccaaagtccaggaggaaaagattaagactctccagaaggagcgggaagacaaagaggagacaatagatatcttacgaaaagaactgtcaagaacagaacaaattaggaaggagttgagtataaaggcatctagtttagaggtgcagaaggcacaactggagggacgcctcgaagaaaaggagtctctggtgaagctgcagcaagaagagctgaataaacactctcatatgatcgcaatgattcacagtctctccggcggtaaaatcaaccctgagaccgttaatttgagtatctag

SEQ ID NO: 130462 - DNA, 840 bp, Artificial Sequence
  Description of Artificial Sequence: Synthetic coding sequence
atgactctgccattcttcgcttttcctttgattatctggagcattagaaccgttatcatcttcttcttttctaagaggaccgaaaggaataacgaggccctcgacgatctgaagtcgcagcgcaaaaagatccttgaggaagttatggaaaaggaaacgtacaaaacagctaaactcatactagagcgttttgacccagactcaaagaaggccaaggagtgtgagccaccatctgccggcgccgccgtaaccgcccgtcccgggcaggaaatccgacagcgcactgcggctcagcggaatctgtctcccacccctgcctcacctaaccaagggcctccaccacaggtgcctgttagtcccggccccccaaaagattcctctgcccctggtgggcctccagaaagaactgtgacaccggcactcagctcgaacgtgcttcctcgacatctgggctcccctgcaacatcagtcccaggaatgggcctacatccgcctggtccccctctcgcaagaccaatcctaccccgcgagagaggagctcttgatagaattgtcgagtacctagttggcgacggcccccagaatcgctacgcccttatctgccagcagtgcttttctcataatggcatggctctaaaagaggagttcgagtatatcgcctttcgatgtgcctactgttttttcttgaaccctgcaaggaagaccagacctcaggcgccccggctcccggaattttccttcgagaaacggcaggtggtggaaggctccagcagcgttgggcctctgccctctggaagtgtgttgtccagtgataatcaatttaatgaggtccagtactag

SEQ ID NO: 130463 - DNA, 3192 bp, Artificial Sequence
  Description of Artificial Sequence: Synthetic coding sequence
atgacccggctgggttggccctccccatgttgtgcaagaaagcagtgttccgaaggccgcacctactcaaatgcggtgatttctcccaacttggaaaccactcgtataatgcgggtgagtcacacatttcccgtggtagattgtactgcagcgtgttgcgacttatctagctgcgatttagcatggtggtttgaaggtaggtgttaccttgtgagctgccctcataaagaaaattgtgagcccaagaagatgggcccaattaggagttacctcacctttgttctgagacctgtgcagcgacctgcccagttactagattacggggatatgatgctcaacagaggcagccctagtggtatctggggagattctcccgaagacatccgaaaagatcttacttttctcggcaaggattggggactggaggaaatgtccgaatactctgatgactatagagagctggaaaaagacctactccagccttctgggaaacaagaaccccggggctccgccgaatacacagattggggcctgctccctgggagcgagggggcattcaattcttctgtgggcgattctccagcagtgccggcagagacccagcaggatccagagctgcattatcttaatgagtccgcctcaacacccgctccaaagctgcccgaaagatccgtgctgctccctctcccgacgacccctagctctggggaagtcctggaaaaagagaaagcgagccagctgcaagaacagagcagtaattcctcgggaaaggaggtgctgatgccctcccattctctgccgcccgccagcctggaactctctagcgtcacagtggagaagagccccgtgctcacagtgacaccaggaagcacagaacacagtatcccaacgccaccaacttctgctgccccatcagagtctacaccgagcgagctccctatcagcccaacaactgccccccgtaccgtgaaggagctgactgtgtccgccggggacaatctgattattacgttgcccgataacgaggtggaactgaaggcatttgtcgccccggccccaccagttgagactacttacaattacgagtggaacctgatcagtcacccaaccgattaccagggagaaattaagcagggccacaagcagacactgaacttgagccagctgtcagtcggactctatgtattcaaggtgacagtctccagcgagaatgcctttggcgaaggattcgtgaacgtcacagttaaacccgctcgcagagtgaacctccccccagtcgccgtagtgagccctcaacttcaagaactaaccctgcctctcacctctgccctcatcgatggatcccaatccaccgatgacaccgagattgtctcctaccactgggaagaaattaatggtcccttcatcgaagagaagacttccgtggattctccagtgctgagactgtccaacctggaccctggaaactacagcttcagactgactgtaacggacagcgacggcgcgactaatagcacgaccgccgccttgatcgtcaacaatgccgtggactaccccccagtggccaacgccggccctaatcacaccatcactctgccccagaactcgataacactgaacgggaaccagagcagtgatgatcatcaaatcgttctttacgaatggagtctggggccaggaagtgaaggcaagcacgtggtcatgcaaggagtacaaaccccttacctgcacctgtcagctatgcaggaaggcgactatacctttcagctgaaggtgacagactctagtaggcagcagagcacagcggtggtcaccgtgatcgtgcagccagagaataacagaccgccggtggcggtggctggccctgataaggagctgatttttcccgtcgagagcgccaccctagacggcagctcgagctccgacgatcacggtattgtcttttatcattgggagcacgtgagaggccccagcgctgtggaaatggaaaatatcgacaaggccattgccaccgtgaccgggctgcaggtgggaacctatcactttcgcctaaccgttaaagaccagcagggccttagcagcaccagtacactaactgtggcagtgaaaaaggaaaataatagcccccccagagccagagccggcggcaggcatgtcctggtcctgcccaacaatagcatcaccctcgacggatctaggagcacagacgatcaaagaattgtcagttacctgtggataagggacggccagagcccagccgctggtgatgtgatcgatggtagcgatcactcggtggccctccagttaactaacctggtcgagggtgtctacactttccatcttagagtcacagattcccagggagcatccgacacagatacggctacagtagaggttcagcctgatcccaggaaaagtggacttgtggaactgacattacaggtgggcgtgggacagttaacagagcagagaaaagacacactagtaagacagcttgcagtgctcctgaacgtgctcgactcggacattaaggtacagaagattcgagcacattccgatctgagcactgttattgtgttctacgtccagagtcgaccccccttcaaagtgctgaaggcagcggaggtggcacgcaatctgcacatgcgattaagtaaagagaaagcagattttctgctattcaaggtattaagagtcgataccgcagggtgtttgctgaaatgttcgggccacgggcactgcgaccctttaacaaaaagatgtatatgttcacatctgtggatggagaaccttattcagcgctacatttgggatggcgagagcaattgcgagtggtcaatcttttacgtgactgtactcgcctttaccttgattgtattgactggagggttcacctggctgtgcatctgttgttgcaagcgtcagaagcggacgaagatccggaagaagacaaaatacacaatcctggataatatggacgaacaggagcgcatggaactccggccaaagtacggcataaaacatcgctcaacagaacataacagctcccttatggtgtctgagtccgagtttgactcagatcaggacacaattttcagtcgcgagaaaatggaaagaggaaacccaaaggtgtcaatgaatggttccatacgaaacggggcttccttcagctactgctcgaaagatcgatag

SEQ ID NO: 130464 - DNA, 1293 bp, Artificial Sequence
  Description of Artificial Sequence: Synthetic coding sequence
atgggtcgcagctggccaggactgagtttgtgccaatggcgacttctgccggccttggaagcaggatgggcagttgcagccgagaccggtggcggaggacgacccggaagagccgcaccagcctcctgttcatgcgaattcctgtggaccatagatgacatctatcactgcgcccagtttctacagatcaaggatgggtggataatatttagcatggaagccagacttgcaatgacactgccttttttcgcattccccctgatcatttggagcattaggacagtcattattttcttctttagtaagcgcactgagagaaataacgaagccctcgacgatctcaaatcccagaggaaaaagattttagaggaggtgatggaaaaggagacctataaaacagccaagctgatcttagagcggttcgaccccgatagtaagaaagcaaaggaatgcgagcccccaagcgccggagctgccgtaaccgccagacctggacaggagattcgtcaacggactgccgcccagagaaacctgtcccctacacccgcatccccaaatcaggggccacccccgcaggttcccgtgagtcctggtccgcccaaggacagcagcgcccctgggggacctccagagcgcactgttacgcccgctctgagcagcaacgtcttacccaggcacctcgggagtcccgcgacctctgtccccggaatgggcctccacccccccggcccacctctggcccgtcccatattgccaagagaaagaggagctttggacagaatcgttgaatacctggtcggcgacggcccacagaaccgctatgccctgatctgtcagcagtgtttctcacacaacgggatggccctgaaggaagagtttgaatacatcgcttttaggtgtgcttactgcttcttcctcaacccagcccgtaaaacgagaccccaagcacccagactcccagagttcagttttgaaaagcgccaggtggtggaaggctcctcctccgtggggccgctcccatccggtagcgtgctgagctcagacaatcagtttaatgaggagagcctggaacacgatgttctggacgacaacactgagcagacggatgacaagattccagcaacagagcagaccaaccaagtgattgagaaggcctcagattccgaagaaccggaggagaagcaagaaacagagaacgaggaggcctccgtgatcgagactaattctaccgtccccggcgcagattctatacctgatcccgaactgagtggtgagagcttgacggcagagtag

SEQ ID NO: 130465 - DNA, 3036 bp, Artificial Sequence
  Description of Artificial Sequence: Synthetic coding sequence
atggccccaccaaccggggtgctgtcttccttgcttcttctcgtaacaatcgctggatgtgcccgtaaacaatgtagcgaaggccggacatattccaatgccgtgatcagtcccaatttagaaaccacccggataatgcgggtgtcacacacatttcccgtggttgactgcacagctgcttgttgtgacttaagctcttgtgatctggcatggtggttcgagggtcgctgctatctagtcagctgtccccataaggagaattgcgaacccaagaagatggggcctatccgaagctaccttacctttgttctcaggccggtccaacgccccgcccagctgttggattatggcgatatgatgctgaaccgaggcagccccagcgggatttggggcgactctcccgaggatatccggaaggatttgacattcctgggtaaggactggggtctggaagagatgagcgagtattcggacgattaccgtgaattggagaaggacctgttacagcccagcgggaagcaggaaccacgaggatccgctgagtatacagactgggggctgctcccaggttctgaaggcgccttcaactcgtctgtgggagatagtccggctgtccccgccgagacacagcaggatccagaacttcattacctcaatgaatctgccagcactccagccccaaaactgccggaacgcagcgtacttctccctttgcccaccaccccctcaagcggcgaggtcctggaaaaagagaaggcatctcaacttcaggaacagagcagcaatagtagcgggaaggaggtcctgatgccctctcattctctcccacccgcctccctggagcttagttccgttaccgtggaaaagtcccctgtgctaacggtgaccccaggcagtactgagcacagcattcccacacctcccacatctgctgccccgtccgagtccacaccaagcgagttgcctatctctcctactaccgccccgcggacggttaaagaactgactgtatccgcaggagataacttaatcatcaccctgcccgacaatgaggtagagttgaaggcatttgtggcaccagcgccgcccgtggagaccacctataactacgagtggaaccttattagtcacccaaccgactatcaaggggagattaagcagggccacaaacaaactttgaatctatcccagctgtcagtggggctatatgtgtttaaagtgaccgtaagctccgaaaatgcgttcggggagggcttcgtgaacgtgacagtgaaacccgcccgcagggttaatttaccacccgtggcagtggttagtcctcagctccaagaactgactcttccactcacttcagccctaattgatggaagccagtccactgacgacacagagattgttagctaccactgggaggagattaacggcccattcatcgaagagaaaacctcagttgattcccctgtcctgagattgtcaaatttggaccccggaaactacagcttcaggctgactgtgacagactcagacggagcaaccaacagcacaactgcagctctcattgtgaataacgctgtggattaccctcctgtggctaatgccggacccaaccacaccatcacgctgccccagaattcgatcaccctcaacgggaaccaatcgtccgatgaccaccagatagtactgtatgagtggtccttgggtccaggatccgagggcaagcatgtggtcatgcagggagtccagacgccatatttacacctgtccgcgatgcaggaaggcgactacaccttccagctgaaagtcaccgacagttctcgtcagcagtccacagcggtggtgacagttattgtccagcctgagaataatcggccacccgtggcagttgcaggccccgataaggagcttatctttcccgtcgagtctgccaccctagatggcagtagctccagcgatgatcatggcatcgtgttctatcattgggagcatgtgcgcggtcctagcgcagtagaaatggaaaacattgataaagcaatcgcaactgtgaccggtttgcaggtcggcacctaccacttcagactcactgtcaaagatcagcagggacttagctcgacctcgacactcacagtagctgtcaagaaggaaaacaatagccccccaagggccagagctgggggcaggcacgttttagtgctgcccaataactcaatcaccctggatgggagtcggtctactgatgatcagcgaattgtttcgtacctgtggatcagagatggacagagccccgctgccggcgatgtaatcgatggatctgatcactcagtagcgctccagttaacaaacctggtcgagggggtgtacaccttccacctcagagtaaccgattctcagggcgcttcagatacggataccgctacagtggaagtgcagccagatcctcgtaaaagtgggctggtggagctcactctgcaggttggtgtgggtcaattaaccgaacaaagaaaagatacacttgtgaggcagttggctgtgctgcttaacgtcctggacagtgatatcaaggtccaaaaaataagagcacactctgatctgagtactgtaatcgtgttctatgtccagtctcgcccaccgttcaaggtgctgaaggccgctgaggtggctcgcaacctgcacatgagactttccaaggagaaggccgactttcttctttttaaagtccttagggtcgataccgctggctgcctcctcaaatgcagcggccatggccactgtgatcctctgaccaagcggtgtatctgttctcacctatggatggaaaacctcattcaaagatatatatgggatggggaatccaattgcggtatcaaacacaggtctactgagcataattctagcctaatggtctcagaatccgagttcgattccgaccaggataccatattcagtagagagaaaatggagagaggaaatcctaaagtgagcatgaatggctctataagaaacggggctagcttcagttattgtagcaaagataggtag

SEQ ID NO: 130466 - DNA, 1206 bp, Artificial Sequence
  Description of Artificial Sequence: Synthetic coding sequence
atggagacacccgaagtgcctgtgggatcccttatagactttggccctgaagcccccactagctcccccctggaggctcctcctcccgtattacaggacggagacggttctctcggggacggcgcaagcgagtcagagaccacggaatcggccgatagcgaaaacgatatgggggagtcaccatcccatccctcctgggaccaagatagaaggagcagctccaatgagagcttctcttccaaccagtcaaccgagtcgacccaggatgaagaaacgctcgcccttagggactttatgaggggatacgtcgaaaagattttttcaggtggcgaggatttggaccaggaggagaaggcaaagtttggagagtactgttcctccgaaaacggaaagggacgtgagtggttcgccaggtacgttagcgcccagcggtgtaattccaagtgcgtgagtgaagctacattttataggctggtgcaatctttcgccgtagtgctatttgagtgtcatcaaatggacgacttcggccccgccaagaatttaatgactatgtgctttacttattaccacattggcaagcctcagcttctgcctccagaatcaagagagaaacctgcggggtccatcgactcatatttaaagagtgcaaactcctggctcgctgagaagaaggacatcgcggaacgtctcctgaagaacactagcgcaagaacggagaatgtgaagggattttttggcggtctcgaaacgaagctcaagggccctctcgcccgtcggaatgaagaggatgagaataaaccgcaagagaaacgcccacgtgccgtgaccgcgtactctcctgaggacgaaaagaagggcgagaagatttatctgtatacccacctgaaacagcagccgatttggcacacgctccggttttggaacgcagccttcttcgacgccgtgcattgtgaacggaccaaacggagcccaaccactcgcgagaaatggtgccatatgacacaggaggaacgcgacgacagcctgcgatttaacgaaaatatcacatttggacagttagggacattcactcataatatgctggccttcgggctgaacaaaaaactgtgcaatgacttcctaaagaagcaggctgttatagggaacctcgacgaagagcagtacaagctgctgtcagaccatattgagcagatggctaccgaatag

SEQ ID NO: 130467 - DNA, 3219 bp, Artificial Sequence
  Description of Artificial Sequence: Synthetic coding sequence
atggccccacctactggggtacttagttcactactgttgttggtcaccattgctgggtgcgcgaggaagcaatgctctgagggccgcacttacagcaacgccgttatcagtcctaatctcgaaacaaccagaatcatgagggtgtctcacacattccctgtagtggattgtacagcagcctgttgtgacctgagctcatgtgatctagcatggtggtttgagggacggtgttatttagtcagttgtccacataaggagaattgtgagcccaagaaaatgggtccaatcaggtcttatctgacattcgtcctacggcccgtgcagagaccagcccagttgctggactacggcgatatgatgcttaatagaggcagcccatctggaatttggggcgactcgcccgaagacataaggaaggatctcacctttctgggaaaagattggggactcgaagagatgtccgagtactctgatgattatcgggaactagagaaagatttgttgcagccaagcggcaaacaggagccccgaggctctgccgagtacacagactggggcctgcttcccggctctgagggagcctttaactccagcgtgggggactctcctgccgtgcccgccgaaacgcagcaagaccccgaattacactacctgaacgagtcggctagcacccccgcccccaagctaccagaaagatcggtcctgctgccactcccaaccactcctagcagcggagaagtgctagagaaggagaaagccagccaactgcaagagcagagcagcaactctagcggcaaggaagtgctgatgccatcacacagcctaccccccgcttctctggagctctcgtccgtgaccgtggaaaagtctcccgttctcaccgtcacccccggttcaacagagcacagtatcccaactcctccgacctccgctgcgcctagcgaaagcaccccttccgagcttcctatttcacccaccaccgccccccgcacggttaaagaattaaccgtaagcgcaggtgacaacttgattattacactaccagataacgaggtggagctaaaggccttcgtggctcccgcccctcccgttgaaactacatacaactatgagtggaatctcatatcccatcccaccgattatcagggggagatcaagcaggggcacaagcagacactaaacctgagccagttgtctgttggcctgtatgtgttcaaggtgactgttagttcggagaacgctttcggtgaaggcttcgttaatgttacagtaaaacccgccaggcgagtgaacctaccccccgtggccgtagtcagtcctcagctgcaagagctgaccctgccgctgacttcagcactcattgacggaagccagtcgaccgacgacacggagatcgtgtcataccactgggaggagatcaacggtccctttatcgaggagaaaacatccgtggacagtcctgtgcttcgactgtctaacctcgatccaggaaactatagctttcggctgaccgttaccgactccgatggcgctacgaactcgaccacagcagcactcattgtgaacaacgccgttgattacccacccgttgccaacgcaggccctaatcacaccataactctccctcagaattccattaccttgaatggaaatcagagcagtgacgatcatcaaattgtgctgtatgagtggagccttggcccggggtcagaaggaaagcatgtcgtgatgcagggggtgcaaacgccctacctgcacctgagtgcaatgcaagagggagactacacttttcagctgaaagttaccgacagctcccgccagcagtcaacagccgtcgtcactgttattgttcagccagagaacaatagacccccagttgcggtggccggacccgacaaggagttaatttttccagtcgagtccgccaccttggacggctcaagcagctccgacgaccatgggattgtcttttaccattgggaacatgtaaggggcccgtcggcagttgagatggagaacatcgacaaagctatcgccaccgtgacagggttgcaggtaggtacttatcacttccgactgaccgtgaaagaccaacagggcctgagcagtacctcaacattgacagtcgccgtgaaaaaggagaacaactcaccgccgcgcgcacgcgctggtggacggcatgtgttagtgctgcctaacaactcgattaccctggatggcagtagaagcaccgacgaccaaagaatcgtgagttacctgtggatccgcgatggtcagtcgcctgccgcgggcgacgtcatcgacggctctgatcattctgtggctctccagttgacaaacctggtggagggcgtgtacaccttccaccttagggtgaccgactcccaaggggctagtgataccgatactgcgaccgttgaggttcagccagacccccgtaaaagcgggctcgtggaactgactctccaggtgggcgtgggacagctgaccgagcaaagaaaggatacactagttcggcagctagctgtgttactgaatgtgctggattccgatattaaagtccagaagattcgggcacattctgatttgtccacagtcatagtgttttacgttcaatcccggcctcccttcaaggttctgaaagcagcggaggtggctcggaacctgcacatgcgactgagcaaggagaaagccgactttttattgtttaaggtgctgcgggtcgacactgcgggctgcttgttgaaatgtagcggccacggccactgtgacccactgactaagaggtgcatctgcagtcatctgtggatggagaacctcattcagcgctatatttgggacggtgaatccaactgtgagtggagcatcttctatgtgaccgtcctcgctttcactctgatcgtcctgaccgggggctttacttggttgtgcatctgctgttgtaagcgacagaagcgaaccaaaatccggaagaagacaaagtacaccatactggataacatggatgaacaggagcggatggagctccgcccaaagtacggcatcaagcaccggtctaccgagcataattcaagtctgatggtgagcgaatctgagttcgactccgaccaagatacaatcttctctagagaaaagatggaacggggcaaccctaaggtctctatgaacgggagtatacgtaacggggcatccttctcttactgcagcaaagataggtag

SEQ ID NO: 130468 - DNA, 1380 bp, Artificial Sequence
  Description of Artificial Sequence: Synthetic coding sequence
atgggtggactattcagccgatggcgcacaaaaccctccacggtggaggtcctagagtctatagacaaagagatacaggccctggaagagtttcgcgaaaaaaaccagcgattgcaaaaactctgggttgggagactgattttgtacagttctgtgctgtacctcttcacgtgtctaatcgtatacctgtggtacctcccagatgaattcactgcccggcttgcaatgacactccccttctttgcctttccactgatcatatggtctatcagaaccgtgattatcttcttcttcagcaaacgcactgagcgcaataacgaagctctcgacgacctcaaaagccagaggaagaaaatactggaggaagttatggagaaagagacatataaaacagccaaactcattctggaacgcttcgacccggacagcaaaaaagcaaaggagtgcgagcctcctagtgcaggagccgcagtaacggctcggccaggccaggaaattcgacaaaggacagccgctcaaagaaacctgtcccctaccccggcctctcccaatcaaggtcccccgcctcaggtgccagtttcgcccgggccccctaaagactcgtcggcccccggcggacccccagaacgcactgtaaccccggccctgagttccaacgtgttaccgagacacttgggttcccccgccacaagtgttccaggcatggagatggggctgccccacatcgcccaggccggattggagcacttgagtagcagtgatctcagtacatcaaccagccagtctgcaggtatcacagggttacacccgcccggccctccactagcccggccaattttacctagggagagaggggccctagacagaatcgtcgaatatcttgttggtgacggtccccagaaccggtacgccctcatatgccaacaatgcttctcccataatggaatggcgcttaaagaggagtttgagtacatcgccttccgctgtgcgtattgttttttcttaaatccggctagaaagactcggccacaggccccacggctgccagaattcagctttgaaaagcggcaggttgtggaagggtcaagctctgtaggtcccttgccctctggttctgttctgtcatctgacaatcagttcaatgaggagtctctggaacacgacgtcctggacgacaacaccgaacagaccgacgacaagatccctgcaacagaacagacaaaccaggtgatcgagaaggccagcgactcggaagaacctgaagagaaacaggaaaccgagaacgaggaagcttcagttatcgaaacaaactccacggtgcccggagcagactctatcccagaccctgaattaagcggcgaaagcctaactgcagagtag

SEQ ID NO: 130469 - DNA, 240 bp, Artificial Sequence
  Description of Artificial Sequence: Synthetic coding sequence
atgcatcctgatctctccccacacctacatacggaggagtgtaatgtgcttataaatctgctcaaagaatgccataagaatcacaatattctcaagtttttcgggtattgcaacgatgtcgatcgggaactgcggaagtgcctgaaaaatgaatacgtcgagaataggaccaaatctagagagcacgggattgctatgcgtaaaaagctcttcaacccgccagaggagtccgaaaagtag

SEQ ID NO: 130470 - DNA, 1569 bp, Artificial Sequence
  Description of Artificial Sequence: Synthetic coding sequence
atgagccggcaactcctgccagttcttctcctgctgttgttacgggcctcctgtccctgggggcaggagcagggcgcgcggagtccaagtgaagagcccccagaggaggaaatccccaaggaggatggaattctggtcttaagtaggcacaccctgggccttgctctgcgggagcaccccgccctgctggtcgagttctacgcaccctggtgcggccattgccaagctttggcacccgagtatagtaaagccgctgctgtccttgccgccgagtcgatggtcgtaaccctcgccaaggtcgacggtccagctcagcgagagttagccgaagaatttggggtgactgagtatcccactttaaaattcttccgcaatggcaaccgaacccatcctgaggaatacaccggtccccgtgacgccgagggaatcgcagaatggctgaggcggagggtgggtccttctgcaatgagattagaagacgaagctgcagcacaggcccttatcggaggcagagatttagtcgtcatcgggttctttcaggacgaagacgtcgccacgttcttagccctggcccaggacgctttagatatgaccttcggacttaccgaccgccctcgcttgtttcaacagttcggactaacgaaagacacagttgtgctctttaaaaaattcgatgagggcagggctgattttccagttgacgaagaactgggcctggacctgggggatttgtcacggttcttggttactcattctatgcgcctagttactgaattcaacagccaaacaagcgcgaaaatcttcgctgctaggatcctgaaccacctgctgctttttgtgaaccaaaccctggccgcccatagagagctgttggccggattcggtgaggctgcaccaagatttcgaggccaggttctgttcgttgtcgttgacgtcgcggccgacaatgaacacgtgttgcaatattttgggctgaaggcagaagccgcccctacactccgcctggtgaacctggaaacaacaaaaaagtacgcgccagttgatggtggtcctgtgaccgcggctagcatcactgccttctgccatgccgtgctcaatggacaggtaaagccatatctcctgtctcaggaaatccccccagattgggaccagcgccccgtcaaaaccttagttggaaaaaacttcgaacaggttgcctttgacgagacaaagaacgtgttcgtcaagttctacgcgccatggtgcactcactgcaaggaaatggccccagcttgggaggctctggcagaaaaataccaggatcatgaggatatcattattgcagaactggacgcaactgccaatgaactggacgcctttgctgtgcacggctttccgactctcaagtactttcccgctggacccggtcgcaaggtgattgagtataagagcacgagagatttggaaacttttagcaagtttctagacaacggcggtgtgctccccaccgaggaaccaccagaagaacccgccgcgccttttcctgagcctcctgccaattccactatgggcagcaaggaagaattgtag

SEQ ID NO: 130471 - DNA, 1485 bp, Artificial Sequence
  Description of Artificial Sequence: Synthetic coding sequence
atgggcagcggaaccgggagcgaggagccgctaggcggtgcctctcgaggggggaatcctcaagggggctgggatctgggcgcagagcccccccaccctggccctgggcctgctggggcgccatgccccgccgggggcatcctttgcccagttgtttgggctcttccaggaccaggacctagggttcaacagggtagttgtagggcccgagggcgagttaacggggggcacgccgaggagtttggcgtgacagaatacccaacattaaagttctttcggaacggcaaccgaactcaccctgaagaatatactggaccacgagatgccgaaggaattgccgaatggctgcggaggagagttgggccctcagctatgcgtctcgaggacgaagctgctgcgcaggccctcatcgggggccgcgacctggtggtcatagggttctttcaagatttgcaggacgaagacgttgccacgtttctggcacttgctcaagatgcccttgatatgactttcggacttaccgatcgcccacgactgtttcagcagttcggactgactaaagacacggtggtccttttcaagaagttcgatgagggccgcgctgacttcccagtggacgaggaactgggactggatttaggggatctgagccgcttcctcgtgacccatagcatgagacttgttaccgaattcaacagccagacctctgcgaaaatctttgcagctcgaatcctcaaccacttgttgctgttcgttaatcagacactggctgcccatagagaactcttggcaggtttcggggaggccgcacctcgatttagaggacaggtgctgttcgtagtggtggatgtggctgctgataacgagcacgttctgcagtacttcggcctgaaagccgaggctgcgcccactttacgcctcgtgaaccttgaaaccaccaagaagtatgctccagtcgacggtggccctgtcacagccgcttcaatcaccgcgttctgccacgccgtactaaacgggcaagtgaaaccatatctcctaagtcaggagattccgcccgactgggatcagaggcccgtgaagacgcttgtggggaagaactttgaacaagtcgcatttgacgagactaagaacgtttttgttaaattttacgcgccgtggtgcacccattgtaaggagatggctcctgcctgggaggccctagccgagaagtaccaagaccacgaagacattattatcgctgagctggacgctaccgccaacgagttggacgcattcgccgtgcacggattccccaccctgaagtattttcccgcgggcccgggacggaaggtgattgagtataagagcacgcgggacctggaaactttctctaagtttctggacaatggaggggtccttccgacagaagaaccccccgaggagccagccgccccattccccgaacccccagctaattccacaatggggtccaaggaggaactttag

SEQ ID NO: 130472 - DNA, 1323 bp, Artificial Sequence
  Description of Artificial Sequence: Synthetic coding sequence
atggctttgctcgtccttggactcgtgtcgtgcacgttctttctcgcggtcaatggactgtactcatcatccgacgacgttatcgagttaaccccatcaaatttcaaccgcgaggttatccagtctgatagcctgtggctggtggagttttacgccccctggtgtggacactgccagcggctgaccccagagtggaagaaggccgctacagctttaaaagacgtcgttaaggtgggagcagtggatgctgacaagcatcattctctaggtggacaatacggtgtgcaggggtttcccactatcaaaatttttggctccaacaaaaaccgccctgaggactatcagggcggtcggaccggagaggctatcgtagatgctgctctgtctgctctgagacagttagtgaaagacaggctcggtggcaggagtggcggttacagcagcggaaaacagggacgctccgatagctcttctaagaaagatgtgatcgagctcactgacgacagctttgacaagaatgtgttggactctgaagacgtctggatggttgagttctatgctccgtggtgtggccattgcaaaaatttggagcctgagtgggccgctgcagcttctgaagttaaagagcagactaaaggcaaagtcaagctagccgcggtggacgctactgttaatcaggttctggcttctcgttatggtattcgcgggtttccgacgatcaagattttccaaaagggtgagagccccgtcgattatgacggtggcaggactcgctcagacatagtttcaagagccctggacctgttttctgataacgcgccaccaccggaacttttagagattattaacgaggatatcgcaaaaagaacatgtgaagagcaccagttatgcgttgttgcggtgctgcctcatatcctggatacaggagctgctggaaggaattcatatctggaagtcctcctgaagttggcggacaagtacaagaaaaaaatgtggggatggctatggacggaagcaggggcacagtcagagctcgagaccgctctcggaatcggaggtttcgggtacccggctatggcagccattaacgcccggaagatgaagttcgcactgttaaaaggaagcttctccgaacagggcatcaatgagttcttaagggagctgtctttcggcagagggtccaccgctcccgtcggtggcggggcgttcccaacaatcgttgagcgcgagccctgggacggtagggatggcgagctacctgttgaggacgatattgatctttccgacgtggaattggacgaccttggcaaagacgagctctag

SEQ ID NO: 130473 - DNA, 1338 bp, Artificial Sequence
  Description of Artificial Sequence: Synthetic coding sequence
atgtacccgtctacaaccatggccaacgcccctggcttggtcagctgtacattctttcttgctgtcaatggtttgtattcctcaagtgacgatgtcatagaactgactccttctaatttcaaccgtgaggttatccagtctgatagcctgtggttagtcgagttctacgctccctggtgcggacattgccagaggctgacgcccgagtggaaaaaggcagccacggctctgaaggacgttgtaaaagttggtgccgtcgacgccgacaagcaccactccctgggtggccagtatggagtgcaaggctttccaaccatcaagatctttggttctaataagaaccgacctgaggattatcagggcgggcggactggcgaggccattgtcgacgctgccctgtccgctctgagacaactcgtgaaggacaggctgggaggacgaagcggtggctacagttctggtaagcagggccgaagtgattctagctccaagaaggacgttatcgagctgacagatgattcattcgacaaaaacgttctggactccgaggatgtgtggatggtagagttttacgccccatggtgtggacactgcaaaaatttagagccagagtgggcggccgcagcttctgaagtcaaggaacagacaaagggcaaagtcaaactggcggcggttgacgcaactgtgaatcaggtccttgcgagcagatacgggatacgcggcttccctacaatcaaaatctttcagaagggcgagtctccggtcgactatgacggggggaggacccggtccgatatcgtgtctcgggcactggacctgttctccgataatgcgcccccccccgagttattagagattatcaacgaggatattgccaagagaacgtgcgaggagcatcagctgtgtgtggttgcggttcttcctcacattcttgataccggggcagcagggcggaatagctatcttgaagtcctccttaaactggctgataagtacaagaaaaagatgtggggctggctttggaccgaagcgggcgcccaatccgaattagagactgccttggggattggcgggttcggttacccagccatggctgccattaatgccagaaagatgaagtttgctctgcttaagggttccttttctgagcaggggatcaacgagttcctgcgggaattgtcattcggcagagggtccacagctcctgttggtggaggcgcattccctacaatcgttgagcgcgagccttgggacgggcgggatggggagctccctgttgaagacgacattgatctatccgacgtggagctcgacgatctgggcaaagacgagctctag

SEQ ID NO: 130474 - DNA, 36 bp, Artificial Sequence
  Description of Artificial Sequence: Synthetic coding sequence
atgtatcccagcacgaccatggcaaacgccccatag

SEQ ID NO: 130475 - DNA, 1314 bp, Artificial Sequence
  Description of Artificial Sequence: Synthetic coding sequence
atgatcttaggtctggtgtcttgtacctttttcctggccgtgaatggattgtactcaagttctgacgacgtcatagagttgactccctctaactttaatcgggaagtcatccaaagtgattccttgtggctggttgagttttatgccccctggtgcggccactgccagaggttaactcctgaatggaaaaaagccgccaccgccttaaaggatgttgtaaaggtgggcgccgtggacgccgataagcaccatagtctaggcggacagtacggggtgcagggttttcctacaatcaagatctttgggtcaaataagaataggccggaggactatcagggtggaaggaccggcgaggccatcgtggacgctgctctctccgcgctgcggcagctggtgaaagaccgcctgggtgggcggtccggcggatacagctcaggaaagcaaggcaggtccgatagcagctctaagaaggacgtgattgagttgactgacgactccttcgataagaatgtgcttgatagtgaagacgtctggatggtggagttctacgcaccctggtgtggacattgtaagaatttagaacccgagtgggcggcagccgcctccgaggttaaggaacagacaaagggcaaagtgaaactggcagcagtcgatgccaccgtaaatcaggtacttgccagcaggtacgggatcagaggcttccccactatcaaaatcttccagaagggggagagccctgttgattacgacggaggaagaacccggagtgacatcgtgagtagagctctagacctgtttagcgacaatgctccccctcccgagctgctggagatcattaacgaggatatcgccaagcgcacctgcgaggagcaccagctgtgcgtggtggcggtcttgccccatattctcgacacaggcgcggccggccgaaactcgtacctcgaagtcttactgaagctagctgacaaatacaagaagaagatgtggggctggctttggacggaggcaggcgcacagtcagagttagagaccgcattaggtattgggggattcggctatcccgcaatggcagcaataaatgcccgcaagatgaagtttgccctcctcaaaggcagtttcagcgagcagggcattaatgaattcctgcgggagctgtcatttgggaggggctccaccgcccctgttggtgggggagcattccccaccattgtggagcgcgaaccttgggacggtagagacggcgaactgcctgttgaggacgacattgacctgagtgatgtcgaattagacgatctgggtaaggacgaattgtag

SEQ ID NO: 130476 - DNA, 1956 bp, Artificial Sequence
  Description of Artificial Sequence: Synthetic coding sequence
atggcggactcagccgagttgaagcagatggtgatgagcttacgggttagcgaactgcaggttttactaggatacgccggacgcaacaagcacggcaggaagcatgaactgctgacaaaagcactgcacctcctgaaggctggctgtagcccagcggttcaaatgaaaatcaaggaactttatagaaggcgatttccccaaaagattatgacacctgccgatctcagtatccctaacgtgcactcatcccctatgcccgcgaccctgtctccctcaacaattccacagctgacgtatgacgggcaccctgcatcaagtcctctgcttccagtgtctctcttaggccctaaacacgagctcgagctgcctcacctgacgagcgccctccaccccgtccacccggatatcaagttacagaaactgccattttacgacttactggacgagctgattaagccgactagccttgcttccgacaactcacagaggttccgagagacgtgcttcgcctttgctcttacaccacagcaggttcagcagatcagcagcagtatggatatcagtggaaccaagtgcgatttcaccgtccaggtccagctcaggttctgcttgagtgaaacatcatgtcctcaggaggatcacttccctccgaacctctgcgtgaaggttaacaccaagccctgttctctcccagggtacctgccccctaccaaaaacggggtggagccaaaaaggccctctcggccaattaacattactagtctagttcggctttccacgactgtgccgaataccatcgtggtgtcctggactgcagagatcggaaggaattatagtatggctgtttatttggtcaagcaattaagttccacagtcctgctccaaagattgcgggcaaaggggatacggaatcctgaccacagcagggccctaatcaaggaaaaactgaccgccgaccccgattccgagattgcaacaacatccctgagagtgagtctcctgtgccccctggggaaaatgcgactgactatcccgtgcagggcccttacttgctcacacttgcaatgtttcgatgcgacgctgtacatccagatgaacgaaaagaaacctacatgggtctgccccgtgtgcgataaaaaggcaccgtatgagcacttaatcatcgacggcttgtttatggagattctcaaatactgtaccgattgcgacgaaatccagttcaaggaagatggtacttgggccccaatgagatcaaaaaaagaagttcaggaggtgtcggcaagttataatggtgtcgacggctgcctttcctcgacgctcgagcaccaggttgcctctcatcaccaatcctctaataagaacaaaaaagtggaagtaatagatctgacaattgactcctccagcgatgaagaagaggaggagcctagcgccaaacggacatgcccatctctttcaccaacgtcaccacttaataacaaagggatcttgtccttgcctcatcaggctagccctgtatctaggacaccaagtttgccagctgtcgacacgagctacatcaacacaagcttgatccaagactacagacaccccttccacatgactcccatgccgtacgatttacaaggactggactttttcccttttctatcgggtgacaaccaacattacaacacttcccttctagcagccgccgccgccgccgtgagcgacgaccaagatcttcttcattcatctcgattctttccatacacatcttcacagatgttcctagaccagctgtcagctgggggttccacctctctgcccactacaaacgggtccagttcagggagtaattcgtccttggtgagcagtaattctctccgagaatcccattcacatacggtaacgaaccgaagtagcactgacaccgccagcattttcggcataatccctgatattattagtcttgattag

SEQ ID NO: 130477 - DNA, 1962 bp, Artificial Sequence
  Description of Artificial Sequence: Synthetic coding sequence
atgtttaccctgcaggatagttacgttaagcagatggtaatgagcttgagggtgagcgaactgcaagtcttacttggatacgccggacggaataagcacggacggaaacacgaactcctcacaaaagcccttcatttgctgaaggccggatgctcaccagccgtgcagatgaagatcaaggagctgtaccgacggcgctttccacagaaaatcatgaccccagccgaccttagcatccccaacgtgcatagcagtcccatgcccgctacattgagcccatcaaccattcctcagttaacatacgacggacatcctgcgagctctccccttttgccggtgtccctgctcggacctaaacatgaactcgaattgccacatctgacatctgcactacacccggtccaccccgacatcaagctccagaagctccccttttacgacctgcttgatgagctgattaagcccacatccttagcgagtgacaactcccagagattccgcgaaacctgctttgctttcgcccttacgcctcaacaggtgcaacagatttccagcagtatggacatttcaggcacaaagtgcgactttacagtccaagtgcagttgagattttgcctaagtgagacctcgtgtccgcaagaggatcatttcccccctaacttatgtgtaaaggtaaacaccaagccctgttcattaccaggataccttcctcccacaaaaaatggcgtagagccaaaaagacctagccggcccataaatattacatctctggttcggctgtctaccacggtgccaaatacgatcgtcgtgagttggaccgccgaaatcggaagaaactattcgatggccgtgtatctggttaagcagcttagcagtacagtgctactgcagaggctgcgtgctaaaggtatacgcaatcctgaccacagtcgcgcactgattaaagagaaattgaccgcagacccagactccgagatcgctactacttcattaagggttagtcttctttgcccacttggtaaaatgcggctgaccatcccttgtcgggctctgacttgttcccacttacagtgtttcgatgcaactctgtacattcaaatgaacgagaagaagcccacatgggtgtgtcctgtgtgcgataagaaagcgccgtacgagcaccttattatcgacggtcttttcatggagatcctcaaatactgtacagattgcgacgaaatccagtttaaagaagatgggacatgggctcccatgcggagtaagaaagaggtgcaagaggtcagcgcctcgtacaatggcgtcgatggctgtctcagttctactctggaacatcaggttgctagtcaccaccagagttctaataagaataaaaaggtagaagtgatcgatctgaccatagacagctcgtccgacgaggaagaggaagaaccatctgcaaaacgtacctgcccatcgctaagcccaacaagtccgctcaacaacaaggggatcctatccttgcctcaccaggccagtcccgtttccaggacccctagcctgccagccgtggacaccagctatatcaacaccagcctcatacaagactatcgacatcccttccacatgacccctatgccatacgatctgcaaggactggacttctttcctttcctctctggggacaaccagcattacaacacctcgctgcttgccgccgcagcagccgcagtgtccgatgaccaggatctgctgcacagtagcagatttttcccttacactagttctcagatgtttctggaccagctcagcgctggtgggtccacatccctgcccacaacaaatggaagttcatccggttccaactcctcactcgtgtcttcaaatagtttacgagaaagccactcgcatacagtcaccaaccgctcctccactgacacagcctctatatttggtatcattcctgatatcatctcactggattag

SEQ ID NO: 130478 - DNA, 1782 bp, Artificial Sequence
  Description of Artificial Sequence: Synthetic coding sequence
atggcagagctgggcgagttgaagcacatggtaatgtcgttccgcgtgtctgagctgcaggtcctgctgggttttgcaggacggaacaaatcaggacgtaagcacgagttgctggcgaaggccctccacctattaaagagcagctgcgcccccagtgtgcagatgaaaattaaagagctgtaccgacgccgctttccccgaaagacgctgggtccctccgacctttctttgcttagtctgccaccagggaccagccctccggtccatcccgatgttacgatgaaacccctgcccttttacgaggtctacggtgaactgatccgtcctacaactcttgcttccactagctcccagcgattcgaggaggcccattttacattcgcactgactccccaacaggtgcagcaaatattgacctcgagggaagtgttgcctggagcgaagtgtgattatactatacaggtgcagctccggttctgcctgtgtgagacctcctgtccccaagaagactacttccctcctaacctttttgtgaaggtgaatggcaaattgtgtccgctccctggctatcttccacccactaaaaacggcgcagaacccaaacgtccttcccgcccaataaatattacccccctcgcccgtctgtctgccacagttcctaacacgattgtcgtgaactggtcctccgaattcggcagaaactactcactgagtgtatacctcgtgaggcaattaacagccgggactctgctgcaaaagctgagggccaaagggatcaggaaccctgaccatagccgcgcactgattaaggagaagcttacagccgacccagacagcgaggtggcgactacgagcctccgcgtgtctctgatgtgccctctggggaagatgcgtctgacggtaccgtgcagagctttgacctgcgcccacctgcagtccttcgacgcggctctgtacttgcagatgaacgagaagaaacccacatggacatgcccagtctgtgacaagaaagcaccttacgagtctttgattattgatggcctgtttatggaaattctctcgagctgtagtgactgcgatgagatccagttcatggaagacggcagttggtgtccaatgaagcctaaaaaggaggccagtgaagtgtgccctcccccgggttatggtctagacggactccaatatagtcctgttcagggcggcgacccgagcgagaataaaaaaaaggtggaggtaatcgacctgacaattgagagctcgtcggatgaagaggacttgccacctactaaaaagcactgttcagtgacttcggccgctatccccgcccttccaggaagcaagggtgtgctgaccagtgggcatcagccatcctctgtcctgcgctcccccgcgatgggcacgctgggtggcgattttttgtcatctctccccttacatgagtatcctcccgcttttcctttgggcgctgacattcagggactcgacctgttctcctttttgcagaccgaatcgcaacattacggaccatcagtgataactagccttgatgaacaggacgccctgggccattttttccaataccgcggcactcccagccactttttaggtcctctagcccccacattggggagctctcattgctcagctactcctgcgccaccccccggacgtgtgtcatctattgtcgcgcccggaggggcactgagagaagggcacgggggccccctcccaagcggtccttcccttacaggctgccgatctgacataattagtttagattag

SEQ ID NO: 130479 - DNA, 873 bp, Artificial Sequence
  Description of Artificial Sequence: Synthetic coding sequence
atggtgatgtccttccgcgtgtctgagttacaggtactgctggggtttgctggaaggaacaaaagcggacggaaacacgaactgttggcaaaagctctgcacctgctcaaaagctcatgtgcaccgtcagtccaaatgaagatcaaggagttgtaccgcaggcgttttccgcggaagacacttggcccatccgacctgtcactgcttagcttaccacctgggacatccccggtgggatcccctggcccactggctcctattccaccaacactgctagctcccggcacacttctgggccccaagagagaggtggatatgcatcctccactgccacagccagttcacccagatgtgaccatgaaacctctgcctttctatgaggtatacggtgagctcatcaggcctactacattagcctctacctcgtcgcagagatttgaggaagcccatttcactttcgcactcaccccacagcaagttcagcagattctgacttctagagaagtcctgcctggtgctaaatgtgattacacgatacaggtgcagctgaggttctgcctatgcgaaacgtcttgcccacaggaagattactttccaccaaacctgtttgtcaaagtaaatggcaagctgtgcccactccccggatatctgcccccaactaagaatggtgcagaaccaaagcgaccgtcgaggccaataaatataactccactggctcgcctttcggcaactgtgcctaacactattgtggtgaattggagcagtgagttcggccgggttagcactgctaaagccggggcttggaagagcttgctacgcgtaaaaggaaaccaccctgtgagctgggtcggggaggccttctctagcctctag

SEQ ID NO: 130480 - DNA, 1887 bp, Artificial Sequence
  Description of Artificial Sequence: Synthetic coding sequence
atggcagaactgggggagctgaagcatatggtcatgagttttagagttagtgagttacaggtcctgcttgggttcgcaggccgtaataagtctggtaggaaacacgaactgttagccaaggcccttcaccttttgaaatctagctgtgctccctcagtgcagatgaaaatcaaagaactgtaccgccgcaggtttcccaggaagacacttgggccatcagacttatccctgctaagcttgcctcccgggacctcccccgttggatcacccggtcctctagccccaatcccaccaaccttgctggcgcccggcacattactgggaccaaaacgcgaggtggacatgcacccaccgttgccacagccagtacatccagatgtgacaatgaagccactgcctttctacgaagtgtacggtgaactcatcaggccaacgacacttgcctcaacctcctcccagcggtttgaggaggcccacttcaccttcgcgctgacacctcagcaggtccaacagatcctgacatcccgcgaagtgctccccggcgccaaatgcgactacaccattcaggttcagctgagattctgtttatgtgaaacctcatgtcctcaagaggactacttcccacccaacctcttcgtcaaagtgaatggtaagctgtgccccctgcccgggtacctcccccccaccaaaaacggagctgagccaaaaaggccctctcgcccgattaacatcacgccactcgcccgtctaagcgctaccgttcctaacacaatcgttgtgaattggagcagcgagtttgggcgaaactattctttgagtgtttatttggttcgccagctaaccgcaggcaccctcctgcagaagctaagagcaaaggggattaggaatccagaccacagtcgagctttgattaaggagaagctcacagctgaccccgattctgaggttgctacaacgtctttgagggtatcactgatgtgcccgctcgggaaaatgagacttaccgtgccttgccgagccctaacttgtgctcatctccagagttttgacgccgcactctatttacagatgaacgagaagaagcccacctggacttgtcccgtgtgtgataaaaaagccccatatgaaagccttattattgatggcctgtttatggagatactctcatcatgctcggattgcgacgaaattcagttcatggaagatggctcttggtgtcccatgaaaccaaaaaaagaggcctccgaggtgtgtccaccaccgggttacggcctggatgggctgcagtacagccctgtacagggcggagacccatctgaaaataaaaaaaaggttgaggttattgatctaacaatagaatcatcctctgacgaagaagatcttccacctaccaaaaagcactgtagcgtgaccagtgccgctattccagcacttccgggaagcaagggcgtcctgacaagtgggcaccagccatctagcgtgctgagaagccctgcaatgggaaccctgggcggagacttcctgagcagtctaccactacacgaatatcctccagccttcccactgggggctgatatccagggcttagacctgttctcgtttctacagacagagtcgcagcactatgggccgagtgtaataacctcactcgacgagcaggatgcactgggacacttttttcagtacagaggcaccccaagccactttctgggaccgctggcaccaaccttgggcagcagccattgctctgcaactccggcccctccaccggggcgggtgtcgtcaattgtggcacccggaggggcgctgagggaggggcacggcggccccctcccgagcggtccgagcctcaccgggtgccggtctgacattattagcctcgattag

SEQ ID NO: 130481 - DNA, 780 bp, Artificial Sequence
  Description of Artificial Sequence: Synthetic coding sequence
atggtcatgtcctttcgagtgagtgagttacaagtgcttctaggcttcgctggacgcaacaaaagtgggaggaaacatgagctgcttgcaaaggccctccatctgctgaaatcttcttgtgccccctctgtgcagatgaagatcaaggagctctacaggagaaggttccctaggaagacactgggaccctccgacctctcgcttctgagcctgcccccagggacctccccggttggatctccagggcccttggctcctatacctcccaccctattagccccgggcaccctcctgggtccaaagcgggaagtcgacatgcacccaccgctgcctcagccagtccacccagacgtgaccatgaagcccctgccgttttatgaggtctacggggagctcatcaggcccacaacccttgccagcacttccagccagcgcttcgaggaggcccacttcacattcgctctgaccccacagcaggtacagcagattctcacttcgagggaggtactgccaggggccaagtgtgactacaccatccaggtccagttgcggttctgcctctgcgagacctcttgcccccaggaagactattttcccccaaatctgtttgtcaaggttaatgggaaactctgtccactgcccgggtacctacccccaacgaaaaacggcgcagagcccaaacgtccaagtcggcctattaatattacaccactggccaggcttagcgccacggtcccaaacactattgtagtcaattggagctctgagttcggccgctag

SEQ ID NO: 130482 - DNA, 1248 bp, Artificial Sequence
  Description of Artificial Sequence: Synthetic coding sequence
atgttcgctgacctggactatgatatcgaggaggataaactgggcatccctacagtaccagggaaagttacacttcagaaggatgctcagaacctgatcgggatatccataggtgggggcgctcaatattgtccatgcctttacatcgttcaagttttcgacaacactccggccgccctcgacggaacagttgccgctggagatgagataaccggagtcaatggccggtccatcaaagggaagacaaaggtcgaggtcgctaagatgatccaggaggtgaagggtgaagtcactattcactacaataaactccaggctgaccccaagcagggcatgtccctcgacattgtgctgaagaaggttaaacataggctcgtagagaatatgagttccgggactgccgatgctcttggtttaagccgtgcaatcctttgcaatgacggcctggtgaaaagactagaggagcttgagagaactgctgagctttacaaagggatgacagagcatacaaagaatctgctcagagcattctacgagctaagccagacccaccgtgctttcggggacgtcttctctgtgataggcgtgcgagaaccccagcccgcagctagtgaagccttcgtcaagtttgccgacgctcataggagcatcgaaaaattcggtatacgactcctcaaaaccatcaaaccgatgctaactgaccttaacacttatttaaataaggccatacctgatacaagattgactattaagaagtacctggacgtaaagttcgaatacctttcctattgtcttaaggtcaaagaaatggatgacgaggaatactcgtgtattgctctgggggaaccgctttaccgcgtgagtaccggaaactatgagtatagacttattctacggtgccgtcaggaagcaagggctagatttagtcagatgaggaaagacgtcctagagaaaatggagctccttgatcaaaaacacgtgcaggatatagtatttcagctccagagactggtgagtaccatgtccaagtactataacgattgctatgcggtgctccgagatgctgacgtgttcccaatcgaagtcgatttggcgcacactactttggcctatggcctgaaccaggaggaattcaccgatggggaagaggaagaggaggaggaggacacagctgcaggtgagccaagtcgcgatacacggggagccgctggacctctggataaaggcgggtcttggtgtgatagctag

SEQ ID NO: 130483 - DNA, 1248 bp, Artificial Sequence
  Description of Artificial Sequence: Synthetic coding sequence
atgttcgcggatttggattatgatattgaggaggacaaattagggattcccacagtgcctggtaaggtgaccctgcaaaaagatgcacagaatctcatcggcatctccataggaggcggggcgcaatactgtccatgcctgtacattgtgcaagtctttgataacacccccgcagcactggacggtactgtcgcagccggggacgagatcactggtgtcaacggccggtcaattaagggcaaaacaaaagtggaagtcgcaaaaatgattcaagaggtgaagggtgaggtgaccatccattacaataaactgcaagccgatcccaagcaaggaatgtctcttgacattgtccttaagaaggtgaagcaccggctcgttgaaaacatgagctcaggcacggccgatgcactcggtcttagtcgggcaattctgtgcaacgacggacttgtgaaacggcttgaggaattggagcggaccgctgagctgtacaaggggatgacagaacatacaaaaaacctgctgagagctttctatgaacttagccaaacacaccgggctttcggggatgtgttctcagtgattggagtgagagagccacagccagctgctagcgaagctttcgttaagtttgctgatgctcatcgatcaatcgagaagttcggtatcagactccttaaaacaatcaagcccatgctcactgatctaaacacgtacctgaacaaggctatacccgatactcggcttacaatcaagaaatacctggatgtcaagtttgagtatctgtcctattgcctgaaagtcaaggagatggacgacgaggagtattcttgtattgccttaggcgagcccctgtacagagtaagcaccgggaactatgaatacagactgattttgcggtgtcggcaggaagctagggctagattttctcaaatgcgaaaagacgtactggaaaagatggaattgcttgatcagaaacacgtccaggatatagtcttccagctgcagcgtttagtatccacaatgagtaagtactacaatgactgctacgccgtgctacgcgacgctgacgtctttccaatcgaggtagatttggctcacaccaccctggcttatggtctgaaccaggaagagtttaccgacggtgaggaggaagaagaagaagaggacacagcggccggagagccaagccgggacactagaggggccgctggccctctggacaagggcggctcctggtgcgattcatag

SEQ ID NO: 130484 - DNA, 690 bp, Artificial Sequence
  Description of Artificial Sequence: Synthetic coding sequence
atgtttgccgatctcgactacgacattgaggaagataaacttggcatccccacggtacctggcaaagtgacattacaaaaggacgctcagaaccttattggaatctcaatcggcggaggcgcccaatattgtccatgtctgtacatcgtgcaggtgtttgacaacacaccggctgcattggatggaactgtagctgctggcgacgagataaccggagtgaacggtagatccatcaagggaaagaccaaggtggaagtagcaaagatgattcaggaggtcaaaggcgaggttactatccattataacaaactgcaggccgatcccaagcagggtatgtcgctggacatcgttctgaaaaaagtgaaacacaggctcgtcgagaacatgtctagcgggactgctgatgctctgggacttagcagagcaatactatgtaatgatgggcttgttaaaaggctggaggaactggagaggacagccgagctttacaagggaatgacagaacacactaaaaacctgcttcgggctttttatgaactttcacagactcatagggcatttggcgatgtcttcagtgtaatcggtgttcgagagccacaaccagcggcttctgaagctttcgtgaagtttgctgatgcccacaggtcgattgaaaaatttggaatcaggcttctcaaaacgataaagtag

SEQ ID NO: 130485 - DNA, 405 bp, Artificial Sequence
  Description of Artificial Sequence: Synthetic coding sequence
atgtttgcggacctcgactatgacatagaggaggacaagctggggattccaaccgtccctggcaaagttaccctgcagaaggacgctcagaatctcataggcatctctatcgggggcggcgctcaatactgtccgtgcctttacatcgttcaggtgttcgacaacacgcccgctgctctggatggaaccgttgccgcgggcgacgagatcactggtgtcaacgggcggtccattaagggcaagacaaaagtagaagtagccaaaatgattcaggaggtgaaaggcgaggtgactatacactacaacaagctacaggctgatcccaagcagggtatgtcactcgacatcgtgcttaaaaaagtcaaacatcggctcgtggagaatatgagctccggcacagcttag

SEQ ID NO: 130486 - DNA, 393 bp, Artificial Sequence
  Description of Artificial Sequence: Synthetic coding sequence
atgttcgccgacttggactatgacatcgaagaggacaaacttggaatcccaaccgtccctgggaaggtcacattgcaaaaagatgctcagaacctgattggcattagtatcggagggggcgctcagtactgtccttgtctttacatcgtccaggttttcgataataccccagccgcccttgatggaaccgtagctgccggtgacgaaatcacaggtgtcaatggccgcagcatcaagggaaaaactaaagtggaagtggccaaaatgatccaggaggtgaaaggggaggtcacaatccactataacaagctgcaggcagatcctaagcagggcatgtctctggatattggccagagactcggatttcatggccctggcccacatagctcgtag

SEQ ID NO: 130487 - DNA, 117 bp, Artificial Sequence
  Description of Artificial Sequence: Synthetic coding sequence
atgttcgccgacctggattacgatattgaggaggataagctgggaatcccaaccgtccccggaaaggtcacactgcagaaggacgcgcagaaccttataggaatctccattggatag

SEQ ID NO: 130488 - DNA, 231 bp, Artificial Sequence
  Description of Artificial Sequence: Synthetic coding sequence
atgaccgatgtggagacaacatatgccgacttcatcgctagcggccggaccggaaggaggaatgccatccacgacatcttggtgagcagcgcctcagggaactcgaacgaactggcccttaagttagctggtctggatatcaacaaaacagagggtgaggaggatgcccagcgctcttccaccgaacaaagtggcgaagcacagggagaggccgctaagtcggagagctag

SEQ ID NO: 130489 - DNA, 231 bp, Artificial Sequence
  Description of Artificial Sequence: Synthetic coding sequence
atgactgatgtggaaactacatacgccgatttcatcgcgtcggggaggacggggcgccgcaatgcaatccacgacattttggtgagcagtgcctctggaaactccaacgagctcgctctgaagctggccggacttgatataaacaaaaccgaaggggaggaagacgcccagagatcttcaacggaacagtctggcgaggctcaaggagaggcagccaagtccgagtcatag

SEQ ID NO: 130490 - DNA, 231 bp, Artificial Sequence
  Description of Artificial Sequence: Synthetic coding sequence
atgacggatgttgaaacaacctacgcagacttcattgcctctggaagaactgggagacggaacgctatccatgacatactggtatcttctgctagcggaaacagcaatgagctggctctgaagctggcgggactcgacattaataagacagagggggaagaagacgctcagcgaagttctaccgagcagtccggagaggctcagggagaagccgctaagagcgaatcctag

SEQ ID NO: 130491 - DNA, 258 bp, Artificial Sequence
  Description of Artificial Sequence: Synthetic coding sequence
atgagtcaccaagacgtggccatgcggacggattcatccaaaatgacagacgttgagagcggagttgctaattttgcctcatcagcaagggctgggaggaggaacgccctccctgacatccaatcatccgccgccactgacggtacgtcggatctccccctgaagcttgaggccttgagcgtcaaagaggacgccaaggagaaggatgagaaaacaactcaggatcagttggaaaagcctcaaaacgaagagaagtag

SEQ ID NO: 130492 - DNA, 237 bp, Artificial Sequence
  Description of Artificial Sequence: Synthetic coding sequence
atgcgtactgactcgtccaagatgactgatgtagagtcgggagtggccaactttgcatcgtctgctagagcgggcaggcggaacgcgctacccgacatccaatctagtgctgccaccgatggaacctctgacttaccactcaagttagaagctttatccgtgaaggaggatgccaaggaaaaggacgaaaaaactacccaggaccaactggaaaagcctcagaacgaggagaagtag

SEQ ID NO: 130493 - DNA, 264 bp, Artificial Sequence
  Description of Artificial Sequence: Synthetic coding sequence
atgcacatcctctttgtggacgtggccatgcgcaccgactcatccaagatgacggatgtcgagagcggcgtcgccaacttcgcctcttcagctagagccggccgacgcaatgccctcccggacatacagtcaagtgctgcgaccgatggcacgagcgatctgccactgaagctagaggcactttccgtaaaggaagatgctaaggagaaagacgaaaaaaccacgcaggaccagttggaaaaaccacaaaatgaggagaagtag

SEQ ID NO: 130494 - DNA, 237 bp, Artificial Sequence
  Description of Artificial Sequence: Synthetic coding sequence
atgcggactgacagttcgaagatgaccgatgtggagtctggcgtggctaattttgcaagcagcgcccgggccggtcggagaaacgcactccctgacatccaatcaagcgctgccaccgacggcacctccgatctgcctctgaaattggaggccctatctgttaaggaggacgctaaggaaaaagacgaaaaaacgactcaggaccagttggaaaagccacaaaatgaggaaaagtag

SEQ ID NO: 130495 - DNA, 237 bp, Artificial Sequence
  Description of Artificial Sequence: Synthetic coding sequence
atgcgtacagacagttctaaaatgaccgacgtggagtcgggcgtggctaacttcgcttcctcagccagggcaggccgtagaaacgctctccccgatattcagtcatcagctgccaccgatggaacttctgacctaccattaaaattggaagctctaagcgttaaggaagatgcaaaggaaaaggacgaaaaaactacccaggaccagctggagaagccccagaacgaggagaagtag

SEQ ID NO: 130496 - DNA, 237 bp, Artificial Sequence
  Description of Artificial Sequence: Synthetic coding sequence
atgcgcactgactcaagcaagatgaccgacgtggagagcggagttgcgaattttgctagttctgccagagcgggacggagaaatgcattgcctgacattcaatcaagcgccgccacggacggaacatcagatctgccactgaaactcgaggccttgtccgtcaaagaggatgcaaaagagaaagatgagaagaccacacaggaccagcttgaaaagcctcagaacgaagaaaagtag

SEQ ID NO: 130497 - DNA, 237 bp, Artificial Sequence
  Description of Artificial Sequence: Synthetic coding sequence
atgcggaccgattcatcaaagatgactgacgttgaaagcggcgtcgcaaatttcgcatcatctgcccgcgcagggagaagaaatgcactgcccgatatacaatcaagtgccgcaacagacggtacctctgacctgccactgaagctggaagcattgagtgtcaaagaagacgcaaaggagaaggatgaaaagactacccaagaccaactggagaaaccccagaatgaagaaaagtag

SEQ ID NO: 130498 - DNA, 231 bp, Artificial Sequence
  Description of Artificial Sequence: Synthetic coding sequence
atgatggaggtagagtcctcctactctgactttatttcctgcgatcggaccggtcggcgtaacgccgtgccagacatccagggggactccgaggcagttagcgtgaggaagctcgccggagacatgggcgagctggctctcgagggcgcggaaggacaagtcgagggatctgcccccgataaggaggccgggaaccagccccagagctcggatgggaccacctcctcttag

SEQ ID NO: 130499 - DNA, 195 bp, Artificial Sequence
  Description of Artificial Sequence: Synthetic coding sequence
atgatggaagtggaaagctcatacagcgactttataagttgtgaccggacgggtcggagaaacgcagtcccagacatccagggtgactctgaggccgtgtccgttcgtaagctggcgggtgatatgggcgagctggccctggaaggtgccgagatggacttgacaatgctaccatggttagtcagcaatagctag

SEQ ID NO: 130500 - DNA, 231 bp, Artificial Sequence
  Description of Artificial Sequence: Synthetic coding sequence
atgatggaggtggaatcttcctacagcgatttcatatcctgcgacagaacaggaagaaggaacgcagtgcctgatatacaaggtgactccgaagccgtgagcgtgagaaagttagccggggatatgggcgaattggcactcgagggagcagaaggccaggttgagggaagtgccccagacaaagaagccggaaaccagcctcagagcagcgatgggactacaagcagttag

SEQ ID NO: 130501 - DNA, 231 bp, Artificial Sequence
  Description of Artificial Sequence: Synthetic coding sequence
atgatggaggtggagtctagctatagcgatttcatcagctgtgatcgtacgggcaggaggaatgccgtaccagatatccagggcgactccgaggccgtgagcgttcgcaaacttgccggtgatatgggcgagctggcccttgagggcgctgagggccaggtagagggctctgccccggacaaggaagccgggaaccagccgcaatcttccgacggcaccacaagttcgtag

SEQ ID NO: 130502 - DNA, 231 bp, Artificial Sequence
  Description of Artificial Sequence: Synthetic coding sequence
atgatggaggtcgagtcctcttactcagatttcattagttgcgatcggaccggccgtcggaatgccgtgcctgacatccagggagattctgaggccgtctctgtacggaaattggcaggcgacatgggagagctcgcattggagggcgccgaaggtcaggtagaaggatccgcccccgataaagaggctgggaatcagccccagtcctctgacggcaccacatcctcttag

SEQ ID NO: 130503 - DNA, 231 bp, Artificial Sequence
  Description of Artificial Sequence: Synthetic coding sequence
atgatggaagtagagtccagctactccgatttcatctcatgtgatagaactggtcgccgaaacgctgtgccggacattcagggagattccgaggctgtgtccgtcagaaagctggcaggcgatatgggagaattggcactcgagggcgccgaagggcaagtcgagggatccgcaccagacaaggaagccggtaatcagccacagtctagcgacggcaccacctcttcatag

SEQ ID NO: 130504 - DNA, 231 bp, Artificial Sequence
  Description of Artificial Sequence: Synthetic coding sequence
atgatggaagtcgaatccagttatagtgattttatctcatgtgaccgcactggacggcgcaatgccgtgcctgacatccagggggattccgaggctgtctccgttcgaaagctggcgggcgatatgggagagctggcgttggaaggggctgaaggccaggtcgaggggagcgcacctgataaggaggccggcaaccaaccccagtcttctgacggcaccacctcctcctag

SEQ ID NO: 130505 - DNA, 1578 bp, Artificial Sequence
  Description of Artificial Sequence: Synthetic coding sequence
atgcctttactcgacggcgacctcgagggtagtggaaagcatagctcccgcaaggtggattctccgttcggacctggatcgccttctaagggatttttcagtagggggccacagccgcggccgtccagtccgatgtctgcccctgtgcggccaaaaacctcccctggttcacccaagacagtttttcccttcagctaccaggaatctccccccagaagcccgaggcggatgagtttctctggaatattccggagtagctccaaagaaagttctcctaactctaatccggccactagtcctgggggtattcggtttttttctcgaagtcgcaagactagcgggctttccagctcaccttccacgccgacacaggtgacaaagcagcatacttttccattggagtcgtacaagcacgagcccgagaggcttgaaaatcggatctacgcatctagttccccccccgatactggccagcgcttttgtccttcttcttttcagtcacctacacgtccccctttagccagcccaacacattatgccccgtcaaaggccgccgctctggctgctgccctcggccccgcagaagcgggaatgctggagaagcttgagtttgaggatgaagcagtcgaggacagcgagtcaggtgtttatatgcggtttatgaggtcccataagtgttatgatattgtgcccacgagtagcaaattggttgtcttcgacacaacgctccaggtcaaaaaggcctttttcgctctggtcgctaatggggttcgggctgcacccctttgggaaagtaagaaacagtcattcgtggggatgctgaccattactgacttcattaatattctgcataggtactataaaagccccatggtgcagatctatgagctggaggaacacaagatcgagacatggcgcgagctttacctgcaagagacttttaagcctttagtcaatatctctcccgacgccagcctgtttgatgcagtgtactccctcattaaaaataaaattcatcggttacctgttatcgacccaatcagtggaaacgcattgtacatccttacacataagcgaatattgaaatttctgcaactatttatgtccgacatgccgaagccagcattcatgaaacaaaacctggatgagctggggatcggaacataccataacatcgccttcattcatccagatactccaataataaaggctctgaacatctttgttgagcgccgaatcagcgctctgcccgtggtggacgaatcaggcaaggtagtagatatctacagcaaatttgatgttattaatctcgctgccgaaaagacatataataacctcgacattactgttacccaggcccttcaacatcgctcccagtactttgaaggcgtggttaagtgcaataaacttgagattctggaaactattgtagacaggattgtgcgtgcagaagtgcacaggcttgttgtggtgaacgaggctgattctatcgtgggcatcatctccctctctgacatcttgcaggccttgattctgaccccggccggagctaagcagaaggagaccgaaaccgagtag

SEQ ID NO: 130506 - DNA, 987 bp, Artificial Sequence
  Description of Artificial Sequence: Synthetic coding sequence
atgttagagaagttagagtttgaggatgaagccgtggaggactcggagtccggggtgtatatgcgcttcatgcgctcccataagtgctatgatatcgttccaacaagctctaagctggtggtgttcgacaccacactgcaggtgaagaaggctttttttgccttggtggcgaacggggtgcgtgctgcaccgctctgggaatcaaagaaacaatcctttgtcggaatgctgaccatcaccgactttattaacattttgcacaggtattacaagtctccgatggtgcagatttacgaacttgaggagcacaagattgagacctggcgagaactctacctccaggaaacgtttaagccactggtgaacatttctcccgatgcttcactatttgatgctgtgtacagcctgatcaaaaataagatccaccggctgccagtgattgatcccatttcgggaaatgctctttacattttgacccacaagcgcatcttaaagttcctacagctgttcatgagtgacatgcctaaacctgccttcatgaaacagaatctggacgagttgggaatcggcacctaccacaacatagctttcatccacccagatacaccaataataaaggctctgaacatctttgttgagcggcgcatttccgcattaccagtcgtggacgagagcggaaaagtagtggatatctattcgaaattcgacgtaatcaacctggcagctgaaaagacttataacaacctggatatcaccgtcactcaggctttgcagcacaggagccaatattttgagggcgttgtgaagtgtaataaactagagatcctggagaccatagtcgaccggatagtccgagccgaggttcaccgactggtggtcgtaaatgaggcagactccattgttggcatcatcagtttgtccgacatcctgcaggcactaatcctgacccctgctggcgctaagcagaaggagaccgaaacagaatag

SEQ ID NO: 130507 - DNA, 1335 bp, Artificial Sequence
  Description of Artificial Sequence: Synthetic coding sequence
atgtcatcgagctacgacgaagcttctctggcgcccgaggagacaaccgattcattctgggaggtgggaaactataaacgaaccgtgaagcggattgatgacggccaccgactgtgtaacgatctgatgaactgcgtccaagaacgagctaagattgagaaagcctacggccagcagttaacggactgggccaagcgttggcggcagttgatcgaaaagggcccacagtatggtagcctggaacgagcctggggcgctattatgaccgaggccgataaggtgtccgagctgcaccaggaggttaagaacaacctcttaaacgaagacctcgagaaggtgaagaattggcagaaagatgcataccacaaacagatcatgggcggatttaaagaaacaaaagaggcggaggatggattcagaaaggcacaaaaaccttgggcaaagaagatgaaagagctggaagccgccaagaaggcatatcacctggcttgtaaggaggaaaagctggcaatgacccgcgagatgaattccaaaacagagcagagcgtcacccccgaacagcaaaagaagttgcaagacaaagtggataagtgtaaacaggatgtgcagaagacgcaggaaaagtacgaaaaagtcctggaggacgtaggcaaaactactccacagtatatggaaaatatggagcaggtctttgagcagtgtcagcaatttgaggaaaagcgtctggtattccttaaagaggttctgctggacatcaaaagacatctgaaccttgccgagaactctagctacatccacgtgtaccgcgaacttgaacaagcgattcggggtgctgacgctcaggaagatcttaggtggttccgttctacctccggcccgggcatgcctatgaactggccccaattcgaggagtggaatccagatttgcctcacacgaccaccaagaaggagaaacaaccaaaaaaggccgagggtgtggctctgaccaatgccacaggtgcagtggagagcacctctcaggctggcgataggggaagtgtttctagctacgatcgaggtcagccctatgcgacagagtggtcagatgacgagtcaggtaaccccttcgggggatccgaaacgaacgggggtgcaaatccattcgaagatgattccaagggtgttagggtccgcgcactctatgattacgatggccaggagcaggacgaactgagcttcaaagccggcgacgaacttactaagctcggcgaggaagatgaacaggggtggtgccgtggaaggctagactccggccagctgggtctctatccggcgaattacgttgaagccatatag

SEQ ID NO: 130508 - DNA, 1281 bp, Artificial Sequence
  Description of Artificial Sequence: Synthetic coding sequence
atgagcagtagttatgacgaggcctctcttgccccagaggagactacagactctttttgggaagtaggcaactataaacgcaccgtcaaaagaattgacgatggacaccgtctttgcaatgacttaatgaactgcgtccaagagcgtgcgaagatcgaaaaggcctacggccagcagctgaccgattgggcaaagcgatggcggcaactcattgagaaaggtccacagtacggatccctcgaaagagcctggggagctatcatgacagaggccgataaagtctccgaactacaccaggaagtgaaaaataacctgctcaatgaggatctcgaaaaggtgaagaactggcagaaggacgcttaccataagcagattatgggaggatttaaagagacaaaagaggccgaagacgggtttagaaaggctcaaaaaccttgggccaaaaaaatgaaggagttggaagctgccaagaaggcctaccacctcgcctgcaaagaggagaaactcgccatgactagagaaatgaactccaagactgaacaaagtgtgacaccagagcagcagaagaaattgcaggataaagtcgacaaatgtaaacaggacgttcagaagacccaggagaagtatgaaaaagttctggaagatgttggcaagactacgccacagtacatggagaacatggagcaggtcttcgaacaatgccaacagttcgaagagaagaggctcgttttcctaaaagaggtgctactggatattaagcggcacctgaatctggctgaaaactcttcatatatccacgtatacagggagctagaacaggccattagaggcgccgatgctcaggaagacctgagatggtttcgctctacctctggtccaggcatgcctatgaactggcctcaatttgaggagtggaacccagatcttccccataccacaactaagaaggaaaagcagcccaagaaagcagaaggtgtggccctcaccaacgccaccggggctgtcgagtccacttcccaagccggcgacaggggctccgtttcttcttacgacaggggccaaccttatgccactgagtggtccgatgatgagtcgggtaacccgtttggggggtctgagaccaacggcggggccaatccattcgaggacgactccaaaggcgtgcgagtgcgggctctgtacgattacgacggacaggagcaggacgaattaagtttcaaggctggcgatgaactgaccaagctgggcctgtaccctgctaattacgttgaagctatctag

SEQ ID NO: 130509 - DNA, 1335 bp, Artificial Sequence
  Description of Artificial Sequence: Synthetic coding sequence
atgtcatcatcctacgacgaagcctccctggccccagaagaaacaactgattctttttgggaggttgggaattacaagagaacagtcaaacggattgacgacgggcaccgcctatgcaacgaccttatgaactgtgtgcaggagcgcgccaaaatcgagaaagcctatggacagcagctcaccgactgggccaaaaggtggcgccaactcatcgaaaaggggccacagtacggttctctggagcgagcttggggggccatcatgaccgaagcagacaaagtgagcgaattacaccaggaagtgaagaataatttgctgaatgaagatttggagaaggttaagaactggcagaaggatgcctaccacaagcagattatgggcggtttcaaagagacgaaagaggctgaagacggttttagaaaagctcagaagccatgggccaaaaagatgaaggagctggaggctgctaagaaggcttaccacctggcctgtaaagaggaaaaactggcaatgacccgggagatgaactctaaaaccgagcagagcgtgactcccgagcagcaaaagaaactgcaagacaaagttgataagtgcaaacaggacgtgcaaaaaacccaggaaaaatacgagaaagtgctggaggatgtaggcaagaccacgccgcagtacatggaaaatatggaacaagtttttgaacagtgtcaacaatttgaggaaaagcgcctcgtgttcctcaaggaggtgctgctcgacataaagcggcaccttaacctcgccgagaactcctcttacatccacgtttacagggagctggaacaggctatccgcggcgccgacgctcaagaggatcttcgctggttccgctccaccagtggccccggaatgcccatgaactggcctcagtttgaagagtggaaccccgatctcccacatacaacgaccaaaaaagagaagcagcccaagaaggcggagggcgtggcgcttacaaacgccaccggggctgtggagagcacaagccaagctggcgaccgtgggagtgtgtcttcttacgatagaggacaaccatatgccactgagtggagcgacgatgaatccggaaatccatttggaggctccgaaacaaacggcggagcgaatccttttgaagatgactcgaaaggcgtccgggttagggccctgtacgactatgatggccaggagcaggatgagctcagctttaaggctggtgacgaattgaccaaactaggcgaagaggacgagcagggatggtgccgcggccgcctggactcgggccagcttggactctacccggctaactatgtggaagctatatag

SEQ ID NO: 130510 - DNA, 1275 bp, Artificial Sequence
  Description of Artificial Sequence: Synthetic coding sequence
atggccccagaagaagacgctggaggtgaagccctgggaggaagtttctgggaggccggaaactacagacgcaccgtgcagagagtcgaagacggccataggctctgcggagatctggtaagttgtttccaagagagagctagaatcgaaaaagcatatgcccagcagcttgctgattgggcccggaaatggaggggcacagtggaaaaggggcctcaatatgggactttagagaaggcatggcatgctttcttcacggcagccgagagactttccgcccttcatctggaagtcagagagaagcttcaaggccaggactccgaacgagttagagcttggcagaggggagctttccaccggccagtgcttggcggttttcgggagtcgcgcgccgcggaggacggcttccggaaagctcagaagccatggctgaaacgcttgaaagaggtggaggcaagcaagaagagttaccacgctgccagaaaggatgaaaagactgcccagacaagagagagccacgctaaagcagattctgccgtgagccaggagcagctgcgaaaactccaggagcgcgtcgaaaggtgcgctaaagaggccgaaaagaccaaagcccagtacgagcaaaccttagccgagttacatcgatacaccccacgttatatggaagacatggagcaggccttcgagacctgccaggcagctgagagacagagactcctcttctttaaggacatgctgctgaccttgcaccagcacctcgacctctcaagctctgagaagttccacgagctgcacagagatctgcatcaaggcattgaggcggcatctgacgaggaagacttgcgatggtggcggtcaactcatggccccggcatggcgatgaattggccacagttcgaagagtggtctcttgacacccagcgtaccatatctaggaaagaaaagggcggaaggtccccggatgaagtgaccctaacctccatcgtccctacacgcgacggaaccgcccccccaccccagtctccaggatctccaggcaccggacaagacgaagagtggagcgacgaggaatcaccgagaaaggctgccacaggagtgcgggtgcgtgcactttatgattacgccggacaggaggccgacgagctctcgtttagagccggagaagagctgctgaaaatgtctgaagaagatgagcagggatggtgccagggacagctgcaatccgggcgcatcggactctatcccgccaactacgtggagtgtgtgggggcttag

SEQ ID NO: 130511 - DNA, 879 bp, Artificial Sequence
  Description of Artificial Sequence: Synthetic coding sequence
atggcccccgaggaagacgctggcggagaggcgctgggcgggagtttttgggaggcaggcaactaccgcaggaccgtccagcgcgtggaggatgggcacagactttgtggcgatttagtctcatgtttccaggaacgcgcacgcatcgaaaaggcatatgctcagcagttagctgactgggccagaaaatggcgcgggactgtggagaaaggcccccaatacggcacactggaaaaagcgtggcacgccttctttacggctgccgagcgtctgagcgctctgcacctggaagtgcgtgaaaaattacagggacaggactccgaaagagtgcgggcctggcaaaggggcgcctttcacagacctgtcctcggagggttccgcgagtccagagcggccgaggatggatttcggaaagcccaaaagccatggttaaaaaggttgaaggaagtggaagccagcaagaaatcttaccatgccgccaggaaagatgaaaagacggcccagacgcgggaaacccaacggcaaaccgcccctagcccgcgcagttcatgcgcaaactgccgaaacggctggaacgccgttccacgtcggcctagaagacagaagttgagtatgagccggcggtggcagagttgcatcgccaccctccatgcgacttggaggacctggaataggcctttaaggccagcccgcccaccttctgcttctgggttcttttcaagccggatatgttgttctccctatacatcaacctggacattcccagccgtgagatcgagcatgaatagcaccgtgacttgcacaagagccctaaggcaaccagtgacaaaacgcatatgtgccggcggggccgctccaactgggcaggcctggccatag

SEQ ID NO: 130512 - DNA, 210 bp, Artificial Sequence
  Description of Artificial Sequence: Synthetic coding sequence
atggcccccgaggaggacgcaggtggagaggcactgggtggatccttctgggaggccggcaactataggcggacagtacaaagggtggaggacggccatcgactttgtggcgacctggtttcatgcttccaggagagggcccggattgaaaaagcttacgcgcaacagctggcggactgggccaggaagtggagaggaacggtagagtag

SEQ ID NO: 130513 - DNA, 429 bp, Artificial Sequence
  Description of Artificial Sequence: Synthetic coding sequence
atggctccggaggaagatgcaggaggcgaggcactgggcggatccttttgggaagctggtaattaccgaagaacagtgcagagggtagaggacggccacagactttgcggtgacctggtttcatgcttccaggagcgagcaagaattgagaaagcttacgcccagcagctcgcagattgggcgagaaagtggaggggaacagttgaaaagggacctcagtatggcaccctggagaaagcctggcatgcgttctttacggccgccgaaagattatcggcactgcacctcgaagtgagagaaaaactccaggggcaggactccgagagagtgcgcgcctggcaacggggagccttccatcgacccgtgctgggcggcttcagggaatcgagagccgccgaggatggctttcgcaaggcccagaaaccttag

SEQ ID NO: 130514 - DNA, 1218 bp, Artificial Sequence
  Description of Artificial Sequence: Synthetic coding sequence
atggcacccgaagaggacgcgggcggcgaagcactgggcgggagcttctgggaagccggcaactatcgacgcaccgtccaacgggtggaggatggacaccgcctgtgtggtgatctggtgtcgtgtttccaggagcgtgcccggatcgagaaggcgtatgctcaacagctcgccgactgggcccgaaaatggcgaggcacggtcgaaaaggggcctcaatatggcaccctggaaaaggcctggcatgcattcttcactgccgcagaacgcctctctgctttgcatctggaggtgcgggaaaagctacaagggcaggactccgaaagggtgagggcctggcaaagaggggccttccatcgacccgtgctggggggcttccgggagtcacgggcagcggaggacggattccgaaaagcgcaaaagccttggcttaaacggctgaaagaggtggaggccagtaagaagagctatcacgccgcccgcaaagacgagaagacagcccaaacacgtgaatctcatgcaaaagccgattccgcagtttctcaagaacagcttcggaaactgcaggagcgcgtggaacgctgcgcaaaggaggcggagaagaccaaggctcagtatgaacaaaccttagcagagctgcatagatacacaccgcgatatatggaggacatggagcaggcttttgagacttgtcaggctgctgaaagacagagactgttgttttttaaagacatgctcttgactctccatcagcaccttgacctctctagcagcgaaaagttccacgaacttcaccgcgacctacaccaaggcatagaagccgcctccgatgaggaagacttgcggtggtggcggtccacacacggacccgggatggcgatgaactggccccaattcgaagaatggtcactggatacccagagaacaatctctaggaaggagaaagggggcagaagccctgacgaagtaaccctcacatcaatagtgccaaccagagacgggactgcccccccacctcagtcaccgggcagtccagggaccggccaagacgaggaatggtcagacgaggaatcacctcgtaaagccgcgacaggagttagggtacgtgccctatacgactatgccggacaggaggctgatgaattgtctttcagagcaggcgaagagcttctgaaaatgtctgaggaggacgagcagggttggtgccaaggccagtag

SEQ ID NO: 130515 - DNA, 210 bp, Artificial Sequence
  Description of Artificial Sequence: Synthetic coding sequence
atggcacccgaggaggacgctggaggggaagccctgggcggatccttctgggaagcaggaaactacagaaggaccgtgcagagggtcgaggacggccacagactgtgcggcgacctggtatcttgtttccaggagagagcccgtattgagaaggcctacgcacagcagttggcagattgggcacggaaatggcggggcaccgttgaatag

SEQ ID NO: 130516 - DNA, 447 bp, Artificial Sequence
  Description of Artificial Sequence: Synthetic coding sequence
atggcccccgaggaggatgctggcggagaggcgttgggcgggagcttttgggaggccgggaactaccgccgtacagtacaacgcgtggaagatggacaccggctttgtggcgatcttgtgagttgcttccaggaaagagctagaattgagaaggcctacgctcagcagctagccgattgggcaagaaagtggagaggcaccgtagaaaagggtcctcagtacgggacattggaaaaggcctggcacgcttttttcaccgctgcggaacggttgtctgctttgcacttagaagtgcgtgagaaactccaaggccaggactccgaaagggtcagggcttggcagagaggggcgttccacagacccgttctgggaggtttccgcgagtcccgagccgctgaagatggatttcggaaggcccaaaagccttggctgaagagactcaagtag

SEQ ID NO: 130517 - DNA, 1275 bp, Artificial Sequence
  Description of Artificial Sequence: Synthetic coding sequence
atggccccggaggaggacgccggcggcgaagctttgggcggaagcttttgggaagccggaaattaccgtcggacagttcagcgggtcgaggacggacaccgtctgtgcggagacctggtttcatgttttcaggaacgggcccgcatagagaaggcttatgctcagcagctggctgattgggcccggaaatggagaggcacagttgagaaaggcccccagtacggaactttggaaaaagcctggcatgccttttttacggctgcagagcggctttccgcgctccatttggaagtgcgtgaaaagctccagggtcaagattcagagagagtcagggcctggcagcgcggcgcattccataggccggtgctgggcggttttcgtgagtctcgcgccgccgaagacggcttccgcaaagctcagaagccctggctgaaaaggctgaaagaggtggaggcctctaagaaatcttatcatgccgccaggaaggacgaaaagacagcccagacgcgggaaagccatgcgaaggctgacagcgccgtcagccaggaacaacttcgcaagttgcaagagcgcgtcgagcgctgcgctaaagaggcagaaaaaacaaaagctcagtatgagcagaccctggctgagctccaccggtatactccaagatacatggaagatatggagcaagcatttgagacatgtcaagctgctgagagacagcggctgcttttcttcaaggatatgctgttgacgttgcatcagcacttggatctatcctcatcagagaaattccacgagctgcatagagacctgcaccagggcatagaggccgcaagtgacgaggaagacctgcggtggtggcgcagcacacatggcccgggcatggcaatgaactggccccagttcgaggagtggagtctcgatacccagagaactatttcaagaaaagaaaaggggggtcgaagtccagacgaggtgaccttgacctcaatcgtcccgactcgcgacggcacagctccccctccccagtctcccgggtcacctggaacagggcaagatgaggaatggtccgatgaagagagcccacgcaaagctgcaacaggcgtacgcgtgagggctctgtatgactatgctggccaggaggctgatgaactcagtttccgagccggcgaagaactcttaaaaatgagtgaggaggacgagcagggatggtgtcagggacagctccagtctggtcgaattggcctgtacccagccaactacgtcgagtgcgtgggcgcttag

SEQ ID NO: 130518 - DNA, 1587 bp, Artificial Sequence
  Description of Artificial Sequence: Synthetic coding sequence
atgctgctacccctgctgctcctcctgcccatgtgctgggcggttgaagttaagcggcctcgaggagtgtctctgaccaatcaccatttttacgacgagtcgaagccgttcacctgtctcgatggatccgccaccatccccttcgaccaggtgaacgatgattattgtgattgcaaagatggctctgacgagcccgggaccgcagcatgtcccaatggttccttccattgtactaacacggggtacaaacccctctacataccatctaacagagtgaatgacggagtttgtgactgctgcgatgggacagacgagtataacagcggggttatctgcgagaatacatgcaaggagaaaggcagaaaagagcgcgagagtcttcaacagatggccgaggtcacacgcgagggctttagattaaaaaagattttgatcgaagactggaaaaaagcccgagaggagaagcagaaaaagctgattgagctgcaggcgggaaagaagagtcttgaggatcaggttgagatgctgcggacagtaaaagaagaggccgagaaaccagagagggaggccaaagagcagcaccagaagctttgggaagagcagctcgctgctgccaaggctcaacaggaacaggaactggcagctgatgcgttcaaagaactggacgatgacatggacgggaccgtgtctgtgaccgagctgcagactcaccctgaactggatacagacggggatggcgctctcagtgaagcagaagctcaagcactgctgagtggggatacccagactgacgccacttccttttatgatagggtgtgggctgctattcgcgataagtatcggtctgaggccctcccgactgacctgcccgccccttccgctccagacctgaccgagcccaaagaggagcagccccctgttccttcaagtcccacggaagaagaggaggaggaggaagaagaagaggaggaagaggcagaagaggaggaagaggaagaagactctgaagaggccccgccgccattgtctcctcctcagccagccagtccagccgaagaggacaagatgccaccatatgacgaacagacacaggcgttcattgatgccgcacaggaagcacggaataaattcgaggaagccgaaagatccctcaaagacatggaagagtccatcagaaacctcgagcaagagattagcttcgatttcggcccaaatggagaatttgcctatttgtactctcagtgctacgaacttacgacaaacgagtatgtttataggctgtgtcctttcaagctcgtgtcacagaagcccaaactgggaggctctccaactagcctggggacatgggggtcctggataggccccgaccacgataaattctctgctatgaagtacgagcaaggtacagggtgttggcagggcccgaaccgttcaacaactgtgcgactcctgtgtgggaaagaaactatggtgacgagcactaccgaaccctccaggtgcgaatacctaatggaactcatgacgcctgccgcctgccctgaaccccctcctgaagcacccactgaggacgatcatgacgaactgtag

SEQ ID NO: 130519 - DNA, 1578 bp, Artificial Sequence
  Description of Artificial Sequence: Synthetic coding sequence
atgctcctgcccctactcctgttacttccgatgtgttgggccgttgaagtcaaaagacccaggggagtgtctctcacaaaccaccacttttacgacgagagcaaaccgttcacatgcctggatggatccgctacaatcccatttgaccaggtgaacgatgattattgtgattgcaaagacgggagcgatgaacccgggacagctgcctgccccaacggtagcttccattgcacaaacacaggctacaaaccattatatattcctagtaaccgagtcaatgatggcgtgtgcgattgttgtgacggcaccgatgagtacaactctggtgtgatatgtgaaaacacctgcaaggagaaaggccgcaaggagagagaatctctgcagcagatggcagaagtaacacgggagggttttaggctgaagaaaatcttaatcgaggattggaagaaggccagagaagagaaacaaaaaaagctgatcgaactccaggctggaaagaagtcactcgaagatcaggtggaaatgcttagaacagttaaggaggaggctgagaagcccgagcgggaggctaaagaacagcaccagaagctgtgggaggaacagcttgctgcagcgaaagcccagcaggagcaggagttggcagcagatgccttcaaagaactggacgatgatatggatggaacggtctcagtgacagaactacagacccaccctgagttggataccgatggcgacggcgcactctccgaggctgaagctcaggctttgctctctggagatactcagaccgatgccacgtcattttacgatcgggtgtgggcggccatccgtgacaagtacagatctgaagcgctaccaacagacctgcctgctcctagtgcacctgacctgacagagccaaaggaggaacagccaccagttccttctagtcccacagaggaggaggaagaagaagaggaggaagaagaggaggaggctgaggaggaagaagaagaagaagacagtgaagtgcagggggaacagcctaagccagccagcccagcggaggaagacaaaatgccaccgtatgacgaacagacacaggcattcatcgatgcagctcaggaagccagaaacaaatttgaggaagctgaacgatccctgaaagacatggaggaaagcatccgcaatctagagcaggaaatttcttttgactttggacctaatggagagtttgcatatctgtacagccaatgctacgaactgaccaccaatgagtatgtgtaccgcctatgtcccttcaaactcgtctcccagaaaccaaaactggggggcagtcccacttcccttggaacatggggaagttggatcggccccgaccacgataagttcagcgcaatgaaatacgaacagggtactggctgctggcagggacccaacagatccacaaccgtgcgactgctgtgtggaaaagaaactatggtcactagcacaacggagcctagccgctgcgagtacctgatggagctcatgacgccagctgcatgccctgagccgcctccagaggctcccaccgaggacgatcacgatgagctgtag

SEQ ID NO: 130520 - DNA, 2031 bp, Artificial Sequence
  Description of Artificial Sequence: Synthetic coding sequence
atggccccctttctcagaatcgcatttaactcgtacgagctgggttccctccaggccgaggatgaagcaaatcagccgttttgtgctgtgaagatgaaagaagcactgtcaaccgagcgggggaagaccctagttcagaagaagcctacaatgtatcccgagtggaaatctactttcgacgcacacatctacgaaggacgggtcatccagatcgtgctgatgagggcagccgaggagcctgtttccgaagtgacggtcggcgtgagcgttctggcagagagatgtaaaaagaacaacggcaaagccgagttctggctcgacctacagccacaggccaaggtcctaatgagcgtccagtacttcctggaagatgtggattgcaaacaatccatgagaagtgaggacgaagccaagttccctacaatgaacaggcgcggcgccatcaagcaagctaagattcactatatcaagaatcatgaatttatcgccaccttcttcggacagccaacattctgttcagtgtgcaaggactttgtttggggcttaaataaacaagggtacaaatgccgtcagtgcaatgcagcaattcacaagaagtgtatagacaagatcatcggtcgatgcaccggtaccgctgctaactcgagggatacaatattccaaaaagagcggtttaatatagacatgccccacaggttcaaagttcacaactacatgtcccctaccttctgtgaccattgcggtagcctcctgtggggcctcgtgaagcagggacttaagtgtgaggactgcggaatgaacgttcaccacaagtgtagagagaaagttgccaatctctgcgggatcaaccagaagctgcttgcagaggcgctcaatcaagtgactcagagagcatccagaagatcagacagtgcctcaagtgagccggtgggcatctaccagggatttgaaaaaaagacaggagtcgcgggagaggatatgcaggataactccggaacctatggaaagatttgggagggcagctccaagtgtaacatcaataacttcattttccataaggtgcttggtaaaggctcctttgggaaagtgctcttgggggaactcaagggtcggggcgaatacttcgccattaaggcactcaagaaggatgtagtgttgattgacgatgacgtagaatgcacaatggtggagaagcgcgtccttacattggccgccgagaaccccttcctgacacacctcatctgcactttccagaccaaggatcacctcttcttcgtgatggagttcttaaacggaggagatctcatgtaccatatccaggataagggccgattcgaactgtacagagccaccttctacgccgcggagattatgtgtgggctccagtttctgcatagtaaaggcataatctatagagacctgaaacttgataatgtactgctggatcgcgatggacatatcaaaatcgctgactttgggatgtgcaaggagaatatcttcggcgagtctcgagctagcacgttttgtggaacccctgactatattgcaccagagatactgcagggcttaaaatacaccttcagtgtggactggtggagcttcggcgtcttactttacgagatgcttatcgggcagagcccctttcacggcgatgacgaggacgagctgtttgagagcatcagagtggacactccacactaccccaggtggatcaccaaagaatctaaggacatacttgagaaactgtttgagcgcgaacccactaagagactgggcgtaaccgggaatatcaaaatacatcctttctttaagaccatcaattggacactcttagagaagagaaggctggaaccgccctttcggcccaaggttaaatctcccagggattattccaattttgatcaggaattcctgaacgagaaagctcgcctgagctactctgataagaacctcattgacagtatggaccagtcagcgttcgccggtttctctttcgttaacccaaaattcgaacatttactggaggattag

SEQ ID NO: 130521 - DNA, 2031 bp, Artificial Sequence
  Description of Artificial Sequence: Synthetic coding sequence
atggccccttttttgcgaattgcctttaatagttatgaactggggagcctgcaggccgaagacgaagccaaccagcctttttgcgctgtgaaaatgaaggaagccctgagtaccgagcgcgggaagaccctggtccagaaaaagcccaccatgtacccagaatggaaatcgaccttcgatgcccatatctatgaagggcgtgtcatccaaatcgtacttatgcgagccgctgaggaaccagttagtgaggtgactgtaggggtttccgtgctcgccgagcggtgtaagaaaaacaacggcaaagccgagttttggctggacctccaaccccaggcaaaggtattgatgagcgtgcagtacttcctggaggatgtggactgcaagcaaagcatgcggagcgaagatgaggctaagttcccgaccatgaacagacgcggtgccatcaagcaggccaaaattcactacattaagaatcacgaatttatcgcgaccttctttggccagcctactttctgtagcgtatgtaaagacttcgtttggggcctgaataagcagggatacaaatgtaggcagtgcaacgcagctatccacaaaaagtgtattgataaaatcattgggaggtgcactggaacagctgctaatagtagagataccatattccaaaaggagaggttcaacattgatatgcctcacaggtttaaagtgcacaattacatgagccctacattctgcgatcattgcgggagcttactttggggcctggtcaagcaaggtctgaagtgtgaggactgcggcatgaacgtgcatcacaagtgccgggagaaagtggccaacctctgcgggataaaccagaaactcctggcagaggcgctgaaccaggtgacacagcgggcttcacggagatcagactccgcctcgtccgagcccgtgggaatttaccaggggttcgagaaaaaaacaggtgtggcaggagaggatatgcaggacaattctgggacttacggaaagatctgggagggctccagtaaatgtaatattaacaacttcatcttccataaagtgttgggtaagggatcattcggtaaggtcttacttggagaactgaagggtcggggagaatactttgctattaaggcgctgaaaaaggacgtggtgcttattgatgacgacgtcgagtgtacaatggtggagaagcgtgtgttgacactggccgccgagaatccgttcctcacacacctcatttgtacatttcagactaaggaccaccttttttttgtgatggaattcctcaacggcggcgacctcatgtaccatatccaggacaagggacgattcgaattatatcgagccaccttttacgccgctgagattatgtgcggactgcagtttctacacagtaagggtatcatctaccgtgatctgaagttagacaatgtgttgcttgaccgagacggccacattaaaatagccgatttcggcatgtgtaaagagaacatttttggcgagtcccgagcttctaccttttgtggcacacccgattatatcgcccccgagatcctgcaaggccttaagtacacattctccgtagactggtggagctttggcgtgctgctttacgagatgttgatcgggcagtccccgttccacggtgacgatgaagatgaactgttcgaatccataagagttgacaccccccactatccaaggtggatcaccaaggagagcaaggatattcttgagaagctcttcgaacgggaacccacaaaacgcctgggggtgaccggcaatataaaaatccaccccttttttaaaacgataaattggacactgctggaaaagagaaggctggaaccacccttcaggccgaaagtgaagagtcccagggactactcaaattttgatcaagagtttctgaacgagaaggctcgcctcagctactccgataagaatcttatcgattcgatggatcagagtgcattcgccgggttttcctttgttaatcccaaatttgagcacctgttagaggattag

SEQ ID NO: 130522 - DNA, 234 bp, Artificial Sequence
  Description of Artificial Sequence: Synthetic coding sequence
atggctccatttctcagaatagcttttaactcctacgaactaggaagtctacaggctgaagatgaggccaaccagcccttctgtgctgtaaagatgaaagaggctttgagcacagagagaggtaaaacactggtgcagaagaaacctaccatgtaccccgagtggaagtccacatttgacgcccatatatacgaaggcagagtaatacagattgtcctcatgagggctgcctag

SEQ ID NO: 130523 - DNA, 378 bp, Artificial Sequence
  Description of Artificial Sequence: Synthetic coding sequence
atggcccccttcctgcggatcgcctttaattcttatgaattgggatcccttcaggcagaggacgaagccaatcagccattttgcgccgtaaagatgaaagaggccctatccaccgaacgcggcaagactctagtgcagaaaaaacctaccatgtatcctgagtggaagtccacctttgatgcccacatctacgagggccgagtgatccagatcgtgctgatgagggctgccgaagagccagtgagtgaggtcaccgtgggcgtctccgtattggctgaacgttgcaagaaaaacaatggcaaggccgagttttggctggaccttcagcctcaggctaaagttctcatgtctgtgcagtacttcttggaagacgtgtag

SEQ ID NO: 130524 - DNA, 2052 bp, Artificial Sequence
  Description of Artificial Sequence: Synthetic coding sequence
atgtcttctggcaccatgaaattcaatggatatctgcgggtgaggatcggcgaggcagttgggctacaaccgacgcggtggagtctccggcattcacttttcaagaagggtcaccaactgctcgatccctaccttaccgtatcagtagaccaggttcgcgtgggacagactagtacgaaacagaagactaataagccgacctataatgaagagttttgcgccaacgtgacggacggtggccacctggagctagcagtgtttcatgagacgcctctcgggtacgaccactttgtggctaattgtacactgcagttccaggaattacttcggaccaccggtgcaagcgatacctttgaaggctgggtcgacctcgaacccgagggaaaggtgtttgtcgtcatcaccctgactggctcatttactgaggcgactctgcagcgagacaggatatttaagcacttcactaggaaacggcagcgagccatgaggagacgcgtgcatcagattaatggccacaaatttatggcaacctacttacgccagcctacatactgcagccactgtcgtgagttcatctggggcgtctttggaaagcagggatatcagtgccaggtgtgcacgtgtgtcgtgcataagaggtgtcaccacctgatcgtgacggcatgtacatgccagaacaatatcaataaagtcgatagcaagatagccgagcagagatttggcatcaacattccacacaagttcagcatccacaattacaaggttcccactttttgcgaccactgcggctctctgttatggggcattatgagacaggggttacagtgtaagatctgcaaaatgaatgtccacatccggtgtcaggccaatgtggctcctaactgcggggtgaatgcggtggaactggccaagacccttgctggcatgggcctgcagccagggaatatttcacccaccagtaaactggtgagtagatcgacacttaggcgacaaggcaaagaatcatcgaaagagggaaatgggattggcgttaacagcagtaacaggcttgggattgataacttcgaattcatcagggtgctgggcaaaggcagctttggtaaggtgatgctggcacgcgttaaagagactggggacctttacgcggtgaaggttctgaagaaggatgttatactgcaggatgacgatgtggaatgtacgatgactgaaaagcggatactcagcctcgcccgcaaccatcccttcctgacacagctcttctgttgctttcagactcccgatcgacttttctttgtcatggaattcgtgaatggcggagaccttatgttccatattcagaagtcacgacggttcgacgaggctcgcgcacgattttacgcggccgaaataatcagcgcgctgatgtttttgcacgacaaagggatcatctatagagacctgaagctggataatgtccttctggatcacgagggacactgtaagcttgccgatttcggaatgtgcaaagagggtatttgtaacggggtgaccactgcaacattttgcgggacccccgattacattgctccagaaattcttcaggagatgctgtacggtccagcagtcgactggtgggccatgggcgtgttgttgtacgagatgctctgcggccacgcaccctttgaagctgaaaatgaggacgatctgtttgaagcaatcctaaatgatgaagtggtctacccgacgtggctgcacgaggacgccaccggaatccttaagagtttcatgaccaaaaaccctaccatgagactgggctccttaacccagggcggagagcacgccatcttgcgacaccccttctttaaagagattgactgggctcagctgaatcaccggcagatcgaacctcccttccgacctcggataaaaagtagagaggatgttagtaattttgatccagacttcattaaagaagaacctgttctcacaccaatcgacgaggggcatttgccaatgataaaccaagacgagttccgcaatttcagctacgtttctccagagttacagccctag

SEQ ID NO: 130525 - DNA, 357 bp, Artificial Sequence
  Description of Artificial Sequence: Synthetic coding sequence
atgtcatccggcactatgaaattcaatggctacctcagggtccgtataggcgaagccgtcgggcttcagcccactagatggagcttaaggcactcactgtttaagaaaggacaccagctgttggacccctacctgacagtgagcgtggaccaagtgagggtgggccaaacctctaccaaacaaaagactaacaagccaacttataatgaggagttctgtgcaaatgtgacggatgggggtcacctggagctggccgtttttcatgagaccccactagggtacgatcatttcgttgctaactgcacattgcaatttcaggagctgctccgcaccacaggggctagtgatacgttttag

SEQ ID NO: 130526 - DNA, 1791 bp, Artificial Sequence
  Description of Artificial Sequence: Synthetic coding sequence
atgcctactcagcgggattctagtacgatgtctcacaccgtcgctggcggaggctctggcgatcactctcatcaggtcagagtgaaagcctactataggggcgacataatgatcacgcactttgaaccttccatcagtttcgaaggattatgtaacgaggtacgtgacatgtgctcatttgacaatgaacagctgttcacgatgaaatggattgacgaagaaggcgacccttgcacagtaagctcacagttggaactcgaagaggcgttccgtctgtacgagctaaataaagactcagagctgttgattcacgtctttccttgcgtcccagagcggcctgggatgccgtgccccggagaggacaaaagtatttataggcgcggagcccgaagatggagaaaactttattgcgcgaatggacacacgttccaggctaaaagattcaatagacgcgcccactgcgccatttgcacagatcgaatctggggccttggccggcaggggtacaaatgtatcaactgcaaactcttggttcataagaaatgccacaaactagtgaccatcgagtgcggtcggcactctctgccccaggagccagtcatgcctatggaccaaagctccatgcatagtgaccacgcacagaccgtaatcccttataatccgtcaagccatgaaagcctagaccaggttggagaggagaaggaggcaatgaacactcgcgagagcgggaaggcctcctcgtcactgggcttacaggactttgacctcctcagagtgatcgggagagggtcttatgccaaggttctcctggtgcgactgaagaagaccgatagaatctatgcaatgaaagtggtaaagaaggagctggtgaacgatgatgaagatatagactgggtgcagactgaaaagcatgtttttgagcaggcttccaaccacccattcctagtcggtttgcactcctgttttcagacagagtctcgcttattttttgtgatcgagtacgtcaacgggggcgatctcatgtttcacatgcagcgtcagcgtaagcttccagaagagcacgccagattctacagcgctgagattagtctggctctcaactatcttcatgaaagggggatcatctatagagaccttaagctggacaacgtgctcctggactctgaaggccatattaagctgacagattatggtatgtgcaaggaaggactgcgtcccggtgataccacgagtacattttgtggcactcctaactatatcgctccggaaatactacgaggcgaggactacggtttctccgttgactggtgggctcttggagtgctcatgttcgagatgatggcaggccgctctccattcgacatcgtgggttccagtgataaccccgatcagaatacagaggactacctcttccaagtgatactagaaaagcaaatacgcatcccccgatcgctgagcgtaaaagccgcttccgtgctgaagtccttcctgaacaaagacccgaaggagcggctcgggtgtcatccgcagacaggattcgctgatattcagggacatccattcttccggaatgtcgattgggacatgatggagcagaagcaagtggtacctccttttaagccaaatatctcaggcgagttcggcttggacaattttgattctcaattcactaacgaacccgtgcaactgacaccggatgatgatgacatagtgcggaaaatcgatcaatccgaatttgaggggttcgagtacattaatccactgctcatgagcgcagaggaatgcgtgtag

SEQ ID NO: 130527 - DNA, 2121 bp, Artificial Sequence
  Description of Artificial Sequence: Synthetic coding sequence
atgtcacctttcctgaggattggcctgtcgaatttcgactgcggctcctgtcagagttgtcaaggtgaagcagtgaacccttactgcgcggtgctggtgaaagagtacgtggaaagtgagaatggacagatgtatatacagaagaagcccaccatgtatcccccctgggattcgactttcgacgcacacatcaacaaaggccgggttatgcaaatcatcgttaaaggaaaaaacgtggacctaataagtgagacaactgtggaattgtatagcttagctgaacgttgcaggaagaataacggtaaaacagaaatctggctggaactgaaacctcaaggcaggatgctgatgaatgcccgatattttctggagatgtccgatacgaaagatatgaatgaattcgaaacagagggcttctttgcactgcaccagcggcgcggcgccattaaacaagcaaaggttcatcacgtcaagtgtcatgagttcactgccacattttttccacagcccactttctgcagtgtctgccacgaattcgtctggggcctcaataagcagggatatcaatgccgacagtgtaatgccgccatacataagaagtgcattgataaggttatcgctaaatgcaccggaagtgctattaattctagagagactatgttccacaaggagcgcttcaagatagatatgccgcatcgattcaaggtgtacaactacaaaagtccaactttttgtgagcactgcgggaccttgctgtggggcctcgcccgccagggcttgaagtgcgatgcatgcgggatgaatgtgcaccatagatgccagacaaaagttgccaacctctgtggcattaaccagaagctgatggccgaagcactggccatgattgagtccacccagcaagcacgatgcctgcgggacacagagcagatctttcgggaggggcccgttgaaatcgggcttccttgcagcatcaagaacgaggcacgacccccctgcttacccacccctggaaagcgggagccccagggaatctcatgggagtctccccttgacgaggtggacaagatgtgtcaccttcctgagccagagctgaataaggaacggcccagtctgcaaattaaactgaagatcgaagactttattctccataagatgctaggcaaggggagctttggaaaggtttttcttgccgagttcaaaaaaacgaatcagttctttgccattaaggccctgaaaaaagacgtggttctgatggatgatgatgttgagtgtactatggttgaaaaaagggttctgtctctagcctgggagcacccctttctcactcatatgttctgcacgtttcagaccaaggaaaaccttttctttgtgatggagtacctaaacggcggtgatctgatgtatcatattcaatcatgccataaattcgacttgtcccgagctacattttacgccgcagagattattttgggtcttcagttccttcactctaagggcatcgtgtatagggacttgaaactggataacattctgctcgataaggacggccacataaaaatcgccgacttcggtatgtgcaaagagaatatgctgggcgacgccaaaactaacaccttctgcggcactcccgactacatcgccccagaaattctattaggccagaagtataatcactcggtagactggtggtccttcggcgtgctgttgtacgagatgttgattggacaaagccccttccatggccaggatgaagaagagctcttccacagcatccgtatggataatcccttttatccgaggtggcttgagaaagaagctaaagatctgcttgtcaagctgtttgttcgtgagcctgaaaaacgcctgggcgtgcgtggtgacatcagacagcaccccctctttagagaaataaattgggaggaactcgaaaggaaagaaatcgaccctcctttcaggccaaaggtcaaaagtccattcgactgtagcaatttcgataaggaatttctgaacgaaaagcctcgcctgagtttcgctgatagagcgcttattaattccatggaccaaaacatgttccgaaacttcagtttcatgaatcctgggatggagaggttgatcagctag

SEQ ID NO: 130528 - DNA, 1932 bp, Artificial Sequence
  Description of Artificial Sequence: Synthetic coding sequence
atgagccctttcttacgcattggcctaagcaacttcgactgcggtagttgccagtcctgccagggcgaagccgtgaacccgtactgcgcagtgctggttaaggagtatgttgaaagcgaaaatggacaaatgtacatccagaagaagcctacaatgtatccgccatgggactctacattcgacgcccacataaacaaaggccgggttatgcagattatagtgaagggcaagaacgtcgatctgatctctgagactacggtggagctatattcactagcggagcgctgccgcaagaacaatggcaaaaccgaaatatggcttgaactgaagccacagggccgcatgctgatgaatgccagatacttcctggagatgtctgatactaaagatatgaacgagttcgaaaccgaaggattctttgcgctgcatcagagaagaggagcaatcaagcaggccaaagtgcaccatgtaaaatgccacgaattcaccgccaccttttttccgcagcccacgttctgttccgtgtgtcatgagtttgtgtggggtcttaataaacaagggtaccagtgcaggcagtgcaatgccgcaattcacaagaagtgcattgataaagtcatcgccaaatgcacaggaagtgcgatcaactctagagaaaccatgttccataaggagagatttaaaatcgacatgccacatcgctttaaagtctacaattataagagcccgacattctgtgagcactgtgggacattactgtggggattggcaagacagggacttaaatgcgacgcctgcggtatgaatgtgcatcatagatgccagacaaaagtcgcaaatttgtgcgggataaatcaaaaattgatggccgaagcgctcgccatgatcgaatctacacagcaagctcgatgcctgcgagacactgagcaaatctttcgggaaggccctgtggagattggccttccttgcagtatcaagaatgaagcaagaccgccctgtctgccgacgccagggaagagggagccgcaaggcatatcctgggaaagtcccttggacgaagtggataagatgtgccacctccctgaaccagaacttaataaggaacgcccctctctgcaaatcaagctcaagatagaggatttcattttgcataagatgctcgggaaaggcagcttcggaaaggtctttctggccgaattcaaaaagacgaatcaattcttcgccatcaaggctttgaagaaggatgtggtgttgatggacgatgacgtcgagtgcactatggtggaaaagcgcgtcctgtcattggcttgggaacatccattcctgactcacatgttttgcacctttcagacgaaggagaacctgttctttgtgatggagtacctgaatggtggggatcttatgtaccacatacaaagctgccataagttcgacctatctcgggcaacattttatgctgccgaaattatcctcggactgcaattcctgcactcaaaagggattgtgtaccgagatttgaagctcgacaacattctgttggataaagacggccacattaagatcgcagatttcgggatgtgtaaagagaacatgctgggggatgccaaaaccaatactttctgcgggacccctgactacatagcacccgagctctttgtcagagagccggaaaaacgactgggcgtgcggggagacattcggcagcacccactttttcgtgaaatcaattgggaagagctcgagcgtaaagaaatcgaccctcctttcagacctaaggtgaagtctcccttcgactgctcaaatttcgataaggaatttctcaacgagaagcctaggctgagcttcgctgatagagctctgataaattccatggaccagaatatgtttcgcaacttctcgttcatgaatccaggcatggagaggctaattagttag

SEQ ID NO: 130529 - DNA, 1440 bp, Artificial Sequence
  Description of Artificial Sequence: Synthetic coding sequence
tgactgagcttgctgccttgtctgttattcctgcctacgataatccctaaaaagattgtgattcaaagagattctctgccgagcaagaagttgtcgtatggactgattgcctgcgggatgaacgtccatcacaggtgtcagactaaggtggccaacctgtgtggcatcaatcaaaaactgatggctgaagcactcgccatgattgagagcactcaacaagcacgctgtctcagggatacggagcagatatttcgagaaggacccgtggagataggactgccgtgctccatcaagaatgaggctcgcccaccctgcttgcctactcctggcaagcgcgagccacaagggatcagttgggaatctccgttggatgaggtggacaaaatgtgccatcttcccgagcctgagctcaataaagagaggccttccctccagattaaattgaaaatcgaagacttcatcctgcacaagatgctgggaaaagggagcttcggaaaagttttcctggctgagtttaagaagaccaaccagttctttgccatcaaggccctgaaaaaggacgttgttctcatggatgatgatgtagaatgcactatggtggagaagagggtgctctcactagcttgggagcatcccttcttaactcatatgttctgtactttccagactaaagaaaacctattcttcgttatggagtaccttaatggtggcgacctgatgtatcacatccaatcctgccacaaatttgatcttagcagagccactttctatgccgccgaaattatccttggcctgcaatttctgcactccaaagggattgtatatagggatctgaagctcgataacatcctgcttgacaaggacggtcacattaaaatcgccgattttgggatgtgtaaagagaacatgctgggtgacgccaagaccaacaccttttgtggtacacccgactacatcgcccccgaaatcttgctcggccagaagtacaatcactcagtggattggtggagcttcggcgtccttctgtatgagatgctgatcggtcagtcaccttttcacggccaggatgaggaagaactgtttcattccattcggatggataacccattctacccaagatggctcgaaaaagaggctaaagatctccttgttaagctattcgtgcgtgagccggagaaacgcttaggcgtccggggagacatccgacagcaccctctattcagagaaattaattgggaagagttggagcggaaagaaattgaccctcccttccggccgaaagtgaagtcacccttcgattgcagtaatttcgacaaggaatttctgaacgaaaagccccgcctgtccttcgccgatcgggcgctgataaatagtatggaccagaacatgtttaggaatttttcctttatgaaccctggcatggaacggctgatctcctag

SEQ ID NO: 130530 - DNA, 1746 bp, Artificial Sequence
  Description of Artificial Sequence: Synthetic coding sequence
atggataccaaggacatgaatgagttcgagactgagggtttcttcgcccttcatcaacgccgaggcgcaataaaacaagctaaagtgcaccatgttaaatgccatgaatttacagcaaccttttttcctcaaccaactttttgtagcgtgtgccatgaatttgtctggggcctgaataagcaaggctaccagtgcaggcaatgcaatgccgctatccataaaaagtgtatcgacaaggtgatagctaagtgtactggctcagcaatcaactctcgagagaccatgttccacaaagagcggtttaaaatcgacatgccgcaccggtttaaggtgtacaactacaaaagtcccaccttctgcgaacactgtgggaccctattatggggattggccaggcagggcctaaagtgtgatgcttgcgggatgaacgtgcatcatcgttgccagactaaggtcgctaacctctgtgggattaaccaaaaactgatggccgaggctttggccatgatagagagtacccagcaggcccgctgtctcagagacacagaacagatatttcgggagggtccagtcgagatcggcctcccatgttccattaaaaacgaggcaaggcccccttgtctcccgactccaggtaagcgagagccccaaggaatctcctgggagtcaccgcttgatgaggttgacaaaatgtgccacctgcccgagcctgagcttaacaaggagcggcctagcttgcagatcaaattaaaaatcgaggattttatcttacataaaatgctggggaagggctcatttgggaaagtattcctggcagagtttaagaagacgaatcagttcttcgctatcaaagcattgaaaaaagacgtggttttgatggatgacgacgttgaatgcacaatggtagagaaacgtgtgctgagcctcgcctgggaacacccgtttctgacacatatgttttgcaccttccagaccaaggaaaacttattttttgtaatggaatatttgaatggtggagatctgatgtaccacattcagtcttgccataaattcgatttgtcacgagctacattttatgctgccgaaatcatcctgggactccagtttcttcactctaaagggattgtatatcgggatctgaagcttgacaacattctcttggacaaagacgggcacataaagatcgctgacttcggaatgtgcaaggaaaatatgcttggagatgctaaaacaaataccttctgcggcacccctgactatatagctccggagatattactaggccaaaaatataaccactccgtagactggtggagtttcggcgttctcctctatgagatgctcattggccagagtccattccatggccaggatgaggaggaactctttcattcaataagaatggacaatcctttctacccaaggtggctagagaaagaggccaaggatctgctggtgaagctgttcgttcgagagcccgagaaaagacttggggtgaggggcgatatccggcaacacccactctttcgcgagatcaactgggaggagctggaaagaaaggagatcgatcctccttttcgcccaaaagtcaagagccctttcgattgtagcaacttcgataaggaatttctgaatgaaaaacctagattgagcttcgcggacagggctttaattaattctatggatcagaacatgttccgcaactttagcttcatgaaccccggcatggagaggctgatttcctag

SEQ ID NO: 130531 - DNA, 1032 bp, Artificial Sequence
  Description of Artificial Sequence: Synthetic coding sequence
atggcaagcaacagcagcgatgtgaaggaattcctagccaaggctaaggaagactttctcaagaagtgggagagcccagctcaaaataccgcacacctggaccagttcgagagaattaagacactaggcaccggaagctttggccgtgtgatgttggttaagcataaagaaacgggcaatcactatgctatgaagattttggataagcagaaggtggtgaagcttaaacaaatcgagcacaccctgaatgagaagcgcatattgcaggccgtgaatttccccttcctggtgaaactcgagttttccttcaaggataacagcaatctctacatggtcatggaatatgtcccggggggggaaatgtttagccacctgcgtcggattgggcggttcagtgagcctcatgcgaggttctacgccgcgcaaattgtgcttacattcgaatatctccattcattggacctgatctatagggatctaaagcctgagaatctgctcatagatcagcaagggtacatccaggtgaccgattttggctttgccaaacgggtgaagggacgaacatggacattatgtggcacccccgagtatctggctcctgagataatattgtctaagggctataacaaggccgtcgactggtgggccctgggcgtgttgatctatgaaatggccgccgggtatccacctttctttgcggaccagcccattcagatttacgagaagatcgtctcgggtaaagtccggttcccctctcatttcagtagtgatttgaaagacctgctgcgaaatctgttgcaggtagatctaacaaagcgatttggtaatctgaaaaatggagttaacgatataaaaaatcacaagtggttcgctacaacggattggatcgccatttaccaaagaaaggtcgaggcccctttcattccgaaattcaaagggcccggagacacgagcaactttgatgattacgaagaagaggagattcgggtgagtataaatgaaaaatgcgggaaggaattttccgagttttag

SEQ ID NO: 130532 - DNA, 1146 bp, Artificial Sequence
  Description of Artificial Sequence: Synthetic coding sequence
atggaaagcggcagcaccgcagcttctgaagaggcccgatccctgagggagtgcgagctctacgtgcagaagcataacatccaggctttactcaaagatagcatcgttcagctctgcaccgcacggcccgaaagaccaatggcatttcttagggaatatttcgagagactagaaaaagaggaagctaagcaaatccaaaatttacagaaggctggtacacggaccgactcacgagaggatgagatatcccccccaccacccaaccccgtggtgaaggggaggaggagacggggcgccatctctgctgaggtatatacagaggaagatgctgcttcgtatgttcggaaagtgatcccgaaagattacaagacgatggcggcgctggctaaggctatcgaaaagaacgtcctgttcagccacctggatgacaacgagcggtcggatattttcgatgctatgttctcagttagctttattgcaggcgagacagtgatacagcaaggggatgaaggcgataatttctatgtgatcgaccagggtgagacagacgtctatgtgaataacgaatgggcgacctccgttggagaggggggaagcttcggcgagctcgccctgatctacggcacaccccgtgctgctacagttaaggctaaaacaaacgtcaaactgtgggggatcgaccgggattcttatagacggatcctgatgggatctaccctcaggaaaagaaaaatgtacgaagagtttctgtccaaagttagcatcttggagtccctcgataaatgggagcgcctcaccgtggctgacgcactggaacccgttcaattcgaagatgggcagaagatcgttgtgcagggagagcctggcgacgaattttttataattctggagggtagcgcagccgttctacagagaaggagcgaaaacgaggagttcgtggaggtggggcggttagggccctcagattacttcggggaaattgccctcctcatgaataggcctcgggccgccaccgtagtggcaagaggtccgctgaaatgtgttaagctggacaggccaagattcgagagggttttgggtccctgcagcgacatcctgaaaaggaatatccagcaatataactcgtttgtcagcttaagcgtgtag

SEQ ID NO: 130533 - DNA, 2739 bp, Artificial Sequence
  Description of Artificial Sequence: Synthetic coding sequence
atgtcggccccccctgtcctgcgacctccctcccctcttctgcccgttgccgctgccgcagcggcggctgctgcagccctggtcccaggatccgggccgggtcccgccccttttctggcgcctgtggctgcccctgtgggggggatttctttccacctccagatcggactgtctcgagaacctgtgcttctgctgcaggactcatcaggggattattctctcgcccacgtccgggagatggcatgtagcattgtagaccagaagttccccgagtgcggcttctacgggatgtacgataagattctgctgtttcggcacgacccaacaagcgagaatatcttgcagctggttaaagccgcaagcgacatccaagaaggggacctgatagaagtcgtccttagcgcctccgctacattcgaagacttccagattagaccacacgccctgtttgtgcatagctatcgagcccctgcattctgcgatcattgcggcgagatgctttggggcttagttcggcagggcctaaaatgtgaagggtgtggcctgaactatcacaagagatgcgccttcaagatccccaataactgttccggcgtgaggagaagaagactgagtaacgtctctctgactggcgtaagtaccatccgaacaagctcagccgaattgtcaacatctgcacccgacgagccgctcctacagaaatcaccatccgagtcttttattggaagggagaaacggtcaaactcccagagctatataggcaggccaatccaccttgataaaatactgatgagcaaggttaaggtgccgcacacattcgtaattcacagttatacacgtcctaccgtctgtcagtattgtaaaaagctcttgaaagggttattcagacaaggcctccagtgcaaagactgtcgcttcaactgtcacaaaagatgcgcacccaaagttcccaataattgtctaggcgaagtgactatcaacggggatcttctgagccctggtgcagaaagcgatgtggtgatggaagagggcagtgacgataatgactccgaacgtaactcaggactgatggacgacatggaggaggcaatggtgcaggatgccgaaatggctatggctgagtgccagaacgattcaggagagatgcaggaccccgaccctgaccatgaagacgccaacaggactatctcacctagcacctcaaacaacatcccgttaatgagagtggtccagagtgtaaaacataccaaaagaaaatctagtaccgtgatgaaagagggatggatggtgcattacacatccaaggataccctccggaagcgccactactggcggctggacagtaagtgtattacactttttcagaacgacaccggctcccgctattataaggaaattccactgtccgaaattctcagcctagagcctgtaaaaacgtctgctctgattcccaatggtgcaaatccacattgcttcgaaattaccacagccaacgtagtctactacgtgggggagaatgtggtaaacccctcttctcctagtccaaacaatagcgtgctaacatccggtgtcggggctgatgttgcgcgcatgtgggaaatagccatacagcatgcccttatgcccgtaatccccaaggggagctcagtcggaaccggaaccaatcttcaccgggatatcagtgtctccatctctgtttctaactgtcagattcaggaaaacgtagatatctctaccgtgtaccagattttcccagatgaagtcctaggttccggccagtttggaatcgtgtacggcggaaagcacagaaaaacaggccgcgacgtcgcaatcaagattatcgacaaattgcgcttcccgacaaaacaggagtctcagctcaggaatgaggttgcaatcttgcagaatctccatcaccccggggtggttaatctggagtgcatgtttgagacgccagaacgcgtgtttgttgtgatggagaagttacatggtgatatgttagagatgattctgtcatctgagaagggcaggctgcccgagcacattaccaagttcctgattacccaaatcttagtggctctccgccacttacatttcaagaacatcgtgcactgtgacctaaaacctgaaaatgttctactggcttctgctgatccattcccccaggtgaaactctgtgatttcgggtttgctcgtataatcggggaaaagagttttcgacggtcagtcgtcggcaccccagcgtatctggccccagaggtgctcagaaataaaggctataataggagcttggatatgtggtcagtgggcgttattatctatgtgtctctgtctggaacatttccctttaatgaggacgaggatattcacgaccaaatccagaatgccgccttcatgtatccacctaacccctggaaggagatcagtcacgaggccatcgatctgatcaacaacctgctgcaagtgaaaatgcgcaaaaggtactccgttgacaagacactctcccatccttggctccaggactaccaaacctggctcgacctgcgggagctggaatgcaagatcggcgagcggtatatcacgcacgaatcggacgatctgcgctgggagaaatacgctggcgaacagggccttcaatatccaacccacctcatcaaccctagcgcttctcacagcgatacaccagaaaccgaagagacagagatgaaagccttaggagaacgagtctcaatcttgtag

SEQ ID NO: 130534 - DNA, 2637 bp, Artificial Sequence
  Description of Artificial Sequence: Synthetic coding sequence
atggcaacggctcccagctatcctgccggattacccggcagccccggcccagggtccccgccccccccaggcgggctcgagctgcagtcccctccacctctcctgccgcagatccccgctcctggcagcggcgtaagcttccatattcagattgggctgacccgtgaattcgtcctcctgcctgcagccagcgagctggctcatgtgaagcagctcgcatgtagcattgttgatcaaaagtttcccgagtgcggcttctatggcctgtatgataagattttgctatttaagcacgatcctacttcggcaaatttgcttcagttagtgagatccagtggcgacatacaggagggcgacttggtcgaggtggtcttgtcagcgagcgctacgtttgaggatttccaaatccggcctcacgcactaactgtgcatagctatcgggctccggcattttgtgaccactgcggcgaaatgcttttcgggctcgtccgacagggcttgaaatgcgatggatgcggactgaactatcataagaggtgcgctttctccataccaaacaactgcagcggggcaaggaagcgccgactttcttcgacaagcttagcctccggccattccgtgagacttggtacgtccgagtcactgccctgtactgccgaggagttaagtcgtagcactaccgagctgctccccagaaggcccccttctagcagttcttcgtcctctgcctccagctacaccggaagaccgattgagctggacaaaatgctgttgtccaaggtcaaggtcccacatacctttctcatccactcgtacactagacctaccgtgtgccaggcctgtaaaaagctgttaaagggtctattcaggcagggcctgcagtgtaaggactgcaaatttaactgtcacaagcgctgcgccacccgggtgcctaacgattgcctgggcgaagcgttgataaacggggatgtgcctatggaggaggcaaccgacttctccgaagcggataagagcgctcttatggacgaatcagaggactctggagtgatccccggtagccattccgaaaacgccctgcacgcaagcgaggaggaggagggtgagggcggtaaggcccagagttctcttggatacattcccctgatgcgtgtcgtgcagagcgtgaggcatacaacccgcaagagctcaaccactctgcgcgagggttgggtagtgcactattctaataaagacaccctgcggaaaaggcactactggaggctagactgcaagtgcataaccctgttccaaaacaacactacaaatcgatactataaggaaatccctttgtccgaaattctcaccgtggaatctgcccagaatttcagcctagtcccccctgggacaaatccccactgctttgagatcgtgacagccaacgccacatactttgtcggagaaatgccgggcggtactccggggggaccctccggacagggagcagaagctgccagaggatgggagacagccatccgacaggcactgatgcccgtgattttacaggacgctccgagcgcccccgggcatgcaccccatcggcaggcatccctgtcaatttcagtttcaaattctcagattcaggaaaatgtggatatcgccactgtctaccagatcttccctgatgaagtactgggttctggtcagtttggcgtggtgtatgggggaaagcacagaaagaccgggagagatgttgcagtgaaggtcatcgacaaactgcggtttcctacaaagcaagaatcccaactgagaaatgaagtcgctattttgcagagccttcgccaccctggtattgttaaccttgagtgtatgttcgaaactcccgaaaaggtatttgttgtaatggagaagctgcacggggacatgcttgagatgattctgagctccgagaagggccggctgccagaacggctcacgaagtttttgataactcagatcctggtggccctccggcacctacattttaagaatattgtgcactgtgatctcaagccggagaacgtgctcttggcatctgcggaccccttcccccaggtgaaactgtgtgatttcggcttcgcacggataattggggaaaagtcgtttaggcggtccgtggtgggtacacccgcctacctggcgcccgaagtgctgctgaaccagggttataatcgttccctagatatgtggagtgtaggtgtcatcatgtatgtttctttgagtggaacatttccttttaacgaggatgaggacatcaatgaccagatacaaaatgctgcctttatgtacccggcctccccttggtcccacatctctgcaggggccattgacctgatcaataacctgctccaagtcaagatgagaaagaggtattccgtggataaatctctttctcacccttggttacaggagtaccagacttggctcgacctacgcgagctggaaggtaagatgggcgagaggtatattacacatgaaagcgatgacgtacgctgggaacagttcgcagccgaacaccctcttcccgggtccggacttccaacggaccgcgacctcggtggcgcctgtccaccccaggaccacgatatgcagggcctggccgagagaatttccgttctatag

SEQ ID NO: 130535 - DNA, 2637 bp, Artificial Sequence
  Description of Artificial Sequence: Synthetic coding sequence
atggccaccgctccttcatatcctgcggggctccctggtagcccaggacccgggagcccccctcctcccggaggcctggagctacagtctcccccacctttgctgccgcagattcccgccccgggctctggcgtgtcctttcacatccagattggacttactcgcgaattcgtcctcctccccgcagcctcagaactcgcgcacgttaaacagcttgcctgttccatcgtagatcagaaatttcccgaatgcgggttttatggactgtatgataaaatcctattgttcaagcacgaccctaccagtgcgaacctgttacagctcgtgcgctcctccggcgacattcaggaaggagaccttgttgaagttgtgcttagtgcctcagccaccttcgaggatttccagatcagacctcacgcccttactgttcactcgtatcgcgctcctgcattttgtgaccactgcggcgaaatgctgttcggtttggttcgtcagggcctgaaatgtgatggatgcggtctgaactatcataagcgatgcgctttttccatccctaacaattgtagcggggcgagaaaaaggcgtctctcctccacatcccttgcctctggtcactcggtgcggctggggacctcagaatctctaccttgcaccgcggaggaacttagtcgatcaacaactgaactgctgccaagaagacctccaagcagttcatctagctcctcggcctccagttataccggacggccgattgagctggacaagatgctgctttctaaagttaaagtaccccacactttcctcatccatagctatactcggcccaccgtctgccaggcttgtaagaagctcttgaaaggcttgttccgccagggcctccagtgtaaggattgtaaatttaattgccataagcggtgtgctaccagggtgcccaatgactgtctgggagaggccctgatcaacggcgacgtgccaatggaggaagctaccgacttcagcgaggctgataaaagcgcgctgatggacgaaagcgaggatagcggagtcatcccaggctctcacagtgagaacgccctgcacgccagcgaggaggaggagggggaaggaggaaaggcccagtcctctctgggatacattccccttatgagggtagtgcaaagcgttaggcacaccactaggaagtcaagcactaccttgcgcgaagggtgggtcgtgcattactccaataaggacacactcagaaaaagacactactggcgcctcgattgcaaatgtataactctttttcagaataataccaccaacagatattataaagaaatcccactgagcgagattctgaccgtcgagagtgcccagaatttcagtctggtgccccccggaaccaatccacattgtttcgagattgtcacggccaacgctacgtattttgtgggcgagatgccggggggcacaccggggggccccagcggacagggtgccgaggcagcacgaggctgggaaaccgcaattcgtcaggccctgatgcccgttatattacaggatgcccccagtgctccgggacacgcaccccatcggcaggcctcattgtcgattagcgtgtccaattcacagatacaggagaatgtggacatcgcgaccgtctatcagatatttcctgacgaagtcctgggctcgggccagtttggagtggtatatgggggcaagcaccgcaaaaccggtcgcgatgtagccgtgaaggtcatcgacaaactgaggtttccaaccaagcaggaatctcagctccgcaacgaagtcgccatcctgcagtctttaaggcacccaggcatagtgaacctagaatgcatgttcgaaacccccgagaaagtctttgtggtcatggaaaaactccacggggacatgttagaaatgatcctgtccagcgaaaaaggccgccttcctgaacggctgaccaaatttttaatcacccagatcttagtggcccttaggcatcttcacttcaagaatatagtgcattgcgatctcaaacctgagaacgtgctgctcgccagcgccgaccccttcccacaagtgaagctttgtgacttcgggtttgcccgaataatcggggagaaaagcttccgcagaagtgtggtgggcacccccgcgtatctcgcccctgaggtgctacttaatcagggctataatcggtctctagatatgtggagcgtgggggtaattatgtacgtcagtctaagtggaactttcccttttaacgaggacgaggacatcaacgaccaaatccaaaacgcagcattcatgtacccagcatctccatggtctcatattagcgcaggcgctatcgatcttatcaacaatcttcttcaagtaaagatgaggaagaggtactccgtagataagtccctcagccacccctggctccaggagtaccagacgtggttagatttgcgtgaactggaaggcaagatgggcgaacgctatattacccacgagtctgacgatgtgagatgggaacaatttgcggccgaacatcctctgcccgggagtggcttaccaacggaccgggacctgggaggggcatgccccccacaggaccatgatatgcagggcttggctgagaggatatccgttctctag

SEQ ID NO: 130536 - DNA, 2166 bp, Artificial Sequence
  Description of Artificial Sequence: Synthetic coding sequence
atgctgtttggattggtgcggcaggggctgaaatgtgacgggtgcggtctcaattaccataaaaggtgcgcctttagtatcccgaataattgctcaggcgctcggaagaggagattgtcgtctacatccctcgcctcagggcatagcgtgagattaggaacatctgagtcactgccttgtactgctgaggagttgagcaggtccacaacagaattattaccacggagacccccgtcctctagcagttcctcctctgcttcaagctacactggcagacctatcgaactcgacaagatgttgctctctaaggtaaaggtgccccatacttttcttattcactcatacacacgtccaacagtctgtcaggcttgtaagaagctgctgaaaggattattccggcaaggcttgcagtgcaaagactgtaaatttaattgccacaaacgctgcgccacacgagttcctaacgactgcctgggagaggccctgatcaacggagacgtgccaatggaggaagccacagacttctcggaggcagacaagagcgccctgatggatgagtcagaggactccggcgtgatccccggttcccacagcgagaatgcactacatgcttctgaggaagaagagggcgaaggcgggaaggctcaaagctccctgggatacatccctctgatgagggtggtgcagtctgtcaggcacacaactcgcaagtctagcactacactgagggagggctgggtggtccactactccaacaaagatacgttgagaaaacggcattactggcggctcgactgtaagtgtatcaccctgttccaaaacaataccacaaatcgctattacaaggagattcccttgagtgaaatcctaaccgttgagtctgcacagaacttttcattggtgcctccaggcactaatccccactgcttcgaaattgtgacagcgaacgccacgtacttcgtgggcgagatgccagggggaacccccggggggcccagtgggcagggagccgaggctgcacgcggttgggaaactgccattcggcaggctctcatgcccgtgatcctgcaagatgcaccctcggctccagggcacgccccacaccgacaggcaagtctgtctattagtgtgtctaatagtcagatacaggagaacgtggacatcgccacagtgtaccagatctttccagacgaagtccttggatcaggccagttcggggtcgtgtatggcggcaagcacaggaagactggaagggatgttgccgtcaaggtcattgacaagctgcgattccccaccaagcaggagtcccagctgcggaatgaagtagccatcctccagagtcttcgccatcccggtatcgtcaaccttgagtgtatgttcgaaactcctgaaaaggtcttcgtggttatggaaaaattgcacggcgacatgctagaaatgatcttatcctccgagaagggccgtctccccgagcggttaaccaagttcttaatcactcagatcctggtggcgctccgtcacctgcactttaaaaatattgttcactgcgaccttaaaccggagaacgtattgctggccagcgcagatcctttccctcaagttaaactctgcgactttgggttcgcgagaattataggagaaaagtcttttcgacggtctgtcgtgggtaccccggcgtatctggccccggaggtcctcttaaatcagggctacaataggtcactggacatgtggtctgtgggagtgatcatgtacgtgagcctctctggaacctttccttttaatgaggatgaagacattaatgaccagattcagaatgctgcattcatgtacccagcttctccatggtcccacatatccgcaggagcaatagacctcataaataacctcttgcaagttaagatgcgcaaacgttactctgtggacaaaagcctgagccatccctggttgcaggaataccaaacgtggctggatctgagggaacttgaaggtaaaatgggagagcgctacatcactcacgaaagtgatgacgtgaggtgggaacagtttgccgctgaacaccccctgcccggctctggcctccccacagaccgagatctaggtggcgcctgtccccctcaagatcacgacatgcaggggctcgccgagaggatttccgtgctttag

SEQ ID NO: 130537 - DNA, 1482 bp, Artificial Sequence
  Description of Artificial Sequence: Synthetic coding sequence
atgagacgacggagggcggcagtagctgccggattctgtgccagttttctccttggcagtgtgctcaacgtcctgttcgctccagggtccgaacctccaaggcctggtcagagccctgaaccctctccggcccctggccctggccggcgcggcgggcggggggaattggcaaggcaaattagggcaagatacgaggaggtgcaaaggtatagccgggggggccccggacctggcgcaggaaggcccgaaagaagacgcctcatggatctggcacccggaggtcccggactgccacggccacgtcccccctgggcacggccactttctgatggggcgcccggctggcctccagcccccgggcctggcagccctggcccggggccaaggttagggtgtgcagctctgcggaacgtcagtggggctcagtatatgggctccgggtatactaaagcagtgtacagagtgcgtctgcccgggggcgctgcagtggcgctcaaagctgtggatttcagcggacatgatttggggtcctgtgtgcgtgagttcggtgttagaaggggatgttatagactagcagcacataagctcctcaaagagatggtgctgctggaacggctgcgtcaccccaatgtgctgcagttatatggttattgttatcaggatagtgaggacatcccggatactttgactaccatcactgaactgggagcacctgtggagatgatccagctgctgcagacctcatgggaggatcgatttaggatttgtttgagtctaggcaggcttctgcaccaccttgcccactcccctctcggttccgtgacactgctggacttccggccgcgtcagtttgtactggtcgacggagaactgaaagtgacagatctcgatgatgctcgggtcgaggagacgccgtgcgcaggaagcacagattgtattctcgagttccccgcaaggaatttcacactgccctgctcagcacaagggtggtgtgagggtatgaatgagaaaagaaatttgtacaacgcctaccggttcttttttacctacctcctgcctcactccgcccctccctcacttcgtccactgctggactccattgtcaacgccactggggagctcgcctggggcgtagatgagacccttgcccagctggaaaaagtacttcacctgtatcggagcggccagtatctgcagaactcaactgcatcctctagcacggaataccagtgcatcccagactcgacaatccctcaggaggattaccgctgttggccctcataccatcatggatcctgtctcctcagcgtgtttaatttggctgaggcagttgatgtctgtgagagccacgcccagtgtcgcgcattcgtggtgactaatcagacaacatggacgggacgacagctggtctttttcaagacaggatggtctcaagtggtgcccgatcctaataagacaacctatgtgaaagcaagcggatag

SEQ ID NO: 130538 - DNA, 2829 bp, Artificial Sequence
  Description of Artificial Sequence: Synthetic coding sequence
atggcctccgatgcagtgcaatctgaacctaggtcttggtccctacttgagcagttgggactggccggcgctgatctggccgcccccggcgtgcagcagcagttggaactcgagagggagcgccttcggcgcgagattaggaaagagttaaagctgaaggaaggtgccgagaatctacggagggctacaactgatctcggacggagccttggccccgtcgagctactgctgcgggggagctcaagacggcttgacctgttacaccagcaactacaggagctccacgcccacgtggtcctgcccgaccctgccgctacccacgatggcccccagtccccaggtgccggcgggcccacttgttccgccacaaacctcagtcgagtcgccggcctggaaaaacagttggccatcgaattgaaagtgaagcaaggcgccgaaaatatgatccagacatattccaacggctctactaaggatcggaaacttctgttgaccgctcagcagatgctccaggactctaaaaccaagattgacatcatcaggatgcaactcaggagagcgctgcaggccggtcagctagagaatcaggccgccccagacgatacacaaggctcacctgatcttggcgcagtcgagctgcgcatagaggagctgaggcaccacttccgcgttgaacacgcggtggccgaaggcgccaagaatgtgctgaggctgctgtctgcggcaaaagctcccgaccggaaagcagtgtcagaagctcaggagaagctgactgaatcaaaccagaagttaggtctattgcgggaggctctcgaaaggagattaggagagttgcccgctgaccatccaaaagggcgactgctgagagaagaactggccgcggcaagctctgctgctttctcaactagactggccggcccttttccagcaacgcactattcaaccttatgcaaacctgcaccacttaccggaactttggaggttcgcgtcgtgggatgtcgtgacttgccagagaccatcccatggaacccaactccttcaatgggaggtcccggaacacctgacagtcggccacctttcctgtcccgcccagccagaggcttatactcacggtctggaagcctttcaggaagaagctcacttaaggctgaggcagaaaatacctcagaggtctccactgttttgaagctcgacaacaccgtggttggacaaacatcttggaaaccctgtgggcctaacgcctgggaccaaagctttactcttgaacttgaaagggctcgcgagctggaacttgcggtgttttggcgcgatcaacggggcctgtgcgccttgaagtttctgaagttggaggatttccttgacaatgagagacatgaggtccagttggatatggaaccacaagggtgcttggtggcagaagttacttttcggaatcctgttatagagcggattccccggctgaggcggcaaaagaagattttctcgaagcagcagggaaaagcctttcagcgcgccaggcagatgaacatcgatgtggctacgtgggtgagacttctcaggagattaatccctaacgccacgggaactggtaccttcagtcctggggctagccccggatcagaagccaggactactggggacataagcgtagagaagctgaatctaggaactgattccgatagctccccccagaagtctagcagggaccctccttcctctccgtcaagcctcagttcacctattcaggagtctaccgcccccgagttgcccagtgaaacgcaggagacccccggaccagcactttgctctcccctgcgaaagagccctctgacattggaggacttcaaatttttagctgttttaggccgtggccacttcggcaaagtccttctgagcgaattcaggccgtctggcgaactgtttgccatcaaggcccttaagaagggcgatatcgtggctcgggatgaggtggaatctctcatgtgcgaaaagaggattcttgcggccgtgactagcgccggtcacccattcctggtgaacctgtttggatgcttccaaaccccggaacacgtctgtttcgtaatggagtatagtgctggcggtgacctgatgctgcacattcacagcgatgtatttagcgagcccagagccatcttctattccgcctgcgtggttctgggtctccagtttcttcacgagcataagatcgtgtacagggacttaaaattggataacctgcttttagacactgagggctacgtcaagatagctgacttcggactgtgcaaggagggcatggggtatggcgacaggacctcaaccttctgcggaacccccgagttccttgcgccagaggtgctcacagacacaagttacacacgtgccgtggactggtggggcctcggtgtcctcctctacgagatgctggtgggcgaaagccccttccccggcgatgatgaggaagaagtcttcgattcgatcgtgaacgacgaggtgcgttaccctagattcttgtcagcggaggcaatcgggatcatgcgccgcctcctgcgtcgcaacccagaaagacgactcggaagctcagagagggatgccgaagacgtcaaaaagcagcccttctttagaaccctgggctgggaggctttgctggcaaggaggttgccgcctccttttgtccctactctttctggcaggactgatgtgagtaatttcgatgaggagttcaccggcgaagccccaaccctcagccccccaagagatgccagacctttaacggccgcagaacaagccgctttcctggatttcgactttgtggctggtggttgttag

SEQ ID NO: 130539 - DNA, 2847 bp, Artificial Sequence
  Description of Artificial Sequence: Synthetic coding sequence
atggctgaggccaataaccctagtgaacaagagctggaatccgaacctaggtcatggagcttgctcgagcagttggggcttgctggcgctgaccttgctgccccaggagtgcaacagcaacttgagctggaaagggagagactgcgcagggaaatcagaaaagagctgaagcttaaggagggtgccgagaacctccggcgagccaccacggatctagggagatctctggggcctgtcgagctgttgctgcgcggatccagtagacgcctcgacttgttacatcagcagctgcaggagttacatgcacatgtggtacttcccgacccagcagcgacgcacgatggacctcagtcacctggcgctgggggccctacctgctccgctaccaacttatccagggtagccggactcgaaaagcagctggccatagaactaaaggttaagcagggagcggagaatatgattcaaacctattccaatggatcgactaaggatcgaaaactccttcttaccgcccagcagatgctgcaggacagcaagacaaaaatcgatatcatccgaatgcagcttcgccgagctctgcaagcaggccagctggaaaaccaggccgcaccagatgacacgcaaggctctcctgacctgggggccgtcgaactgaggattgaagagctgcgccaccatttcagagtagagcatgcagttgctgagggagccaaaaatgtgctcaggctgttatcagctgccaaggcccccgatagaaaggcggtgagtgaagcccaggagaagcttacagagtcgaatcaaaagctcggactgttgagagaggccctcgaaaggagactaggagagctgcccgctgaccatccaaagggcagactgctgcgggaagaattagctgctgcctcatctgcagctttctcaactaggctggccggccctttccccgctacccattattcaactctgtgtaagcccgctcctttaactgggaccttggaggtcagagtggtgggttgtcgggatctgccagaaacaattccatggaatccaacaccatcaatggggggcccagggactcccgactctaggcccccgttcctcagtaggcccgcaaggggcctttatagccggtctggttccctgtccggtaggtcttcgctgaaggcggaagccgagaatacgtcggaagtgtccacagtgcttaagctggataacaccgtggtgggacagaccagttggaagccgtgtgggcctaacgcctgggatcagagttttaccctggagctggagagagcaagagagcttgagctcgcggtgttctggcgggatcaaagaggactgtgtgcactaaaatttctgaagctggaggattttctggataatgaacgccatgaagtgcagctggatatggaaccgcaagggtgcttagtcgcggaagtcaccttcaggaatccagtgattgaaagaatcccgcgcctccgccggcagaaaaagatcttctctaagcagcaaggcaaggcattccaaagggctagacagatgaatatcgatgtggcaacatgggtccgtttgctgcgccggctgatcccaaatgccactggaacaggcacctttagtccaggcgcctctcccgggtcagaggcacggactactggagatatctccgttgagaagctcaatctggggactgatagtgacagtagtccgcagaaatctagccgtgatccacccagctctccgtcgtctctgagctcaccgattcaagagtcgactgctcctgagctaccgtccgagactcaggagacccccggaccagcattgtgttcacctctgaggaaaagcccccttacattagaggatttcaagttcctggccgtactggggcgtggacacttcgggaaggtcctactgtctgaatttcgcccttcaggggagctcttcgccatcaaagctctaaaaaaaggcgatattgtcgctagagatgaagtggagagcctgatgtgtgaaaagcgcatcctcgccgctgtgacaagcgctgggcatccgtttctcgtcaacctgtttggttgttttcagactccagaacatgtctgcttcgtgatggaatattcggcaggtggcgatctgatgctccacattcatagtgacgttttctcagagcctcgggccatcttttactcagcctgcgtggtgctcggactccagttcttgcacgaacacaagatcgtttatcgggatttaaagttggataatctgctgctcgacacagaggggtatgtcaaaatcgcggactttggcctatgcaaggagggaatgggctacggagaccggacgagcaccttctgcggcactcctgagttcctggcccctgaagttttgacagacacaagttacacccgtgctgtcgattggtggggccttggggtcctgctgtacgaaatgctggtgggtgagtccccctttcccggcgatgacgaagaagaagtgttcgatagcatagtcaatgacgaggttaggtacccacgctttctttcggccgaggccatcggaatcatgcgaaggctactcagaaggaaccctgagcgcagacttggatctagcgaaagggatgccgaggacgtcaaaaaacagcctttttttagaacccttggctgggaggcccttttggcccgcaggttgccacctcccttcgtccccaccctgagcggcaggaccgacgtgtcaaacttcgacgaggaatttaccggagaagcccccacattgtccccgccgcgagacgctcgccctctgaccgctgccgagcaggccgcattcctggatttcgactttgtggccgggggttgctag

SEQ ID NO: 130540 - DNA, 1815 bp, Artificial Sequence
  Description of Artificial Sequence: Synthetic coding sequence
atggcctccaatccggagagaggggagatcctccttaccgaattgcaaggtgactctcgttccttgcccttcagcgagaacgtgtcagctgttcagaaactggactttagtgataccatggtacagcagaagttagatgatatcaaagacagaatcaagcgcgagatcagaaaggaactcaaaatcaaagagggtgcggagaatcttcggaaggtgacgactgataaaaaatcccttgcctacgtggataacattctgaagaagagcaataagaaactcgaggagctgcatcacaaactccaggagctaaatgcacacatcgtcgtgagtgaccccgaggacatcactgactgtcctagaacgccggatactcccaacaatgatcctagatgctcgacctccaacaaccggttgaaggcgttgcagaagcagctcgacatcgaactcaaagtgaaacagggcgcagagaacatgattcagatgtacagcaacggatcaagtaaagatcgcaagctgcatggtacggcccagcagttgcttcaggacagcaagaccaaaattgaggtcatccggatgcagatcttgcaggcagttcagactaatgagctcgctttcgataacgccaagccggtcatctctccactcgagttgagaatggaggaactgaggcatcacttccgaatcgagtttgccgtggccgagggcgctaaaaacgtgatgaagctgctcggtagcggtaaagttaccgatcgtaaggccctgtcggaagcacaggcccggttcaatgagagctctcagaaattggatctcctcaagtactccttggagcaaaggctaaatgaagttcccaaaaatcaccccaaatcccggattataatcgaagaactgtcactagtcgccgcttcacctaccctgagtcctcggcagtctatgattagcactcagaatcagtactcgaccttgagcaagcctgctgcactaaccggaactctggaggttagactaatgggctgccaggatattctggagaacgttcccgggcggtcaaaggccacttcagtggcattacccgggtggtcgccctccgaaactaggtcctcatttatgagccggacttccaagtctaagtccggatctagtagaaatttgttgaagactgacgatctcagtaacgacgtgtgcgcggtgctaaaactggacaacacagtcgtgggacagacctcttggaagcccatttccaaccagagctgggatcaaaagttcacactagaactggacaggagcagagaactcgaaatctcggtttattggagagattggaggagcctctgcgccgtcaaattcttgcggctggaagattttctcgacaatcaacgacacgggatgtgcctatatctcgaacctcaaggcacacttttcgctgaggtgactttcttcaatcccgtgatcgagagacgaccaaaactccagagacaaaaaaagattttctccaaacagcagggtaaaaccttccttcgggcgcctcagatgaatatcaacatagcgacgtgggggcgcttggtcaggagggccattccgactgtgaatcattccggaacatttagtcctcaggccccagtccctacgactgtgcctgtcgtggacgtccgcataccacagcttgcaccacctgcccgttacgtttccgaaattctgtccatctcctatacgaaactgttaggtcattcatacgtgctgatcatcgccggagtcctgtcattggctttcttcccgtcttcaatcctgaaggtcgtgttttgtctcctgaaaaagtag

SEQ ID NO: 130541 - DNA, 2484 bp, Artificial Sequence
  Description of Artificial Sequence: Synthetic coding sequence
atgatccaaatgtattccaatggcagcagtaaggaccgcaagcttcatggcaccgctcaacagttactgcaagacagcaagactaagatcgaggttattagaatgcagattctacaggcggttcagaccaatgaactggctttcgacaatgcgaagcccgtgattagtccacttgagcttagaatggaagaactacggcatcattttcggatagaatttgccgtggccgaaggagcaaagaacgtaatgaagctccttggctcagggaaagtgaccgaccgcaaggctttgtctgaggctcaggctaggttcaacgagagctctcaaaagctggacctccttaaatacagcctcgagcagagactcaatgaggtgccgaaaaatcacccaaaatctcgaataattattgaggagctttcactcgtggccgcatctccaactctgtctcccaggcagagcatgatctccactcaaaaccagtacagtacactgtccaagccggccgctctgaccggaaccctcgaggttcgactgatggggtgccaggacattctggagaatgttccagggcgaagcaaggccactagcgtcgcattgcccggttggtccccttcagagactaggtcctccttcatgtctcgtacctctaagagtaaatccggctcctcgagaaatctgctaaagaccgacgatttatcgaacgacgtgtgcgccgtcctgaagctggataacacagtagtgggacaaaccagttggaaaccgatctccaaccaaagttgggaccagaaattcaccttggaactggatagatcccgagagttggaaatcagcgtgtactggagagactggcgcagtttatgtgccgtgaaattccttcgcttggaggacttcctcgacaaccaaaggcacggtatgtgtctgtacttggagccccagggcaccctctttgccgaagttacctttttcaaccctgtgattgaaaggagaccaaagctccagcgccaaaagaaaatctttagtaaacaacagggtaagacattcttgcgcgcccctcagatgaatattaatatcgcaacttgggggaggctagttagacgggccattccaaccgtcaaccactcaggcactttcagcccccaggcaccagtgccaaccactgtccctgtggtcgacgttcgcatcccccagctggcacccccagcgagtgattccacagtcactaagctcgactttgatctcgagccagaacctccaccagctcctcccagggcttctagcctgggcgagattgacgagtctagtgaattgcgggttctggatattccagggcaggattcagaaacagtgtttgatatacagaatgacaggaattccattctgcctaaaagccagagcgagtacaagcctgacacccctcaatcaggcctggagtactcgggcattcaggaactcgaggaccggagatctcagcagcgttttcagttcaatttacaggacttcaggtgttgcgctgtgctgggtcgcgggcatttcggcaaggtgctgttggctgaatacaagaacaccaatgaaatgtttgcaatcaaagcactgaagaaaggtgatatagtggctcgggatgaggttgacagtcttatgtgcgaaaagcgcatttttgaaaccgttaattctgttcgccatccgttcctcgtgaacctgttcgcttgcttccaaactaaggagcatgtgtgcttcgtaatggagtacgctgctggcggagatctgatgatgcacatccatacggatgtgttctccgagccgagggccgttttctatgcagcatgcgtggtgctgggacttcagtatctgcatgaacataaaatcgtctatcgcgacctaaagcttgataacttactgctggacaccgagggatttgttaaaatcgccgattttgggctgtgtaaagaagggatggggtatggtgaccgcacctcaacgttctgtggcacacctgaattcttagcccccgaagtactgaccgaaaccagctacactcgagccgtagactggtggggcctgggggttctcatatatgaaatgctggtgggcgagtcaccatttcccggggatgacgaggaggaggttttcgacagcatcgtcaatgacgaggtgagataccctagattcctctccactgaggcaatttcaataatgaggagactactccgaaggaaccctgaacggaggctgggcgctagtgagaaggatgccgaggacgttaagaagcatcctttctttaggctaattgactggagtgctttaatggataaaaaggtgaaacccccattcattcccacaatccggggcagagaggacgtgagcaacttcgatgacgaattcacaagcgaagcacctattctcactccccctcgggagcccaggatattgtccgaagaggagcaggagatgttccgagacttcgactacatcgccgattggtgctag

SEQ ID NO: 130542 - DNA, 2811 bp, Artificial Sequence
  Description of Artificial Sequence: Synthetic coding sequence
atggcttctaatcccgagcgaggcgaaattctcctgacggagcttcaaggagatagtaggtctcttccattttcagagaacgtctccgcggtgcaaaaacttgacttcagcgatactatggtccaacagaagttggatgatattaaggacagaattaagagggaaattaggaaagaactcaagattaaggagggtgcagagaacttacggaaggtaacgacagataagaagagcctggcgtatgttgacaacattctgaaaaagtcgaataaaaagctggaggaacttcatcataaattacaggaactgaacgctcacatagtggtaagcgaccctgaagatatcactgactgccctaggactcccgataccccaaacaatgacccgcggtgcagtacctccaataatcgcctgaaggccctacagaaacagctggacatcgagctgaaagtcaagcagggcgctgaaaatatgatccagatgtacagtaacgggtcttccaaggatcgaaagctacatggaactgcacagcagcttctgcaggactcaaaaactaaaattgaggtaatcagaatgcagatactgcaagcggttcagaccaatgagttggctttcgataacgctaaaccagtcatatcacctttggaactgcggatggaggagttgcggcaccacttcagaattgagttcgcggtggcggagggcgccaagaacgtgatgaaactacttggtagcggaaaagtgaccgaccggaaagcgctgtccgaggcacaggctcgatttaatgagagctcgcaaaagctcgatttattgaaatatagtcttgagcagaggctgaatgaagtgccgaaaaaccacccgaagtcacgtatcataatagaagagctgtcgttggttgccgcttcccccactctttcccccagacagtccatgatttctacccagaatcaatattccacactgtctaaacctgcggctctgaccggtacgctggaagtcaggctgatggggtgtcaggacatcctggagaacgtgcccgggaggtctaaagccacgtcggtcgccctgcccggctggtctccctccgagactaggagcagctttatgagtcgaacctccaaatctaaatctggatcctcaaggaacctgctgaaaacggacgatctttcaaacgacgtgtgcgcagtgctgaagctggacaacacagtggtcgggcagacgtcttggaagccgatttctaaccagagttgggatcagaaattcactctggagttggaccgcgtcactttttttaatccagtgattgaaagacggccaaagctccagagacaaaagaaaatattttcaaaacagcaggggaaaacattcctgagggctccacagatgaacatcaatatcgctacatggggtaggcttgtcagaagggcaatcccaacagtcaaccactcaggcacctttagcccacaggcccccgtgccgactaccgtgcccgttgttgacgtcagaattccccagctagctccaccagcttccgattcgactgtcacaaaactcgacttcgatctggaacccgaaccacccccagccccacctcgggcctcatctctgggggaaatcgatgagtcttccgagcttcgcgttttggacatccccggccaggattccgagacggtgttcgatatccagaatgatagaaatagcatcttgccaaaatcacaatccgaatacaagcccgacaccccacagtcaggcctggagtattccgggatccaggagctggaagaccgacgctcgcagcagcggttccaatttaatctccaggactttaggtgttgtgccgttttggggagaggccattttggcaaggtcctcctcgccgagtataaaaacacaaatgagatgttcgcaattaaggccctgaaaaaaggtgatattgtcgcccgggacgaggtggattccttaatgtgcgagaagcgcatatttgagacagttaatagtgtgagacacccttttttagttaacttgtttgcctgtttccagactaaagagcacgtgtgctttgtgatggaatatgccgccggcggcgatctcatgatgcacatccacacagacgtctttagcgagccccgagccgtcttttacgccgcatgcgtcgttctgggcttacaatacctccatgagcacaagatcgtctatcgggatctgaagctcgataatctgctcctagacactgagggatttgtgaaaattgccgacttcggtctttgcaaggaaggcatgggctatggcgatcgaacttctaccttttgtgggacgcctgagtttcttgctccagaggtgctcactgagaccagttacacacgcgccgttgactggtgggggttgggcgtcctgatatacgaaatgctggtcggtgagtcacccttccctggcgacgacgaggaagaagttttcgatagcatagtgaacgacgaggtgcggtacccaagatttctgtctaccgaggctatcagtatcatgagaaggcttctgcgccggaacccagagcgacgtctgggtgcatctgagaaggatgcggaagatgtgaagaaacacccattctttcggttaatcgactggagcgccctcatggataaaaaggtcaaacccccgtttatccccactattcgtggacgggaggatgtctctaattttgatgacgagttcactagcgaagcgccaatcttgacccctcctcgggagcccaggatcctgtcagaggaggagcaggagatgttccgtgacttcgactatattgctgattggtgttag

SEQ ID NO: 130543 - DNA, 2955 bp, Artificial Sequence
  Description of Artificial Sequence: Synthetic coding sequence
atggcaagtaatccagagaggggagagattttgctgaccgagctgcagggcgacagccggtcactgccattcagtgagaacgtatcagctgtgcagaaattagatttcagtgacactatggtccagcaaaagctcgacgatattaaagacagaattaagcgggagatccggaaggagctcaagattaaggaaggagctgaaaatcttagaaaagtgaccacggataaaaaatccctcgcatacgttgacaatattctcaaaaagtctaataagaagctggaagagctgcaccataagctgcaggagctcaacgcgcacattgtggtatcagatccagaagacatcacagattgtccccggacacctgatacacctaacaacgaccctaggtgcagcacaagcaacaatcggctcaaggccctccaaaagcaacttgacattgagctgaaggtgaaacagggcgccgaaaatatgatacagatgtactctaacggatcctctaaggatcggaaattacacggcactgcccaacagctcctgcaagatagcaaaacgaagatcgaggtgatccgcatgcagatacttcaggctgtacagaccaacgagcttgcctttgataacgccaagcctgtgatttctcccctggagctgcggatggaggagctgaggcaccactttcggatcgagtttgcagtcgcggaaggtgccaaaaacgtcatgaagctgctgggctccggaaaagtaaccgatagaaaggcactcagcgaagcccaggcccgcttcaacgagagctctcaaaagttagacctgctgaaatactcgcttgagcagaggctaaatgaggtgcccaagaaccatccaaaaagcagaatcatcattgaagagctcagccttgtcgccgcaagccccacactttcccctaggcagtcgatgatatccactcagaatcagtattcaactctttctaaaccagcggcgctgaccggtacactggaggtgcggctgatgggctgccaggatattctagaaaacgtgcctggtcgcagcaaggctacaagcgtcgcactacccggctggtccccttccgaaaccagatcctctttcatgtcacgtaccagtaagtccaaatctgggagcagtaggaatttgttgaaaacagatgatttgtccaatgacgtgtgcgcggtcttaaagctggataataccgttgtggggcagacctcctggaaacccatctccaatcaatcctgggatcagaagttcacattagagctggatcggtcaagagagctcgagatctcggtgtactggagggactggaggtcactctgcgctgtcaagtttctgagactggaggactttcttgataaccagagacacgggatgtgtctctaccttgagccccaggggaccctgttcgctgaggtgacattttttaacccagtgatagagaggcgaccaaaattgcagcgccagaaaaagattttctctaagcaacagggcaaaactttcctgcgggccccacagatgaatatcaatatcgcaacatggggccggctcgtgcgccgcgccatacctactgttaaccactccggcacattcagtccccaagccccagtgccgactacagtcccagtcgtggacgtgaggataccacagcttgcccccccggcttcggactccacagtgacgaaactggatttcgaccttgaacccgagcctccacccgcacccccacgcgcctccagcctgggcgaaatagacgaatcaagtgagctgcgggtcctcgacataccgggtcaggatagcgaaactgtttttgacattcaaaatgatcggaatagtatcctgccgaagtctcagagcgagtataaaccagatactccccaatctggccttgaatatagcggcattcaggaactggaagatcgtcgctcccaacagcggttccagtttaacctgcaggatttccgctgctgcgcggtgttgggacgcgggcactttggcaaagtgttgctggccgaatacaaaaacaccaatgaaatgttcgcaatcaaggcactgaagaagggagacatagtagccagagacgaggttgattctctaatgtgcgaaaaacgcatctttgagactgtgaattctgtccgacacccgtttctcgtgaacctctttgcttgttttcaaaccaaggagcacgtgtgctttgtgatggagtacgcggcagggggagatttgatgatgcatattcacactgacgtatttagcgaaccccgcgccgttttttacgctgcctgcgtggtactcggcctgcagtaccttcatgagcacaagatcgtctaccgggacctcaaactggataacctccttttggataccgaggggttcgtcaaaattgcagactttgggctatgcaaggaagggatgggatatggcgatcgtacctcaactttttgcggcaccccagagtttttagcacctgaggtactaactgagacctcttacacacgggcggtcgattggtgggggctgggggtgttgatatacgaaatgcttgtgggcgagtcgccgtttccgggtgacgatgaagaggaagtgttcgacagcattgttaacgacgaggttagataccccaggttcctttcaaccgaggcaatcagcattatgcgtagactgttacgcagaaatcccgagcgcagattgggtgctagcgagaaggacgccgaagacgttaagaaacatcctttctttagattgattgactggagtgccttgatggacaaaaaagtgaaacccccatttatccccacaatccggggcagagaggacgtgagtaattttgacgatgaattcacatccgaggcacctattctcactccgccgagagaaccgaggattctgtcagaagaagaacaagagatgtttagagatttcgactatattgctgactggtgctag

SEQ ID NO: 130544 - DNA, 636 bp, Artificial Sequence
  Description of Artificial Sequence: Synthetic coding sequence
tgagaggagttgcggcaccatttccggatagaattcgccgtggctgagggcgccaagaacgtgatgaaattgctaggcagcggtaaagttacagatcgcaaagcgttgtccgaggctcaagcccgttttaacgaatccagtcagaagctcgacctgctaaagtattccctagaacagaggcttaacgaagtccctaagaaccatccaaaaagtcgcatcatcattgaagaactgtcacttgttgctgcttcccccacgttgtcccctcggcagagcatgatttccacacagaatcagtactcaacgctttcaaaaccggcagcgctcaccgatgatgtgtgcgccgtcctaaagctggataacactgtcgtgggccagacgagttggaagcctatcagcaatcagagttgggatcagaaatttaccctggaactcgatagaagtcgggagctggagatcagtgtttattggagggactggcgctctttatgtgcagtgaaatttctgaggctggaggactttctagacaaccagaggcacggaatgtgcctttacttggagccacagggcacattgtttgctgaagttactttctttaatcccgttatcgagaggagacctaagttgcagcgatag

SEQ ID NO: 130545 - DNA, 198 bp, Artificial Sequence
  Description of Artificial Sequence: Synthetic coding sequence
tgaggatttgtgaagatcgcagattttgggctctgcaaggagggcatgggttatggtgaccggacatctaccttctgtggcactccggagttcctggcaccggaggttctcaccgaaacctcctacaccagggctgttgattggtggggacttggtgtgctgatctacgagatgctggtgggagagacttccgtgtag

SEQ ID NO: 130546 - DNA, 1977 bp, Artificial Sequence
  Description of Artificial Sequence: Synthetic coding sequence
atgaacagcactctagaggtgcggctcatgggttgtcaggatattctcgaaaatgttccaggccgttcaaaggcaacaagtgttgctttgccaggctggagtccgtcagagacacgcagttccttcatgtctcggacttctaaatccaagtcaggaagcagtaggaatttacttaaaacagacgatctgagcaacgacgtttgcgctgtactcaaactggataacaccgttgtcggccagacgagttggaagccaatatccaaccagtcttgggatcagaaattcacgcttgagctggatcggtcacgcgaactggagatctctgtttattggagggactggcggtccctatgcgccgttaaattcctgagactcgaggacttcctcgacaatcagcggcacggcatgtgcctgtatctcgaacctcaaggcaccctgttcgccgaagtcacattctttaatccggttatcgagcggcgacccaaactccagcgacaaaaaaagatcttttccaaacaacaggggaaaaccttcctcagagctccacagatgaacatcaatatagccacctgggggcggttagtcaggagggccatccccaccgttaatcattcaggaaccttctctccgcaggctcccgttcccaccacagtcccggtggtggacgtgcggattccacagctcgccccccctgcaagtgactcaacggtgacaaaactggatttcgatctcgagcctgaacctcccccagcgcctccgagagccagtagcctaggcgaaattgacgagagtagcgagctcagggttctggacattcccggacaggacagcgaaacagtgtttgacatacagaatgatcgcaatagcatcctccccaagtcccagtccgaatacaagccagacacgccccagagtggcttggaatactccggaattcaagaactggaagacaggcgtagccagcagaggtttcagtttaatctgcaggacttcagatgttgtgctgtcctcggccggggccacttcggtaaggtgctattagccgagtacaaaaacacaaacgaaatgttcgccataaaagctctgaagaaaggcgatattgtcgcacgtgacgaggtcgactctcttatgtgcgaaaaacgaatcttcgagacagtgaactccgtgagacacccgtttttagtcaacttattcgcatgtttccagaccaaggagcacgtgtgcttcgttatggagtatgcagcgggaggggacttaatgatgcatatccatacggacgtgttttctgaaccccgcgcagttttttacgccgcttgcgtcgtcttgggcttgcagtaccttcacgagcataaaattgtgtaccgggatctaaaactggacaacctgcttctggataccgagggattcgtgaagattgctgacttcggactgtgcaaagaaggaatggggtacggtgataggaccagcacattctgtggcacgccagagttccttgcccctgaagtcttaaccgagacttcgtatactagagccgtggattggtggggattaggagtgctgatctatgagatgctggttggtgagtccccgtttcctggtgatgacgaagaggaagtgtttgatagcatcgtgaatgacgaggtgagatatcctaggttcttgagcaccgaggccatcagcatcatgcggcgactgctgcgccggaatcccgaacggcgtctgggagccagtgaaaaggacgctgaggacgtcaagaagcacccattcttcaggcttatcgattggagcgccttgatggataagaaggtaaaaccaccgttcatcccaacaatcagagggagagaggatgtttccaactttgacgatgaatttacttctgaagccccaatcttgacgcctcctagagagcctcgcatattaagtgaggaagaacaggaaatgtttcgggactttgattacatagcagattggtgctag

SEQ ID NO: 130547 - DNA, 336 bp, Artificial Sequence
  Description of Artificial Sequence: Synthetic coding sequence
atgcacatacacaccgatgtcttttcagagccccgggccgtgttttacgctgcttgtgtagtgctcgggctgcagtatctccacgaacacaaaatagtgtaccgcgatctgaagctggacaacctacttctggatacagagggtttcgtgaagattgctgatttcgggctctgtaaggaaggcatgggctatggagacaggacctccaccttctgcgggacaccagagtttctggcaccggaggtgctgacagagactagttacacccgtgccgtggattggtggggtctgggagtactgatatatgagatgcttgtaggagagaccagcgtgtag

SEQ ID NO: 130548 - DNA, 2670 bp, Artificial Sequence
  Description of Artificial Sequence: Synthetic coding sequence
atggaagagggtgcaccccgacagccaggcccctcccagtggccacccgaagatgagaaggaagtcatcagacgggctatacagaaggaactcaaaatcaaggagggcgttgaaaatctgcgtagggtggcaacagataggcgtcacttgggccacgtgcagcagctgctgagatccagtaataggaggctggagcaacttcatggagagttgagagaactgcacgcccggatactgctgccaggccccggtccaggcccagcagagcctgtggccagtggcccccgtccatgggctgaacaactgcgtgcccgccacctggaagcccttcgacggcagctgcatgtagaactgaaagtaaagcagggagccgagaacatgacacacacctgtgctagcggaacacctaaagaacggaagctcctcgctgccgcccagcagatgttgagggactctcagttaaaagtcgccttgttgcggatgaagatctcctccctcgaggcgagtggaagcccagagccagggcccgagctactggctgaggaactgcagcatcggctccacgttgaagctgccgtcgcagaaggtgctaagaacgtggtcaaattgctgtcttcgcggaggacacaggatcggaaagctctagcagaggcccaggcccagctgcaggaatcctctcaaaagctcgatctcttacgcctcgccctggaacagctgctcgagcaactgccaccagctcatcctctgagaagtcgcgtaacacgagagctccgggctgccgtgcccggctatccacagccttccgggactcctgtcaagcccacagctctgacgggcacgttacaggtcaggctcctgggctgcgaacaactgcttacagcagtgcccggtcgatcaccagccgcagcattggcctcctccccatccgagggctggctcaggactaaggcgaaacaccaaagaggccgaggcgagttggcttctgaagtgctggcagtgcttaaagttgacaacagggtcgtgggacaaaccggatggggccaggtggcagaacaaagttgggatcagactttcgtgattccattggaacgcgcaagagagctggagattggtgtgcactggcgggattggcgccagttatgtggcgtagccttcctgaggttggaggacttcctggataatgcctgccatcagctgtctcttagtctggtccctcaaggcctcttatttgcccaggtgacattctgcgaccccgtgatagaacggcgaccaaggttacagcgccaagaaagaatcttcagcaagagaagaggacaggattttctgagggcctcccaaatgaacttgggcatggcagcttggggtcgactggtgatgaatctgctgccaccctgctccagtccttccaccatttcccctcctaagggttgccccaggactccaaccaccttgagagaggcctccgaccctgccacaccaagtaacttcctgccaaagaagacaccactcggagaggagatgaccccgcctccgaaacccccaaggctttatttgccccaagagcccacctctgaggagacccctcgaaccaagaggccccacatggagcccaggacccggcgcggtccctccccacctgccagcccgactcgaaaacccccacggctacaagactttcgttgcctggccgtgctaggaagaggacattttggcaaagtacttctggtgcagttcaaaggcacagggaagtactacgccataaaagcactcaagaagcaagaggttctaagtcgcgacgaaattgagagtctttattgcgaaaagcgcatccttgaggcggttggttgcaccggccacccctttcttctgtccttgctggcatgctttcagaccagtagccatgcctgcttcgtgacagagttcgtacccggaggggacctgatgatgcagatacacgaggacgtgtttcctgagccacaggcccgtttctacgtagcctgcgtagtgctcggcctccagttcctgcatgaaaagaaaatcatatatagggatctgaaactcgataacctgcttcttgacgcgcagggcttccttaagatcgccgattttggattgtgtaaggaaggtatagggttcggggaccgaacatctacattctgtggaacacccgagtttctcgccccagaggttcttacgcaggaagcctacacacgggcagtcgactggtgggggcttggtgttctcctgtatgagatgctggtgggagagtgtccctttcctggcgacaccgaggaggaggtctttgattgcatcgttaatatggatgctccatatccgggatttctttccgttcaaggtctagaatttatacaaaagctgcttcagaagtgccctgagaagcggctcggggccggagaacaggatgccgaagagatcaaagttcaaccatttttcaggacgaccaattggcaggcgctgttagcaagaactatacaacctccattcgtcccaacattatgcggcccagctgacctcaggtactttgagggtgaattcacagggctcccaccagctctcacccccccggccccacattcattgctgactgccaggcagcaggctgccttcagggattttgatttcgtgtccgagcgcttcctagaaccttag

SEQ ID NO: 130549 - DNA, 1725 bp, Artificial Sequence
  Description of Artificial Sequence: Synthetic coding sequence
atgaggcggctctcctcctggagaaaaatggccacggctgaaaagcaaaagcacgacggaagagtaaagatcgggcattacattcttggggacactttgggagtaggaacattcggaaaggtgaaggtcgggaaacatgagctgaccggccataaggtcgccgttaaaatcttgaacagacagaagattcggagcctcgatgtggtgggcaaaatcaggcgcgaaatccagaacctcaaactgtttagacaccctcacatcatcaagctttatcaggttattagcacaccgtcggatatcttcatggtgatggagtatgtcagtggaggagaactgtttgattacatatgcaaaaatgggagaaagtcagatgttcccggggtggtcaagacaggatctactaaagagttggacgaaaaggaatctcgccggttgtttcaacagatactgtctggcgttgattattgccaccgccatatggtggtgcacagagacctgaaacccgagaacgttctactcgacgctcacatgaacgccaagattgcagacttcgggctttctaacatgatgtccgacggggagtttttgagaacgtcctgcggctccccgaattatgccgccccggaggttatcagcggcaggctgtacgcagggcccgaggtggatatctggtctagcggggtcatcttatatgctcttctctgcggcacactcccctttgatgatgaccatgtgccaactctgttcaagaaaatttgcgatggtattttctatacgccccaatacctaaacccctccgtgatttccctcctgaaacatatgttacaggttgaccctatgaagagagccacaatcaaagatatcagagagcatgaatggttcaagcaggacctgcctaagtacttgttcccggaagatcctagttactcttcaaccatgattgacgacgaagcccttaaggaggtgtgtgagaaattcgagtgctccgaggaagaagtactttcatgcctttacaataggaaccaccaggatcctctcgcagttgcatatcatttgatcattgacaaccggagaattatgaatgaggcgaaggacttttacctggcaacttctccccccgatagtttccttgatgaccatcatctgacccgaccgcacccagaacgggtgcctttcttggtggcagaaacacctcgggcacgccacacactggacgaactaaatcctcagaagtctaagcaccagggtgttaggaaagccaaatggcacttgggcattaggagtcaaagtaggccaaacgacattatggctgaggtctgccgcgctattaagcaactggactatgagtggaaggtcgtaaacccttactacttgcgggttcgcaggaagaaccctgtgacatcgacctatagtaaaatgtccttgcagctgtatcaagttgatagtaggacataccttttggactttcgctccatagatgatgaaatcacggaagcgaaatctgggactgcaactccccagcgatctggctctgtgtctaattataggtcttgccagcgctcagatagtgacgctgaggcacaagggaagagcagcgaggtttctctcacatcttctgtcacatcactcgattcctcgccagtggatttaaccccaagaccaggatcccacaccatcgaatttttcgagatgtgcgctaacttgatcaaaattctggcccagtag

SEQ ID NO: 130550 - DNA, 1680 bp, Artificial Sequence
  Description of Artificial Sequence: Synthetic coding sequence
atgcggagactctccagctggcggaaaatggctactgccgagaagcagaagcacgatggtcgggtgaagattgggcattatatattgggcgatacactcggagtgggcacctttggcaaagtaaaggttggcaaacatgagctcaccggccataaggttgccgtgaaaattcttaatagacaaaagatcaggtccctggatgtcgtcggaaagattcgcagagagatccaaaatcttaagctgttcaggcaccctcatattattaaactttaccaagtcatctctactccttccgatatttttatggtgatggaatacgtgtctgggggggaattgtttgattatatctgtaagaatggaagactagacgaaaaggagagtcgcagactgtttcaacaaatcctttccggagtggactattgccaccgtcacatggtggtacatagagatctgaagccagaaaacgttctattagacgcacacatgaatgccaagatcgcagactttgggctgagtaatatgatgtcagacggcgaattcttacgcacatcctgcgggtcacctaactacgccgcaccagaggtgatctctgggcggctgtatgcgggccccgaggtcgatatctggagcagtggcgtgatcctctatgccctgctgtgcggaacacttccgttcgacgacgaccatgttcctactctgtttaagaagatatgtgatgggatcttctatacgccccagtaccttaatccctctgtgatctcactcttgaaacacatgctacaagttgaccctatgaaacgggccacaattaaggacattagagaacacgaatggttcaagcaggatctgcccaagtatttgttccctgaagaccccagctattcttccactatgatcgacgacgaagctctgaaagaagtgtgcgagaagttcgagtgctctgaggaagaagttctctcttgtctctacaacagaaaccaccaggaccctcttgccgtggcgtaccacttgatcattgataataggcgaattatgaacgaggcaaaggacttttacttagccactagcccccctgatagtttcctggacgatcaccacctgacacgacctcatcctgagagggtgccattccttgtggctgaaacacctagggcacggcatactttggatgaattgaaccctcaaaagagcaagcaccagggagtgcgaaaagccaagtggcatcttggcatccgttctcagagcagaccgaacgacataatggccgaagtgtgtcgcgccataaagcagttggactacgagtggaaggtggtgaatccctattaccttagggtccggaggaaaaaccccgtaacgtcgacttactctaaaatgtccttgcagttgtaccaggtagactccagaacgtatctgctggacttccgatcaatcgacgacgagataacagaggcgaagtcagggacagctaccccccagcggtctggaagcgtgtcgaactatcggtcttgccagaggtctgacagcgatgcagaagcccagggaaagtcgagtgaggtgtcattgacatcctctgtcacttctctagatagtagccccgttgacctcacgccaaggcctggtagccatacaatcgagttttttgagatgtgcgccaatctgattaagatactagcccaatag

SEQ ID NO: 130551 - DNA, 1659 bp, Artificial Sequence
  Description of Artificial Sequence: Synthetic coding sequence
atggccgaaaaacagaagcacgatggaagagtgaaaatcgggcactacgtactcggggatacacttggcgtggggacgttcggtaaggtgaagatcggcgagcaccagctgacaggccacaaagtcgctgtgaaaatcctgaaccggcaaaagatccgaagccttgacgtggtgggaaagatcaagcgcgagattcaaaatctaaagcttttccgccaccctcacatcatcaagctgtatcaggtgatttcaacgcccaccgacttctttatggtcatggaatacgtgtcgggtggagaactctttgactatatatgcaagcatggcagggtcgaagagatggaggcgagacggctgttccaacagatcctcagtgccgtggactactgccatagacacatggtagtgcatcgcgacctgaagcccgagaatgtgctgctagacgcgcacatgaatgcaaagattgctgacttcggcctgagcaacatgatgtctgacggcgagttcctacgaacctcctgcggttcaccaaactacgccgcaccagaggtgattagtgggcgactttatgctgggccggaagtcgacatttggagctgcggagtaatcctgtacgcccttctatgcgggactctcccctttgatgatgagcacgtgcctacactgttcaagaaaatccggggcggagtattttacataccggagtacctgaaccgtagcgtggcgactctcctaatgcacatgcttcaggtggatcccctcaaacgcgcaacgattaaagatattagagaacatgaatggtttaaacaagatctacctagctacctgtttccagaggatccctcatatgacgccaacgtaattgatgacgaggccgtgaaggaggtttgtgagaagttcgagtgcacagagtccgaggtgatgaattcactgtactcaggcgacccacaagaccagttagccgtggcctatcatctgataattgataaccgtcggatcatgaaccaggcaagtgaattttatctcgcgtcatcgccacccagtggtagctttatggatgatagtgccatgcacatcccaccaggtctgaagcctcatccggagagaatgccgcctctaatcgcagactcacctaaagcacggtgtcctctcgatgctctgaacacgaccaaacccaaatctttggctgttaagaaggccaagtggcacctgggcatcaggtcccagtctaagccctacgacatcatggctgaagtgtatagggccatgaaacagctggattttgaatggaaggtggtgaatgcatatcacctgagggtaagaagaaagaacccggtcaccggaaattacgttaagatgagcctgcaactgtatctcgtggacaacagatcttatctcctggacttcaaatcgattgatgatgaagttgtggaacagaggtcaggctcaagcactccgcagagaagctgctctgctgcagggctccatcgaccccggagtagcttcgattccaccacagccgagagccattcccttagcggcagtctgacggggagtctcactggatccaccctgtcctctgtgagcccacggctaggtagccataccatggacttctttgaaatgtgcgcctccctcatcacaacgctcgcccggtag

SEQ ID NO: 130552 - DNA, 744 bp, Artificial Sequence
  Description of Artificial Sequence: Synthetic coding sequence
atgttgactattacggactttattaacatcctccacaggtactacaagtctgccctggtccagatttacgagttggaagaacacaagatcgaaacctggagggaagtgtatctgcaggatagcttcaagccgctcgtgtgtatctccccgaatgcctcgctgtttgatgcagtgagctctctgattaggaacaaaattcacaggctccctgtgatcgatcccgagtccgggaatacgttgtacatcttgactcataagaggatcctgaagtttcttaaactctttatcacagaatttcccaaacctgagttcatgagtaagtctctagaagaattacagatcggaacttatgccaacatcgctatggtgagaacaacgactcccgtctatgtggccctaggcatatttgtccagcaccgagtgagcgcgctgccagttgttgatgaaaaaggacgggttgtcgacatttattcgaagttcgatgtgataaacctggccgctgaaaagacgtataataatctcgacgtgtccgtcaccaaggcattgcagcatagatcccactactttgagggggtgttgaagtgctaccttcacgagacgttggaaactatcataaatcggttggtggaagctgaggtgcaccgactggttgttgtggacgaaaacgatgttgtgaaaggcatagttagcctatcagatattctgcaggccctggtgctaactggtggcgaaaagaaaccttag

SEQ ID NO: 130553 - DNA, 996 bp, Artificial Sequence
  Description of Artificial Sequence: Synthetic coding sequence
atggagacagttattagtagcgactcatctcctgccgtagaaaacgagcacccccaagagacccctgagagtaataatagcgtgtacacgtcatttatgaaatcacatagatgctatgacctgatccccactagttccaagctcgtagtcttcgatacttccttgcaggtgaaaaaggcgttcttcgcacttgttactaacggtgtgcgggccgctcctctatgggactccaagaaacagtcgtttgtcgggatgctgaccattacagatttcataaatatattacacagatattataagagcgcactggtgcaaatctatgaactggaagagcataagatagagacttggcgagaagtgtacttgcaggatagctttaaaccactcgtgtgcatctctcccaacgcctcactgttcgacgctgtctctagcctaatcaggaataagatccatagactgcccgtcattgacccggagtcgggaaatacgctctacatccttacacacaagagaatcttgaaatttctcaagttgttcatcaccgagttccctaaacccgagttcatgtctaaaagccttgaggaactccaaatcggcacgtacgcaaatattgccatggtgagaacaaccacacccgtttacgtggccctcggaatcttcgtgcaacacagggtaagcgccctccctgtggtggatgagaagggcagagtggtggacatttactccaaattcgatgtgattaacctggctgccgagaagacctataataatctagacgtaagcgtgacgaaggccctccagcatcggagccattatttcgaaggggtactcaagtgttacctacacgaaacgctagaaactattattaatagattagtcgaggcggaggtgcaccgactggtggtcgttgatgagaacgacgtggtgaaagggatagtctctctgtcggatattctgcaggctttagtgctgaccgggggagaaaagaaaccatag

SEQ ID NO: 130554 - DNA, 1710 bp, Artificial Sequence
  Description of Artificial Sequence: Synthetic coding sequence
atgggctccgctgtgatggataccaaaaaaaaaaaggatgtgtcttcccccggcggatcaggaggcaaaaaaaacgcatcccaaaagcggagaagtctacgggttcatattccggatctgtcttctttcgccatgcccttgctggacggagacctggaaggcagcgggaaacacagctctaggaaggtcgattctccatttggccccggctccccaagtaagggcttttttagtaggggcccacagccacggcccagttctcccatgagtgcaccggtacgtccaaagacaagcccagggagccccaaaactgttttcccatttagttatcaggagagcccgcctagatccccacggaggatgtcctttagtggaatcttccgcagtagtagtaaggaaagtagcccaaactctaatccagcaacttcgccaggcggaatacgattcttcagccgctcccgaaagacgtctggcttatcatcatctccctcaactcctacccaagtgaccaaacaacacaccttcccattggaatcttacaaacatgaaccagagcgcctggaaaatcgcatatacgcaagctcctctccccccgataccgggcaaaggttttgcccatccagtttccagagccccactcggccaccgctggcatctcctacacattacgcccccagcaaggctgctgcccttgcagcagcccttggcccggctgaagccgggatgttggagaagcttgagttcgaagacgaggcagtcgaagacagtgaatccggtgtctacatgaggttcatgaggtcccataagtgctatgacatcgtaccaacttccagcaagctcgtggtgtttgacactacgctccaggtcaagaaggccttctttgcactggtggccaacggggtgcgagccgcccccctttgggaatcaaagaaacaatctttcgtgggtatgttgaccatcacagactttatcaacatcctgcaccgctactataagtccccaatggtgcagatctacgagttggaggagcataagattgagacttggcgtgagctctacctacaggagacctttaagccgctggttaacatctccccagacgcctctctgtttgacgcagtgtactcgctgattaagaataagatccataggttaccggtgattgatcccattagcggcaatgcactgtacatactcacgcacaaaagaatactgaagttcctgcagctgttcatgtccgatatgccaaaacccgcatttatgaaacagaatctggatgaactcggaattggaacctaccataacatcgccttcatccatcctgatacgccgatcatcaaagcactgaatattttcgttgagcgtcggatcagtgctctgcctgttgttgacgaaagtggcaaggtcgtagatatttattcgaagttcgatgtgattaaccttgccgcagaaaagacttacaataacttagatataacagtgacacaagcgctccagcatcgctctcagtactttgagggcgtggttaagtgcaacaaattggagatcctcgagaccatcgtggatagaatcgtgagagcagaagttcatcgattagtggtggtgaatgaggccgactctatcgtcggtattatatccttgagcgacatccttcaagccctaatcctcacccctgccggagctaagcaaaaagagactgaaacagagtag

SEQ ID NO: 130555 - DNA, 1335 bp, Artificial Sequence
  Description of Artificial Sequence: Synthetic coding sequence
atgaaacgtttcggctccttgagaagtaacaagaagcataaagaccagaaccggtcaacagagcgaagacagtccgagccccatgggcttttcgcctctgggttgtctagcagtccttctacacctacccaagttactaagcagcacacatttccgctggagtcctacaaacacgagccagaaaggctggagaacaggatttacgcatctagcagcccacccgatactgggcagcgattttgtccctcctcctttcagagccctacacgaccccccctggccagtccaacccattatgccccgtccaaagctgccgccctcgcagccgccctgggcccggcggaagcaggcatgctcgagaaactcgagttcgaggacgaggtggaggactccgaatccggtgtatacatgcgcttcatgcggtcccataaatgttatgatattgtaccaacgtcgtcaaagctggtcgtcttcgacacaacgttacaagtgaagaaggcctttttcgccttagtggccaatggagtcagagctgctccactttgggaatccaaaaagcagtccttcgtgggtatgttgacgatcacagattttatcaacattctccacaggtattataaatcacccatggtccaaatttatgagctcgaagagcacaaaatagaaacctggagagagctgtatctgcaggagacctttaagccactggttaatatcagccctgacgccagtctctttgacgctgtatactcattaatcaaaaacaagatccaccggttgcctgtgatagaccccatatcaggaaatgcactctatatccttacccacaaaagaatcctgaagtttctgcagctgtttatgtcagacatgccaaagcctgcattcatgaagcagaacctggacgaattgggaattggtacatatcacaatatcgctttcattcatccagatacccccattattaaggcactgaacatattcgttgagaggcgtataagtgcactgcctgtagtcgacgagagtgggaaagttgtcgacatatatagcaaattcgatgtgattaatttggccgctgagaagacctacaacaatctcgatatcaccgtaacccaggctctgcagcataggtcccagtattttgaaggtgtggttaagtgcaacaagctggaaatcctagagaccattgttgatagaatcgtgcgagctgaagtgcatcgtttagtggttgtgaatgaggctgacagcattgtgggaatcatctctcttagcgacatactccaggcattaattctgacaccggcaggggctaagcagaaagaaacagagacggagtag

SEQ ID NO: 130556 - DNA, 309 bp, Artificial Sequence
  Description of Artificial Sequence: Synthetic coding sequence
atggcaggtcaggcctttcgcaagttcttgcccctcttcgatcgggttctggttgaaaggagtgctgcagaaacagttaccaagggcggtattatgctgcccgagaaatctcagggaaaggtactgcaggccacagtcgtcgccgtgggatcggggtccaaaggaaaaggcggagaaatccagccggtgtccgtcaaggtgggggacaaagtcttacttcctgagtacggcggaaccaaggttgttctggacgacaaggactattttctcttccgggatggcgatatactgggtaaatatgtggactag

SEQ ID NO: 130557 - DNA, 1062 bp, Artificial Sequence
  Description of Artificial Sequence: Synthetic coding sequence
atggagcctggactcgaacatgccctgagacgtacaccaagctggagcagtcttggtggctctgagcatcaagaaatgtccttccttgagcaggagaactcttcgagttggccttcacccgctgtaacgtcaagctcagaacggatccgaggcaagagacgtgcgaaagccctgagatggactcggcaaaaatcagtggaagagggcgaacctcctgggcagggggaggggccacggtcccgccctgcggctgagtcaaccggcctcgaagcaacttttcctaaaacgacccccctagcccaagccgatccagcgggcgtgggtaccccaccgacaggctgggactgcctgcctagcgattgtacagcctccgccgctggttcatccacggacgatgtggagctcgccactgagttccctgccactgaggcatgggaatgcgagttggagggcctccttgaggaaaggcccgcactttgcctgtcaccccaagcaccctttcccaagctagggtgggacgatgagctgcggaagccaggcgcgcagatttacatgcgatttatgcaggaacatacatgttacgacgctatggcaacctcttcaaaactggtgatttttgacaccatgctggaaatcaagaaggccttcttcgccctggttgcaaacggcgttagggctgcaccactgtgggacagtaagaagcagtcattcgtgggcatgttgacaatcactgatttcattctcgtgctgcaccggtactatcggtcccctcttagatcaacatgcaaggctgcgagctctttatggtcacccagcttactgatgatagcgtgcctcaagttatccacaccaagctcccggacgggctcaatagcatgcttattcctgacacggtgtcaggccacatatagcacgtcttcccataccaatgcatgttcctcctcgtgcacttctctcgtaccatgctgcccaggtcccccatcttcaaccgcgctgagcaagatatgggcttcagcacattctgaaacatggctgtggtgttggcggcaacacccgagttag

SEQ ID NO: 130558 - DNA, 1395 bp, Artificial Sequence
  Description of Artificial Sequence: Synthetic coding sequence
atgtcttttttagagcaagagaattcatccagctggccttcacctgcagtaacttcttcaagcgagagaatacgaggtaagaggagagctaaagctctcagatggactcgccagaaatcagtggaggaaggcgaacctccagggcagggagaaggaccccgcagccggcccgccgcagagtccactggcctggaggccacctttcctaaaacaacacccttagctcaggctgatccagctggagttggaacaccacccacagggtgggactgcctgccaagcgactgcacggcttctgctgcaggtagcagcaccgatgatgtggaactggccacagaattccctgccacagaggcttgggagtgcgaactggaggggctgctggaagaaagaccagccctttgcctgagtcctcaggcgccctttcccaagctgggctgggacgatgaactgaggaagccaggggcccagatctatatgaggtttatgcaggaacatacatgctacgacgcaatggccacatcttccaaactcgtcatttttgacactatgctggagataaaaaaggcgtttttcgccctcgtcgcgaatggagtccgggcagcgccgctgtgggattcaaagaagcagagcttcgtgggcatgctgactattaccgactttatcctggtgctccataggtactatcggagtccattagtgcagatatatgagatcgagcagcataagatcgaaacctggagggaaatttacctacagggatgctttaagcccctggtgtccatatcccccaacgatagtctcttcgaggctgtgtacaccctcattaagaacaggattcatagattgcccgtgctggaccctgtatccgggaacgtactgcacatccttacccataagcggctgctaaaattccttcacatattcggcagtctactgccgcgacctagttttctgtatcggacaatccaggatcttggcatcggtacctttcgggacctcgccgtcgtgctggagaccgcgccgatcctgactgccctggacatattcgtggatcggagggtcagcgccctccctgtcgtaaatgaatgtggacaggtagttggcctgtactccagattcgatgtcattcatttagcagcacagcagacttataatcacctggacatgtccgttggcgaggccctcagacagcgtacactatgcctggagggtgtgctttcttgccaacctcatgagtccctcggggaagtaattgacagaatcgcaagagaacaggttcatcgcttggtactggtcgacgagacacagcacctgctgggagtagtctccctgagcgacatcctgcaggctctggttctctcccctgctggaatcgacgcactcggagcgtag

SEQ ID NO: 130559 - DNA, 1470 bp, Artificial Sequence
  Description of Artificial Sequence: Synthetic coding sequence
atggagccaggccttgagcacgcactgagaagaaccccttcttggagctctcttgggggatctgaacaccaagaaatgagtttcctggagcaagagaattcaagctcgtggccttctcccgctgtaacatcgagctctgaacggattcgtgggaagcgacgggcgaaggccctaaggtggactaggcagaagtccgtcgaagagggggagccacccggacagggcgaggggccacgcagccgccctgctgcagaaagtaccggactcgaggccacctttcccaagactacgcccctggcacaggccgatcccgccggggtgggcacacctcctacgggctgggattgtctccctagcgactgtaccgctagcgccgcgggcagcagtacggacgatgtcgagttggccacagaattccctgccaccgaggcctgggaatgcgagctggaaggcttgcttgaggaacgccccgcactctgcctatccccgcaggcacctttccctaagctgggatgggacgacgaacttcgtaagccgggggcgcagatctacatgcgttttatgcaagagcacacttgttatgacgctatggccacatcgtccaagctcgttatcttcgacacaatgttggaaatcaaaaaggcctttttcgcgctggtggccaacggcgtacgcgcggcgccactctgggattctaaaaagcagagtttcgtgggtatgctcacaattacggatttcatcctggtattacataggtattaccgcagtcccctagtgcaaatctacgaaatcgagcagcacaaaattgaaacctggagggaaatctatttacagggttgtttcaagcctctcgtgtcaatctctcccaacgactcattgttcgaggcggtgtacacattgatcaagaacagaatccaccggctgcccgtgctcgaccctgttagcggaaatgtgctgcacatcctcacacacaaacggctcttaaagttcctacatatattcggctccctcttgccgagaccatcctttctataccgtaccatccaggatcttggtattgggacctttcgggatttggcagtggtgcttgaaacagcgccaattttgactgccctggacatcttcgtggacaggagagtttcggctttaccagtggtaaacgaatgcggacaggtggtcgggttgtacagtcgctttgacgtgattcaccttgctgcccaacagacttataatcacctggatatgtctgtgggtgaggccctgcgacagaggacactgtgcctggagggcgtgctctcttgtcaaccacatgagtcactcggcgaagtgatcgatcgtatcgcacgcgagcaggtgcatcgattagtgctcgtggatgagacccagcaccttctgggagtcgtgtccctgtctgatatcctgcaagcactcgtcctctcacctgcaggaatcgatgcactgggcgcgtag

SEQ ID NO: 130560 - DNA, 918 bp, Artificial Sequence
  Description of Artificial Sequence: Synthetic coding sequence
atgcggttcatgcaggagcatacatgctatgatgccatggccacctcctctaagttggtgatattcgacaccatgctggagattaagaaagctttttttgccctggtggctaatggcgtgagagcagcccctttatgggactctaaaaagcagtcattcgtgggtatgctcactatcaccgacttcatcttggtgctgcaccggtactaccgcagcccgctcgtccagatatatgaaatcgagcagcataagatcgagacttggcgggagatctacctccagggttgctttaagcctcttgtcagcatttccccaaacgacagcctgttcgaagcggtatacactcttatcaaaaatagaattcataggttgccagtgcttgatcccgtatcaggcaacgtgctacatattctgacgcacaagaggcttctgaagttcttgcacatcttcggaagtctgcttccaagaccctccttcctgtacagaacgatacaggacctgggaatcggaacatttagagatctggcagttgtgctggagaccgcgccgattctgacggccctggacatcttcgttgatcgtcgcgtgtccgcgcttcctgttgttaacgaatgcggccaggtggtgggcctctattcaagatttgatgtaattcaccttgccgcccagcagacctacaatcaccttgacatgagcgtgggggaagctctgcggcagaggaccctctgcctggagggcgtattgtcgtgccaacctcacgagagtttgggagaggttattgaccgtatcgcaagagagcaagtccatcgcctcgtgcttgtggacgagactcagcacctgctgggcgtcgtcagcctgagcgacatactgcaagcccttgtgttaagcccggccggcatcgacgctcttggggcatag

SEQ ID NO: 130561 - DNA, 1056 bp, Artificial Sequence
  Description of Artificial Sequence: Synthetic coding sequence
atgggaaatgcagccgcggccaagaagggcagtgagcaggaaagtgtgaaggagtttcttgctaaagccaaggaagactttttgaagaagtgggagagccccgctcaaaatactgcccatcttgaccagtttgagcgcatcaagacattaggcacgggatcttttggccgtgtaatgctggtcaagcacaaggaaaccgggaaccattacgcaatgaagattctagacaaacagaaagtggtgaagctgaagcagatcgagcacacactgaacgaaaaaaggattctgcaggccgtgaattttccattcctggtgaaattagagttctcttttaaggataatagtaacctgtacatggtgatggaatacgtgcctggtggagaaatgtttagccatctgaggaggatcggacgcttttccgagccccatgctcgattttacgctgcacaaattgtgttgaccttcgagtatttacactcccttgacctgatctaccgggatctgaaacctgaaaacctcctgattgaccagcagggctatattcaagttacagacttcgggtttgcaaaaagggtgaaaggcaggacatggaccctctgcggaactccagagtatctagctccggagataattctgtcaaagggatacaacaaagcagtggactggtgggccctcggcgtgctcatttatgagatggcagctggatacccgccatttttcgccgatcagcctattcagatctatgaaaagatcgtgtcaggaaaggtgagattcccttcccatttttcaagcgacttaaaggatcttctgcgcaatctgctgcaggtcgatctgaccaaacggtttgggaacttaaaaaatggggtcaatgacattaagaaccacaagtggttcgctaccaccgattggatcgctatctaccagcgaaaggtggaagctcctttcattcctaagttcaaaggccccggtgacacttcaaatttcgacgactatgaagaggaggaaattcgagtgtccattaacgagaaatgcggaaaggaattttccgaattctag

SEQ ID NO: 130562 - DNA, 1032 bp, Artificial Sequence
  Description of Artificial Sequence: Synthetic coding sequence
atggcctctaactcgagtgacgttaaagagtttttggcgaaggcgaaagaggatttcctgaaaaagtgggagtcgcccgctcaaaacacagctcatcttgatcagttcgaaaggattaaaacactggggactggctcttttgggcgcgtgatgctcgtgaaacacaaagagacagggaaccattatgctatgaaaattctggacaaacagaaggttgtgaaattaaagcagattgagcacaccctgaacgaaaagcggatcctgcaggccgtgaatttcccttttttagtcaagttagagttctcatttaaagacaatagtaacttatatatggtaatggagtacgtgcccggaggggagatgttcagccacctgaggcggatcggtaggttctcagagccccacgcccgattctatgctgctcagatcgttctgacgtttgagtatctgcacagcctggatctgatctaccgtgatctaaaaccagagaaccttctgatagaccaacagggttatattcaggtgaccgattttggattcgctaagcgggtcaaaggtcggacgtggactctctgcggcacccccgagtatcttgctcccgagattatattaagcaaggggtacaataaagctgtggactggtgggctctaggagtgctcatttacgagatggccgccggatatccgcctttttttgccgaccagcctatccaaatatatgaaaagatagtgagcggtaaagttcggtttcctagccacttcagttccgacctaaaggatctcctgcgcaatcttctacaggtggatctgacaaaacgcttcggtaacctgaaaaatggcgtcaatgatattaaaaatcataaatggtttgccacaacagattggatcgccatttaccaacggaaggtggaagcaccctttattccaaaatttaaaggacccggagatacctccaatttcgacgattacgaggaagaagaaatcagagttagcattaatgagaaatgtggcaaagaatttagcgaattttag

SEQ ID NO: 130563 - DNA, 1056 bp, Artificial Sequence
  Description of Artificial Sequence: Synthetic coding sequence
atgggcaacgccgccgccgctaagaagggtagtgagcaggaatcagtgaaggagttcctcgccaaggccaaagaggactttctgaagaagtgggagagcccagcccagaataccgcacacctcgaccagttcgagagaataaaaacactcggtacagggtcctttggaagggtgatgctggttaagcataaggagactggcaatcactatgccatgaagattttggataagcaaaaggtggtcaaattgaagcagatcgagcacacgctcaatgagaagcgtatcctccaggccgtgaatttcccgttcctcgtgaaactggaattttctttcaaagacaattccaacctgtatatggtgatggagtacgtccctggaggcgagatgttctcccacctccggagaattggtaggttttctgagccccatgcaaggttttacgcggcccagattgtgttaacattcgagtacctacattcccttgacctgatttatcgggacttaaagccagagaacctgctcattgaccagcaaggttatatacaggtgacggatttcggctttgctaaacgcgtgaaggggagaacgtggacactctgcggaaccccggaatacctggctcccgagataatcctgtccaagggctataataaggctgtggattggtgggcgttaggcgtactgatctacgagatggctgccggttatcccccatttttcgcggaccaacctatccaaatctacgagaaaattgtgtcgggcaaagtgcggttccccagtcatttctcttccgatctcaaagatctcttgcgcaatcttctccaggttgatctcaccaaaagatttggaaatttgaagaatggcgttaatgatatcaagaatcacaagtggtttgctacaaccgactggattgccatttatcagagaaaggtggaagcccccttcattccaaaatttaaaggccctggggatactagtaacttcgacgactatgaagaggaggagattagagtctcaattaacgagaagtgcgggaaagagtttagcgaattctag

SEQ ID NO: 130564 - DNA, 693 bp, Artificial Sequence
  Description of Artificial Sequence: Synthetic coding sequence
atgctggtgaaacataaggaaaccggcaaccactacgcaatgaaaatattggataaacagaaagtggtgaagctgaagcagatcgagcatacattgaacgagaaacggatactgcaggcagtgaatttcccattcctggtaaaactggagttctcctttaaagacaattccaacctgtatatggtgatggaatacgtacctggcggtgagatgttcagtcatctcagacggatcggccgattcagcgaaccacatgcccgtttctatgctgcgcagattgtactgacatttgaatacctgcacagcttagacctgatttacagggacctaaaaccagagaatctcctcatcgaccagcaggggtatatacaagtaaccgactttggcttcgcaaagagggtgaaggggaggacatggactttatgcggaacccctgagtacctggctcctgagattattctttctaaggggtataacaaggcagttgattggtgggctctgggagtgcttatatacgagatggccgccgggtacccccccttttttgctgaccagccgatccagatctatgagaaaattgtgtctggcaaagttcggagcggctgcggtgataccgcccttgaagagactgataggtctctgctgacacatcccatcccttggggcgcactcttagtggtaaggattatttag

SEQ ID NO: 130565 - DNA, 1074 bp, Artificial Sequence
  Description of Artificial Sequence: Synthetic coding sequence
atgggtctgagccgaaagtcctcagacgcaagcgcgtgttccagctccgagatctcagattttgttaaagagtttcttgccaaggctaaggaggactttctcaaaaagtgggagaatccaactcaaaacaacgccgggctggaagacttcgaaagaaaaaaaacactagggacaggttctttcggccgagttatgctggtcaaacacaaggccactgaacagtactatgcaatgaagatcctggataagcagaaggtggtgaagctgaaacaaatcgagcataccttgaacgagaagaggatcctgcaagccgtaaacttcccattcctggtacgactggaatatgctttcaaggataactctaacctttatatggtcatggagtatgtccctggcggagagatgttctctcacctgaggaggattgggcgattcagcgagccacatgctcgcttctatgctgcgcagatcgtcctgacatttgaatatcttcattctctggatctaatttaccgcgatcttaagcctgaaaacctgttgattgatcaccagggctatatacaggttacggacttcggttttgcgaaacgagtgaaaggccgcacctggaccttatgcggaacacccgagtatctcgctccggagataattttaagcaaggggtacaacaaggctgtggattggtgggctctgggggtgctgatttacgagatggcagccgggtaccctcctttctttgccgaccagcctattcaaatctacgagaaaatcgtaagcggcaaggtcagatttccgtcacatttctcctccgatctgaaggatctgctgaggaaccttttgcaggtagacctgaccaagcgatttggcaacctcaaaaacggtgtaagcgacatcaagacgcataaatggtttgcgactacagactggattgccatttatcagaggaaagtggaggcaccatttataccaaagttcaggggcagtggagatacaagtaattttgacgattacgaggaagaagacatacgtgtgtctattaccgagaaatgtgctaaggaatttggcgaattctag

SEQ ID NO: 130566 - DNA, 795 bp, Artificial Sequence
  Description of Artificial Sequence: Synthetic coding sequence
atgagtgccaggaagagcagcgacgctagcgcttgcagctcctctgagattagtgatagcttcgttaaggagtttctcgccaaggccaaagaggacttcctcaagaagtgggagaatcctacacagaataacgctggactcgaagatttcgagagaaagaaaaccctcgggaccggctcttttgggcgagtgatgctggtgaaacataaagccaccgagcagtactacgccatgaagattctggacaagcagaaagtggtgaaactaaagcagatagagcacacactgaacgaaaagcgtattctgcaggccgtcaattttcctttcttggtgcggctagagtatgcgttcaaagacaattcaaacctgtacatggtgatggaatacgttcctggaggtgagatgttttcccacctgcgcagaatcgggcgcttttcagagccccacgcgcggttctacgcagcccagatcgttctgaccttcgagtacctccattccctggacttaatttacagagaccttaaacctgaaaatctgctgattgaccaccagggatatatccaagtaaccgacttcggcttcgcaaagcgtgtcaaaggacgcacatggaccctttgcggtacccccgagtacctggcacctgagatcattttgagcaagggctacaacaaagcagtggattggtgggcgctcggagtgctcatatacgaaatggcggctggctacccgccattttttgccgatcaacctattcagatttatgaaaaaatcgtatctggcaagcagaatttctag

SEQ ID NO: 130567 - DNA, 942 bp, Artificial Sequence
  Description of Artificial Sequence: Synthetic coding sequence
atgcccgatctgaagatcctgaaagggaagacactggggaccggcagcttcggtagagtaatgctggtcaaacataaggccacggaacagtactacgcaatgaagatcctggataagcagaaagtggtgaagctgaaacagattgagcatactctcaacgagaagaggattttgcaggctgttaatttccctttccttgtaaggctcgagtatgcctttaaggataactccaatctatatatggtaatggaatatgtaccaggcggtgagatgttctctcatctgcgtagaattggccgcttttcagaaccgcatgctcgcttttatgctgcacagatcgtgctcactttcgaatacctccattcattggatttaatctacagagatttaaaacctgaaaacctgctgatcgaccatcaaggatacattcaggtcactgattttggattcgccaaaagagtcaaaggccggacatggaccctctgtggaacgccggaatatctggccccggaaatcattttatccaaagggtataacaaggctgtggattggtgggctttaggagttctaatctacgagatggctgccggatacccgccgttcttcgctgatcagcccatccagatctatgaaaagattgtgagcggtaaggtgaggtttccatcacacttctctagtgatctgaaggacttgttgcggaacctgctgcaggtggatctaacaaaacggttcggaaatctgaagaatggggtgtcggacatcaagacacacaagtggtttgccacgactgactggatagccatttaccaaagaaaggtggaggcccctttcattccaaaattccgcgggtcaggggacaccagtaacttcgatgactatgaagaagaggacatacgggttagcatcacagaaaagtgcgctaaagagttcggagaattctag

SEQ ID NO: 130568 - DNA, 1068 bp, Artificial Sequence
  Description of Artificial Sequence: Synthetic coding sequence
atggggctgtctaggaagagcagcgacgcgagcgcctgcagttcctcagagatctccgttaaggagtttttggcaaaagccaaggaggactttttgaaaaaatgggagaatccaacccagaataacgccggtctcgaggattttgagagaaaaaaaaccttgggaaccggatcgttcggcagggtgatgctggtgaagcataaggctacagagcagtactacgccatgaagatccttgacaaacagaaggttgtgaagctgaaacagatagaacataccttaaacgaaaagcggattctgcaggccgtaaacttccctttcctggtgcggctagagtatgccttcaaggacaattccaatctctatatggtaatggaatacgttcctgggggtgagatgttctcccacctgcgccgcatcggtcgatttagtgagcctcatgcaagattttatgccgcccaaattgtgttaacattcgagtatctccattcgctggatctcatctaccgagatctgaaacccgagaacttgctgatcgaccatcaggggtacattcaggtaaccgacttcggtttcgccaagcgggtgaagggaaggacatggacactctgtggtacacccgaatacttggctcctgagataatcttatcaaaaggatataataaggctgtcgattggtgggctctaggggtgcttatctacgagatggccgcaggctaccctccgtttttcgctgatcagcccatccaaatttacgaaaagatagtgagtggcaaggtgcgcttcccgagccatttctcctcagacctcaaagacctgctgagaaatctgctgcaggtcgacctgactaaacggtttggtaatctgaagaatggtgtgagcgacatcaagactcataagtggttcgctacaactgactggatcgccatataccaacgcaaggtcgaggctccatttatcccaaaattccgggggagcggagataccagcaactttgacgattatgaagaagaggatattcgcgtgtccattactgaaaaatgtgctaaagaatttggggagttttag

SEQ ID NO: 130569 - DNA, 738 bp, Artificial Sequence
  Description of Artificial Sequence: Synthetic coding sequence
atggggctcctgaaggagttcctggccaaagcgaaagaagactttctaaagaaatgggaaaaccctacacagaataacgccggtctggaagatttcgagcgcaagaagacccttggaaccggaagctttggtagggtcatgttggtcaaacacaaagcaaccgagcaatattacgccatgaagatcctggataaacagaaagtggtcaagctcaaacagattgagcacaccctcaatgagaaaaggatcctacaggcagtcaacttccctttcctagtgaggctcgagtacgcgtttaaagacaatagcaatttgtacatggtcatggagtatgtacctggcggcgaaatgttttcccatctgaggcgcatcgggcggttctcggagccccacgccagattctatgctgcgcaaatagttctaaccttcgagtacctacattccctggatctcatatatcgcgacctgaaaccagagaacctgctaatcgatcaccagggttatattcaggtgactgacttcggcttcgctaaacgggtcaaaggccgaacttggactctgtgtgggactcccgaatacctggcaccagaaattattctctcaaaagggtacaacaaggcagtagattggtgggcactgggagtgctgatttatgagatggctgccggataccctccctttttcgcggaccagccaatacagatttatgaaaaaattgtgagtggcaagaatttctag

SEQ ID NO: 130570 - DNA, 1197 bp, Artificial Sequence
  Description of Artificial Sequence: Synthetic coding sequence
atggctgcctatcgcgagcccccttgcaatcaatacactggcacaacgaccgctctgcaaaagctcgaaggcttcgcttccaggcttttccaccgtcattccaaaggaacagcccatgatcagaagactgcgcttgaaaatgacagtctccacttttcggaacatactgccctctgggatcgaagtatgaaagagtttctggccaaggccaaggaagattttttaaagaaatgggagaacccaacccaaaataacgcggggcttgaggattttgaaaggaaaaaaaccctggggaccggtagctttggccgcgtgatgctggtgaaacacaaagctacagaacagtactacgctatgaagattcttgacaagcagaaggtggttaagctgaagcagattgagcatactctgaacgaaaaacgcatcctccaggccgtgaactttccattcctcgtcaggttggagtacgcttttaaagataattctaatctctacatggtcatggaatacgttcccgggggggaaatgttctcccaccttcggaggattgggcggtttagcgagccccacgcccggttttatgctgcccagatcgtgctcacattcgaatatctgcattccctggatttgatttacagggatctcaagcccgagaatctacttatcgatcaccagggatacatccaggtcactgacttcggcttcgccaagagagtcaaaggtagaacttggacgctgtgtggaacaccggagtatctggcacctgaaatcatactgtctaagggctacaataaagccgtagattggtgggcccttggggtgctgatttacgagatggccgctggttatccaccgttttttgctgaccagccgattcagatttacgaaaaaattgtgagtggaaaagtgaggttcccttcccacttttccagcgacttgaaagatctgctcagaaacctgttacaggtagacttgaccaagcgattcggcaacttgaagaacggggtaagcgacataaaaacacacaaatggttcgcaactactgattggatcgccatatatcagcggaaggtggaagcgccgttcatccccaagttccgcggcagtggggatacgtcaaatttcgatgattatgaagaagaagatattcgtgttagtattaccgagaaatgcgccaaagaattcggagaattctag

SEQ ID NO: 130571 - DNA, 774 bp, Artificial Sequence
  Description of Artificial Sequence: Synthetic coding sequence
atgggaaatgcggccactgccaaaaaaggttccgaggtggagtctgttaaggagtttctcgcgaaggccaaagaagactttctgaagaagtgggagaatccgacccagaataatgccggtttggaggattttgagagaaaaaaaaccttgggcaccggaagcttcggtagagtcatgctggtgaaacacaaagcgaccgaacaatattatgcaatgaagatcctggataagcagaaagtagttaagctcaaacagattgaacacaccctgaacgagaagcgaatactgcaggctgtgaattttcctttcttggtgcgcctcgagtatgcttttaaagataactccaatctgtacatggttatggaatacgtgccaggaggggagatgttttcccacctaagacgaattggcaggttttctgagccgcacgcaagattctatgcggcacagatcgttctgactttcgaatacctccattcccttgacttaatctatagggatctgaagcctgagaaccttctgattgatcatcaagggtacattcaggttacggattttggattcgcgaagagggtcaagggtaggacatggaccctgtgcgggactccagagtacctagcccccgagattattctgagcaaggggtataacaaagctgtagattggtgggcccttggggtgctcatctacgaaatggcagccgggtaccctccgttctttgcggatcagcccattcagatctatgagaagatcgtttctggaaagaatttctag

SEQ ID NO: 130572 - DNA, 1056 bp, Artificial Sequence
  Description of Artificial Sequence: Synthetic coding sequence
atggggaacgccgctaccgctaagaaaggctctgaggtggaaagcgtcaaagaatttctagccaaggctaaggaggactttcttaagaaatgggagaaccccacccagaacaatgcggggcttgaagacttcgaaaggaagaagacccttggcacaggatcgtttgggagagtcatgctcgtcaagcacaaggccacagaacaatactacgccatgaagatcctcgataagcagaaggtcgtaaagctgaagcaaattgaacacaccctgaatgagaagcggatattacaggcagtgaacttcccattcctggttcgcctggagtatgccttcaaggataatagtaatttatatatggtgatggaatatgtcccaggaggtgaaatgttcagccatctcaggagaatcgggaggtttagcgaaccccacgcaaggttctatgccgctcagatcgtactcacgttcgagtacctccattctctggaccttatctatagggaccttaagcccgagaatctgctcatagaccaccagggctatattcaggtgacagattttggtttcgctaagcgcgtgaagggaagaacatggacactgtgcggcaccccagagtacctggctcctgaaatcattctgagtaaggggtataacaaggccgtggactggtgggctctcggtgtgctcatttatgagatggcagcagggtaccccccattcttcgccgaccagcctattcagatctacgagaaaattgtaagtggcaaagtaagatttccatctcacttcagcagcgatctgaaggatctgctgcggaacctcctgcaggtggacttaaccaaacggttcggcaacttgaagaacggtgtctccgacatcaagactcacaagtggttcgctaccacagactggatcgcaatctatcagcgcaaagtagaggcaccttttatcccgaagttcagaggtagcggagatacctccaattttgatgactacgaggaagaagatatacgcgtgagcataacggagaagtgtgccaaggagttcggtgaattttag

SEQ ID NO: 130573 - DNA, 1077 bp, Artificial Sequence
  Description of Artificial Sequence: Synthetic coding sequence
atgggcttgagcaggaagagcagtgatgcatccgcctgcagcagctctgaaatttccgatagtttcgtaaaagaatttcttgctaaagccaaagaagacttcctgaaaaagtgggagaacccaacccaaaataatgccggcctagaagatttcgaacgcaaaaagacattagggaccggtagctttggtcgggtgatgctggtgaaacataaggcaacagagcaatactacgctatgaaaatccttgataagcagaaagtcgtcaaacttaagcaaatcgagcacacccttaatgaaaagcggatcctccaggcagtaaacttcccctttctggtgagactggaatacgcttttaaggataacagcaacttgtacatggttatggagtacgtgccaggcggagaaatgttcagtcatctaaggagaatcgggagattttctgagccacacgctcggttctatgccgcgcagattgtactcaccttcgaatatctccatagccttgatttgatataccgtgaccttaagcccgaaaatttacttatagaccaccaggggtacatccaggtgaccgattttggattcgctaaacgcgtgaaaggccgtacatggacattgtgtgggacaccggagtatctggccccggaaattatcttatcaaaggggtacaacaaggctgtggactggtgggcgcttggcgtgctcatctatgaaatggcagcagggtatcctcctttcttcgcagaccagccaattcagatttatgagaagattgtgagcggcaaagtccgtttccccagccacttcagctcagacctgaaggacctgctccgcaacctcctgcaagtggatctgacaaagcgcttcggtaatctgaaaaatggtgtgtccgacattaaaactcataaatggttcgctacaactgactggattgccatctaccaacgaaaggttgaggccccgtttatcccgaaattccgtggctccggcgacacttccaattttgatgactacgaggaggaagacatcagggttagcattaccgagaagtgcgcaaaggagttcggggaattttag

SEQ ID NO: 130574 - DNA, 966 bp, Artificial Sequence
  Description of Artificial Sequence: Synthetic coding sequence
atgtctgcccgcaagtctagtgatgcctccgcttgctcatcctctgaaattagcgtgaaggagttcctcgctaaagccaaggaggattttttgaagaagtgggagaaccctacccaaaacaatgctggccttgaggacttcgaaagaaaaaagaccttgggcaccggctcctttggtcgggtgatgctggtcaagcacaaagctaccgagcaatattatgctatgaagatattagacaagcaaaaagacaattcaaatctatacatggtgatggagtacgtgcccgggggcgagatgttcagtcatctccggcggattggcaggttttccgagccacatgcacgtttctacgctgcgcagattgtgttaactttcgaatacctacactccctggacctgatctaccgcgacctcaaaccagaaaatcttctcatagaccaccagggatatattcaggtgaccgatttcggttttgctaagcgcgtgaagggcaggacttggactctatgcgggaccccagagtacctagctcctgagatcatacttagcaaaggttataataaggcagtggactggtgggccctgggtgtgcttatctacgaaatggccgccggttacccacctttctttgccgatcagcccattcagatttacgaaaaaatagtctctgggaaagtccgcttcccatctcactttagcagcgatctgaaggatcttcttcggaacttgctccaggtagatctgaccaaacggtttggtaatcttaagaatggggtctctgacattaagacccacaagtggtttgccacaaccgactggatcgccatttaccagcgcaaggtcgaggctccttttatccccaaattcagaggatcgggggacacctccaacttcgatgactatgaagaagaagatatcagggtgtcaataaccgagaaatgcgctaaagagtttggggagttctag

SEQ ID NO: 130575 - DNA, 630 bp, Artificial Sequence
  Description of Artificial Sequence: Synthetic coding sequence
atgagcgcctgtagcagtagtgaaatatcggtcaaggagttcctcgctaaagccaaagaggatttcctcaaaaaatgggaaaatcctacacagaataatgccgggctggaagacttcgaacgcaagaagaccctcgggaccggctcattcggacgggtcatgttggtgaagcacaaagctaccgagcagtactatgccatgaaaattctggacaaacagaaggttgttaagcttaagcaaattgaacatactctgaacgagaagcggatactgcaggccgtaaatttcccctttttggtgcgattagaatacgcatttaaggacaatagtaacctgtatatggtcatggaatacgtgccagggggggagatgttctcccatctgaggcgaatcggacgtttctctgaacctcacgccaggttttacgcggcgcagatagtgctgacattcgagtatctgcacagcctcgacctgatttacagagatctgaaacctgagaacctgctaatagatcatcaagggtacattcaggtaactgatttcgggttcgcgaagcgcgttaaggggaggacctggacgctctgcggcaccccagagtatcttgcaccggaaatcatcctaagtaagtag

SEQ ID NO: 130576 - DNA, 594 bp, Artificial Sequence
  Description of Artificial Sequence: Synthetic coding sequence
atgagcgtcaaggaatttctcgctaaggctaaagaggattttttaaagaagtgggagaatcccacccagaataatgcaggcttagaggatttcgaacgcaagaaaactttaggtacgggatccttcggtagagtgatgctcgtgaaacacaaagcaacagaacagtattatgcaatgaagattcttgataaacagaaggtcgtaaagctgaagcagatcgagcacacactcaatgaaaaaagaatccttcaagcagtgaactttccctttctagtcagattggaatacgcctttaaagataattccaatctgtacatggtgatggaatatgtgcctggaggagagatgtttagtcatctgcgacggattgggcggttttcagaaccgcatgcacgtttttacgccgcccagatagtgctgacatttgaatatcttcactcactggaccttatctacagggaccttaagcctgaaaacctcctgatcgaccatcaagggtatatccaggtaaccgattttggatttgccaagagagtgaagggtagaacatggaccctatgcgggacacccgagtacttggctcccgaaatctag

SEQ ID NO: 130577 - DNA, 645 bp, Artificial Sequence
  Description of Artificial Sequence: Synthetic coding sequence
atgggactcagctgttcttccagcgagatcagcgtgaaagagttccttgctaaggcaaaagaggatttcctcaaaaaatgggagaaccctactcagaataacgcagggcttgaggattttgaaaggaagaaaacgctgggaaccggatcgttcggtcgggttatgctcgtgaaacataaagctactgagcaatattatgccatgaaaattctcgataagcagaaagttgtaaagttgaagcaaatcgaacacaccctcaatgagaaaaggatactgcaggcagtcaattttccctttcttgtcagactggagtacgccttcaaggataactccaatctgtatatggtgatggaatacgtgcctggcggcgaaatgtttagccacctgaggagaatcggcaggttcagtgaaccacacgcaagattctatgccgcccagatcgtcctaacttttgaatacctacacagcctggatctgatttacagagacctgaaacccgagaatctgctcatcgaccaccaggggtacattcaggtcaccgattttgggttcgctaaacgggtgaaaggtaggacatggacgctgtgtggcaccccagaatatctcgcacctgagattatactgtctaagggctataacaagtag

SEQ ID NO: 130578 - DNA, 561 bp, Artificial Sequence
  Description of Artificial Sequence: Synthetic coding sequence
atgggtctgtcgcgtaagagctctgatgcatcagcctgctccagctctgagataagtgtcaaggagttccttgcgaaggcgaaagaggacttccttaaaaagtgggaaaaccccactcaaaataacgcagggctggaagacttcgaaagaaagaaaaccctgggtactgggagcttcggccgggtgatgctggtcaagcataaggccactgagcagtattacgccatgaagattcttgataaacagaaggtggtgaaactcaagcaaattgagcacacactgaatgagaagcggatcctgcaggcagttaatttcccttttttggtgaggctggaatatgccttcaaagacaattccaatctgtacatggtcatggagtacgttccgggaggagaaatgttttcccacctgcggcgtattgggcgcttctctgagccccatgctcgtttttatgccgcccagatcgtgcttacattcgaatatctgcattctctagacctgatctatagggacctgaaaccagagaacctgttaatagatcatcaagggtacatacagtag

SEQ ID NO: 130579 - DNA, 528 bp, Artificial Sequence
  Description of Artificial Sequence: Synthetic coding sequence
atggggctgagcaggaagtcatcggatgcttccgcctgctcttcatctgagattagcgacagctttgtgaaggaattcctggccaaagctaaggaggactttctgaagaagtgggagaacccaacccaaaacaatgcagggttggaagattttgaaagaaaaaagacattggggaccgggagcttcgggagggtcatgcttgttaagcacaaggctaccgaacagtattacgctatgaagattctggataaacagaaagtggtgaagcttaaacagatcgagcacactttaaatgagaaaaggatcctccaggcagtgaatttcccttttctggtaagactggaatacgcctttaaggacaactcaaacctgtacatggtcatggagtacgtgcctggcggggaaatgttctcccatctgcgccgaattgggaggttctcggagccgcacgcacgcttctatgcagcgcagatcgtcctgacatttgaatacttgcattccctagatttgatttatagagacctgtag

SEQ ID NO: 130580 - DNA, 621 bp, Artificial Sequence
  Description of Artificial Sequence: Synthetic coding sequence
atgagtgcacggaagagctcagatgcctcagcatgcagtagctcagaaatttctgtcaaagaatttctcgctaaagccaaggaggactttctaaagaaatgggagaatcctacacagaataacgctggactggaggactttgagcgcaagaaaacccttggaacaggttctttcggcagagtgatgttggtgaaacacaaggcaacggagcagtattatgccatgaagatcctcgataagcagaaggttgtgaaattaaaacagattgaacatacactgaacgaaaaaaggattctacaggccgtaaattttcctttcctggttagactggagtacgctttcaaagacaattccaatttgtacatggtgatggagtatgtccccggcggggagatgttctcccatctcagaaggataggtcgcttctctgaaccccacgctagattttatgcagcccagattgtgctcacgttcgagtacctgcactctttggacctcatttacagggacctgaagcctgagaacctgctgattgatcatcagggctatattcaggtgacagactttgggttcgctaaaagggtgaagggacggacatggacgttgtgcggtactccatag

SEQ ID NO: 130581 - DNA, 1056 bp, Artificial Sequence
  Description of Artificial Sequence: Synthetic coding sequence
atgggcaatgcccctgctaaaaaggataccgaacaggaagagtccgtcaatgagtttttggccaaagcgcgcggagactttctgtaccgctggggaaatcctgctcaaaataccgccagctcggatcagtttgaacgactgagaacactcggaatgggctcttttggtagagtgatgcttgttcgacaccaggaaacgggtggccactacgcaatgaaaattctgaacaagcagaaggtagtgaaaatgaagcaggtcgaacacattctcaatgaaaaaaggatactgcaggccatcgattttccgtttcttgttaaactccaattttcctttaaggacaatagctatctctatctggttatggagtacgtcccggggggggagatgttctcaaggctgcagagagtggggaggttcagcgaaccccatgcctgtttctacgccgcccaggtggttctggccgtgcagtatctccacagtttggacctgatccacagggacttaaagccagaaaatctgcttatcgaccagcagggctatctgcaggtgacagatttcggctttgcaaagagagtgaagggtcggacgtggacgctctgtgggacaccagagtatctggctcccgagatcatcttaagcaagggttacaataaggctgtcgattggtgggcattaggggttctgatctatgagatggccgtgggattccctcctttctacgccgatcagcccattcagatctacgagaagatcgtaagcggcagggtccgattcccctctaaattgtcctcagacttgaaacacctgctgaggagtctgttacaggtggaccttaccaaaaggtttggaaatctgagaaacggtgtcggggacattaaaaaccataaatggttcgccaccaccagctggatcgccatatatgaaaagaaggtcgaggcccccttcatccccaagtacactggacctggggacgctagcaacttcgatgactatgaggaagaagaacttcgaattagcattaatgagaaatgtgccaaagaattctccgagttttag

SEQ ID NO: 130582 - DNA, 1146 bp, Artificial Sequence
  Description of Artificial Sequence: Synthetic coding sequence
atggaaagcgggagtaccgcggcgtctgaggaggcgagaagccttagagaatgcgagctgtacgtacaaaagcacaatatccaggcgctgctgaaagatagtatcgtccagctgtgtacggctcgcccagagagaccaatggcttttctgagagaatattttgagaggttagagaaggaggaggccaagcaaatacagaacctccaaaaagccgggacacgcacagactcccgggaagacgagatctccccacctcctccaaaccccgtcgtgaagggacggcgacggcggggcgccatttccgcagaggtttatacagaggaggacgcagcttcttacgtacgcaaagttattcctaaggactataaaaccatggcggccttggccaaagccatcgagaaaaacgtgctgtttagtcacctggatgataatgagcggagtgacatctttgacgctatgttttcagtttcctttatcgccggcgaaaccgtgattcagcagggcgacgagggtgacaacttctacgtgatcgatcagggcgaaacagacgtgtatgtgaacaacgagtgggcgactagcgttggcgaaggaggctcctttggcgagttggcactcatctacggaactccccgcgcagccaccgtgaaggcgaagaccaatgtgaaactctgggggattgatagggacagttatcgtaggatcctgatgggctctaccctgcggaaacggaagatgtatgaggagttcctttccaaagtgtccatcctggagtccctagacaagtgggagcgactgactgtcgctgacgcactcgaacccgtccagttcgaggatggacagaaaattgtggtacagggagaaccaggggatgaattcttcatcatactggaaggctccgccgcagttctccagcggcggtcagagaacgaggagtttgtcgaagtagggagattggggccttccgactacttcggcgaaattgcgttgctcatgaaccggccacgggccgctaccgtcgtggccagggggcctctgaagtgcgtgaaactcgatcggccccggttcgagcgggtgctggggccatgctcagatattttaaaaaggaacattcagcagtacaatagctttgtttctttgtccgtgtag

SEQ ID NO: 130583 - DNA, 1146 bp, Artificial Sequence
  Description of Artificial Sequence: Synthetic coding sequence
atggaatcagggagcactgcagcgtctgaggaggcgcgcagtttaagagagtgcgagctgtatgtgcagaaacataacatccaggccctcctgaaggattctatagtccagctgtgcaccgcacggcctgagagacctatggcattcctaagagagtacttcgagcgcctggagaaggaagaagccaaacagattcagaatcttcagaaagccggcacgcgtaccgactcgcgcgaagacgagatttcccctccccctcctaatcctgtggtgaaggggagacggcgtagaggggctatctctgcggaggtttatacagaggaagacgcagcctcctacgtgcgtaaggttatcccgaaagactataagaccatggcggctctcgctaaagccatcgaaaagaacgtactattctctcacctggatgataacgaacgaagtgatattttcgatgccatgttctccgtgagctttatagcaggcgagaccgtgatacagcagggcgatgagggcgataatttctacgtcattgatcaaggcgaaaccgacgtgtacgtaaacaatgagtgggccaccagtgtgggtgagggcggctcatttggggaattggcgcttatttacggtacgccgcgtgccgccaccgtcaaagccaaaaccaatgtgaaactgtggggcatagatcgggactcctataggaggatcttgatgggcagtacactgcggaagcgtaagatgtacgaggagtttctatccaaggtgtcaatactggagtcccttgacaaatgggagagactgaccgtcgctgatgctttggagccagtacaatttgaggacggccagaagatcgtcgtccagggggagcctggagatgaattcttcatcatcctggagggctctgccgctgttctccaaaggagatcagagaacgaagaatttgtagaagtaggcagactaggtccctcggattacttcggtgaaatcgcattattgatgaaccgacctagagcagcaacagtggttgccagagggcctctcaaatgtgtgaagctagatagaccccggtttgagagggtgcttggaccatgctctgacatcctcaaacgcaatattcaacagtataattcctttgtctccctgtctgtatag

SEQ ID NO: 130584 - DNA, 1146 bp, Artificial Sequence
  Description of Artificial Sequence: Synthetic coding sequence
atggaaagtggtagtacagccgccagcgaagaggctcgctccttgagggagtgcgagctgtacgtccagaaacataatattcaggctctacttaaggatagcatcgtgcagttgtgcacggccagacccgagcgtccaatggccttcctgcgggagtattttgagcgcttagagaaggaggaggccaagcagatccagaaccttcaaaaagccggcactcgcacagactctcgggaggatgagatctctccaccccccccaaatccagtcgttaaaggcaggaggcggagaggagccatttctgctgaggtctacactgaggaagacgccgcctcttacgtcaggaaagtgatccctaaggattacaaaaccatggcggcgctggcaaaggcaattgaaaagaacgtgttgttctcacacctggatgataacgaacggagcgacattttcgacgccatgttcagcgtgtccttcatcgctggtgaaactgtaattcagcagggggatgagggtgacaacttctatgtcatagatcagggcgagaccgacgtatacgtgaataacgagtgggccacctctgtaggcgagggcggctcgttcggggaactggccttgatatatggcacaccccgcgctgctacagtcaaggctaaaactaacgttaagctgtggggcattgaccgtgatagctaccgacggattctaatgggatctaccctgcgaaaaaggaagatgtacgaggagtttttgagcaaagtgagtatcttagagagccttgataaatgggagcggctcactgtcgccgatgccttagagccggtccagtttgaggacggccagaaaattgtggttcaaggcgaacctggcgacgaattttttatcattctggagggaagtgccgccgtgttgcagaggcgctctgaaaatgaagagtttgttgaggtgggccggctgggcccatccgactattttggagaaatagccctgctcatgaataggcctcgcgccgcaaccgttgtggcgcgaggccctttaaagtgcgtgaagctagaccgcccccgcttcgagagagtgttagggccatgttccgacattctgaagaggaatatccaacagtataactccttcgtgtctctatcagtatag

SEQ ID NO: 130585 - DNA, 1146 bp, Artificial Sequence
  Description of Artificial Sequence: Synthetic coding sequence
atggaatccggaagcaccgccgcgtctgaggaggctcgttccctaagggagtgcgaactgtacgtgcagaagcataatattcaggctctgctgaaagattccattgttcaactgtgcactgcacggcccgagcgccctatggccttcctgcgtgagtactttgagcggttggagaaggaggaggccaaacagattcagaatctgcagaaggccggaactcgtacagatagccgcgaggatgagattagcccgcctccaccaaaccctgtggtgaagggcagaagacgccgaggcgccatttccgccgaagtctataccgaagaagatgcagcaagctatgtgcgaaaggtgatcccaaaagactataagaccatggccgcgctggcgaaggccatcgaaaagaacgtgttattcagccatctggacgataacgagcgctcagacattttcgacgccatgttctccgtctcatttatcgccggagagacagttatccagcaaggagacgagggtgataacttctatgttatcgatcagggcgaaactgatgtatacgtgaacaatgagtgggcaacctctgtgggagaagggggttcattcggtgagttggcgctaatctatgggaccccccgggctgcaacggtgaaggcaaagacgaacgtcaaactctggggtatcgatagggacagctaccggagaatccttatgggatcaaccctccgcaaacgcaaaatgtatgaggagttcctctcgaaggtctccattctcgagagtctggacaagtgggagcgtctgaccgttgctgatgccttggagcctgtacagtttgaagatggtcagaagatcgtcgtacagggggagccaggtgatgaattctttatcatcttagaaggctccgcggccgtgttgcagcgccgctcagaaaatgaggagtttgttgaagtggggaggctgggaccaagcgattactttggagagatcgcacttcttatgaacaggcccagggccgctacagtcgtggccagggggccactcaaatgcgtgaaactggacaggccccggtttgagcgtgtgttagggccatgctctgatatcctcaaacgaaatatccagcagtacaactccttcgttagcctctcagtctag

SEQ ID NO: 130586 - DNA, 243 bp, Artificial Sequence
  Description of Artificial Sequence: Synthetic coding sequence
atgggttctacgttgcgcaaaagaaagatgtacgaagaattcctctctaaagtctccattctggaatctctcgaaaagtgggaacgactcaccgtcgcagacgccctggagccagttcaattcgaggatggggaaaagattgttgtgcagggagaaccaggggacgacttctacatcattacagagaagaatctgccaggcgttgtggcacacgcatgcaacccaagctatcttgggggctag

SEQ ID NO: 130587 - DNA, 1146 bp, Artificial Sequence
  Description of Artificial Sequence: Synthetic coding sequence
atggcttctcctcctgcttgtccgtccgaggaagacgaaagtctgaagggttgcgagctgtacgtccagctgcacgggatccagcaggttctcaaggattgtatagttcacctgtgtatttccaaacctgaacgtccgatgaagttccttcgcgagcacttcgagaaactggaaaaagaagagaaccggcagattctggccaggcagaagtcgaactcccagagtgacagccatgatgaagaagtatcaccaacccctcccaacccagtcgtaaaagcgcgcagaaggcgaggtggggtctctgccgaagtgtacaccgaagaggatgctgtgtcgtacgttcgcaaggttattcccaaagactacaaaaccatgaccgccctggcgaaggcgattagtaagaatgttctgttcgcccacctcgatgacaatgagagaagtgatattttcgacgctatgttcccagtcacgcatatcgcgggtgaaactgttatacagcagggcaatgagggggataacttctacgtagttgatcagggagaggtcgacgtctatgtgaacggggaatgggttacaaatataagcgagggggggtccttcggagaactcgccctgatatatggcaccccacgggccgctaccgtcaaggcgaagacagacttaaagctgtgggggattgatcgggactcctaccggcggattttgatgggcagtaccctccgcaaacgaaagatgtatgaagagtttttatctaaggtgagcattctcgagtctctcgagaaatgggaaagacttactgtagctgatgcattggaacccgtgcaattcgaagatggggaaaagatcgtggttcagggagagccaggggacgatttctacatcataacagaaggtacagccagcgttttgcagaggagatcgcctaatgaggagtatgtcgaagtgggacgtctgggaccttcagattatttcggagaaatcgctctgttgcttaatcggccccgagccgccacagtcgtagccagaggccccctgaaatgtgtgaagctggaccgcccgcgctttgaacgcgttctaggcccatgctcagagatcttaaaaagaaatatacaaaggtacaattcgttcattagccttacagtgtag

SEQ ID NO: 130588 - DNA, 1146 bp, Artificial Sequence
  Description of Artificial Sequence: Synthetic coding sequence
atggcatccccgcctgcctgcccaagcgaggaagatgagtctctcaagggctgtgaactttatgtccagctgcacggcatccaacaagttttgaaggattgcattgtccacctgtgtataagcaaacctgaacggccaatgaaattcctcagggagcactttgaaaaacttgaaaaagaggagaatcgtcagatcctcgcccggcagaagtccaatagtcagtctgacagccacgatgaggaagtgtcacccacccccccaaatccagtagtaaaggccagacggagacgcgggggtgtgagcgctgaggtatatactgaagaagatgccgtatcctatgttagaaaggttattcccaaagactacaaaaccatgactgctcttgctaaagcaatctcgaaaaatgtgctgtttgctcatttagatgataatgagcgctcggatatattcgatgcaatgttcccagtaacccacattgcgggggaaaccgtgatccaacagggcaatgagggagataacttttacgtggtcgatcaaggagaggtggatgtgtacgtgaatggcgagtgggtcaccaatatatcggaaggaggatcctttggcgagctcgcattaatctacgggacacctagggcagctaccgtcaaggcaaaaaccgacctgaaactttgggggatcgatcgcgattcctatcgacggatactgatgggctcgacgctccgcaagcgcaagatgtacgaggaattcttgagcaaggtgtcaatcctcgaatctctcgagaagtgggagcgcctgactgtagcagacgccttggaaccagtgcaatttgaggacggggaaaaaatcgtggtacaaggagagcctggggatgacttttatattatcacagagggaactgcatccgtactgcaaagaaggtcccccaacgaggagtacgtcgaggtcggacggttgggtccaagtgattactttggtgagatagctctgctgttgaatcgtcctcgtgctgccaccgtagttgccaggggacccctgaaatgtgtgaaactggatcgtcctcgcttcgagcgggtactgggtccgtgctccgagatcctaaaacggaatattcaacgttataacagtttcatctctctgacagtatag

SEQ ID NO: 130589 - DNA, 1146 bp, Artificial Sequence
  Description of Artificial Sequence: Synthetic coding sequence
atggcctcgccacctgcttgcccctcagaggaagacgagtcgctcaagggctgtgagctctatgtccagttacacggcatccaacaggtgctgaaggactgtattgtccacctctgtatcagcaaacctgaacgtcctatgaagttccttcgggagcacttcgaaaagctcgagaaagaagaaaataggcagatactggctagacagaagtcaaactctcaatcagatagtcatgacgaggaggtgagtcctacgccgcccaatcctgtggtgaaggcccggcggcgccggggaggtgtgtccgctgaagtgtacactgaggaagatgctgtgagctatgtcaggaaagtcatccctaaagattataaaacaatgaccgcactcgctaaagctatatccaagaatgtcctctttgcacacctggacgataacgagaggagcgacatattcgacgcaatgttccctgtgacccacatcgcaggtgaaactgtcatccagcagggcaacgagggagacaatttctatgtagtagaccagggggaagtggatgtctatgtgaacggagagtgggtaacgaacatttctgagggaggttcctttggggagttagccttaatctatggaaccccccgtgccgcaactgtcaaagcaaagaccgatctaaagctttggggtatagatcgggacagctaccgcaggattttaatgggttctaccctgcggaagcggaaaatgtacgaggagttcctcagtaaagtgtctattctcgagagtctggagaagtgggaacggctcacagtggcggatgctcttgaaccagtgcagttcgaggacggtgagaaaattgtcgtgcagggtgaacccggggatgacttttacatcatcactgaagggacagccagcgttctgcaaagaagatcacccaatgaagagtacgtcgaggtcggacggttgggtcctagcgactatttcggggagatcgctctactcctgaataggccacgggctgctacagtggtggcgcgcgggcctctcaagtgtgtgaagctagataggcctagatttgagcgcgtccttggtccttgttcagaaatccttaagagaaatattcagcgatacaacagctttatcagtctcaccgtgtag

SEQ ID NO: 130590 - DNA, 498 bp, Artificial Sequence
  Description of Artificial Sequence: Synthetic coding sequence
atggcatctccccccgcctgcccttcagaagaagacgagtctctcaaaggctgcgagctgtatgtgcagctacatgggattcaacaggtgctcaaagactgcatcgtccacttgtgcatttccaagcctgagagacctatgaagtttctgagagagcacttcgaaaagctggagaaggaagaaaaccggcagatccttgcccggcagaaatcaaatagtcagagcgactcacacgacgaagaagtgtctccaacaccgccaaaccccgttgtgaaagcgcgtagacgccgcggaggtgtgagcgcggaggtctacaccgaagaggatgctgtgtcctatgtgaggaaagtgattcccaaagactataaaactatgacagccttagctaaggcgataagtaaaaacgtcctgttcgcacacctcgatgataatgaaagatctgacatattcgatgccatgtttcctgtgacccacatagccggcgagaccgtgatttag

SEQ ID NO: 130591 - DNA, 894 bp, Artificial Sequence
  Description of Artificial Sequence: Synthetic coding sequence
atggcatcaccccccgcttgccctagcgaggaggatgagtccctgaaaggttgcgaactctatgtgcaactgcatggaattcaacaagtcctaaaggattgcatagttcacctctgcatttccaaaccagaacgccccatgaaattccttcgcgaacactttgagaagctcgagaaggaagagaacagacagattctggcccgccagaagagcaattcccagagtgactcacacgatgaagaagtctcgccaactccccctaatcctgtagtgaaggccagacggcggagagggggagtttctgccgaggtgtacaccgaagaggacgcagtgtcttacgttcggaaggtgatacccaaagactacaagactatgactgcgttggctaaggccatcagcaagaacgtattgttcgcccacttggatgataacgagaggtcggacatctttgacgccatgttccctgttacccatatagccggggaaacagttatccagcaaggaaatgaaggggacaacttttacgtcgtcgatcagggggaggttgatgtctacgttaacggtgagtgggtgactaacatttccgaaggcggctcatttggtgagctagctttaatttacgggacgccacgggccgctacagttaaagccaagactgatcttaagctgtggggcatagacagagatagctaccgcagaattttaatgggctctacattgaggaagcggaagatgtacgaagagttcttgtcaaaggtctcaatcctagaatccctggagaagtgggagcgcctgacggtggctgacgccctcgagcccgtccagtttgaagatggcgaaaagattgtagtgcagggcgagcctggagacgacttctacataattacagagtag

SEQ ID NO: 130592 - DNA, 177 bp, Artificial Sequence
  Description of Artificial Sequence: Synthetic coding sequence
atggcttctccccctgcgtgccctagcgaagaagatgagagcctgaaggggtgtgagctttatgtgcagctccatgggatccaacaggtactgaaggactgcatagtacacctgtgtatatcaaaacctgaacgacccatgaaatttttaagggaacatttcgaaaaacttgagtag

SEQ ID NO: 130593 - DNA, 1146 bp, Artificial Sequence
  Description of Artificial Sequence: Synthetic coding sequence
atggcctctcctccagcttgcccttccgaagaagatgagagtctaaaaggctgcgagctgtatgtgcaactgcacgggatccagcaggtgttgaaagactgtatcgtccacttgtgcatttccaaacccgaacggcctatgaaatttctacgagagcatttcgagaagctggaaaaggaagagaacaggcagatacttgcaaggcaaaagagcaactcccagtcagatagccatgatgaagaagtcagtcctacgccaccaaaccccgtagtgaaagctaggcgccgacgaggcggagtgtctgctgaggtgtatacagaggaagacgcagtgagctacgtgcgcaaggttatcccgaaggactacaagaccatgacagctctcgctaaggccataagtaagaacgtgctcttcgcccacctcgacgacaacgaaaggagcgatatttttgatgccatgttccccgtgacacatattgccggcgagacagtaatacagcaaggcaatgagggggacaacttttacgtcgtggatcagggcgaggttgacgtctatgttaacggggagtgggtcaccaatatctctgaggggggtagttttggtgaactagccctcatttacggcacgccacgggctgctaccgtcaaggctaaaactgatctgaagctgtggggaattgacagagattcatacaggagaatcctcatggggagcactctacgcaagcggaagatgtatgaagagtttctttccaaggtttcaatcttagaatctttggagaaatgggaaagactgacggtggctgatgcattagagccagtgcagtttgaggacggcgaaaaaattgttgtacagggggagcctggagatgacttttacattattactgagggcaccgcttccgtcttgcagcggcgaagcccgaacgaagagtatgttgaggtggggcggctgggcccttccgattattttggcgagattgctttactgttaaatcgaccacgcgccgcaacagtagtcgctagaggaccgcttaagtgtgttaaactggataggccacgatttgagcgggtgttagggccctgtagcgagattctgaaacggaatatccagcggtacaacagctttatctctctcaccgtgtag

SEQ ID NO: 130594 - DNA, 1146 bp, Artificial Sequence
  Description of Artificial Sequence: Synthetic coding sequence
atggcgtcaccccccgcatgtccttctgaggaagacgaatctctgaagggttgcgaactgtatgtccaactccatggcatacagcaggttctgaaagattgtatcgttcacttgtgtatttctaagcccgagcggcctatgaaatttctgagagaacacttcgagaaacttgagaaggaggagaatcggcagatcctggcccgccagaaatctaattcccagagtgatagtcacgatgaggaggtctctccaactccccctaatccagttgtcaaggcaagacggagaagaggaggtgtgtcagctgaagtctatacggaggaggacgccgtctcttacgtgcgcaaggtgatccctaaagattacaagacaatgaccgccctggctaaggccattagtaagaatgtcctgttcgcacatctagacgacaacgaaagatcagacatattcgacgccatgtttccagtgacgcacattgctggtgagacagtgattcagcaggggaatgagggggacaacttttatgttgtggatcagggagaggtagacgtttatgtgaatggagaatgggtgacaaacattagtgaggggggctcatttggcgagctggccctgatctacggaactccacgggcggccactgtcaaggctaaaacagatctcaaactctgggggatcgatagagattcctaccgtcgcatcctgatgggatctacactgcgcaaacgaaaaatgtatgaagaattcctgagtaaggtttcaatactcgagtctttagagaagtgggaacggctaactgttgccgacgcgctggaacctgtccagttcgaggacggtgaaaagattgtggtgcaaggggaacctggtgacgacttttacattattaccgaagggacagcaagtgtgctgcagcgaaggtcacctaacgaagaatatgtagaggtagggcgcttgggcccaagcgattactttggggagatagccctcctattgaataggccacgagcagcaacggtggttgcgagaggacctttaaagtgcgtcaagttggaccggccgcgattcgagagagtgctgggtccctgcagcgaaatcctgaagagaaacatacagcgctataacagcttcatttccctgacggtgtag

SEQ ID NO: 130595 - DNA, 1215 bp, Artificial Sequence
  Description of Artificial Sequence: Synthetic coding sequence
atgtcacacatccagataccgccgggtctcaccgaactactgcagggctatacggttgaggtactccggcagcagcctcccgatctggtcgaattcgccgtggagtattttacccggctcagagaggcccgagccccagctagtgtcctcccagcagcaacaccccggcagagcctgggacatccgcctcctgagccagggcctgaccgggtcgccgacgcgaaaggcgacagcgagtccgaggaggacgaagacttggaggtgcccgtgccatcaagatttaaccgtagggtgtcagtttgtgccgaaacgtataaccccgatgaagaggaagaggataccgacccgagagtgatccaccccaagactgatgaacagaggtgcaggctccaggaggcctgtaaggatatcctgttgttcaagaatctagaccaggagcagctatctcaagtgttggatgctatgttcgaacgcatagtcaaagccgacgagcacgttatcgaccagggcgacgacggggataatttttatgtcatcgagagggggacgtacgatatcctggtgacaaaggacaaccaaacccggtcagtgggacagtatgataaccgcggaagtttcggagaactggctttaatgtacaatactcccagggccgctacaattgttgccacttctgagggaagcctgtggggtctggatcgagtcacatttcggagaattattgtcaagaacaatgcaaaaaaaaggaagatgtttgaaagcttcatcgaatctgtgccactccttaagagtcttgaggtgtcggaacgcatgaagatagtcgatgtaatcggtgaaaagatttacaaggatggtgaacgaataatcacccagggtgagaaggccgattctttttacatcatcgaaagcggggaagtgtccatcctgattcgatctcgtacgaagagcaacaaagatggcggcaaccaggaagtggagattgcacgatgccacaagggtcaatactttggcgaactcgcactcgttaccaacaaacccagagccgcttcagcctacgccgtgggtgacgtgaagtgtctagtcatggatgttcaggcattcgaacggttactcgggccttgtatggatattatgaagcgtaacatatcccattatgaggagcaactggttaagatgttcggctcatctgtcgacttgggaaatctgggtcagtag

SEQ ID NO: 130596 - DNA, 1149 bp, Artificial Sequence
  Description of Artificial Sequence: Synthetic coding sequence
atgtctcacatacagataccccccggtttgactgaactgctgcaggggtacacagttgaggtcctgcgccaacaaccccccgatctggtggagttcgcagtggaatactttaccagactgcgggaagcaagagcccctgcctctgttctgcctgcggccaccccacgccagtccctcggccatcctccccccgagcccgggccggatcgggtggctgacgcaaaaggggacagcgagagtgaggaagatgaggatctagaggtgcctgtcccatcccggttcaaccgacgagtgtcagtctgcgctgaaacatacaatccagatgaagaagaagaagacaccgatcccagagtcatccaccctaaaacagacgaacagaggtgtcggttacaagaggcctgtaaagacattctgctgtttaagaacctggaccaggagcagctgtcgcaggttctagatgctatgttcgaacggatcgttaaagcagatgagcatgttatcgaccaaggggatgacggcgacaatttctacgtgattgagcggggcacctatgatatcctcgtcacaaaagataaccagaccagatctgtgggccagtacgacaaccggggatcgtttggtgaacttgcactgatgtataatacccctagggcagctacaatcgtggcaacctccgaggggagcctttggggtctggacagggtcacatttcgcaggataatcgtcaagaataatgccaagaagagaaaaatgtttgagagttttattgaatccgtccccttgctgaagtccttagaggttagcgaaaggatgaagatagttgatgtgatcggtgagaagatctataaagacggagagcgaatcatcacccagaccaagtccaacaaggacgggggtaaccaggaggtggagatagccagatgtcacaagggtcaatattttggagagttggcactcgtgacgaacaaacctcgagcagccagtgcatatgcagtcggcgatgttaaatgcctggttatggacgtccaggctttcgaacgcctcctgggcccatgcatggacatcatgaaacgaaatatttcccattatgaggaacagctggttaaaatgtttggcagtagcgtggatctgggcaacctgggacagtag

SEQ ID NO: 130597 - DNA, 1215 bp, Artificial Sequence
  Description of Artificial Sequence: Synthetic coding sequence
atgagtcacattcagatcccccccgggctgacagaactgcttcagggttatacggtcgaagttcttaggcagcagccaccagatctcgtggagttcgctgtcgagtacttcaccagactgcgtgaggccagagccccagcaagcgtgctccctgcagcaaccccacgccagtctctggggcaccccccacctgaaccaggacccgaccgcgtggccgacgccaaaggggactcagagtctgaggaggacgaggacctggaggttcccgtgccaagtaggttcaaccggcgggtttctgtgtgcgcagaaacctataacccagacgaggaggaggaagatactgatcctagggtgatacatcctaagaccgatgagcaaagatgcaggctgcaggaagcctgcaaggatatcctcctgtttaaaaacctggatcaggagcagctgagtcaagtgctcgacgcaatgttcgaacggattgttaaggcggacgaacacgtgattgaccagggagacgacggagataatttttatgtaatcgaacggggcacttatgatatcctagtgacaaaggataatcaaacaaggagcgttggtcagtacgataatcgcggctcctttggggagctggccctcatgtacaacacaccccgcgccgcgaccatcgtcgccacttcggaagggagtttgtggggcttggatagagtgacctttaggcggatcattgttaaaaacaatgctaagaagagaaaaatgttcgagagcttcattgagagtgtgcctttattaaagagcctcgaggtgtccgaacggatgaagatcgtggacgtcataggggaaaagatatacaaggacggagagcgcatcatcacacaaggagaaaaggcagactcattctacattattgaatcgggcgaagtgagtatcctgatcaggagcagaactaaaagcaataaagatgggggcaatcaggaggttgaaattgctcggtgtcacaagggacaatatttcggagaacttgcccttgtgaccaataaaccgcgcgcggcctccgcttacgccgtgggggatgtcaagtgcctcgtgatggatgttcaagcgttcgaacggctgctcggaccatgcatggatattatgaagcggaatattagccactatgaagagcagctggtcaagatgttcggctccagcgttgacctgggtaacctggggcagtag

SEQ ID NO: 130598 - DNA, 1257 bp, Artificial Sequence
  Description of Artificial Sequence: Synthetic coding sequence
atgagcatcgaaatcccagcagggttaacagaactgcttcaggggtttacagtcgaggtcctgaggcatcaaccagcagatctgctggagttcgcattacagcactttacaagattgcagcaggagaatgagcgcaagggcactgcgcgatttggtcatgagggccgtacctggggggacctcggagccgctgcaggtggaggcaccccaagtaaaggagtgaactttgccgaggaacccatgcaaagcgattctgaggatggtgaggaggaggaggccgccccggctgatgctggcgccttcaatgcccctgttatcaaccggtttactcggagggcctctgtctgtgcagaagcttacaaccccgacgaggaagaagacgacgcagaatctcgcatcatccaccctaagacagacgaccaaaggaaccggctgcaggaggcgtgcaaagatattcttttgtttaagaacttggatccagaacagatgtcacaggttcttgacgctatgttcgagaagcttgtgaaagacggcgaacacgtcatagaccagggagacgatggcgacaacttttacgtcattgaccgcggtacatttgacatatacgtgaaatgcgatggcgtgggacggtgcgtgggaaattacgacaatcgtggctccttcggggagctcgcactcatgtacaacaccccaagagccgccacaatcactgctaccagccctggagctctgtgggggttggatcgggtcacgttcagaagaatcatcgttaagaataatgcaaaaaagaggaaaatgtacgaatccttcatcgaaagccttccctttcttaaatcactcgagttttccgaaaggctgaaagttgtcgacgtcataggcactaaggtatataacgatggggagcagatcatcgcacagggcgactcggccgacagcttctttatcgtggagtccggcgaggtgaagatcacaatgaagcgcaaaggtaagtctgaagtcgaggaaaatggcgccgtcgaaattgcccgctgtagcagaggccagtactttggagaacttgccctggtgactaacaaaccgcgggctgcttccgctcacgcaatcggtacagtgaagtgtctggcgatggacgtgcaggccttcgaacgacttctgggcccatgcatggaaattatgaaacgcaacatcgccacttacgaggagcagctggtagctctcttcggaactaacatggatattgttgagccaacagcttag

SEQ ID NO: 130599 - DNA, 1218 bp, Artificial Sequence
  Description of Artificial Sequence: Synthetic coding sequence
atgagcattgaaatccctgccggccttacagagctcctgcaagggttcactgtagaggtgctccgacatcaaccggccgacctgctcgagtttgcattgcaacatttcacccgtctgcagcaggagaatgagcgtaaggggactgcccgctttggacacgaggggaggacatggggggacctgggagccgcagccggaggcggcactccaagcaagggggtgaatttcgcagaggaggcggcacctgcagatgcgggcgcgttcaatgccccagtgataaatagatttacccggcgagcttctgtgtgcgctgaagcctataacccggacgaggaagaggatgacgctgagtcaaggattattcatccgaagacagacgaccagcggaatcggctgcaggaagcctgcaaggatattttactgtttaagaacctcgatcccgaacaaatgtcccaggtcttggatgcgatgtttgaaaaattggtgaaggatggagaacacgtaatcgatcagggagacgacggtgacaacttttacgtgatcgacaggggcactttcgacatctatgtaaaatgtgacggggtcggtcggtgcgtagggaactacgataatagggggagctttggggaactggcactgatgtacaacactccacgggcagctactattaccgccactagccccggggccctttggggcctggaccgagttacatttaggcgaatcatcgtgaagaataacgccaagaagaggaaaatgtacgagtcctttatcgagagtcttccatttctgaagagtctagagttcagcgagcgcctcaaggtggtggatgtgattgggaccaaggtttacaacgatggggagcaaatcattgctcaaggtgatagcgccgactcttttttcattgtagagagcggcgaggtcaaaattacaatgaagcggaagggcaaaagtgaagtggaggaaaatggagcagtagagattgcaaggtgtagccggggtcaatacttcggtgagttggccctggttactaacaagccaagagcagcctccgctcatgctattggtaccgtaaagtgcctggcaatggacgtgcaggcctttgaacgactgctcggaccttgcatggaaatcatgaaacggaatattgcaacctatgaggagcagcttgttgcattgttcgggaccaatatggacatcgttgagcctaccgcttag

SEQ ID NO: 130600 - DNA, 1257 bp, Artificial Sequence
  Description of Artificial Sequence: Synthetic coding sequence
atgtcgattgaaatccctgccggtctgactgagttactccagggatttacagtggaagtgctacgtcatcagccagccgatctcctggaattcgctctgcaacactttaccagactacaacaggagaatgaaagaaaaggcaccgctagatttgggcacgaggggagaacctggggagatcttggcgcggccgcgggcggcggcacccccagcaagggcgtgaatttcgcagaagagccgatgcagagcgacagtgaagacggagaggaggaggaggccgcacctgccgacgctggtgcctttaatgcccccgtaataaaccggtttacccggcgagcttccgtctgtgcggaggcatacaatcctgacgaagaagaggacgacgccgaatctcgaatcatccaccctaagactgacgaccagcgtaatcgcctgcaagaagcttgtaaagatattttactgttcaagaatttagatccagaacaaatgagtcaggtgctggatgccatgttcgagaagctggtcaaagacggggaacacgtgatcgatcagggcgacgatggcgacaacttttacgtgatcgatagggggacctttgacatttacgtcaagtgcgatggtgtaggtagatgtgtgggaaattatgacaaccggggctcattcggggagctggcactgatgtacaatactcctagggccgccacaatcacggctacctcgcctggcgccttgtggggtcttgaccgggtcacatttcgacgcatcatcgtgaagaataacgcgaagaaaagaaaaatgtacgagtctttcatcgaatctttgccatttcttaagtccctggaattcagtgagagactgaaggtggtggacgtgataggtactaaggtgtacaacgatggagagcagattattgcccagggcgactctgcagatagctttttcatcgttgagagcggtgaggtgaagataaccatgaaaaggaaagggaagtctgaagtggaggagaacggcgccgtagagatcgcacgatgtagtcgggggcagtacttcggggaacttgcccttgtgacaaataagccgcgcgccgcaagcgcccacgccatcgggactgttaagtgcctggccatggatgtccaggcctttgagcggctgctgggcccttgtatggagataatgaagaggaacattgctacgtacgaggagcaattggttgccctgttcggaactaatatggacatcgtagagccaaccgcttag

SEQ ID NO: 130601 - DNA, 1170 bp, Artificial Sequence
  Description of Artificial Sequence: Synthetic coding sequence
atggaaaagcagaacatgttcctgcacggtagctacatcctgcgcgaggacgtgcggactgcaaacgttattgctgctgaagccgttacttgtctggtgatcgatcgcgactcattcaagcatctgattggagggttagacgatgtcagcaacaaggcctacgaggatgctgaagccaaagctaagtacgaagccgaggccgccttcttcgcaaacctgaaactctctgactttaatattattgatacattgggcgtcggcgggttcggtagagtggagttggtgcagcttaaatccgaggagtctaagacgttcgcaatgaagatactcaaaaaaaggcacatcgtcgacacacgccagcaggagcatatccgctcagaaaaacagattatgcagggagcccattccgactttattgtcagactctatcgtactttcaaggactcaaaatatctgtacatgttaatggaagcctgcctgggcggtgaattgtggaccattctaagagatagagggtctttcgaggattcgactacacgtttttatactgcatgtgtagttgaggctttcgcgtacctgcattccaaagggattatttaccgagacctgaagccggagaacctgatcctggatcataggggctacgccaaactggtggacttcggattcgcaaagaagatcggctttggcaaaaaaacctggacattctgtggaacgcctgagtacgtagcaccggagatcatcctcaataagggtcacgacatctccgccgattactggtctcttggaatactcatgtacgaactgctgacaggttcccctccctttagcggccccgaccccatgaaaacttacaatatcatattacgcgggatcgacatgattgagttccccaagaaaatagcgaagaacgctgccaacttgattaagaaattgtgcagagacaatccttctgagcggctgggaaatcttaaaaacggcgtaaaggacatccaaaaacacaaatggtttgaaggcttcaactgggagggcctccgcaagggcacgctcaccccaccaattatccctagcgtagccagcccaactgacacaagcaatttcgattcttttccagaagataacgacgaacctcctccagatgataattctgggtgggacattgatttttag

SEQ ID NO: 130602 - DNA, 852 bp, Artificial Sequence
  Description of Artificial Sequence: Synthetic coding sequence
atgaaaatactgaagaaacgacacatcgttgacacacggcaacaagaacacatccgctccgaaaagcagattatgcagggcgcccactccgacttcattgtgcgcctgtacagaaccttcaaggatagcaagtatctgtacatgctcatggaggcttgtctggggggagaactgtggaccattttgagagaccgtgggtcttttgaagattcaactacaagattttacaccgcctgcgtagttgaggcttttgcatatctgcacagcaagggcattatctatagggacttgaaaccggaaaacctcatcctggaccaccgcgggtacgccaaacttgtagatttcggattcgctaaaaaaatagggtttgggaagaaaacatggactttctgcggaacgcccgagtatgtggcccctgagatcatcttaaacaaaggtcacgatatcagcgctgattactggtccctgggaattttaatgtacgaactcttaacgggatctccaccgttctcaggacctgaccctatgaagacgtacaacatcatactaaggggcatagacatgattgaattccccaagaaaatcgccaagaacgcggccaacctgatcaagaaactgtgtagagacaacccatccgagcggttaggcaacctcaaaaatggtgtcaaggatatccagaaacacaagtggttcgagggctttaactgggagggtctccgaaaaggaacattaactcctccgataataccttccgtcgccagccccacagatactagcaacttcgactcctttcccgaagacaacgacgaaccgccgcctgacgataattcgggttgggacattgacttttag

SEQ ID NO: 130603 - DNA, 546 bp, Artificial Sequence
  Description of Artificial Sequence: Synthetic coding sequence
agctgcataataaaggagggggacgtgggatccctggtctacgtgatggaagatggtaaggttgaagtcaccaaggagggagtcaagctgtgtacaatgggccccggtaaagtcttcggtgagctggccatcctgtacaattgcacccggactgccacagtgaagactcttgtcaatgttaagctgtgggcaattgacaggcaatgttttcagacgataatgatgagaactggcctcattaagcacacagaatatatggagttcctgaagtcagttcccacatttcagtctcttcccgaggaaatactgtcaaaactcgcggatgttctggaggagacccattacgagaacggcgaatatataatccgccagggggccaggggagacaccttcttcataatctccaaaggcaccgtgaacgtcacccgagaagacagcccatccgaggatccagtctttttacggacgctgggaaagggagactggttcggagagaaggcgctgcagggctggacttggaacctctttgagtacgtcgtagaatag

SEQ ID NO: 130604 - DNA, 2061 bp, Artificial Sequence
  Description of Artificial Sequence: Synthetic coding sequence
atgggcaccctccgcgacctgcagtatgcactacaggagaaaatcgaagaactgcgtcagcgggatgccctcatcgatgaattggaattagagctggaccagaaggacgagttgatacagaagctccagaacgagttagacaagtaccgatccgtgatcagacccgctacccaacaggcgcaaaagcagagcgcgtctacccttcagggcgagcccaggacaaaacggcaggctatttctgcagagcccaccgcattcgacattcaagaccttagccacgttactctgcctttctaccccaaatccccccagagtaaggatttgattaaggaggccattcttgataatgatttcatgaaaaacttagagttgtctcaaatacaggagatagtagattgcatgtatccggtggagtatgggaaggactcatgcatcatcaaggagggagacgtcggaagcctcgtgtacgtgatggaggacggcaaggtagaagtgaccaaggaaggggtaaagctgtgcactatgggccccggcaaagtttttggtgagttggccatcttgtacaattgcacgcgcaccgccactgttaaaactcttgtaaatgtgaaattgtgggcgattgatcggcagtgttttcaaactatcatgatgcgaactggactgataaagcacaccgagtatatggagtttttgaagtctgtgcccactttccaaagcctgcccgaggagattttgtcaaaactggccgatgtcctggaggaaacccattatgaaaatggcgagtatattattaggcagggggcacggggcgacaccttctttatcatcagtaagggtacggttaacgttacaagggaggactcaccctcggaagaccccgtttttttgcggactctgggaaagggggactggtttggcgagaaggccctccagggagaagacgtcagaacagccaatgtgatagctgccgaggctgtaacatgtctggtaatcgaccgcgattcatttaagcatctcattggcggattggatgatgtaagcaataaagcatatgaagacgccgaagcaaaggctaaatacgaggctgaggctgccttcttcgccaatctgaagctgtctgattttaatatcatcgacaccctgggagtcggcggatttggcagagtggagctggtgcaactcaagtccgaggagagtaaaacgtttgccatgaaaatcctgaaaaagaggcatatcgtggatacacgccaacaggaacatatcaggagcgaaaagcagatcatgcagggtgctcattctgacttcattgttcggctgtaccggacctttaaggattccaagtacctgtatatgcttatggaggcgtgcctcggaggcgagttgtggactattcttagagataggggtagctttgaagattctactacgcggttctatacagcttgtgttgttgaagcattcgcctaccttcattccaaaggaatcatatacagagatttgaagcccgagaacctgatactggatcatagaggttacgcaaagttggttgactttggatttgctaagaaaattggatttggaaaaaagacttggaccttttgtggaacgcccgagtatgtggcaccagaaatcatactgaacaaaggccacgacatatctgctgattattggtcacttggcattctgatgtacgagctgctcaccgggagcccgcccttttcaggaccagaccctatgaaaacgtataatatcatactgcgcggcatcgacatgattgagttccccaaaaaaatcgctaaaaatgccgccaatctgatcaaaaagttatgccgcgacaaccccagtgaaagactcggcaatctcaagaacggagtcaaagatatccagaagcataagtggtttgaaggcttcaactgggaggggctgcgtaaagggaccctcaccccccccattatcccatctgtcgccagcccaaccgatacatcaaatttcgattcttttccagaagataatgatgaacccccacctgacgataactctggctgggacattgacttctag

SEQ ID NO: 130605 - DNA, 1980 bp, Artificial Sequence
  Description of Artificial Sequence: Synthetic coding sequence
atgttaaaggaagagagaatcaaagagcttgagaaaaggctgtctgaaaaggaggaggagatccaagagctgaagagaaaactacacaagtgccagagcgtactccccgtgccgtctacccacattggtcctcgcaccacccgggctcagggcatatctgcggaacctcaaacctacagaagcttccatgacctcaggcaggcgtttaggaagttcactaagtccgagcggtcgaaagaccttatcaaggaggccattctggataatgacttcatgaagaatctggagctgtcacagatccaggaaatcgttgactgtatgtatcctgtggagtacggcaaagacagctgcatcatcaaggaaggcgacgttggctcattagtgtacgtgatggaggatgggaaggtggaggttaccaaagagggagtcaagctctgcactatgggacccggcaaggtctttggcgagctggcaatcctgtacaactgtacacgcaccgcgacggtgaagactctggtcaatgtgaaattgtgggcaatagatcggcaatgctttcagaccatcatgatgcggacgggacttattaagcacaccgaatacatggagttcttaaagagcgtccctactttccaaagcctcccggaggaaattcttagtaagttggccgatgtactcgaggaaacccattacgagaatggggagtacatcattaggcagggagccagaggcgacactttctttattatttcaaaaggcacagttaatgtgaccagggaggattccccaagtgaagacccagtgtttctacgtaccctcgggaagggcgattggttcggcgagaaggccctccagggggaagacgtgcgcacagcaaatgtcatcgccgcagaagcggttacatgcctggtaatcgatcgggacagcttcaaacatctgatcggggggctcgacgacgttagtaacaaagcctacgaagacgccgaagccaaagctaaatatgaggccgaagccgccttcttcgccaatctcaaattgtccgacttcaacatcatcgatactctgggagtggggggcttcgggcgcgtggaactcgtccagctgaagagtgaagagtccaagacctttgcaatgaagatcctcaaaaaaagacatattgtcgacaccagacagcaagagcacatcagatccgaaaaacagataatgcaaggcgcacattcggatttcatcgtgagactgtacaggactttcaaggacagcaagtacctatacatgcttatggaagcgtgcctgggaggggagttatggaccatcctgagagacaggggatcatttgaggactcaactaccagattctatactgcatgcgtggtcgaggcatttgcgtatctccatagtaagggtatcatctaccgcgacttgaagccagagaatctcattttagatcatcgaggctatgctaagctggtcgactttggctttgccaagaagatagggtttgggaagaagacctggactttctgtgggaccccagaatatgtagctcccgaaataatactcaacaaaggccatgatatttccgccgattactggtctcttggtattttgatgtatgagctgctgaccggtagccctccattcagcgggccagacccgatgaagacctacaatataatcttaaggggaatcgatatgattgagtttcccaagaagatcgctaagaacgccgccaacctaataaagaagctttgccgagataatccgagtgaacggctgggcaacctaaaaaacggtgtgaaggacatacagaagcacaagtggtttgagggctttaactgggagggattacgcaaaggaaccttgaccccacccattattccaagtgtggcctctcccactgacacaagtaatttcgatagtttccccgaggataacgatgagcctccaccggacgacaattctggttgggacatcgacttttag

SEQ ID NO: 130606 - DNA, 2016 bp, Artificial Sequence
  Description of Artificial Sequence: Synthetic coding sequence
atgtcagagctagaagaagatttcgccaaaattttaatgttaaaggaagagagaattaaagaactggagaagcgtttgtcagaaaaagaggaggagatacaggagctgaaacgcaagcttcataagtgccaatccgtgctcccggtacccagcacgcacatcggacctcggaccactagagcccagggcattagtgccgagccccagacataccggtcattccacgatctgcggcaagcttttaggaagtttactaagtcagaaaggtccaaggacctcatcaaggaggccattcttgataatgattttatgaagaatctggagctgagccaaatacaggagattgtcgactgtatgtatcccgtggagtacggtaaagattcctgtattattaaagaaggcgatgtcgggtccctggtttacgtcatggaggacggaaaagtcgaggtcacaaaggagggagtgaagttgtgtactatgggaccaggcaaggtttttggcgagttagctattttgtacaattgcactaggaccgcaacagttaaaaccctggtgaacgtcaagctatgggcaattgacagacagtgttttcagacaattatgatgcgtacaggtttgatcaagcacaccgaatacatggagttcctgaagtccgtgcccacgttccagagccttccagaagaaattctttcgaagctggcagatgtgttagaggaaacccactacgagaatggcgagtatattatccgccagggtgcacgtggagacacattcttcataattagtaagggaaccgttaatgtgactagggaagattcccccagtgaggatccagtgtttctacgtactctgggcaagggggactggttcggcgagaaagccctgcagggggaggacgtgcggacggcaaacgtcattgcagccgaagccgttacctgcctagtcattgatagggattccttcaagcatttgatcggtggcctcgatgatgtctccaataaggcatatgaggacgccgaagctaaggcaaaatacgaggccgaagctgcctttttcgccaatttgaaactctcagactttaatatcattgataccctgggcgtgggaggtttcggccgagtggagctcgtgcaactgaaatcagaagagtcaaaaaccttcgccatgaagattctgaagaaacggcacattgttgatacgcggcagcaagagcatattaggagcgagaaacagatcatgcaaggagcacatagcgacttcatcgtgaggctttataggacgttcaaagattccaaatacctctacatgcttatggaggcttgtcttggaggagagctgtggacgatcttgcgtgataggggatccttcgaggacagtacaactagattttacacggcatgcgtcgtggaagccttcgcatacctgcactccaagggaattatttatagggatttaaagcctgaaaacctgattttagatcaccgcggctacgccaaactagtcgacttcggatttgcaaaaaaaatcgggttcggtaagaagacctggaccttttgcggtaccccagaatacgtggccccagaaattatcttgaataagggccatgacatctctgcagattattggagtctaggaatactaatgtatgagctgctgacggggtctcctcccttcagtggccccgatcccatgaagacttacaacatcattctgagaggcatagatatgatcgagttcccaaagaaaattgccaagaacgcagctaacctgataaaaaagttatgccgcgacaaccctagtgagcggctgggcaatctcaaaaacggcgtgaaggacatacagaagcacaagtggttcgagggcttcaattgggagggactcagaaaaggcaccctgacaccacccattattccgagcgtggcctcacccacagacacaagtaacttcgactccttccccgaggacaacgatgaaccgcccccagacgacaactccggttgggacattgatttttag

SEQ ID NO: 130607 - DNA, 2289 bp, Artificial Sequence
  Description of Artificial Sequence: Synthetic coding sequence
atgggaaatggctcagtgaagccgaagcacagcaaacatccagatggtcactctggcaacctgactactgacgcgctgcgcaacaaggtgacggagctggagagggaactgagaagaaaagatgcagagattcaagaacgcgagtatcacctaaaagagctgagagagcagctgagtaaacagactgtagccattgccgagcttacagaggagttacagaataagtgcattcagttgaacaaattacaggacgtggtgcacatgcagggcggctcccctcttcaggcatctcccgataaagtgcccctggaagtccatagaaagacctctggtctggtgtctctgcatagccggcgcggcgccaaagctggagtgagtgctgagcccacaacccggacctatgacctcaacaagcccccagagttcagcttcgagaaggcacgcgttcgcaaggacagctctgaaaaaaaactgataaccgatgccctcaacaagaatcagttcctgaaaaggctggacccccagcagatcaaagatatggtggagtgcatgtatggtaggaattaccagcagggctcctacatcatcaagcagggtgaacctggcaaccacatcttcgtgcttgctgaaggcaggctggaagtgttccagggcgaaaagctcttgagctctatcccaatgtggaccaccttcggagagctggccatcctttataattgcactcgcaccgcctccgtgaaggctattaccaatgttaagacctgggccctggatcgggaggtgtttcagaatatcatgcggaggacagctcaggcaagggatgagcagtacagaaacttcctccggagtgtctccttgctgaaaaacctccctgaagacaaactgacaaaaatcatcgattgcttagaggtcgagtattacgataagggcgattatataattagagagggagaggaagggtctactttctttatactagccaaaggcaaagttaaagttacgcaaagcaccgagggccacgatcagccgcagctcatcaagacactgcagaagggggaatacttcggggagaaggctctgatctcagatgatgtgcgtagcgcaaatataatagctgaagagaacgacgtagcttgtctcgtgatcgatcgcgaaacattcaaccagacagttgggacgttcgaggagctgcagaaataccttgaagggtacgtcgctaacctgaaccgcgatgatgaaaagagacatgcaaaaagaagcatgagtaactggaagttgtctaaagctctgagcctcgaaatgattcaactgaaggaaaaagtggcccgtttttcttccagcagcccattccaaaatctggagattatcgccactctcggagtgggcggttttggtagggttgaactcgtgaaggtcaaaaatgagaacgttgcgttcgcaatgaagtgcattagaaaaaagcacattgtggacactaagcaacaggagcatgtttactcggaaaaacgaatcctcgaagaactgtgttcacctttcattgtgaaactatacagaactttcaaagacaataagtacgtgtatatgctgttggaagcatgtctgggaggggaactctggtcaattctacgagatcgtgggtcttttgacgagcccaccagtaaattttgtgtggcctgtgttacagaggcatttgattacttgcaccggctcgggattatttacagagatctcaaaccagaaaacttgatcctagacgccgaaggatacctgaagctggtggatttcggatttgccaaaaaaatcggttcaggacagaaaacctggaccttttgtggcactcctgaatacgtagctcctgaagtgatcctgaacaagggccatgatttctctgtggacttttggagcctgggcatcctggtgtatgaactcttgaccggaaacccaccctttagtggcgtggaccaaatgatgacatataacctgattctaaaaggtattgaaaaaatggactttcctcgcaaaattacacgcagacccgaggacctgatcagaagactgtgtcgacaaaaccccaccgagagactcgggaatctgaagaatggaatcaatgatataaaaaagcataggtggctgaacggcttcaattgggaaggactaaaggcacgttcccttccaagtcctctgcaaagggaactgaaggggcctatcgatcacagctattttgacaagtaccccccagaaaagggcatgccgcccgacgagctgtccggctgggacaaggatttctag

SEQ ID NO: 130608 - DNA, 2289 bp, Artificial Sequence
  Description of Artificial Sequence: Synthetic coding sequence
atgggcaatgggtccgtgaaaccaaaacactcaaagcatcccgatggccactctggtaacctaacaacagatgccttgcgaaataaggtgaccgaactggagcgtgaactgcgcaggaaagacgccgagatccaagagcgcgagtaccatctcaaagaattgagggaacagctgtcaaaacaaaccgttgccatcgccgagctgactgaggagctgcagaataaatgcatacagttaaacaaactgcaggatgtggttcacatgcaaggggggtcaccactgcaagcctcccccgataaggtcccattggaggtacatcgcaagacatccggcctggtttctctacacagccgccgcggggccaaggcgggcgtctctgcagaaccgaccacaagaacatacgacctcaacaaaccacccgaattttcttttgagaaggctcgggtgagaaaagatagctctgagaagaagctgatcactgacgcactgaacaaaaaccagttcctgaaaaggctcgacccccagcagattaaagatatggttgagtgcatgtacggacggaattaccaacagggctcatatattatcaagcagggcgaacccgggaatcatatctttgtccttgcagaaggacgattggaggtgttccagggggaaaagctcctctcctcaattcctatgtggacaacattcggagagctggccattttatataactgcacccgtactgccagcgtgaaagcaattacaaatgtgaagacatgggctctggatcgtgaagtctttcaaaatataatgagaaggacagcccaagcccgagatgagcagtataggaattttcttagatccgtctctctcctgaagaacctacccgaggataaactaaccaagattatcgactgcttggaagtggagtattatgataagggagattatatcatccgagaaggagaggagggctcaacattttttattttggccaaaggaaaagttaaggtaacacagagcactgaaggtcatgaccagccccagctgatcaagaccctgcaaaagggagaatacttcggagaaaaagcgctgatctctgacgatgtaaggagtgccaatattatcgctgaagagaatgatgtagcgtgccttgtgatcgatcgcgagacatttaatcagaccgttggaacatttgaagaactccagaagtacttggaggggtacgttgctaacctgaaccgcgacgatgagaagcggcatgccaaacgctctatgagcaattggaagttgtcgaaggccctgagcttggagatgatacagctgaaagagaaagtagccagattcagcagctctagcccgttccaaaatcttgaaatcatcgcgacccttggagtaggcggatttgggagggtggaattagtaaaagtgaagaacgagaacgtggctttcgctatgaaatgcatccggaagaaacatattgtggacactaagcagcaagaacatgtgtattctgaaaaaagaatcctggaagaattgtgttctccctttatagtaaaactgtacagaaccttcaaggacaacaagtacgtgtacatgttgcttgaagcctgtctggggggcgaactgtggtctattcttagagaccgcggcagtttcgacgaacccacctccaagttttgcgtagcttgtgtaacagaggcatttgattacctacatagactgggcatcatttatagggacctgaagcccgaaaacctgatcctggacgccgaaggttatttgaaactggtggatttcgggttcgctaagaaaattggatccggccagaagacctggacgttctgtggaacccccgagtacgtggcgcccgaggtaatcttgaataaaggacacgatttttccgtcgacttctggtctcttggaatccttgtatatgaattactgactggcaatcctccatttagtggggttgatcagatgatgacctataatctgattctgaagggtattgagaagatggattttccgcgtaaaattactaggagacccgaggatctgattagaaggctgtgccggcagaatcccaccgaacgcctaggcaatctcaaaaacggcatcaacgacataaaaaaacaccgctggctgaatgggttcaactgggaaggtcttaaagcccgcagtttgccctctcctttgcagcgggagctcaagggccctatagaccatagctatttcgacaagtaccctccagagaagggcatgcctccagacgagctgagcggatgggacaaagacttctag

SEQ ID NO: 130609 - DNA, 2202 bp, Artificial Sequence
  Description of Artificial Sequence: Synthetic coding sequence
atgggcaatggctccgtgaagcctaaacattccaaacaccccgatggacactctggcaatttaactaccgacgctctccgtaataaggtgactgagctggaacgggaactgcgtaggaaagatgcagaaatacaggagcgcgaataccatctcaaagagttacgggaacaattgagtaaacagaccgttgctattgctgaattaaccgaagagctgcagaacaaatgcattcagttgaataagctccaggacgtggtgcacatgcagggtggtagtccgctccaggcttcgcccgacaaggtaccactcgaagtgcacaggaaaacatcaggcctggtgagccttcattctcgcagaggcgcgaaagcaggcgtgagtgccgaaccaacaaccaggacctatgatctgaacaagccaccagaattttccttcgagaaagcccgcgtccggaaggattcatctgaaaagaagttgattaccgacgctctgaataagaatcagttccttaagcgccttgacccccagcagattaaggacatggtcgagtgcatgtacgggaggaactatcaacaagggagctacattatcaagcagggcgaaccaggcaaccatatcttcgtcctggccgaggggagactggaagtgttccagggcgagaaattgctctcgagcatccctatgtggacaacatttggcgaactcgcgattttgtataattgtacccgcaccgcttctgtgaaagcgatcaccaatgtaaagacatgggcactcgatagggaggttttccagaacatcatgcgaaggacagcacaagctcgggacgagcagtatagaaactttctgcgatccgtatccctactcaaaaacctgccagaggataaattaactaagattatcgactgtttggaggtcgaatactatgacaaaggagactatattataagagaaggcgaggaagggagtaccttcttcattttggccaagggaaaagtgaaggttacacagtctactgaaggccacgatcagccacagctgatcaaaaccctccagaagggtgagtactttggcgaaaaggctcttatctctgatgacgtgaggtctgctaacattatcgccgaggagaatgatgtcgcttgcttggtgatcgacagagaaacgtttaatcagaccgttggcacatttgaggaattgcagaaatatctggagggctacgtggctaatctgaacagggatgatgagaagcgccacgcaaagagaagtatgtcaaactggaagctctctaaagccttgtcgttagagatgatccaacttaaagaaaaggtgaaagtgaagaatgaaaacgtggcctttgcgatgaagtgcattcgaaagaagcacatcgttgacaccaagcagcaggagcacgtctatagcgaaaagagaatcctggaggaactttgctcacccttcatagtgaagttgtatagaacgtttaaagacaataagtatgtttacatgctcctggaggcatgtttagggggcgagttatggtcgattcttagggatagaggcagcttcgacgagccgaccagtaagttttgtgtggcttgcgtcaccgaagccttcgactacctccataggctcggaatcatatatagagacctcaaacctgagaatctgatcctcgatgcggagggttacctgaagctagtggattttggctttgccaaaaagattggcagcgggcagaagacatggactttctgtggcacaccagagtacgttgcccctgaggtgatccttaacaaagggcacgatttttccgtcgatttctggtcgctgggaattttagtgtatgagctcctgacagggaacccccccttcagtggcgttgaccagatgatgacatacaaccttatcttgaagggtatcgagaaaatggatttcccccggaaaatcacacgacggccggaggacttaattaggcggctatgtcgccagaacccaaccgaaaggctgggcaacctgaagaatggaatcaacgacatcaagaagcacagatggctgaatggtttcaattgggaaggactgaaagcccgttctctgcctagccctctgcagagagagctgaaagggcctattgaccacagctattttgataagtacccacccgaaaaagggatgcccccggacgagctgagtggttgggacaaggatttctag

SEQ ID NO: 130610 - DNA, 1029 bp, Artificial Sequence
  Description of Artificial Sequence: Synthetic coding sequence
atgagcaactggaaactctccaaggcgttaagcctggaaatgatccagctcaaagagaaggttgcacggttctcgtccagtagtccgtttcagaacctcgaaatcattgcaaccttgggtgtgggcgggtttgggagggttgaactggtgaaggtgaaaaacgagaatgtagcatttgccatgaaatgcataagaaagaagcatatcgtcgatactaagcaacaggagcatgtctactctgagaagagaatcttagaagagctgtgctccccttttatagtcaaactctaccgcaccttcaaggacaacaaatacgtttatatgttactggaggcctgtctcggaggcgagctgtggagcatcttgagggacaggggcagctttgacgaacctaccagcaaattctgtgtggcgtgtgtcactgaggccttcgattacctccaccgcttgggcatcatctatcgagacctcaaaccagaaaacctgattctggatgcggaagggtacctcaaattggtggactttgggtttgccaagaaaataggatccggccaaaaaacgtggactttttgcgggactcctgagtacgtggcacctgaagtgattcttaataagggtcatgacttttcagtggacttctggtctttgggcatccttgtgtatgaattactgactggcaatccacccttcagcggcgtcgatcagatgatgacttacaacctcatcctgaaaggaatagaaaaaatggacttccccagaaagattaccagaaggccagaggacctgatccgacgcctgtgtcggcagaatcccaccgagcgcctgggcaacctgaagaacggaattaacgacatcaaaaaacaccgctggttgaacggttttaattgggagggcctcaaggctcgatccttgccatcccctctgcagcgagagctgaaagggcccatcgatcactcatactttgataagtacccacctgagaaggggatgcccccagatgagttaagcggctgggacaaagacttttag

SEQ ID NO: 130611 - DNA, 942 bp, Artificial Sequence
  Description of Artificial Sequence: Synthetic coding sequence
atgagtcagtcgcgccaccgcgccgaggcacccccactagaacgcgaggactccggtacatttagcttgggtaaaatgatcactgccaagccaggtaagacaccgattcaggtcttgcatgaatatggaatgaagactaaaaacatccccgtgtacgagtgtgaacgatctgatgtccagatacacgtgcccacattcacttttagagtaacagtaggtgacattacttgcacaggggagggtacctctaagaagttggctaagcatagagcagccgaggccgccataaacattctcaaggcaaatgcctccatttgctttgcagtgcccgaccctctgatgcctgatccctccaaacagccgaagaatcaacttaacccgataggcagcctgcaagagctcgccatacaccatggctggaggttaccagagtatactctttcacaagagggaggccccgctcataaaagggaatacaccacaatttgtcgacttgagagttttatggagactggaaaaggggcttcaaaaaaacaggctaaaaggaatgccgcagagaaattcctggctaagttttcgaacatttcccccgagaaccacatctccctgaccaatgtcgttgggcatagcctgggctgcacatggcactccctcaggaattcaccaggcgagaaaatcaacctgcttaaacgtagtttgctgtcaatcccaaacacagactatattcaattgttgtcagagatagcaaaagaacagggttttaacattacataccttgacatcgatgagctcagcgcgaacggacagtaccagtgcctcgctgagctgagtacgagtcccattactgtctgtcacgggtccggcattagttgcggcaatgcacagagtgatgctgcacataacgccctgcaatacctgaaaattatcgcagaaaggaagtag

SEQ ID NO: 130612 - DNA, 909 bp, Artificial Sequence
  Description of Artificial Sequence: Synthetic coding sequence
atgcaatctaccccattctgtggtttctgttcactgggaaaaatgatcacagctaagcccggcaagacgcctatccaggtgctccacgaatacggaatgaaaacgaagaacatacccgtttacgaatgcgagcgttctgacgttcagattcacgtcccgacttttacatttcgagtgaccgtgggagacataacgtgcactggcgagggcacttccaaaaagcttgcgaaacaccgggcggcagaagcagccatcaacatactgaaggcaaatgcctccatatgcttcgccgtgcctgaccccttgatgcccgatccatcaaaacagcctaaaaaccagcttaatcccataggatctctacaggagctggcaattcaccacggatggagacttcccgaatacacactatctcaggaaggcggaccagctcataagcgggagtatacaactatttgccgactcgagagctttatggagacaggaaaaggggcctcaaagaagcaggccaaaaggaatgccgccgagaaatttctagcaaaattcagtaatatcagtccggagaaccacatatccttgaccaatgtggtcggacactcacttgggtgcacttggcattctcttcggaatagccccggcgagaagatcaatcttcttaaaagatcccttctgtccattcccaatacggactatattcagcttttaagcgaaattgccaaggagcagggttttaacattacatatcttgatattgacgagctctccgcaaacggccagtatcagtgtctcgctgaactgtctacctctcccatcacggtttgccatggcagcggaataagctgcgggaacgcacagagcgatgctgcccacaacgccctacagtatttgaagattattgccgaacgcaagtag

SEQ ID NO: 130613 - DNA, 603 bp, Artificial Sequence
  Description of Artificial Sequence: Synthetic coding sequence
atgccggatccctctaaacagcctaaaaaccagctgaaccccattggttccttgcaggaattggcgattcatcacggctggcggctccctgagtatacattgtctcaggaggggggaccagctcataaaagagagtacacaacaatttgcagactagagtcgttcatggagacaggcaagggcgcctctaaaaagcaggccaaacggaacgccgctgagaagttcctggccaagttttctaatatctcgcctgaaaatcacatatcactgacaaatgtggtcggccatagtctaggatgcacttggcactccctgcgtaattcacctggggaaaagatcaacctgctcaagcgctcccttctcagtatcccaaacacggattacatccaactgctgtctgagatcgctaaagagcagggctttaacatcacatatttggatattgacgagctgtcagcaaacggccaatatcagtgtctggctgagctgtcgacctcccccatcaccgtttgtcatgggtctggaattagctgcgggaatgcacaatccgatgctgcccacaatgcactgcagtatctgaagattattgctgagagaaaatag

SEQ ID NO: 130614 - DNA, 867 bp, Artificial Sequence
  Description of Artificial Sequence: Synthetic coding sequence
atgattaccgctaagcccggcaagaccccaatacaggtgctccatgaatatggaatgaaaacaaagaatattcccgtttacgaatgtgaaagatcggatgtccagattcatgtcccaacatttacgtttcgagtaacagtgggtgacattacttgtactggtgagggcacatccaaaaagctggccaagcaccgggctgctgaagctgccatcaatatcctgaaggccaacgcctcaatttgctttgctgtccctgatcccctgatgccggatccgagcaaacagcctaaaaaccagttgaaccccattggtagcctgcaggaacttgctatccaccatggttggcgattgcccgagtataccttgtcccaggaaggaggacccgcgcataaaagagagtacaccaccatctgtcgtttggaatcgtttatggagactggcaaaggcgcttctaagaaacaggcaaagcgtaacgcagctgagaagtttctggccaagttcagcaacattagccccgaaaatcacatctccctgaccaacgtcgttggtcactccctcggttgcacttggcactctcttagaaattcgccgggtgaaaaaatcaacttactcaagaggtcactgttgagcatcccgaacactgattatatacagctgctctcagagatagcaaaggagcagggttttaatattacctacctagacatagacgaattatccgccaacggccaataccaatgcttggcagaactcagtacgagcccaattacggtttgccatgggagcgggattagttgtggcaatgcccagagcgacgccgcacacaatgccctgcagtatctcaagatcatcgccgagcgcaaatag

SEQ ID NO: 130615 - DNA, 1077 bp, Artificial Sequence
  Description of Artificial Sequence: Synthetic coding sequence
atggaggccccagggttggctcaggccgccgctgccgaatcagactctaggaaggtcgcagaggaaacgccagatggcgctcccgctctgtgtccatcgcctgaagcattgagtcctgaacctcccgtctattcactccaggatttcgatacactcgccacagtgggaacaggtactttcggcagagtgcacctggtaaaggaaaaaaccgctaagcacttcttcgcgctcaaagtaatgtcaatacccgacgttatccgcctgaagcaggaacagcatgtgcacaacgaaaaatccgttcttaaagaggtttcccatccattcctgatccggcttttctggacctggcatgatgaaagattcctctacatgctgatggaatacgtccccggtggtgagcttttcagttatcttagaaatcgaggaagattcagctctactactggccttttctactcagcggaaattatttgcgccatcgaatacttgcactcaaaggagatcgtctaccgcgacctgaaacccgagaacattctgctggacagggatggacacatcaagctaacggactttggctttgccaaaaaactggtggaccggacatggacgttgtgtggaacgccagagtaccttgcccccgaagtcattcaatccaagggacacggccgggctgtagactggtgggctctaggaattctcatatttgagatgctgtctggctttccacccttcttcgatgataacccattcgggatatatcaaaaaatcctggctgggaaaattgactttcctcgccatcttgattttcatgtgaaggatctaatcaaaaaattgctggtagtggatcgaacaagaagactgggcaacatgaagaacggcgcaaacgacgttaagcaccaccgctggttccgctctgtggactgggaggcggtgccacagagaaagctcaagccccccattgtccccaaaattgcaggcgacggggatacctccaacttcgaaacatacccagagaatgactgggacaccgctgcccccgtgcctcagaaggatctggaaatcttcaagaatttttag

SEQ ID NO: 130616 - DNA, 1983 bp, Artificial Sequence
  Description of Artificial Sequence: Synthetic coding sequence
atggacgattggaagccatctcctcttattaaaccattcggggcacgcaaaaagcgttcttggtatctaacttggaagtacaagctgacaaaccaacgagcgctgagaagattctgccaaacaggggccgtactgtttttactggtcacagtcattgtgaacatcaaactcatactagatactcggcgggccatctcggaggccaacgaagaccctgagcccgaacaggactatgacgaagctttagggagactggagccacccagacggagaggttccgggccgaggcgagtgttagacgttgaggtgtacagttcccgatccaaagtgtatgtcgcagtggatggcactaccgttcttgaagacgaagcccgggagcagggtcgcggcattcatgttattgttctgaatcaggccacagggcacgttatggcaaaacgcgtgtttgacacgtattccccccatgaggacgaggcaatggtcctgtttcttaatatggtggccccaggacgcgtgttaatctgtaccgtgaaagacgagggcagtttccaccttaaggatactgccaaagcgctgctacggtcattggggtcccaggctggccctgccttagggtggcgggatacatgggctttcgttggtcgtaaaggtggacccgtattcggcgagaagcacagtaagtcgccagccctgtctagctggggagacccggtcttactgaagaccgacgtgcccctgtcttcagcagaggaggccgagtgtcactgggccgacacagagcttaatcgacgtcgcaggaggttttgctccaaagtcgagggctacggttctgtctgttcctgcaaggaccccacccccatagagttctctcctgaccccctcccagataataaagtgctgaacgttcctgtcgcggtgattgccggcaaccgaccaaactacctttatcgcatgctcagaagtttgctgagcgcccagggggtgagtccccagatgattacagtctttattgacggttactacgaggaacctatggacgtcgttgcactgtttggcctgaggggaatacaacacacccccatctcaatcaaaaatgcccgtgtctcacagcactacaaagcaagcctaacggctacctttaatctttttcccgaggcaaaattcgccgtggtcctggaagaggaccttgacatcgcagtcgatttcttctcgtttcttagtcaatctatccacctgctcgaggaggatgactccctgtactgtataagtgcatggaatgatcaggggtacgagcacactgcagaggatcctgctctcttgtatcgtgttgaaaccatgccgggcctgggttgggtattgcggcgcagcttgtacaaggaagaattagaacctaaatggccgaccccagagaagttgtgggactgggacatgtggatgagaatgccggagcagaggagagggcgcgagtgcatcattcctgacgttagtcggtcatatcactttggtatcgtcgggctcaacatgaacggttatttccacgaggcctacttcaagaagcacaaattcaataccgtgcctggggttcagctgcgaaatgtggactcacttaagaaagaggcctacgaagttgaagtgcataggctgctgtccgaagctgaggtgttggatcatagtaagaatccctgcgaggattctttcttacctgatacagaggggcatacttacgtcgcctttatcagaatggagaaagatgacgattttacgacctggacccagttagctaaatgcctgcatatttgggacctggacgtgcgtgggaatcaccgtggcctgtggcgcctctttcgcaaaaaaaatcacttcctgatggtcggcgtgccagcttccccatatagtgtcaagaaaccccctagcgtgacccctatttttcttgagccaccgcctaaagaggagggcgctcccggtgctccagagcaaacttag

SEQ ID NO: 130617 - DNA, 2247 bp, Artificial Sequence
  Description of Artificial Sequence: Synthetic coding sequence
atggacgattggaagcccagtccactgattaaaccctttggcgctcgtaaaaagaggagctggtatctgacgtggaagtataagctgaccaatcagagggcccttcgcagattctgtcagactggtgctgttctgttcctactcgtcacagtgatcgttaacattaagttgattctcgacacaagaagagcaatcagcgaagccaatgaggatcccgagccagagcaggactatgacgaagctctggggcgcctggagccccccagaaggaggggatccggacctcggagagtgctggatgtcgaagtgtactcctctcggagtaaagtctatgtggccgtcgacggtactacagtattggaggacgaagccagagaacaagggcggggaattcatgtgattgtgcttaatcaggcgacaggacacgtgatggcaaagcgtgtctttgatacatactctcctcacgaggacgaagctatggttctcttcctcaacatggtggctcctggaagagttctgatctgcacggtgaaagacgagggatcgtttcacctgaaggataccgccaaggcactgctgagaagcctaggtagccaggccggccctgcactgggttggcgggacacttgggcattcgttggtagaaagggggggcccgtgttcggagagaagcacagtaaatcaccagccctttccagctggggggacccagttctgctcaagacggacgtgccactgagcagcgccgaggaggctgaatgccactgggctgataccgagctgaacaggcgtaggaggcgattttgctctaaggtggagggctacggtagtgtgtgcagttgcaaggatccaactccaatagagttcagcccagaccccctgccggacaacaaggtcctgaatgtgcctgtggctgtcatcgctggcaatagacccaactatttatacaggatgctcaggagtttgctgagtgcgcagggtgtgagcccccagatgatcacagtgtttattgatgggtactatgaggagcccatggatgttgtggcactctttggcctgcgtggtatccagcacacacctatcagcattaagaacgcgcgggtgagccagcattacaaggcctcccttaccgccaccttcaacttatttccagaggccaaatttgcggtagtcctggaagaggacctggatattgcggtcgattttttttcatttctgtcgcagagcattcacctgcttgaagaggacgacagcctctactgcatctctgcttggaacgaccagggatatgaacacacagcagaagaccccgccctgctatacagggtcgagactatgccggggttaggctgggtgctccgccggtcactatataaagaagaactcgagcccaagtggcccacccccgagaaactctgggattgggatatgtggatgcggatgcctgagcagaggagggggagagagtgcattatcccagacgtttcaagaagctatcattttggcattgtgggcctgaatatgaatggatatttccacgaagcctattttaagaaacataaattcaacaccgtgccaggcgttcagctacgcaacgtcgactcactgaagaaggaggcttatgaggtggaagttcatagactactttccgaggcggaggtgctggatcattctaagaatccatgtgaggattctttccttcctgataccgaaggccatacttatgtcgcatttatacgcatggagaaagatgacgacttcaccacctggacgcagttggcaaaatgtctacacatttgggacctggacgtcagaggaaatcaccgtggactgtggcgtctcttccgcaaaaagaatcacttcctgatgagcgaagaagccacactttcccaccctaatttccctggcgccacccccaaaggaggcggttctccccggtcccctcggaccgatatgcggcctcctcctgggccttgtggggcaggccccggcagcgagagtaacctatttattgattgtccagaggggcttgagaaccggccaaacctggagggactggatttctttttggggtggaatgcggcacttcgcgtcggccttgctcttacccaggagaccgccgtgcccaacccttggacaggtccagccggcgcccacatgttgacacagactcactcagaaacgttacgccactggaccagacctcctctgtctctgctttttgttcagatctctaaggcaggctag

SEQ ID NO: 130618 - DNA, 2247 bp, Artificial Sequence
  Description of Artificial Sequence: Synthetic coding sequence
atggacgattggaaacctagccccctaattaaacccttcggagcgcggaagaagagatcttggtacctcacttggaagtataagcttaccaaccaaagggctctgcggagattctgtcagaccggcgccgtgctgtttcttctggtcactgttatcgttaatatcaaactgatcctggacaccagacgtgctatttcagaggcgaacgaggatccagagcctgagcaggattacgacgaggctctgggaagactggagccgcccaggcgacgaggctccggcccgaggcgggtactcgacgtggaagtctacagttccaggtctaaggtgtatgtcgccgttgacggcactaccgtcttagaagacgaggcccgggagcaggggagaggaattcatgtgatcgtgcttaatcaggcgaccggccatgtgatggccaaaagggtgtttgacacctattctcctcatgaggacgaagcaatggtgctttttctgaatatggtcgcgccgggccgtgttttgatatgcacagtgaaggatgagggctcctttcacctgaaggatacagccaaagctctactccgctctttaggcagtcaggctggaccagccctcggctggagggacacttgggctttcgtgggtcggaaaggaggccccgtgtttggagagaagcattcaaagtcaccagccctgagctcatggggagatccagtgctcctgaaaaccgatgtaccgttgtcctccgccgaggaagcggagtgtcactgggctgatactgaactaaatcgaagaagaaggcgtttttgttctaaagtagagggctatggctccgtttgctcatgcaaggatccaaccccgattgaattcagccctgatccactgcccgacaataaggtacttaatgtcccagtggccgtgattgctggcaatcggcctaattacctgtaccggatgctgcgctccctgctctcagcccagggcgtgtctccccagatgatcacagttttcatcgacggctactatgaagagccaatggacgtggtcgccctcttcgggctgagaggaattcagcacactccgatctctataaaaaatgctcgtgtgtcgcaacactacaaggctagcctgaccgccactttcaacctgtttcccgaggctaagtttgcagtcgttctggaggaagacttggatattgctgtggatttcttcagcttcttaagccaatcaatacatttgctggaggaggatgatagtttatattgtatatctgcatggaatgatcaggggtatgaacataccgcggaagatcctgcactgctctatagggtagaaaccatgccagggctggggtgggtcctgaggcgatcactgtacaaggaagagctggagccgaaatggcctacacccgagaaactctgggattgggacatgtggatgaggatgcctgagcaaaggcgtggcagagagtgcattatcccagatgtgtcacgcagttaccatttcggcatcgtagggcttaatatgaatggctacttccacgaggcatactttaaaaaacacaagtttaacacggtaccaggggtacaactccgcaacgtggatagcctaaaaaaggaagcatacgaagttgaggttcacagactgctgtccgaggccgaggtcctggatcacagcaaaaacccctgtgaagactctttcctgcccgacaccgagggccacacatatgtcgcctttatccgaatggaaaaggacgatgacttcacgacttggacccagctggccaaatgtctgcatatctgggatctggacgtgagaggcaatcataggggcctttggaggctcttcaggaaaaaaaaccatttcctgatgtccgaggaagccaccctctcccacccgaatttcccaggcgccactcctaaaggaggtggctccccaagatcaccaagaacagatatgcgccccccaccaggtccttgtggagccggtccaggtagcgagtccaatctgttcatcgattgcccagagggtctcgaaaaccgccctaatctggaaggcctggactttttcctgggatggaacgccgccctcagggtcggcctggccctgactcaggagaccgccgtgccaaatccctggacgggcccagcaggggcccatatgctgacccagactcattcggaaactctgcgacattggacccggccccctctctcgttgctgtttgtccaaatctccaaggcgggatag

SEQ ID NO: 130619 - DNA, 603 bp, Artificial Sequence
  Description of Artificial Sequence: Synthetic coding sequence
atggatgactggaagccttcacccttgattaaaccatttggtgctcgcaagaaacgatcctggtatcttacatggaaatacaagctcacgaaccagagggcgctgcggcgcttctgccaaactggtgccgtgctgttccttttggtcaccgtgatcgtaaacattaaacttatccttgacactcgacgcgccatctcggaagccaacgaggatcctgaacccgaacaggattacgacgaagctctgggccgactagaacctcctcgtcggcgcggatccgggccaagacgtgtgcttgacgtagaggtttactccagcaggagcaaggtttacgtagccgttgatggaaccactgtcctcgaggatgaggctcgcgaacaggggcgtgggatacacgtgatcgtgctgaatcaagctaccggccatgttatggcaaagcgcgttttcgatacatactcaccacacgaggatgaggccatggtgctgtttcttaatatggttgcacccggtagagttctcatttgtactgttaaggttctttcaagtgggagaaatatcctgaaccatctgccctccttgcctgggggtactcagagctgctag

SEQ ID NO: 130620 - DNA, 1917 bp, Artificial Sequence
  Description of Artificial Sequence: Synthetic coding sequence
atggagggcacaaaggaaatcaaggtgtcgaacaggaggattcaggaacactggactggcgccgtgctcttcctcctcgtgaccgtcatcgtcaatataaaattgattctggacaccaggcgcgctatcagcgaagctaacgaagatcccgaaccagagcaggactacgatgaggcgctcggccggctggaacctcctcgacggcgagggtcagggccgcggcgcgtgctggatgtagaggtgtactccagcaggagtaaagtgtacgtcgctgtcgacggcaccactgtgcttgaggacgaagccagagaacagggcaggggtatccatgtaattgtacttaatcaggcaacaggacatgtgatggccaagcgcgtgttcgatacgtatagcccccatgaggacgaagctatggtcctgtttctaaatatggtggcacctggtcgggtgttaatctgcacggttaaggacgagggtagctttcacctgaaggataccgccaaagctcttctgcgctctctgggatcccaggccgggcctgccctaggatggagggatacttgggctttcgttgggaggaaggggggccctgtatttggcgagaaacactctaagtctcctgctctgtcttcttggggagaccccgtgctgttgaagaccgacgtcccactgagctccgcagaagaagccgaatgtcattgggctgacaccgagttaaacaggagacgcagaagattctgttccaaggtagaaggctacggctcagtgtgtagttgtaaggatccaacacctatcgaattttcacctgatcctctgccagacaataaggtgctaaacgttccggtggccgttattgctggcaacagaccaaactatctctatcgaatgctgaggtccttgcttagcgcacagggcgtttcccctcaaatgatcactgtgttcatcgatgggtactacgaagaaccaatggacgtcgtggctcttttcggactccgggggattcagcacaccccaatcagcattaaaaatgcgagagtgagccagcactacaaggcctctttgactgcaacatttaatctcttcccagaagccaagtttgctgttgtgctggaagaagatttagacatcgccgttgactttttctcctttctctctcagtccatacacctgctcgaagaggatgactctctgtattgtatctccgcatggaatgatcagggttatgagcataccgcagaggaccctgcattactttatcgggtggagaccatgccaggactcggttgggtattgcgaagaagcctatacaaggaagaattggaacccaaatggcctacccctgagaagttatgggattgggatatgtggatgagaatgccagaacaacggagggggcgagagtgcatcattcctgacgtgagccggagctatcacttcgggattgtggggctaaatatgaacggatactttcacgaggcatacttcaagaagcataagtttaatacagtgccaggagtccagctccgcaatgttgacagcttgaagaaagaagcttacgaggtggaagtacaccgtctactgtctgaagcagaggtattagatcatagcaaaaatccctgtgaggatagctttctaccagacacagaaggccacacttacgtggcttttattcgaatggagaaggacgacgacttcactacatggacacagttagctaaatgtctacacatctgggacctggatgtgagaggtaaccacaggggcctgtggagactcttcaggaagaaaaatcacttccttatggtcggggtgccagcttctccctacagcgtcaagaaacctccatctgtcactccgatctttttggaaccccctcctaaagaagaaggtgcgcctggagcccccgagcagacctag

SEQ ID NO: 130621 - DNA, 861 bp, Artificial Sequence
  Description of Artificial Sequence: Synthetic coding sequence
atgtccgattctgagaagctcaatctcgactcaattatcgggaggctcctcgagggggacatccatgggcagtattacgaccttcttcgccttttcgaatacggcggatttccccccgagagcaattacctcttcttgggcgactatgtcgatcgcgggaagcaatcccttgagactatctgcctgctgctggcctacaagatcaaatacccggagaatttctttctgttgcgcggtaaccatgagtgcgcatccattaaccggatttacggattctacgacgaatgtaaacggagatacaatatcaaactgtggaagaccttcacggactgctttaactgtctcccgattgctgccatcgttgatgaaaaaattttctgttgccacggcggcctcagtccagatctccagtcaatggagcagataaggcgaatcatgagaccaaccgacgtgcctgaccagggacttctttgcgacttattgtggtccgatcctgacaaggacgtgcagggctggggcgaaaatgatcggggtgtctctttcaccttcggagccgaggtggtcgcaaagttccttcataaacacgacttagacttaatttgcagagcccaccaggtggtggaagatggttacgagttctttgcaaagagacagctggttaccctattcagcgcacctaactactgcggcgagtttgacaacgccggcgcgatgatgtcagtggatgaaacccttatgtgcagctttcagattttaaagcccgcagacaagaataagggaaagtacggtcagttttcggggttaaacccgggcggaagaccaataacccccccgcggaactcagccaaagcaaaaaaatag

SEQ ID NO: 130622 - DNA, 1548 bp, Artificial Sequence
  Description of Artificial Sequence: Synthetic coding sequence
atggccgagttggagcatcttgggggcaagagggctgaaagtgctaggatgagacgggcagagcagctgagaagatggcgcggatctctgactgagcaagaacccgcagagaggagaggggctggcagacagcccctcacgcgccggggcagcccaagggtgcgatttgaagacggagccgtgttcctggcagcctgctcctctggagacacagacgaagttcggaaactcctcgctcgaggagccgatatcaacacagttaatgtagacggccttacggcactacaccaggcatgcattgatgagaacttggatatggtaaaattccttgttgagaatcgcgccaatgttaaccagcaagataacgagggctggacccccttacacgcagcagcctcctgtggatatctcaacattgcggagtactttatcaaccacggcgcctcggtgggaattgttaattctgaaggcgaggtaccctccgatctagcagaggagccagccatgaaggacctccttctggaacaggtgaaaaagcaaggagtcgatctggagcaaagtaggaaagaggaggaacagcagatgctgcaggatgccagacagtggttaaatagtgggaagatcgaagacgttcgacaggcccgaagcggcgccacagcgttacatgtggccgccgcaaaagggtatagcgaagtactgcgtctgctcatccaggcaggttacgagctcaatgtacaagattacgacggatggacccccctgcatgcagccgcacattggggtgtgaaggaggcgtgtagtattctcgcagaggctttgtgtgacatggatattaggaacaagctggggcagactcctttcgatgttgcagacgaaggcttggtagagcacctggagttactgcagaagaaacagaacgtgttgaggtctgagaaggaaactagaaataagcttatcgagagtgatctcaattcgaaaattcagagcggcttcttcaagaacaaagagaagatgctgtacgaagaagagacaccaaaatctcaggagatggaggaggagaacaaggagtcttccagctcctcaagcgaagaggaggagggtgaggacgaagcctcagagagcgagaccgaaaaagaagctgataaaaagccagaggcctttgtcaaccactcgaacagcgagagtaagagcagtattacagagcaaatcccggcaccagctcagaatacattctccgctagctcagccaggagattttcttctgggttatttaataaacctgaagagccaaaggacgaaagtcctagtagctggaggctgggccttcgtaagaccggcagccataacatgttgagcgaagtggctaacagtagagagcccattcgtgataggggcagcagcatttatcgatccagcagctctccccggatcagcgcattgctggacaacaaagacaaggtacagttcggtagagtgtgggggaatagtaaggccgtgttttttttccatgaaaactctattctgggcacaaacgaaaacattttttag

SEQ ID NO: 130623 - DNA, 4125 bp, Artificial Sequence
  Description of Artificial Sequence: Synthetic coding sequence
atgctaaaaaccgaatcttctggagagaggacaaccctgcggtccgcctcccctcatcgtaatgcttatcggactgagtttcaagccctcaaatccactttcgacaagcccaagtcggacggcgagcagaagaccaaggaaggtgaaggatcacaacagtcccgcgggagaaaatacggaagcaacgtaaatcgaataaaaaatctttttatgcagatgggcatggagcccaacgaaaacgctgcagtgattgccaagacgaggggaaagggcggccattcttcaccccaacgtcggatgaagcccaaagagtttctcgagaaaacggacggcagcgttgtgaaattggagtcttcagtgtcagagcgcatcagtcggttcgacaccatgtatgatggcccgagctactccaaatttaccgagactaggaagatgtttgagcgcagcgtgcacgaatcaggacagaataatcggtatagtcctaagaaagaaaaagccggcggctccgagccccaggatgaatggggcgggagcaagtcaaatcgcggctcaactgattccctcgatagtctgtcctccagaacagaagctgttagtcccaccgtgtcacagcttagcgccgtattcgagaatactgactccccatccgctatcatctccgagaaagctgagaataatgaatacagcgttacaggccattaccctctgaatcttccgtcagtcactgtcacgaacctggatactttcgggcacctgaaggactctaactcttggcctccctccaacaagcgaggagtcgataccgaagatgcccataagtctaacgcaacacccgtaccggaggtggcttcgaagtccacctccctggcatctatcccaggggaagagatccagcagtctaaagagccggaggactcaacttcaaaccaacagacacctgactccatcgataaagacggtcctgaggaaccctgcgctgagagcaaggccatgcctaagtccgaaatcccgagtccacagtctcagctccttgaagatgccgaggccaatctcgtcggccgcgaagcggccaagcagcagcgtaaggagttagcagggggcgacttcacatcgcctgacgcctcagcctcctcctgcgggaaagaggtgcctgaagattccaataactttgatgggagccacgtttatatgcattcggactacaatgtataccgggtgagaagtcgctacaatagtgattggggcgaaaccggcaccgagcaagatgaggaggaggattctgatgaaaatagttattaccaacccgacatggagtactccgagattgtgggactgcccgaagaagaggagatccccgcaaatcgcaaaatcaagttttcctctgctccgattaaagttttcaacacctactctaacgaagattacgaccggaggaatgacgaggtggacccagttgcagccagcgccgaatatgagcttgagaaacgcgtggagaagctcgagttattcccagtcgaattggaaaaagatgaggacgggctcggcattagcatcataggcatgggagtcggagccgacgccgggctggagaagctggggattttcgtgaagacagtgacagaaggtggagctgcacaacgggatgggcggatacaggtaaatgaccagatagtggaggtcgacgggatctcccttgtcggcgtgacacagaactttgcggcaactgtgcttcggaacactaagggtaacgtccggttcgtcattggcagagagaagcccgggcaagtgtcagaggtggcccagctaatcagccagacattggagcaagagcggaggcaacgtgagttgttggaacagcattatgcacagtacgacgctgatgatgacgaaaataccgttgccgagcttcagggaatgagcggcaactgcaataacaacaataattactttttgaaaactggcgagtacgccaccgacgaggaggaagatgaagtagggcccgtgcttccaggaagcgacatggctatagaggtgtttgaactccctgaaaatgaggatatgtttagcccgagcgaactagatacgagcaagctaagccataaattcaaggaactccagattaagcacgcagtgactgaagctgagattcaaaagttaaagacaaagttacaagcagccgagaatgagaaggtaaggtgggaactagagaaaacccagctgcagcaaaacattgaggaaaataaagaacgcatgcttaagctagaaagctactggatcgaggcccagaccctctgccacacggttaacgagcaccttaaggaaacccagtcccagtaccaggccctggagaaaaagtataacaaggcgaagaagttaataaaagattttcaacagaaggaactggatttcatcaagaggcaggaagccgaaaggaagaagatcgaagacctcgaaaaggctcatcttgtagaagtgcagggcctgcaggtgcgaatccgcgatttggaggctgaagtgttcaggctcctgaagcagaatggaacccaggtgaataacaataataatatttttgaacgtaggacctcactgggcgaagtgtccaaaggcgacacaatggagaacctagatggcaagcaaacgagctgccaagatggactcagccaagacctgaacgaggcggtgccagagaccgagcgtcttgactctaaagctctcaaaaccagagcccaactcagcgtcaagaatagaaggcagcgacccagccgcactcgactgtatgacagtgtaagctccaccgatggggaagattcattggagcgcaagccctccaattccttctataatcatatgcacattacaaaactcctgcctccaaagggactgagaacctccagccccgagagtgactctggcgtgcctccactgactcccgtagatagcaatgtgcccttttcttcagatcacatcgctgagttccaggaggagccactcgatcctgagatgggcccactgtcaagcatgtggggtgacacatctctgttctcgacatctaagtccgaccatgatgtcgaagagtctccttgtcaccatcagacaacgaacaagaaaatcctgagagagaaagatgacgcaaaggatccgaagagcttgagggcaagctcatccctcgcggtgcaagggggaaaaatcaagaggaagtttgtggacctcggtgcgcctttgaggcggaacagtagtaaaggcaagaaatggaaggaaaaagagaaggaggcatctcgcttcagtgctggttctaggatcttccgcgggaggctggagaactggacccctaagccttgcagcactgcacagacctccacgcgatcaccgtgtatgccctttagttggttcaacgatagccgtaaagggtcctattccttccgtaacctaccggcacccacttcttcactgcagcccagtccagaaaccttgatctcagacaaaaaaggaagcaaagtggagaacacctggatcacaaaagctaataagcgtaatccaaatccatcatcttcaagtatcttcggaaggcattctcagctcatgtccgtagtatggatccaggagacgaacaactttacttttaacgacgacttctccccttcatctacctcttccgctgacctaagcggtcttggggctgaacccaagactccagggctgtcgcagtccctggctttgagcagcgacgagattttggacgacggtcagtctccgaagcactcacaatgccagaatcgagcagtgcaagagtggagcgtgcagcaggtcagccattggttaatgagtctgaacctggagcaatatgtctccgaattctccgcccagaacattacaggcgagcagctgctgcaactcgacggcaataagcttaaagcactgggtatgaccgcctctcaggatcgcgccgtggtcaaaaaaaagctgaaagagatgaaaatgtccctagaaaaggcccgaaaggctcaggaaaaaatggaaaaacaacgcgaaaagctgcgaaggaaggagcaggagcaaatgcagcgtaagtctaagaaaactgagaaaatgacatcaacaaccgccgagggagctggagagcagtag

SEQ ID NO: 130624 - DNA, 1026 bp, Artificial Sequence
  Description of Artificial Sequence: Synthetic coding sequence
atgagtgacagcgagaaactgaacctggacagcatcatcggaagattgctagaggggagccgggtgcttacaccgcattgtgcccccgtacagggctccaggcccggaaagaatgtgcagttgactgagaacgagattcggggactatgcctgaaaagccgcgagatctttctcagtcaacccatccttttggagttggaggctccacttaagatttgcggagatatccacggacaatattacgacctgcttaggttgtttgagtacggcggattcccacctgaaagcaactacctgttcctaggagactacgtggaccgcggcaaacaatcccttgaaactatatgcttgctactggcttacaaaatcaaataccctgagaacttcttcctgctgagaggcaaccatgagtgcgccagtattaaccgcatctatggcttctacgacgaatgcaagcgtcgctacaacataaagctatggaaaacatttactgactgcttcaattgtctgcccatcgctgctatcgtcgatgagaaaatcttttgttgccacggcggtttaagcccggatctacagtccatggaacagatcagacgtattatgagaccgactgacgtcccagaccagggcttgctttgcgatttgctgtggagtgacccagataaagacgtgcagggttggggcgaaaacgatagaggagtcagctttacattcggtgcagaagtagtcgcaaagtttctacataaacacgatctggacctgatttgtagagcacaccaggtcgtggaagatggatatgaatttttcgccaaaaggcaactagtgactctgttctctgcccctaattactgtggcgagttcgacaatgcgggcgctatgatgtccgtggacgagactctgatgtgtagtttccagatcctcaaacctgcagacaagaataagggcaaatatgggcagtttagtggcttgaacccgggaggacgcccaatcacgcccccacggaattctgccaaggcgaagaaatag

SEQ ID NO: 130625 - DNA, 993 bp, Artificial Sequence
  Description of Artificial Sequence: Synthetic coding sequence
atgagtgacagtgaaaaattgaacctggatagcattataggcaggctgttagaagtgcagggatcacgacctgggaagaatgtccagttaacagaaaacgaaattaggggcttgtgtctcaaaagtcgcgagatattcttatcccagcctattttactggagctggaggcccctctcaaaatttgcggtgatattcacggacagtactacgacctccttcgcttatttgaatacggcggtttcccacccgagtccaattatctatttctgggagactatgtcgacagggggaagcagtcattggaaactatctgtttattgctagcttataagataaagtatccagagaactttttcttgttgcgcgggaaccatgagtgtgcctcaatcaaccggatctatggcttttatgacgaatgcaagcgcaggtacaacatcaagttatggaagaccttcacagattgtttcaattgccttcccatagccgcgatcgtcgacgagaaaattttctgctgtcatggcggactgagccccgatctgcaatcaatggaacaaatcagacgcatcatgcgcccaactgacgtgcccgatcagggactcctgtgcgacctcctctggtcagatcctgataaagatgtccagggatggggtgagaacgatcgtggtgttagctttacttttggagcggaagtagtggccaaatttctgcataaacacgatctcgatctaatctgtagagcccatcaggtggtggaagatggctacgaatttttcgccaagcgtcaactggtaactttattctcagcccccaattactgcggcgaattcgacaacgctggggctatgatgtcagtggacgagacattgatgtgttccttccagattctgaagcctgctgataagaataagggaaagtatggccagttcagcggcctgaacccgggagggagacccatcacacctcctcgcaactcagcaaaagcaaaaaagtag

SEQ ID NO: 130626 - DNA, 1245 bp, Artificial Sequence
  Description of Artificial Sequence: Synthetic coding sequence
atgcgccaacgggccgacagacggtctatggtatcaacaagtggagctgcaacagccagttctgcagccggaccttctagaggcgctgctcacagtccatctagtgctccgcacgcctcgaggcaccgccctccctttagttcccgtgccacagggctgttgcagcaacgtcagcattgtgtgcaccattgcactcagctctgccctagagttcagactccttgcctccctccaccccccgccccagccaccgagcttcacagctacctccagcagggcggggagcgcggcttgctggatacaacccctggaaccgcgggttggggcacatccgctaccggcgcagtgcagggctctcgtccaggcaaaaacgtgcaactcacagagaatgaaattagaggactgtgcttaaaatctcgcgaaatctttttgagccaacccatcctactggagctcgaggccccactgaaaatctgtggagacattcatgggcagtattacgacttgctgcgtcttttcgaatacgggggctttcctccggaatccaactacctgttcctgggcgactacgtggaccggggaaaacagagtctcgagaccatctgtctgctgctcgcctacaagattaagtatcccgagaacttttttctgctgcgcgggaaccatgagtgcgcctcaattaatcgaatctacggtttttacgacgagtgcaagcgcagatacaacatcaagctctggaagacattcaccgattgcttcaactgtctccctattgctgccatcgtcgatgagaagattttctgttgtcacggtggcttgagcccggatctccagagcatggaacagatcagaaggatcatgcgacccactgacgtcccggatcagggcctgctgtgcgatctgctgtggtccgaccccgataaagacgttcaaggctggggtgaaaacgaccgcggagtcagctttacgttcggtgctgaagtagtcgctaaattccttcacaagcatgatctcgatctgatttgcagggctcaccaagtcgtcgaggatgggtacgagttctttgcgaagaggcagctggtaacgctgttctccgctcctaactattgtggggaatttgacaacgccggtgcaatgatgagcgttgacgaaaccctcatgtgctccttccagatcctgaaaccagctgacaaaaacaaaggtaaatacggccaatttagcgggctcaatcctggaggtcgatag

SEQ ID NO: 130627 - DNA, 984 bp, Artificial Sequence
  Description of Artificial Sequence: Synthetic coding sequence
atggccgatggcgaattgaacgtggactcactgatcacccggctactggaggtgcggggctgtagacccggaaagatcgtccagatgaccgaagcggaagtaagaggtctgtgcataaagtccagagagatctttctgtctcagcctattctgctggaactagaagcccccctcaagatttgcggcgacatccatggccagtacactgatctactacggttgtttgagtacgggggcttcccccccgaagccaattacctttttctgggagactacgtggataggggaaaacagagcctggagaccatctgcctgctgctagcatataagataaaatatcccgagaacttttttctgcttcgggggaatcacgagtgcgcttccattaacagaatatacggtttttacgatgaatgcaagcggaggttcaacattaaactctggaaaactttcacagactgtttcaactgtctgcccatagctgccattgtcgacgagaagatcttctgctgccatgggggcctgtcccccgatctacagtctatggaacagatccgccggatcatgcgacccacagacgtccctgatactggactgctgtgcgatctgctatggtctgacccagacaaagacgtgcagggatggggagaaaacgatcggggtgtcagctttactttcggcgctgacgttgtttcaaagttccttaatcgtcacgacctggacctgatctgcagagctcatcaggtcgtggaggatggttacgagttcttcgccaagcgccagctggtcactctgtttagcgctccgaattactgcggcgagtttgataatgccggcggcatgatgagcgtagacgagacacttatgtgcagtttccaaattctcaagccaagcgaaaagaaagctaaatatcagtacggcggactaaatagtggcagaccagtgacaccccccaggaccgccaatcctcctaagaaaaggtag

SEQ ID NO: 130628 - DNA, 984 bp, Artificial Sequence
  Description of Artificial Sequence: Synthetic coding sequence
atggctgatggagagctgaatgttgacagtcttatcacccggctcctggaagtgagaggatgccgcccagggaaaattgtgcagatgacagaggccgaagtgaggggtctgtgtatcaagagcagggagattttcttgagccagcccattctcctggaattagaagccccactaaaaatctgcggcgacatccatggacaatatactgatctgcttcgcttgtttgaatatggtggctttcctccggaagctaattatttgtttttaggcgattatgtggaccggggaaagcagtccctcgagaccatctgcctccttctagcttataaaatcaaatatcccgaaaacttctttctattgcgtggcaatcacgagtgtgcatccataaaccggatatacggtttttatgatgaatgtaagaggcgcttcaatatcaagctttggaagaccttcaccgactgctttaattgtcttccaattgcagcaattgtggatgaaaaaattttctgttgtcacggtggcttaagcccagatctgcaatcaatggagcagattcggcgtataatgaggcccaccgacgtgccagatacgggccttctttgcgaccttttgtggagcgaccctgataaggacgtgcaggggtggggcgagaacgacaggggagtgtctttcacattcggcgcggacgtcgtgtcaaagttcttgaaccggcatgatcttgacctgatttgccgggcccatcaggtagtggaagatgggtacgaattttttgcaaagagacaactggttacactgttttccgcacccaattactgcggtgagtttgataatgctgggggaatgatgagtgtggacgaaaccttaatgtgctcattccagatcctcaagccttccgagaaaaaagccaaatatcagtatgggggactcaattctggtaggccagtgaccccaccacgtacagcgaatccacccaaaaagcgttag

SEQ ID NO: 130629 - DNA, 984 bp, Artificial Sequence
  Description of Artificial Sequence: Synthetic coding sequence
atggctgacggagagttgaacgtcgattcccttattacacgtctgctagaagtgcgcggttgccggccgggcaagattgtccagatgacagaagccgaagtgcgtggcttatgcattaaaagtagggaaatcttcctgagccaaccaattcttttagagctggaagctcctctcaagatttgtggggatattcacggccagtacaccgacctgctgcggctgttcgagtatggaggctttcctccggaggctaattacctttttttaggtgactacgtcgaccggggaaaacagtctctggagaccatctgccttctcctcgcatataaaataaagtacccagagaactttttcttacttagaggaaaccatgaatgtgcctctattaaccgcatatatggtttttatgatgagtgtaaacggagatttaacatcaaactttggaaaacgttcactgactgctttaactgcttaccaattgctgccatcgttgacgagaaaatcttttgttgccacggcggcttgagtcctgatctgcagagtatggaacagattcgcagaatcatgagacccactgatgttcccgacacggggctgctctgcgacctgttgtggtcagatccggataaggacgttcaggggtggggagagaacgataggggagtatcatttactttcggagccgacgtagtatcaaagtttctgaacagacatgatctggatcttatatgccgggcccatcaggtcgtggaagatggttacgagttcttcgcaaaacggcagctggttaccctgtttagcgcccctaattattgtggcgagttcgacaacgccggaggcatgatgagcgtggacgaaaccctgatgtgctcctttcagatcctgaagccctctgagaaaaaggccaaatatcagtatggcggactgaactccgggagacccgtgacaccgccacgcactgctaaccctcctaagaaacgctag

SEQ ID NO: 130630 - DNA, 378 bp, Artificial Sequence
  Description of Artificial Sequence: Synthetic coding sequence
atggcagatggcgaactcaatgtcgattcactcattactcgccttctggaagtgcggggctgcagaccgggaaagatcgttcagatgactgaagccgaagttcgagggctctgcataaagtcccgggagattttcctgtcacaaccgatcttattggaactggaagcgcccctcaaaatctgtggggacatccacggtcagtacactgatcttctgaggctttttgaatacgggggattccctccagaggcaaattatctgttcctgggcgattatgtcgacagagggaagcagagtctcgagaccatttgtcttctgctagcttacaagataaagtaccccgagaatttcttcctgttaagagggaaccatgagtag

SEQ ID NO: 130631 - DNA, 417 bp, Artificial Sequence
  Description of Artificial Sequence: Synthetic coding sequence
atggccgacggggagttaaatgtggacagtctgatcactaggctcctggaagtcagaggctgccggccgggcaagattgtgcagatgactgaagccgaggttcgggggctctgtattaagtcccgcgagatttttctctcacagccaattttgctggagcttgaagcccctttgaaaatttgcggcgatatccatgggcagtacacagacctgctgcgcctgttcgagtacggcggtttccctcctgaagcaaactatctgttcctcggcgactacgttgaccgcggcaagcagtcactcgagacgatttgcctgctcctggcatataagataaaatatccagagaattttttccttctacgcgggaaccacgaatgtgcgtcaatcaaccgtatctatgggttttatgacgagtag

SEQ ID NO: 130632 - DNA, 510 bp, Artificial Sequence
  Description of Artificial Sequence: Synthetic coding sequence
atgactgaagctgaggtgcggggcctttgtatcaaatcgcgggagatctttctttcacagcccatcctactcgagcttgaagcccccttgaagatctgcggtgacatccacggccagtacactgatctgctccgactgttcgaatatggaggtttcccacccgaggccaattatttgtttctcggggactacgtagacagagggaaacagtccctggaaactatttgtctcttgctcgcctacaagatcaaatatccggagaatttcttcctccttaggggtaaccatgagtgcgcctctattaatcgcatatacgggttttatgacgaatgtaagcgacggttcaatatcaagttatggaagaccttcactgactgctttaactgcttaccaatcgcggcgatcgttgatgagaagatcttctgctgccatggaggactgagccccgatctacaatcgatggagcagatccgcaggattatgcggccgaccgatgtcccagatacatag

SEQ ID NO: 130633 - DNA, 972 bp, Artificial Sequence
  Description of Artificial Sequence: Synthetic coding sequence
atggctgatcttgacaagttgaacatcgatagcattatccaaaggttactagaggtccgcgggtccaaaccaggcaagaacgtgcagctccaggaaaacgagattagagggctgtgcctgaagagtagggaaatttttctatctcagcccatcctcctggagctcgaggctccgctgaagatttgtggagacattcatgggcagtactatgaccttttgcgcctctttgagtacggcggatttcctcctgagagtaattatttatttctgggggattacgtcgatcggggcaagcagtcccttgaaaccatatgtttgttattagcatacaaaatcaaatatcctgagaacttttttctcctgagaggaaaccacgaatgcgcctcaattaataggatttacggcttttatgatgagtgcaagagacgatacaatataaaactctggaagactttcacagactgtttcaattgcctgccaatagctgctattgtcgatgagaagatcttttgctgccacgggggactgagtcccgacctccagagcatggagcagatcagacgcataatgcgccccactgatgtgccagatcaagggctgctgtgtgatctattatggagtgatcccgataaggacgtgctcgggtggggagagaacgaccgcggagtctccttcacatttggagccgaggtggttgcgaaattccttcataagcacgatttggatcttatttgcagagcccatcaagtcgtggaagacgggtacgagttcttcgctaagaggcaactggtgacgttattttcagcaccaaattactgtggagaatttgacaacgccggtgccatgatgtctgttgatgagaccctcatgtgctcgttccagattctcaaacccgcagagaaaaagaaaccgaacgctacaagacccgtgactcctcctagagggatgattactaaacaggctaaaaagtag

SEQ ID NO: 130634 - DNA, 1014 bp, Artificial Sequence
  Description of Artificial Sequence: Synthetic coding sequence
atggcagatctcgacaaattaaatattgacagtatcattcagaggctcctagaagtaaggggatctaaacccggaaagaacgtgcagctccaggagaatgaaatcaggggtctgtgtctgaagtctcgcgagatctttttatctcagcctattctgctggaattggaagcccccttgaaaatttgtggtgatatccacggtcaatactatgatctcctaaggctgtttgagtacggggggttcccaccagaatcaaattatctgtttctgggtgactacgtggacagaggcaaacagagtctggagacaatctgcctgctgcttgcctacaaaataaagtaccctgagaactttttcctacttagaggcaatcatgagtgtgcatccatcaaccgcatatacggcttctacgatgagtgcaagaggcggtacaatataaagctgtggaagacttttacagactgtttcaattgcctgcctattgcagccatagtggatgagaagattttttgctgtcatggcggactatcccctgacctgcagtcaatggaacagatacgcagaatcatgcgcccaacggatgtgccggaccagggacttctgtgtgatctgctttggtcggatccggacaaggatgtcctggggtggggggaaaacgatcgaggggtgtctttcaccttcggggccgaggtggttgcaaaatttttgcacaaacacgatctggacttaatctgccgtgcccatcaggtagtggaagatggttatgagttcttcgcaaagcggcaactcgtaacgctcttttccgccccaaactattgcggagaattcgacaacgctggcgctatgatgtcggtagatgagacactgatgtgtagtttccagatcctcaagccagcggaaaagaaaaagcccaacgccaccaggcccgtcactcctcccagagtggcttcgggcttaaatccctcaatccagaaggcctcgaactatcggaataatacagtactctatgagtag

SEQ ID NO: 130635 - DNA, 999 bp, Artificial Sequence
  Description of Artificial Sequence: Synthetic coding sequence
atgtttctgcccctatacctgaatcttgtactgtacttcgtcttttggttgcattggacaaattgtgatttctccctggctgtcagaggatctaagccgggaaaaaacgtacagctgcaggagaatgaaattagaggcctgtgtctcaaatctcgggaaatattcctatcacagccgatcctgctggagctggaagccccactgaaaatctgtggcgacatccatggtcagtattatgacctgttgaggctgttcgagtacggaggattcccacccgagtctaattatttattcctgggggactatgtggaccgcggaaaacagagcctcgaaacaatttgcctgctgctggcctataagattaaatacccggaaaacttcttcctgttacgaggcaaccacgaatgcgccagtataaatagaatttatggattttacgatgagtgtaagaggagatacaacatcaagctctggaaaacttttactgattgctttaactgtctccctatcgctgctattgtggacgagaagatcttctgttgccatggcggactttcacccgacctccaatccatggaacaaattcgccgtatcatgcggcccacagatgttcccgaccagggtcttctttgcgacttgctgtggtctgaccccgacaaggatgtcctgggatggggagagaatgataggggcgtgagctttacattcggagctgaggtggtggcgaaattcctccacaagcacgatctcgacctgatttgtagggcacaccaggtagtggaggacgggtacgaatttttcgcgaagcgccaactggtgactctgttcagcgcaccaaactactgtggagaatttgacaatgcaggggccatgatgtctgtggacgagacacttatgtgttcattccagatcctgaagcctgccgagaagaagaagcccaatgcgacccggcccgtaacacctcctcgaggaatgattactaaacaagctaagaaatag

SEQ ID NO: 130636 - DNA, 426 bp, Artificial Sequence
  Description of Artificial Sequence: Synthetic coding sequence
atggagcagatacgcagaatcatgcgcccaaccgatgtaccagaccagggccttttatgtgatctcctgtggtctgaccccgataaggatgtgctggggtggggggagaatgatcggggggtgtcgttcacctttggagcagaggtcgtggctaaattcctgcataaacacgatctggatctgatttgtcgggcacaccaggtcgtggaggatggttatgagtttttcgcaaagcgtcaattagtgaccctgttctctgcgcctaactattgtggagaattcgataacgccggtgccatgatgagcgttgacgagacactgatgtgtagcttccagattctgaaacccgccgaaaaaaagaagcccaatgctacgcgacccgtcactcctccccggggcatgatcacaaagcaggcgaaaaagtag

SEQ ID NO: 130637 - DNA, 225 bp, Artificial Sequence
  Description of Artificial Sequence: Synthetic coding sequence
atgggccggaggagtagcaaatgctgctgtatttacgagaaacccagagcgttcggggagagttctacggagagcgatgaggaggaggaggagggatgcgggcatacccactgtgttcggggccatagaaaaggccggagacgcgccactctcggacctaccccaactacacccccacagcccccagacccctctcagcccccgcctggccctatgcaacactag

SEQ ID NO: 130638 - DNA, 225 bp, Artificial Sequence
  Description of Artificial Sequence: Synthetic coding sequence
atgggcagacgctcttccaaatgttgttgtatatatgaaaaacctcgagcctttggggaaagctcaacagaaagcgacgaggaggaagaagaggggtgtggtcacactcactgtgtgcgggggcaccgcaagggaagacgaagagccaccctgggtcccacccctacaactcccccacagccccccgatcctagccagcctcccccgggcccaatgcagcactag

SEQ ID NO: 130639 - DNA, 225 bp, Artificial Sequence
  Description of Artificial Sequence: Synthetic coding sequence
atggggaggcgatcatcgaagtgttgctgtatttatgaaaagccacgtgcctttggcgaatcctctaccgagtccgatgaagaggaagaggagggctgtggccacacccattgtgtccgaggccatagaaaggggcggaggagagccacactcgggccgacccctacaactcccccccagccccccgatccttcacagcccccccctggcccaatgcaacactag

SEQ ID NO: 130640 - DNA, 225 bp, Artificial Sequence
  Description of Artificial Sequence: Synthetic coding sequence
atgggccgcagaagctctaaatgttgttgtatttacgagaagccaagggccttcggtgagtcttcgaccgagagtgacgaggaagaagaagaaggctgtggccatactcattgcgtaagggggcaccgtaagggtaggcgcagagcaacgctggggcccacaccaaccacacccccccagccgccggatcccagtcaaccccctcctggccccatgcagcactag

SEQ ID NO: 130641 - DNA, 381 bp, Artificial Sequence
  Description of Artificial Sequence: Synthetic coding sequence
atggccgaagctggagccggcctgagtgagactgtgactgagacgacagtaacggtaaccacggaaccagagaaccggagtctgaccataaagctgagaaaacggaagcctgaaaagaaagtcgaatggacatcggatacagtagataatgagcacatgggtaggcgctcatcaaagtgttgttgcatttacgaaaagcctagggccttcggcgaaagctcaacggagagtgatgaggaggaagaggaagggtgtggccatactcactgtgttcggggccacaggaagggtagacgcagagccacactcggtcctactcccactacacccccccagccacccgatcccagccagccaccccctgggccaatgcaacactag

SEQ ID NO: 130642 - DNA, 225 bp, Artificial Sequence
  Description of Artificial Sequence: Synthetic coding sequence
atggggaggcggtctagcaagtgttgttgcatttacgaaaagcctcgggcgtttggagaatcctcaaccgagtcagacgaggaggaggaagagggatgcggccacacacactgcgtgagagggcatagaaagggcagacgcagagctaccctcggccccactccaacgactcctccccagccccccgacccttcgcagcctccccccggacctatgcagcactag

SEQ ID NO: 130643 - DNA, 381 bp, Artificial Sequence
  Description of Artificial Sequence: Synthetic coding sequence
atggcggaagcgggcgccggcctcagtgaaaccgtcacggaaacgaccgtgacagtgacaactgagccggagaacaggtcgttaacaattaagctgaggaagcgtaaacctgagaagaaggtggagtggaccagtgatactgtggacaacgagcacatgggaaggaggagttcaaaatgctgttgcatctacgagaagccaagggccttcggcgaatcgtcaacggaatcagatgaggaggaggaagaggggtgtggccacactcactgtgtgagagggcatagaaaggggagacgtcgagccaccctgggacctactcctacaacacccccccagccaccagatccttcacagcccccccctgggccaatgcagcactag

SEQ ID NO: 130644 - DNA, 225 bp, Artificial Sequence
  Description of Artificial Sequence: Synthetic coding sequence
atggggcgccgttcttccaagtgctgttgtatttatgagaagccaagagcctttggagagtcttctacagaatccgatgaggaggaagaggaaggttgtggacacacgcactgtgtgcgcggccataggaaagggcgcaggagggccaccctgggtccaacacctaccacgcccccacagccccccgaccctagtcaacctcctcccggtcctatgcagcactag

SEQ ID NO: 130645 - DNA, 225 bp, Artificial Sequence
  Description of Artificial Sequence: Synthetic coding sequence
atgggacgccgcagctcgaaatgctgctgcatctatgaaaagcctcgggcgttcggtgaatcctccactgagtccgacgaggaggaagaagaaggttgtggtcatacccattgcgtgaggggtcataggaaagggagacgcagagccacgctggggccgacacctaccacacctccacaacctcccgacccctcacagccaccgcccggacccatgcagcattag

SEQ ID NO: 130646 - DNA, 225 bp, Artificial Sequence
  Description of Artificial Sequence: Synthetic coding sequence
atgggtagaaggtcttccaaatgttgctgcatctacgagaagccacgagctttcggcgaaagcagcaccgagagcgatgaagaggaagaggagggttgcggacacactcactgcgtgcgtggacatagaaaaggacggcggagggccaccttgggacccacacctacaacccctccacaacccccagatccatcacagcctcctcctggacccatgcaacactag

SEQ ID NO: 130647 - DNA, 225 bp, Artificial Sequence
  Description of Artificial Sequence: Synthetic coding sequence
atggggagacgctcctcaaagtgctgttgcatttacgagaagcccagggccttcggcgagagtagtacagagtccgacgaagaggaggaagaaggctgcggccacacacattgcgtccgcggccatcgcaaaggccgcaggagggccactctgggccccacgccaaccacgcccccccagcccccagatccttcacagccacctccggggccgatgcagcactag

SEQ ID NO: 130648 - DNA, 225 bp, Artificial Sequence
  Description of Artificial Sequence: Synthetic coding sequence
atgggtcgccgctcgagtaaatgttgttgcatatacgaaaagcccagagcattcggcgagtcctctaccgaaagcgacgaagaagaggaggaagggtgcggacatactcactgtgttcggggccaccgcaagggccggcgccgggcgactctggggcccactccgacgacccctccccagccgccagatcctagccagcctccccccggcccgatgcagcattag

SEQ ID NO: 130649 - DNA, 225 bp, Artificial Sequence
  Description of Artificial Sequence: Synthetic coding sequence
atgggacgaaggagctcaaagtgttgttgtatctatgaaaagcccagagcattcggcgagagtagtactgagagcgatgaagaggaagaggaaggatgcggacatacacactgcgtacgtgggcatcgcaagggccgccgccgcgccaccttaggtcccactccaaccacaccaccccagccaccagatcccagtcagccaccaccaggtcccatgcagcattag

SEQ ID NO: 130650 - DNA, 225 bp, Artificial Sequence
  Description of Artificial Sequence: Synthetic coding sequence
atgggacgacgctcttctaagtgctgttgcatctacgagaaaccgcgggcttttggggagtcttcgaccgaatctgatgaggaagaggaagaggggtgcggccacactcactgtgtgagaggccatcggaagggcaggcgacgggctaccctaggacctacgcccacgacacctccacaaccacctgacccctcccagcccccccccggtcctatgcagcattag

SEQ ID NO: 130651 - DNA, 225 bp, Artificial Sequence
  Description of Artificial Sequence: Synthetic coding sequence
atgggtcggcgatcaagtaagtgctgttgcatttacgagaaacctcgtgcatttggggaaagcagtacagagtcagacgaggaggaggaagaagggtgtggccatacccattgcgtccgcggccaccgaaagggcaggagacgcgccacccttggacctactccaaccacccccccacagcccccggatccaagccagccaccacccgggccaatgcagcattag

SEQ ID NO: 130652 - DNA, 225 bp, Artificial Sequence
  Description of Artificial Sequence: Synthetic coding sequence
atgggtcgaagatcttcgaaatgctgttgcatctacgaaaagccccgcgcctttggagagtcttccactgaaagcgacgaggaggaggaagaggggtgcggtcacacccattgtgtgaggggccataggaaggggagacgtagagccacgttggggcctacccctacaacacctccccaaccacccgatccaagccagccccctccgggcccaatgcagcactag

SEQ ID NO: 130653 - DNA, 225 bp, Artificial Sequence
  Description of Artificial Sequence: Synthetic coding sequence
atggggcgacgctccagcaagtgctgctgcatctacgagaagccccgggcattcggggaaagctctactgagtccgatgaggaggaggaagagggatgtgggcacacacactgtgtgcgaggacaccgcaaagggagaaggcgcgcaaccctcggacctacccctaccacccctccacagcctcctgacccatcccagcccccccccggcccgatgcagcactag

SEQ ID NO: 130654 - DNA, 225 bp, Artificial Sequence
  Description of Artificial Sequence: Synthetic coding sequence
atgggtagaagatcatcaaagtgctgctgcatctacgaaaagccaagggctttcggggagtcgtcaactgaatccgacgaagaggaagaagagggctgcgggcatacacactgtgtgcgcggacatcgcaaaggccgacgtcgggcaaccctgggaccaaccccgactacgcccccacagcccccggatcccagtcagcccccccctgggcccatgcagcattag

SEQ ID NO: 130655 - DNA, 225 bp, Artificial Sequence
  Description of Artificial Sequence: Synthetic coding sequence
atgggaagaaggtcttccaaatgttgttgcatctacgaaaaaccgcgcgcattcggcgaaagcagtacagaatccgatgaggaggaagaggaggggtgtggccacacgcattgtgtcagaggccatcgtaaaggcaggcgaagggccactctcgggccaacaccgacgacacctccccagcccccagacccaagtcagccccccccggggcccatgcagcattag

SEQ ID NO: 130656 - DNA, 225 bp, Artificial Sequence
  Description of Artificial Sequence: Synthetic coding sequence
atgggacgccgctcctcgaagtgctgctgcatttatgagaagcctcgcgcattcggagagagttcaactgaaagcgatgaggaagaagaagaagggtgtggacacacacactgtgttcgcgggcatcggaaaggccgaaggagagccaccctgggaccaacaccgacaacccccccacagccacccgacccatcacagccccctcccggtcctatgcagcactag

SEQ ID NO: 130657 - DNA, 225 bp, Artificial Sequence
  Description of Artificial Sequence: Synthetic coding sequence
atgggcagacgttcttcaaaatgttgctgcatttacgaaaagccgcgggcctttggcgagtcttctacagagagcgatgaggaagaagaagagggctgtggccacactcactgcgtgcgcggtcacaggaaggggcggaggcgggcaaccctggggccaacccccaccactcctccccagcccccagaccctagtcagcctccacctggtccaatgcagcattag

SEQ ID NO: 130658 - DNA, 225 bp, Artificial Sequence
  Description of Artificial Sequence: Synthetic coding sequence
atgggaagacgatcctctaagtgctgctgtatttatgagaagcctagggcatttggagagagttcaacagagtcagacgaagaagaggaggaaggatgcggccacactcactgcgtcagagggcatagaaaggggagacgccgagcgactctaggacccactcctaccacaccaccccagccccccgatccaagtcagccccccccgggtcctatgcagcactag

SEQ ID NO: 130659 - DNA, 381 bp, Artificial Sequence
  Description of Artificial Sequence: Synthetic coding sequence
atggcggaggcaggagccgggctctcagagacagtaacagaaaccactgttacagtcacaactgagcctgaaaaccggagtctaaccattaaattgagaaagagaaagcctgagaagaaggtggagtggactagcgacactgttgacaatgagcatatgggaaggcgttcttctaagtgctgctgcatctacgaaaaaccgcgtgccttcggcgaatcaagcaccgagtcggacgaggaagaggaggaaggctgcgggcatacacactgtgtgaggggacaccgaaagggtaggcggagggctacacttggacctactcccacaacaccgccccagcctccggacccctctcaaccgcccccggggcctatgcagcattag

SEQ ID NO: 130660 - DNA, 381 bp, Artificial Sequence
  Description of Artificial Sequence: Synthetic coding sequence
atggccgaggccggagccggtctgtcagaaacagttactgaaactaccgtcactgtaacgaccgaacccgagaatcgatccctgacgattaaattgcgcaaacggaagccagaaaagaaggtggagtggacaagcgacacggtggataacgagcatatggggaggcggagttctaaatgttgttgcatatatgaaaagcccagagcattcggggaaagcagcacagaatccgacgaggaagaagaagagggctgtggccatacgcattgtgttcgcggtcatcgtaagggaaggcgtagggcgaccctcggccctacgccaacgacaccacctcagccacccgatcccagccaacccccacccggaccaatgcagcattag

SEQ ID NO: 130661 - DNA, 225 bp, Artificial Sequence
  Description of Artificial Sequence: Synthetic coding sequence
atgggcaggaggtctagtaaatgctgctgcatctacgagaaaccacgggcctttggcgagagctcgactgagtccgacgaggaagaagaggagggctgtggtcacactcactgcgtacggggccacagaaaaggacgccgccgcgctaccctgggtccaacccctaccactcccccacagcccccagacccatcccagcccccaccgggccctatgcagcactag

SEQ ID NO: 130662 - DNA, 225 bp, Artificial Sequence
  Description of Artificial Sequence: Synthetic coding sequence
atgggccgccgcagcagtaaatgttgctgtatctacgaaaaacctcgagcattcggcgagtcctccacagaatcagacgaagaggaggaagaggggtgcgggcacacacattgcgtgaggggccaccggaaggggcgtagaagggctaccctgggacccaccccgaccacacctccccaaccacccgacccatcccagcctccccctggccccatgcagcattag

SEQ ID NO: 130663 - DNA, 225 bp, Artificial Sequence
  Description of Artificial Sequence: Synthetic coding sequence
atgggcagacggagctcgaagtgttgctgtatctatgagaaacctcgagcatttggggaatccagcacagagagcgatgaggaggaggaagagggctgcggccacacccattgtgtcagaggacacagaaagggaaggaggcgggccaccctgggccctactccgactaccccgccgcagcctccggacccgtctcagcctccacccgggccaatgcaacattag

SEQ ID NO: 130664 - DNA, 381 bp, Artificial Sequence
  Description of Artificial Sequence: Synthetic coding sequence
atggccgaggctggagccggtctctcagaaactgtgaccgaaacaactgtgaccgttacgacagaaccagaaaaccgcagcttaactataaagttgaggaaacgaaaacccgagaagaaggtcgagtggacctcagataccgtcgataacgagcatatgggccgaagatcttccaaatgctgttgtatttatgagaaaccaagagcctttggagaatcgagcacagagagcgatgaggaagaggaagagggttgtggccatactcactgcgttaggggacatcggaagggtcgaaggagagccactctcggtccaaccccaacaacacccccacaaccccctgatccatcccaacctcccccagggccaatgcaacactag

SEQ ID NO: 130665 - DNA, 225 bp, Artificial Sequence
  Description of Artificial Sequence: Synthetic coding sequence
atgggccgacgtagtagcaaatgttgctgtatctacgagaagcctcgggccttcggggaaagttccactgagtccgacgaggaagaagaggaaggatgtggacatactcactgcgtccgtggccatcgcaaaggtcggcggcgggcaaccctaggaccaactcccaccacaccaccacagccacccgatccttcccaaccaccacccggacccatgcaacactag

SEQ ID NO: 130666 - DNA, 225 bp, Artificial Sequence
  Description of Artificial Sequence: Synthetic coding sequence
atggggagaagaagttcgaagtgttgctgtatctacgaaaaacccagagctttcggggaaagcagcaccgagagtgacgaagaagaagaagagggatgtggccatacacactgcgtgagagggcatcggaaggggcggcgccgcgccacactcggcccgaccccgaccacccccccccagcctcctgaccccagccaacctccaccaggaccaatgcagcactag

SEQ ID NO: 130667 - DNA, 381 bp, Artificial Sequence
  Description of Artificial Sequence: Synthetic coding sequence
atggccgaggctggcgccgggctcagcgaaaccgtgacagagacaaccgttaccgttacgacagaacccgagaaccggagcttgactattaagctgagaaagcgcaagccagaaaaaaaggttgagtggacatccgatacagtagataacgagcatatggggaggcgatcctcgaaatgttgctgcatatatgagaagccacgggcgtttggcgaaagcagtacagaaagcgacgaggaagaagaggagggttgtgggcacacccactgcgtgcgaggtcaccgcaagggtcggagacgtgctactctggggcctactcctactactcctccacagcctccagacccttctcaaccacctcctggcccaatgcagcattag

SEQ ID NO: 130668 - DNA, 225 bp, Artificial Sequence
  Description of Artificial Sequence: Synthetic coding sequence
atggggcgcaggtcatctaaatgctgttgcatatatgagaagcccagagcgtttggcgagagcagcaccgagagcgacgaggaggaggaggaaggctgtggtcatactcactgtgttaggggccaccgaaagggccggcgtcgagccaccctgggccccacccctactacacccccccagcctcccgatccgagccagcccccccccggacccatgcagcattag

SEQ ID NO: 130669 - DNA, 225 bp, Artificial Sequence
  Description of Artificial Sequence: Synthetic coding sequence
atgggacggcgtagctccaaatgctgctgcatttacgagaagcctcgggcatttggagagtcttctacagaatcagatgaggaggaagaagagggctgtggccatactcattgtgtccgcggccatcgcaagggtcgccggcgcgcaacgctgggtcctactcctaccacccctccacagcccccggacccctcccagcctcccccaggacccatgcagcattag

SEQ ID NO: 130670 - DNA, 225 bp, Artificial Sequence
  Description of Artificial Sequence: Synthetic coding sequence
atgggaagaaggtcctctaagtgttgttgtatatatgagaagcccagagctttcggggagtcctccaccgaatctgacgaggaagaggaagaaggatgcggacatacgcattgtgtaaggggacatcgtaagggccgtagaagagcgaccctcggcccaaccccaaccacacccccccagccgcctgatccctcccagcctccccccggtccgatgcagcattag

SEQ ID NO: 130671 - DNA, 225 bp, Artificial Sequence
  Description of Artificial Sequence: Synthetic coding sequence
atggggcgtcgctctagtaaatgctgctgtatttatgagaaacctcgggccttcggggaaagctctacagagagtgatgaggaggaggaagagggttgtggacacacacattgtgtgcgaggccacagaaaaggacgccgcagggccaccctggggccaacccccacaaccccccctcagcctcccgatcccagccagccccctccaggccctatgcaacattag

SEQ ID NO: 130672 - DNA, 225 bp, Artificial Sequence
  Description of Artificial Sequence: Synthetic coding sequence
atgggtcgacgcagctccaagtgctgttgcatatatgagaagcccagagccttcggtgagagtagtacggaaagcgacgaagaagaagaggagggatgtggacacacacactgcgttcggggtcaccgcaagggccggaggcgggctactctcggcccgactcccacaacccccccacaacccccagatccctcccaacctccaccgggaccaatgcaacactag

SEQ ID NO: 130673 - DNA, 225 bp, Artificial Sequence
  Description of Artificial Sequence: Synthetic coding sequence
atgggacgtagaagctcaaaatgctgttgtatctacgaaaagccacgggctttcggcgaatcctcaacagaatccgatgaggaggaggaagagggatgcggccacactcactgcgtgagggggcacagaaagggtcggcgcagagcaacattgggaccaacacccactacaccaccccaaccgcccgatccatctcagccacctccaggacctatgcaacactag

SEQ ID NO: 130674 - DNA, 381 bp, Artificial Sequence
  Description of Artificial Sequence: Synthetic coding sequence
atggccgaagccggggcaggactgagtgaaacggtgaccgaaaccacagttaccgtcactactgagcctgagaacagaagcctgactatcaagctgcggaagagaaagcctgagaagaaagttgaatggacctctgacaccgtggacaacgaacacatgggacggcggtcctctaaatgctgttgtatctatgagaaaccgcgagcctttggtgagtctagcacagagagcgacgaagaggaggaagagggatgcggccatacccattgtgtacggggccaccggaagggcaggcggcgggcaacacttggacccacaccgacgacccctcctcaaccccctgacccctcccagcccccccccggccccatgcagcactag

SEQ ID NO: 130675 - DNA, 225 bp, Artificial Sequence
  Description of Artificial Sequence: Synthetic coding sequence
atgggtcggaggtcctctaaatgctgctgcatctatgagaaaccccgcgcatttggggaaagtagtacagagtccgacgaagaggaagaggaaggttgcgggcacacacattgtgtacgcgggcaccgtaagggacgacgtcgggctacactgggcccaactcccaccaccccaccacagcccccagatccctcccagcccccgcctgggccaatgcagcactag

SEQ ID NO: 130676 - DNA, 225 bp, Artificial Sequence
  Description of Artificial Sequence: Synthetic coding sequence
atgggtcgccgctcatccaaatgctgttgcatttacgaaaaacctcgagcctttggcgaatcctccactgagagcgatgaggaggaagaggagggctgcgggcacacacactgcgtgcggggtcatcgcaaagggagacgccgagcaacactcggtccaacgccaaccacacctccccaacctcccgatccttcgcagcccccgccaggcccaatgcagcattag

SEQ ID NO: 130677 - DNA, 225 bp, Artificial Sequence
  Description of Artificial Sequence: Synthetic coding sequence
atgggtcggaggtcatctaagtgctgctgcatttacgagaagcccagagcttttggtgagtcctccacagaaagcgatgaagaagaagaagaggggtgcggacacacgcactgcgtgcgtggccatcgcaagggcagaaggcgggccaccttggggccaactccaacaacaccaccacagcctccagatccgagccaaccccctccaggccctatgcaacactag

SEQ ID NO: 130678 - DNA, 225 bp, Artificial Sequence
  Description of Artificial Sequence: Synthetic coding sequence
atgggtaggcgatcgagcaaatgttgctgtatctacgaaaaaccccgggcctttggtgagtctagcaccgaatctgacgaggaggaagaggaagggtgcgggcacacccactgcgtcaggggacaccggaagggtagaaggcgggccactttgggccctacacctaccacaccacctcagcccccggacccatcccagccaccgcctggacctatgcagcactag

SEQ ID NO: 130679 - DNA, 225 bp, Artificial Sequence
  Description of Artificial Sequence: Synthetic coding sequence
atgggtagacggtcctctaaatgctgctgtatctatgagaaaccacgcgcattcggggaatcttccaccgaatcagacgaggaggaagaagaaggctgcggccacacacactgtgtccgagggcaccggaagggtcggcggcgcgctaccctgggaccgactccgaccactcccccgcaaccccctgacccttctcaaccaccccctggtcctatgcaacattag

SEQ ID NO: 130680 - DNA, 225 bp, Artificial Sequence
  Description of Artificial Sequence: Synthetic coding sequence
atgggacgaagaagctctaaatgttgctgtatctatgagaagccgagagcatttggggagagttctaccgaatccgatgaggaggaggaagagggctgcggacacacacactgcgtcaggggccacagaaaggggcgcaggcgagctacgctgggtcccacacccaccacaccaccacagcccccagaccctagccagccccccccaggtcctatgcaacattag

SEQ ID NO: 130681 - DNA, 381 bp, Artificial Sequence
  Description of Artificial Sequence: Synthetic coding sequence
atggccgaggctggcgctgggctttccgaaactgtgaccgaaaccaccgttacggtgacaactgagccagagaacagaagcctgactataaagcttagaaagaggaagcctgaaaaaaaagttgaatggacctctgacacagttgacaatgagcacatgggcagaaggtcaagtaagtgctgttgcatatacgagaagccccgggcttttggcgagtcaagcacggaaagcgatgaagaggaggaagaggggtgcggacatacgcactgcgtgaggggccatcgaaagggccggcgccgggctacgcttggcccaacccccactactcccccacagccacctgaccccagtcagcccccccctggccctatgcagcactag

SEQ ID NO: 130682 - DNA, 225 bp, Artificial Sequence
  Description of Artificial Sequence: Synthetic coding sequence
atgggtcgccggagtagtaaatgctgttgcatctacgagaaaccaagggccttcggggaaagtagtactgaatcagacgaagaggaggaggagggctgcgggcatacacactgtgtgcgcggccatcgtaagggacgtaggcgagcgacacttggacccacccctaccacccctccgcagccccccgacccatctcagcccccccctgggcctatgcagcactag

SEQ ID NO: 130683 - DNA, 225 bp, Artificial Sequence
  Description of Artificial Sequence: Synthetic coding sequence
atgggccgacgttcatcaaaatgctgctgtatatatgagaaaccccgtgcctttggagagagctccaccgagtccgatgaggaagaggaggaagggtgcggccacactcactgcgtgcggggccatcggaagggccgacgccgggctacgttgggtcctactcctacaacacctcctcagccccccgacccttcccagcctccacctgggcccatgcagcattag

SEQ ID NO: 130684 - DNA, 225 bp, Artificial Sequence
  Description of Artificial Sequence: Synthetic coding sequence
atgggtcgacgcagttccaagtgctgctgcatatacgagaaacctcgtgcgtttggcgaaagcagcactgaaagtgatgaggaggaagaggagggctgtgggcacacacactgtgttagaggtcatagaaaaggaaggcgccgggctaccctcggcccaacacccaccaccccgccgcagccacccgacccctcacagccgcctcctggacctatgcagcattag

SEQ ID NO: 130685 - DNA, 444 bp, Artificial Sequence
  Description of Artificial Sequence: Synthetic coding sequence
atggctgactcaggtactgcaggaggagctgctttggctgcccccgccccgggccctgggtccggagggcccggcccgagagtgtactttcaaagcccaccgggcgcggcgggggaggggcctgggggtgccgatgatgagggtccggtacgtagacaggggaaggtcacagtgaagtatgatcgtaaggaactgcggaagagattgaatttggaagaatggatacttgagcagcttacacgcttgtatgactgccaagaggaggaaataccagaactggagatagacgtcgatgagctgctggatatggaaagtgacgacgcacgggctgctagagtaaaagagctgctggtggactgctacaagcccacagaggccttcatctccggtttactcgataagatacgaggaatgcagaagttgtctactccccagaaaaagtag

SEQ ID NO: 130686 - DNA, 498 bp, Artificial Sequence
  Description of Artificial Sequence: Synthetic coding sequence
atgtcagttgcgacaggcagtagcgaaaccgccggtggcgcatctgggggaggggcacgtgtgttttttcagtctccgaggggaggagcaggagggtcccctggatcttcttctggatccggctcatcgagagaagacagcgccccagtggctacagccgcagctgccggccaggtgcagcagcagcaacagagacgccatcagcaggggaaggtgactgttaaatacgacagaaaagagctgcggaaacgcttggtgctggaggaatggattgtcgagcaacttggccagctctatggctgcgaagaagaagagatgccggaggtggaaattgatatagacgacctgttggacgccgactcagatgaggaaagagcctctaagttgcaggaggctctggtggattgttacaaacccactgaggagttcataaaggagttattgagccggatacggggcatgcgcaagctgagccctcctcagaagaaatcagtttag

SEQ ID NO: 130687 - DNA, 438 bp, Artificial Sequence
  Description of Artificial Sequence: Synthetic coding sequence
atgctgagttcgtcccccgcctcatgcacatcccccagccccgatggggaaaatccttgtaagaaggtccactgggccagcggtcgcagacgcacgtcctcgaccgattccgaaagcaagagtcacccagactcctccaagatcccccgctcaagacggcctagtagattgaccgtaaaatatgacaggggtcagcttcaacggtggttagagatggagcagtgggtggatgctcaagtccaagaattatttcaggaccaggctacaccatccgagccggaaattgatttggaagcactgatggacctgagtaccgaagaacaaaaaactcagctagaagccattttagggaattgcccacgacccacggaagcctttatatcagaactactgtcccagctcaaaaagctgagaaggttaagccgcccccagaaatag

SEQ ID NO: 130688 - DNA, 603 bp, Artificial Sequence
  Description of Artificial Sequence: Synthetic coding sequence
atgctgtcttccagtccagcgagttgcacaagcccttcaccagatggcgagaatccttgcaaaaaagtgcattgggcgtctggtaggaggcgaacttcttcaacagattcggaatccaagtctcacccagactcctctaagatcccgaggagcaggcggccatcccgactcacggtgaaatacgaccgaggtcagttgcagcgatggctcgaaatggaacagtgggtcgatgcccaggttcaggaactcttccagagcctcgccctctcccccagattagaatgttcaggggttattcattcacttcagctcctgcccccagggtttaacagattcagctgtttaagctcatggagcagctgggactacgggattaaacaacctctccttagtcttagattgacatggaagctttcatggatctacccgcaacgaagcaggcgcctttcgtggcgcccattccttggcacagcaccggctccccaacggctgctgagcctgtcctgttctgtgaacagccgaaacagtggcgatagcgctggattaaggaacaagccagagcggccttctctggcagcttccgctctgccgggtctgccttag

SEQ ID NO: 130689 - DNA, 516 bp, Artificial Sequence
  Description of Artificial Sequence: Synthetic coding sequence
atggagcaggataactcccctaggaagattcaattcacagtacctctgttagagccacacctggatccagaagccgcagaacaaatccgtagacgacggccgaccccagccacgctagtgttaacttctgaccagagctctcctgagatcgacgaagatcgcattcccaatccgcatctaaaaagcactctggcgatgtccccccgtcagcgaaagaaaatgaccagaatcactccaaccatgaaggaactccagatgatggtggagcatcacctgggccagcagcagcagggagaggagccagagggggcggccgaatccaccgaaactcaggagagcaggcctcctggaattcctgacactgaagtagagtcccgactgggaacctctggcaccgccaagaagacagctgagtgcattcccaaaactcacgagagagggtctaaagagccatctaccaaagaaccgtcaacacatatccctccactggatagcaagggagccaattccgtctag

SEQ ID NO: 130690 - DNA, 462 bp, Artificial Sequence
  Description of Artificial Sequence: Synthetic coding sequence
atggaacaagacaatagccctaggaagatccagtttaccgtgcccctcttagagcctcaccttgatccggaggccgctgaacagatccggaggcgccgccctactccagcaactttggtgctcacctccgaccaaagcagccccgaaattgacgaggacagaattcccaatcctcacctgaaaaagcttcagaacgcgtcacttaagctaacccgagaggctgtgcgtaatccggctcagaagaatccacagcctatttatcaccactggatccctagggaaccaacaagatgtcaccgcagagggggtactggtgggcaaaaaagcgtaggcggatttccatgttcgacccatactttggcccctttttacgttttcacgcgaagtattctgctgctgaaacgcggagaaagaatgagccatccgttagaaccaagggacgatccaaccaagatgccatag

SEQ ID NO: 130691 - DNA, 330 bp, Artificial Sequence
  Description of Artificial Sequence: Synthetic coding sequence
atggaaccaaattctccgaaaaaaatccagtttgcagtgccagtgtttcagtctcagattgctccggaggcagccgagcaaatcagaaagaggcgaccgacccctgcgagcctggtaattttgaacgagcacaatcctcccgagatcgatgacaaaagaggtcccaatacccagggagagctgcagaatgcctctcccaagcagagaaagcagagcgtctacacgcccccgacaatcaaaggagtcaagcacctgaagggtcaaaacgaatctgcgttccccgaagaagaagagggcaccaacgagcgcgaggaacaacgggaccattag

SEQ ID NO: 130692 - DNA, 330 bp, Artificial Sequence
  Description of Artificial Sequence: Synthetic coding sequence
atggagccaaactctccgaaaaaaatacaattcgctgtgcctgtctttcagagtcagattgctcctgaagctgcagaacaaattcggaagcggagacctactcctgcctcccttgtcatactgaatgagcataaccccccggagatcgatgataaaagaggcccgaacactcagggcgaactccaaaacgcctccccaaagcagcggaaacagtctgtctatacaccacctacaatcaagggcgtaaagcatctaaagggccagaatgagtccgccttcccagaggaagaagaagggacgaacgagcgtgaagaacagagggatcactag

SEQ ID NO: 130693 - DNA, 330 bp, Artificial Sequence
  Description of Artificial Sequence: Synthetic coding sequence
atggagccaaactcccctaaaaagattcagtttgccgttcctgtgttccagagtcaaatagccccggaggccgctgagcaaatccgtaaacgaaggcccacaccagcatctctcgttatactgaacgagcataacccacccgagattgacgacaaaagaggccccaacacccagggggaactgcagaacgcatctccaaagcagagaaaacagtcagtgtacacaccaccaacaataaaaggtgtgaaacacctcaaggggcagaacgagtcagcattcccggaggaagaagaagggactaatgagcgagaggagcaacgagatcattag

SEQ ID NO: 130694 - DNA, 618 bp, Artificial Sequence
  Description of Artificial Sequence: Synthetic coding sequence
atggcagcgagtacagctagtcacagacctatcaaaggcatcctcaagaacaaaacctcaaccactagcagtatggtggcctctgcagaacagcccagggggaatgttgacgaagaactgtcaaaaaaaagccagaagtgggatgaaatgaatattctggctacctaccatccggcggacaaggactacgggctaatgaaaatagatgaaccctccaccccataccatagcatgatgggggatgacgaggacgcctgtagtgacacggaggctaccgaggctatggctccagatatcctagcacgaaagctcgccgccgctgagggactggaacccaaatatagaatccaggagcaggagtctagtggagaagaggattctgaccttagtccagaggagagagaaaagaagagacagtttgaaatgaaacgtaagctgcattacaacgaaggtcttaacataaaactggcaagacagctgatttccaaagacctccatgacgacgacgaggacgaggagatgctcgagactgctgacggggaatccatgaacacggaagaatcaaatcagggatcgactccaagcgaccagcagcaaaataaattgaggtcctcttag

SEQ ID NO: 130695 - DNA, 3093 bp, Artificial Sequence
  Description of Artificial Sequence: Synthetic coding sequence
atgaaaatggccgacgcaaaacagaagcggaacgaacagctcaaaagatggattggctccgaaacagatctggaaccgccagtcgtcaagcgccagaaaactaaagtcaagttcgacgacggggcagtcttcctggcagcatgttcctcgggagataccgacgaagtgctcaagcttctgcatcgcggagcagatatcaactacgctaatgtcgatggactcactgcgctgcaccaggcctgcatcgacgacaatgtggacatggtaaagtttttggttgaaaacggcgcaaacattaatcaacccgacaacgaggggtggattccactgcatgccgcagcttcatgcgggtacctggatattgctgagttcctgatcgggcagggcgcccacgtcggggccgttaacagcgagggcgatacccctttagatatcgccgaagaagaggctatggaagagttactccagaacgaagtcaatcggcagggtgtcgacatcgaagctgctcgcaaagaagaagaaagaatcatgctcagagatgctagacagtggctgaactctggtcatatcaacgacgttcgccatgcgaagtccggcggtaccgccctgcacgtggctgctgccaaggggtacacggaggtgttgaaactgttgatccaggccggttatgacgtgaacatcaaggattacgatgggtggacccctcttcacgccgctgcccattggggcaaagaagaggcctgtcgaatcttggtggacaatctttgtgatatggaaatggtgaataaagtgggacagactgcctttgatgtcgctgatgaagacatcctgggttatctcgaagagctgcagaagaagcagaatctgctgcactcggaaaagcgggacaagaaaagccctcttatcgagtctaccgcaaatatggacaataaccagtcccagaagaccttcaaaaataaagaaacgctgatcattgaacctgagaagaacgcctctcgtatagagagcctggagcaggagaaagttgacgaggaagaggagggcaaaaaagacgagtctagttgctctagtgaagaagacgaggaggacgatagtgagagtgaggccgaaactgacaagactaagccattagcctctgttaccaatgcgaatacgagctcaacccaggccgcacccgtagcagtaaccactcccacggtgtcaagtggccaggctacacccacctcaccaatcaagaagttccccacaacagctactaaaattagtcccaaggaggaggagcgcaaagacgagtcgcccgcaacgtggcgactgggccttcgaaaaaccggatcatatggcgccctggccgagatcactgcctccaaggaaggtcagaaagagaaggacactgccggcgtcacaaggagtgccagttcccctagactgagcagctctctcgacaacaaagagaaagaaaaggacagtaaagggaccaggctggcatacgtggctcctactattcccaggcggctagcctccactagtgacattgaagagaaggaaaatcgggacagttctagtttacgtacatccagctcttatacccgtcgcaagtgggaagacgatctaaagaaaaatagtagtgtaaacgagggttctacctatcataagagctgttccttcggccgaagacaggacgatctgatctcctctagcgtgccttctacaaccagtactcccactgttactagcgccgcagggctgcagaaaagccttctgagctcaacctcgacgactaccaagatcacaacaggctcttcctccgctggcacccagagcagcacgtccaaccgactttgggcagaggacagcacagaaaaggagaaagattccgtcccgacggccgtgacaatccctgtcgcaccgactgttgtcaatgcggcagccagcaccacaaccctcacaactacaaccgctggaaccgtgtctagtacgactgaggtccgcgagcgacgtaggtcctacttgactccagtgcgggatgaggagagcgagtcacagcgcaaagctagatcccggcaggctcgacagagtagaagatccactcagggggtgacactgacagatcttcaagaggcagaaaagaccataggaaggagccggagcactcgcactcgtgagcaggagaacgaagaaaaagaaaaggaggagaaggaaaagcaggataaggagaaacaggaagagaagaaggaatccgagacttcgagggaggatgaatacaagcagaaatacagccgtacctacgacgaaacttaccagcgctatcgccccgtgtctacaagcagctcaaccacaccttcgagcagtctctctacgatgtcgagcagcctttatgcatcctctcagctcaataggcctaactcccttgtcggtattacatccgcgtactcccgcggaatcacgaaggaaaatgagcgtgaaggtgaaaagcgtgaggaagagaaggagggggaggataaatctcagcccaagtctatccgggaaaggcgtcgcccgcgtgaaaagcggcgtagcaccggggttagcttctggacccaggacagcgacgagaatgagcaggaacagcagtcggacacagaggaggggtcaaataagaaagaaacccagactgacagtatttctagatacgagacctcttccacaagtgccggggatcgctacgactcactattgggcagatcagggtcctactcttatctggaggaacgaaagccctattcctcccggttagaaaaggacgatagcactgacttcaaaaaattatatgagcagatcttagccgaaaacgagaagctcaaggcccagttgcatgacaccaacatggagctgacagatctcaagctacagcttgaaaaggccacccagagacaggagcggtttgctgacaggtccctactcgagatggaaaagcgagaaaggagagcactcgagagacggattagcgaaatggaagaggagcttaaaatgctgcccgatctaaaagcggataatcagcgccttaaggacgagaacggtgcactgatacgcgttatcagtaaactgtccaaatag

SEQ ID NO: 130696 - DNA, 2916 bp, Artificial Sequence
  Description of Artificial Sequence: Synthetic coding sequence
atgaaaatggcggatgccaaacagaagcggaatgagcagctcaaaagatggattggaagtgaaacagacctagagccacctgtggttaaaaggcagaagacaaaagtaaagtttgatgacggagctgtcttcctcgctgcttgctctagtggtgacacggacgaagtgctcaagcttctgcatcggggtgctgatatcaactacgccaatgtagatggattaacggctctccaccaggcctgcatcgacgataacgtggacatggttaaattccttgttgagaatggtgctaatataaatcagccagataatgaggggtggatacccctccacgctgcagcttcttgtggatatctggacatagcagagttcttaataggacagggagcccacgtcggggcagtcaactcagagggtgacacccccctggatattgcagaagaagaggctatggaggaacttttacagaatgaggtcaaccgccagggggtagatatcgaggccgccagaaaagaagaagagcgcatcatgttgcgcgacgccaggcagtggctcaacagtgggcacattaatgatgtgcgacacgccaagagcgggggaacagcgctgcatgtcgctgcagctaaagggtacaccgaggtgctcaagcttttaatccaggcaggctatgatgtgaatatcaaagactatgatggatggacacctcttcacgccgccgctcactgggggaaagaggaggcttgtaggatactggtagacaacttgtgcgacatggaaatggtcaacaaagtgggacaaactgcattcgacgtcgcggacgaggacattctcgggtacctggaagagttgcaaaagaaacagaacctgcttcattccgagaagagagataagaagagtcctttgatcgagtcgactgcaaatatggacaacaaccagagtcagaaaacgtttaaaaacaaggaaaccctaatcatcgaacccgagaaaaatgcttcacggattgaaagtctcgagcaggagaaagttgatgaggaggaggaggggaaaaaagatgaatcatcatgtagctcagaagaggatgaagaagatgactcggaatctgaagcggagacagataagactaaaccactggcaagcgttacaaatgctaacaccagctctactcaggctgccccagtggccgttactacccccacggtgtctagtggacaggccacacccacttcaccaattaagaagttccccacaaccgcaaccaagattagtcctaaggaggaagagaggaaggacgaaagtcccgccacctggcggctgggactaaggaaaactggaagctacggggcactagcggagattacagctagcaaagaaggacaaaaggagaaggataccgccggcgttactagatctgccagttcaccacgtctctcctcaagccttgacaacaaggagaaggagaaggactctaagggtaccagactggcatacgttgctccaacaattccaaggcgcctggccagtaccagcgacattgaagagaaggagaacagggacagtagttccctccgcacttcttctagttatactcggcgaaagtgggaggatgacctgaagaagaattcctcggtgaatgaaggttcaacctaccataagtcttgctcctttggtaggaggcaagatgacctcattagtagcagtgtcccaagcaccacatcgacacccactgtgacaagcgccgccgggctgcaaaagagtctattgtcttccacatctactacaactaagataacaaccggatccagtagtgctggtacccaaagccggagctatttaacccccgtccgtgacgaagagtctgaatcacaaagaaaggctcgctcccggcaggcccggcagtcaaggcggagtactcagggcgtcaccttaacagacttacaggaggcggagaagacaatcgggcgaagtcgatcaacccgcacccgagaacaggaaaatgaggaaaaagaaaaagaggaaaaggagaaacaagacaaagagaaacaggaagaaaagaaggaatccgagacaagcagagaggacgagtataagcagaaatacagcagaacttacgacgaaacctaccaaagatatagacccgtgagtacaagctcgagcactactccctccagctctctctctaccatgtcgtcgtcactgtatgccagttcacagttgaaccgtcccaattcactggtgggcatcacaagtgcatactcacggggtatcacaaaagaaaacgagagggaaggcgagaagagggaggaagagaaggagggggaggataagtcccagcctaaatctattagagagcggagaaggccacgagagaagaggaggtccacaggcgtgagcttctggacgcaggatagcgatgagaatgagcaggaacagcagtctgacacggaggagggcagcaacaagaaagagacccaggtcaataccattaccctctacgaaactagctctacttccgccggcgacaggtatgacagtcttttggggcgatcaggatcctatagctaccttgaggaacgtaagccctactcgtctaggttggagaaagatgattctactgactttaagaagctttacgagcaaatactggctgagaatgagaaactgaaggcccaactgcacgataccaatatggagttaacagaccttaaattgcagctcgagaaggctactcaacggcaggaacgctttgccgaccgttccctgctggaaatggagaagagggagcgcagagctctggagaggcgcatctcagagatggaagaggaattgaagatgctccccgatctcaaggcagataatcagcgcctgaaagacgagaatggagccctgatacgggtgatatccaaactgtccaagtag

SEQ ID NO: 130697 - DNA, 2925 bp, Artificial Sequence
  Description of Artificial Sequence: Synthetic coding sequence
atgaagatggcggacgccaagcagaaacgcaatgagcagctgaagcgctggattggttcagaaactgacctggaaccgcctgtagtgaaacggcagaagactaaggtgaaatttgatgatggagcagtgttcctggctgcctgttcctctggtgacactgatgaagtcttgaagctcctgcatagaggcgccgacatcaactacgccaacgtggacgggctgactgcacttcatcaagcttgcatcgatgacaacgtggatatggtaaagtttctcgtggagaacggggcgaacatcaaccagcccgataacgaaggatggatccccctgcatgctgccgcttcttgtggctatctggacattgccgagtttctgatcggtcagggggcccatgtcggggccgtgaatagcgaaggagatacgcccttggacatcgccgaggaggaagctatggaggagcttttacaaaacgaagttaaccgtcagggcgttgatattgaggccgcacggaaagaggaggaacggataatgctgcgggatgcgagacaatggctgaacagtggtcacattaacgacgtaaggcacgctaaatcaggcggcacagccctgcacgtagcagcagctaaaggctataccgaagtgctgaaactccttattcaggctggatatgatgtgaatattaaagactacgatggttggacgcctttacacgcggctgctcattggggtaaagaagaagcgtgtcgcatcctggtggataacctatgcgatatggaaatggtcaacaaggttgggcagaccgcattcgacgtcgctgatgaagatatactaggctatttggaggagctgcagaagaagcaaaatttgcttcacagcgaaaagagagacaaaaaatcgccccttatcgagagcacagccaatatggacaataaccagtcccaaaagacatttaaaaataaagagaccctaatcattgagcccgaaaagaatgcaagccgtattgaaagtctggaacaggaaaaagtggacgaggaggaagaaggcaaaaaggatgagagttcgtgcagcagcgaggaggacgaagaagatgactccgagagcgaggccgagaccgacaaaaccaaacccctggcaagtgtgaccaatgccaacacaagctctactcaggctgccccagtggccgtaaccacccccacagtgtctagtggccaagcgacgccaacatcaccaattaaaaagttccccaccaccgctaccaagattagccctaaagaagaggaaagaaaggatgagtcccctgccacatggcggttaggtttaagaaaaaccgggtcttacggcgccctggcagagatcactgctagcaaagaaggccaaaaggaaaaagacactgctggcgtaacacgatcggctagctctccccgcctctcctcgagcctggacaacaaggaaaaggaaaaagatagtaagggcacgcgcctggcgtacgtcgcaccaaccataccaagacgcctagccagtacatctgatattgaggaaaaagaaaaccgcgattccagttctctgagaacgtcaagctcctatacccggcgcaagtgggaagacgatcttaaaaaaaattctagcgtgaacgagggttccacctaccacaagagtactagtaatcgcctttgggcagaggattcaacggagaaggagaaagacagtgtcccgactgcagtgacaatcccagtggcacccacggtagtcaacgccgctgcctccactacaacactcaccacaacgactgcaggtacagtgtcgagcactacggaagttagagagaggaggcggtcttaccttactccagtgagggacgaggagtctgagtctcaaagaaaagcacggagccggcaagctcgacagagtcgtcggtccacccagggagtcactttgaccgacttacaggaggctgagaaaacaattggccgtagtaggtcgacacgtacacgagaacaggagaatgaagagaaggaaaaagaggagaaagaaaagcaggacaaggaaaagcaggaggagaagaaagagtcggagactagccgagaggatgaatacaagcaaaaatacagccggacatacgacgagacctatcagaggtaccgaccagtgagtacaagttccagcaccaccccgagctcatctctgagtacgatgagttcttccctttatgcctccagtcaactgaaccgaccaaactccctcgtaggaattactagcgcttatagccgcggaatcacgaaggaaaacgagcgcgagggggaaaaacgagaggaagaaaaagagggagaggacaagtcacagcccaagagcattagagaaagaaggagacctcgggaaaagagacggtccacaggagtgagcttttggacccaggacagcgacgagaatgagcaggaacagcagtcagataccgaggaggggtcgaacaagaaggagacacaggttaacacaattacactgtatgaaacctctagcacctccgccggagatcgctatgatagcctgttggggcgtagcgggtcctattcatacctcgaagaaaggaagccttactcttccagactggaaaaagacgactcaaccgatttcaaaaagctttatgagcaaatactggctgagaacgaaaagctcaaagctcagctgcatgacactaatatggagctgaccgacctgaagctgcaactagagaaagcgactcaaaggcaggagaggttcgctgacagatccttgctcgagatggagaagcgagaacggcgcgctctcgagaggcggatcagtgaaatggaggaggagttaaaaatgctgcctgatctgaaagctgacaatcagcgactgaaggacgagaatggggcccttatcagggtaattagcaagctgtctaaatag

SEQ ID NO: 130698 - DNA, 2988 bp, Artificial Sequence
  Description of Artificial Sequence: Synthetic coding sequence
atgaaaatggccgacgcaaaacagaaaaggaacgagcagctgaaaagatggattgggtctgaaacggaccttgaacctcctgtggtgaaacggcaaaagacaaaggtcaagtttgatgacggcgcagttttcctggctgcctgttccagtggagacactgatgaggtactaaagctgctgcacagaggagccgacattaactatgccaacgtggatggtctgactgcccttcatcaggcttgcatcgatgacaatgtcgacatggtcaaatttttggtggagaacggcgccaatatcaatcagccagacaatgagggttggatccctttacacgcagccgcctcctgcggttatttagacatcgctgaattcctgatcggacaaggagcccatgtcggagcagtgaattcggaaggagacaccccactggacattgcggaagaagaagccatggaggaattacttcagaatgaggtgaataggcaaggcgtggacattgaggctgctcgcaaagaagaggaacgtattatgcttcgtgatgcccgccagtggctgaatagcggacacataaacgacgttaggcacgccaagtccggggggacagctctccacgtggccgccgccaaaggctacactgaggtgctgaaactgctgatacaggccggatacgatgttaatatcaaggactacgatggatggacccccctccacgccgccgcccactggggaaaggaggaagcatgccggatacttgtggacaacctgtgcgacatggagatggtgaacaaggtcggacaaacagcattcgatgttgcggatgaggatatcctgggctacctagaggagctgcagaagaaacagaacctgctgcacagcgagaagcgggataagaagtcccctctgatcgaaagcacagccaatatggacaacaaccagtcacagaagacatttaagaacaaagagactctgattattgagccagagaagaacgctagcagaattgaaagtctggagcaggagaaggtcgatgaagaagaggaagggaaaaaggatgaatcttcctgtagctctgaagaggatgaggaggacgattcagagagcgaagcagaaacggataaaacaaaaccgctggcttccgttaccaatgcaaacacctccagcacccaggccgccccagtggccgtgactactcccaccgtaagctctggacaagcaacacccacaagccccataaaaaaattcccgacaaccgccaccaagataagtcctaaggaagaggaaaggaaagacgagtctcccgcaacgtggagactcggcctacgaaaaaccggatcatatggcgccctcgccgagatcaccgcaagcaaggaaggtcaaaaagagaaagatactgccggcgttacacggagtgccagctcgccacgcctttcctcgtcactggacaataaagagaaagaaaaggacagtaaagggacccgcctggcctatgtcgcgccgactattccaaggaggcttgctagcacatcggatatagaggagaaagagaatcgtgattcctccagtctgcggacctctagctcatacacgcgtcggaagtgggaggacgacctgaaaaaaaactcaagcgttaacgaaggcagcacctaccacaaatcttgcagtttcggccgcagacaggatgatcttatctcgtcttcggtgccatccaccacttctacccccactgtaacctctgcggccggtctacaaaagtcactgctgtcatccactagtacaacaacgaaaattaccactggtagcagttccgcggggacgcagtcctcgaccagcaaccgcctctgggccgaggatagcactgagaaagagaaggacagtgtgccaaccgcggtgacaattcctgtggcccctacagtcgtgaatgcggcggctagtactaccacacttacaactactactgccgggacggtgtccagcacaacggaggttagagaacgtagaagatcatacctgacacccgtgagggatgaggagagtgagagccaacgcaaggcccgctcacggcaggctcgccagtcaagacggagcacgcaaggcgttaccctgaccgacctgcaagaggccgagaaaacaatcggaagatcacggagcaccaggaccagggagcaggagaatgaggagaaagaaaaggaagaaaaggagaaacaggacaaagagaagcaggaggaaaaaaaggagtctgaaacatcacgtgaggacgaatacaagcagaaatatagtcgcacgtacgacgaaacttatcagcgctatcgaccggtcagcacgtcttcttccactacaccgtcctccagcctttctactatgtcatcatccttatacgcttcatcccagctcaatagacccaactctttggtggggatcacttccgcttatagccggggaatcaccaaagagaacgaaagggaaggggagaagcgagaagaggagaaagagggcgaagacaaatcacagcccaagtctattcgagaacgacgtaggccgcgcgaaaagagacggtctacaggtgtctcattctggacccaagactctgacgaaaacgaacaggagcaacagtccgatacggaggaggggagcaataaaaaggagacgcaggtgaacactatcactctctacgaaacaagtagcaccagtgctggcgatcggtacgactccctcttggggagatccggctcatactcctatttagaagagcgtaagccttattcttcaaggttggaaaaagatgatagcacagacttcaaaaagcgacaggagcgattcgcagaccgctctctgctcgaaatggaaaagcgcgaaagacgggcgctggagagacggatctccgaaatggaggaagagctgaagatgctcccagatttgaaggcagacaaccaacgcctcaaagacgagaacggcgctttgatcagagtgatctcaaagctcagcaagtag

SEQ ID NO: 130699 - DNA, 2988 bp, Artificial Sequence
  Description of Artificial Sequence: Synthetic coding sequence
atgaaaatggcggatgccaagcagaaacgtaacgaacagctaaaacgttggataggcagcgaaacagatctggagcctccagtcgtcaagaggcaaaagactaaggttaagtttgacgatggcgccgtgttcctagccgcgtgctcatctggtgacacagatgaggtgttgaaactgttgcatagaggagccgatataaactacgctaatgtggatgggctcacagctctccaccaagcctgcatcgacgataacgtggatatggtcaagttcctcgtggaaaacggggccaacattaatcagccagacaacgagggatggatcccacttcacgcagctgcctcatgtggttacttagatatagcagagttcctgattgggcaaggtgctcacgtgggcgcagtcaactctgagggagatactcccctggatattgctgaagaagaggctatggaagaactgctccagaacgaggttaacaggcagggtgtggatattgaggcagcacgcaaggaggaggagcggatcatgcttagggacgcccgccagtggttaaattctggtcatatcaacgacgttcggcatgcgaaaagcggaggcacagcactccatgtggctgctgccaaggggtacaccgaggtactcaaacttctcattcaagctggctacgatgtgaatatcaaggactacgatgggtggaccccattgcacgcggcagctcactggggaaaggaagaggcctgccgtatcctggtcgacaacttgtgtgatatggagatggtcaataaagtaggacagaccgccttcgacgtggctgatgaggatatcttgggatatttggaggaactgcagaaaaaacagaacttactccactcagaaaagagggataagaagtccccactcatagagagcaccgcgaacatggataacaaccagtctcaaaagacttttaaaaacaaggagacactgattattgaaccagaaaagaacgctagccgtattgagtctctcgaacaggagaaggtcgacgaggaagaggaaggtaagaaagacgaatcctcttgctcctccgaagaagacgaagaggacgactcggaatcagaagccgaaaccgacaagaccaagcctctagcatccgtgacaaatgctaacacctccagtacacaagccgctccagttgctgtgaccacccccaccgtctcctcgggacaggctacacccacttcccctattaagaagtttccgactacagcaacgaaaatttcgcctaaggaggaggagcgcaaggacgagagtcctgcgacctggcgcctcggtttgagaaagacagggtcttatggagccctagcggagatcacagccagcaaagagggtcagaaggaaaaggacacagcgggggtcacaaggtccgccagctctccccggctgagctccagcttggataacaaagagaaagagaaggacagcaaggggacccgtctcgcatacgttgccccaaccattccgagacgcctggccagcacaagcgacattgaagagaaagagaatcgcgatagcagctccctgcggactagctctagctataccagaagaaaatgggaagatgatctaaaaaagaatagcagcgtgaatgaggggagcacataccacaaaagttgcagcttcgggaggcgccaagacgacctaattagctcgagcgtgcctagcacaacgagcacacctaccgtcacaagcgcagctggactgcaaaagtccctgttgagctctacatccaccaccacaaaaatcacaactggatcaagctctgccgggacccagtccagcacctccaaccgactctgggcagaagattctaccgagaaagagaaggatagtgtcccaactgcagtcactattcccgtcgcccccaccgtcgttaacgccgctgcctccaccacaactctgacaacaaccacagctggaacagttagcagtacgacggaagtgagagagagacgaagatcctatctcacacctgtccgcgatgaggagagcgagagccagaggaaggcacggtcccggcaggccaggcagtcaagaagaagcacccagggcgttacgctcacagacctgcaggaggccgagaaaactatcggccgctcccggtcaacaaggaccagggaacaggagaacgaggagaaggagaaagaggaaaaggagaaacaggataaagagaaacaagaggaaaagaaggaatctgaaacaagccgggaggatgagtataaacaaaagtactcccgaacctacgatgagacctatcagagataccggcccgtgtcaacttcatcatctaccactccttccagttccctgagcaccatgtcatctagcctgtatgcctcgtctcagttaaaccgcccgaattccctggtcggaatcacctcggcatacagtcgcggaattactaaggagaatgagagggaaggagaaaaaagagaagaggaaaaagagggagaggataagtcccagcctaaatctatcagggagcgtcgacggccccgggaaaaaaggcgctccactggggtgtcattttggacccaggattcagatgagaatgagcaagaacagcaaagcgacaccgaggaaggatcaaataagaaggaaacccagactgattctattagtcgttatgaaactagctccacgagcgcaggggacaggtatgacagtctcttgggcaggtcagggtcctatagctatctggaagagagaaagccctattcctcaagactggagaaggatgactcaactgactttaaaaaacgccaggagcgattcgcagaccgctccctgctggagatggagaagagggaaagacgggctctggagcgccgtatcagtgaaatggaggaggagctgaaaatgcttccggacctaaaagctgataaccagaggctgaaagatgaaaatggtgccttgattcgcgtcatttccaagctcagcaagtag

SEQ ID NO: 130700 - DNA, 3093 bp, Artificial Sequence
  Description of Artificial Sequence: Synthetic coding sequence
atgaaaatggccgacgcaaaacagaaacgaaacgagcagttgaagaggtggatcggctctgagactgacctggaacctccagttgtgaaaagacaaaagacgaaggtaaagtttgatgacggcgccgtctttctcgctgcttgcagctccggcgatactgacgaagttctaaagctgctccaccggggagccgatataaactacgccaacgtggatggtctgactgccttacaccaggcctgcattgacgacaatgtcgacatggtgaagtttcttgtagaaaatggggctaatattaaccagcccgataacgagggttggatccctttacacgctgccgcaagctgcgggtatttggacattgccgagttcctgataggtcagggtgctcacgttggggctgtcaactccgagggcgacacccctctggacatcgcagaagaggaggccatggaagagctgctgcaaaatgaggtgaacaggcagggggtagacatcgaagccgcacggaaggaagaggagaggattatgttacgtgacgctcgtcagtggctgaattctgggcatatcaacgatgtgaggcacgccaaatcaggcggcactgctctgcatgtggccgcggctaagggatataccgaggtcttaaaactgctcattcaagccggatacgatgtgaatatcaaggattatgacgggtggacgccccttcacgctgccgcacactggggcaaggaggaggcatgtagaatcctggtggacaatttatgcgacatggaaatggtcaataaggtcggacagactgcttttgatgtggccgatgaagatattctcggataccttgaagagctgcagaagaagcagaatttactgcattctgaaaagagagacaagaagagtcccctgatagagagtaccgctaacatggataataaccagtcccagaagactttcaaaaataaagaaaccctgatcatagaaccggagaagaacgcctcaagaattgagagcctggaacaggagaaagtggacgaagaagaggaaggcaaaaaagatgagtcaagttgcagctcagaagaagacgaggaagacgactctgagagcgaggccgaaacagataagacgaagcctctggccagcgtaacgaacgccaacacgagtagtacgcaagctgctccagtggcagtgaccacccccactgtaagttccgggcaagccacccctaccagtccaatcaaaaaattcccaacaacagctaccaagatcagcccaaaagaagaagagcggaaagatgagtcacccgccacttggagactgggcctcaggaaaacaggctcctatggggccctcgctgagatcactgccagtaaagagggccaaaaggagaaggatacagcaggcgtgactcgctccgcatcttcgcctagactaagttcaagccttgacaataaagaaaaagaaaaagactccaaagggacaagactggcctacgtggcacccaccatcccaaggaggttagcgtctacctccgacatagaggaaaaggaaaatcgggactccagctcgttacgaacctctagcagttatacccggaggaagtgggaagatgacctgaaaaaaaactcttccgtgaatgaaggcagcacttaccacaagtcctgtagctttggccgaaggcaggacgacctcatctcatcatcggtcccttccacgaccagtactcccaccgtcacttcagccgccggcttacagaaaagcctgctatccagcacaagcactaccacgaagatcacaacgggttcttccagcgccggcacgcagagctctactagcaaccgactgtgggctgaagacagtactgagaaggaaaaagactctgtcccaaccgccgtgactattcctgtcgcccccaccgttgtcaatgctgctgcctctaccacgaccctgaccaccaccacagccggtacagtgtcttccaccaccgaggtccgggagcgcagaagatcttacctgacccctgtgagagatgaagagagtgagtcgcagaggaaggccaggtctagacaggcacgtcagtcacggaggagcactcagggtgtaactttaaccgacctacaggaggcagagaaaactatcggccgatcccgtagtacccgcacgcgggaacaggagaatgaggagaaagagaaggaggagaaggagaaacaagataaggaaaagcaggaggaaaagaaggaaagtgaaacaagccgggaagacgagtataagcagaaatattctagaacttatgacgaaacctaccaacgttacagacctgtgtccacatcgtcttcaaccactccatcatcgtcattaagcacgatgagttcttccctctacgcctctagtcagcttaaccgtcctaatagtctggttgggattacatctgcatactctagggggatcacaaaagaaaacgaaagagagggggagaaaagagaggaagagaaggaaggtgaggacaagtcccaaccgaaatcgatcagggagcgtagacggccccgagagaaacgccgatctaccggcgtatccttctggacgcaagactctgatgaaaacgaacaagagcaacagtcagatacagaagagggatctaacaagaaagagacccaaacagactctatttcaagatatgaaacgtcatcgaccagtgcgggggatagatacgattcactgctggggcggtccgggtcctactcctacctcgaggaaaggaagccctactcttccagactagagaaagacgatagcaccgatttcaagaaattgtacgagcaaatcctggctgagaacgagaaattaaaggcccaacttcatgatacgaatatggagctcacggaccttaaattacagctggagaaggcaacccagaggcaagaacgattcgcggatcggagcttgctggagatggaaaagcgtgaacgaagagcactggagcgccggattagcgagatggaagaagagctaaagatgctgccagatctcaaagcggataaccagcgcttgaaggatgagaatggcgcattaatacgggtgattagtaaactgtcaaagtag

SEQ ID NO: 130701 - DNA, 3093 bp, Artificial Sequence
  Description of Artificial Sequence: Synthetic coding sequence
atgaaaatggccgacgccaagcagaaaaggaatgagcaattgaagaggtggataggatcagagacagacctggagccccccgtggtgaagcgtcagaagaccaaagtgaagtttgatgatggcgctgtgtttcttgctgcctgctcaagtggcgacacggatgaagtgttgaaattactccatcgcggcgccgatatcaactatgcaaacgtcgacggtcttacggccctgcatcaggcctgtattgacgataatgtcgacatggtcaagttcctggtggagaacggggctaacattaaccagcctgacaatgagggctggattccactacacgctgccgctagctgtgggtacctggatatcgccgaattcctcatagggcagggcgcccatgtcggggccgttaacagtgagggggacaccccacttgacattgccgaggaggaggccatggaggaattgcttcaaaatgaggttaatagacagggcgtggatattgaggctgccaggaaggaggaagaaaggatcatgttgcgggatgcaaggcaatggctaaattctggccacattaacgacgtccgccatgccaagagtggaggcacagccctgcatgttgctgcagctaaaggatatactgaggtcttgaaacttctgattcaggctggatatgatgtaaacattaaagactacgatgggtggacccctctccacgcggcagcccattgggggaaggaggaggcgtgtcgcatcctggtagataacctttgcgacatggagatggttaataaggtagggcagactgcatttgacgtggctgatgaggatatattgggctaccttgaagagctgcagaagaaacaaaatctgctgcatagtgagaagcgcgataagaagagtccactgatcgagagtaccgccaacatggataacaaccagtcccagaaaactttcaaaaacaaggaaacactgatcattgagcccgaaaaaaacgcttctaggattgagagccttgagcaagagaaggtcgacgaagaggaagaaggaaaaaaggacgagagtagctgctcatcggaggaggatgaggaagatgactccgagagtgaggcagaaacggacaaaactaaacctctcgcctcagtgactaacgccaatacctcctcaactcaagccgcccctgttgccgtaaccacgcccaccgtgtctagtggacaggcaacccctacttcacctatcaagaagttcccgactacagcaactaagatctcacctaaagaggaggaacgcaaagatgagtcacctgccacttggcgcttaggcctgcgcaaaaccgggagttatggagctctcgcagagatcacagcttctaaagagggacagaaagagaaagatacggcgggggtcacaagatcggcctctagtccgagactcagctcaagtctggacaacaaggagaaggagaaagattctaaaggaacacgtttagcctatgtggcaccaactatacccagacggctggcttcaacgtccgacatcgaggaaaaggaaaaccgggacagttcttctctgagaacctcaagctcttacacaaggagaaagtgggaggacgaccttaaaaagaattcgagtgtcaatgagggatcaacttaccacaagagctgcagctttgggaggaggcaggatgatttgatatcttcaagtgtgccgtccactaccagcactcctaccgttacctcagcggctggcctgcaaaagtcactgctcagctctacgtctacgaccaccaagatcacaacagggagctcctcagccgggacgcaatccagtacctcaaaccggctgtgggccgaggacagcacagaaaaggaaaaagacagcgtgcccacagctgtgaccatccccgtcgctcctactgtggtgaacgccgctgcatctacaacgacgctgacgaccaccacggcaggcaccgtctccagtactaccgaggttcgcgagcgaaggaggagttacttaactcccgtgcgcgacgaggaatcagaatcacagcgtaaagcaaggtctcgtcaggcccgacagtctcgtcgctccacacaaggggtaacccttactgatcttcaagaggcagaaaaaacgattggtaggagtcgctctacaaggacacgggagcaagaaaacgaagagaaggaaaaggaagagaaagagaagcaggataaggagaaacaggaagagaagaaggagagcgaaacatcccgcgaagacgagtacaaacaaaagtattctcgaacctacgatgaaacctaccagaggtatcgaccagtttctacctctagctctaccacgccctccagctccctgtcaactatgtcctccagcctatacgcttcctcccagttaaatcgacccaacagcctagttggaattacgtccgcatattccagaggcatcactaaagaaaacgagcgagagggggagaaaagggaggaggaaaaagaaggagaggacaagagccagcccaagagtattagagaacgacgcaggcctcgagaaaaaaggcggagcaccggcgtgagcttctggactcaggattcagacgagaacgagcaggagcaacagtcggacaccgaggaaggctctaacaaaaaggaaacccaggtgaatacaattactctctatgagacgagcagcacatctgcaggtgataggtacgattccctgctgggacgaagtggatcttatagctacctggaagaaagaaagccatactcctcacgcctggagaaggacgattccaccgatttcaaaaaattgtacgaacaaattcttgctgagaacgaaaagctgaaggcacagttgcatgatacaaatatggaactgactgatctgaaacttcagctggaaaaggccactcaacggcaggaacgttttgccgatcggagcttactggaaatggagaagcgggagaggagggcattagagcggcggatcagcgagatggaggaggaacttaaaatgctaccagacttaaaagctgataatcagcggctgaaggacgaaaacggggcattaatcagagtgatttctaagctctccaagtag

SEQ ID NO: 130702 - DNA, 2832 bp, Artificial Sequence
  Description of Artificial Sequence: Synthetic coding sequence
atggtgaagttcctagtcgaaaacggcgcgaatatcaaccagcccgataacgaaggatggattcctctgcacgccgccgcctcatgcgggtacctggacatcgcagagtttttaatcggacaaggcgctcatgtgggtgcagtgaacagcgagggagacaccccactcgatatagcagaggaagaagctatggaggagctgttgcagaatgaagttaatcggcagggcgttgatatcgaggccgctcgtaaagaagaagagcggattatgcttcgggatgcgagacagtggttgaactcgggacacatcaatgacgtgcggcacgctaaatccgggggcacggcattacacgtggccgctgcaaagggctataccgaggttcttaagttattgatccaggctggttatgacgtcaacattaaggattacgatggctggactcccctgcatgcagcggcgcactggggtaaggaagaagcgtgcaggatcctggtggacaacctttgtgacatggagatggtcaataaggtcggacagaccgccttcgacgtagctgacgaggatattctgggctatttggaagagctgcagaaaaagcagaatctgttgcactccgagaaaagggataagaagtcccctctgatagagtctacggcaaatatggacaacaatcagtcccagaagaccttcaaaaacaaggagactctgataatcgaaccggagaagaatgccagtcggattgagtctctagagcaagaaaaggttgatgaagaggaggagggcaagaaggatgagagtagctgttcctccgaggaggatgaagaggacgacagcgagtctgaggctgagacagacaagactaaaccattagcttccgttactaacgctaatacatctagcacgcaggccgctccagtggctgtgaccaccccgacagtgtcttcgggccaagcgacacctactagccccattaagaaattcccgaccacagccacaaagattagtccgaaggaagaggaacgaaaggatgaaagccccgcaacctggcgcctgggattgaggaaaacaggcagctatggagccttagccgaaattactgcatccaaggaaggtcagaaagagaaagatactgctggcgttactagatccgccagtagccccaggctgagtagtagcctggataataaagagaaggaaaaggattctaaagggacacgcttagcatatgtagctcccacaatcccccggcgcctcgcatccacctctgatatcgaagaaaaggagaatagggactccagcagcctgaggaccagtagtagttacaccagaagaaaatgggaggacgatctcaagaagaacagtagcgtgaacgagggaagcacttaccacaagtcatgcagctttgggcggcggcaggatgacctcatttccagtagcgttccatccactacgtcgacacccaccgtgacgtccgccgccggactgcagaaaagtttacttagttcaacatccaccactactaagattaccacagggagtagcagcgccggaactcagagttctaccagcaaccgcctctgggccgaagattctacggagaaggagaaagactctgttccaaccgccgtaacaatccctgttgctcctaccgtggtaaatgccgccgcttccaccaccacgctgacaaccactacggccggcactgtatcatctacgacagaagtgcgagagcgtcggcgctcttacttaaccccggtgcgggacgaggaaagcgagtctcagcgaaaagctaggtccagacaggcccgccagtctaggcggagtacgcagggggtgaccctgactgacctgcaggaagccgaaaaaaccattgggcgctctaggtcgacacgtactcgagagcaggagaatgaggagaaagagaaggaggagaaggagaaacaggataaggagaagcaggaagagaaaaaggagtcggaaacaagtcgggaggatgaatacaaacagaaatatagccgaacctacgacgaaacttaccagagatatcgtcctgtgtccacgtcaagcagtaccacccctagcagcagcctctctactatgtcatcttccctgtatgcctcatcgcaactgaaccgtccaaacagtctagtcgggatcacatctgcctatagtaggggcattacaaaagagaatgaaagagaaggggaaaaacgggaggaagaaaaagagggcgaagataaatctcaaccgaaaagtattagagagcgccgtaggccccgcgagaaaagacgatccacaggcgtctccttctggacccaagactcagatgagaacgaacaagaacagcagtctgataccgaggaggggtcaaacaagaaggagacccagacagattcaattagcaggtacgagacatcctcaacatctgccggagaccgctatgactcacttcttggccgatcgggtagttactcttatctggaagagagaaagccatattcttccaggctggagaaagacgactcaacagatttcaagaagttgtacgagcagatcctggccgaaaatgaaaaactcaaagcacaactgcacgacacgaacatggaactcaccgacctcaaactccagctagaaaaagcaacgcagcggcaggagagatttgccgatcgttccctcctggaaatggagaagagggagaggcgcgctctggaaaggcggatttcagagatggaggaggagctgaaaatgctcccggacctgaaggccgataaccagcgcctgaaggacgagaatggcgccctgattcgagtgatctccaaacttagtaaatag

SEQ ID NO: 130703 - DNA, 2925 bp, Artificial Sequence
  Description of Artificial Sequence: Synthetic coding sequence
atgaagatggctgatgccaaacaaaaaaggaatgagcaactcaaacggtggataggatctgagaccgacctggagcccccggtcgtcaagcggcagaaaactaaggtaaagttcgatgatggggccgtgttcctcgctgcttgctcttctggggatactgatgaggtgttgaagttgctacaccggggcgccgatatcaactatgcaaatgtagatggcctgacagctctccaccaggcctgtatcgatgataacgtagatatggtgaaatttttggtggaaaatggagctaatattaatcaaccagataacgaagggtggatcccattgcacgccgcagcatcctgtggttacctagacattgctgaatttctgattggacagggagcacacgtcggagctgtcaacagcgaaggtgacacaccattggacatagcagaggaggaagccatggaggaattgttgcaaaacgaggtcaaccggcaaggtgtggatatcgaagctgcaagaaaggaggaggagcggatcatgctccgtgacgcccggcaatggcttaactccggccacatcaatgatgttagacacgccaagagtggagggacagccctgcacgtggctgcagctaaggggtacacagaggttctgaagcttctgatccaagccggttatgatgtgaacattaaggactatgatgggtggacaccactgcacgctgctgcacattggggcaaggaggaggcctgtaggattttggtggacaatctgtgcgacatggagatggtgaataaagtgggccaaactgcgtttgacgtggcagacgaggatattttgggctacctggaggaacttcagaaaaagcaaaacctcttacattcagaaaagagagacaagaagtcacctctaatcgaaagcaccgcaaatatggacaataatcagagtcaaaagacatttaagaataaagagactctcataatcgaacctgagaagaacgcatcaaggatcgagtctctcgagcaagagaaggtggatgaagaagaagaagggaagaaggatgagtccagctgttcctcagaggaggatgaggaagacgactccgaaagcgaggccgaaacggataagaccaaaccgttggcaagcgtgaccaatgccaatactagtagtacgcaagcagccccggttgctgtgaccacacccaccgtctcaagcggacaggccacaccaacatcccctatcaaaaagtttcccacaactgccaccaagatcagccccaaggaagaggagaggaaggatgagtcccctgccacatggaggctcggacttcgcaagacaggaagttatggagctctagcagagattaccgcgtcaaaggagggacagaaagagaaggataccgcgggggttacacgctcagcctcttctccccgcttatcgagctcgctggacaacaaagagaaagagaaggatagcaagggcacacgactggcctatgttgcccccacgattccgcgccgcctcgcctccacctcagatatcgaggagaaagaaaatagagacagtagctctttaaggacatcttcgagctacactcggaggaagtgggaggatgacctaaaaaaaaactccagcgtgaatgagggctccacctatcacaaaagtacctccaaccggctgtgggctgaagattccacagaaaaggagaaggattcagtacccaccgctgtgacaatacccgttgcacctactgtggtcaacgcagcagcgagtactaccactctgaccaccactaccgccgggaccgtgtcatccactacagaggttcgagaacggaggagatcttacctcacacccgttcgtgacgaggagagcgagagccaaaggaaggcaagatcaagacaggctaggcaaagtagaaggtcaacccagggagttaccctcacagacttgcaggaggccgagaaaacaatcggcagaagtaggtctactcgaactcgcgagcaggaaaatgaggagaaggagaaggaagaaaaggaaaaacaggataaggagaaacaggaggaaaagaaagagtctgaaacgtcacgagaagatgagtataagcagaagtatagcagaacttatgacgagacttaccagaggtatagaccagtatccacaagctcttctactaccccttcttcttctctttcgaccatgtcatcatcgctctatgcctcatcccagctgaatcggccgaatagtctggttggtattacaagcgcttacagtagggggattacgaaggagaacgagcgggaaggggagaaaagggaggaagaaaaagagggggaggataagtcccagcctaaaagcattagagaacggaggcgcccacgggaaaaaaggcggagtactggcgttagtttttggacacaagactcagatgaaaacgaacaggaacaacaatccgacacggaggaagggagcaataaaaaggagacccagaccgatagtatttctaggtatgagacttcctccacctctgctggggaccggtacgactcactgctcgggagatcagggagttattcgtacttagaggaacggaagccctattccagtaggttagaaaaagatgacagcaccgattttaagaagctgtatgagcagatcctagcagagaacgagaagctaaaagcacagctccacgatacaaacatggagcttacggatctgaagctacagctggagaaggccacgcagaggcaggaaaggttcgccgatcggagtcttctcgaaatggagaagcgcgagagacgggctcttgagaggagaatcagtgagatggaggaagagctgaaaatgcttcccgacctgaaggctgataatcagaggttaaaagacgaaaatggggctcttatcagggtgataagcaagcttagcaaatag

SEQ ID NO: 130704 - DNA, 2949 bp, Artificial Sequence
  Description of Artificial Sequence: Synthetic coding sequence
atggccgagctggagcaccttggaggcaagcgagctgaaagcgccagaatgcgcagggcagaacagctgcggaggtggagggggtctctgacagaacaagaacctgctgaacgaagaggagctggcagacaacccctcacccggaggggatccccacgtgttaggttcgaagatggtgccgtgttcctggcagcatgtagcagtggagataccgacgaagttcggaaactgttggcccggggagccgacataaacacagtgaacgtggacgggctgaccgccttgcatcaggcttgtattgatgagaacctggacatggttaagtttctggttgagaaccgggctaatgtcaatcaacaggataatgaagggtggacacccctgcatgccgctgcctcttgcggatacctgaatattgccgagtatttcatcaatcatggggcttccgtgggcatcgtgaactcggaaggtgaggtaccatctgacttggcagaagagcctgctatgaaggacctcctgctcgagcaggtgaagaagcaaggggtggatcttgaacaatcccgcaaggaggaggaacagcaaatgctgcaagacgctagacagtggttgaattcaggcaagattgaagatgtgagacaagcacggagcggcgctacagctctccacgttgcagccgcgaagggctacagtgaggtattgaggcttctgattcaagccggctacgagctgaacgtgcaggattatgatggctggactcccctccatgcggcagctcactggggtgtgaaagaagcgtgctccatcctcgcagaagccctgtgtgatatggacataagaaataagctgggccagaccccatttgacgtggccgacgagggcttggtcgaacacttggaattgctacaaaagaaacagaacgtgcttcgctccgaaaaggaaactagaaacaagctaattgagtccgatttaaattctaagattcaatcaggtttctttaaaaataaagaaaaaatgctgtacgaggaagagacccctaaaagccaggagatggaggaggagaataaggagtcttccagcagtagcagcgaggaggaggagggcgaggatgaagccagtgagtctgagacagagaaagaggcggacaagaagccggaggcgttcgtgaaccactccaacagtgagagtaagtcttctatcacggagcagatccccgcgcctgcccagaacacattcagtgcctcttcggcaaggaggttctccagcggactgtttaataagccagaggaacctaaggacgagtcaccctcttcttggcgcctgggtcttcggaagacaggcagccataatatgcttagcgaagtcgccaattcaagagaacctattcgcgacaggggctcatctatttaccggtccagttcgtcacctcgtatcagtgccctgctagacaacaaggataaggaacgggagaacaaaagttacatttctagcctggctccacgaaagttaaactccacgagtgatatcgaagagaaagagaaccgtgagagcgctgttaacttagtccgcagtgggagttatactaggcagctgtggagagacgaggccaagggaaatgagattccacagacgatagccccaagcacatacgtgagcacttatctaaagaggacaccacacaaaagtcaagctgacacgaccgccgagaagacagccgataacgtcagttcttcgacaccgctgtgtgtaatcactaaccggcccctgccttcaaccgccaacggagtgaccgctacccccgttctctcaattactggaacagacagctccgtggaggcgagagaaaaacgtcgctcctatctaacccccgtacgcgatgaggaagccgaatcgctccggaaagcaaggtccagacaggcgaggcagacaaggaggtccactcagggcgtgacactgaccgatttgcaggaggctgagaggaccttctcccggagcagagccgagcgtcaggctcaggaacagccgcgcgagaagccaacagatacagagggccttgaaggatcacctgagaaacatgaaccttcagctgtccctgccactgaggctggcgaaggccaacagccatggggaaggtctctagacgaggaaccaatctgtcaccgcctgcgctgtcccgcccagccagacaaaccaacaacacccgccagtcccagtactagccggccatctctgtatacctcctcacacctgttgtggacaaatcgatttagtgtgcccgactcagagtccagtgaaacaaccaccaacacaaccacggcaaaggagatggataagaacgagaacgaagaggccgatctagatgagcagtcttccaagcgtttatccattagagagcgacgaaggcctaaggaaagacgaaggggcactggcatcaacttttggaccaaagacgaggacgagaccgatggtagcgaggaggtcaaggaaacatgggctgagcgcctgaaacgtctcgaaagcggaggatctaatcccaccaccagcgacagttatggagacagagctagtgctcgggcgaggagagaggcgagggaggcccggttagctacacttaccagtagagtggaggaagactctaaccgcgattacaaaaaactgtatgagtcagcactgacagagaatcagaaactgaagacaaagctgcaggaagcacaacttgagcttgcagacatcaaatctaaactggaaaaggtcgcacagcagaaacaggagaagacctcagacagatctagcgtactggaaatggagaagcgtgagagaagggcccttgagcggaaaatgtccgaaatggaggaggaaatgaaggtgctgactgagctgaagtctgacaatcagaggctgaaggacgaaaacggggcccttatcagagtcatctccaaactttctaagtag

SEQ ID NO: 130705 - DNA, 1161 bp, Artificial Sequence
  Description of Artificial Sequence: Synthetic coding sequence
atggccgaacttgaacacttgggtggaaagagggccgagagtgcccgcatgcgtcgcgcagagcagctccgtaggtggcgaggcagcctgactgagcaagaaccagcagagcgccgtggagccggtcgtcagccgctaacaaggcgaggaagcccaagagttcggttcgaagacggagccgtctttcttgctgcctgttcctcgggggataccgacgaagtgcgcaagctcctggcgcgaggggccgacataaacacagtgaatgttgacggcctgaccgccctacaccaggcctgtatcgacgagaacctagatatggtaaagttcctcgtagagaaccgggcaaacgtgaatcaacaagacaacgaagggtggactcctttacacgctgccgcctcttgcggctatttaaacatagcagagtactttattaatcatggtgcttctgtgggaattgtcaattccgaaggagaggtgcccagcgatttagccgaggagcctgctatgaaagatcttcttcttgagcaggttaaaaaacagggagtggatctggagcagtcacgaaaagaagaggaacagcagatgctgcaggatgctcgccagtggctcaactctggaaagatcgaggacgtgagacaggctcgcagtggggctaccgccttgcatgttgccgccgccaaagggtatagcgaggtcctgagactgctcattcaggctgggtatgagctgaatgtgcaggactatgacggctggacacccctgcacgcggccgcccattggggtgtgaaggaggcctgctccatcctcgcagaagctctttgtgacatggacattcgcaataaattgggacagaccccattcgacgtggcagacgagggactggtggagcatctggagctcttgcaaaagaagcagaacgttctgcggagcgagaaggagacgagaaataagctcattgaatcggatcttaactccaaaatacagtctggtttcttcaagaataaagaaaagatgttatatgaggaagaaaccccgaaaagtcaagaaatggaggaggagaacaaggaaagctcttcgtcatcttcagaagaggaagaaggtgaggatgaggcgagtgagtccgagactgaaaaggaggccgtcttgttctggcccttctag

SEQ ID NO: 130706 - DNA, 675 bp, Artificial Sequence
  Description of Artificial Sequence: Synthetic coding sequence
atggacaagaatgagaacgaggaagctgacctggatgaacagagttctaagcggctttccatccgcgaacgccgcaggcccaaggaaagacgaaggggaacgggaattaacttttggactaaagatgaggacgagactgatggatccgaagaggtaaaggaaacttggcatgaacgactttctagactcgagagtgggggctcaaaccctacaacgagcgatagctacggcgatagagcctctgccagggcccgcagagaggcccgggaggctcggctggccaccctgacaagcagggtggaagaggacagcaatagagattacaagaagctgtacgagagtgctctaaccgaaaaccagaagctgaaaacaaaattgcaggaggcccagctggaactggccgatataaagtctaaattggagaaagttgcccagcagaaacaagagaaaactagtgatcggagcagcgttctcgagatggaaaaaagggaaaggcgcgcgctcgaaaggaaaatgtccgaaatggaggaagaaatgaagaacctccaccagctgaagcagatccaaacgctgaaacaaatgaacgaacagcttcaagccgagaacagggctctgactcgtgtggtggcgcggctctccgaatctatcgagtcttcagacacccaggagctctag

SEQ ID NO: 130707 - DNA, 627 bp, Artificial Sequence
  Description of Artificial Sequence: Synthetic coding sequence
atggacaagaacgaaaacgaggaggccgatctcgacgaacagtcatctaaacgactgtcaatccgcgagcggcggcggccgaaggagcgtcgtcgggggacggggatcaatttttggaccaaggacgaagacgagactgacggcagtgaggaagtgaaggagacatggcacgagcgcctgagtaggcttgaaagcggaggctctaaccccaccactagcgactcgtatggggaccgtgcaagtgcccgagcgagacgcgaagctagggaagctcgtctcgcgactctgacctctcgcgtggaggaagattctaacagggattacaagaagttgtacgagagcgctctgacagagaaccagaagttaaaaacaaaactccaggaggcacagcttgaactcgctgatattaaatcaaagctagagaaggtggcacagcagaagcaagaaaaaacttcagacagatcttccgtgctcgagatggagaaacgcgaaaggagggccttggaaagaaaaatgagtgagatggaagaggagatgaaagttctgacagagctcaagtctgataatcagaggcttaaggacgaaaacggggccctcatccgtgtaattagtaagttatctaagtag

SEQ ID NO: 130708 - DNA, 2949 bp, Artificial Sequence
  Description of Artificial Sequence: Synthetic coding sequence
atggcggaactcgaacacctgggaggcaaacgggctgagtccgcaaggatgaggagggcggagcagctccgtaggtggcggggaagtcttaccgagcaggaaccagctgagcggagaggcgcagggagacagcctttgacacggcgggggtctccaagagtgaggtttgaggacggagccgtgttcctggctgcatgcagttccggcgacacggacgaggtgcggaagctgttggcccgcggcgcagacatcaacacggttaatgtggacggtctgaccgccttacatcaggcatgtatcgacgaaaatctggacatggtcaagttcctggtggaaaacagggccaatgtcaatcaacaggacaacgaagggtggactcctctgcatgccgcagcttcttgcggctatctcaatattgctgagtacttcattaaccatggggctagcgtgggaatcgtgaactcagaaggtgaggtgccatcagacctggctgaagagcctgcgatgaaagaccttttgctcgagcaagtgaagaagcagggtgtcgatctggagcagtccaggaaggaggaggagcagcagatgctgcaagatgctcgtcaatggctgaactctggaaaaatcgaggacgtcaggcaagcgcgctcaggagccactgctttacacgtggcagcagccaaagggtactccgaggtactgcgcctgctgattcaggccggctacgagctgaatgtccaggattacgatggctggactcccctgcatgctgctgcacattggggggtcaaggaggcctgttcaatcctggcagaagcactctgcgacatggacatacgcaacaagctgggacagaccccatttgacgtggctgatgaggggttagtggagcatttggagctgttgcagaagaagcagaatgtactaaggtcggagaaagagacaaggaacaagttgatcgagagtgaccttaactcaaagatccagtctggcttctttaaaaataaagaaaaaatgctatacgaggaagagacacctaaatcacaggagatggaggaagagaacaaagagagctcctcatcttcttccgaggaggaggagggtgaggacgaagcttctgaatccgaaactgagaaagaggcagacaaaaaacctgaagcctttgtgaaccacagcaactcagagagtaagtctagcatcaccgagcagattccagcgcccgctcagaacaccttcagtgcaagcagcgccaggaggtttagctctggcctgttcaacaagcccgaggagccgaaggatgaaagtccatcttcgtggagactgggtttaaggaagaccggatcccataatatgttgtccgaggtcgccaattcaagggaaccgatccgagatagaggatctagcatctacagatcttcttcttctcctcgcataagcgctctgctggacaataaggacaaagaaagggagaataaatcctatatttcaagccttgcaccaagaaagcttaactcaactagcgacatcgaggaaaaggaaaatagagagtccgccgttaacctagtgcggtccggctcgtacacccgccagctgtggcgagatgaagccaaagggaacgaaatcccccagacgatagcaccttccacatacgtctcgacgtacttaaaaaggacacctcacaagagccaagccgacactaccgccgaaaaaacagctgacaacgtatcctcttccacccccttatgtgtcattactaatagacctctcccatctaccgccaatggggtgacggccacacccgtgctttctattacaggaacagacagcagcgttgaagctagggagaaacgccggagttatctgactcccgtgagggacgaagaagccgaaagtctgaggaaagcccggtcacgacaggctcggcagactagacgcagcacacagggagttaccctcactgacttgcaggaagcagagagaaccttctcacgctctagggccgagcgccaggctcaggaacagccacgcgagaagccgaccgacaccgaagggttggaaggaagtccggagaaacacgaaccgtctgccgtgcctgctacagaggcaggggagggtcagcaaccgtggggacggtcacttgatgaagagcccatctgtcaccgcctcagatgccccgctcagccagataagcccaccacccccgccagtcctagtacctctagaccttcactgtatactagttctcatctgttgtggactaatcgcttcagtgtgccagattcagagtcttctgagaccactacaaataccacgacagccaaagagatggataagaatgaaaacgaggaggctgacctagacgagcagagttccaaacgattgtcaattcgggagaggaggagacctaaagaacgaaggagaggcactgggatcaacttctggaccaaggatgaggatgagaccgatgggtctgaggaggtaaaggaaacatggcatgagagattatctcggctcgagtctggaggttctaatcccactacaagcgattcctatggcgaccgcgcctctgccagagcgcgccgagaggcccgcgaagcccggctggcgactctgacatcccgcgtcgaagaggattcaaatcgggactacaagaaactgtatgagtccgccctaacagagaaccagaagctgaaaactaagctccaggaggcccagctggagttagccgacatcaagtcaaagcttgaaaaagtagctcagcagaaacaagaaaagacttccgacagatcatcggtactggagatggagaagcgggagaggcgagccctggagcgcaagatgtcagaaatggaagaagagatgaaggtcctcacggaactcaaaagcgataaccagcgcctgaaggacgaaaacggggcactgattcgagtgattagcaaactgtctaagtag

SEQ ID NO: 130709 - DNA, 2349 bp, Artificial Sequence
  Description of Artificial Sequence: Synthetic coding sequence
atgagtggggaagatggacccgctgctggaccaggagcagccgcggcagcagcccgagaacgccgaagagagcagttgaggcagtggggcgcgcgagcaggcgccgaacccgggccgggtgaacgaagggcccgaaccgtgaggttcgagagagcagctgagtttttagcagcctgcgcaggcggagatttagacgaggcgcggcttatgctccgcgccgcagatcccggcccaggtgctgaattggatccggctgctccaccacccgctagggcagtgctcgattcaactaacgctgatggaatttcggctctacaccaggcatgcatcgatgaaaatttagaagtggtgagattcctcgtggagcagggcgcgaccgtgaatcaagccgacaacgagggatggacacctcttcatgttgcagcgtcctgcggctacctggacatcgctaggtacctgctgagtcatggcgccaatatcgcagctgtcaattcagacggagaccttccacttgacctggctgagtctgatgcaatggaagggttgctgaaagccgagattgcgagacggggggtcgatgtagaagccgccaagcgagccgaggaggaactattgcttcatgatacacgctgctggctgaacgggggtgctatgccagaagcacggcacccgagaactggagcttcagcgctccacgtagccgctgcgaaaggatacatcgaagtgatgagactgcttctgcaggcagggtacgaccccgagctgagagatggcgacggatggactccgcttcatgctgccgcccactggggcgttgaggatgcttgtaggctgctggccgagcatggcggaggtatggatagcctcactcatgccggccagaggccatgcgatctggccgacgaggaagtcctgagccttctggaagaattggccaggaaacaggaagaccttcggaaccaaaaagaggctagccagtctcgaggtcaggagccacaagcacccagctcctctaagcataggaggtcttccgtgtgcagactcagcagtagagaaaagatctctctgcaggatcttagtaaggagagacgccccggcggtgctgggggaccccctatccaggatgaagacgaaggcgaggagggtcccactgagccaccgccagccgagccacgcacgctgaatggcgtgtctagtccaccccacccgtctcctaagagcccagttcagttggaggaagcccctttcagccgccgattcgggttgcttaaaaccggctcgtctggggcacttgggccccctgaaaggaggaccgccgaaggggcccctggggcgggcctgcagcggagcgctagctcctcgtggctggaagggacaagtacccaggcaaaagaacttaggctggcacggattacaccaacccccagcccaaaactgcccgagccttctgttcttagcgaggttacaaagccaccaccatgcctggagaattcttctcccccttcaagaattccagagcccgagtcccctgcaaagccaaatgtgcccacggcatccactgccccccctgctgactccagggacaggcgacggagttatcaaatgcccgttcgcgatgaagagtcagagagtcagcgcaaggctagatctcggctaatgaggcagtcccggcgctcgacacagggagtcacgctgacagatctgaaggaagcggagaaggcagctggaaaggcccctgagtcagagaagcctgctcaatctttggatccttctcggcgtccccgcgtcccaggtgtggagaactcggactctcccgcccaaagggccgaggcacccgatggtcagggcccaggccctcaggcggccagggaacaccgtaaggtggggaaggaatggcgggggccagcagagggcgaggaagccgagccagctgatagatcacaggagtcatccactttggaaggcgggcctagcgcacggcgacaaagatggcagcgggacctgaatcctgaacctgaacctgagtctgaagagccggacggtggctttcgtaccctatatgccgagcttagacgggagaacgagagattgcgagaggccctgaccgagaccacactgcgcttagctcagctcaaggtggaactggaacgagctacacagagacaggagcgtttcgcagagcgaccggccctgttagagctggagagatttgagagacgcgctctggaaagaaaagcagcggagctggaagaggaactaaaggccctttcagacctgcgtgcagataatcagcggcttaaggacgaaaacgctgctttgatccgcgtgatctccaagctgtccaagtag

SEQ ID NO: 130710 - DNA, 2160 bp, Artificial Sequence
  Description of Artificial Sequence: Synthetic coding sequence
atgtctggggaggatggcccagcagccgggcctggagccgccgcagcagccgccagggaacggcggagagagcagcttagacaatggggagctcgcgccggagctgagccgggcccaggagagagacgggcccgaaccgtccggtttgaaagggccgctgaatttctggctgcctgcgccggcggagacttggatgaggccagactcatgctccgagccgctgacccagggcccggggctgaactcgaccctgctgccccccccccggccagagcggtactggattcaacaaatgcggacgggatttcggctctgcatcaggcgtgcattgacgaaaatttggaagttgtgaggttcctcgtcgaacaaggggctaccgtgaaccaggccgacaatgagggctggactcccctacatgtggcagcctcttgcggctacctggatattgcccggtatttgctcagtcacggagctaatattgccgctgtgaatagtgatggagaccttcccctcgacttagccgagagtgatgccatggagggactccttaaagcggaaattgcccgcaggggagtcgacgtcgaagcagccaaacgagctgaggaggagcttcttctacatgacacgcggtgttggttgaatggaggtgccatgcctgaggcacgccatccaagaacaggcgcctccgcccttcacgtggccgcagccaagggatatattgaagtaatgcggctgctcttgcaggccgggtatgacccggagttgcgcgatggtgatgggtggactcccctccacgccgctgcccactggggtgtggaggacgcatgccggcttcttgcagaacacggagggggcatggattctttgacgcatgcgggacaacgaccctgtgatctcgctgatgaggaagttctcagtctcctcgaggagttagcacgtaaacaagaagatcttagaaatcagaaggaggcttcccaaagtcgtgggcaggaacctcaggcaccttcctccagcaagcacagacggtcatcagtgtgccggctgagctcacgcgagaagatctctctgcaggatctgtctaaggagcggcgaccagggggagcgggaggccctcccatccaggacgaagacgagggcgaggagggcccaaccgagccgccaccggccgaaccacgcactctgaacggcgtttcatcaccaccccacccaagtcccaaatcaccagtgcagctggaggaggcgcccttttctcgtcgcttcggccttctgaaaacaggcagctctggggcactgggaccgcccgagcgtcgcacagcggagggtgctccaggcgccggactgcaaagatcagcatcatcaagctggttagagggaacctcgactcaggctaaagagctgcggctcgctagaattacccccacccctagcccaaaacttcccgaacctagcgtccttagcgaagtaaccaagccccccccctgtctggaaaattcctctcccccatcaagaatccccgagcctgaaagtccagccaaacccaacgtgcccacggcatcaaccgcgccaccggcggattctagagacagacggaggagctaccagatgcctgtgagagacgaggaaagcgaaagtcagcgcaaagccaggagcaggctaatgcgtcagtctcgcaggtctacccagggtgtgactttaaccgaccttaaggaggccgagaaggccggcgaagaggcggagcctgccgaccggagtcaggagtccagcactctggaaggcggaccttcagctcgacggcagagatggcagcgggacctaaacccggaaccggagcccgagagcgaagagcctgatggtggcttccgaacactctacgccgagctgcgcagggagaatgagagactgcgcgaggcgcttacagaaacaactttgaggctggcccagctcaaggtggagcttgagcgggctacacagagacaggaaaggttcgccgagagaccagccctcttggagctggaacgctttgagagaagggccctcgagcgcaaggccgccgaactggaggaggaactgaaagccctctccgatctgagggccgataaccagcgactgaaggacgagaatgccgctttgatacgagtgatctcaaagctctccaagtag

SEQ ID NO: 130711 - DNA, 2124 bp, Artificial Sequence
  Description of Artificial Sequence: Synthetic coding sequence
atgcgtaatggcggaccttgccagccattggccgccgggccaagggccgagggggcctccgttaattggagtgtgactgcctgggggcccggtacccaggcctgtatagacgagaacttggaagtggtgaggttcctggtggagcagggagctactgtgaaccaggccgacaacgaaggatggacacccctgcacgtcgccgcgtcctgcggatatttagacattgccaggtacctgctgtctcacggggccaacatcgcagccgtcaatagcgatggcgacctccccctggacctcgccgagtccgacgccatggagggactgctcaaagccgagatcgcgcgacgcggggtcgacgtggaggccgccaaacgggctgaagaagagctattgctacatgatacgcggtgttggctgaatgggggagcaatgccagaggcacgccacccacggacaggtgcctcagctctccacgtcgccgctgcaaaggggtacatcgaagtgatgaggctgctgctccaggcaggctacgaccctgagctgcgcgatggagacgggtggacgccgcttcacgccgccgctcattggggcgtagaagatgcctgtaggctcttggccgagcatgggggcggtatggatagcttaacgcatgcaggtcaacggccatgtgatttagccgatgaggaggtgctgtccttactcgaagagctggccaggaaacaggaggacctgagaaatcagaaagaggcctcgcagagtcgaggacaggaacctcaggcaccatcctcctcgaaacaccggagatcttcagtgtgccgactgtcatctagagagaagatctcactgcaggacctctctaaagagaggagaccggggggggccggagggccccccatccaagatgaggatgaaggagaagaaggacccaccgagccaccccccgccgaaccccggactttaaacggcgtttctagccccccacatccaagtccaaagtctccggtgcagctagaggaagcccccttttccagaaggtttggactgctgaagacagggtccagcggcgcactcggcccacctgaaagaaggaccgccgaaggtgcccccggagctggcctccaaaggtccgcttccagcagctggctggagggcaccagcactcaggctaaggagttgcgccttgctagaatcacgccgactccatctccgaaactgccggagccctcggtgctctccgaggtgacaaaaccccctccgtgcttggagaattcttctccaccctccaggatcccagagccagagtcccccgcaaagcctaatgtcccaacggcaagcacagcgcccccggccgatagccgggaccgccggaggtcatatcaaatgccagtcagagacgaggaaagtgaatcacagcgcaaggcaaggtctcgcttgatgagacagtctcgccgaagtacccagggggtcacactgactgacctcaaggaagctgaaaaggcggcagggaaggcacctgaaagtgagaaacccgcccaaagcctggatcccagccgtaggcctcgcgttcctggtgtcgagaactctgatagtccagcccagcgtgaggcccccgacggccagggccctggaccacaggccgcccgcgagcaccgcaaggtgggtaaggaatggagggggccagccgaaggcgaggaagctgagccagccgatcgctctcaagaatcctctaccctagagggcggcccgagtgccagaagacagcgctggcaacgtgatcttaaccccgaaccagaacctgaaagcgaggaaccggacgggggatttaggaccctgtatgccgagctgcgtcgcgaaaatgaaaggcttcgagaagcattgactgagaccacactacgtctggcccagctgaaagtggaattggaacgggccactcaacggcaagaaaggtttgccgaaagacctgctttgctggagttagaacgtttcgagcgacgcgcacttgaacgcaaggccgcggagttagaggaagagctcaaggcactgtcagatctccgcgccgacaatcaacggcttaaggatgaaaatgcagcccttatcagagtaatttcaaagctgagcaaatag

SEQ ID NO: 130712 - DNA, 2142 bp, Artificial Sequence
  Description of Artificial Sequence: Synthetic coding sequence
atggagcccggaaccggaggctctcgcaaacgtctgggcccccgagctggcttcagattttggcccccgttcttcccgaggcgatcccaagctggatcctctaagtttccaacccctctcggaccagaaaatagcggcaatccgaccttactctcatcagcacagcctgagaccagggtcagctactggacgaaactcctatctcagctgttggctcccttgcctggcctgctacaaaaggtgttgatctggagccaattattcgggggtatgttccccacgcgatggctggatttcgccggtgtgtactcagctctcagagcgctgaaaggaagagaaaagccggccgcgcctacggcccagaagtcattgagtagtttgcagttggactcctcagatccaagtgtgacttcacctctggattggctggaagaaggaattcattggcagtactcccctccggacctcaagcttgagctgaaggccaaggggtcagccctggaccccgccgcccaggcgttcctcctggagcaacagttatggggggtcgagttattacccagtagcctgcaatccaggctctactcaaaccgggagctaggaagttctcccagcggcccacttaatattcagagaatcgataattttagtgttgtgtcatacctgcttaacccgtcctacctggactgtttccctcgactggaggtgagctatcagaattctgacggaaatagcgaagttgtcggcttccagaccctgaccccagaaagctcctgcctcagagaagaccattgtcatccccaacccctgtccgctgaactgatcccagctagctggcagggctgccccccactgtctaccgaagggttgcccgaaatccaccacttgcgcatgaagcgcttggaattcctgcagcaggccaacaaggggcaggacttgcctacaccggatcaagataacggctaccatagcctcgaagaggaacattccctgttgcgcatggaccccaaacactgtcgggataatcccacccagtttgtacccgctgccggcgacattcccggaaatactcaggagagtactgaagaaaagattgagctcctgacgacagaggtccccttagccttggaggaggagagcccttcggaagggtgcccttcatcagagatccctatggaaaaggagcctggagaaggccgcatatcagttgttgactacagctacctggagggggatctgccgatttcggcacgtcctgcttgctccaataaattaatcgactacatactgggaggtgctagtagcgatttagagacatcaagcgaccctgagggggaagattgggacgaagaagcggaggatgatggatttgactccgacagctccctttcagatagcgaccttgagcaggaccccgagggcctccatttatggaattctttctgctccgtcgacccatataatccacaaaactttaccgctaccattcaaaccgccgcaaggatcgttcccgaggaaccttctgactccgaaaaggacctcagcggcaaatctgatttggagaattcaagtcagtccggatcactgccagaaactcccgaacactcctcaggagaagaagatgattgggagagctccgcggatgaagccgaaagcctcaagctttggaactcattttgcaactccgacgatccctataatcctctcaattttaaggctccgttccagaccagtggagagaacgaaaagggatgccgcgactccaagaccccgagtgagagcattgtggccatatcagagtgtcatactttattatcttgcaaggtacagttattaggttcccaggaatcagagtgtcctgatagtgtccagcgggatgtgctgtctgggggtcggcacacccacgtgaaacgaaaaaaggtgacgttcctcgaagaagtgactgagtattatatatccggggacgaggacagaaaggggccttgggaagaatttgctagggatggatgtaggtttcagaagcgcatacaggagacagaagatgcaatcgggtattgcctgaccttcgagcaccgcgagcgaatgtttaaccgattacaggggacatgtttcaaggggctcaacgttcttaagcagtgctag

SEQ ID NO: 130713 - DNA, 1872 bp, Artificial Sequence
  Description of Artificial Sequence: Synthetic coding sequence
atgttccccaccagatggctggactttgctggagtgtactctgcactgcgcgccctcaaaggccgcgagaaaccagctgctccaactgcccagaagagtctgtcaagccttcagctcgacagcagcgacccctctgttacaagcccactcgattggctcgaagagggaattcactggcaatacagtcctccagacctgaagctcgaactgaaagctaaggggtctgcccttgaccccgctgcccaggcttttctgctcgagcagcagctgtggggggtcgagctgctcccttcatccttacaatctaggctttactcaaaccgcgaactcggtagctctcctagtggaccactcaacatacagagaattgacaactttagtgtagtgtcatatttactgaacccgtcctacctggattgttttccaagactggaagtaagctaccaaaactccgacggaaacagcgaggtcgttggtttccagaccctgactccagagagctcatgcctcagggaggaccattgccatccacaaccccttagcgccgaactcattccggcttcctggcaggggtgtccacctctatccacagaggggctccccgagatccaccatcttcgcatgaagagactggagttccttcagcaggcgaataagggccaagacttgcctacccccgaccaggataacggctatcattctctagaggaggaacattccctgctgcgcatggacccaaaacattgccgcgataacccaacccagtttgtcccagctgcaggtgacattcctggtaatacgcaggagtctacagaagagaaaatagaattacttacaaccgaggtccctctggccctcgaagaagagtctccttccgagggttgtcccagcagtgaaattcctatggaaaaggaacccggtgaaggaagaatatctgtggtggactactcatacctggaaggagacctccccatctctgctcgtcccgcctgctcgaataagctaatcgattatattttggggggagcttctagtgacctagaaacatcgagcgacccggagggagaagactgggatgaggaggccgaagatgatggtttcgacagtgattccagtctgtctgactctgatttagaacaggatcctgaaggcctgcacctgtggaattcattttgtagcgtcgacccttataatccacagaactttacagccactatacagacagccgcccgtatagtgccagaggagccaagtgacagtgagaaagacctgtccggaaagtccgatctggagaattcttctcaatcaggctcactgcctgagactcctgagcattcttccggagaagaagacgactgggaaagctctgctgacgaggccgagtcactgaagttatggaattccttctgtaactccgatgacccctacaatcccctcaattttaaagccccgtttcagaccagcggcgagaacgagaagggatgcagggatagtaagaccccctccgagtcaatcgtggctatctccgagtgccacactttattgtcatgtaaggtgcaattgctcggctcccaggaatccgaatgtcctgacagcgttcagcgcgacgtgctttcaggcggaaggcatacgcacgtgaagcgcaaaaaagtgacgttcctcgaagaagttactgaatactacatctcaggtgacgaagaccgaaaaggaccatgggaggaatttgcccgggatggctgtaggttccagaagcgtatccaggagaccgaagatgcaatcggttattgtcttacattcgaacacagagagcgtatgtttaacagactgcaagggacttgtttcaaaggcctaaacgtgctgaaacagtgttag

SEQ ID NO: 130714 - DNA, 1704 bp, Artificial Sequence
  Description of Artificial Sequence: Synthetic coding sequence
atggcttctcacgtcgacctgcttacagaactgcagttgctggagaaggttcccacattggaacgccttcgggccgctcagaaacgaagagcgcagcagctgaagaagtgggctcagtacgaacaggatcttcagcacaggaaacggaaacatgagcggaaacgctctactgggggcagaagaaagaaggtgagttttgaggctagcgtcgcactgctggaagcctcactcaggaatgacgctgaagaggtgagatacttcctcaagaacaaggtgtctccagatctttgtaatgaggacggcctgactgcactgcaccagtgctgtattgacaactttgaagagatagtcaaacttctgctgagtcacggggctaacgtgaatgccaaggacaacgaactctggacgcccttgcacgccgcggcaacctgcggacacatcaacttggtgaagatcctggtacagtatggagcggatctccttgccgtgaactctgatggaaatatgccctacgacctgtgcgaagacgagcctacccttgatgtcattgaaacttgcatggcataccaaggtatcactcaggaaaaaattaacgagatgcgggtagcccccgaacaacagatgattgctgacatccattgtatgattgccgccggacaggacttagactggattgacgcgcagggagctaccctactgcacatcgccggggctaacggatacctccgggccgcggagctgctcctcgatcacggagtgcgggtcgacgtgaaagactgggacggatgggagcccttacacgcagcagcgttttggggccagatgcagatggcagagttgttggtaagtcatggtgcttcgctgtccgctcgaacaagcatggatgaaatgccgatcgatctgtgcgaggaggaggagttcaaggttctgctgctggagttgaagcataagcacgatgttatcatgaagagtcagctacggcacaagtccagcctgtccagacgcacgtcttcggcgggcagcagagggaaagtcgtgcggcgcgctagtttatccgacaggactaatctatatcgaaaagaatacgaaggcgaggccattctttggcagcgtagcgccgccgaagatcagcggaccagcacctacaatggagacatcagggaaactagaacagatcaggaaaataaggacccaaaccctcgactggaaaagccagtgctcctttcagagtttccaactaaaattcctagaggagagctggacatgcccgtggagaatggtttgcgtgctcctgtgtccgcctatcagtatgcactcgctaacggagatgtttggaaggtccatgaggtgcctgactactcgatggcttatggcaaccctggtgtagccgacgcaacccctccctggagctcttataaagaacaatccccgcagactttactggagttgaagaggcaacgtgccgcggccaaactgttaagtcacccatttctctccacgcacttgggcagctccatggcacgcaccggagaatcttcaagcgaaggtaaggcaccgttgatcggtggtcgaacatctccctatagtagtaacggaaccagcgtgtattatacagtgaccagcggcgatcccccattactgaagttcaaggccccgatagaggaaatggaggaaaaggtccatggctgctgtaggataagctag

SEQ ID NO: 130715 - DNA, 1578 bp, Artificial Sequence
  Description of Artificial Sequence: Synthetic coding sequence
atggcttcccacgtcgatcttcttactgagctgcagttgctagagaaagtaccaaccttagagcggttgcgcgccgcccagaagcggcgagcacagcagctcaagaaatgggcacaatacgaacaggacctccagcatcggaagcgaaagcacgaacgtaagcgatcaacaggaggacggcgcaaaaaggtgagttttgaagcctcagtggcattattggaggccagcctgcggaacgacgccgaagaagttcgttacttcctgaagaacaaggtctctcctgatctgtgcaatgaagatggccttacggctctgcatcagtgttgtatagataatttcgaggagatcgttaaactgttattgtcacacggggccaacgttaatgccaaggataacgagctgtggacgcctctccacgcggccgcgacctgcggacatatcaacttggtgaagattctagtgcaatatggggccgatctgctggcagttaactcggacggcaacatgccatacgatctgtgtgaagacgagcccacactggatgtcattgaaacctgtatggcctaccaggggataacacaagaaaagataaatgagatgcgtgttgcacccgaacagcagatgatcgccgatatccattgtatgatcgccgcagggcaagaccttgattggatcgacgcccagggtgccacactgatgcagatggcggagctactggtttcacatggggccagcctgagtgcgcgtactagcatggatgagatgccgatcgacctgtgtgaggaggaggaatttaaggtcctcctcctggaacttaagcataagcatgacgtgatcatgaagtctcagctgcggcataaaagctctttgtcccgccgtaccagcagcgcgggatcaaggggaaaggtggtgcggcgggcaagtctgagcgacagaaccaatttgtaccgtaaggagtacgagggagaggcaatcttatggcagcggtctgcagctgaagaccagagaaccagtacctataacggggatatcagggagactcgaaccgaccaggaaaataaggatcccaatccacgactagaaaaacccgttctgctgagcgaattccccacaaagattcctcggggggagttagacatgcctgtggagaatggcctgcgggctcctgttagcgcataccagtacgccctcgcaaatggagatgtgtggaaagtgcatgaggtgcctgactatagcatggcttatggcaaccctggagtcgccgacgcaaccccaccctggtctagttataaggagcagtctcctcaaacgctcctggagcttaagcgacagagagcggcagcaaagctgttgtcccatccctttttatcaacccatctgggaagctcaatggctcggaccggagaatcttcatccgaaggcaaagctcccttaattgggggccggacttctccatacagcagtaacggaacaagcgtttactatacagtgacatctggggaccccccactgcttaagttcaaggcccctattgaagaaatggaagaaaaggtgcatggctgttgtcggattagttag

SEQ ID NO: 130716 - DNA, 3369 bp, Artificial Sequence
  Description of Artificial Sequence: Synthetic coding sequence
atggaacctagcgaagtgccttcgcagattagtaaagacaactttttagaggtgcctaatttgtccgattccttatgtgaggacgaggaagtcacctttcagcctggcttctctccccagcccagtaggcggggctccgatagctcagaggacatctaccttgataccccgtcctctggcacaaggcgcgtaagtttcgccgactcctttgggtttaatctggttagcgtgaaggaatttgactgctgggagctgccatctgcctcaacaacttttgacctgggcacggacattttccacacggaagagtacgtcctggctccattattcgacctgccgagctctaaggaagatctgatgcagcagcttcagatacaaaaggcaattctggaaagcaccgaaagcctgctcggcagtacctccataaaaggaatcattagggtgctgaatgtcagctttgagaagctcgtgtacgtgcggatgtcactcgacgactggcagacccattatgatatcctggctgagtacgtgcctaattcatgtgatggtgagaccgaccagtttagctttaaaatcgttctggtgccaccataccagaaggatggatccaaggtcgagttctgcatccggtacgaaaccagtgtggggactttttggtccaacaataacggcacaaactacactttcatctgtcagaagaaggagcaggagccagagccggttaaaccctggaaggaagtgccaaaccggcagatcaaggggtgtttgaaagttaaaagctccaaagaggagagctctgtcacatctgaagagaacaacttcgagaacccaaagaatactgacacttacatccctacaattatttgcagccacgaggacaaggaggatctggaggcctcaaataggaatgtgaaagatgtgaatagagagcacgacgaacataatgagaaggaactggagctgatgattaatcagcatcttattcgaacccgttccactgccagcagggatgaacgcaataccttttctaccgatccagtgaactttccgaacaaagccgagggcctggaaaagaagcagattcacggggagatatgcactgacctgttccaaaggagtctgtcccctagcagttctgcagaatcgagcgttaagggcgacttctattgcaacgagaagtacagctccggagacgattgtacacaccaacctagcgaagaaacaactagcaatatgggtgaaattaaaccctctctcggcgacacatcaagtgacgagcttgtgcaattgcacactggatctaaggaagtcctggacgataacgcaaaccctgctcatgggaacggcactgttcagatcccttgtccctcaagcgaccagctgatggccggcaacctgaataaaaaacacgaaggcggcgccaagaatatagaagtaaaggatctaggctgcctgcgccgcgacttccattccgacaccagtgcgtgtctgaaggagtctactgaggagggctcttccaaggaagattattacggaaacggaaaggatgacgaagagcaacgaatctatctgggcgtgaacgaaaagcaacgcaagaacttccagaccattctgcacgatcaggaaaggaagatgggtaacccaaaaataagtgtagctggtatcggggcgagcaacagggacctggccactctgctttctgagcacaccgcaatccccactagagccattaccgccgatgtgtcacacagcccacgtactaatctgagttgggaggaggccgtactgacacctgaacatcatcatctgacttcagaaggaagtgcccttggaggaattacaggacaagtgtgctcctcccgcacggggaacgtgcttcgcaacgattacctctttcaggtagaagaaaagagcggcggaatcaatagcgaagaccaggataacagccctcaacacaaacagagttggaacgtcctggaatctcagggaaagtcccgcgagaacaagacaaacatcacagagcacattaaagggcagaccgattgtgaagatgtctggggcaaacgcgacaatacccggagcctgaaggctactaccgaggagctcttcacctgccaagagactgtgtgctgcgaattaagttcactcgcggaccacggcataacagagaaagctgaggccggaacagcctatatcattaagacaacgtctgagagtacgcctgagagtatgtcagccagagaaaaggcaattattgcaaaactgcctcaggagaccgcccgctccgacaggccaattgaggtgaaggaaacagcttttgatccgcacgaagggagaaacgatgatagccactatacactttgccaaagagacaccgtaggggtaatctacgataacgatttcgaaaaggaatcacgtctcggaatctgcaacgtcagggtagacgagatggaaaaagaggagaccatgtccatgtataacccaagaaaaacacacgaccgcgagaagtgcggcactgggaacatcacttctgtcgaagagagcagttgggtaataaccgaatatcaaaaggccaccagcaagctggacctgcagctcggcatgctacccactgacaaaactgtgttttcggaaaacagagacttacggcaagtgcaggagctctcgaagaaaactgatagcgatgccattgtgcactccgcttttaatagtgataccaatcgtgctccgcagaatagctccccattttctaagcatcacaccgagatctctgtcagtactaacgagcaggcaattgcagttgagaacgcggtgaccaccatggcgagccaaccaatctccacaaagagcgagaacatctgcaattccacccgcgagatccaaggaatagaaaagcacccgtacccggaaagcaagcctgaggaggttagcaggagttccgggattgtgacttccggcagcagaaaggaacgatgcatcgggcaaatattccaaactgaagaatatagtgtggagaagagccttggccccatgatcctaatcaacaagcctctcgaaaatatggaagaggcacgacacgaaaatgagggtctggtgtcttcaggccagtctctgtacacctcaggagagaaagagtcggattcgtccgcctcaaccagtctgcccgtggaagaaagccaggcgcagggcaacgagagcctgttcagcaaatacaccaacagcaaaattccatacttcctgttattcttgatttttctgatcacagtataccactatgatttgatgataggcttgaccttttatgtattaagcctgtcctggttgtcttgggaagagggtcggcaaaaagagagtgtgaagaagaaatag

SEQ ID NO: 130717 - DNA, 954 bp, Artificial Sequence
  Description of Artificial Sequence: Synthetic coding sequence
atgtcttgtacaagaatgattcaggtactcgaccctcggccactgacatccagcgtgatgcccgtcgacgtggcgatgcggttgtgtttggcccactccccacctgtaaaaagttttcttgggccctatgacgaattccagagaaggcactttgtgaacaagctgaagcccctgaagagctgtctgaacatcaagcacaaggccaaaagccagaatgactggaagtgctcccacaaccaggcgaaaaagagggtggtgtttgcagattctaaaggactaagtctaaccgcgatacacgtgtttagtgacctccctgaggaacctgcatgggacctacagtttgacctcctcgatctcaatgacatctccagcgcgctgaaacaccatgaggaaaaaaacctcatcctcgattttccacaacccagcactgactacttatcattcagaagtcattttcaaaagaattttgtctgtctcgagaactgtagtttgcaggagcgaactgtcaccggcacggtcaaggtgaaaaatgtatcattcgaaaagaaagtgcagatccgtatcacatttgatagctggaagaactacaccgatgtagattgtgtctatatgaagaatgtgtacggagggaccgactctgacacctttagctttgccattgatcttccaccagtgatacccacagagcagaagatcgagttttgcatctcctaccacgctaacgggcaggtgttttgggacaacaacgacggccagaactataggatagtccacgtacagtggaaacccgacggggtccaaacgcagatggcacctcaggactgcgcctttcatcagacatctccaaaaactgaattggaaagcacaattttcgggtcacccagactggcatctggcctgtttcccgagtggcagagctgggggaggatggaaaaccttgctagctacaggtag

SEQ ID NO: 130718 - DNA, 894 bp, Artificial Sequence
  Description of Artificial Sequence: Synthetic coding sequence
atgagctgcacaagaatgatccaggtcctggacccgcgtccgctgaccagctctgtgatgccggtggatgtggcgatgagactttgcttagcacactcccccccagtgaagtcatttttgggcccctatgacgagtttcagagacgacattttgtgaataaacttaaaccacttaagtcctgcctcaatataaagcataaagcgaaatcccagaatgattggaagtgttcacataaccaggcgaagaaacgggttgtgtttgcggactctaagggactgtccctgacggccatacacgtgttcagcgatctgcccgaagaacccgcatgggatctacagtttgacctgctggatttgaacgatataagctctgctttgtcgttccggagccatttccagaaaaactttgtatgtcttgagaactgttcactgcaggaaaggaccgtcactggtaccgttaaagtaaaaaatgtgagtttcgaaaagaaggtacagattagaatcacattcgattcctggaaaaactacacagatgtagactgcgtttatatgaagaatgtctacggtgggactgacagcgacactttcagcttcgccatagacctccctcctgtgatccctactgagcagaagatcgagttttgtatctcctatcacgcgaacggccaggtcttctgggataataacgacggtcagaattaccggattgttcatgtgcagtggaaacccgacggcgtgcagactcagatggctccacaggactgtgccttccaccagacatctcccaagaccgagctggagtcaacaatctttggatcaccccggctggctagtggcttatttcccgagtggcagagctggggtaggatggaaaacctcgcttcctatcggtag

SEQ ID NO: 130719 - DNA, 600 bp, Artificial Sequence
  Description of Artificial Sequence: Synthetic coding sequence
atgagttcccctacatcccccttgaagcatcacgaggagaaaaaccttattctcgatttccctcagcctagtactgactatctttcattccgctcccactttcaaaagaattttgtgtgtctggagaactgctcattgcaggagagaaccgtgaccggcactgtgaaggtgaaaaatgtgtccttcgaaaaaaaggtccaaattaggattaccttcgacagttggaagaattacactgatgtggactgtgtctacatgaagaacgtttacggagggaccgattccgataccttttcttttgctatcgacctaccacccgtaatcccgacggagcagaagatcgagttttgcatttcctaccatgccaacggtcaagttttttgggacaataacgacggtcaaaattatcgcattgtgcatgttcaatggaagccggacggcgtgcagacccaaatggcaccacaggattgcgccttccaccagacaagccccaagactgagctggagtccaccattttcggcagtccacgattggcctctggactgtttccggagtggcagtcctggggaaggatggaaaacctggcgtcatatcgctag

SEQ ID NO: 130720 - DNA, 900 bp, Artificial Sequence
  Description of Artificial Sequence: Synthetic coding sequence
atgtctcgcgggcctagctctgccgtgctaccttctgctctgggcagccgaaagctgggacctcgctccctgagttgcctctcagatctagacggcggagtggctttagaaccccgcgcgtgccgccccccaggttcccccggaagggcgccgccccccacccctgcaccatccggttgtgatcccagactccggccaatcattctgaggcgtgctaggtcactcccaagcagcccagagcggcgccaaaaagctgcaggcgccccgggagctgcatgtaggcccggctgcagccagaagctgcgggtacgatttgccgatgccctcggtctcgaactggctcaggtgaaagtcttcaacgcaggggacgacccatccgtgcccctgcatgtcctgtccagattagccattaacagcgatctctgctgcagctcccaggacctcgagtttaccctgcactgcctggtgcccgattttccccctccagtcgaagcagcggacttcggtgaacggctgcaaagacagctggtgtgcctcgaacgcgtgacctgctccgacctgggcatttccggaaccgtaagagtgtgcaacgtcgcctttgagaaacaggtggcagtgcgctataccttttcgggctggagatccacgcacgaggctgtggctcgatggcggggtcccgctggaccggaggggactgaagacgtgttcacatttggctttccggttcccccttttctgttggaactcgggagcagagtacactttgccgtacgttaccaggtggccggggctgagtactgggataacaatgaccacagagactattcactcacctgtaggaatcatgcattgcacatgccaaggggtgagtgcgaggaaagctggatccattttatttag

SEQ ID NO: 130721 - DNA, 756 bp, Artificial Sequence
  Description of Artificial Sequence: Synthetic coding sequence
atgacaaggctgaccgttctggccctcctggccggactgctcgcatctagccgggctggtagctcccccctcctggacatagttggtggacgcaaagctagaccacgccaatttccattcttggcctccatccagaaccaggggaggcacttttgtggtggagccctcattcacgcccgattcgtcatgacggcagcatcatgttttcagagccagaatcccggggttagcactgtggtgctgggggcttacgacctccgacgcagggaaagacagagtagacagacgttcagcattagctctatgtctgagaacgggtacgacccccaacagaacttaaatgacttgatgctacttcagctcgatcgggaggccaacctgacgtcttctgtgaccattctgcctcttccactccaaaatgcgactgtcgaggccgggactcgctgtcaggtcgctggatggggctcccagcggtccggaggcagactgtctcggtttccccggtttgttaacgtgaccgtcacaccggaagatcagtgcagacctaataacgtttgcactggggtgctgacacgacgagggggtatctgcaatggcgacggggggactccattggtttgtgagggactggcacatggtgtagcaagcttctccctcgggccttgcgggcgcggcccagatttctttacccgagtagcattgtttcgggattggattgatggtgtgctgaacaatcccgggccaggccctgcctag

SEQ ID NO: 130722 - DNA, 954 bp, Artificial Sequence
  Description of Artificial Sequence: Synthetic coding sequence
atggccgctgagcgtggtgctgggcagcagcagtcccaggagatgatggaggaagaacacgagctacctgtggacatggagactataaacctggaccgtgacgcggaagacgttgatctgaaccactataggattggtaaaattgaagggttcgaggtcttaaagaaggttaagaccctatgtctgcggcagaacctaatcaagtgtattgagaacctcgaagaactccaatccttgagggaactggacttgtatgacaatcagattaagaagatcgagaacctggaggccctcaccgagctcgagattttggatattagttttaatctcctgcggaacatcgaaggagtggacaagcttactcggctgaaaaaacttttccttgtgaataacaaaatttcgaagatagaaaatctgtcaaatctgcaccaactacagatgctagagctgggaagcaatagaattagggccattgagaacattgatactcttacaaatttggagtcactcttcttgggtaaaaataagattacaaagctgcagaacctggacgcactgacaaaccttacagtgctcagcatgcagtccaacaggttgacgaaaatagaaggcctacaaaacctggtgaacctgcgcgaactctacctttcacataatggaattgaagtcattgaaggtttagaaaataacaacaagttaacaatgctagacattgcgagtaatcgcatcaaaaagattgagaacatatcccatctgactgaactgcaggaattttggatgaacgacaatttgctggagagttggtccgacctcgatgagctgaaaggcgccagatctctagaaaccgtgtaccttgaacggaatccacttcagaaggacccacaataccgacgtaaagtgatgttggctctccctagtgttagacagatagacgccacatttgttagattttag

SEQ ID NO: 130723 - DNA, 714 bp, Artificial Sequence
  Description of Artificial Sequence: Synthetic coding sequence
atggccgccgagcggggtgctggccaacagcaatctcaagaaatgatggaggaggaacacgaattacctgtggacatggaaaccattaatctcgatagagacgctgaagacgtggacctgaatcattatagaattggtaagatcgaaggcttcgaagtattgaagaaggtgaaaacgctgtgtctgagacagaacctcattaaatgcattgaaaatctcgaggagttgcagagtctgagggaactggatctgtacgacaaccagatcaagaagatcgaaaacctggaggcgctcacggaattagagatattggatatttcctttaacctcctgagaaacatagaaggagtggataagttgactaggcttaagaagttatttctcgtaaacaacaagataagcaaaatagagaacttaagtaacctccatcagcttcagatgctggagttaggttccaatcggataagggccatcgagaatatcgacaccctgaccaatctggaatcactgtttctggggaagaacaaaattaccaagctacagaacctggatgctctcactaatctgaccgtactgtctatgcagtccaatagactcacgaaaattgagggactgcaaaacctggttaatctaagagaactctatctgtctcacaacggtattgaggtgattgagggattggaaaacaatgtgcaggatagcctaacctattag

SEQ ID NO: 130724 - DNA, 843 bp, Artificial Sequence
  Description of Artificial Sequence: Synthetic coding sequence
atggccgccgagaggggcgctggccaacagcagtcgcaggaaatgatggaggtagacaggagggtcgagtcagaagaaagcggggatgaggaagggaaaaaacactcatctggtattgtcgccgacttaagtgagcagagcctgaaagatggcgaggagagaggggaggaggaccccgaagaggagcacgaattacctgtggacatggaaacgattaacctggacagagatgccgaagacgtggaccttaatcattatcgcatcggcaagatagaaggcttcgaggttctgaaaaaagtgaaaacactgtgccttaggcagaatctgatcaagtgcatcgaaaacctggaggagcttcagagtctccgggagcttgacctttacgataaccagatcaaaaagatcgaaaatctggaggctctgaccgagttggaaattcttgacatcagcttcaacctcttacggaacattgaaggcgtggataagctcacccgcttgaaaaagctgttcctcgtaaataacaaaatatcaaaaatagagaacctctccaacctgcaccagctgcagatgctcgagttgggttcaaaccggatccgcgcaatagagaatatcgatactctgactaacctggaaagtcttttcctaggaaaaaacaagatcactaagctgcaaaacctcgacgcgctcacaaacttaacagtgttgtccatgcagtctaacagactgactaaaattgaaggacttcaaaacctggtaaatttgcgggagctctacctgtctcacaatggcatagaagtaatagaaggcctggaaaacaacgtccaggatagtctcacttactag

SEQ ID NO: 130725 - DNA, 1083 bp, Artificial Sequence
  Description of Artificial Sequence: Synthetic coding sequence
atggctgcagagcgaggtgctggtcagcagcagtcacaggagatgatggaagtggatcgcagggtggaatccgaagagtccggggacgaggaaggtaagaagcattcctctgggatcgttgccgacctctcagaacagagtctcaaggatggagaagagaggggagaggaggacccggaggaggaacatgaattgcccgtggacatggagactatcaacctggatcgggatgccgaggatgtggacctcaaccattacagaatagggaagatcgagggctttgaggtactgaaaaaggtgaagaccctgtgcctgcgtcagaacctcatcaaatgcatagagaatttggaggagctccagagcctgcgcgagctggacctgtatgacaatcagataaaaaagattgaaaatctggaggccctcaccgaactagagattttggatattagctttaacttattacgaaatattgagggagtcgataagctcacacggctgaagaagctctttttagttaataacaaaatatccaaaatcgagaacctctcgaacctccaccaactccagatgttggaacttggaagcaaccggattagggcgatagaaaacatcgacacgctcacaaacctggagagcctgtttctgggcaagaataagatcacaaagttgcagaatctggatgctctgaccaatctgaccgtgttaagtatgcagagtaatcgcttgacgaaaatcgagggtctccaaaacctcgtgaacctgagggagctatacctgagccacaatggcattgaagtgattgagggcctagagaacaacaacaagttaaccatgctggatattgcctcaaacagaattaaaaagatagagaatattagccatttgactgagcttcaggagttctggatgaatgacaatttgcttgagtcttggtcagacttggatgaattgaaaggcgccagatccctggagactgtatatctcgagaggaaccccctgcagaaggaccctcagtaccgccgcaaggtcatgctggcactcccttccgtccggcagattgatgctacattcgtgcgattctag

SEQ ID NO: 130726 - DNA, 384 bp, Artificial Sequence
  Description of Artificial Sequence: Synthetic coding sequence
atggttcagacagctgttgtccctgtgaaaaagaaacgtgtggagggtcccggaagcctggggctcgaggaaagcgggagcaggcgaatgcaaaacttcgctttctccgggggcctctatggtggtcttcccccaacccactcagaagcgggttcccagccgcacggcatacacggaactgccttgataggaggactaccgatgccttatcccaatctggccccagacgtcgatctcaccccagtggtgccttctgcagtaaatatgaaccccgctcccaatcccgccgtatacaaccctgaagccgtgaacgagccaaaaaaaaagaagtatgctaaggaggcctggcccggaaagaaacctacacctagtctactcatttag

SEQ ID NO: 130727 - DNA, 1056 bp, Artificial Sequence
  Description of Artificial Sequence: Synthetic coding sequence
atggctgccgccgctaacagcggctcgagtctcccactttttgattgccctacctgggccggtaaaccccctcccggtcttcacctggatgttgtaaagggggacaaactgatagagaagctcattatcgatgagaagaagtactatttattcggaagaaacccagacctgtgtgattttacaattgatcatcaatcctgctccagggtccatgcagctctagtctatcacaagcatctcaagagagtcttccttatagacctgaattccactcacggaactttcctggggcatatacggctggaacctcataagccccagcaaattccaatcgattccactgtctcgttcggagcctcgacaagagcatacactttgcgtgaaaagcctcagactctcccatctgcagtcaaaggggacgagaaaatgggtggggaggatgacgaacttaagggacttctgggtttgccggaggaggagaccgagcttgacaacctgacagaattcaacactgctcacaacaagcgcatttctaccttgacgatcgaggaagggaacctggacattcaaagacccaagagaaagagaaagaattcgagagtcaccttcagcgaggatgacgagatcatcaatccagaggatgtcgatccaagcgtgggaaggtttaggaacatggtgcagacggccgtggtcccagttaaaaagaagagagtggagggacctggtagcctcgggttggaggagtcaggatctcgacgcatgcaaaactttgcattcagcggggggctgtatggaggactccctcctacacactccgaggcgggaagccagcctcatggaattcacggaaccgcgctgattggcggccttcctatgccttatcccaatctagcccccgacgtggatcttactccagtcgtgcctagcgccgtgaacatgaatccggcgccaaacccagcggtgtacaatcccgaggcagttaatgagcctaaaaaaaaaaagtacgctaaggaggcctggcccgggaagaagccaacacccagtttattgatatag

SEQ ID NO: 130728 - DNA, 630 bp, Artificial Sequence
  Description of Artificial Sequence: Synthetic coding sequence
atggggggcgaagatgatgaattgaagggcctgctgggcctccccgaggaggaaaccgaactagacaatctgaccgagttcaacaccgcgcacaacaagcgaatttcgacccttactattgaggagggcaatctggatattcagagacctaagagaaagagaaaaaactcccgagttactttttccgaggacgacgagataattaatcctgaagatgtagacccttcggtgggtaggtttaggaatatggtccagacggcagttgtccctgtcaagaaaaagcgtgtcgaaggtcccgggtccctgggtctggaagaaagtggctcacgcagaatgcagaacttcgcattctccggcggactttacggagggttacctcctactcacagtgaagcaggaagtcaaccgcatggcatccacggaactgcccttatcggtggattgccgatgccgtaccccaatctcgcccctgacgtggatctgactcccgtggttccgtccgccgtgaacatgaaccccgcccccaatcccgccgtctataacccggaggctgttaatgagccaaagaaaaagaagtacgccaaggaagcctggcccggcaaaaagcctaccccctccctacttatctag

SEQ ID NO: 130729 - DNA, 711 bp, Artificial Sequence
  Description of Artificial Sequence: Synthetic coding sequence
atgggcggagaggacgatgaactgaaagggttgttaggccttccagaggaggaaacagagctggacaatcttacagagttcaacaccgcacacaataaacgcattagcaccctcaccattgaagaaggaaatctagacatccagagacctaagaggaaaaggaaaaattctcgcgttactttttctgaggatgatgaaatcataaatcctgaggatgttgacccctcggttggaagatttaggaacatggttcagacagccgttgtcccagttaagaagaaacgggtagagggtccaggctctctcggcctggaagagtccgggtcaagacgcatgcagaacttcgccttcagtggcgggctctacggcgggctgcctccaacacattcagaagcagggtctcaaccacatggtattcacggcacagcactgatcggaggacttcccatgccatacccaaacctggctccggacgtggacctgacgccggtggtgccctccgcggtcaacatgaatcccgcccctaaccccgcggtgtacaatccagaagccgtgaatgagccaaaaaagaagaaatacgccaaagaagcctggcccgggtgtgaatttgtgtcccagagccttattgccaccgctatttggaagtgcctgttaaaggcccagtcgctgggcctgggtggaaatgcaccaagccccctctactataagtag

SEQ ID NO: 130730 - DNA, 618 bp, Artificial Sequence
  Description of Artificial Sequence: Synthetic coding sequence
atgggcggtgaagacgacgagctcaagggtctattgggcctgcccgaagaagaaaccgaactcgataacctaaccgaattcaatacagcccacaataagaggatcagcacacttacgatcgaggaggggaacctagatattcagaggcctaagagaaagcgcaagaacagtagggttacatttagtgaagacgacgaaatcattaacccggaagatgtagatccaagtgtgggcaggttcagaaatatggtgcaaacagctgtggtcccggtcaagaaaaagcgcgtggaaggacccggatctctggggctggaagaaagcgggtccaggaggatgcagaattttgccttttccggagggctgtacggaggtctacctccaactcatagcgaagcaggatcccagccgcacggcatacacggcactgctctgattggagggctgccaatgccgtacccgaatctggcccccgatgtcgacctgacaccagtggttccaagtgccgttaatatgaaccctgcacctaatcccgcagtttataatccagaagcggtgaacgagccgaaaaaaaagaagtatgctaaggaggcatggccaggaaaaaaacccacgccctag

SEQ ID NO: 130731 - DNA, 600 bp, Artificial Sequence
  Description of Artificial Sequence: Synthetic coding sequence
atggccgcagccgctaattctggttcttctctgcctctgttcgactgtcctacctgggccggaaaacctccacctgggctacatctggacgtcgtcaaaggggataaactgattgaaaagcttataatcgacgagaaaaagtattacctgtttggtcgcaaccccgatctttgtgacttcacaatcgaccatcagagttgtagtagggtgcacgccgcactcgtgtaccataagcacctgaagcgtgtctttctaatagaccttaatagcactcatggaaccttcctgggacatatcaggcttgagccacacaagccacagcaaattcctattgatagtaccgtgagttttggggccagtacacgggcctacaccctcagggagaagccccagacactgccctccgccgtgaaaggagatgagaagatgggtggagaagatgacgagctgaaggggctgctagggctgcccgaagaagagactgagctggacaatttgaccgaattcaatacagcacacaaccatatggcttccatgggccaacatagttctgtagcttgtccctgccacacccagactctgcctctgatgtggacttag

SEQ ID NO: 130732 - DNA, 3891 bp, Artificial Sequence
  Description of Artificial Sequence: Synthetic coding sequence
atgctgaaaactgagtcgagcggggagcgaaccacattgcgatccgcctccccacaccggaatgcgtaccgcactgaatttcaggctctgaaatcaacctttgacaaacctaaaagcgatggcgagcagaaaacaaaggaaggagaaggatctcaacagtctcgggggaggaagtatgggtctaatgtgaaccgcataaagaacctgtttatgcagatgggcatggaacctaacgagaacgctgcagtgattgcgaaaacccgggggaagggtggccacagttctccccagaggcggatgaagccaaaggagttcctggagaagaccgacggatcagttgttaagcttgagagcagcgtttctgaacgaatctccagattcgataccatgtatgacggacccagttattctaagtttactgagacgcgcaaaatgttcgagcgctctgtgcatgaaagcggccagaacaacaggtattcacctaaaaaagaaaaagccggcggaagcgagccgcaagatgaatggggcggctcaaagtcaaatcggggctctactgattctcttgatagcctgtccagtcgcactgaggctgtatcgcctaccgtgagtcagctcagcgctgtctttgagaacactgatagccccagcgctattatatccgagaaggccgaaaacaacgagtactcagttacaggacattatcctctcaacttgcctagcgttacagttaccaacctggacaccttcggtcacttaaaggattccaattcttggccaccatcaaacaaaagaggggttgacactgaagatgctcataagtcaaacgctaccccggtgcccgaagtggcgagtaagtccaccagtctagctagtatccccggggaggaaattcagcaatcaaaggagccagaggactccacctcaaaccaacagactccggactccattgacaaggatggccccgaggaaccatgtgctgaatctaaagcgatgccaaaatccgaaataccctcacctcagtctcaactgctcgaggacgccgaggccaacctcgtgggaagggaggccgctaagcaacagcgtaaggaactagctggaggagactttactagccccgatgcttctgcctcaagctgtggcaaagaggtgcctgaagattccaataacttcgacggttctcatgtttacatgcactccgattataacgtatatagggtacgctccaggtataatagcgactggggtgagacaggcactgagcaagacgaggaggaggacagcgacgagaacagctattaccagccagacatggaatactcagaaattgtagggctgcctgaagaagaagagatacccgccaacagaaagatcaagttttcaagcgcgcctattaaggtgtttaatacctattccaatgaggactatgataggcgaaacgatgaagtcgatcccgtggctgcttcggccgagtacgagttggagaaaagagtggaaaagctcgagctttttcctgtagagctcgagaaggacgaggatggtctgggcataagcattatcggaatgggagtcggagcagacgcaggtctggagaagttaggcatcttcgtgaaaaccgtcacagaggggggcgctgcacaacgggacggccggattcaggtgaatgaccagatcgtcgaagtagatggtataagtttagtgggggtgacccagaattttgccgcaaccgttcttcggaatacaaaaggaaacgtgcgctttgtcatcggacgagagaagcccggacaggttagcgaggtagcccagttaatctcccaaacactggaacaggagaggcgacaacgggagctgctggaacaacactacgctcaatacgacgcagacgatgacgagaccggtgagtacgccactgacgaagaggaggacgaggtgggccccgtactgcccggaagtgacatggcaatcgaagtgttcgaactccccgagaatgaggacatgttctcaccttcagagctggatacctctaagctgagccataagttcaaagaactgcagataaaacacgctgtgaccgaagcagagatccagaaattgaagaccaaactccaggccgcagagaacgagaaggtacgatgggagctggaaaagactcagcttcagcagaacatcgaagagaataaggaaaggatgttgaaacttgaatcttactggatagaggctcagacgctgtgccataccgtcaacgagcatctgaaggaaacgcaaagtcagtatcaagcccttgagaagaaatacaataaagcaaagaaactcataaaggacttccagcagaaagagctggactttatcaagcgccaggaagccgagcggaaaaagattgaagatctagaaaaggctcatttagtggaagtgcaaggcctacaggttcggatccgagatctggaggcagaggtcttccgattactgaaacagaatggtactcaagttaataacaataataacattttcgaacgacggactagtttgggggaagtgagcaaaggagatacaatggaaaacctcgatggaaaacaaacctcatgccaggatggcctcagccaggacctgaatgaggccgtgccagagaccgaaagactcgattcgaaagcactgaagacacgcgcgcagctgagcgttaaaaataggaggcagcggccctcacggacccggctatacgattcagtgtcttccacggatggagaagatagcctcgaacgaaaaggactacgtacaagcagtcccgagtcagatagtggagtgccccctctaacaccagtcgactccaacgttcctttttcttccgaccacattgccgaattccaagaggagcctctcgaccccgagatgggccctctgagctctatgtggggcgacacctctctgttttcaacctccaagagcgatcatgatgtggaggagagcccatgtcatcaccagacaacgaacaaaaaaattctacgtgagaaggatgatgccaaagatcctaagtcccttcgagcctcgtcatccctagcggtccagggtggcaagatcaaacggaagtttgtggacctgggcgcaccattgaggagaaatagctctaaagggaaaaagtggaaggagaaggaaaaggaggcaagccggttctcagcaggctctcggatcttcagggggagactggagaattggactccaaaaccttgtagcaccgcccagaccagtacgcgcagcccgtgcatgcccttttcctggttcaacgacagtagaaagggcagctactcttttagaaatctgccagcacctacgtcttctctccagccctcgccagaaaccctgataagcgacaaaaagggtagcaagaattttacatttaatgacgacttctctccttcctctactagttccgccgacctgtccgggttgggcgctgagcctaagacgcccggcctgtcacagagtctggccctgtcatctgatgagatcctagacgacggccaatcccctaagcacagccagtgtcagaatcgggcggtgcaggagtggtcagtgcagcaggtgtcccactggctgatgtctctgaacctagagcagtacgtatccgagttttccgcacagaacataacaggggagcagctcctccagctggacggcaataagttaaaggccctaggtatgacagccagccaggaccgtgcagtcgtgaagaaaaaactgaaagaaatgaagatgtctctggagaaagcccggaaagctcaggagaagatggagaagcaaagagagaaactgcggcgtaaagaacaggaacagatgcagcggaagagtaagaagactgaaaaaatgacctccaccaccgccgagggagctggagaacaatag

SEQ ID NO: 130733 - DNA, 3297 bp, Artificial Sequence
  Description of Artificial Sequence: Synthetic coding sequence
atgctgaagactgagtctagcggagagagaaccacactaagatctgctagcccccataggaacgcttaccggacagagtttcaggccctaaagtccacgttcgataagccaaaaagcgatggagagcagaagacgaaagagggggaggggtcacagcagtcacgagggcggaagtacggcagtaatgtcaataggatcaaaaacctctttatgcagatgggcatggaacccaacgagaatgctgccgtgattgcaaagacccgcggaaagggaggtcactcttcaccccagaggcggatgaaaccgaaggagttcttagaaaaaacggatgggtctgtggtcaagcttgaatccagtgtttcggagcggatttcacgttttgacactatgtatgacggcccctcttattctaaattcacagagactcggaagatgtttgagcgttctgttcacgaatccggtcagaataatcggtacagccctaagaaggagaaggccggaggctccgagccacaggatgagtgggggggctccaagtcgaatcgaggcagtacggattccctggactcactttccagtcggacggaagcagtgtcccccactgtaagtcaactatccgctgtcttcgaaaacaccgatagcccgagcgccatcatcagcgagaaggctgaaaacaatgaatacagcgtaaccggccattatcctctgaacttgcccagcgtcaccgttaccaaccttgataccttcggacatttaaaagactcaaactcttggccgccctcgaacaaacgcggggtggacaccgaggatgctcacaaatctaacgctacccccgttcccgaggtggccagcaagagtacatctcttgcttcgattccaggggaggagattcaacagagtaaggaacccgaagatagcacgtcaaatcagcagacacctgattcaattgacaaggatggaccagaagagccatgcgccgagtccaaagctatgcctaaatcggagattccttcacctcaatcccagctactggaggacgccgaggcaaacctagttgggcgcgaggccgccaagcaacaacgaaaagagctggcaggtggagacttcaccagtcccgatgcttccgcttcatcctgcggtaaggaagtcccggaagactccaataacttcgacgggtcgcatgtgtacatgcactctgattacaacgtctatcgggtccggtcccggtacaattctgactggggcgagacaggtactgagcaagatgaagaggaggattccgatgaaaacagttactaccaacccgatatggaatactcggagatcgtgggtctccctgaagaggaggagatccctgcaaaccggaagattaagttctcttcggccccaatcaaggtgttcaacacatatagcaacgaagattacgatcggcgcaatgacgaggtcgatcccgtggcggcgtctgcagaatatgaactggaaaagagagtcgaaaaactcgaactgttccccgtcgagcttgagaaggacgaagatggcctcggaatatctattatcggcatgggtgttggagcagacgccggtctggagaaacttggaatcttcgtcaaaacagtcactgaaggaggcgcagctcagcgcgacggtagaatccaggttaacgatcaaatagtggaggtggatggtatctcactagtgggcgtaacccagaacttcgccgccacagtgctgagaaacacaaaagggaatgtgagatttgttattggaagggagaaaccgggccaggtgtcagaagtcgctcagctcatctcccagacactggagcaggaaaggaggcagcgagagttgttggagcagcattatgcgcaatatgacgctgacgacgacgagacaggagagtacgcaaccgatgaagaggaggacgaagttggtcccgtgctgccggggtctgatatggcaatcgaagtgtttgagctgcctgaaaacgaagatatgtttagcccctctgagctggatacctccaagttatcgcataagttcaaggagttacagataaagcatgcagtgaccgaggccgaaatccagaagttgaaaaccaagctgcaggcggctgaaaacgagaaggtgagatgggagctggagaaaactcaattgcagcaaaacatcgaggagaacaaggaacgcatgctcaaattagaatcatactggattgaggctcagacactgtgccatactgtgaatgagcatttgaaggaaacccaatcccagtatcaggctctcgaaaagaagtacaataaagccaagaaactgatcaaggacttccagcagaaggagctggactttattaagagacaagaggcagaacggaaaaaaattgaagacctcgagaaggctcatttggtggaagtccagggtctacaagtaagaattcgcgatctcgaggccgaggtctttaggctgctcaagcagaacgggacccaggtgaataataacaacaacatcttcgaaagacgtacctccctgggcgaggtgagcaagggcgacacgatggagaatctggacggcaaacagacctcatgccaagatggcctcagccaggacctcaatgaggccgtccccgaaacggagcgcctggatagtaaagcattgaagaccagagcccagctgagtgtcaagaatcgacgacagagaccttctaggacgcgactatacgatagtgtgtcttctacagacggggaggattctctggaacgaaaaaattttacatttaacgacgatttcagcccgtcaagcacctcatccgccgacttgagcggactcggtgccgagcctaagactccaggcctctcacaatctctcgctctgtcctcagacgaatctcttgacatgatcgacgacgaaatactggacgacgggcagtcacctaaacactctcagtgtcaaaaccgggccgtccaggaatggagcgtgcagcaggtgagccactggctgatgtccctgaacctagaacaatacgtttcggagttctctgcacagaatataacgggggagcagctgctgcagctcgacggcaacaaactgaaggctttaggcatgactgcgtcccaagaccgggccgtggttaagaaaaaactcaaagagatgaaaatgtccctggagaaagcccgaaaggcccaggagaaaatggaaaaacagagagaaaagctccgaaggaaggagcaggagcagatgcagcgtaagagcaagaagaccgagaagatgacatctacaaccgctgaaggggctggagagcaatag

SEQ ID NO: 130734 - DNA, 222 bp, Artificial Sequence
  Description of Artificial Sequence: Synthetic coding sequence
atgttgaagactgagagttccggagagcggaccacactgaggtctgcttcacctcaccgaaacgcttacaggaccgagtttcaggctctgaaaagcacatttgacaaaccaaagagtgatggcgaacagaagacaaaagaaggcgagggcagccagcagagccgcggaaggaagtatggatctaacgtcaatcgcatcaagaacctgtttatgcagatgtag

SEQ ID NO: 130735 - DNA, 126 bp, Artificial Sequence
  Description of Artificial Sequence: Synthetic coding sequence
atgctgaagacggagtcttctggtgagcggacgactctgcgcagcgcctctccgcatcgtaacgcataccgcacagagttccaggcccttaagtccacattcgataaaccgaaaagcgacgggtag

SEQ ID NO: 130736 - DNA, 3297 bp, Artificial Sequence
  Description of Artificial Sequence: Synthetic coding sequence
atgctgaagaccgaatcgagcggtgaacggaccaccctccggagcgccagcccacaccgtaacgcatataggaccgagtttcaagccctcaagtcaactttcgataaaccgaaatcagacggcgagcaaaaaactaaggagggggagggcagtcagcaatcccgcggtaggaaatacggatctaacgtgaaccgaattaagaatctgttcatgcaaatggggatggaacccaacgagaatgccgcggtcattgctaagactaggggcaagggaggacacagtagcccccaacgccgaatgaagccaaaggagtttctagaaaaaaccgatggtagcgtggttaagctcgagagcagtgtgtccgaacggatctcaaggttcgatacaatgtatgatgggccttcctacagcaaattcaccgagacaaggaaaatgttcgagcggagcgtacatgagagcgggcaaaataatagatattctccaaaaaaggagaaggctggggggtccgagccacaggacgaatggggcggctccaagtcaaacaggggctctacagattcccttgactctctttctagccggacagaggctgtcagccccaccgtgtcacagctgagcgctgtttttgagaatacagacagtccctccgcaataatctccgagaaggctgaaaataatgagtactccgtgacgggacattaccccctcaacctcccctccgtgactgtgactaacttagatacatttgggcacctgaaagattccaatagttggcccccgagcaataaacgcggcgttgacaccgaggatgcccacaaatcaaatgcaacaccggtgccagaggtcgctagtaaatctacgtccctagccagtattccgggggaagaaatacagcagagtaaggaacccgaggactctacgtccaatcagcaaacacctgactctatagacaaagacggtcctgaagaaccttgtgccgagagcaaggccatgcccaaatccgagatcccctcgcctcagagtcagctcctcgaggatgccgaggctaacctggtcgggagagaggctgcgaagcagcagcgaaaggagctcgctggcggagattttactagtcccgacgctagtgccagctcctgcggcaaggaggtacccgaagactctaataactttgatggttcccacgtttatatgcattccgattataatgtgtatagggtgcggagtcgctacaactctgactggggcgagacggggactgagcaagacgaagaggaggattccgatgagaatagttactatcaacccgatatggaatacagcgaaattgtcggtttacccgaggaggaagagatcccggcaaaccggaaaatcaagttctcctctgctccaataaaagtttttaacacctacagtaacgaggattatgataggcggaacgatgaggttgaccccgtggccgcttcagctgagtacgagttggagaaacgagtcgagaagctagagcttttccctgtagagttggaaaaagacgaagacggcctaggaatctctattatcgggatgggcgttggagccgacgctgggctggaaaagctgggaatcttcgtgaagaccgtgaccgaggggggtgcagcccagagggacggacgaattcaagttaacgaccagatcgtggaggtagacggcattagcctggtgggcgtgactcagaatttcgccgcaaccgtgctccggaacaccaaaggaaacgtcagattcgtaattggaagagagaaacctggacaagtgagcgaggttgctcagctaatctcccagacacttgaacaggagagaaggcagcgggaacttctcgagcagcactatgctcagtacgacgcggacgacgacgaaaccggggagtatgccacagatgaagaggaggatgaggtcggtccggttctcccaggctccgatatggccatcgaagtgtttgaattgccagaaaatgaggatatgttctctccttcggagctggataccagtaagctcagccataagttcaaggagctgcagattaagcatgctgtgaccgaggcagagattcagaaactgaagacgaaactccaagcagcggagaacgagaaggttcggtgggagttggaaaaaactcagttgcagcaaaatatcgaagaaaataaggaacggatgctgaagctcgaatcctactggatcgaggctcagaccctttgtcacacagtcaatgaacaccttaaagaaacccagtcccagtatcaggccttagagaagaaatacaacaaagcaaaaaaattgattaaagatttccagcagaaggaattagatttcattaagagacaggaagccgagcggaagaagatagaggacctggaaaaagctcaccttgtggaagttcagggacttcaagtgaggattcgcgaccttgaggccgaggtttttcgcctgctgaaacagaacgggacacaggtgaacaacaataacaatatcttcgagaggcggacttcactcggggaggtgagcaagggcgatacaatggagaatctcgacgggaaacaaaccagctgtcaggatgggctcagccaagacctaaatgaggccgtgcctgagaccgagagattggactccaaagcattgaagacgagggcgcagctttcagtgaagaatcggcgtcagaggccgtcccgtacacgcctgtacgacagtgtgagctcgactgacggggaggattccttggagcgcaagaacttcacattcaacgacgacttctctccaagtagcacctcttccgccgacctctccggcctgggagctgaacccaagacacctgggttatctcagagccttgccctctcgtccgatgagagccttgacatgatagacgacgagattttggacgatggacagtctcctaagcactcccagtgccaaaatagggccgtgcaggagtggtctgtccagcaagtaagtcactggcttatgtccttgaacttggagcaatacgtgtctgagttttccgcccagaacataacaggcgagcagctcctgcagctggatggtaacaaactaaaggcactgggaatgacagcctctcaggacagagctgttgtgaagaaaaaattgaaggaaatgaagatgtctctggaaaaggccagaaaagcccaggaaaaaatggagaaacagagggaaaaactgaggcggaaggaacaggaacagatgcagaggaaatctaagaagacggaaaaaatgacctctactaccgcagagggcgctggggaacagtag

SEQ ID NO: 130737 - DNA, 3762 bp, Artificial Sequence
  Description of Artificial Sequence: Synthetic coding sequence
atgctcaagactgagtcttctggggagcggacaactttacggtcagcctcgccacacagaaacgcgtaccgaaccgagttccaggcactgaaaagcaccttcgacaagccaaaatctgacggagagcagaaaactaaggaaggcgaggggtcgcagcaaagcagaggccggaagtacggttcaaacgtgaatcgaataaagaatctgttcatgcagatgggcatggagcccaatgaaaacgccgcggtgattgccaagaccagaggcaagggtggccatagttcccctcaacgccggatgaagcctaaagaatttctcgaaaaaaccgacggaagcgtcgtgaagctggagagctcagtgagtgagaggatctctagattcgacacaatgtatgatggcccttcatattccaaatttacggagacacggaaaatgtttgaacgaagtgtgcacgagagcggtcagaataataggtacagccctaagaaagaaaaagccggcgggtctgaaccacaggatgaatggggagggtcgaaatctaatagaggcagcacggatagcctggactcgctcagttctagaacggaggccgtctctcctactgtgtcccaactgagtgcagtcttcgaaaatacggacagccccagtgccataatatcagagaaggcagagaataacgaatatagtgtgacgggccattacccacttaatctaccgagtgtgacagtaacaaacctggatactttcggccatctaaaagatagcaattcttggcccccttcaaacaagagaggcgtggacactgaagatgcccataaaagtaacgccacacccgtcccagaagtggcgagtaagtccacctcactggcttcaattcccggggaagagatacaacagtccaaggagcctgaggattctacatccaaccagcagactcccgattccatcgataaggacggccctgaagaaccctgcgcagaatccaaagcaatgcctaaaagtgaaattcctagccctcagagtcagctcctggaggatgccgaggcaaacttggtgggacgtgaggcagccaagcagcagagaaaggagctggctggcggggactttacctcccccgacgcatcagctagtagctgtgggaaagaggtccctgaagactccaacaactttgatgggtctcacgtgtacatgcatagcgattataacgtttacagagtgcgttctcgctataactctgattggggcgagactgggaccgagcaggacgaggaagaggacagcgatgaaaactcctattaccaacctgacatggagtattctgagatcgtgggattgccagaggaagaagagatcccagcgaaccgtaaaatcaagttctcctcagcgccaattaaggtctttaacacttactcaaatgaagattatgaccgaagaaatgatgaagtagatcctgtcgccgctagtgccgaatacgagctcgagaagcgcgtcgaaaaacttgagctttttcccgtggagctggaaaaagacgaggatgggctgggtattagcatcattggtatgggcgtgggagccgatgcaggcctcgagaagctcggtatttttgtcaaaacggtgaccgaaggcggagctgcccagagggacggcaggattcaggtcaatgatcaaatcgtagaggtggatggcatctctttggttggagtcacacagaactttgcagcaactgtgctgcggaatacgaaagggaatgtgagatttgttattggccgtgaaaagcccgggcaggtttcggaagtggcccagctgattagccaaactctggagcaggaacgacgccaaagagaactgttggagcaacactacgcacagtacgacgcagatgatgacgaaacaggagagtacgcgaccgatgaagaagaggatgaagtgggcccggtgctgcccgggtccgacatggctatcgaggtcttcgagctgcctgagaacgaggatatgttcagcccatcggagctggataccagtaagctttcacacaaatttaaagagctccagataaagcacgcagttactgaagctgaaatacagaaactcaagactaaactccaggccgccgaaaatgagaaggttaggtgggaactagaaaaaacgcagctccagcagaacatcgaggagaataaagaaaggatgttgaagctggaaagctactggattgaagctcagactctgtgccacacagtaaacgaacacctcaaagaaactcagtctcagtaccaagctcttgaaaagaagtacaacaaagcaaaaaaactcatcaaggacttccaacaaaaggaactcgactttatcaagcgtcaggaggccgagcggaaaaaaatcgaggaccttgaaaaggctcacttggtggaggtgcagggacttcaggtgcggattcgggatctggaggccgaagtgtttcggttgctgaagcagaatgggacacaagtgaacaataacaacaacatcttcgaaagacgcaccagtcttggcgaggtttctaaaggcgataccatggagaacctggacggcaagcaaacgtcttgtcaggacggccttagccaggacctgaatgaggcggtccctgagactgagcgactcgattccaaagccttaaaaactagagcacaacttagtgttaagaacaggcgacagcgaccctctcggactcgtttgtatgatagtgtgagttccactgatggcgaagatagcttagaacgcaagccaagtaactctttctacaatcacatgcacattacaaaattgctgccacctaagggcctgcggacgagttcacctgagtccgatagtggagtaccacctttaacacccgtggactcaaacgttcctttttcgtctgatcatatcgctgagtttcaggaagaacccctcgaccctgaaatgggcccattaagctccatgtggggggatacctcactgtttagcactagtaagagcgatcatgacgtcgaggaatccccctgtcatcaccaaactaccaataaaaagatcttaagggagaaggacgatgccaaagaccccaaatcactccgtgcgtcgtccagcctggctgtacagggtggaaagatcaagcggaagtttgtcgatctcggggcacccctcagaagaaatagttccaaaggtaaaaagtggaaggagaaggagaaggaggcaagtagattttcagctgggtcacgcattttccggggacgcctcgaaaattggaccccgaaaccatgcagcactgcccaaacgagcacacggtccccttgtatgccattcagctggttcaacgactcccggaagggaagctactccttccgcaatcttcctgctcccacgagctcccttcagcctagcccagaaaccttgattagtgataaaaagggttcaaagaactttactttcaatgatgatttttctccatctagtacaagctctgcagatttgtccgggctcggggccgagcctaagactcccggcctgtcccagagcttggcactgtcctccgacgaagccctgggcatgaccgcttcacaggaccgggccgtggtcaagaagaaattaaaggaaatgaaaatgtccctcgagaaagctcggaaggcccaggaaaagatggaaaagcagagagaaaagctgcgtaggaaggagcaggagcaaatgcagcgaaagtcgaaaaaaacagagaaaatgacatcaaccacggctgaaggagcaggtgagcagtag

SEQ ID NO: 130738 - DNA, 930 bp, Artificial Sequence
  Description of Artificial Sequence: Synthetic coding sequence
atggatgagaaggtcttcacaaaagagctcgaccagtggatagaacaacttaacgagtgcaaacagctgtccgagtcacaggtgaagtcgctttgtgaaaaagctaaggaaattctgacaaaagagtcgaatgttcaggaggtcaggtgccctgtgactgtgtgcggtgatgtgcacggacaattccacgacctcatggagctttttagaataggaggcaaaagtccggatactaactacctgttcatgggcgactacgttgatcggggctattacagcgtggaaacagtcactctcctggtggcattgaaggtacgatacagagaacggataaccatcctccggggaaatcatgagagccggcagatcactcaggtctatggcttttatgatgaatgcttaaggaagtacggtaatgctaacgtctggaaatactttacagatctcttcgactacctgccactgactgccttagtggatggccagattttctgcctgcatggtgggttgtcaccatccattgataccttggaccatatccgtgcactggatagactgcaggaggtgcctcacgaaggccccatgtgcgacttgctgtggtcggacccagacgatcgtggcggttggggtatcagccccaggggcgcaggctacacattcggccaggatatctccgaaaccttcaaccacgccaatggactgaccctggtaagccgggcccatcaactggtaatggagggttacaattggtgccatgacagaaatgttgtgactatcttctctgcaccaaattactgttacaggtgcggcaaccaggccgctataatggaactcgacgataccctgaagtattcatttctgcagttcgaccccgctccccggaggggcgagccccacgtgacaagaaggacacccgattactttctctag

SEQ ID NO: 130739 - DNA, 1407 bp, Artificial Sequence
  Description of Artificial Sequence: Synthetic coding sequence
atggcccctcccccagcccgagtccacttgggagctttcctggcagtcaccccaaatccaggctccgcagcttcaggaacagaggctgccgctgccaccccgagcaaggtgtggggatcttctgccggtcgcatcgagccccgcggcggcggcaggggcgccctaccaacctccatgggtcaacatgggccctccgctcgagccagagctgggcgggctcccgggcccaggccggcgcgagaagcttcccccagactaagagtgcacaaaacgttcaagttcgtggtggtcggagtcttactgcaggtggtcccatcgtctgcagcaacaattaaactgcatgatcagtccattggcacacaacagtgggagcatagcccactaggcgagctctgccctccaggcagtcaccgctccgagcacccaggtgcatgtaacagatgtacagaaggggtcggctacaccaatgcgagcaataacctctttgcttgcctcccctgcaccgcctgtaaaagtgacgaagaggagagatcaccatgcactacaactaggaatacagcctgccagtgtaaacccggcactttcaggaacgacaactccgcggaaatgtgtcggaagtgttcacgaggctgtcccaggggcatggtcaaagtgaaagactgtacaccctggtcagacatagaatgcgtccataaagagtccggcaacggccacaatatttgggtcatactcgtagtaacactcgttgtaccactgttactggtggcagtgctgatcgtctgttgctgcattggcagcgggtgcggcggtgaccccaagtgtatggatagggtttgcttctggcggttagggctgctcagggggcctggcgcagaggataacgcccataacgaaatcctgtctaatgctgattcattgtccacattcgtcagcgagcagcagatggagtcccaggagcccgctgatctcactggggtgaccgtgcagagccctggagaggcacaatgtctgcttggccctgcggaagcagagggatctcagaggaggcggttgctcgtccctgctaatggcgctgatccaaccgagacactgatgctgttctttgataagtttgctaacattgtgccatttgattcctgggaccagctgatgcgacagttggatctgacgaaaaatgaaatagacgtggttagagcgggtactgcaggccccggagacgccctctacgccatgctgatgaagtgggttaataagacaggtcgtaacgcctcaattcacaccctgcttgacgcactggagcggatggaagagcggcatgccagggagaagatacaggatctcttagtagacagcggtaaatttatttatctcgaagacgggactggctctgccgtgagccttgaatag

SEQ ID NO: 130740 - DNA, 930 bp, Artificial Sequence
  Description of Artificial Sequence: Synthetic coding sequence
atggacgataaggcgttcacaaaagaattggaccagtgggtggaacagctcaatgaatgcaagcagctgaacgagaaccaggtccggacactttgtgagaaagccaaggaaatcttgactaaggagtccaatgtgcaggaggtcaggtgcccagttactgtgtgtggcgacgtacatgggcaattccacgacctcatggaacttttccgtattggagggaagtctccggacacgaactacctgtttatgggtgactacgtggatcggggctactattctgtcgagaccgtaacactgctggtagcactgaaagtccgatatcctgagcgcataacaattctgagaggcaatcatgaaagccgccagatcactcaggtgtacggcttctacgacgaatgcctgcggaaatacggtaacgctaacgtgtggaagtatttcactgacctctttgattacctcccacttaccgcattggtggacggacagattttctgcctccatggaggcctttccccatctatagatactttagatcatatccgcgctctggacaggctgcaggaggttccgcacgaggggcctatgtgcgatctgctgtggtccgatccagatgacagaggaggatggggcatcagcccaaggggcgcaggatacacattcggccaagatatttcagaaaccttcaatcacgctaatggcctgaccctggtttcacgggcccaccaactcgtgatggaggggtacaactggtgtcatgatagaaacgtagtgaccatttttagtgcacccaactattgttatagatgtgggaaccaggcggctatcatggagctggatgacaccctgaagtactcatttcttcagttcgaccccgctccgagaaggggcgaacctcacgtaacccgccggaccccggactacttcctgtag

SEQ ID NO: 130741 - DNA, 1461 bp, Artificial Sequence
  Description of Artificial Sequence: Synthetic coding sequence
atgtcttctagcagcccgcccgccggagcagcatccgcggccatttcagccagcgagaaagtggacggctttaccagaaaaagtgtgcgcaaggcgcagagacagaagcggtcccaaggatcctcgcagtttaggtctcagggaagtcaggcagaactgcatccgctcccacaactcaaagatgccaccagtaatgagcagcaagaactgttttgccaaaaactgcaacagtgttgcatattgttcgacttcatggactcagtgagcgatctgaagagtaaggaaatcaagcgggcaacactcaacgaactcgttgagtacgtttcaaccaatcggggagtcattgttgagtcggcgtacagcgacatcgtcaaaatgatttccgcgaacatcttcaggacactgcccccgagtgacaatcccgacttcgaccccgaggaagatgaaccaactctggaggctagctggccccacattcagctggtgtacgaattcttcttaagattcctcgagtcccccgatttccagccgagcatcgcaaaacgatacatagatcagaaatttgtgcagcagctgttggaattgtttgactccgaggacccccgcgaaagagacttcctgaaaaccgtgcttcacagaatctatggtaagtttctaggcctgagggccttcatcaggaaacagatcaacaacatctttctcaggtttatctatgaaaccgaacacttcaatggtgtggctgaactgcttgaaattttaggaagcattattaatggctttgcactgccactgaaagccgagcacaagcaattcttaatgaaggtgctgatccccatgcacacagccaaaggattagcactgtttcatgcacagttagcttattgtgtagtgcagttcttagaaaaagacaccaccttgactgaacctgtcatccggggcctgttaaaattctggcccaaaacctgctcccaaaaggaggtcatgttcctcggggagatcgaggaaatcttggatgtaatcgagccaacacaattcaagaagatagaggagcctttattcaaacaaatctccaagtgcgtgagtagttctcattttcaggtggcggagcgcgccctgtacttttggaataatgaatacattctaagcttgattgaagaaaacatcgataagattttaccaatcatgtttgcatccttgtacaagatatctaaggaacattggaaccccacaattgtcgcgcttgtctataatgtcctgaaaacgttaatggaaatgaacgggaagctctttgatgacctgacttcctcctacaaggcagaacgccaacgcgagaagaaaaaagagctggagcgggaagagctttggaaaaagctggaggaactgaagttgaaaaaggctctggaaaagcagaatagcgcctataatatgcactcgatcctgtcaaatactagcgcagaatag

SEQ ID NO: 130742 - DNA, 1290 bp, Artificial Sequence
  Description of Artificial Sequence: Synthetic coding sequence
atgatcatgaacgcaacctccaacgagcaacaggaactgttctgtcagaagctgcaacagtgctgcatattgtttgatttcatggatagcgtgtctgatctgaaatctaaagaaattaaacgcgccaccctgaatgaactcgttgagtacgtcagcactaaccggggcgtaatcgtcgaatccgcgtactctgacatcgttaaaatgatctctgcaaacatttttcgaacgctgcctccatccgacaacccagatttcgatccagaagaggatgaacccactctggaggcatcttggccccacatccagctcgtctatgaattttttctgaggttcctggagtcaccagactttcaaccatctattgccaaacgctacatcgaccaaaaattcgtgcaacagttactggagctgttcgatagtgaggatcccagagagagggacttcctcaaaaccgtgctgcaccgtatttacggtaagtttctgggcctgagggcctttataaggaagcaaattaacaacatctttcttcgcttcatttatgaaactgagcatttcaatggagtagctgagctgctcgagatcttaggttccatcatcaacggcttcgcgctgcccctgaaggccgagcacaaacaattcctaatgaaagtcctcattcctatgcatacagccaagggtctcgccctgtttcacgctcagctggcatactgcgtagtccagtttctggagaaagataccacattaactgaacctgttatccgggggctccttaagttttggccgaagacctgctcgcagaaggaggtcatgtttctaggagagattgaggaaatcctagatgtgattgagcccactcagttcaaaaagatcgaggagcccttatttaaacagatctccaaatgtgtgagctcttcgcatttccaggtcgccgagcgagctttgtacttctggaataacgagtatatcctcagcttaatagaagagaatatcgataaaatcttgcccattatgtttgcaagcctgtataagatatcaaaggagcattggaatccaacaattgtagccctggtgtataacgtgctgaagaccttaatggagatgaatggaaagctattcgacgatcttacaagctcctacaaagccgaacgtcagagagagaagaaaaaagagctggagcgggaggagctctggaagaagttagaagaacttaaactgaagaaagccttggagaagcaaaactccgcatataatatgcacagtatcctcagtaacacctctgccgagtag

SEQ ID NO: 130743 - DNA, 1461 bp, Artificial Sequence
  Description of Artificial Sequence: Synthetic coding sequence
atgtctagcagtagtcctccagctggcgccgcaagcgctgctatttccgcctcagaaaaagtggacggattcaccagaaaatctgtccggaaagcccaacggcagaaacggtcacagggctcgtcacagttccgctcccaaggatcacaagctgaactgcatccactcccacagcttaaggacgctacttctaacgaacagcaagagctcttctgtcaaaaactccagcagtgttgtatcctgtttgactttatggattcagtgtccgacctcaagagtaaggagatcaagcgcgctacactgaacgaactcgtggagtacgtgtctacaaatcgcggcgtcatcgtggaatccgcctatagtgatattgtgaaaatgatctccgctaatatcttccgcaccttaccgccgagtgacaacccagatttcgaccctgaggaggatgagcctacactggaagcatcctggccgcatattcaactcgtctacgagttctttcttcggtttttggagtcacctgattttcaaccatccattgcaaagagatacatagaccaaaaatttgtccagcagctgctcgagctgttcgatagtgaggacccacgtgagcgggatttcctgaagacggtgttgcacaggatctacggcaaatttcttggcttgcgtgccttcattcgcaagcagatcaacaatatttttctacgatttatctatgagacagaacattttaacggcgtcgctgaacttttggagattcttggctccatcatcaacggttttgcactcccacttaaggctgaacacaaacagtttctgatgaaagtactgatacctatgcatacagccaagggtctagccctgtttcatgctcaattagcctactgtgtggtccaatttcttgaaaaagacacgaccctcactgaaccggtaatccgtggccttctcaagttttggcccaaaacctgctctcagaaggaggttatgttccttggggagatcgaagagattctcgacgtgattgagcccacgcagttcaagaaaatcgaggagcccctgttcaaacagatctctaaatgcgtgtccagctcacattttcaggtagctgagagagccctgtatttttggaataacgagtatattctgagccttatcgaggaaaacattgataagatcctgccaattatgttcgcatctctctacaagatctctaaagaacattggaatcccactatcgtagcactcgtatacaatgtgctcaagaccctcatggagatgaatggaaagttattcgacgatctaacttcatcctataaggcagaacggcagcgggaaaagaaaaaggagttagagcgtgaagaactgtggaagaaacttgaggagctgaaattaaagaaagcgcttgagaaacagaactccgcctacaacatgcatagtattttgagcaatacttcggccgagtag

SEQ ID NO: 130744 - DNA, 1341 bp, Artificial Sequence
  Description of Artificial Sequence: Synthetic coding sequence
atgaagtgcttctcccgctacctgccatacatctttaggccacctaacactattttgagcagttcttgtcacacggaggctgatattattagcacggtggagttcaaccatactggtgaattgctggctacgggggacaaaggaggacgggtcgtgattttccagcgcgagcaggagtcgaagaaccaggtgcataggaggggcgagtacaatgtctactctaccttccagtctcatgaaccagagttcgactacctcaagtctctggaaattgaagagaagatcaacaagatccggtggcttcctcagcaaaacgccgcgtatttcctactgtctaccaatgataagaccgtcaaactctggaaggtgtccgagcgcgataaacggccagagggttataaccttaaagatgaagaggggaggctgagagacccggccacgattaccacgctgagagttccagtactgaggccaatggatctcatggtggaggcaacaccaagacgagtgtttgctaacgctcatacctaccacattaacagcatctccgtgaattctgattatgagacctacatgtcggccgacgacctgagaattaatctgtggaatttcgaaatcactaatcagtcatttaacatagtggacattaaacctgctaatatggaggagttaactgaggtgattactgcagccgaatttcatccgcaccactgcaacacatttgtgtacagctctagtaagggaacaatcaggttgtgtgacatgcgcgctagtgccctttgtgatcggcacaccaaattttttgaagagccagaggatccaagcaaccgcagctttttttcagagattatctcaagtatcagcgacgttaagtttagccactctgggaggtacataatgacgcgcgattatctgacagtcaaggtttgggatcttaacatggagaatcggcctatcgagacctaccaggtacatgattacctgaggtctaaactgtgtagcttgtacgagaacgactgtatttttgacaagtttgaatgcgtgtggaacggcagcgactctgtgataatgaccgggtcctacaacaacttcttcagaatgtttgacaggaataccaagagggatgttaccctcgaggcatctcgcgaaaactctaagccacgcgccatcctgaagcctcgcaaggtgtgtgtaggagggaaaaggcgaaaggatgagatcagtgttgattctttggattttagcaagaaaatcctacacaccgcctggcacccaagtgaaaatatcattgcggtggccgccaccaacaacttatatatcttccaagacaaggtcaactag

SEQ ID NO: 130745 - DNA, 1332 bp, Artificial Sequence
  Description of Artificial Sequence: Synthetic coding sequence
atggaagaagatatagatacccggaagattaacaattcttttttgagggatcacagttacgctaccgaggcagatattatctcgacagtcgaatttaaccacacgggcgaactgctggctaccggggacaaggggggccgagtggtgatcttccagagggagcaagaaagtaaaaaccaggtccaccgtagaggcgagtataacgtttacagcacattccagtcacacgagcctgagttcgactacttgaaaagcctggaaattgaggagaagataaataaaatacgctggctgccgcaacagaatgcagcgtattttttactcagcaccaatgataaaactgtgaagctatggaaagtaagtgagagagataaaagaccagagggctataacttgaaagatgaggaagggaggctgcgggatccggccacgattacaacgctaagggtgcctgtcctgagacctatggacctcatggtcgaagctactcccagaagggtgttcgccaacgcgcacacctatcacatcaattctatcagtgtgaactctgactatgaaacttatatgtctgcagatgacctaaggattaatctttggaacttcgaaataactaatcagtcgttcaacatcgtggacattaaacccgctaatatggaggaactgaccgaagtgatcacagctgcagaatttcacccacatcactgcaataccttcgtatactcctcttcaaaagggacaataagactctgcgacatgcgcgctagcgcactgtgtgatcgccatactaagttcttcgaggagcctgaagatcccagcaacagatccttctttagtgagatcatatcaagcatatccgacgtcaagttcagtcatagcggcagatacattatgacacgagactacttaacagtgaaagtgtgggacctgaatatggaaaacagaccaatcgagacgtaccaggtgcatgattatctcaggtctaagctgtgttcactctacgaaaatgactgtatcttcgacaagtttgaatgtgtttggaacgggtctgactccgtgattatgactggctcttacaataatttctttagaatgttcgaccggaacacgaagagagacgtcactctcgaggcatctcgagagaactccaagcctagagctatccttaagccaagaaaagtttgcgttggagggaaacgccgcaaggacgaaatttctgtcgactccctcgatttttcaaaaaagattctccacaccgcgtggcatccatctgagaatataatagcagtggcagctactaataacctatatatcttccaggataaggttaactag

SEQ ID NO: 130746 - DNA, 1506 bp, Artificial Sequence
  Description of Artificial Sequence: Synthetic coding sequence
atggtgctgcagccttcagaaagacattacagggattggaaccatagacgcctggggccatggtgtagtccaacagggtctcctgcccccctctcttgcgaaaccgggtgcggggagggttcttggatcctggtttgcagacttctggtgccgacccaggtttccctgctgtctatggaggaggacattgacacaaggaagatcaataatagttttttaagggaccactcctacgccaccgaagctgatatcataagcaccgttgaatttaatcatactggcgaactgctggctactggagacaagggaggacgggtcgtgatctttcaacgggagcaagagtcaaaaaaccaggttcaccgtaggggtgagtacaacgtctactccacatttcagtcccacgaacccgaattcgattaccttaagtctctagaaattgaggaaaaaataaacaaaattcggtggctacctcaacaaaacgccgcttactttctgctgtctacaaatgacaagactgtgaagctttggaaagtctcagagcgggataagaggcctgaaggatacaatctcaaagatgaagagggtcggcttagagatcctgcgaccataactacgttaagagtccctgtccttcggccaatggatctgatggtggaagcgactcctaggcgcgtgtttgcaaacgctcatacataccatatcaattctatttccgttaatagcgactacgagacttatatgtctgccgacgacctgaggattaatctatggaacttcgaaatcacaaatcagtccttcaacatagtggacatcaagcccgcaaacatggaggagctgactgaggtaattaccgccgcagagtttcacccacaccactgcaatactttcgtttacagctcctccaaaggcaccattcgcctgtgcgacatgcgcgcaagcgcgctctgcgacagacacactaagttctttgaggagccggaggacccgagtaatagatccttttttagcgagatcatttctagcatctctgacgtcaagttctctcactcaggccgatatatcatgacacgggactatctcactgtcaaggtgtgggatttgaacatggaaaacagacctatcgaaacctaccaggtccacgactatttgaggtcaaagctgtgctctctttacgaaaacgattgcatcttcgacaagtttgaatgcgtttggaatggctctgactcggttataatgacaggctcttacaacaattttttcagaatgttcgaccgaaatactaaaagagatgtcaccttggaagcctcgagggagaatagcaagccacgggctatactaaagccacgcaaagtgtgtgtgggtggaaaaagaaggaaagatgaaatttccgtcgactctttagacttcagcaaaaaaattctgcatacagcttggcaccctagcgagaatataattgccgtggccgcaactaacaatttatatatctttcaggacaaggtgaattag

SEQ ID NO: 130747 - DNA, 1299 bp, Artificial Sequence
  Description of Artificial Sequence: Synthetic coding sequence
atgaattatcccgatgaaaatacatacggaaataaagctgatataatcagcacagttgaatttaatcacacgggtgaactgctagccactggggataaaggaggcagagtggtgattttccagcgggaacaagaaagcaaaaaccaggtgcatagaaggggggagtataatgtgtactccactttccaaagtcatgagcctgaatttgattacctgaaaagcctcgagattgaagagaaaattaataaaatacgctggctgccacaacagaacgccgcttattttcttctgtccacaaacgataaaacagtcaagttatggaaagtgtctgaacgcgataagagacctgaggggtacaatttaaaagacgaagaagggaggctgagggaccccgcgaccattaccacactgagggtgcctgtgttacggcccatggaccttatggtggaagctacccctcgccgcgtgtttgcaaacgcccacacctaccacattaattccatctctgtgaacagtgactacgagacttatatgtccgctgacgatctccgcattaatttatggaatttcgagattacgaatcagtcttttaatatcgtggacattaagccagctaacatggaggagttaactgaagtgattaccgccgctgaatttcacccacatcactgcaatacattcgtgtatagcagtagcaagggcaccattcgcttgtgtgacatgcgagctagcgcactttgcgatcgccacacaaagttctttgaggagcccgaggacccaagcaacaggtcctttttcagtgagataatttcctctatttccgatgtcaagtttagccattctggccggtatatcatgactcgtgactaccttactgtcaaagtgtgggacctcaatatggagaatagaccaatagaaacatatcaagtacatgattatctgcgatctaaactctgttctctttatgaaaatgattgcatttttgacaagtttgagtgcgtgtggaatgggtcagatagtgttattatgactggcagttacaacaattttttcagaatgttcgaccggaatacaaaacgcgacgttacattggaggcctcccgagagaatagcaagccccgagctatcctgaagccccgcaaagtgtgtgtgggaggtaaacggcgtaaggacgagatcagcgtcgattcactggacttttctaaaaaaattcttcacaccgcatggcatcctagtgagaatataatagctgtggcagcaaccaataatctgtacatcttccaagataaagttaactag

SEQ ID NO: 130748 - DNA, 1332 bp, Artificial Sequence
  Description of Artificial Sequence: Synthetic coding sequence
atggaagaggatattgacactaggaaaattaataactcatttctcagagatcacagttacgcaactgaggctgacatcatttctacagtcgagttcaaccacactggagaactgctcgcaaccggtgacaagggcggccgggtcgttatcttccagcgggagcaggaaagcaagaaccaggtccacaggaggggtgagtataacgtctattcgacctttcaaagtcatgagcccgagttcgactacctgaagtcactcgagatcgaggaaaagatcaacaaaataaggtggctacctcagcaaaacgctgcatactttctgctgagcaccaacgataaaaccgttaagctatggaaagtctccgaaagagacaagagacccgaggggtataatttgaaagacgaggagggccggctccgggatccggcaacgatcacgactctgcgcgtccccgttctgcgaccgatggacttgatggtggaggcgacgccccgcagggtgtttgctaacgcccatacctaccatataaactctatcagtgtgaatagtgactacgagacctacatgtctgcagacgatctgcgcatcaatctgtggaatttcgagatcaccaaccagtccttcaacatcgtagatatcaagcccgcaaatatggaggagttgactgaagtcatcacagccgccgagttccatccacaccactgtaatactttcgtgtactcctctagcaaagggactatacgcctctgcgacatgcgcgccagtgccctttgtgatcgtcacacgaagttctttgaggaacccgaagatccttccaaccgctctttcttcagcgagatcatcagcagcatatcggacgtcaagttctctcatagtggaagatacatcatgaccagggactacttaaccgtcaaagtttgggatttaaacatggagaataggccgatcgagacctaccaagtccatgactatctgcgcagcaagctctgttctttatacgaaaacgattgtattttcgacaaatttgagtgcgtttggaacggctcggattctgtgatcatgaccgggagctataacaacttctttcgcatgttcgacaggaatacaaaaagagacgtgacacttgaggcatcacgtgagaactcaaagcctcgagcaatcctgaagccgcgtaaggtatgcgtgggtggtaagagacgaaaggacgagatcagcgtggacagcctagacttctctaagaagattctgcacacggcgtggcacccctccgagaacataattgctgtggcagctacaaacaatctctacatctttcaggacaaggtcaactag

SEQ ID NO: 130749 - DNA, 1332 bp, Artificial Sequence
  Description of Artificial Sequence: Synthetic coding sequence
atggaagaggacatcgacacgcgcaagattaacaacagctttctgcgcgaccatagctatgcaaccgaggctgatatcatctcgactgtggaatttaaccatactggggagttactggccaccggagataaaggcgggagagttgtcatcttccaacgggagcaggagagcaagaatcaggtgcaccggagaggcgagtacaacgtatattccacttttcagagccatgagcccgagttcgactacctaaagtccctcgagatcgaggagaaaataaataaaatccgctggctgccgcagcagaacgcagcatactttctgctgagtaccaatgacaaaactgtaaagctctggaaagtatctgaaagggataaacgcccggagggatacaatctaaaggacgaggagggtcgactgagggaccctgccaccataactacgcttagggtacctgtcctgagacctatggatctaatggtcgaagcaactcctcgacgtgtctttgcaaacgcccacacctaccacataaattccatttcagttaactctgattatgagacctacatgtccgcagacgaccttcggatcaatttatggaacttcgagatcacaaaccagtctttcaacatcgtggacataaagcctgccaacatggaggagctgaccgaagtaatcaccgccgccgagtttcaccctcaccactgcaatacgttcgtgtactctagctctaaaggcaccatccgcctgtgtgacatgcgggcctctgcattgtgtgacaggcacacaaaattctttgaggaacccgaagatccatctaataggagcttcttttcagagatcatctcatccatctctgacgtgaagttttcgcacagtggcaggtacatcatgacgagagactacctaaccgtgaaagtttgggacctgaatatggagaaccgacctattgaaacatatcaggtccacgattatctccggtctaagctgtgcagtttgtatgagaacgactgtattttcgacaagtttgagtgtgtgtggaacggtagcgactcagtgatcatgacgggcagctataacaacttctttcgcatgtttgatcggaataccaagagagacgtcacactggaggcctctagggagaatagcaagcccagagctatactgaagcctaggaaagtttgcgttggcggcaagcgccggaaggacgagatctcagtggatagtctggatttctcgaagaagatcctgcacaccgcctggcacccatctgaaaatattatcgctgtcgcggcaactaataacttgtatattttccaagataaagtgaactag

SEQ ID NO: 130750 - DNA, 1530 bp, Artificial Sequence
  Description of Artificial Sequence: Synthetic coding sequence
atgttactgtctttgcccgctctgcacctacagacttcggaacaccacccattctttcagttaccacatcggcgcctgggtccctggtgtagccccaccggcagcccagccccactgtcttgtgaaactggctgcggcgagggttcttggattctggtgtgtaggttgctcgtacctactcaggtcagcctcctgagcatggaggaagatatcgacacccgaaagataaacaattctttcctgagggaccatagttatgcaaccgaagccgatattatttctaccgtcgaatttaaccatacaggggagttgctagccacaggagacaaagggggtagggtagtgatctttcaaagagaacaggaatcaaaaaatcaggtacacagacggggggaatacaacgtttacagcacttttcaatctcatgagccagaattcgactacttaaagtccctcgaaatagaggagaaaataaacaaaatacggtggctgccccaacagaatgctgcctacttcctactctcaacgaatgataagacagtgaaactctggaaggtgagtgaaagggacaagcgtccagaaggttataatcttaaggacgaagagggccgcctccgagaccccgccacgatcactaccctgagagtcccggtactccggcctatggacctgatggtcgaggccacgccacgaagggtgttcgcgaatgctcacacataccatattaactcgatcagcgtcaatagcgattacgaaacctacatgagcgcagatgaccttcgcattaatctctggaatttcgaaataaccaaccagagcttcaatattgtggacataaaacccgctaacatggaagagctgaccgaagtgattactgccgctgagtttcacccacaccactgcaatacattcgtgtatagctcctcaaagggaaccattagactttgcgacatgcgagcttctgcattgtgcgatcggcatactaaattcttcgaggagcctgaggatccgtccaaccggagcttctttagcgagatcatttctagtattagcgatgtcaaattctctcatagcggacgatacatcatgacaagggattacctgactgttaaggtatgggacctgaacatggaaaatcgccccatcgagacatatcaggttcacgattacctgcggtccaagctctgctctctgtacgagaacgactgtattttcgacaagttcgaatgcgtttggaacggatctgattccgtcattatgacaggcagttacaacaacttcttcaggatgtttgatcggaacactaagcgcgacgtgacgctcgaggcctcccgcgaaaactcaaagccaagggccatcctgaagcctagaaaagtctgcgttggcgggaagcgccgcaaagatgagatcagcgtcgactccctcgacttctctaagaaaatattacacacggcttggcacccatcagagaatatcatcgcagtggcagcaactaataacttatacatatttcaggacaaggtgaactag

SEQ ID NO: 130751 - DNA, 1332 bp, Artificial Sequence
  Description of Artificial Sequence: Synthetic coding sequence
atggaggaggatatcgatacaagaaaaatcaataacagttttttgagagaccactcatatgctacggaagcggatattatttccaccgttgagtttaatcatacaggagagctcttagcaacaggagataaaggcgggcgcgtagttatttttcagcgggaacaggagtccaaaaatcaggtccataggcggggcgaatacaacgtatactctacctttcagagtcatgagcccgagttcgattacctgaagagtctggaaatcgaagagaagatcaacaaaatccgttggctcccacagcaaaacgccgcttactttctactgtccacaaacgacaaaacagtcaagctctggaaggtgagcgagagggacaaacgtcctgaaggttacaatttaaaggacgaggaaggaaggctgcgtgatcccgctaccatcaccaccctgagggtgcccgtgctgagacccatggacctgatggttgaagctaccccccggcgagtgttcgcaaatgcccatacctatcacatcaactcaatatcggtaaatagtgactacgagacctatatgtctgctgatgatctgcgcataaatctgtggaatttcgagattactaatcagtcctttaatatagtggatatcaaaccggctaacatggaagaactcacggaagtcataacagccgcggagtttcacccccatcactgtaacacattcgtgtacagctcctccaaaggaactataagattatgtgatatgcgcgcttctgctctgtgcgatcgacatactaaatttttcgaggaacctgaggacccatccaaccggagtttctttagtgagataatttcatcaatctccgatgtgaaattcagccacagtggtagatatatcatgactcgcgactaccttaccgtgaaggtgtgggatctgaacatggaaaaccgtccaatcgagacatatcaggtgcatgactacctacggtctaaactctgtagcttgtacgaaaacgattgcatctttgataaatttgagtgcgtgtggaatgggtccgattcagtaattatgaccgggtcgtataacaactttttccggatgtttgacagaaataccaagagggacgtgacccttgaggcgtctagggagaacagcaagcctcgcgccatcctgaagccgcgaaaggtttgcgtgggaggtaaaagacgcaaggacgagatctctgtcgacagcttggatttttccaaaaaaatacttcacaccgcctggcatccgtctgagaatatcatcgccgtggccgcaaccaataatctgtatatattccaggacaaggtcaactag

SEQ ID NO: 130752 - DNA, 1350 bp, Artificial Sequence
  Description of Artificial Sequence: Synthetic coding sequence
atgattcccgggatcgggaccctcactcaggatacactctggtgtttcagccaggtgaaggggactatcgagatcggaacgaccgaagcagacatcatttcaacagtagagtttaaccacacaggtgaacttctcgcgacgggcgataaggggggtcgcgtggtgatttttcagcgggaacaggaaagcaagaatcaagtgcacagaagaggcgagtacaatgtttactccaccttccagtcgcacgaacccgaatttgattacctgaagtcactggagattgaggaaaaaataaataagatacgctggttgccccaacaaaatgccgcctacttcctcctgtcaacaaacgataaaacagtgaaactgtggaaggttagcgagagggacaagcgaccggaaggatacaatctgaaagacgaggagggaagacttcgtgatcctgccacgataacgaccctgagagtgccggtgcttcgtccaatggatcttatggtcgaggcaactcctcgtcgcgtctttgctaatgcccacacctatcacataaattctatttctgtcaatagcgattacgagacttacatgtctgctgatgatctccgaattaatttgtggaacttcgagatcacgaatcagtccttcaacatcgtcgacataaaacccgccaatatggaggaattaacagaagtgatcacagccgccgaatttcacccccatcattgtaatacctttgtgtatagctcgtcaaaaggaaccatccggctctgcgacatgagggcttctgctttgtgtgacagacacactaagttcttcgaagaacctgaggacccatccaacaggtcctttttcagcgagataataagcagcatctcagatgtgaagttttctcattccggcagatacatcatgacacgagattacctcacagtcaaagtctgggatcttaatatggagaaccgacccatcgaaacgtaccaggtgcacgactacctccgctcgaagttgtgctccttgtatgagaatgactgcatcttcgacaagttcgagtgcgtgtggaacggctcagattctgtgatcatgactggctcctataacaacttcttcaggatgttcgacagaaatacaaagcgagacgttacgctggaggcgtccagggagaatagtaaaccgagagccatccttaagccccggaaagtgtgtgtgggtggaaaacgccgaaaggacgagatatccgtggattcattggactttagcaaaaagatcctccataccgcatggcacccctctgaaaacattattgccgttgcagcaaccaataacctctacattttccaagataaggtgaattag

SEQ ID NO: 130753 - DNA, 1299 bp, Artificial Sequence
  Description of Artificial Sequence: Synthetic coding sequence
atgaattaccccgacgaaaatacatacggcaacaaagccgacattatcagtaccgttgagtttaatcatactggtgagctcctggctaccggtgataagggaggaagagttgtgatttttcagagggagcaggagtcgaagaaccaggtgcaccgcagaggagaatacaacgtgtactctacattccagtctcacgaaccagaattcgattatcttaagagcctcgagatcgaagagaaaatcaacaagatccgttggctgcctcaacagaacgcggcctatttcttgctcagtaccaatgataagaccgttaagctttggaaggtgtctgaacgggacaagcggcctgagggctacaatctcaaggatgaggaggggcgcctcagggacccagcaaccatcaccacactgcgcgtgcccgttctcagaccaatggacttgatggtagaagctacgcctagaagggtttttgcaaatgcacatacatatcacatcaactctatatctgtgaacagcgactatgagacctatatgagcgccgacgatcttcgaatcaatttgtggaacttcgaaatcaccaaccagagcttcaacatcgtcgacattaaaccagccaacatggaggagctcaccgaagtgattactgcagcagagtttcatcctcatcactgtaacacttttgtgtacagtagcagcaagggaacaatcaggctttgtgacatgagagcctcagccctttgtgaccgacataccaaattctttgaggagcccgaagaccccagtaataggtcatttttttccgaaatcatctcttctatctccgacgtcaaatttagccattctggtagatacatcatgaccagggactatctcacagtcaaggtctgggacctaaacatggagaatcggccaatagagacctaccaggtgcacgactacctgaggtccaagctgtgttcactatatgagaacgactgcatctttgataagtttgagtgtgtctggaacggctcagactccgtcatcatgaccggatcatataataacttctttcgtatgttcgaccggaacacgaagcgagatgtcacactcgaggcctctagagagaatagtaaacccagagctattctgaagcctaggaaggtgtgcgtgggtgggaagcggaggaaagacgaaatttcagtcgacagtctcgacttcagcaagaagatcctccacacagcttggcacccatctgaaaatataatcgccgtggcagctaccaataatctctatatcttccaggataaggttaattag

SEQ ID NO: 130754 - DNA, 1494 bp, Artificial Sequence
  Description of Artificial Sequence: Synthetic coding sequence
atggagaccaagctccctccagcatctacccccacctcccccagctctcctgggctgagcccagtgcctcctccggataaggtggatggattcagccgtcggagtctgcgtcgcgctagaccccgaaggagccactcctcaagccagtttcgctatcagtccaatcaacaagaactgactccgttgcctcttctgaaggacgtgcccgcaagcgaacttcacgagctgctgtcacgcaaactggcacagtgcggcgtgatgttcgactttttagattgcgttgcagatctcaagggcaaagaagtgaagcgagccgctctgaatgaactggtggaatgcgttggcagtaccagaggagtacttattgagcccgtgtatcctgacattatccgaatgatctcagtgaacatatttcggaccttgccaccctccgagaacccagaattcgaccccgaagaggatgagccaaacctcgagcctagctggccgcatctccagctggtgtacgagttcttcctccgcttcctcgaatccccagacttccaaccttcagttgcaaaaaggtacgtggaccaaaagttcgtcctcatgctgctggagctgtttgactcggaggacccccgcgagagagaatacctaaaaacaatcctgcatagggtgtatggcaaatttctaggattgcgggcttatataagaaagcagtgtaatcacatttttttgaggttcatctatgaatttgaacactttaatggggtcgcggagctgctggaaatcttaggctccatcatcaacggatttgccctccctctgaagacggagcacaagcagtttctggtaagggtactgattcccctgcatagcgtgaaatcactaagcgtatttcacgcccaactcgcctactgcgtggtgcaattcttggaaaaagatgccacccttacggagcatgtgattcggggattattgaaatactggcccaagacctgcacacaaaaggaagtcatgttcctaggggaaatggaagaaatactcgacgtgattgagccatcacagttcgtaaagatacaggaaccgctgtttaaacaggtggcacgatgtgtctccagcccccacttccaggtagctgagagagccttatatttttggaataatgagtacatattgtccctgattgaagataattgccacaccgtactgcctgcagtttttgggaccctataccaagtttctaaagaacattggaatcagaccatcgtcagcctcatctataacgtccttaagacttttatggagatgaatgggaagctgtttgatgaactgaccgcttcatataaactcgagaaacagcaagagcagcagaaagcacaggagcggcaggaactttggcagggccttgaagaactgcgtctccgcagactccagggcacacagggagctaaagaggcgcctttgcaaagactgacaccgcaggtggcagcaagcggaggtcagtcctag

SEQ ID NO: 130755 - DNA, 1107 bp, Artificial Sequence
  Description of Artificial Sequence: Synthetic coding sequence
tctgtgcagtcccaccccgccccaccaaggccccgcgaaaacccgcgaggatctgagtcactcccatgtcggctgactgcgatggagactaagttgcctccggccagcaccccaacctcgcctagttcacccggcctctcacccgttccacctcccgataaggtggacggtttttctcgtaggtccttgcgcagggcaaggcccagacgatcacattcgagctcacaatttagataccaatccaaccaacaggagttgacgccactcccactgctcaaagatgttccagcgtcggaattgcatgagcttctgagccggaagctggcacagtgcggagtcatgttcgacttccttgactgtgtggccgaccttaaaggtaaggaggtcaaaagagccgccctcaatgaattggtggagtgcgttggctctaccagaggggtgctgatcgaacctgtttaccccgacattatccgcatgatcagcgttaatatctttcggaccctgccacctagcgagaatccagaatttgatcctgaggaggacgagcccaacttagaaccgagctggccccacctgcagctggtttatgaattctttctgaggttccttgagtctcctgacttccaacctagtgtggctaaacgttatgtcgatcagaagttcgttctgatgctgcttgagctgttcgacagcgaagaccccagggagagggaatacctgaaaaccattctgcaccgcgtatacggtaaatttctgggactacgtgcctacataagaaaacagtgcaatcatattttcttgcgatttatctatgagtttgagcactttaacggcgtggctgagctgctcgaaattctaggatcgattattaacggcttcgccttgccattaaaaactgaacacaagcctggcagtcgccccgatccgcccgctttgtgccaggtggccgtctgcctgccatgccccgccggaattctatgcggtgcagtcccgggggaaggctgtcattctgacagggccagggaccccggcgccgcccaaatcctggcaaaaaatctccaccctgagggtggcgacgtcagcggcggggacggtcgagatagctag

SEQ ID NO: 130756 - DNA, 582 bp, Artificial Sequence
  Description of Artificial Sequence: Synthetic coding sequence
atggagacgaagttgccgccggcctccactcccacaagcccttcttcccccggattatccccagttcctcctcccgataaggttgacggattcagtcgtcggtcacttcggcgcgcgcgcccacgacggagtcactcttcctcccaattcaggtatcaatctaatcagcaagagttaactcctttacccttgttgaaggatgttcctgctagcgaactgcacgagctgcttagtcggaagctcgcccagtgcggagtgatgttcgactttcttgactgtgtggctgacctgaaaggtaaagaagttaagagagctgcactgaatgaattggttgaatgtgtgggctctacaaggggcgtactgatcgaacctgtttaccccgacataatcaggatgatcagcgttaacatttttcgaaccttgccaccttcagagaatccagagtttgatcccgaagaggacgaacccaacctggaaccctcctggccacaccttcagcttgtgtacgaatttttccttagatttctggaatctccagattttcaaccctcagtggccaaaagatacgtggatcagaagtag

SEQ ID NO: 130757 - DNA, 1494 bp, Artificial Sequence
  Description of Artificial Sequence: Synthetic coding sequence
atggaaactaagctgccaccggccagcacgcctacttccccctcctcccccgggttgagcccagtccctcctcctgacaaggtcgatggattcagtcgcagaagtctgagacgcgctcgccccaggcgttcccactcttctagtcaatttagatatcagagtaatcagcaggaactcacccctctgcccctgcttaaggacgttcctgcttcggaacttcatgaactcctctctcggaaactggcccaatgcggtgtcatgttcgactttctcgattgcgtggctgacttaaagggaaaagaggtaaagcgcgcagctctgaatgaactggtagaatgcgtggggagcacgcgcggtgtcctcatcgaacccgtctatccagatataattcgcatgatcagcgtcaacatattccggacactgcctccatcggagaatcctgagttcgaccctgaagaagatgagcctaatttggaaccctcctggccccaccttcagctcgtgtatgagttctttctcagatttctggaatctccagacttccagccgtcagtggctaaacggtacgtcgaccagaaattcgttttgatgttgctggaattatttgattcagaggatcctagagagcgcgagtaccttaagacaattctgcatagggtttacgggaaattcctcggattgagggcttacattaggaagcagtgtaatcacatcttcttaagatttatctacgagtttgaacatttcaatggcgtggcagagctgctggagatcctgggctctatcatcaatggattcgccctccctttgaagacagaacacaaacagttcttggtgagagtgctgattcccctgcatagcgttaaaagtctcagcgtgtttcacgcacaactggcatattgtgttgtgcagttcctggaaaaggatgcaacattaaccgagcacgtaatccgagggcttctgaaatactggccaaaaacctgtacacagaaggaggttatgttcctgggagagatggaagaaattttggacgtgatcgaaccgtcacaatttgttaagattcaggagcccttgtttaaacaagtcgctagatgcgtgtcttcaccacattttcaggtggccgagagggctttgtatttctggaataatgagtacattctgtccctcatcgaagacaattgccatacggttctgccagcagtttttggtaccctatatcaggtgtcaaaagaacattggaatcaaactattgttagccttatctataacgttcttaaaacctttatggaaatgaacggcaaattatttgatgagcttaccgcatcatataagttggaaaaacagcaggagcaacaaaaggctcaggaacggcaggagctgtggcagggcttggaggaactcagactccgccggctgcagggaacccagggtgcgaaggaggcgccgttacagagactgaccccgcaggtcgcagcctccggcggacagtcctag

SEQ ID NO: 130758 - DNA, 408 bp, Artificial Sequence
  Description of Artificial Sequence: Synthetic coding sequence
atggaggagcttacagaggtgattactgccgcggagttccacccacaccagtgtaacgtttttgtatactcctcatccaaaggaacgattcggctatgtgacatgcggtcatctgcactgtgtgatagacattcaaagttcttcgaagaacctgaggatccctcatctagaagcttttttagcgaaattatcagttccattagtgatgttaaattctcccactctgggaggtacatgatgaccagagatcctgtcggtgagggcgtcgggccacagcatagggccggccgctggcggcccacgcggtctacatcaacatgcgctgcaagctctgcccttagcatgaggactacagcttctctcacttccctgagcgtagctggcaccgtgcggatcgctcctagctag

SEQ ID NO: 130759 - DNA, 1269 bp, Artificial Sequence
  Description of Artificial Sequence: Synthetic coding sequence
ctcactgccgatattatatcaacagtagagttcaattatagcggagatctcctagccacgggcgacaagggcggccgtgtcgtgatcttccagcgcgaacaagaaaataagtcaagaccccattcccgtggagagtataacgtgtattctacttttcaaagtcatgagcccgaatttgactatcttaagagcctcgaaatcgaggaaaaaataaacaagatcagatggctgccacagcaaaacgctgcacattttctgctctctactaatgataaaactattaagctctggaaaatttccgaaagggataagcgggcagaggggtacaacctgaaagatgaagatggccggctgcgggatccgttccggatcacagccctgagggtacccatcctgaagcccatggacctgatggtggaagcctcaccgcggaggatattcgctaatgcccacacctaccacatcaattcaatcagcgttaactccgatcacgaaacttacttgagtgctgacgatctcaggatcaatttatggcatctcgaaattacagatagatcgtttaatatagtggacataaaacctgctaatatggaagaactcaccgaggtgattaccgccgcggagtttcacccacatcagtgcaacgtgttcgtgtattcaagtagcaaagggacaattaggctatgcgatatgaggagcagtgcactctgtgatcgacatagcaaattcttcgaagaaccagaagatcctagctctaggtcttttttcagtgagataataagcagcatttctgacgtgaagttctcccactccggacggtatatgatgacccgcgactacctttctgtgaaagtatgggacctcaatatggagagccgcccagtggagacacaccaagtccacgaataccttcggagtaaactttgtagcctgtacgaaaatgactgcatcttcgataagttcgagtgctgttggaacggttccgattctgcaattatgacgggttcctataacaacttctttagaatgtttgatcgggatacccggcgggatgtcactcttgaggccagcagggagagcagcaaaccacgcgcgagtttgaaaccccggaaggtgtgtactgggggaaaaagaagaaaggacgagattagtgtggattcactcgatttcaacaaaaagatcttgcacactgcatggcacccggtggacaatgtgattgccgtggccgcaaccaacaatttatatatcttccaggataaaatcaactag

SEQ ID NO: 130760 - DNA, 1713 bp, Artificial Sequence
  Description of Artificial Sequence: Synthetic coding sequence
atgccctacaagttaaagaaggaaaaggagcctccaaaagtggctaagtgtacagctaagccctcttccagcggcaaagatggtggcggggagaacaccgaggaagcccaaccgcagccacagccacagcctcaaccacaggcgcagagccagcctccctcttcaaacaagagaccaagcaattctacacccccacctactcaactgtctaaaataaaatattcaggaggtcctcagatagttaaaaaggagcttttcatccagaaattgcgacagtgttgcgtactcttcgacttcgtgtccgatcccctgagtgacttaaagttcaaagaagtaaagcgagctggactgaatgagatggtagagtatattacacactcacgggacgtggttactgaagccatataccctgaagccgtgaccatgttttcagttaacttgtttaggacacttcctccatcctctaacccaactggtgcagaattcgatccagaagaagatgaacccactctcgaagcagcctggccccacctgcagctggtgtatgagtttttcttgcggtttctggaaagtccagactttcagcccaacatagctaaaaagtacatagatcagaaatttgtgcttgccctcctagatttgttcgatagtgaagatccacgtgaaagagatttccttaagactatcctccatcgaatctacgggaaattcctgggactccgcgcctacattagacgtcagatcaatcatatcttttatagattcatatatgagaccgaacaccataatgggatcgccgagctcctggagatactgggaagcatcatcaatggctttgctctgcctttaaaggaggagcacaaaatgttcctaatccgggttctgcttcctctgcataaggtgaagtctctgtccgtctatcacccgcagctggcctattgcgtggttcagttcctagagaaggagagcagtcttactgagcccgtaatcgtgggactgcttaagttttggcctaaaacccattcgccgaaggaggttatgttcctgaacgaactcgaggagatacttgatgtgatcgagccgagcgagttctctaaggtgatggaaccgctgtttcgccaacttgctaagtgcgttagctccccgcacttccaggttgcagaacgggcgctgtactactggaacaatgaatatatcatgagcttaatttcggataatgcagctagagtgctgccaatcatgtttcctgctctctataggaacagcaaaagccactggaataagactatccatggccttatctataatgctttgaagttattcatggaaatgaaccagaagctgttcgatgactgcacgcagcagtacaaagctgagaaacagaagggaaggtttcgcatgaaggagcgggaagagatgtggcagaagattgaagagctggcgcgcttgaaccctcagtaccccatgttccgagcaccacctccccttccccctgtgtatagtatggaaactgagactcccaccgccgaggacatccagttactcaaacggacagtagaaacagaggcagtgcagatgctcaaagatattaaaaaagagaaggtgctgctgcgaagaaaatcggagctcccccaagatgtctataccatcaaagcacttgaggcccacaagcgggctgaggaatttctgactgccagccaggaggccctatag

SEQ ID NO: 130761 - DNA, 1491 bp, Artificial Sequence
  Description of Artificial Sequence: Synthetic coding sequence
atgccctacaagcttaaaaaggaaaaggaactcttcattcagaagcttagacagtgttgtgtactctttgattttgtttccgatcccctcagcgacttaaagtttaaggaggtgaagagggcaggtcttaacgaaatggtggaatatataacgcactcacgtgatgtagtgacagaagccatctatcctgaagccgtgacgatgttttccgtgaaccttttcagaaccctgcctccgagctcaaacccaaccggagccgagttcgacccagaggaggacgaaccaactctcgaggcagcatggcctcacctgcaacttgtctacgaattctttctgcgctttctagagtctcctgattttcaaccaaatattgctaaaaagtatattgatcagaagtttgttcttgctcttcttgatttgttcgattctgaagatccgagggagagggacttcttgaaaactatcctacatcggatctacggcaagttcctgggtctgcgagcgtacataaggagacagataaaccatatattctacagatttatttatgaaaccgagcaccacaacgggatcgcggaattactcgagatactcggtagcattattaatggtttcgctctacccctgaaagaggagcacaagatgtttctgatacgtgtgctgctgcctttacacaaagttaagagtctaagtgtgtatcatccgcaactggcatactgcgtagtccagtttctggagaaagagtcaagtctgaccgaacccgtaatcgtcggcctgctgaagttctggcctaagacacacagccctaaagaggtgatgtttttgaacgagcttgaggagatactggacgtgatcgagccgtccgagttttctaaggtgatggagcccttatttcgccagctggcaaaatgtgtgtcctcacctcattttcaggtggctgagcgcgccctctactactggaataatgaatatattatgagcttgatatccgacaacgctgcccgagtactgcctatcatgttccctgcactctaccggaatagtaagtctcactggaacaaaacaatacatggcttgatctacaatgcgctcaagttgtttatggaaatgaatcaaaagcttttcgatgactgtactcagcagtataaggctgaaaagcagaaaggaagatttagaatgaaagagagggaggaaatgtggcagaaaatcgaggagttggcacgattaaatccccaatatcctatgtttcgcgccccgccccctcttcctcctgtgtattccatggaaaccgagactcctacagcggaagatatccaattactgaagagaaccgtcgaaacggaagcagttcaaatgctgaaagacattaagaaggagaaggtactgctccgcaggaagagtgagctcccccaggacgtgtatacaattaaggctctcgaggcccacaaacgggctgaagaattcctaactgcctctcaagaggctctctag

SEQ ID NO: 130762 - DNA, 1515 bp, Artificial Sequence
  Description of Artificial Sequence: Synthetic coding sequence
taaaaaaaggaaagacgacagtcgtcttcccgatttaacctgtcaaagaaccgagaactgcagaaactgccagctctgaaagatagtcctacacaagagcgggaggagctctttatacagaaactgcgtcagtgctgtgtgcttttcgacttcgttagcgaccctctgagcgatctgaagtttaaggaggtgaaaagggccgggctcaatgaaatggttgagtacataactcacagcagggacgtggtcacagaggccatttacccggaggccgttaccatgttttccgtgaacctgttccgaactcttccaccatccagtaaccccactggagcagaattcgatcccgaagaggacgagccaaccctggaggctgcctggccccaccttcaacttgtatacgaattttttcttcggttcctggagtcgcctgacttccaaccaaatatcgccaagaagtatattgatcagaagttcgtgctggctttactggacctcttcgacagtgaagaccctcgcgagcgggatttcttgaaaacaatcctgcataggatctacggcaagttcctcgggcttagggcctatattcgacgccagatcaatcacatattctatcgctttatatatgagacagagcaccacaatggaattgcggagctgctggagatcctggggagtataatcaatggctttgctctgcccctgaaggaagaacataagatgtttctcattcgagtgctccttcctctgcacaaagtcaagagtctctcagtctatcatccgcaggtgattgtgggtctccttaaattctggcctaaaacacactcccccaaagaggttatgttccttaacgagctcgaagaaatcctggacgtgattgagccttccgaattttcaaaggtgatggagcctctgtttcgacagctggcaaagtgcgtgtcaagcccgcactttcaggttgccgagagggcactgtactactggaacaatgaatatattatgagcttaatctcagataacgccgcaagggtgctgccaataatgtttccggccctctaccggaactccaagagccactggaataagaccatccacggtctcatttacaacgctcttaagctgtttatggagatgaatcagaaattgtttgatgactgcacccagcaatataaagctgagaagcaaaaaggaaggtttcggatgaaagaaagggaagagatgtggcagaaaatcgaggaactggcaaggctcaatcctcaataccccatgttccgcgcgccaccccctctccccccggtgtacagcatggagacagagacccccactgcagaggacattcagttattgaagcggacggtagaaaccgaagcagtgcaaatgctgaaagacatcaaaaaggagaaggtgttgttacggcgcaagtctgagctgcctcaggatgtgtatacaattaaggccctggaggcccataaacgcgccgaagaatttctgacagcctcccaagaagcactgtag

SEQ ID NO: 130763 - DNA, 1809 bp, Artificial Sequence
  Description of Artificial Sequence: Synthetic coding sequence
atgccttacaagctcaaaaaggagaaagagcctcctaaagtggcaaaatgtaccgccaagccttccagctcagggaaggatggcggcggcgaaaataccgaagaggcccaaccgcagcctcagcctcagccccagccgcaggcacagagccagccgcccagctccaataaacgtcccagtaactcaacaccgccaccaactcagctgtctaagatcaaatacagcggggggccgcaaattgtgaagaaggagcgtcggcaatcttcatcgcggttcaatctgtccaagaacagagaactgcagaagttgccagccctgaaggactccccaacacaggaaagggaagagctatttatccagaagcttcgacagtgctgcgtgctttttgactttgtgtctgatcccctgtctgatttgaagtttaaggaggtgaaacgggcaggactgaatgagatggtagagtacataactcatagcagagatgtcgtcacagaagctatttatccggaggctgtgaccatgttttcagtgaatctgtttcggaccctgcccccatcctccaatcccactggtgctgagttcgatcccgaagaggacgagccaacactggaagccgcgtggccccatctccagcttgtttacgaattttttcttcggtttctcgagagccccgattttcagccaaacatagccaagaagtacatcgatcaaaagttcgtgttggccctgctggacctgtttgacagcgaggatccgcgggagcgagattttctgaaaactatcctccaccgaatttatgggaaattcttgggactgagggcttatatccgccgccagattaaccacatcttttatcgctttatttacgaaaccgaacatcataatggcatcgcagagcttttagaaatcctgggcagtataattaatggtttcgctctacccttaaaagaggaacacaagatgttcctgatcagagtgcttctgccgctacataaggtgaaatccctgtctgtataccacccacaattagcttactgtgttgtgcaatttctggaaaaagaaagctctctaaccgaaccagtgattgtgggacttctgaaattttggcctaaaacccattcacccaaagaagtgatgtttctcaatgaactggaggaaattctggatgtcatagagccgtcagagttctctaaagtaatggagccgcttttcagacaacttgctaagtgcgtgtctagccctcacttccaggttgcagaacgcgctctgtactattggaacaatgaatacataatgagccttatttcagacaatgctgctagagtcttaccaatcatgttccccgctctctacaggaacagcaaatctcactggaataagacaattcacgggctgatatacaacgctttaaagttatttatggaaatgaaccagaagctgtttgacgattgtacccagcagtataaggccgagaagcaaaagggcaggttccgcatgaaagagagagaagagatgtggcaaaagattgaagagcttgcccgacttaacccccagtatcccatgtttcgcgccccgcctcccctgcccccagtgtattcaatggaaacagagacaccgaccgccgaggatatacagctgctgaaacgcacagtagaaacagaagccgtccagatgttaaaagatatcaagaaagagaaggtcctgttacgcaggaaaagtgagcttccccaagacgtgtataccatcaaagctttagaagctcataagcgcgccgaagagttcttaacagcctcacaagaagcgttatag

SEQ ID NO: 130764 - DNA, 1755 bp, Artificial Sequence
  Description of Artificial Sequence: Synthetic coding sequence
atgccgtataagctaaaaaaggagaaggagcctcctaaagtagctaagtgtaccgccaagccctcttcctccggcaaggacgggggaggggagaacactgaggaggcccagccccaacctcaaccccagcctcagcctcaggcacagagccagccaccatcatcaaataagagaccgtcaaactcaacacctcctccaactcagctcagtaagataaaatactctgggggccctcagatcgttaaaaaagaaaggcgccaatcctccagccggttcaatttaagtaaaaacagagaactgcagaagctaccggccttgaaagactctcctacccaggaacgtgaagaactgttcatccagaagcttcgccagtgttgcgttctgttcgacttcgtttctgatcccctgtctgatctcaaattcaaagaggttaagcgcgccgggctcaatgaaatggttgagtacatcactcactcgagggatgttgtaaccgaagccatttatcctgaagccgtgacaatgtttagcgtgaacctattccgaaccctgccaccttcgtcaaatcccaccggggcggaatttgatcccgaggaggacgaacctacccttgaagcagcttggcctcacctacagttggtctatgaattttttctgcgcttcctcgagagtcccgatttccagccgaatattgcaaagaaatacatagaccaaaaatttgtcctggctctgctggacctgtttgatagtgaggacccgagagaaagagattttttgaagacaatcctgcacaggatctacggcaaatttctgggccttagagcatacatcaggaggcagatcaaccacatcttctatcgcttcatttacgagactgagcatcacaatggtattgccgagctcctggagatcctcggtagcataattaatgggttcgctctaccgttgaaggaagagcataagatgttcctaattcgagtgttgctcccactacacaaagttaaatctctgtcggtctaccacccgcaggtgatcgtcggtctccttaagttttggcccaaaactcattcaccaaaggaagtgatgtttttgaatgagctagaagagatactggatgtaatcgaaccttccgagttcagcaaggtcatggaacctttattccgccaactcgctaagtgtgtatcgtcccctcatttccaggtagctgagcgcgccctctactactggaacaatgagtacatcatgtctctgattagcgataatgccgcccgcgttctcccgatcatgttccccgcattatatcgaaactctaagtcgcattggaataagacaatccacgggcttatctacaatgctctgaaactctttatggagatgaatcaaaagctatttgatgactgcacacagcagtataaagccgaaaaacaaaaaggcaggttcagaatgaaggaacgagaggaaatgtggcagaagatagaagagcttgctcgccttaatccacagtacccaatgtttagggctcccccgccactacctcccgtctactccatggagaccgaaacgcctactgccgaggacatccagttgctgaagagaactgtggagacggaagccgtgcagatgctgaaagacataaaaaaggagaaggtgctgctcagaagaaagtctgaattgcctcaggatgtatacacgattaaggcgctagaggcccataaaagggctgaggagttcctgactgcctcccaagaggcattgtag

SEQ ID NO: 130765 - DNA, 1404 bp, Artificial Sequence
  Description of Artificial Sequence: Synthetic coding sequence
atgtccagcgcccccaccaccccgccctcagttgacaaggtggatggcttctctcggaaaagcgtccgcaaggcacggcaaaagaggagccagtcctctagccagtttcgaagccaggggaaacccattgaactgacacccctgccacttctcaaggacgttccttccagcgagcagcccgagctttttctgaaaaagctccagcaatgctgtgtaatctttgacttcatggatacgctgtcagatctgaagatgaaggagtataagagaagcaccttgaacgaactagtggattatattactatctctcgcggatgtctcactgaacagacttacccggaagtcgtcaggatggttagttgcaatatattccgcacattgcctccgtccgacagcaatgaatttgaccccgaggaggacgagccaaccctggaggccagctggccacacctccaactggtatacgagttcttcattcgcttcctggagagtcaagaatttcaaccttctatcgccaagaagtacattgaccaaaagtttgtgctgcagcttctggaactctttgatagtgaggacccacgagagcgcgactacctgaaaactgttctgcatagaatctacggaaaattcctaggtctgcgagcattcattcggaaacagatcaacaacatcttcctgcggttcgtgtacgagactgaacatttcaacggggtggcagagctcctggagatcctcggaagcatcatcaatgggttcgctctgcccctgaaggcagagcataagcagttcctggtaaaggtgcttattccactccacacagtacgttcactgtccctgttccacgcccagttggcctactgcatagttcaatttctggaaaaagacccgtccctcacggagcctgtgatcagaggtttaatgaaattctggcctaagacttgtagtcagaaagaagtcatgttccttggcgagctagaggagattctggatgttattgaaccatctcagtttgtgaagatccaggagcctctattcaaacaaatagcgaaatgtgtttcatccccacacttccaggttgccgaacgggcactctattattggaacaacgagtatatcatgagcctcattgaagaaaactcaaatgtgatcttgcccattatgttcagcagcctgtacagaatatctaaggagcattggaatccagcaattgtggcgctggtatacaatgtcctcaaggcttttatggagatgaattccactatgttcgacgaactaacggctacttataagtcagatcgccagagggagaaaaaaaaggagaaagagcgggaggaattatggaagaagttggaagatctagagctaaaacgggggctgcgtagagacggtatcatccctacctag

SEQ ID NO: 130766 - DNA, 1176 bp, Artificial Sequence
  Description of Artificial Sequence: Synthetic coding sequence
atggatactttgagcgatctgaagatgaaagagtacaagagatcaactcttaacgaacttgtggactatatcaccatttcaagggggtgcctgacggagcaaacctatcccgaggtagtccgaatggtttcttgcaatatcttccgaaccctgcccccctccgactcgaacgagtttgatcccgaagaggatgagcctactctcgaggcctcttggccccacctgcaattggtgtatgaattttttatcagatttctggaaagccaggaattccagcctagcatcgctaagaaatatatcgatcaaaagttcgttctccagctcctagaactgttcgactctgaggaccccagggaaagggattacctgaaaactgtgctccacagaatttatggtaagtttctggggttaagagcttttatcagaaagcagatcaacaatatcttcctgagattcgtgtacgagacagaacacttcaatggggtggcagaactgttagagatcctcgggtcaatcattaatgggttcgcactgcctctcaaggcagagcacaaacagtttctagtgaaagtgctgataccgttgcacaccgtgagatcactcagtctcttccacgcacagcttgcatattgcatcgtacagttcctggaaaaagatccctcgctcacagagccggtcattcgtgggcttatgaagttctggccgaagacatgctcgcagaaggaagttatgttcctgggtgagctagaggagatcctggacgtcatcgagcccagccagtttgtaaagatacaggagccgctcttcaagcaaattgccaagtgcgtctccagcccacacttccaggtggccgagagggccctgtactactggaataacgaatatatcatgtctctcattgaagagaactcaaacgttatacttcccataatgttttcatccctttatagaatttcaaaggagcactggaaccctgctatagtcgcactggtgtataacgtcctgaaggccttcatggaaatgaacagtactatgtttgatgaactcacggcaacctacaaaagtgaccgacaaagagagaagaaaaaggagaaggagcgcgaggagttgtggaaaaagctagaagatctcgaactgaagcggggactgaggcgcgacggaatcattccaacttag

SEQ ID NO: 130767 - DNA, 1389 bp, Artificial Sequence
  Description of Artificial Sequence: Synthetic coding sequence
atgtcatccgctcccactactcccccaagtgtcgacaaagtggacgggttctcccgtaaatccgtgcgcaaggcgagacagaagaggagccagtcctcctcccagtttcgcagccaaggaaaacccatcgagctgacacccttgcctctgctaaaagacgtgcctagttctgagcaacctgagttatttctcaaaaagctgcagcagtgctgcgtgatttttgattttatggacacccttagtgatctaaagatgaaagagtacaaaaggtcgacacttaacgaactggtcgattacatcactatctcaagaggctgccttacagaacagacataccccgaggtggtccgaatggtgtcatgcaatatctttagaacgcttcctcctagcgactccaacgaattcgacccagaggaggatgaacccacccttgaggcatcctggccccatctgcagctggtatatgagttctttatcagatttctggagtctcaggaatttcagccaagtatcgcaaagaaatatattgatcaaaaattcgtccttcaattactggagttgtttgattctgaggatcccagggagagggattacttaaagaccgtattacacagaatttacgggaaatttctcgggctccgggcgttcattcgcaagcagatcaacaacatttttcttagattcgtgtatgaaactgagcacttcaacggcgtcgctgaattgctggaaattttgggaagcatcattaacggatttgctttgccattgaaggctgagcacaagcagtttctcgtcaaagtgctgataccgctccacacagtgagatcgctcagcctcttccatgcacagctagcatactgtatcgtccaatttctcgaaaaggacccatctctcactgaacccgtcattcggggactcatgaaattttggccaaaaacctgcagtcagaaggaggtgatgtttctgggggaactggaagaaatcctcgacgtcattgagccaagccagttcgtcaagattcaggaaccactcttcaagcagatagctaagtgcgtatccagtcctcactttcaggtggcagaacgcgcactgtactactggaataacgagtacataatgtccctaatcgaggagaattctaacgtgatccttcccataatgttcagctctctctaccgcatttccaaggagcattggaacccagccattgtggcacttgtgtataatgtgttaaaggcgtttatggagatgaacagtacaatgtttgacgaactcaccgccacatataacgaaaaaaaaaaagagaaagaacgtgaagaactgtggaagaaactggaagacctggaactgaagaggggcttacgacgagacggaattattcccacatag

SEQ ID NO: 130768 - DNA, 1344 bp, Artificial Sequence
  Description of Artificial Sequence: Synthetic coding sequence
atggggctgtctttcttttctaagcacctgcctatccaggaaggacagccatgggccctaaaaactcccgccgatatcatctcaaccgtggagttcaaccatacaggggaactgctagctacaggcgacaaaggtggcagggtggtgatcttccagagggagcctgagtcaaagaacgcccctcatagccagggggagtatgatgtttatagtacatttcaatcacacgaacccgaatttgactatctgaagtcgttagaaatcgaggagaagatcaacaagatcaagtggctcccccagcagaatgccgcccattctctccttagcaccaatgacaaaactatcaagctatggaagataacagaaagggataagagacccgaagggtacaacctcaaggatgaagaaggcaagctgaaggacctgtcaaccgtgactagtctgcaggtgcctgtgttgaagccaatggacctcatggtggaagtgtcccctcggcgcatcttcgcaaacgggcacacctaccacattaattccatttctgtcaactccgactgcgagacctacatgagtgctgatgacctccgaatcaacctgtggcatctggccattactgataggagctttaacattgtagacatcaagcccgccaacatggaggacctgactgaggtcatcactgccagcgaatttcacccacaccactgcaatcttttcgtctattcgagttcaaagggatctttgcgattgtgtgatatgagggccgcggctctttgcgacaaacactctaagcttttcgaggaacctgaagacccttctaatcgtagcttcttcagcgaaattatttcatcagtgtccgatgtgaagttttctcactccggtaggtacatgttgacacgggactatctgactgtgaaagtgtgggatttgaacatggaggccagacccattgagacttatcaggtgcacgactatctgcggagtaaactgtgcagtttatatgaaaatgattgcatctttgacaagttcgagtgcgcctggaacggctccgactctgtgattatgacaggcgcctacaacaacttcttccgaatgttcgatcggaacacgaagcgagatgtgacactggaagcatctagggagagttctaaaccacgcgccgtcctcaagccaaggcgcgtatgcgtgggcggaaagcggagaagggacgatatctcagtggactcactggatttcacgaagaagatccttcacaccgcttggcatcctgcagaaaatattatcgccattgctgctacgaacaatctgtatattttccaggacaaggtgaattccgatatgcattag

SEQ ID NO: 130769 - DNA, 1344 bp, Artificial Sequence
  Description of Artificial Sequence: Synthetic coding sequence
atgggtgaggacacagatacaaggaaaattaaccattcttttctcagagaccattcctatgtcaccgaagccgacataataagcaccgtcgagtttaatcataccggcgaactcctggccactggtgataaaggaggaagggtagtgatctttcagcgggaacctgaatctaagaatgctcctcatagccagggggagtatgacgtgtattccacattccagtcacacgaacccgagttcgattacctgaaatcattggaaatcgaggagaaaataaataagatcaaatggctcccccaacagaacgccgctcactccttgttgtccactaacgataaaactatcaagctctggaaaattacggagcgtgacaagcgccctgaaggttacaacttaaaagacgaggagggcaaactgaaagatctgtctaccgtgacttccttgcaagtgccagtcttgaagcctatggatttaatggtagaggtgagccctaggcggatcttcgccaatggccacacctaccacattaactctatcagtgtcaactcagactgcgaaacctacatgagtgcggatgacctgcgtatcaacctgtggcacttggctattaccgacagatctttcaatatcgtcgacataaagcccgccaatatggaggacctcaccgaggtgatcaccgctagtgaattccaccctcatcattgcaacctgttcgtgtatagttcaagtaaaggcagcctccgactatgcgatatgagggccgccgcactgtgtgacaagcacagcaagcttttcgaggagcccgaggaccccagcaacagaagctttttcagtgagatcatttcctcagtgagtgatgtgaagtttagccacagcggacggtacatgttgacgagagattacctcactgtgaaagtctgggatctcaatatggaagcccggccgatcgagacctatcaggtccacgattaccttaggagcaaactctgctctctttacgaaaatgactgcatctttgacaagtttgagtgtgcatggaatgggtcggacagcgtaataatgactggagcctataataacttcttccggatgttcgatcggaatactaaaagagacgtgacgctcgaagcgagccgcgaatcatctaagcccagagctgtattaaagccaaggcgcgtgtgtgtcggggggaaacggcgccgcgacgatatcagcgtcgattcactcgattttaccaagaagattttgcacacagcatggcatccagccgagaacatcatagctatagccgccaccaataacctatacatcttccaggacaaggtgaattcagacatgcattag

SEQ ID NO: 130770 - DNA, 1323 bp, Artificial Sequence
  Description of Artificial Sequence: Synthetic coding sequence
atgcgcgaggctgacacactcaggcctccccagctcatggaggtcagcgcagatattatctcgaccgtggagttcaaccacaccggggaactacttgcaacgggggataaaggcggacgagtggtgattttccagagagaacccgaatccaagaacgcacctcattctcagggagagtacgatgtatacagcacatttcagtcacacgaacccgagttcgattatctgaagtctcttgagattgaagagaaaataaacaaaatcaaatggctgcctcagcagaatgcagctcacagtctgctgtcgactaacgacaaaaccataaagctgtggaaaatcactgagagagataagcgtccagagggctataacctgaaggacgaagagggcaaactgaaggatctttccacagtcacaagtctgcaggtacccgttttgaagcccatggacctcatggttgaggtgtcaccgcggcggatttttgctaatggtcacacataccatataaactccatcagcgtgaactcagattgcgaaacttatatgtcagctgacgacctcaggattaatctatggcacttagccattacggacaggtcatttaatatcgttgacatcaaacctgccaacatggaagaccttactgaggtgattaccgcctctgaatttcatccacaccactgtaatctctttgtatattcttcatccaagggatccctccggctatgcgatatgcgcgcagccgcattgtgcgacaagcatagcaagctctttgaggagccagaagatccatccaatagatcctttttttccgagatcatctcttcagtgagcgacgtgaagttttcccacagtggaagatacatgctcactagagattacctaaccgtgaaggtctgggacctgaatatggaggcccgccctatcgagacgtatcaagtccacgattatttaagatctaagctctgcagtctgtacgaaaatgactgtatcttcgataagttcgagtgcgcttggaatggcagcgactctgtgattatgacgggggcatacaacaatttcttccgcatgtttgaccgaaatacaaaaagggatgtgaccctcgaagctagcagagaaagctccaaacctcgtgctgtgctaaaacctaggcgggtgtgcgtgggtgggaaacgcagacgggatgatatcagcgtcgactcacttgacttcactaagaaaatacttcacactgcctggcaccccgctgaaaatatcattgctattgctgccaccaacaacctctacatttttcaggacaaagtgaattccgacatgcattag

SEQ ID NO: 130771 - DNA, 1323 bp, Artificial Sequence
  Description of Artificial Sequence: Synthetic coding sequence
atgcgagaggctgacactcttcgacctcctcagctaatggaggttagtgctgatatcatcagtactgtggaatttaatcatacgggagagctgctggccactggagacaaagggggacgggtggttatatttcaaagggaacccgagagtaagaatgcaccccattcccagggtgaatatgatgtgtactccacattccaaagtcacgaaccagagttcgattacttgaagagtctcgaaatcgaggagaagatcaacaaaattaaatggctgccgcagcagaatgctgcccactcgctgctgtccaccaacgataaaacaatcaaactgtggaaaatcaccgagcgagacaaacgcccggagggctacaacctcaaagacgaagagggcaagctgaaggatctgagtactgtgacttccctgcaagtccccgtcctcaaacccatggacctgatggttgaggtgtcacctaggagaattttcgctaacggtcacacctatcatatcaattctatttcggttaatagcgactgtgaaacttatatgtctgcagacgacttacggattaacctgtggcacctggccatcacagatcggtcctttaatatcgtggatatcaagcccgcaaacatggaagatctgactgaagtcataaccgcatctgaattccatccccaccactgtaacctgttcgtgtattcctctagcaagggctcactgaggctgtgcgacatgagggccgctgcactatgcgacaagcactcgaagctgttcgaggaacccgaggatccctccaatcgaagtttctttagcgagattatttctagcgtctcagacgtcaagttttcccattctgggagatatatgcttactcgcgactatcttactgtgaaggtgtgggaccttaacatggaagcaaggccaattgagacttatcaagtgcatgactatctgagatccaagttatgttctctgtacgaaaacgattgtattttcgataagttcgagtgcgcatggaacggtagcgattcggtcatcatgaccggcgcctacaacaacttcttccgaatgttcgatcgcaatacgaaaagggacgtgacattggaggctagcagggaaagttcgaaacctcgtgcagtgttgaagccaagacgagtatgtgtgggcgggaaacgcagaagagacgacatatcggttgacagccttgacttcaccaaaaaaatcctccacactgcttggcatcctgccgaaaacatcatagctatagcagccactaataacctctacattttccaggacaaagttaattcagatatgcattag

SEQ ID NO: 130772 - DNA, 1293 bp, Artificial Sequence
  Description of Artificial Sequence: Synthetic coding sequence
atgggcaagagggatacagcagacattatcagcaccgtggagtttaaccacaccggcgaactgctggccaccggagataaagggggccgtgtagtaatatttcagagagagcccgaatccaagaatgcaccacattctcagggtgagtacgatgtgtatagtacatttcagtctcatgagcccgaattcgactacctgaaaagcttagaaattgaagagaagatcaacaagattaagtggctcccccagcagaatgcagcccacagcctcttgagtaccaacgacaaaaccatcaagctgtggaagatcaccgaacgggacaagagaccagaaggttacaatctcaaagatgaggaaggcaagctgaaagatttgtcaactgtcacctcactgcaggttcccgtactgaagcccatggatctaatggtagaggtgtccccaaggagaattttcgcaaacggccatacgtatcacatcaacagtatcagcgtgaacagtgactgtgagacctatatgtcagccgacgacctacgcataaacctctggcacctggccattaccgaccgcagtttcaacattgtggatataaaacctgccaacatggaggatttgactgaggtcattaccgctagtgagtttcatccccatcactgcaatctctttgtgtattcttccagcaagggctccctgaggctttgcgacatgcgggccgccgccttgtgcgacaaacacagcaagctgttcgaggagccagaagaccctagcaacagatcatttttctctgagatcatttcctcggtgtctgatgtcaaatttagccactcaggtcggtacatgctcactcgggattaccttactgtcaaagtttgggacctgaacatggaagccaggcccatcgaaacatatcaggtgcatgactacctcaggagcaaactctgttccctatacgaaaatgattgtattttcgacaaattcgagtgtgcatggaacggctcagactctgtgattatgaccggtgcctataataatttctttagaatgttcgaccgaaacacgaaacgcgacgtgaccttagaagcaagccgggagtctagcaagcccagggccgtgctaaagccacgtcgggtttgtgtaggagggaagcggcgcagagacgacattagcgtggatagcctcgatttcacaaagaaaatcctgcacaccgcctggcaccctgcagagaacattattgccattgcggccaccaacaatctttacatctttcaggataaagtgaattcagacatgcactag

SEQ ID NO: 130773 - DNA, 1623 bp, Artificial Sequence
  Description of Artificial Sequence: Synthetic coding sequence
atgcctaacaaaaataagaaggaaaaagagtcgcccaaggcaggaaagtccggaaaaagctccaaagaagggcaggacacagtggagagcgagcaaatcagcgtgaggaaaaacagcctggtggccgtccccagtaccgtgagcgctaaaattaaagtgccggtgagccagcccattgttaagaaagataaaagacagaactccagcagattctcagcctccaataatagagaactgcagaaactgccctcactgaaggatgtccccccagctgatcaggagaagttattcatacagaagctgaggcagtgctgtgttctgtttgactttgtatctgaccctctgtcagatttgaaatggaaggaagtgaagagagccgctctatctgaaatggttgagtatatcacacataaccgaaacgtgattactgaacccatctacccagaggtggtccacatgttcgccgtaaatatgttccgcacacttccccccagcagcaatcctacaggagcagaattcgatccagaagaagacgagcccaccctggaggcagcctggcctcaccttcagctggtgtatgaattctttctcaggttcctggagagccccgattttcaaccgaatatcgcaaagaagtatattgaccagaaattcgtgctgcagcttttggagctgttcgactctgaggacccacgcgagagggattttctcaagactaccctccacagaatctacgggaaatttttgggccttagagcttacatcaggaaacagatcaataatatcttctaccgctttatatacgagactgagcatcacaacggaattgcagaattgctcgaaatactagggtcgatcattaatgggttcgcccttccactgaaggaggagcacaaaattttcctgctgaaggtgctcctgcccttgcacaaggtgaagtcgctgagtgtatatcacccccagctagcatactgcgtcgtccagtttttagagaaggacagcacactgaccgagccagtagtcatggctctgttgaaatactggcccaaaacacattctccgaaggaggttatgttcctgaatgaactcgaagagatacttgatgtgattgagccatctgagttcgtaaagattatggaacctctcttcaggcagttggctaagtgcgtctcttctccccatttccaagtggccgaaagggctctgtactactggaataatgagtatattatgtccctgatctccgataacgcggctaaaatccttcctattatgttcccgtccttatatagaaacagcaaaacgcactggaataaaactatccatggcctaatctacaatgcgttgaagttatttatggaaatgaatcagaagttattcgatgattgcacacagcagttcaaggcagagaaactgaaagagaagctcaaaatgaaagaaagggaggaagcctgggtgaagatcgagaatttagctaaggccaaccctcaggcccagaaagaccccaagaaggatcgaccattggcccgccgtaagtcggagttgccacaggacccacatacaaaaaaagccctggaggcccattgtagagcagacgaattggccagtcaggacggtcgttag

SEQ ID NO: 130774 - DNA, 1575 bp, Artificial Sequence
  Description of Artificial Sequence: Synthetic coding sequence
atgctgacatgcaacaaggctggatcaaggatggtggtggatgctgcaaactctaacggccccttccaacccgtggttttgttacacatccgcgacgttcccccagcggatcaggaaaagttattcattcagaagcttcggcaatgctgtgtgttattcgactttgtcagcgatccgctcagcgatttaaagtggaaggaagtaaaacgggccgcgttaagcgaaatggtggagtacatcactcataataggaacgtgattaccgagccaatttaccctgaagtggtgcacatgttcgctgtcaacatgttcaggaccctgccacccagttccaatccgactggtgccgaatttgaccctgaggaagatgaacccaccctggaggcggcatggccacacctacagctggtctatgaattcttccttagattcctagagagcccagacttccagcccaatattgccaaaaaatacatcgaccagaaattcgtgcttcaacttttggaactgttcgactccgaagacccaagagagcgggactttctcaagaccacattacacaggatctacgggaagttccttggtctacgagcatacattcgcaaacagataaataacatcttctatagatttatctacgagaccgagcaccataatggcattgccgaattactcgagattctggggagcataataaatggctttgctttacccctcaaagaagagcacaagatctttctgcttaaagtcctcctgcccctgcataaggtcaaatcactctccgtctatcatccacagcttgcatactgtgttgtgcagtttcttgagaaagatagtacattaaccgagcctgtagtgatggctctgttgaagtattggcctaagacacactcgccgaaagaagtgatgttcctaaacgagctcgaagagattcttgacgtcattgaaccgtctgaatttgtgaaaattatggaacccttattcagacagctggcaaagtgcgtttcctcaccacactttcaggtcgctgagagggcactgtactactggaataacgaatacataatgagtttaatcagcgacaacgcagctaagatactccctatcatgttcccctccttgtataggaattccaagacccattggaataaaacaatccacggtctgatctacaacgcccttaagctgtttatggagatgaaccagaaattgttcgatgattgtactcagcagttcaaagccgaaaagctaaaggaaaagctaaaaatgaaagaaagagaggaggcatgggtgaaaattgagaacctggcgaaggccaaccctcaatacaccgtgtactcccaggcaagcaccatgagtatcccagttgctatggaaacggatgggcccctgttcgaagatgttcaaatgttgcggaaaacggtcaaagatgaggcccaccaggcgcagaaagaccccaagaaggatcgacccctggccaggcgtaagtccgagctgcctcaagaccctcacactaaaaaagcactcgaggcacattgtagggctgatgagttggcctcccaggatggtcgctag

SEQ ID NO: 130775 - DNA, 783 bp, Artificial Sequence
  Description of Artificial Sequence: Synthetic coding sequence
atgtttcggacgctgcctccatcctccaatccaaccggcgccgagttcgacccagaggaggacgagccaaccctggaagccgcctggccgcacctgcagctcgtgtatgagttttttctgcgattcctcgagagtcctgactttcagccaaacatcgcaaaaaaatacattgatcaaaaattcgttctgcagctgctggaactgtttgactcagaggatcctcgggagagggactttcttaagacgactcttcacaggatatacggaaaattccttggcctccgcgcctacattagaaaacagattaataacattttttatagattcatatatgagaccgagcaccataacggaattgctgagctcctggaaatacttggtagcatcatcaacggtttcgctttgcccctcaaggaagagcataagatatttctgctgaaagtccttctgccgctacataaagtaaaatctctgagcgtttatcacccacagctggcttactgcgtggtgcagtttttggagaaggattccaccctcactgagcctgtagtgatggctctgctgaagtactggcccaagacccattcacctaaggaggttatgttcctcaacgaacttgaggagatcctcgatgtgatcgagccgtcagagtttgtaaaaatcatggaacctctattccggcagctggcaaagtgcgtgtcctctccacattttcaggacaatacctggctcgacattcaacgcccagaggctctgcacggggacgagcctaaggcaatctag

SEQ ID NO: 130776 - DNA, 1458 bp, Artificial Sequence
  Description of Artificial Sequence: Synthetic coding sequence
atgttgacttgcaataaggctggctcacgaatggtagtagacgcagccaactccaatggcccgttccagccagtggttctattacatattcgggatgtgcccccagccgatcaggagaaattatttatccagaagttgcggcagtgttgtgttctgttcgactttgtcagcgacccgttgtcagacctgaagtggaaagaagtcaagcgggccgcacttagcgaaatggtggaatacattactcacaaccgtaacgtgatcaccgagcctatttatccagaggtcgtccatatgtttgctgtgaatatgtttagaacgctaccgccatcatcaaatcctacgggggctgaatttgacccagaggaggatgaacctaccctagaagcagcctggcctcatctccaactggtgtatgagtttttcttgcggttccttgagtctcctgacttccagccgaacatcgctaagaaatacatcgatcagaagtttgtattgcagctgctcgagttgtttgactctgaagatccccgggaaagggatttcctcaaaacaacgctgcacagaatctacggcaaattccttggtcttagagcttatatccggaagcaaatcaacaacatattttacaggttcatatacgagacagaacatcacaatggtatcgcggagctgctagaaattctcggttctataatcaatgggtttgccctaccattaaaagaggaacacaagattttcctgctgaaggtgctgttgccgctgcacaaggtgaaatccctctctgtgtaccacccccagctggcctactgtgtcgtacaattcctcgagaaggacagcaccttaaccgagccagtcgttatggccctcctcaagtactggcctaagacacattcgccaaaggaagtcatgttcctgaatgaactggaggaaatcctggatgttattgagcccagtgagtttgtgaaaattatggaacctcttttcaggcaactggcaaagtgcgtatcctccccgcacttccaggtcgccgagagggcactatactactggaataacgagtacattatgagcctgataagtgacaatgccgctaagatcctccccattatgtttccttccttgtaccggaattctaagacacactggaataagaccattcacggcttgatttacaatgccctgaagttgtttatggaaatgaaccagaagttattcgacgattgcacacaacagttcaaagcagagaagctgaaggagaagttgaagatgaaagaaagggaggaggcctgggtcaagatcgaaaatctggctaaggctaaccctcaagctcaaaaagaccctaaaaaggacagaccacttgctcgcaggaagagcgaactcccccaggaccctcacaccaagaaagcgctcgaagcccattgccgagctgacgagctggcttcacaggatggcaggtag

SEQ ID NO: 130777 - DNA, 1668 bp, Artificial Sequence
  Description of Artificial Sequence: Synthetic coding sequence
atgcctaataagaacaagaaggaaaaagaatcacccaaggctggcaagtccggaaaatcctccaaggagggacaggatacggtggagagcgaggggacctcgccagaggaacccagcagcccaaaagtgccaccgcctctgctgcctgagctgttagtgttgattttcgggggtctgcagggccgtgatgtgcccccagccgaccaggaaaaactgttcatccagaagctgcgccaatgctgcgtgctgtttgacttcgtttcagacccgctgagtgatctgaagtggaaagaggttaaaagagcagctctctccgaaatggtggagtatatcacccacaatagaaacgtcatcactgagcccatttacccagaggtggtgcacatgtttgccgttaacatgtttcggactcttcctcctagcagcaaccccacaggcgctgagttcgaccccgaagaggatgaaccaaccttggaggccgcctggcctcacctgcagcttgtgtacgagttttttctgcgcttcctcgaatcacctgatttccagcctaacattgctaagaagtacatcgaccagaagttcgtgcttcagctcctcgagctcttcgacagcgaagatccacgcgagcgggatttcctgaaaacaaccctgcacagaatctacggaaaattcctgggcctgcgtgcttatattcggaaacagatcaacaacatcttttaccggttcatctatgaaaccgagcatcacaatgggattgccgagttgttggagatccttggctcaatcattaatggattcgctttgcccctcaaagaggagcataagatctttctcttgaaggtgctgctgcccttgcataaggttaagtcactgagcgtctaccacccacagttggcttattgcgtggtgcagttcttagagaaggactccaccctgactgaaccagtggtcatggcgttactgaaatactggcctaaaactcatagcccaaaggaagttatgtttctgaatgaactggaggagattcttgatgtaatagagccttcggagtttgtgaaaatcatggaacccctcttcagacagctcgctaagtgcgtgagttccccccattttcaggtcgcggaacgtgccctatattattggaataatgagtatatcatgagcctaatatccgataatgcggccaagattctgcccattatgtttccttctctgtatcgaaattccaagacccactggaataaaaccattcatggcctgatatacaacgccctaaagctttttatggagatgaatcaaaaactttttgatgattgcacccaacagtttaaggcggaaaaactaaaggagaaactgaagatgaaagaaagggaagaggcgtgggtcaagatcgagaacctggcaaaagcaaacccccagtataccgtgtactcccaggcaagcaccatgagcatccctgttgctatggagactgacggccccctctttgaagatgtccagatgctgagaaagaccgtgaaagatgaggcccaccaagcgcagaaggatcccaagaaagaccgcccccttgctcgcagaaagtccgaactgccgcaggacccacacaccaagaaggcattggaagcccactgcagagcagacgaactggccagccaggacggcaggtag

SEQ ID NO: 130778 - DNA, 1350 bp, Artificial Sequence
  Description of Artificial Sequence: Synthetic coding sequence
atgctgacatgtaacaaagccggcagtcggatggttgtggatgccgcaaattctaatgggccattccagccagtggttctgcttcatatacgagatgtgccacctgccgaccaagaaaagctgttcatccaaaagctgagacagtgttgcgtgctgttcgatttcgtgtccgatcccctttccgaccttaagtggaaggaagtgaaacgggcggctctgtccgagatggtggaatacatcacccacaacagaaatgtgatcaccgagccaatttaccccgaagttgtgcacatgttcgctgttaatatgttcaggacactccccccctcctccaatcccacaggcgccgagttcgatcccgaagaggacgagcctacgctcgaagcagcatggccccacttgcagttagtgtacgagttttttctgagattcctggagtccccggattttcaaccaaacatcgctaagaagtacatcgaccagaaattcgtgttgcaactgctggagctctttgattctgaggatccaagagagagagatttccttaagaccacattgcaccggatttacgggaaatttttgggtctcagggcctacatcaggaaacagattaacaacattttttaccgatttatctatgagacagagcatcacaacgggatcgccgaactgcttgaaatcctgggttctattatcaacggctttgctctcccgctcaaagaggaacacaaaatcttcctgctgaaggtcctcttaccactacacaaggtcaaatcactaagcgtgtaccacccccaactggcctactgcgtggtccagttcttggaaaaagatagtaccctgacagaacctgtggtgatggcacttttgaagtattggccgaaaacgcactcccccaaagaggtgatgttcttgaacgagttggaagagattctcgacgttatcgaaccctcagagtttgtcaaaattatggagccactcttccggcagctcgcgaagtgtgtgagttctcctcactttcaagtggctgagcgggctctctactactggaataacgaatacatcatgagcctgatctcagacaatgctgccaagatcctgccgatcatgttcccatcactgtatcggaactctaagactcactggaataaaacgattcatggcttaatttacaatgcactgaaactctttatggagatgaaccaaaagctattcgatgactgcacgcagcaatttaaagccgaaaagttgaaggagaagctgaagatgaaagaacgtgaggaagcgtgggtgaaaatcgagaacctggccaaagctaatccccaggtgctcaagaaaagaattacatag

SEQ ID NO: 130779 - DNA, 1155 bp, Artificial Sequence
  Description of Artificial Sequence: Synthetic coding sequence
atgctgacctgtaacaaagcagggagccgaatggtggtagatgcagcaaactcaaacggcccctttcagcccgtggtcctactgcatatccgtgacgtgcccccagcagaccaggagaagctgtttatccagaaactgcgccagtgttgcgtgctatttgactttgtttccgatcctctgagtgacctgaaatggaaagaggtaaagcgcgctgccctttctgagatggtcgagtacatcacgcacaaccgcaacgtgataaccgaacccatatatcctgaggtcgtgcacatgtttgcagtaaacatgttcagaacgctgcctccatcctcaaatccaacaggtgcagagtttgatcccgaagaggatgaaccaactttggaggctgcgtggccacacctacagcttgtgtatgagttttttttgagatttctggagagccccgatttccagcccaacatcgctaagaaatacattgaccaaaagtttgtcctgcagttgctagagctgttcgactctgaggacccgcgcgagcgggactttctcaaaacaactttgcatcgcatctatggcaaatttctgggcctgagagcctacatccgtaagcaaataaataatatattctatagatttatctatgagacagagcaccataatgggatcgcagagctcctggagatcctgggatcaatcataaacggttttgctctgcccctcaaagaagagcataagatcttcctcctgaaggttctcctgcctctccacaaagtgaaaagtctctctgtctatcatccccagttagcctactgtgtggtacagtttttggaaaaggactctacgctcactgagcccgtcgtgatggctctcttaaaatattggccgaagacacattcacccaaggaggttatgtttttgaacgagctggaagagattctggatgtgattgaacctagcgaattcgtgaaaataatggaaccactgttccgccagctggcaaaatgcgtcagttcaccccattttcaggtcgccgagagagcgttgtactattggaataacgagtacatcatgagtctcataagcgataacgcggcgaagatcttgccaatcatgttcccctctttataccgtaactctaagactcactggaataagtag

SEQ ID NO: 130780 - DNA, 1662 bp, Artificial Sequence
  Description of Artificial Sequence: Synthetic coding sequence
aacaaaaataagaaagagaaagagagccccaaagctgggaagagcggcaagtctagtaaggaagggcaggacactgtagagtctgagggaacatctccagaggaaccatcgtctccgaaggtaccgccacctctgttgccagaactgcttgtgttgatctttggtggactgcagggaagagatgtccccccggcagaccaggagaagctgttcatacaaaaactccgtcagtgctgcgttctgtttgattttgtgtccgatccactcagcgatctcaaatggaaagaggtgaaacgggccgcactgagcgagatggtggagtacattacccacaaccgcaacgttattaccgaaccaatctaccccgaggtagtacacatgtttgcagtgaacatgttccgcactcttcccccctccagtaatcccacgggcgccgagttcgaccccgaagaagatgagcctacactagaagccgcatggccccatcttcagcttgtgtacgaatttttcctgcggttcctggagagtcctgattttcagcctaatatcgccaaaaagtacattgatcagaaattcgtgctgcagctcctcgagctgtttgacagcgaggatcctcgcgagcgcgactttctcaaaacaactctgcatcgaatctacggcaaattcctgggtttacgagcatacataagaaaacaaattaacaacatcttctaccggttcatctacgaaacagagcaccataacggcatcgcagagctgcttgaaatcctggggagcattatcaatggtttcgccttgcccttaaaagaggagcataagattttcctcctgaaggtcttactccctctgcacaaggtcaagagcctcagtgtgtaccacccacagttagcctactgtgtcgtccagtttctggaaaaagacagcactctcacagagcctgtcgtcatggcgctcctgaaatactggccaaaaacacactcgcccaaggaggtcatgttcctcaatgaactcgaagaaattctcgatgttatcgaacccagtgaattcgtaaaaatcatggagccactatttcgtcagttggccaagtgcgtgagtagtccccactttcaagtggccgagagggctctctattactggaacaacgagtacataatgtctctgattagtgacaacgcagctaaaatactcccaatcatgtttccatccctctaccgcaacagcaagactcattggaacaaaacaattcacggactaatctataacgcgctgaagctgttcatggagatgaatcagaagctgttcgatgattgtactcaacagttcaaggccgaaaaactcaaagagaagctgaagatgaaggaaagggaagaggcatgggtaaaaatagagaacctggcaaaagccaaccctcaatacactgtgtactcccaggctagtacaatgagcatcccggttgctatggagaccgacggtcctctgttcgaagacgtacaaatgctgagaaaaacagtcaaagatgaggcccatcaggcacaaaaagatcctaaaaaggaccgacctctggcgcgtagaaaatccgaactgccccaggatccccataccaagaaagcactcgaagcccactgtagagctgacgaactggcaagtcaggatggaagatag

SEQ ID NO: 130781 - DNA, 1077 bp, Artificial Sequence
  Description of Artificial Sequence: Synthetic coding sequence
atggcagaaggggagcgtcagcctcctcccgatagttctgaggaagcacctcccgctacccaaaatttcatcatccccaagaaggagatccataccgttccagatatgggcaagtggaaacgatcccaagcgtacgcggattatatcgggtttatccttaccttaaacgagggcgtgaagggcaagaagcttacctttgaataccgagtctcagagatgtggaacgaggtgcacgaggagaaggagcaggctgctaagcagagcgtaagctgtgacgaatgcatacccctaccccgcgccggtcattgtgccccgagcgaggccattgaaaaactcgtagcgttgctgaatacgctagacagatggattgacgagacaccacctgtcgatcaaccatcccggttcggcaacaaagcctaccggacgtggtatgccaaattggacgaggaggcggagaatctcgtggcaacggtagtgccaacccatctggccgccgccgtccctgaggtggctgtctaccttaaagagagtgtggggaattccacacgcatagattacgggaccggtcatgaggccgcgttcgctgccttcctctgctgtctatgcaagataggcgtgttgagagttgatgaccagatcgccatcgtgtttaaggtcttcaaccgctatctcgaagtgatgcggaaactacaaaagacatataggatggaacccgctgggtctcagggcgtctggggtcttgacgatttccagttccttcccttcatttggggcagctcacagctcatcgatcatccttacctggaaccaagacactttgtggatgagaaagctgtcaatgagaatcataaagattatatgtttctggaatgtattttattcattaccgaaatgaagactggtccgttcgccgagcactctaatcagctgtggaatatctccgcagtgcctagctggtccaaagtcaatcaggggctcattcgcatgtataaggcggaatgcctcgagaaatttcctgttattcagcattttaagtttggctcattacttcctatacatcctgtaacatctggttag

SEQ ID NO: 130782 - DNA, 990 bp, Artificial Sequence
  Description of Artificial Sequence: Synthetic coding sequence
atggccgaaggcgagcgccagcctccacccgacagttccgaggaagccccacccgcaacccagaatttcatcattcctaagaaggaaattcacacagttcccgatatggggaagtggaagcgttctcaggtgccattcgggaccgtggcttacgcggactacatcgggttcatcctcacccttaacgaaggtgttaagggaaaaaagctcacctttgaatatcgagtctccgaggccatcgaaaagctggtggccctgttgaataccctggatagatggattgatgaaacacccccggtggaccaaccgagcagatttgggaacaaggcgtaccggacatggtacgcgaagctcgacgaggaggctgagaacctagtcgctaccgtcgtgcctacacacttagcagcggccgttcctgaagttgcggtatatctcaaggagtctgtgggaaattcgacccgtattgattacgggacaggccacgaagctgcattcgccgctttcttgtgttgtctgtgcaaaatcggagttctcagagtagacgaccagatcgccatcgtctttaaagtgtttaaccgatacttagaggtgatgagaaagctgcagaaaacctatcggatggaacctgcaggcagccagggtgtctgggggctagacgacttccagtttctgccttttatctggggctcttcccagttgatcgaccacccttacctcgagccacggcacttcgtggatgagaaggccgtcaacgagaatcataaggactatatgtttctggaatgcatcttgtttataactgaaatgaagacaggacccttcgccgagcactccaatcaactgtggaatatctcagccgtgccctcttggtccaaggtgaatcaggggttgatcagaatgtataaagcagagtgtctggagaaattccccgtaatacaacacttcaaatttggctccttgctgcccatccatcctgtgacttcaggttag

SEQ ID NO: 130783 - DNA, 846 bp, Artificial Sequence
  Description of Artificial Sequence: Synthetic coding sequence
atggccgagggggagcgtcagcccccaccagacagctcggaggaagcgccacctgctactcagaacttcatcatacctaaaaaagagatacacaccgttcctgacatgggcaagtggaagcgttctcaggcgtacgccgattacatcggattcatactgaccttgaatgagggggtgaaggggaaaaaactcacatttgagtatagagtttcggaagaggcggaaaatcttgtggcaacggtcgtccccactcatttggctgccgccgtgcccgaggtggccgtttaccttaaagagtctgtgggaaactccacccgcattgattacggcaccggccacgaggctgcttttgcggctttcctatgttgtctgtgtaagatcggcgtgctgcgagttgatgaccagatcgcaattgtgttcaaggtttttaaccggtacctcgaagtgatgcgcaagttacaaaagacataccgcatggaaccagctggatcgcagggggtgtgggggctggacgatttccagtttcttccttttatttggggctcttctcagctgatagatcacccatacctcgaaccaaggcactttgtcgatgaaaaggctgttaacgaaaaccataaggactatatgttcttggagtgcatcctgtttatcacagagatgaaaacaggtcccttcgccgaacactccaaccagctctggaatattagtgctgtgccttcatggtccaaggtgaaccagggtttgatacgaatgtacaaggcagagtgtctggaaaagttcccagtgatccagcattttaaattcggatccctgcttccgattcaccctgtaacgtccggttag

SEQ ID NO: 130784 - DNA, 885 bp, Artificial Sequence
  Description of Artificial Sequence: Synthetic coding sequence
atggctgaaggcgagaggcaacctcctccagatagctcagaagaggctccaccagctacacaaaacttcataatcccaaaaaaggaaatacacacagtgcctgatatgggcaagtggaagagatcacaggcaattgaaaaactagttgcactcctgaacactttagaccggtggatcgacgagactccaccagtcgatcagccctcacgttttggcaacaaagcatatagaacgtggtatgccaaattagatgaggaggcagagaacctggttgctactgtagtccccacccatcttgccgcagccgtgccggaagtcgccgtatacctgaaagaaagtgttgggaactctacacgaatcgactacgggacagggcacgaagcagccttcgcggcttttctctgctgcctgtgcaagattggggtgcttcgcgtcgacgatcagatcgcaatagtctttaaagtgttcaatcgttatcttgaggtgatgcggaagcttcagaaaacttataggatggaacctgctggatctcagggcgtgtgggggctggacgattttcagttcttgccattcatttggggctctagccagcttatcgaccacccgtatctcgagccgcggcacttcgtcgacgaaaaagctgtgaatgagaaccacaaagattatatgtttctagaatgcatactgttcattaccgagatgaagaccggcccttttgcagaacacagcaatcagctttggaatataagtgccgtgccctcttggagtaaagttaaccagggactgatcagaatgtataaggccgagtgcctggagaagttcccagtcatccaacatttcaaatttggtagcctgctacctatccaccctgtgacttccggctag

SEQ ID NO: 130785 - DNA, 972 bp, Artificial Sequence
  Description of Artificial Sequence: Synthetic coding sequence
atggccgaaggagaacggcagccacctcccgatagcagtgaggaagccccacccgctacacagaactttatcattccaaaaaaagagattcacactgtccctgacatgggcaaatggaaacgatctcaggcctacgccgactatattggctttattttgacccttaatgagggggttaaaggaaagaagcttacctttgaatacagggtgtctgaggctatcgaaaaacttgtggctctcttgaatacacttgataggtggattgatgagactccacccgtggatcagccctccaggttcggtaataaagcatacagaacatggtatgccaagttagatgaagaagccgaaaacctggtggcaacagttgtgccgactcacttagctgccgctgtgccagaagtcgccgtgtacttaaaagagtccgtcggaaattctacaaggatcgactacggcaccgggcatgaagctgcgtttgcggcttttctgtgctgcttgtgcaagattggggttctgcgggtcgacgatcagatagccatcgttttcaaggtgttcaatagatatctggaggtgatgcgcaagttgcagaaaacctacagaatggaacctgctggctcgcagggggtttggggactggacgacttccagttcctacctttcatctggggttcttcacaattaattgatcatccctacctcgagccgcgccactttgtggatgagaaggcagtaaatgaaaatcataaagattatatgttcctggagtgcatcttattcatcacagagatgaaaacaggaccatttgcggagcactctaaccaactctggaacattagcgccgtcccctcctggtcaaaggtgaatcagggcctgattcggatgtacaaggctgagtgtttggaaaagtttccagttattcaacacttcaagttcgggagcctcttacccatccaccctgtaaccagtggctag

SEQ ID NO: 130786 - DNA, 972 bp, Artificial Sequence
  Description of Artificial Sequence: Synthetic coding sequence
atggctgagggcgaacggcagccgccccccgactcctctgaggaagctcctccagcgacccagaactttattattcccaaaaaggaaattcataccgtgcccgacatgggcaaatggaagcggtctcaagcctacgccgactatataggatttattttgaccctcaacgagggcgtgaagggtaagaaactgacatttgaataccgtgtaagtgaggccatcgaaaaactggtcgctttactgaacactttggataggtggattgacgaaaccccccccgttgaccagcccagcaggtttggtaataaagcttacaggacatggtatgccaaactggatgaggaggccgagaacctggtggcgacagtggtgcctactcacctggccgctgccgttcctgaggtcgctgtttacctcaaggagtccgttggcaattccaccaggatcgactacggaacagggcacgaagctgcctttgccgctttcctgtgctgcctctgcaagattggagttttgcgggttgacgaccaaatcgccatcgtgttcaaggtcttcaacagatatctggaagtgatgagaaaactgcagaagacttacagaatggaaccagctggcagccaaggcgtctggggccttgatgactttcaattccttccttttatttggggctcctcccagttgattgatcacccatacctggaaccacgccatttcgttgatgaaaaagcagtgaatgagaatcacaaggactacatgtttttagagtgtattctttttattacagaaatgaagaccgggccattcgcggaacacagtaatcaactgtggaacatctctgccgttccatcttggtcgaaggtgaaccaaggtcttattcgtatgtacaaagctgaatgtctggagaaattccctgtcattcaacacttcaaattcggctccctgctcccaatccatccagtcacctccggatag

SEQ ID NO: 130787 - DNA, 792 bp, Artificial Sequence
  Description of Artificial Sequence: Synthetic coding sequence
atgggaaaatggaaaagaagccaggcatatgccgactatattgggttcattctcactctaaacgagggcgtgaaaggaaaaaagctgaccttcgaatatcgcgtgtccgaggccattgaaaagctagtcgctctgcttaatacacttgataggtggatcgatgagacgcctccagtcgaccagccaagcaggtttggaaataaggcctatagaacatggtacgctaagctggacgaggaagccgagaacctcgtagccaccgttgtgcctacccaccttgccgctgccgtaccagaggtcgccgtgtatctaaaagagagtgtgggcaacagtacccgcattgactatggaactggccacgaagcggcattcgcagcctttttgtgctgtctttgcaaaattggggttctgagagtggatgatcaaattgcaatcgtgttcaaggtcttcaataggtatctggaggtgatgaggaagctgcagaaaacatatcggatggaacccgctggatcccagggtgtgtgggggctcgacgatttccagttcctgccatttatctggggtagcagccagttgatcgaccacccctacctcgagcctcggcacttcgtagacgagaaagctgttaacgagaaccataaggattacatgttcctagagtgcatcctgttcattactgaaatgaaaacaggaccttttgccgaacacagcaatcagctgtggaacatctcagctgtaccatcttggtctaaagtgaatcagggcctgattagaatgtataaagccgaatag

SEQ ID NO: 130788 - DNA, 1125 bp, Artificial Sequence
  Description of Artificial Sequence: Synthetic coding sequence
atggccgaaggggaacgtcagccgccccctgatagctccgaggaggccccccccgccacccagaactttatcatccctaaaaaagaaattcatacagtccccgacatggggaagtggaaaaggtcccaggcctacgccgattacattggcttcattctgacgttgaacgagggtgtgaaaggtaagaaactgaccttcgaataccgcgtgtccgaaatgtggaatgaagtccacgaggaaaaggagcaagcggctaagcagtcggtatcatgcgacgagtgcatcccactcccccgcgcaggtcactgtgctccttccgaagccattgaaaaattggtggcactcctgaacaccctggaccgatggatagatgagacaccacccgtggatcagccaagccggtttgggaataaagcctatcgaacttggtatgcgaagctggatgaggaggccgaaaatctggttgcgaccgtcgttcccacacatctggcagcagccgtgccggaggtggcggtgtacctaaaggagtcggtgggaaattccacaaggatcgattatggcaccgggcacgaggccgcttttgccgcctttttgtgctgcctgtgtaagatcggggtgctgcgcgtcgacgaccaaattgctatcgttttcaaggtctttaacagatacctagaggtgatgcggaaactgcaaaagacctaccgaatggagcctgcaggctctcagggggtctgggggcttgacgactttcaatttctaccatttatctggggttcctcccagctgatcgaccatccgtatcttgaaccacgacattttgtcgacgaaaaggctgtgaacgagaaccacaaggactatatgtttctcgagtgcattctttttatcaccgaaatgaaaaccgggccgtttgccgagcacagtaatcagttatggaatatttccgccgtgcccagctggtcgaaggtcaatcagggcttaatcaggatgtacaaagcggaggcttccccatctgatacctggggactggggatatcacacctggggcacgggcagtcggaaaagcatcaacccccccagcccaggaaggctgctgtgcagctttgtcctgacgagctgggtggctag

SEQ ID NO: 130789 - DNA, 456 bp, Artificial Sequence
  Description of Artificial Sequence: Synthetic coding sequence
atgaagaccggcccatttgccgaacacagcaaccaattgtggaatatctcagccgtcccctcctggagcaaagtgaaccaggggttaatcagaatgtataaagctgaagtgagcggcggctggcccgtatgcccttctctactgccccacctggtgctgggttgggggcagtcgaaaagatgtggcacttggggctcctgctttttgctccctcactgctttgccttaaatcttcgacccgctcctctaaccctgggcgcatcagaatcgcccatttggggcatgggtagccaacgaagcactagccacccctcccctgaaaagttacagagctcaagcgtactgatgtcactggaggctgaagccaggacctgctgtatgggtagtgggggggacggagggctcccttctcctcttagctctggtcagagactcctgaaggcacgagcagtctag

SEQ ID NO: 130790 - DNA, 2802 bp, Artificial Sequence
  Description of Artificial Sequence: Synthetic coding sequence
atggctgatctgtctctgctccaggaggacttacaggaagacgctgacggctcactcgactttgtctcacaggatgaaatgctcacccccctcgggagactggataaatacgctgcgtccgagaatattttcaatagacagatggtagcccgatccctgttggatacacttagagaggtgtgcgacgatgagagagactgcattgccgtactcgaacgcatttctagattagctgacgattccgaacctacagtgagggctgagctgatggaacaagtgccacacatcgctttattttgccaggaaaatagaccaagtatcccctatgccttcagcaaatttcttctcccgatcgtggttagatatctggccgatcagaacaatcaggtgagaaagacaagtcaggcagcattgttggccttgctggaacaggagctaattgaacgattcgacgtggagaccaaggtgtgccctgtgctcatcgagctaacagctccagatagtaacgacgacgtgaagacagaagcagtggccataatgtgcaagatggcccctatggtgggcaaagatataactgagagactaattcttccccgcttctgtgaaatgtgttgtgattgccgcatgttccacgtgaggaaggtttgcgccgctaactttggagacatctgttctgtcgtcgggcagcaggccaccgaggaaatgctgctgccgcgcttttttcagctgtgttccgataatgtatggggagttaggaaggcgtgtgctgagtgcttcatggctgtctcctgcgccacatgccaggagataagaaggaccaagctcagtgccctatttatcaacctgatatcggatcctagtcggtgggtgcgtcaagccgcctttcaaagtctgggcccatttattagtacttttgccaacccctcttcctctgggcaatacttcaaggaagagagtaaaagttcggaagagatgtccgttgagaataaaaatcgcacgcgggatcaagaagctcccgaagacgtgcaggtacggccagaagatactcctagcgatctctcagtgtctaattcctccgtgattctcgaaaataccatggaagatcacgctgctgaagcatctggaaaaccgctcggcgagatctctgtgcccttggatagcagcttgctgtgcactctgagcagtgagagccatcaagaggccgcttccaacgagaatgacaaaaaacccgggaactataaatctatgttaaggcccgaggtgggtacaactagccaggactctgcgctactggaccaggagctgtacaattcctttcacttctggcgaacacctttgcccgaaatcgatctggatatcgaactagaacagaattccggagggaaaccgtcgcctgaagggcccgaggaagagtcggagggtcccgtgccatcaagccccaatattactatggctacgcgcaaagagctagaggagatgatcgagaacctggagccccacatcgatgaccctgacgtaaaagcgcaggtggaagtcctgtcagctgctctcagagcctcgtctcttgacgctcatgaagaaacaattagcatcgagaaacgcagtgatctccaagacgagctcgatatcaacgagctcccaaactgtaagatcaatcaggaggatagcgtcccactgattagcgatgctgtcgagaacatggactccactctgcactacatacatagcgactccgacttgtccaacaattccagcttttctcccgatgaagagaggcggaccaaggtgcaggacgtagttccgcaggccctgctggatcagtacttatcaatgaccgatccatctcgtgcacagaccgtcgataccgagatcgccaagcactgtgcttattcgctccccggcgtggctctgacgctcgggcgtcagaattggcactgcttgagagagacctacgagacactggcttcagatatgcagtggaaggtcagacgtactctggccttttcaatacacgagttggctgtgatcctcggtgaccagttgactgccgccgacttagtccctatttttaatggctttctgaaagacctcgatgaagttcggattggagtgctgaaacacctgcacgatttccttaagctattgcacattgataaacggcgtgaatatctgtatcagctgcaggagtttttggtcaccgataattcccgcaactggaggttcagggccgaactggccgaacagcttattctcctgcttgagctgtactctcctcgcgatgtttacgattacctacggcccattgccctcaacttatgcgccgataaggtgagcagtgtgagatggatcagttacaaactggtttccgagatggtcaagaagctgcacgcggcgaccccacccacatttggtgtggacctcatcaacgagttggtggagaacttcggacgctgccccaaatggagcggcagacaagccttcgtgtttgtttgtcaaacggtcatcgaagacgattgcctccctatggaccagttcgcggtgcatctcatgccacacttactcacgctggccaacgaccgtgtgcccaacgtccgggtcctgctggctaagacccttcgtcagactttgctagaaaaggattactttctggcctctgcgtcctgtcatcaggaagccgtagagcagaccataatggctttacagatggatagagactcagacgtcaaatatttcgcatccatacatcctgcaagtacaaaaatcagcgaagatgccatgagcacagcgagctcgacctactag

SEQ ID NO: 130791 - DNA, 924 bp, Artificial Sequence
  Description of Artificial Sequence: Synthetic coding sequence
atggccgagatctctgacctcgatcggcaaattgagcaactaagacgatgtgagctcattaaggaaagtgaggttaaggccctgtgtgccaaagcccgcgagatcctggtggaagaatcaaacgtgcagagggttgacagccccgttacggtctgcggggacatccatggacagttctatgatttgaaggaattgtttcgcgtgggtggagacgtccccgaaaccaactatctcttcatgggggacttcgtcgaccgaggattttacagcgtcgagacattcctactgctgcttgccctgaaggtgaggtaccctgataggatcactttgatcagggggaaccacgagagccgacagatcacccaggtttacggcttttatgacgagtgcctacgcaaatacggaagcgtgacggtctggcgatactgcacagaaatattcgactacctctctctctctgccattattgatgggaagattttttgtgtgcatggcggcctgtcgccttccatacaaactctggaccagatccggacaatcgaccgcaaacaggaggtgccccacgatggccctatgtgcgatctcctgtggtcggatccagaggatacaactggatggggagtaagtccaagaggcgctggctacctgttcgggtcggacgtggtggcccagttcaatgctgccaatgacatcgatatgatttgcagggcgcaccagctggtgatggagggttacaaatggcacttcaatgagactgtgttgacagtgtggagcgctccaaactactgttacagatgcggcaacgtcgctgcaatcctggagttggacgagcatctgcaaaaggattttatcattttcgaagccgctccccaggaaactagaggcattccctccaaaaagcccgtggccgactatttcctctag

SEQ ID NO: 130792 - DNA, 1413 bp, Artificial Sequence
  Description of Artificial Sequence: Synthetic coding sequence
atgcttcaggtcaggacatacctaacagagccaacagtccgcgccgagctcatggaacaggtccctcacattgcgctgttttgccaggagaatcggccctccataccatacgccttcagcaaatttctgctgcctattgtggtgagatatctggcagaccagaataatcaggtgcgcaagacctctcaggccgccctgctcgccttgctggagcaggagctgattgaacgctttgacgtagagacaaaagtgtgtccggtgctgattgaattaacagcccccgatagtaacgatgacgtcaagactgaggcggtggccatcatgtgtaagatggcgccaatggtgggaaaagacatcactgaaagactgatcctgccacggttttgtgagatgtgttgcgactgccgaatgttccatgtgagaaaagtgtgcgctgcaaacttcggtgacatttgctccgttgtcggccagcaagcgacagaggaaatgctcctgccaaggttctttcagctttgctcagacaatgtttggggagttagaaaagcgtgcgcagaatgtttcatggccgtgagttgtgccacatgtcaggaaattcgtcgtaccaaactgagcgccctatttatcaacttgatcagtgacccttctaggtgggtacgccaggctgcgtttcagtcccttggtccgttcatctccacattcgcaaacccgtcttcctccgggcagtacttcaaggaagagtctaagtccagcgaagaaatgtcggtggagaataagaatcgtacacgggatcaggaggcgcctgaggacgtgcaggtccgtccagaagatacccctagcgacctttctgtgagcaattcaagcgttattcttgagaacacaatggaggaccacgcggctgaagcatccggcaaaccgcttggggaaattagcgtgcccctggactctagcctgctttgtacattgagctcggagtcacatcaggaagcagcgtcaaatgaaaatgacaagaaaccaggaaattacaaaagcatgctgcgccccgaggtaggaacgacgtctcaggatagcgccctcctggatcaagaactgtataattcattccatttctggaggaccccacttcctgagatagatcttgatattgaactggagcagaacagcggaggaaaacctagcccagagggaccagaagaagaaagcgaaggcccagttccttccagccctaacatcaccatggcaactcgcaaggagctcgaggagatgattgaaaacctggaaccacacatcgacgatcctgatgtgaaggcccaggtggaggtcctttcagctgctttgagagcctcctctctcgacgcccatgaagagaccatctctattaagcgtgaggttatctgcaagatgaattggatttag

SEQ ID NO: 130793 - DNA, 2853 bp, Artificial Sequence
  Description of Artificial Sequence: Synthetic coding sequence
atggctgatttaagcctgttgcaagaagacctgcaggaagacgcagacggctttggagtagacgactactcctccgaatccgatgtgatcatcatccccagcgcgctggacttcgtgtctcaagatgagatgttgacacccttggggcgcctagacaaatatgcggcctccgaaaacatttttaatagacaaatggtggcacggtctctcctggacacactgcgcgaggtatgcgacgacgagcgcgattgcatcgccgttctagagaggatttctaggctggcagatgattccgaacctacagttagagcagaactgatggaacaggtcccccacatcgccctgttctgccaagagaatcgtccatctatcccctacgcgttcagcaaattcctcctccctatcgtcgtgagatacctggctgaccagaataaccaggtccggaagactagtcaagctgctctcctggccctgctggagcaggagctgatcgagagattcgacgtggaaacgaaggtctgtcctgtcttaattgaactcacagcaccagacagcaacgatgatgttaagacagaagccgtagcgatcatgtgcaaaatggcaccaatggtcgggaaggacatcaccgagcggctaattctccctaggttctgtgagatgtgctgcgactgtagaatgttccacgtacggaaggtttgcgcagctaatttcggggatatttgttcggtcgtcggccaacaggctacagaagaaatgcttttgccacgttttttccagttgtgttcggataacgtatggggagtacgcaaagcttgtgctgaatgcttcatggcggtatcttgtgctacatgtcaggagataaggcgcactaagctgtctgctttgtttatcaatctgataagcgaccctagcagatgggtccggcaggccgcttttcagtctctgggcccgtttatctctacgttcgcaaatccatcttcatcgggtcagtacttcaaggaggagtcgaagagctcagaagaaatgtcagttgagaataagaaccgcactcgagatcaagaggccccggaagatgttcaggtgcggcccgaagacactccttctgatctatctgttagtaactcctccgtcattctggagaatactatggaggatcacgccgccgaggcatccggcaagccgttgggcgaaattagcgtcccactcgactctagtctgctttgcaccttgagctctgaatcacatcaagaggccgcaagcaatgaaaacgataagaagccggggaattacaaaagcatgctcagaccagaagttgggactacttcacaggattctgctctgcttgatcaggaattatataactccttccacttctggaggacccctctccccgaaatcgacctagacatcgagctcgaacaaaactcaggcggaaaaccatcaccggaaggccctgaagaagaatcggaaggccctgtgcctagcagccctaacataacaatggccacgcgcaaagagttggaggagatgatagagaatctggaaccacatatagacgatccagatgtaaaagcacaggtggaagtccttagcgccgctctcagggctagttcactggacgcacacgaggaaacaatttccatcgaaaaacgcagcgatctgcaggacgaacttgatattaacgaactcccgaactgcaagattaaccaggaagatagtgtgcctctgatatccgacgccgtagaaaatatggattcaacgttacactacatccacagtgattctgatctgagtaataactccagcttcagcccagacgaggaacggcggactaaggtccaggacgtagtgccacaagcgctactggaccagtatctgtccatgaccgacccttccagagcacaaacagttgatactgagattgcaaagcattgcgcatattccctgcctggagtggctctgactctgggacgtcagaattggcactgcctcagggaaacttacgaaaccctggccagtgacatgcaatggaaagtgcgccgcacacttgcgttcagtatccatgaattggcagtgatcttgggcgaccagctcacagctgcggacctcgtacctatctttaacgggttcttaaaagacctggacgaggtgcgcattggggtgttaaagcatctccatgactttctgaagctgctccacattgataagcggcgggagtatctataccaactgcaggaatttctggtcaccgacaatagccggaattggaggttcagggcagagctggccgagcaactgatcctgttactggagctatacagtcccagagacgtatacgattatcttaggcctatcgcactaaacttgtgcgccgataaggtgtcctccgtgagatggatcagctacaagctggtttctgagatggtgaaaaagctgcacgcggcgacccctccaacttttggggtagatctaataaacgagctcgttgagaactttggccgctgccctaagtggtcggggaggcaggctttcgtcttcgtctgccagacagttattgaggacgactgtctcccgatggaccagtttgctgtacacctcatgccacatctccttacattggccaatgaccgagtgcccaacgttagagtgttgctggccaaaactctgaggcaaactctgctcgagaaggattatttcctggcaagcgccagctgtcaccaagaggccgttgaacagactatcatggcgcttcagatggatagagatagtgacgtgaaatactttgctagcatacatcccgccagtacgaagatctcagaggacgccatgagcacagcctcgtctacgtactag

SEQ ID NO: 130794 - DNA, 1086 bp, Artificial Sequence
  Description of Artificial Sequence: Synthetic coding sequence
atggatgattttaggacttccgcacctgaaccaaggggccctcctaatccaaatgtcgaatatattccattcgatgagatgaaagagaggatcctgaagatagtgacagggtttaatggaataccctttactatccagcgcttatgtgagttgctcaccgatcctcgtcgaaattatacggggacggacaaattcctgcgaggggtggagaaaaatgtgatggttgtaagttgtgtgtatcccagttccgagaaaaacaatagtaactccctgaaccggatgaacggagtcatgttccccggtaatagcccatcttacaccgaaaggagtaatattaatgggcctggaaccccaagacccctgaataggcctaaagtcagtctttccgcaccaatgaccactaacgggctacctgagtctaccgacagcaaggaagcaaatcttcagcaaaatgaggagaagaatcacagcgacagttccaccagcgaatctgaagtgtctagcgtgagtcctctgaagaataaacaccccgacgaagatgctgtcgaagccgagggacatgaggtaaagcggctccgctttgacaaggagggggaggtgcgggaaacagccagccagacaaccagctcagagattagtagcgtgatggtgggggagacagaggcttcttcctcctcccaggacaaagacaaagactccagatgtacccgccaacattgcactgaggaggacgaggaggaggatgaagaagaggaagaggaatcatttatgacctctcgggagatgatccctgagagaaagaaccaggagaaagagtccgatgatgccctgacggtcaacgaagaaacatcagaagaaaataaccagatggaagagagcgatgtgagccaggccgagaaggatctgctgcatagcgaaggctcggagaatgaggggcctgtttcctcatcgtcttcagactgcagggagaccgaggagctggtgggctcgaattcttccaaaacaggtgagatcctgagcgagtcatccatggaaaacgatgatgaggccactgaagtgactgatgaaccaatggagcaggattag

SEQ ID NO: 130795 - DNA, 1254 bp, Artificial Sequence
  Description of Artificial Sequence: Synthetic coding sequence
atggatgtagaaagactgcaggaggccctcaaagatttcgagaaaaggggaaaaaaggaagtatgtccagttctggaccagttcttgtgtcatgttgccaagaccggggaaacaatgatccagtggtctcaattcaagggctattttatcttcaaactggaaaaagtgatggatgatttcagaaccagcgctcccgagccgcggggaccacccaatcctaacgtagagtacattcccttcgacgaaatgaaggaaaggatccttaaaatcgtaacaggattcaacggaatacctttcacaatccagcgcctgtgcgagttattaaccgacccacggcggaactataccgggacagacaagtttctcaggggagttgagaagaatgtaatggtagtgtcctgcgtgtacccctcaagtgagaaaaataacagcaactccctgaacaggatgaacggcgtgatgttcccaggaaattctcccagctatacggaaaggagtaatatcaacggacccggtactcctcggcccctgaataggccaaaggtctccctgagtgccccaatgacaaccaacggactgcctgaaagcaccgatagcaaggaggccaatctgcaacagaacgaggagaaaaaccattctgattcttccacctctgaaagcgaagtctcctccgtatcgccgttgaaaaataagcacccagatgaggacgccgtggaggctgaaggacacgaggtgaaaagactgaggtttgacaaagagggcgaggtgagagagactgccagccagactacatcttccgaaattagctctgtgatggtaggcgaaacggaggcttctagttcatcccaggataaggataaggattcgcggtgcacaaggcagcactgcaccgaagaggacgaagaggaagacgaagaagaagaggaagagagctttatgacctcgcgggaaatgataccggagaggaagaaccaggagaaggaaagcgatgacgctttgactgtgaatgaagagacctccgaagagaataatcagatggaggaatccgacgttagccaagccgagaaggatcttcttcacagtgaaggatctgagaatgagggccctgtttctagcagctcatccgattgtcgggagacagaggagctcgtggggtcgaactctagcaagactggcgagatcctcagcgagtcaagcatggagaatgatgatgaggctacagaagtcactgacgaacccatggagcaagactag

SEQ ID NO: 130796 - DNA, 1083 bp, Artificial Sequence
  Description of Artificial Sequence: Synthetic coding sequence
atggacgtcgaaaggctacaggaagcactgaaggattttgagaagaggggtaaaaaagaagtttgccccgtcctcgatcagtttctgtgccacgtggctaagacaggcgaaactataatccctttcacaatccaacggctctgtgagttattgaccgacccccgcagaaattacacagggactgataagttcctgaggggagtcgagaagaatgtgatggtggtgtcatgcgtttacccatcctccgaaaagaataattctaatagcctgaaccgtatgaacggcgtcatgttccccggaaactcaccctcgtacacagaaaggtcgaacattaacggacccggaactcctagaccactaaacagacccaaagttagcttatccgcgccaatgacgacaaacggccttcccgagagtacagatagcaaggaagcaaacctccaacagaatgaagagaaaaaccacagtgacagctctaccagtgaaagtgaagtgagctctgtgtcaccgttaaaaaataaacacccagatgaagacgccgtggaggctgagggccacgaggtgaagcgcctgagatttgataaggagggtgaagtcagggagacggcctcccaaacaacttcctcggaaatctcgagcgtcatggtgggagagacagaggcatccagttcaagtcaagataaggataaagactctcggtgcactagacagcattgcactgaggaagacgaagaggaagacgaggaggaagaggaggaaagctttatgacttccagagaaatgattcctgagagaaagaatcaggaaaaggaatccgatgacgcactcactgtgaatgaggaaacctctgaggaaaacaaccagatggaggagtcagacgtgagccaggccgagaaggacctgctgcacagcgaaggctcagagaacgaaggccctgtgtcttcatctagttccgactgtcgtgaaacagaggagttggtgggaagcaacagctccaagacaggagagatcctgagcgaaagctcaatggaaaacgacgacgaagctacagaggtgacagacgagccgatggagcaggattag

SEQ ID NO: 130797 - DNA, 1116 bp, Artificial Sequence
  Description of Artificial Sequence: Synthetic coding sequence
atggcgttgggtaagtttagggccgctttgagggattacgaaactgtagtgaaagtgaagccacatgacaaggacgctaaaatgaagtatcaagaatgcaacaaaatcgtcaaacagaaagcgttcgagcgagctatcgctggggacgaacataagaggtccgtcgtcgacagtctcgatatcgaaagcatgaccatcgaggatgagtattcaggcccaaaacttgaggacggaaaggttaccatttccttcatgaaggaactgatgcaatggtacaaggatcaaaaaaaacttcatcgcaagtgcgcatatcagaccgaaaaaatcactgtatgtggcgacacacacggccagttctatgacctgttgaacatattcgaactgaacgggctgccgagcgaaactaatccctacatcttcaatggcgatttcgtcgacagaggatccttcagtgtggaggtaattctcacactgtttgggtttaagctcttgtatcctgatcacttccacctgttaaggggtaatcacgaaaccgacaatatgaatcagatctatggatttgaaggtgaggtcaaggccaagtatacagctcagatgtacgaactttttagcgaagtgtttgaatggctcccactggctcagtgcatcaatggaaaagtgctcatcatgcatggagggctgttttccgaagacggggtcactctggacgacattcggaagatagaaagaaatcgacagccccccgacagcggcccaatgtgcgatctactatggtccgatcctcagcctcaaaatggccggtccataagcaaaaggggagtgtcttgtcagttcgggcctgatgttaccaaggcattcctggaggagaataacctcgactatatcatacgaagccatgaggtcaaggccgagggttatgaggtggcgcatgggggccgctgtgtcacagttttcagcgccccgaactactgcgatcaaatgggaaataaggctagctatatccacctccaagggtctgatctgaggccccagttccatcagtttacagcagtaccacaccccaacgttaaaccaatggcctatgcgaataccctcctgcaactgggcatgatgtag

SEQ ID NO: 130798 - DNA, 1500 bp, Artificial Sequence
  Description of Artificial Sequence: Synthetic coding sequence
atggcaatggctgagggggagcgcaccgaatgcgctgagcccccacgggatgaacctcccgctgacggcgcattgaaaagggccgaagagttgaagacccaggcaaatgactactttaaggctaaagactacgagaatgccatcaaattctactcgcaggcgattgaattgaatccttccaacgcaatatactatgggaatagatcacttgcttacctaagaaccgagtgctacggttatgccttgggcgacgctaccagggcaatagagctggacaaaaaatacataaaaggatactacagacgtgccgcttcaaatatggctctcggcaaattccgcgccgcgcttagggactacgagacagtagttaaagtgaagccgcacgataaagacgctaaaatgaaatatcaagaatgcaataagatcgttaagcagaaagcattcgagagagcgattgctggagacgagcacaaacggtctgtggtggacagcttggacattgagagcatgacaatcgaggatgagtattcagggccaaagttagaagatggaaaagtcactatcagcttcatgaaagagttaatgcagtggtacaaggaccagaagaaattgcacaggaaatgtgcctatcagattctcgtacaggtgaaggaagtattgagcaaactgtcaactctggtggagaccaccctgaaggagactgaaaagattacggtctgcggtgatacccacggccagttctatgatcttctgaatatcttcgagctcaacgggttaccctcagagactaatccttacatctttaacggcgattttgtagatcgggggagcttttcagttgaggtgatcttgaccctgtttggattcaaacttttatatcctgaccactttcacctactccggggcaatcatgaaactgacaatatgaatcaaatctatgggtttgaaggtgaagtgaaggccaagtacactgcccagatgtatgagctgttttcagaagtatttgaatggctgcccctggctcagtgtatcaacgggaaggttctgatcatgcatggaggattattctcagaggatggtgtaaccctggacgatattcgtaagatcgaaaggaatcgtcaaccgcctgattccgggccaatgtgcgacctattgtggagcgacccacagccgcagaacggacggtctatcagtaaaaggggtgtgagttgtcagttcgggcccgacgtgaccaaggccttcctagaggagaacaatctggactatattataaggagccatgaggtcaaggcagagggctatgaggtagctcacggtggccggtgcgtgacagtgtttagcgcaccgaattattgtgatcagatggggaataaggcttcctacatccatttgcaaggcagcgaccttagacctcaatttcaccagttcaccgctgtccctcaccccaacgtgaagcctatggcttatgctaatacactgctgcagctagggatgatgtag

SEQ ID NO: 130799 - DNA, 1461 bp, Artificial Sequence
  Description of Artificial Sequence: Synthetic coding sequence
atggcgatggcagaaggagagagaaccgagtgcgctgaaccgccacgggacgaaccccctgccgatggggctctgaagcgggcagaggagcttaagacgcaggcgaacgactacttcaaggctaaagattatgagaacgcaattaaattttatagccaggccattgagctgaatccctctaacgcaatctactacggatacgctctcggcgacgcgacacgtgccatcgaactggataaaaagtacattaagggctattatagaagagctgcgtcgaacatggctcttggaaagttcagggcggcactccgtgactatgaaaccgtggtgaaggtgaagccccacgacaaagatgcaaaaatgaaatatcaagagtgcaacaagatcgtgaagcagaaagctttcgaaagagctattgcaggtgacgaacacaaaaggagcgttgtggactcccttgacatcgaatcgatgacaatcgaggatgaatattccggacctaagctggaggacggtaaagttacgatttcgttcatgaaagaacttatgcagtggtacaaggaccagaagaagctccaccgcaagtgcgcctaccagatcttggttcaggttaaagaggtgctctctaagctttcaactctggtcgaaactacacttaaagagacagaaaaaatcactgtgtgcggggacacacacgggcagttctacgatctgcttaatatctttgagctcaacggcttaccttctgaaacaaacccatacatcttcaatggggactttgtagaccggggttccttttccgtggaagttattctgactctcttcggatttaagcttctctacccagatcatttccaccttctcagaggcaatcatgaaaccgataatatgaaccagatctatggttttgagggtgaggttaaggcgaagtataccgctcagatgtatgagctcttttccgaagtttttgaatggctacccctagcacagtgtatcaatggaaaagttctgattatgcatggaggcctcttcagcgaggatggagttactctggacgacatccggaaaattgaaagaaaccgtcagccccctgattcgggaccaatgtgcgatctgctgtggtcggaccctcagccgcagaatggtaggagcatttctaaacgtggcgtgagctgccagtttgggcccgacgtgacaaaggcatttttagaggagaacaacctggactacataattcgcagccacgaggtgaaagccgagggttacgaggtggctcacggcggccgatgtgtgaccgtgttctcggccccaaattattgtgatcagatggggaataaggcaagttacatacatcttcaaggctcggatcttagacctcagtttcatcagtttacagctgtcccacatcctaacgtgaaacccatggcttacgccaacaccctgcttcagttgggcatgatgtag

SEQ ID NO: 130800 - DNA, 1458 bp, Artificial Sequence
  Description of Artificial Sequence: Synthetic coding sequence
tgaatggcagagggagagcgcacagagtgtgccgagcccccgagagacgagccaccagccgacggagctcttaaacgcgccgaggaactgaagacccaggcaaatgactattttaaagccaaagactacgaaaacgccataaagttttattcgcaggccatcgaattgaatccatccaacgctatttactacgggaatcggtccctggcatacctgcgtactgagtgctacgggtatgcgcttggagacgctaccagagccattgagctggacaagaaatatattaaagggtattaccgacgggctgcttcaaacatggctctgggaaaatttcgggccgccttgagagactacgaaactgtagtgaaagtgaagccacacgacaaagacgcaaaaatgaaatatcaggagtgtaataaaatcgtgaagcaaaaggcgtttgagcgtgctatagctggcgatgagcataaaagaagtgtggttgatagcctggatatcgagtccatgactatcgaggacgaatacagcgggccgaagcttgaagatggcaaggtgaccatcagcttcatgaaggagctgatgcaatggtataaggatcagaagaagttgcaccgcaaatgtgcctaccaaatcctggttcaagtaaaggaggttttgtccaaactgagtacccttgtcgaaacaactctgaaggaaacggagaagatcacagtatgtggagatactcacgggcagttctacgacctgctgaacatctttgaacttaatggtctgccatcagagacgaacccttatatcttcaacggggactttgtagaccgtggctcttttagcgtcgaggtcattctcactttgtttggcttcaaattgctgtatcccgatcacttccatttgctgaggggtaaccacgagaccgacaatatgaaccaaatctacggcttcgagggagaagtgaaggccaagtataccgcccagatgtatgaactcttttcagaggttttcgagtggctccctctcgcgcagtgtattaatgggaaagtgctgattatgcacggggggctgtttagcgaagacggcgtgacattggatgatattcgcaagatagaacgcaatcgccagcccccagattccgggcccatgtgcgacctgctctggagtgatcctcaacctcaaaatggccggtccatctctaaaaggggggtctcctgtcagtttggcccagacgtgaccaaagcattcctggaagaaaataacctcgactatatcattaggtctcacgaggtaaaagcggaaggttacgaagtggcccacgggggtcgctgcgtgactgtcttttctgctccaaactattgcgatcagatggggaacaaggcatcttacatccatctgcagggatcagacctgagaccacaattccatcaattcacagcagttgggcggcctagctccggttcttag

SEQ ID NO: 130801 - DNA, 477 bp, Artificial Sequence
  Description of Artificial Sequence: Synthetic coding sequence
atgcttacagtcgcagcactgattgatgagcagatactttgcgtgcacggaggtttgtcacctgacattaaaacgctcgaccagattaggaccatcgaaaggaatcaggagataccccataaaggagctttttgcgacttagtgtggtctgacccggaggacgtggacacttgggctatttcaccaagaggtgctggatggctgttcggtgctaaggtcacaaacgaatttgtgcacatcaataatcttaagctaatctgccgtgcccaccagctagtgcatgaggggtacaaattcatgtttgatgaaaagctcgttaccgtgtggtctgcccctaattactgctacaggtgtggaaacattgcttctattatggtgttcaaggatgtgaacacaagagagcctaagctctttagggccgtccctgattcggaacgcgtcataccaccgcgaaccactactccttattttttgtag

SEQ ID NO: 130802 - DNA, 918 bp, Artificial Sequence
  Description of Artificial Sequence: Synthetic coding sequence
atggctcctctcgacttagataagtacgtggaaatcgctcggctgtgcaaataccttcccgagaacgacttgaagcgcctttgcgactacgtgtgcgacctgctcttggaagagagcaacgtacagcctgtgtccacacctgtcactgtgtgcggtgatatccatggccagttctacgacctgtgcgaactgttccgcaccggcggtcaggtacccgacaccaattatatatttatgggcgacttcgtcgacagaggatactactctcttgaaacatttacctacctgttggcactgaaagccaaatggcccgaccgcatcacactgcttaggggtaaccacgagtctagacagatcacacaagtctacggcttttatgatgagtgtcagacaaagtatgggaatgccaacgcctggaggtattgtacaaaggtattcgatatgctgactgtggctgctctgattgatgaacaaatattgtgtgtccatgggggactgagccctgatatcaagacactggatcagatacggaccatagagaggaaccaggagatcccccacaagggtgcattctgtgaccttgtgtggtctgaccccgaggatgtggacacctgggcgattagcccgagaggggcagggtggcttttcggcgcgaaggtgactaatgagttcgtgcatatcaataacctgaaattgatatgtagagctcaccagttggtgcatgaaggctacaaattcatgttcgatgagaagctggtgaccgtttggtctgctcctaactattgctaccgatgtggtaatatcgctagcattatggtattcaaagatgtgaataccagagaacccaagctgtttcgcgcagtacctgactcggagagagtgatccctccacgaaccaccacaccctattttctgtag

SEQ ID NO: 130803 - DNA, 852 bp, Artificial Sequence
  Description of Artificial Sequence: Synthetic coding sequence
atggcacctctcgacctagataagtacgtggagattgcccggctctgcaagtaccttccggagaatgacctcaaacggctttgcgattatgtgtgcgatttactgttggaggaaagcaacgtgcagccagtgagcacccccgtgacggtatgcggagatatccacgggcagggcgattttgttgaccgtggctactactcactggagacctttacctacctcctcgctttaaaagccaaatggcccgacaggatcaccctactgcgggggaaccacgagtctcgccagattactcaggtctatggattttacgatgagtgtcagaccaagtatggaaatgcaaacgcctggagatattgcaccaaggtgttcgacatgttaactgtggcagccttaatagatgagcagattctgtgcgtgcacggtggattatcacctgacatcaagactctcgaccagattaggacaatcgagagaaatcaggagattccgcacaagggcgctttctgtgacctggtgtggtcagatccggaagatgtggacacctgggcaatatctccccgaggcgcaggctggctgttcggcgctaaggttacaaatgaattcgtacatatcaataatctcaagctgatttgcagagctcatcagctggtgcacgaaggctataaattcatgtttgatgagaagcttgtgactgtgtggagtgctcctaactactgttaccgctgtgggaacatcgcctccatcatggtctttaaggatgttaatacaagagagcctaagctgttccgggccgtccccgattctgaaagggtaatcccccccaggacaactaccccctacttcttgtag

SEQ ID NO: 130804 - DNA, 1029 bp, Artificial Sequence
  Description of Artificial Sequence: Synthetic coding sequence
atggcccctctagacctcgacaaatacgtggaaatagcgcgactctgtaagtacctgcctgaaaatgacctgaaggtctcccctatttgcgggctcgctcccagcggctgcggagcgcctgccggccggcccttcctgtcaccaggcccaccacccgtgttccattttctccgatttttgaaggagagactctgtgactacgtctgtgacctgctcttagaggagtccaacgtgcaaccagttagcacacctgtgaccgtgtgcggggacatccatgggcagttttacgacctgtgcgagctgtttcgcacaggaggacaagtcccagacacgaattatatcttcatgggagacttcgtggatcgggggtattacagtctcgaaaccttcacttatttattggcactcaaggccaagtggcctgaccgcattactctgttgagagggaaccatgaatcgcgccagattactcaagtgtatggcttctacgatgaatgccagacaaagtatggtaatgctaatgcttggcggtattgtacaaaggttttcgacatgctgaccgtggccgctttgatagatgagcagatcttgtgtgtgcatgggggcttatccccggacataaaaactctcgatcagattagaactatagaaagaaatcaggaaattccacacaagggcgctttttgcgacctggtttggagtgacccagaagatgtggacacttgggccatatctccacggggcgccggatggctatttggagctaaagtcacgaacgaattcgtgcatatcaacaaccttaaactgatctgtcgggctcatcagctggttcacgaggggtacaagtttatgttcgacgagaaacttgtcactgtctggtcggcccccaactactgctatcgctgtgggaacatcgcatctataatggtctttaaagacgtgaacaccagagaacccaagctattcagggccgtaccagattcagaacgcgtcatcccccctcgcactactactccatactttctgtag

SEQ ID NO: 130805 - DNA, 378 bp, Artificial Sequence
  Description of Artificial Sequence: Synthetic coding sequence
atgtttcttctgcctaggctccaactgcttggtcaaatgcggctctgtgattatgtatgtgacttgttgctagaggaatccaacgtgcagccagtgtctactccggtaactgtgtgtggcgacattcatggccaattctacgacctttgtgagctgtttaggactgggggccaggtgccagacaccaattacatctttatgggagattttgtggatagaggttattattccctggagaccttcacttatctcctggctcttaaggcaaagtggcctgatagaatcacgctgcttcgcggaaatcacgaatctcggcagatcacccaagtgtatggtttttacgatgaatgtcagactaagtatgggaatgccaactag

SEQ ID NO: 130806 - DNA, 1161 bp, Artificial Sequence
  Description of Artificial Sequence: Synthetic coding sequence
atgagcgccctggagaagtccatgcacttgggccgcctaccatccaggccaccattaccgggatctggcgggagtcagagcggtgccaagatgcgaatggggccagggcggaaacgcgacttcagccctgtgccttggagtcagtactttgaaagcatggaagacgtggaggtggagaacgagaccgggaaagataccttcagagtttacaagtccgggtctgaagggcctgtacttcttctgctgcacggagggggccactcagctctgtcttgggcagtctttacagctgctatcatctctcgggtccagtgccgcatcgtcgccctagacctgaggagccacggggagaccaaggtgaaaaaccctgaagatctgtcagccgagacaatggcgaaagatgtcgggaatgtggtggaagcgatgtacggtgacctgccccccccaatcatgctcatcggccattccatgggcggcgctattgctgtacacactgcctccagcaatctcgtgccctctttgctagggctgtgcatgatagatgtggtagaaggtaccgcgatggacgccttaaattcaatgcagaatttcctccggggacggcccaagacctttaagtcattggaaaatgccattgagtggtctgttaaatcaggccagattcggaacctggagagtgcaagggttagcatggtgggtcaggtaaagcagtgtgagggaataacatctcccgagggatccaagagcatagtcgagggtataatcgaagaggaggaagaagacgaagaaggaagtgagtcaatcagcaaaagaaaaaaggaggatgatatggagacaaaaaaggatcacccgtatacttggagaatcgaactagctaagaccgagaaatactgggacgggtggtttagaggtctgtctaacttattcttgtcgtgtcctataccgaagctgcttctcctggctggagtggaccgcttggacaaggaccttaccattggacagatgcaggggaagttccagatgcaggtgttacctcagtgcgggcatgcggtgcatgaggatgctcccgataaggtcgccgaggcagtggccacatttctcattagacaccgctttgcagaaccgattggtggcttccagtgtgtttttcccggctgctag

SEQ ID NO: 130807 - DNA, 600 bp, Artificial Sequence
  Description of Artificial Sequence: Synthetic coding sequence
atggatgctcttaattctatgcagaattttctgcgcggcagaccaaagacgtttaagtctctagaaaacgccatcgagtggagtgttaagtccgggcagatccgtaacctcgagtcagcaagggtttcaatggtggggcaggtaaaacaatgtgagggtattacttcacctgaagggagcaaatctatcgtggagggaatcattgaagaagaagaagaagatgaggaggggtccgagtctatttccaaacgcaagaaagaggacgacatggaaaccaagaaagaccatccatacacctggcgaattgaattggcaaagaccgaaaagtactgggatggatggttccggggcctgagcaacctatttctgagctgtccaatccccaaactactgctcctggccggcgtcgacagattggacaaggaccttacaattggtcaaatgcagggcaagttccagatgcaagtgctgcctcagtgcggacacgccgtgcatgaggatgcaccagacaaggtggccgaagccgtagccacctttctgattaggcacagattcgccgaacccatcggcggcttccagtgtgtttttcctggctgctag

SEQ ID NO: 130808 - DNA, 1203 bp, Artificial Sequence
  Description of Artificial Sequence: Synthetic coding sequence
atgtctgcgctagaaaagtcaatgcacctgggacgtcttccttcccgcccccccctccctggtagcggaggctcccagagcggcgcaaaaatgcgcatgggcccgggccggaagcgggatttctcccctgtaccctggagtcagtatttcgaatccatggaagacgttgaagtggaaaacgagacagggaaggatacattcagagtctataagagtggtagcgaaggaccggtacttctcttgctgcacggcggtggtcattccgcactgagttgggcagtttttactgccgccattatatccagggttcagtgccggatcgtcgctctggatttgaggtctcacggcgagacaaaggtgaaaaatccggaggacctgagcgctgagacgatggcaaaggatgtgggtaacgtcgtggaggcaatgtatggtgacctgccaccacccatcatgctgataggtcactccatgggaggggccattgctgttcacacggctagcagtaatttagtcccctcactgctgggcctgtgcatgatcgacgtggtggagggaactgcaatggacgctttgaattcaatgcagaactttctgcgcggacggcccaaaacgttcaaatccctcgagaacgccatcgaatggagcgtgaaatctggtcagattcggaacctcgaatcagcccgggtcagcatggttggtcaagtaaagcagtgcgagggaataactagccctgaaggctctaaaagtatagtggagggtattatagaagaggaagaagaggatgaggagggctccgaatcgatcagtaagaggaaaaaagaagatgatatggaggggctgccttccgaaacccagaacctgttactcttcctccaaaccaaaaaagatcacccttacacctggcgcatcgaactagccaagactgagaagtactgggacggctggtttcgggggcttagcaacctgtttttgagttgtcccattcccaaactgctgctgttagcgggtgtcgataggttggataaagaccttactataggccagatgcaagggaagtttcagatgcaagtgctgccccaatgcggacacgccgtgcacgaggacgcaccagacaaagttgcggaggcggtggctacctttctgatcagacacagatttgctgagcctatcggcggcttccagtgtgtattcccaggctgctag

SEQ ID NO: 130809 - DNA, 1776 bp, Artificial Sequence
  Description of Artificial Sequence: Synthetic coding sequence
atgggctgcagtagctctagcacgaaaactcgtcgctccgatacaagcttgcgcgccgcgcttattatccagaactggtaccgaggttacaaggctagactgaaagctaggcaacattacgcgctcaccatattccagagcattgagtatgccgatgaacaaggccagatgcagctgtcaacattcttttcctttatgttggagaattacactcacatccataaagaggagctcgagctgaggaaccaatcgctggaatctgaacaggacatgcgcgaccgctgggactacgtggacagtatcgacgtccccgactcttacaatgggccgcgactgcagttccctctgacctgcactgacattgatctgctcctcgaggcatttaaggagcaacaaatccttcatgctcattacgtcttggaggtgctttttgaaacaaagaaagtgctgaagcagatgcctaacttcacacacatccagactagcccctccaaagaggtaacaatctgcggagacctgcatgggaagttagatgatctgtttctgattttctacaagaatgggctccctagcgaacgcaatccctacgtgttcaatggcgatttcgtggaccggggaaaaaactccatcgagatcttgatgatcttatgcgtatcattccttgtgtatccaaacgatcttcacttgaataggggtaatcacgaagattttatgatgaacctccgatacggattcaccaaagaaatcctgcacaagtacaaacttcacggcaaacgcatacttcagatattggaagaattctacgcctggcttcccatcgggaccatagtggacaatgagatactcgtaatccatggcgggatctctgagacaacggacctgaatctactgcacagggtggaaagaaataaaatgaaatctgtgctgatcccccctacagagactaatcgagaccacgataccgattccaagcacaacaaagtaggcgtaacattcaatgcccatggaagaatcaaaactaatgggagccctaccgagcatctaactgaacatgagtgggagcaggtggttaccatcttctccgcctccaattactacgaggagggcagtaatcgcggggcctatattaaactgtgctcgggaacgacaccaagattctttcaataccaggtgaccaaggctacttgctttcagccgctgcgacagcgcgtcgatacgatggagaattcagcaatcaaaatcctgagagagcgtgtgattagccggaagtctgatctgactcgggcctttcagctccaggatcatagaaaatccggcaagctgtccgtgtctcagtgggctttctgtatggagaatattctgggccttaatctgccatggaggtccctgagcagcaatctggtgaatatagaccagaatgggaatgtggagtacatgtcatccttccagaatatcagaatagaaaaaccggtgcaggaggcgcattccaccctggttgagacattgtatcgatataggagtgatctcgagatcatcttcaacgctatcgatacggaccacagtggactcatttccgtggaagagtttagagccatgtggaaactgttctcaagccattacaacgtgcatattgacgatagccaggtgaacaagttggccaacatcatggatctgaacaaagacggctctatcgactttaacgaatttctgaaggctttctatgtggtgcacaggtacgaagatcttatgaaacccgacgtgaccaacctcggttag

SEQ ID NO: 130810 - DNA, 1803 bp, Artificial Sequence
  Description of Artificial Sequence: Synthetic coding sequence
atgggctgttcatctagtagtaccaaaacaaggagatctgatacctcacttagggcggccctgattattcagaactggtaccggggatataaggctcggctgaaggctcgacagcattacgctctcacgatttttcaatctatcgagtatgccgacgaacagggtcagatgcaactgagtactttctttagtttcatgctggagaactacactcacattcataaagaggagctagaaattctccatgcgcactacgtacttgaagtcctgtttgagactaaaaaggtactcaaacagatgccgaatttcactcatatccagaccagcccctccaaggaggtgaccatatgcggagacctgcacgggaagctagatgatctgtttctgatattctataaaaatggacttccaagcgaacggaatccctacgtgttcaacggggactttgtagatcggggtaagaattctatcgagattcttatgatactctgcgtcagctttctggtctaccccaacgaccttcacctcaatcgtgggaatcatgaggatttcatgatgaatctccgctacggattcactaaggaaatcctgcataaatacaagcttcacggaaagagaatcttgcagattctggaagagttttacgcgtggctgcccataggcactatcgtagataatgaaatcctggtaatccacggcggcatctccgagacaaccgatttaaatctgttgcatcgagttgagagaaacaaaatgaagagtgtgctcattcctccaactgaaaccaatagagaccatgacacagactcaaagcataataaggtcggagtgacctttaatgcgcacggacggattaagacaaatggctcccctaccgaacacctcactgaacatgagtgggagcagattatagacatcctgtggtcggatcccaggggcaagaatggctgtttcccgaatacatgcagggggggaggctgttactttggacccgatgtgaccagtaaaatcctgaataagtatcaattgaaaatgctcattagatcacacgaatgtaagcccgaaggttatgaaatttgccacgacggcaaagtcgtaactatattcagtgccagtaactactacgaggaagggtcaaaccgcggggcctacattaaattgtgttctgggacaacccccaggtttttccaataccaggtgacgaaagcaacgtgtttccagcccctgcggcagcgcgtggacaccatggagaatagcgctataaagatactgagagaacgtgtgatctctcgaaaatcagacctcaccagggcgttccagctacaggatcaccggaagagtgggaaactctcagtgtctcaatgggccttttgcatggaaaatattcttggtctaaacttgccatggcgctcactgtcgtcaaatcttgtgaacatcgatcagaacggcaacgttgaatatatgagtagcttccaaaacatcaggattgaaaagcccgtacaggaggcacactccacacttgtggaaaccctttataggtacaggtcagacctggagatcatcttcaacgccatcgataccgaccactcgggactaatttcagttgaggagtttagggccatgtggaagttattcagcagccactacaacgtccacatcgatgactctcaggtcaacaaactggccaatattatggacttgaacaaagacggctccatcgattttaatgagttcttgaaggccttttacgtggttcacaggtatgaagatctgatgaagcccgacgtaactaacctcggttag

SEQ ID NO: 130811 - DNA, 1962 bp, Artificial Sequence
  Description of Artificial Sequence: Synthetic coding sequence
atggggtgctccagctcatctacaaaaacacgcaggtccgatacatccctaagagcagctctcattatccagaactggtacaggggatataaggcacgtttaaaagcacgtcagcattatgccttgaccatttttcagtcaattgagtacgccgatgagcagggccagatgcagttgagcaccttttttagcttcatgctggagaactatactcacatacacaaggaggagttggagctgcgcaaccagtcactcgagtctgagcaggatatgcgcgaccgctgggattatgtggattctattgatgtccctgatagctataacggaccaagattgcagtttccccttacctgtaccgatattgacctcttactggaagcattcaaggagcagcagatactgcatgctcactacgttctagaggttttattcgagactaagaaggtgctgaagcagatgcccaacttcacacacattcagacttcccccagtaaggaggtcactatttgcggcgatctacatggtaagctggacgacctatttctgattttctacaaaaatggcctcccatctgagaggaacccctatgtcttcaacggggacttcgtcgatcgcggcaaaaattccatcgagattctgatgattttgtgcgtttcttttcttgtgtacccgaacgacctgcatctcaacaggggaaatcatgaggacttcatgatgaatctgcggtacggattcacaaaagaaattctgcataagtataaactacatgggaagagaattcttcagattctcgaagaattttacgcgtggttacccatcggaacgatcgtggacaacgagatcctcgtaattcatggggggatcagcgaaaccaccgatctgaatctgttacatagagtagagagaaacaagatgaagagtgtgcttatcccacccactgagacgaatcgtgaccatgacaccgattctaaacacaataaggtgggcgtgaccttcaatgcccatgggaggatcaagactaatggtagtcctacggaacacctaacagagcatgaatgggagcaaataatcgatattttgtggtcagatcctcggggcaagaatgggtgctttccgaatacctgtcggggcggcggatgttactttggacctgatgtcacgtcaaaaatattaaacaagtatcaactgaagatgcttatccggtcacacgaatgtaagccagagggctacgaaatctgccacgatgggaaagtggtgaccatctttagcgccagcaattattatgaagaagggtcgaatcgcggcgcctacatcaagctgtgcagtgggactacccccagattctttcaataccaggtgaccaaggctacctgcttccagccactaaggcagcgcgtcgataccatggagaattcggctattaagatcctgagagaacgcgtgattagccgtaagtcggacctgacccgggcgttccagctgcaagaccacaggaagagcgggaagctttcagtctctcagtgggccttctgcatggagaatatcctgggtttgaacctgccgtggcgtagcctgagctccaacctcgtcaatatcgaccagaatgggaatgttgagtacatgtcttccttccaaaacatccgaatcgagaagccagttcaagaggcccactctacactcgtggagactctgtacaggtatcgcagtgatctggaaataatcttcaatgccatcgataccgatcatagcggtcttatctcagtagaagagtttagagcaatgtggaaactgttttcgtcccactacaatgtgcatattgacgacagtcaggtcaacaagctggctaatatcatggatctgaataaggatgggtcaatcgacttcaatgagtttttaaaagctttctacgtggtgcaccgctacgaggatctgatgaagccagatgtgaccaatcttgggtag

SEQ ID NO: 130812 - DNA, 1131 bp, Artificial Sequence
  Description of Artificial Sequence: Synthetic coding sequence
atggggtgtagctcgagttctacaaaaactagacgatctgatacgtcattacgtgctgcattgataatacagaactggtacaggggctacaaagcccgcctgaaggcgaggcagcattacgctctgacaatttttcaatccatagagtatgccgacgaacagggacagatgcagctcagcacgttcttctccttcatgttggagaactatactcacatccataaagaagagctggaactccggaatcaatcgctcgagagtgagcaggatatgagagaccggtgggactacgtggactctatagatgtacccgatagctataacggtccccgtctccagttcccactgacctgcaccgacattgatctgctcctcgaagcctttaaggagcaacaaatcctccatgcacactatgtcctcgaggtgctgtttgaaacaaagaaggttcttaaacagatgccgaattttacccacattcaaacttccccttcaaaggaggtcaccatctgtggtgacctccatggaaaactggacgacctgtttcttatcttctacaaaaacggcctgccttccgagaggaacccctacgttttcaacggtgactttgttgatagaggaaaaaacagcattgagattcttatgatcctgtgtgtgagcttcctggtctaccccaacgatttgcatctcaaccgaggaaatcacgaggactttatgatgaatcttagatacgggttcactaaagagattctccacaagtacaaactccacggcaagcggattttgcaaatcctggaggaattttacgcttggctgccgattggcaccatcgtcgataacgagattttggtgatacatggggggatttccgagactaccgatctgaatctcttacatagagttgaaagaaataaaatgaagtctgttttaattcctcctaccgagactaacagggaccacgacaccgattcaaaacacaacaaagtgggggtgaccttcaacgctcatggccgcataaaaacgaatggatcccctactgaacacctgacagagcatgaatgggaacaaagtgggtactatggcaagcagcgacaccaggacattaagcgcgaaagcgacttcacaaaaaagtag

SEQ ID NO: 130813 - DNA, 1767 bp, Artificial Sequence
  Description of Artificial Sequence: Synthetic coding sequence
atgctcgagaactacacccatattcacaaagaggagctcgaactccgaaatcagtcattagaaagtgaacaagatatgcgagataggtgggactacgttgattcaatagatgtccctgattcgtacaacgggcctcgtttgcagtttccactgacatgtactgacattgatctgctcttagaggcttttaaggagcagcagatcctccacgcgcactatgtcctcgaggtcctttttgagacaaagaaggtcttgaaacagatgcctaattttactcatattcagacctctccaagcaaggaggtcacgatatgcggtgatttacacggtaaactcgacgacctgttcctgatcttctataaaaatggcctcccctccgagcgcaatccttatgtctttaatggagacttcgtggaccgtgggaaaaactctattgagattctgatgattttgtgtgttagttttcttgtctatcccaatgatctgcatttaaaccgcggcaaccacgaggacttcatgatgaatttgcgctacggcttcactaaggagatcctccataaatataaactccatggcaagagaatactccagatcttggaggaattttacgcctggttacctattgggacaatagtcgataacgaaattctcgtaattcatggtggcatttcagaaactacagacctgaatttgctccatcgggtcgagcgaaataaaatgaaatctgtcctaatcccaccgactgagaccaacagggatcacgacacagattctaaacacaataaggtgggcgtgacattcaatgcccacgggcgcattaaaacaaatggatcccctactgagcaccttactgagcacgagtgggagcagattatcgatatactctggagtgatcctcggggtaagaacgggtgtttcccaaacacatgcagaggtggcgggtgctatttcggacccgacgtcacctccaagatcctgaacaaataccagctgaagatgctgataagatcccacgagtgtaaaccagaggggtacgagatttgccatgatggcaaggtcgttacaatcttctctgccagtaactactatgaggaagggtctaatcgaggcgcctacatcaagttgtgtagcgggaccaccccacgcttcttccagtaccaggtcactaaggcaacttgctttcagcccctgagacagagagtcgacaccatggagaacagtgctatcaagatattgcgggagcgtgtcattagtcgaaagagcgatctgactcgggcctttcagctgcaggaccaccgcaaatccggaaaactgtctgtctctcaatgggcattctgcatggagaacatccttggactgaacctgccgtggaggtctctctcttctaatctggtgaatatagatcagaatgggaacgttgaatatatgtccagctttcaaaatattaggattgagaagcctgtccaagaagcccactctacattagttgaaacactctatcggtatagatctgatctcgagattattttcaatgccattgatacagaccactcaggtctgatctctgtggaagagtttcgggcaatgtggaagctcttttcgagtcactataatgtacatatagacgattcccaggtcaacaagctggccaatattatggacctgaacaaagatggctctatagacttcaacgagtttctgaaggcattttacgtagtccataggtatgaagacctgatgaagccagacgtgacaaacctgggatag

SEQ ID NO: 130814 - DNA, 2262 bp, Artificial Sequence
  Description of Artificial Sequence: Synthetic coding sequence
atgggttctggaacttccactcagcaccatttcgccttccagaacgctgagagggccttcaaggctgcggccctgattcaacgctggtacagaaggtatgtagctagactagagatgcgtcggagatgtacctggagtatttttcagagtattgagtacgctggccagcaggatcaggtgaagctacacgacttcttttcttatcttatggatcatttcatccccagtagccataacgatcgagactttcttacaaggatcttcaccgaggataggttcgctcaagattccgaaatgaagaaatgttccgactacgaaagcatagaggtacctgactcctacactggccctcggttgtccttccccctcctccctgatcacgcaaccgccttagtggaagccttccgactgaaacagcagctgcatgctcgttatgtcttgaatttgctatacgaaacaaagaaacatctagtccaattacctaatatcaaccgcgtgtccacgtgctactcggaagagatcacagtgtgtggggaccttcacggccagctggacgatctgatatttattttctacaagaatggtctgcccagccccgagagatcatacgtgttcaacggcgatttcgtcgacaggggtaaggactcggttgagattctcatgatactgtttgctttcatgctggtgtatccaaaggagtttcaccttaacagaggaaatcacgaagatcacatggtaaacctacgatatggcttcacaaaagaagtgatgaacaagtataaggttcatgggaaagagattctgagaaccctgcaggacgtgttttgctggctgcccctggccactctcatcgatgagaaggtgctaatactccacggaggcgtttccgacattactgacctggagttgttagataaaatagagagaagtaaaatcgtctcgacgatgaggtgcaagacgcgacagaaaagtgagaagcagatggaggagaaacgccgggctaatcagaagagcagtgctcaggggcccattccctggttcctgcctgagtctaggagtctgccgagctctcccttacgactgggtagttacaaggcccagaagacatccaggagcagtagcatcccatgttctggctcacttgacggtagggagctgtccaggcaggtccgttcaagcgtggagcttgaactggagcgctgccgccagcaggctgggctgctggtgaccggggaaaaggaggagcctagccgtagtgcatctgaggccgactctgaagctggagaactgcggaagcctactcaggaggaatggcgacaagtcgtggacattctgtggagtgacccaatggcccaggagggatgtaaggccaacaccatacgaggtggtggctgctacttcggtcccgacgtgactcagcaactactgcaaaagtacaacatgcagttcctgataaggagccacgaatgtaaaccggaggggtatgagttttgccataatcgcaaagtcctgacgatcttctcagcttccaattattacgaggtgggctctaaccgaggcgcctacgtcaaactcggccccgctctaacacctcatatcgtacagtaccaggccaataaggtaacacacacattaactatgcgtcagagaatcagtcgggtggaggaatctgcactcagagcactaagagagaagctgtttgcacacagctcggatttgctatcggagtttaaaaagcatgatgccgacaaagtggggttaattactctgtctgactgggcagcggctgtcgagtcagttctccacctcggcctgccttggaggatgctgcgtccccagctggtgaattcctccgcagacaatatgcttgagtataaatcctggcttaagaacctcgccaaggagcaactgtcgcgggagaatatccagagttctctactggaaacactctatcgaaacaggagcaatttggagactatttttagaattatagacagcgatcacagtgggtttatatctcttgatgagtttaggcagacttggaaactatttagttcccacatgaatatagacatcactgacgactgcatttgtgatttggcccggtctatcgattttaataaagacgggcacattgatattaacgaattcctggaagccttccggctggtggagaaatcatgtcctgaaggggacgcctccgaatgcccccaggccacaaacgccaaagattccggatgcagctcaccaggcgcccattag

SEQ ID NO: 130815 - DNA, 1797 bp, Artificial Sequence
  Description of Artificial Sequence: Synthetic coding sequence
atgggcagcggcacgtccactcagcaccactttgcgttccagaacgccgagcgtgcttttaaagctgccgcattgatccagcgctggtacaggcggtacgttgctcgtctggaaatgcgccgcaggtgtacatggagcatctttcagtcaatagagtacgctgggcaacaggaccaggtgaagctacacgacttcttttcctatctgatggaccatttcattccaagctcccataacgaccgggacttcttgacaaggatattcactgaggaccgttttgctcaggattcggaaatgaaaaagtgctcggactacgagtccatcgaggtgcccgacagctatactggccccagactgtcatttccactgttgcctgatcacgccaccgccctggtggaggccttcagactgaaacaacagctgcatgcacgatacgtgctcaacctcctgtacgagacaaaaaaacacctggttcaactgcctaatatcaacagggtcagtacctgttattcagaggaaattaccgtgtgcggcgaccttcatgggcagctggatgatctgatcttcattttctacaaaaatggactgccaagccctgaaagaagctacgtattcaatggagactttgtggaccgtggaaaagactctgtggagatcttaatgattctttttgccttcatgttggtgtacccaaaagagttccaccttaatcggggaaatcacgaggatcatatggtgaatctgagatatgggttcacgaaagaagtgatgaacaagtataaagtccacggtaaggagatcctccggacactccaggacgtgttttgctggttaccgttagcgaccttaatcgatgagaaggtgttaattttgcacgggggggtcagtgatataaccgatctggaactgctggataagatcgagcggtccaagatcgtgtccacaatgcggtgcaagacgaggcaaaagagtgagaagcagatggaggaaaagcgccgcgccaatcagaaaagctcggcacagggccccataccgtggtttctgcctgagagcagaagcctcccatcaagccccctgcgtctcgggagctacaaagcacaaaagacgagccggtcttctagtatcccttgttcgggatcactggatggtagagagctgtccaggcaggtgcgaagctctgtggagctggagctggagcggtgtcgccagcaagctggtctcttggtgactggcgagaaagaggaacccagcaggtctgcaagcgaagcagacagtgaagccggtgagctgcgcaagcccacccaggaggaatggagacaggtggtggacatcttgtggagtgaccctatggctcaggagggctgcaaggctaatacaatcaggggtggcggatgctactttgggcccgacgtgactcagcaactcttgcaaaaatacaatatgcaattcctgattaggtcccacgagtgcaaacctgaggggtatgagttctgccataaccgtaaggtcctcactattttctcagcgagtaattattatgaagttggctctaataggggggcttatgtgaaactgggcccagctttgactcctcacatcgtccagtaccaggcaaataaagtgacacatacactgaccatgcggcagaggatcagtcgggtggaagagtccgcactgcgggccctccgggaaaagctatttgcacattcttcagacctcctgtccgagtttaagaagcacgacgcagataaagtggggctggccagttctcagctgtgttactaccaacagaagtag

SEQ ID NO: 130816 - DNA, 1440 bp, Artificial Sequence
  Description of Artificial Sequence: Synthetic coding sequence
atgggagcattcctggacaaaccaaaaacggagaaacataacgctcatggggccggaaacgggctgcggtacggacttagtagtatgcagggttggagagtcgagatggaggacgctcacactgccgtggttggtatcccacatggcctggaggattggtcatttttcgcagtgtacgacgggcacgctggctcacgagtcgccaattattgttcaactcacctccttgagcacatcactaccaacgaggattttcgtgccgccgggaagagcggctccgcattggaactgagtgtggagaatgttaaaaacggcatacgtactggtttcctgaagatcgacgagtatatgcgcaatttctccgatctacgaaacggcatggacaggtcggggagcacagctgtcggcgtaatgatcagccccaaacatatctactttatcaattgcggcgacagccgtgctgtactctacaggaatgggcaggtttgcttctcgacacaagatcacaaaccgtgcaatcctagggagaaggaacggatccaaaatgcagggggtagcgtgatgatacagcgcgtcaatggaagcttagcagtgtcccgggcactgggcgactacgactacaagtgtgtagatggaaaaggaccaacggagcaacttgtttccccggagcctgaagtatatgagatcctgcgcgctgaggaagatgagtttatcattctcgcctgtgacggaatatgggacgtcatgagcaatgaggagctatgcgaatatgtcaagagcagactcgaggtgtctgacgacctggaaaacgtgtgcaactgggtagtagatacatgtctgcacaagggcagccgcgacaatatgagcatcgtactcgtgtgtttcagcaatgcaccgaaggtctcagacgaggctgtaaaaaaggacagtgagctcgacaaacacctggagagtcgggtcgaggaaataatggagaagagcggtgaagagggaatgccagaccttgctcacgtgatgagaatcttatcggccgaaaatattccaaaccttccgcctgggggcgggctggccgggaagcgcaatgtcatagaggccgtgtactccaggctgaatccgcatcgcgagtctgatggcgcttccgatgaggccgaagaaagcggcagtcaaggcaagttagtcgaggcactccgacagatgcgtattaatcacagaggtaattatagacagttactggaagaaatgttaacatcctatcgactcgcaaaagttgagggggaagaatcaccagctgagcctgctgccacggcgacctctagcaacagcgacgctggcaatcctgtgaccatgcaggagtctcacacggagtctgagtccggattagccgagctggatagcagtaacgaggacgcagggacaaagatgtccggagagaaaatttag

SEQ ID NO: 130817 - DNA, 579 bp, Artificial Sequence
  Description of Artificial Sequence: Synthetic coding sequence
atgagcattgtactggtgtgcttttccaatgcgcctaaagtttctgatgaagccgtgaagaaagattcagagctggataaacaccttgagagtcgagtggaggagataatggaaaaaagtggtgaagagggaatgccagatttggcccacgtaatgagaatactttctgccgagaatattcccaacttgccaccaggcggaggcctggctgggaaaagaaatgtgatcgaggcggtgtattcacgccttaacccacatagggagtccgacggagcgagtgatgaggctgaggagtccggctctcaaggaaaactcgtggaggctctccggcaaatgcggataaaccatagaggcaactaccggcagctgctggaagagatgctcacttcctacaggttggctaaggtcgagggggaagaaagccctgcagaacccgcagccacggcaacttcttccaattctgacgccgggaatcccgtaactatgcaggagtcccacaccgagtccgagtcagggcttgctgaattggatagcagcaacgaggacgcaggaacaaagatgtctggggaaaaaatctag

SEQ ID NO: 130818 - DNA, 1164 bp, Artificial Sequence
  Description of Artificial Sequence: Synthetic coding sequence
atgggtgcttttttggataagcccaaaacagagaagcacaatgcccatggcgctggcaacgggctgcgctatggtctgagcagcatgcagggctggcgcgttgagatggaggacgcgcatacggctgtggtgggcattcctcacggcttagaggactggtcattctttgctgtttatgatggccatgcgggctcacgcgtcgccaattattgttccacccacctactggagcacatcaccactaacgaggactttcgcgcagcagggaaatcagggagcgcactcgagctgtctgtggagaacgtcaagaatggaattcgcaccggatttcttaaaattgatgagtatatgcgcaatttctctgacctgcggaatggcatggatcggagcggctccacagctgttggtgtcatgataagcccaaagcacatttacttcattaactgtggcgacagtcgcgccgtgctttaccgtaatggccaggtgtgctttagcactcaggaccacaagccctgcaaccctcgagaaaaagagcgaattcagaatgccgggggttccgtgatgatccagagggtcaacggttcacttgcagtgtccagggcactgggggattatgattataaatgcgtcgacggcaaaggacccactgaacagctagtgagtcccgagcctgaggtatatgagatactcagagcagaagaggacgagttcataatactggcatgcgacggtatctgggacgtgatgagtaacgaagaactatgcgaatatgtgaaaagccggctggaagttagcgatgatctggagaatgtctgtaactgggttgtcgatacctgcctgcacaagggctcccgggataacatgtcaattgtgctggtgtgctttagcaatgctccgaaggtaagtgacgaagcagtgaagaaggactcagaattggacaagcacctggagtctagggtcgaggagatcatggaaaaatctggggaagaaggcatgcccgatctcgctcatgttatgcggatcctgtccgcagagaatatccctaacctgcccccaggtgggggcctggctgggaaacggaacgtgatagaagccgtgtattctcggctgaacccacatagggagtcagacggtggcgccggggatctggaggatccttggtag

SEQ ID NO: 130819 - DNA, 1143 bp, Artificial Sequence
  Description of Artificial Sequence: Synthetic coding sequence
atgggagccttccttgacaaacccaagacagaaaaacacaacgctcacggtgctggcaatggactgagatatggattgagctcaatgcagggctggagggtggagatggaagacgcccatacagctgtcgtggggattccccacggtctagaggactggtcctttttcgcagtttacgatggacatgccggtagccgtgttgcaaattactgctctacccacctgctggaacatattacgacaaatgaagattttagagctgccggaaaatcaggcagcgctctggagctcagcgttgagaatgtaaaaaacggtatcagaacaggttttctcaaaattgatgaatatatgagaaatttttcagatctgaggaatgggatggataggtctgggtcaaccgccgttggcgtgatgatcagccctaaacacatctactttattaactgcggagatagtagagccgtgctctaccgaaatggacaagtgtgcttttcaacacaagaccacaaaccatgtaaccctcgtgaaaaggaacggatccaaaacgcggggggctctgtgatgatccaaagggtgaatggaagcttagccgtgtcccgggccctcggggattacgattacaagtgcgtggacgggaagggcccaacagagcaacttgtgtctccagagcctgaagtgtacgaaatactgcgcgctgaggaggatgagttcattatcctcgcatgcgacggcatttgggacgtgatgtcaaacgaggagctttgcgaatacgtaaagagcagactggaagtgtccgatgatctggaaaatgtgtgtaactgggtcgtcgacacatgtttgcacaagggatcaagagataatatgtctattgttctcgtttgcttctcgaatgcccctaaggtgagtgacgaggccgtaaaaaaagattcggagctcgataagcacctggaatcccgggtagaggagataatggaaaagtcaggcgaagaaggaatgcccgacctagctcacgtaatgcggattctaagtgccgaaaacattcccaatctgcctccaggcggcggactggcaggcaaacgcaatgtgatcgaagccgtatatagtcgactcaacccccatagagagtctgatggccagaagtag

SEQ ID NO: 130820 - DNA, 984 bp, Artificial Sequence
  Description of Artificial Sequence: Synthetic coding sequence
atgggcgctttcctggacaagcccaaaactgaaaaacataatgcccatggggctggaaatggcttgcggtatgggctgtcctcaatgcagggctggagagttgaaatggaggacgcacacactgctgtcgtgggaataccacacgggctcgaggattggtcattttttgccgtgtacgacggccatgcaggaagtcgggtggctaattactgctccacccacctgctagagcacatcacaactaacgaggatttccgggcagccgggaagtccggctcggccctggagctgagcgtcgaaaatgtgaagaacggcatcagaacgggctttctgaagattgatgagtacatgcggaatttcagcgatctgcgcaacggcatggatcgcagtggctcaactgccgtcggtgtcatgatctcgcccaaacacatttactttattaactgcggggatagtagggctgtgctgtaccggaacggccaggtgtgcttttctacacaagaccacaagccgtgcaacccccgagagaaagaacgtatccagaatgccggcggctcagttatgattcagcgagttaacggttctctcgccgtttccagagctctaggcgactacgactacaaatgcgtcgacggaaaggggcccactgagcagctggtgagtcctgagccagaagtgtatgaaatcctgagagctgaggaagacgaatttatcattttggcttgtgacggtatctgggacgtgatgagcaatgaagagctctgcgaatacgtcaagtcccggctggaagtctcagacgacctggaaaatgtgtgtaactgggtggtcgacacctgtttacataagggaagtcgggacaacatgtctatcgttctagtctgtttttccaacgctccaaaggtttccgatgaagcagtgaagaaagactcagagctggataagcatctggagtcccgcgtcgaagggaagactaacgccttttag

SEQ ID NO: 130821 - DNA, 1137 bp, Artificial Sequence
  Description of Artificial Sequence: Synthetic coding sequence
atgggggcatttctggataaaccgaaaacagagaaacataacgcacacggagcagggaatggccttagatatggcctgtccagcatgcagggatggagagtggaaatggaagacgctcataccgctgttgtgggaatccctcatggactagaagattggagtttttttgccgtctatgatggacatgcaggttcccgagtcgctaattattgtagcacccatctattggaacatatcactacgaacgaggatttccgcgccgccggcaagagcggcagcgctctggagctgtctgtcgaaaatgtaaagaacgggatcaggaccggtttcctgaaaatagacgaatatatgcgaaactttagtgatctgaggaacggaatggataggagtggttctactgccgtgggcgtgatgattagccccaagcatatttacttcattaactgcggcgatagtagagccgtgctatataggaatggtcaggtgtgtttctccacgcaggaccataagccttgcaaccccagagaaaaggagaggattcagaacgctgggggctcagtcatgattcaaagagtgaatggatctctggcagttagccgagctctcggagactatgattacaaatgcgtcgatggcaaagggcccacagaacagctcgtctcgcccgagccagaagtttatgaaattctccgagccgaggaagatgagttcatcatcctggcctgtgacggcatctgggatgttatgagcaacgaagaactgtgcgagtatgttaaatcgagacttgaggtatctgacgatctcgaaaacgtgtgtaattgggtggtggatacttgtttgcacaaaggctcaagggacaatatgagtatcgtattggtttgcttcagcaacgctccaaaggtatctgacgaagctgtgaagaaggacagcgagctggacaagcatctggaaagccgtgtggaggagattatggagaaatcgggggaggagggcatgccagacctcgcacacgtcatgcgaatcctgagtgctgaaaacattccaaatttgcccccaggggggggcctcgctggtaagcgaaatgtcatcgaggccgtgtactctagactgaacccccaccgtgagagtgacggttag

SEQ ID NO: 130822 - DNA, 1518 bp, Artificial Sequence
  Description of Artificial Sequence: Synthetic coding sequence
atgttaaaccgggtgagatctgcagtggcacacctcgtgtccagcgggggggcacccccgcccaggcccaagagtcctgatctgcccaacgccgcctctgcaccacctgccgctgcgcccgaagccccccgcagtccgcccgcgaaggccgggtcgggctccgcaacaccagctaaggcagttgaagcacgggcctccttttcacgccctactttccttcaattatccccaggaggactccggagagccgacgaccacgccggccgtgctgtgcagagtcctccagacacgggacgcaggctgccctggtccacaggctacgctgaagttatcaacgcagggaagtcccgccataatgaagatcaagcttgctgtgaggtggtttacgtggaaggcaggaggagcgtaacgggtgttccccgagaaccatctagaggacagggtctgtgtttttactactggggcctgtttgatggccacgcgggagggggggcagccgagatggcatctagattacttcacagacatataagggagcaattaaaagacctggtggagattttgcaagatccttccccacctccattgtgcctgcccacgacaccgggaacccccgactccagcgacccttcccatcttctgggccctcagtcttgctggtccagtcagaaggaggtcagccacgagagcctggtggtcggcgctgtagagaatgccttccaattgatggacgaacagatggccagagagagaaggggacaccaggtggaaggtggttgttgtgcactggtcgtaatttacctgcttgggaaggtctatgtggctaatgcaggggatagccgtgcgattatcgtccgaaatggcgagataattcctatgtcgcgcgaattcactcccgagacagaacgccagagattgcaacttcttggctttctgaagcccgagttgctgggatctgagtttacccacctggagtttccaaggcgcgtgctgcccaaggagctagggcagcgcatgctctaccgtgaccaaaacatgacagggtgggcctataagaaaatagaactagaagatctgagatttcccttagtttgcggagagggtaagaaggctcgcgtgatggccactatcggagttacgcgcggactaggcgaccactccctgaaagtctgttcaagcactttgccaataaagccttttctcagctgcttccccgaggtcagggtgtatgacctgacccagtacgagcactgcccggatgacgtacttgtgcttggcacagatggattatgggacgtcactacagattgcgaagtggctgccactgtcgacagggttctctcagcttacgagcccaacgatcattccaggtacactgcacttgcgcaggcactggttctcggggccagaggcacgccacgcgaccgtggctggaggctgcccaataacaaactcggatctggcgacgacatttccgtgttcgtgatcccactgggcggcccgggcagctacagctag

SEQ ID NO: 130823 - DNA, 900 bp, Artificial Sequence
  Description of Artificial Sequence: Synthetic coding sequence
atggccagccgcctattacaccggcatatcagggagcaattgaaggaccttaaggaagtttcacacgaatcacttgtggtgggagccgtcgagaatgctttccagctcatggatgagcagatggctagagaacgccggggccatcaggtcgaagggggttgctgcgctcttgtggtaatctacctcttgggcaaggtgtacgtcgcaaatgcaggggactccagggcaatcattgtgagaaatggagagataatccctatgagccgggagttcacgcccgagacggaacgccagcgccttcaattgctgggctttctgaaaccagaactattaggttcagagtttactcatctcgagttcccacggagagtgctccccaaagagctcggccagagaatgctgtaccgtgaccagaatatgacgggatgggcgtacaagaagatcgaactggaggacctgcggttccctctcgtttgcggcgaaggaaaaaaggcccgggtcatggcaaccatcggcgtgacgcggggcttaggagatcacagcctcaaagtatgctccagcactctcccaatcaaaccattcctcagctgctttcccgaggtgagagtgtacgacttgacccaatacgagcactgtccagacgatgtgcttgtactgggaacggacggcctttgggatgtgacaaccgattgcgaagttgcagccactgtagatcgagtgctgtcggcatatgagcccaatgaccacagtaggtatactgcattagctcaggccctcgtcctgggggcccggggtacgccaagagatagggggtggcgactcccaaataacaaactcggatcaggcgacgacatcagtgtgtttgtcatcccgctgggggggcccggcagctactcgtag

SEQ ID NO: 130824 - DNA, 1119 bp, Artificial Sequence
  Description of Artificial Sequence: Synthetic coding sequence
atgtctaccgctgcactgatcacactggtccgcagcggcggcaaccaggtgagacgtcgcgttcttctgagttcacggttgctccaggatgaccgaagagtgacgcctacgtgccactcaagtacatccgaaccacgctgctctagattcgatcccgatggcagtggcagcccagcgacctgggataatttcggcatatgggacaaccgaattgacgaaccaatactcctaccgccaagcataaaatacgggaaacccataccaaagatctcgttagaaaatgttggctgcgccagccaaatcggcaagcggaaggaaaacgaggatcggttcgactttgcccaacttaccgatgaggttctgtattttgcagtttacgacggccatggtggcccagccgctgctgacttttgtcatacccatatggagaaatgcattatggaccttcttcccaaagaaaaaaatctcgaaacactgctgaccttagcctttttggagattgataaggctttcagttcccatgcacgcctgtcagccgacgccaccctgctgacttcgggaacaacagcaacggtggccttgctgcgcgacggtatcgagctcgtggttgcttctgtaggcgatagcagggccatcctgtgtcgaaaggggaagcctatgaaactgaccatcgatcacacgccggaaagaaaggatgagaaggagcgaatcaagaagtgcgggggtttcgttgcatggaatagtctggggcagcctcatgtgaacggtcggctggcaatgacaaggtccattggagatctggacctcaagacctctggagtgatcgccgaacctgagaccaagcgcatcaagttacaccacgcagacgattcttttttagtgctcacaactgacggcattaacttcatggtaaactctcaagaaatttgcgacttcgtcaaccaatgtcacgacccaaacgaggcagcccacgcggtgactgaacaggcaatacagtacggaaccgaagataattcgaccgctgttgtcgtgccttttggagcctggggcaaatacaagaatagtgagattaatttctcattttcacgttcattcgcctcatctggacgctgggcatag

SEQ ID NO: 130825 - DNA, 702 bp, Artificial Sequence
  Description of Artificial Sequence: Synthetic coding sequence
atgtccacagctgctctcatcactctagtaaggagcggcggcaaccaagtgcgccgcagggtgctactctcttctagacttctccaggacgaccgacgcgtgaccccaacatgccatagctcgacgagcgaaccacgctgctcacgcttcgatcccgacgggtccggctctcccgcaacctgggataacttcggaatctgggataatagaatagacgagccaattctgctcccaccctccattaaatatgggaaacccatccctaagatttctctggagaatgtggggtgcgcttctcagattggaaagcgcaaagagaatgaggacagattcgacttcgcccagttaaccgacgaagttctgtattttgctgtgtacgacgggcatggtggaccagctgccgctgacttctgccatacccacatggagaagtgtattatggacctgctgcccaaggaaaagaacctggaaaccttattaacactggcttttctcgaaattgacaaggccttttcatcccatgcgaggctctcagctgacgagaactgtgcatggtctgccgcccttgatctagagcccgtcgacactatctgcggggcttcagtggaacgcgagatctgcctgattctgtcgcaggtaaaggagtcttcaggatcttatccagggctgagggagggatcccatatttctctgagtcactag

SEQ ID NO: 130826 - DNA, 702 bp, Artificial Sequence
  Description of Artificial Sequence: Synthetic coding sequence
atgagcaccgccgctttgattactctggtgaggagcgggggaaatcaagtgcgaagacgcgtactcctcagcagcaggctgctgcaagacgacagaagagttacacccacctgccactcttctaccagcgaacccagatgctcacgttttgacccagacgggagcggaagccccgctacatgggacaattttggcatctgggataatcgaattgacgagcctatactgctgcccccctccattaagtatggcaagcccatccctaagatctctctggaaaacgttgggtgtgcaagccagattggcaaacgcaaagagaatgaggatcggttcgatttcgcccaattgacggacgaggtcctgtattttgccgtctatgatggacatggcggccctgccgccgcggacttttgccacactcatatggagaaatgtattatggatctccttcccaaggagaagaatctggaaacactgctaacgctggcctttcttgaaattgataaagctttttccagccatgctaggctctccgccgatgagaattgtgcttggtctgccgcgctcgatctggaaccagtcgatacaatttgtggagccagtgttgagagggaaatatgtctgattctttcccaagtaaaagagtctagcgggtcctacccaggcctgcgtgagggctcacatatttccctttcccattag

SEQ ID NO: 130827 - DNA, 585 bp, Artificial Sequence
  Description of Artificial Sequence: Synthetic coding sequence
atgatagaggatactatgacgcttctttcgctcctgggcaggatcatgagatattttttgttacgaccggagacactatttctgctgtgcatctcccttgcattgtggagttactttttccacaccgatgaggtgaagacaatcgttaagtcctccagggacgcggttaagatggttaagggcaaggtggccgagatcatgcagaatgatcgcctgggcggcctcgatgtgcttgaggctgagttctccaaaacgtgggagttcaaaaaccacaatgttgcagtgtactccattcaggggaggagagaccacatggaggatcgattcgaagtgcttaccgatctggctaataaaacccatcccagcatttttggcatatttgacggccatggaggcgagacggcggccgagtacgtcaagtcgcgtctccctgaggcccttaaacagcatctgcaggattacgaaaaggacaaggagaattcagttctgtcctaccagactatcctggagcagcagattcttagcatagaccgggagatgttggaaaagttgacggtgtcttacgacgaggcagtcaccttctag

SEQ ID NO: 130828 - DNA, 1083 bp, Artificial Sequence
  Description of Artificial Sequence: Synthetic coding sequence
atgatagaggacaccatgaccctgttgtcactgctggggaggatcatgcggtacttcctgctccgcccggaaaccttgttcctcctgtgtatcagcctcgctttgtggtcatatttcttccacacggatgaggttaagaccatagtgaaatctagccgggacgccgttaagatggtgaagggcaaggtagccgagatcatgcagaacgacaggctgggcggactggacgttctggaagccgagttcagcaagacatgggagtttaagaatcataatgtggccgtgtactccatccaaggaagacgggaccacatggaggaccgcttcgaagtgctgaccgatctggccaacaaaacccacccttcaatcttcgggatttttgacggtcacggcggcgagactgcggccgaatacgttaaaagcaggctgcctgaagccctgaaacaacacctgcaggattatgagaaggataaagaaaactctgtgctcagctaccaaaccatcctggagcagcagatcctatccattgacagagaaatgctggaaaagctcacggtctcttatgatgaagcagggactacatgcttgatcgccctattgagtgataaagacctgaccgttgctaatgtgggcgacagcagaggggtgctgtgtgataaagatgggaatgctattcccctgtcccatgaccataaaccctaccaactcaaggagagaaagcgcataaagcgcgcaggcggtttcatctcatttaacggcagttggcgtgttcaagggattctcgccatgtctagatccctgggcgactatccgctaaagaatcttaacgtcgtgatccctgatccagatattctcacatttgatttggacaaattgcagcccgaattcatgatcctggcaagtgacggactttgggacgccttctcaaacgaagaagcagtccggttcataaaggaaaggctggacgagccgcactttggggcaaaaagtattgtgttacaatctttctacagagggtgccccgataacatcacagtgatggtggtgaaattccgaaactcctccaagacggaagagcagtag

SEQ ID NO: 130829 - DNA, 813 bp, Artificial Sequence
  Description of Artificial Sequence: Synthetic coding sequence
atgcacctgaatggaaggtgcatctgccctagtgatcctcagtttgtcgaagaaaagggaatccgcgcagaggatctcgtcatcggtgcacttgagtccgctttccaggaatgcgatgaagtgattggaagggagttagaagcctctggtcagatgggcgggtgcaccgcactggtggccgtcagcctccaggggaaactgtacatggctaatgccggggactcccgggctattctggtgagaagggatgagattaggcccctgtcctttgagttcacccccgaaactgagcgtcaaagaatccagcagctggcattcgtttatcccgagctcctggccggcgagttcactaggttggagtttcccagacggttaaaaggcgacgacctggggcagaaagtgctgtttcgtgatcatcacatgagcggttggagttacaaacgggtggagaagagtgacttaaagtatcccctaatacacggtcagggaagacaagccagactgctgggcacgctggctgtgtcaagaggcttgggagatcaccaactacgtgtgctcgataccaacattcagctgaagccatttctgctgtctgtgccccaggttactgtgttggacgtcgatcagctggaactgcaagaggatgatgtcgtcgtgatggctacggacgggctttgggacgtcctgtccaacgagcaagtagcctggctcgtgagatccttccttcctggcaaccaggaggacccccacaggtattgttcatgctggggccccgcctgggcatgggtgggtgcctctagcaaacccaagtag

SEQ ID NO: 130830 - DNA, 897 bp, Artificial Sequence
  Description of Artificial Sequence: Synthetic coding sequence
atgcatcttaacgggcggtgcatctgccctagcgatccgcaatttgtcgaggagaagggtatacgggccgaagacctggtcataggggcgctggaatccgcattccaggagtgtgacgaagtgatcggccgggagctggaggcctccgggcagatgggcgggtgcaccgcgctcgtagccgtgtcgttacagggtaaactctacatggccaacgcaggcgactcccgggccattctcgttcggagagacgaaattaggcctctgagctttgagttcactccagaaactgaaaggcagaggatccagcaactcgcatttgtgtacccagagctgctagccggtgaatttaccaggttggagttcccccgcaggctcaaaggcgatgatctggggcagaaggtgttgtttcgagaccatcacatgtcgggatggagctacaagagggttgaaaagagtgacttaaagtatcctctaatccatggccaagggcgacaagctaggctcttggggaccttggcagtatcaagggggctcggggaccatcagctgcgggtgctggatacaaacatacagcttaagcccttcttgttgtcggtcccccaagtgaccgttctggatgtagaccagctggagcttcaggaggacgacgtcgtggtaatggcaacagatggactgtgggacgtcctgagcaatgagcaggtggcttggcttgtgcgatcttttttaccaggtaatcaggaagatccacatagatttagtaaattggcgcagatgcttatccactccactcaggggaaggaggatagtctgacagaggagggtcaggttagctacgatgacgtctctgtgtttgtcatccctctgcattcacaggggcaggagtctagtgatcattag

SEQ ID NO: 130831 - DNA, 744 bp, Artificial Sequence
  Description of Artificial Sequence: Synthetic coding sequence
atgggcggatgtacagcccttgtggcagtgagcctgcaggggaagctgtacatggccaacgcaggcgactcccgcgctatactcgtaaggcgcgacgaaatcaggcctctgtctttcgagtttactcctgagaccgaaaggcaaaggatccagcagctggccttcgtgtaccccgaactgctggctggcgagttcacgcggttggagttccctcgtagattgaaaggcgacgacctcgggcagaaggtgttgtttcgtgaccaccacatgtctgggtggtcttacaaacgtgtggaaaaatccgatctaaagtatcccctgatccacggccaaggaaggcaggctcggctcctgggcaccctcgccgtttcacggggactgggcgatcatcaattaagagttctcgataccaatatacagctgaaacctttcctgctgagcgtgccccaggtgacagtccttgacgtagatcagcttgagctccaggaggatgatgtggtggttatggcgaccgacggtctttgggatgtgctttctaatgagcaggtggcgtggctcgtccggagcttcctcccaggcaatcaggaggatccacatcggttttcaaaactagcgcagatgctaattcacagcactcagggcaaagaggatagccttaccgaggagggtcaggtgtcttacgatgacgtgtctgttttcgtcatcccattacatagtcagggccaagagagctcggaccactag

SEQ ID NO: 130832 - DNA, 1380 bp, Artificial Sequence
  Description of Artificial Sequence: Synthetic coding sequence
atgtccgcaggatggttcagaagacggttcctcccaggagagccacttcctgctcctcggcccccagggccacatgcttcccccgtaccatacagacgcccgagatttctacgaggcagctcatcaagccctggtgccgctgacgcaagccgacggcccgacagcaggccagtcagaagccccgctcggggcagaactcttccctggaatgctggatacgcagagattatcaacgccgaaaaatccgagtttaatgaggaccaagctgcctgtggcaagttgtgcataaggagatgcgagttcggcgcagaggaagagtggcttaccctttgcccagaggagttcttgacaggacattattgggcactattcgacgggcacggtggccctgccgccgcaatattagcagccaacacactgcattcctgcctgaggagacagctcgaagcagttgtggagggcctggtcgctacccagccaccgatgcacctgaatggtagatgcatctgtccatctgatccccagttcgtagaggagaagggaatccgtgccgaggatctggtgattggcgcacttgagtctgcctttcaggaatgtgacgaggttatcggtcgcgagctggaggcatctggccagatgggggggtgcacagcactggtcgccgttagccttcagggcaaactctatatggccaacgccggggactcccgggcgattctcgtgagaagggacgagatccggcctctttcattcgagttcactcccgagacggaaaggcagaggatccagcagctggcatttgtctaccctgaactgttggccggagagttcacaagactggaatttccccggcggctcaagggggatgatctgggacagaaggtgttgttccgggaccatcatatgtctggttggtcctacaagagggtcgaaaagagcgatctgaagtaccctctgatccatggtcaggggaggcaggccagattgctggggaccttagccgttagcaggggattgggggaccaccaacttcgggttttggatactaacattcagttgaagccattcttactgtccgttcctcaagtcacagtcttggatgtcgaccagttggaacttcaagaggatgacgttgtggtgatggcaacggacggtctctgggacgtcctgagtaacgagcaagtggcttggttggttagatcatttctgcccgggaaccaggaggatccccatcggttctccaagttagcccagatgcttatccattccacccagggcaaggaggatagccttactgaggagggacaggtgagttacgatgacgttagcgtcttcgtgatccccctacactcccagggacaggaaagttctgaccattag

SEQ ID NO: 130833 - DNA, 1821 bp, Artificial Sequence
  Description of Artificial Sequence: Synthetic coding sequence
atgcggcgaagcgaggtgctcgcggaggagtccatcgtctgcttgcagaaggccttgaatcatttgcgggagatttgggagcttattgggattcccgaagaccagaggctgcagagaacagaagtggtgaagaaacacatcaaagaactcttggatatgatgatagccgaggaagaaagcctgaaggaacgtctgataaagtccatttcagtgtgccagaaagaactcaatacgctttgcagcgagctgcatgtggaaccttttcaagaggaaggggagacaactatcctccagctggagaaagatttgaggacccaagttgagctcatgcggaaacaaaaaaaagagaggaagcaggagctcaagctcttgcaggagcaggatcaggagctctgtgagatcctatgcatgccccattacgatatcgattctgcctccgttccaagcctggaagaattgaatcagttcaggcagcatgtgaccacgctgcgggaaacaaaggctagccgtagggaagagttcgtgagcattaaacggcaaatcatattgtgcatggaggccttagatcacactccagatacaagcttcgagagagacgtggtgtgcgaagacgaggacgcattttgcctgtctcttgaaaacatcgcaaccctgcagaagctcctgcggcagttagaaatgcagaaatctcaaaacgaagccgtgtgcgagggcctgcgcactcagataagagagctctgggaccgactccagataccagaagaggaacgtgaggcagtcgccacaatcatgagcggctcgaaagccaaagtccggaaggcactgcaactcgaggtcgacaggctggaagagctgaaaatgcagaatatgaaaaaagtgatagaggcgatcagagtagagctcgtccaatactgggaccagtgtttttattcacaagaacagcggcaggcatttgcacctttctgtgccgaagattacactgaatccctgctgcagttgcacgatgctgaaatcgtgcgcctgaaaaactactatgaggtccacaaggagctctttgaaggcgtgcagaaatgggaagagacatggagattattcctcgaatttgagcggaaagccagcgatcccaatcggtttacgaaccgcggggggaatctcctgaaggaagagaaacaaagggcaaagctgcaaaagatgctacccaaactcgaggaagagctgaaggccagaattgaactttgggaacaggaacactcaaaagcctttatggtgaatggacaaaagttcatggaatatgtggccgagcaatgggaaatgcaccgactagaaaaggagcgggcgaagcaggagcggcagcttaaaaataaaaaacagacagaaacagagatgctgtacggatccgccccccgaaccccgagcaagaggcgcggccttgcccctaacacgccagggaaggccaggaaattgaatactacaacgatgagcaacgcgaccgccaattccagcatcaggccaatctttgggggtaccgtgtatcactctccggtgtcacgtttgcccccatctggttctaagccagtggcagctagcacgtgcagcggcaagaagacgccgagaacaggacggcacggcgcaaacaaagaaaacctggagctaaacggcagtattctttccggcggatacccaggatccgcacctctgcagcgtaatttctcgataaactctgtcgcctccacatacagtgagtttgctcgcgaactttcaaaggctagcaaaagcgacgcgaccagcggaatcctgaattccacgaacattcaatcctag

SEQ ID NO: 130834 - DNA, 1701 bp, Artificial Sequence
  Description of Artificial Sequence: Synthetic coding sequence
atgcggcggtctgaagtcctggccgaagaaagcattgtgtgtcttcagaaggcactgaaccacctgagagagatctgggaactcatagggatccctgaggaccaaaggctccaacgtactgaagttgttaaaaaacacatcaaggaactgctggacatgatgattgccgaagaggaatccctgaaagagcgcctcatcaagtccattagcgtatgccagaaggaacttaacacactttgttctgagctccacgttgaaccatttcaagaagaaggtgagacaacaatattgcagctggagaaggatctgcgcacccaggtcgaactcatgcggaaacaaaagaaggaacgaaagcaggagctcaaactgcttcaggagcaagatcaggagctttgtgaaatcttatgcatgcctcactatgacattgatagcgcatctgtaccctccctggaggaactcaaccagtttcggcagcacgtcaccacactgagggagaccaaggctagtcggagagaggagttcgtctcaattaagaggcaaatcatcctttgcatggaggcactggaccatacacccgacacgtcctttgaacgagacgtcgtttgcgaggatgaggatgctttttgcctctcgctcgagaatattgcgacactccagaaattactacggcagctggagatgcagaagtctcagaacgaggcggtgtgtgagggtttaaggacccagattcgggagctttgggacagattgcaaattcccgaggaagaacgcgaggcagtcgctacaatcatgtctggctcaaaagcaaaagtccgaaaggccctgcagctcgaagtcgatcgcctagaggagctcaaaatgcaaaatatgaaaaaagtgatcgaggctatccgggtggagttggtgcagtactgggaccagtgcttttatagtcaagaacagcgccaggccttcgctccattttgtgctgaggactacacagagagtttgttacagctccacgatgcagagattgttcggttaaagaactattacgaagtgcataaggagctattcgagggcgttcaaaaatgggaggaaacctggagactgtttctagagttcgagcgtaaagcttcagaccccaatcgtttcacgaatagaggaggaaacctgctgaaggaagagaaacagagggctaaactccaaaaaatgttgcccaagctggaggaagagctgaaagccaggatcgagctatgggagcaggagcactctaaggccttcatggtgaacgggcagaaatttatggaatatgtagctgagcagtgggagatgcaccggctggagaaggagcgagctaaacaagagagacagctcaaaaacaaaaaacagaccgagacagagatgctttacgggtctgcgccacggactccgagcaagaggcgagggctggccccaaacaccccaggtaaggcaaggaaactgaacactaccacaatgtccaatgcgacagccaactcctccatcaggccaattttcggaggaaccgtctatcactctcctgtgtcccggctgccgcctagtgggtccaagcctgtggccgccagcacatgttcaggcaagaaaactcccagaaccggaaggcatggagccaataaggaaaaccttgagctgaatggcagtatactctctgcgcgcaccttcaaaggattccaaatttag

SEQ ID NO: 130835 - DNA, 1863 bp, Artificial Sequence
  Description of Artificial Sequence: Synthetic coding sequence
atgcgccgatccgaggtccttgcagaagaatctatcgtgtgtctgcaaaaggcccttaaccaccttagagagatttgggagcttatcggcatccctgaggaccagcgtctgcaaagaactgaagtcgtcaagaaacatataaaagagctcctcgacatgatgattgctgaagaagagagcctgaaggaacgccttataaaaagtatctcagtatgccagaaagagctgaacaccttgtgttctgaactgcacgtagaacctttccaggaggagggcgagaccacaattctgcaactggagaaggacttaagaacccaagtggagctgatgagaaaacagaagaaggagcgcaaacaggagctaaagttactgcaagaacaggaccaggaactctgtgagatcctttgcatgccccactacgacattgacagcgcatccgtgccttccttggaggagctgaaccagttccggcagcatgtgactaccttgcgtgagacgaaagcatcccgaagggaggagttcgtctctatcaagcgacaaatcattctctgtatggaggccctcgaccacacaccagatacaagctttgagagagacgtggtctgcgaggacgaggacgcattctgcttaagtctggaaaacatcgcaacactacagaagctgcttcggcagctggaaatgcagaaatcacagaacgaggccgtgtgcgagggacttagaacccaaatccgtgaactatgggatagactgcagattccagaggaggaacgggaagccgtggcaactattatgtctggctccaaagccaaagtcagaaaggcactgcaactggaggtggaccgcctcgaagaactaaaaatgcagaacatgaagaaagtcatagaagccattcgggtcgaactggtgcagtattgggatcagtgtttttactcccaggaacagaggcaagccttcgcccctttttgtgctgaggactacacagagagtcttctccagctccacgatgcagagatagtgaggttgaagaattattacgaggtacacaaagagttgtttgagggcgtgcagaagtgggaggaaacgtggcgcctcttcctggagtttgaacggaaggcttcagaccctaaccggttcacgaatagaggagggaatttgctgaaagaggagaagcaaagggccaagcttcaaaaaatgctacccaagctggaagaagagctgaaagccagaattgagctctgggagcaagagcatagtaaagcctttatggtgaacggtcaaaagttcatggagtacgtggccgagcagtgggaaatgcacaggcttgaaaaagagcgagcaaaacaggaaagacagttgaaaaacaagaaacagaccgagaccgaaatgctctatgggtctgccccccggactccaagcaaaaggaggggtctggcccccaatacaccaggaaaggccaggaagctcaataccacaaccatgtctaatgccactgctaactccagcatccgacccatcttcggaggcacagtgtaccatagccccgtttctcgattgcccccttccggatcaaaaccagtagccgcctcaacctgttccggaaagaagactccaaggaccggccgccatggcgccaataaagagaacctcgagttgaacggtagcatcctgagcggcgggtaccctgggagtgcaccccttcagcgcaacttctctatcaactctgtggcttccacatactccgaatttgccaaggacccatccctgagtgactcgtctacggtggggcttcaaagggagctcagtaaggcatcgaagtccgatgcaacctcaggtatcctaaattcaacgaacatacaaagctag

SEQ ID NO: 130836 - DNA, 1578 bp, Artificial Sequence
  Description of Artificial Sequence: Synthetic coding sequence
atgcgaagatccgaagtgctggcggaggagagtatcgtatgcctgcaaaaagccttaaatcacctgagggagatctgggaactgatcggaattccagaagatcagcgtctccagaggactgaggtggtgaagaagcatattaaagaggagggcgagaccaccatactccaactggagaaagacttgcggactcaggtggagcttatgcggaaacaaaagaaggagcgcaaacaggaacttaaactcttgcaggaacaggaccaggagttatgcgagatcttgtgtatgccccattatgacattgattctgcttcggtcccatccctggaggaactgaaccagtttagacaacacgtgaccacactccgcgaaacaaaagcctcccggcgggaggagtttgtatccattaagaggcagatcattctgtgcatggaggctttggaccatacacctgatacgagctttgagcgggacgtggtctgcgaagacgaggatgcattttgtttatccctcgagaatattgccaccctgcagaaactactgaggcaacttgaaatgcagaagtctcagaacgaagcggtgtgtgaaggtctgcgcacacagatcagggaactttgggatagactgcagataccagaggaagagagggaagctgtcgctactataatgtcaggaagtaaggcgaaggtgaggaaagccctacagttggaggtcgatcgcctggaggaacttaaaatgcagaatatgaagaaagtgatcgaggcgatcagggtagagttggttcagtactgggatcagtgcttctattcccaggagcagcggcaggcgtttgccccattttgcgcagaggattacaccgagagcctcctgcagcttcatgatgctgagatcgtgcgcctgaaaaactattacgaggtccataaggaactgttcgagggtgtgcagaaatgggaggagacgtggagactgtttctggaatttgaacgaaaggccagtgatccgaatagattcacaaaccgagggggcaacctgctgaaggaggagaagcagagagcgaagctgcagaaaatgctgcctaaactggaggaagaactaaaggcccgaattgaattatgggagcaggaacatagcaaggcctttatggtgaatggacagaagtttatggagtatgtggctgagcagtgggagatgcatcgcttggaaaaagaacgcgccaagcaggagcgtcagctgaaaaataaaaaacaaaccgagactgagatgctctacgggtcggcaccccggacacctagcaaaaggcggggcctggcacccaatactcctggtaaggcaagaaagctgaatacaactacaatgtcaaacgctaccgccaactcctcgatacgtcccattttcggcggcacggtctatcacagcccagtgtcccggctcccaccttctgggtccaagcccgttgcagccagcacctgtagtggcaaaaagaccccccgcacaggtcggcatggtgctaacaaggaaaatctagagctgaacggcagtattttgagcgcccgaacatttaaaggcttccagatctag

SEQ ID NO: 130837 - DNA, 696 bp, Artificial Sequence
  Description of Artificial Sequence: Synthetic coding sequence
atgagggtgctcggtggccgctgtggagcactcttggcctgcctcctgctcgtcctcccggtgagtgaggctaacttctgcctgtatttccgcaatgattttatttataaccgggcatgtatttccgtcctcgtgggcctgagtgggtgcaatttcttctacagtatttgtttcctctccaagcaacaggccagccaggtcctcgtccgcaaacgccgggccaactcactcctggaggagacaaaacaagggaacttggagcgcgagtgcatcgaagagttgtgcaataaagaagaagctcgcgaggtgtttgaaaacgatcccgagactgactacttttaccccaagtacttggtctgccttcggtccttccaaactgggctgttcacagcggcccggcagtcgaccaatgcctacccagaccttaggtcctgcgtaaacgcgattcctgaccagtgcagtccactgccctgtaacgaagacgggtacatgtcctgtaaggacggaaaagcctcttttacatgtacatgcaaacctggctggcagggcgaaaagtgtgagtttgacatcaacgaatgtaaagacccaagtaatatcaatggaggttgctctcagatctgtgataacacaccggggagttatcattgctcatgcaaaaacggctttgttatgctgtcaaataaaaaagactgctag

SEQ ID NO: 130838 - DNA, 2031 bp, Artificial Sequence
  Description of Artificial Sequence: Synthetic coding sequence
atgagagtcttgggcggtcgttgtggtgctctgctggcatgtctgctgctggttttacctgtaagcgaggcgaatttccttagtaaacagcaggcatctcaggtcctcgtgaggaagcgacgggctaattcattgctggaggagaccaagcagggaaatctggaacgggagtgtatcgaggagttgtgtaataaggaggaggctagagaagttttcgagaacgaccctgagaccgactatttctatccaaaatatttagtttgtctgaggagctttcaaactggactctttacagccgcaaggcaaagtactaacgcttatccagatcttcggtcttgtgtcaacgccattcccgatcaatgctccccccttccttgcaatgaagacggctacatgtcttgcaaagacggtaaggcatcattcacgtgtacgtgcaaaccaggctggcagggggagaaatgcgagttcgatatcaacgagtgcaaggatccaagcaacatcaatggaggttgttcccagatctgtgacaacacaccaggctcatatcattgttcctgtaaaaatggatttgtaatgctgagtaacaagaaggactgcaaagacgtcgatgaatgtagcttaaagcctagcatctgcggcacagccgtgtgtaagaacattccaggggatttcgaatgcgaatgccctgagggctacaggtataaccttaaaagcaaatcatgcgaagacatcgatgaatgctccgaaaatatgtgcgcacagttgtgtgttaattacccaggtggttacacctgctactgcgatggtaaaaaaggcttcaaactagcccaggaccagaagtcctgcgaggtcgtttccgtttgcctgccacttaacctcgacaccaagtatgagctcctgtatttggctgagcagtttgccggcgtggtgctgtatctcaaatttaggctgccagagatatccagattcagtgccgagtttgattttcgcacttatgactccgaaggcgttatcctgtacgcagagtcgatcgaccatagcgcatggctgctcattgctttacggggtggaaagatcgaggtgcagttaaagaacgagcacacgtcaaagataaccacagggggggatgtcattaacaacggactctggaatatggtgtccgtggaggaacttgaacattctatcagtatcaaaattgccaaagaagctgtgatggacatcaataagcccggccccttgttcaagcctgagaatgggctcctggagactaaggtgtatttcgcaggattccctcgaaaggtcgagagtgagttgattaagcctattaatccacgactggatgggtgcatccgatcctggaatcttatgaaacagggcgcctctggaataaaggagattatccaggagaagcagaataagcactgtctagtgacggtagaaaagggcagctactatccagggtctggcatcgctcaattccacatcgactataataacgtgtcctccgctgagggatggcacgttaatgtgacacttaacattcggccaagcactggaactggagtgatgctcgctctggtctctgggaataacacagtgcccttcgcagttagcctagtagactccacttcggaaaagtcccaagacattctcctttctgtagaaaacactgtgatttaccgcatacaggcgctctcgctgtgttctgaccagcagtctcacctggagttccgggtgaaccgcaataacctggagctgagcactcctcttaaaatcgagaccatttctcacgaagacctgcagcggcaactggccgtcctcgataaggcaatgaaggccaaagtggccacctacctgggaggcctgcctgatgtcccgttctcggcaactcccgtcaatgccttctacaacggctgcatggaggtgaacataaatggtgtccagctggacttagatgaggccatctcaaaacacaatgatattcgagcacattcttgtccatcagtgtggaaaaagacaaagaactcatag

SEQ ID NO: 130839 - DNA, 1275 bp, Artificial Sequence
  Description of Artificial Sequence: Synthetic coding sequence
atggggtgcggcacatcaaaggtgttgcccgaaccacccaaggatgtgcagctcgacttggtaaaaaaggtggaaccattctctggcaccaagtctgatgtgtacaaacacttcatcacagaggtcgatagtgtggggccagtcaaggccggcttcccagcagcttcccaatatgcacacccttgcccagggccccccacggcgggccataccgagccaccatctgaaccccctagacgagcccgtgtcgctaaatacagagccaaattcgaccctcgagtcactgcaaagtacgatataaaggctttgatcgggaggggtagttttagccgagttgtccgggtggagcatagagctaccaggcagccatacgctatcaaaatgatagaaactaagtatcgagagggccgcgaagtgtgcgagagcgaactgcgagtgctgaggcgtgtccggcacgctaatattatacagctcgttgaggtgtttgagacacaggagcgggtgtacatggtcatggaactggctacgggaggcgaactattcgaccggataattgccaaggggtcattcaccgaacgggatgctacccgggtacttcagatggtcctggatggcgtaagatacctgcacgccctgggtatcactcacagggaccttaagcctgaaaatttgttgtattaccatccaggcactgattcaaagatcattatcactgattttggactggcatccgctcggaagaagggtgatgattgtctcatgaagacaacatgtgggacccccgagtacatagcaccagaggtgctcgtacgtaagccttatactaactctgtcgacatgtgggccctgggtgtgatagcctatatactcctctctggcacaatgccctttgaggacgataatcgcacccgtctctacagacagatcctcaggggcaaatacagctatagtggggaaccttggccctctgtcagtaacttggccaaggactttatcgatcgattgttaacggtggacccaggggcccgaatgaccgcacttcaggcactgaggcacccttgggtggtgagtatggccgcgtcctcctccatgaaaaatcttcatcggtctattagtcagaacctacttaaaagagctagttccagatgccaatccacaaagagcgcccagagcacaaggtcatcgcggtctacacgctcaaacaaaagtcgaagggtaagagaaagagaactgcgcgaattgaatctgagataccagcagcagtataatggctag

SEQ ID NO: 130840 - DNA, 1953 bp, Artificial Sequence
  Description of Artificial Sequence: Synthetic coding sequence
atggcgtgccgagaattcgaaatgggtcgaaaaaaatgcgagcgctattggcctctctacggagaagacccgatcacattcgcaccatttaagatcagctgtgaagacgagcaggcccgaacagattacttcatcagaactctcctgctggaatttcaaaatgaatcccgccgattataccagttccactacgtgaattggccagaccatgacgtcccatcatcattcgattctattttggacatgataagcctcatgcgcaaatatcaggagcatgaggatgtccccatctgtatccattgttccgctggctgcggaaggaccggggctatctgtgcaatagattacacatggaacttgttgaaggcaggtaagatcccagaagagttcaacgtcttcaatttgattcaagagatgcgaacacagaggcattccgcggtgcagactaaggagcagtatgagctggtccatagagctatagctcagctgtttgaaaaacagctacagttatacgagatccatggagcccagaagatagctgacggcgttaacgagatcaacacggagaacatggtgagctcgatcgagcctgaaaagcaggactccccaccccccaagcctccacgcacccgcagttgccttgtggaaggtgacgctaaggaggagatactccaaccacccgagccccatccggtccctcccattctgacaccatcaccgccttcagcctttccaacggtgaccaccgtgtggcaggataacgatcgctatcacccgaaacctgtgctccacatggtcagttctgagcaacattccgccgatctcaatcgcaattatagcaagtccactgagctgcccggaaagaacgagagcaccattgaacaaatcgataaaaagttggagagaaacctgtccttcgagataaagaaggtgccacttcaggagggacctaagtcgttcgacggaaacaccctccttaatagaggccacgcaattaaaataaaatccgcttctccttgtatagctgataaaatctccaaaccacaggagttgtcaagtgacctgaacgtgggcgatacctcgcagaattcgtgcgtcgactgctccgtcacacaatcaaacaaggttagcgtcacgcccccagaggaaagccaaaactcagacacaccccccagaccggacagactccctctggatgagaagggtcatgtgacgtggagcttccacgggccagaaaacgctatccccataccggacttatcagagggcaactcttctgatatcaattaccagacgaggaaaaccgtctctctgaccccttcgccgacaacccaggttgaaacccccgatctagtggaccacgataatacttcccccctgttcagaacccccctgagctttaccaaccctctgcacagcgatgacagtgactctgatgagaggaacagtgatggcgctgtcacccagaacaaaacaaatatctctacagccagcgccaccgtgagcgctgctacctctacagaaagtattagtacacgaaaggtcctccccatgtcaatcgcaagacataacatcgctgggaccacgcacagcggtgctgagaaggatgttgacgtttccgaagacagtcccccaccattaccagaaaggacacctgagtctttcgtgcttgcctcagagcacaacacccccgtgcggtccgagtggtccgagcttcaatcgcaagagcggtctgaacagaaaaaatccgagggcttaatcactagcgaaaatgaaaagtgtgaccaccctgctggggggattcactatgaaatgtgtatcgagtgtccacccacattctcagataagcgagagcaaatttccgagaatccaaccgaggcgactgacattggatttggcaatcgttgcggcaagccgaaggggccacgggaccctccctctgagtggacttag

SEQ ID NO: 130841 - DNA, 1062 bp, Artificial Sequence
  Description of Artificial Sequence: Synthetic coding sequence
atgagtcgctcacttgattctgcgcgcagctttctggaaagactggaggctcgcggcggcagagaaggggccgtactagcaggtgagtttagtaaaaggtgcgaaaggtattgggcccaggaacaggagcctctgcagactggtcttttctgtatcactctgattaaggagaaatggctgaacgaagatattatgctgagaacgcttaaggttaccttccagaaagagagccgttccgtctatcagttgcagtatatgtcttggcctgatcggggcgtgccatcttcacctgaccatatgctcgcaatggtggaggaagctcgcaggttacaggggagtggtcctgagcccctttgtgtccactgcagcgctgggtgcgggcggactggtgttttatgcacggttgattacgtcagacaactgctgctgacacagatgattccgcctgacttcagcctgttcgatgtagttctcaagatgcgaaaacaaaggccagcagccgttcagaccgaagagcagtacaggttcctgtatcataccgtggcccagatgttctgttccacgcttcagaacgcgagcccacattaccaaaacatcaaagagaactgcgcacctctgtacgacgatgctctgttcctccgtaccccccaagctctgctagccatacccagaccacctggaggggtcctgcggagcatcagtgtccccggcagtccaggccatgcaatggccgatacatatgctgtggtgcaaaagcgaggcgcgccggcgggtgctggctccggcacccagacgggaaccggcactggcactggggcaaggtcagccgaagaagcccctctgtacagtaaggtgacaccacgggcccagcggcccggggcccacgccgaagacgctagaggcactctccccggaagggttcctgccgaccaaagcccagctggctccggcgcctacgaggatgtagcgggcggagctcaaactggtggcctcggatttaatctgaggatcggccgtccaaagggaccaagagacccacccgccgaatggacacgcgtatag

SEQ ID NO: 130842 - DNA, 1233 bp, Artificial Sequence
  Description of Artificial Sequence: Synthetic coding sequence
atgccaacaaccatcgaaagagagttcgaggagcttgatacacagaggagatggcagcccctatatctggagatcagaaacgagtcccacgactatccccaccgcgtcgccaaatttcccgaaaatagaaatagaaaccgctaccgggatgtctctccttacgaccattctagagttaaactgcagaacgccgaaaatgactacataaatgcgtcattggtagatatcgaagaggcacagagaagctatatcttgactcaaggccccctccctaatacttgctgtcatttctggttgatggtctggcagcagaaaacaaaagcagtcgtgatgctgaaccgtatcgtcgagaaagaaagtgtaaaatgtgctcaatactggcctacagacgatcaggaaatgctgtttaaagaaacaggcttctccgtcaaactcctctcagaggacgtgaagagctattatacagttcacttgctccaacttgagaacataaactacatcgaaaatctatggatcactctgtacctgaagctcttgatgctggacgtaaaacgctctttaaagagcggcgaaacaaggaccatctctcattttcactatacgacctggccggacttcggagtgcctgagagcccagctagcttcctgaacttccttttcaaggtgcgtgaatccgggtctctaaaccctgaccacgggcccgccgtgattcattgttcagcaggcataggtagatcgggcacattctctcttgttgacacctgcttggtgctgatggagaaaggcgacgacatcaacattaaacaagtattgctgaacatgcgcaagtaccggatgggcttaatccagacccctgatcagttgcggtttagctacatggccattatcgagggtgccaaatgtattaagggcgatagcagtatccagaaaaggtggaaggagctaagcaaagaagaccttagccctgccttcgatcactcccccaacaagatcatgactgaaaaatataacggtaacaggataggcctggaggaagaaaagttgacgggggatcgatgtacgggcctgtcgtccaaaatgcaggacaccatggaagaaaattccgagtctgctctcaggaagagaatccgtgaggaccgaaaggctaccaccgctcagaaagtacaacagatgaagcaacgccttaatgagaatgagaggaaacgaaaacgccctcgactcactgacacgtag

SEQ ID NO: 130843 - DNA, 2259 bp, Artificial Sequence
  Description of Artificial Sequence: Synthetic coding sequence
atggaccagcgggagatcctccagaagttcctagatgaagcccagagcaaaaaaataacaaaggaagaattcgcaaatgaatttctgaagctcaagaggcagtccaccaaatataaggccgacaagacgtatcctacgactgtagctgagaagcctaagaatatcaaaaaaaatagatacaaagatattttgccatacgattattcacgcgtcgaactgtcgctgatcacatctgacgaagactcctcctacattaacgccaactttatcaagggcgtctacggacctaaagcttacattgccacacagggcccgctctctaccaccctgctcgacttttggagaatgatctgggaatattctgtcctgatcatcgtgatggcctgcatggagtacgaaatgggaaaaaaaaagtgcgagagatactgggccgagccgggcgaaatgcagttagaatttggtcctttctcagtatcctgcgaggctgaaaagcgaaaatctgattatatcatccgaacactcaaggttaagtttaacagtgagactcgcacgatttaccagtttcactacaagaactggccggatcatgacgtacccagctccattgatcccattcttgaactcatatgggatgtgaggtgttatcaagaagacgatagcgttccaatctgcattcactgctccgcaggctgcggaaggacgggcgtcatctgcgcaatagactatacctggatgctcttgaaggacgggagccaagcaaaacactgtattcctgagaagaatcacacccttcaggcagattcttactcccccaacctccccaaaagcactacaaaagctgcgaagatgatgaaccagcagagaacgaagatggagatcaaggagagctcatcttttgacttccgcacttcagagatcagtgctaaggaggaactcgtgttgcacccagcaaagagctctacttcatttgactttctggagctgaactactcttttgacaagaacgccgataccactatgaagtggcagaccaaggctttccccattgtcggcgagcctcttcagaaacaccagtccctcgacttaggttctctactctttgaaggttgttcaaattctaaaccggtgaatgccgccggtaggtatttcaacagtaaagtcccgatcacccgcaccaaaagtaccccttttgaattaattcagcagcgggagaccaaggaggtggactctaaggaaaacttctcctatctagagagtcaaccccatgattcctgtttcgtggagatgcaggctcagaaggtgatgcatgtctctagcgctgaattaaattattcgttgccctacgatagcaaacaccagatccggaatgccagcaatgtcaaacatcacgatagcagtgcattgggcgtttactcttacatcccgctggtggaaaacccctacttttcttcatggcccccgtctggcacatcaagtaaaatgtcactcgatctgcccgaaaaacaagatggaaccgtatttccctccagccttctgcctacttcttccaccagtcttttcagctactacaattcacacgactcgttgtccctcaattctcctacgaacatttcctccctcctgaaccaggagagcgcagtgctggcaacggccccaaggattgatgatgaaatcccccccccactgccagtgtggacacccgagagttttattgtggtggaagaagccggtgaattttcgccaaatgtacctaaatcgcttagctccgctgtcaaggtgaagatcggaaccagcttggagtggggcggtactagcgagcccaaaaaatttgacgactcagttattctcaggccatcaaagagcgtgaaattgcgatcccccaaaagtgaacttcatcaggatcgcagctcaccccctccccctctccccgagcggacattagagtcttttttccttgccgacgaggactgtatgcaggctcagagcattgagacgtactcaactagttatcccgacacaatggaaaactctacaagctctaaacagactctaaagaccccaggcaagtcgttcactcggtcaaagagcttaaaaatcttgcgcaatatgaaaaaatcgatttgtaattcctgtcccccgaacaagcctgcagaatcagttcaatcaaacaactccagctcttttctcaatttcgggttcgccaatcgtttcagcaaaccaaaaggccctcggaaccctcctcctacctggaacatttag

SEQ ID NO: 130844 - DNA, 5724 bp, Artificial Sequence
  Description of Artificial Sequence: Synthetic coding sequence
atgttgtcacatggtgcggggctggctttatggatcactctgtccctgctgcaaacgggcctcgccgaaccggagcgctgcaactttactctggccgagtctaaggcttcttctcattccgtttcaattcaatggagaatcctcggatccccctgcaatttcagcctgatatattcctctgataccctgggggctgccttgtgccctacctttcgtatcgacaataccacctatggatgcaatctgcaagatctccaggctggaacgatctacaattttcgcatcatcagtttggacgaagagcggactgttgtgcttcagactgatcctctgccccccgccaggtttggcgtgtccaaggagaagacgacctccacctccctccatgtgtggtggacaccttccagcggcaaggtgacgtcttacgaggttcagttattcgacgaaaacaaccagaaaattcaaggcgtgcagatacaagaatccacaagttggaatgagtacactttctttaacctgactgcagggagtaaatataacatcgcaataacagctgtcagcggaggcaaacggtccttcagtgtttacaccaacgggagtactgtgcccagccccgtgaaagatatcggaatttccacaaaagcaaatagcttgctcattagctggagtcacgggtccggaaacgtcgaaaggtataggttgatgctgatggataaaggtatccttgttcacggaggggtagtcgacaagcatgctacatcctacgccttccacggcctgacccccggttacctgtacaacctgaccgtcatgactgaggcagcggggcttcaaaactacaggtggaaacttgtgcgaacagcccctatggaggttagcaacctaaaggtcacaaatgatggcagcctcactagtctgaaggtcaaatggcagcgcccaccgggaaatgttgattcatacaatataacgctgagtcacaaggggactattaaagaatctcgcgttctcgctccatggattacagagactcatttcaaggagttggtgcctggtcggctgtatcaggtgacagtcagctgtgtgtccggggaattgagtgcccagaaaatggctgtgggccggaccttccctgataaggtggccaacctggaagccaacaacaacggccggatgcgcagtctggtggtgagttggtccccccccgccggtgattgggagcagtacaggatccttttgtttaacgactcagtcgtcctcctcaatataacagttggaaaagaagagacccagtacgttatggatgacacagggctggttcctggtaggcagtacgaagtagaagttatagtggaaagtggaaatctcaaaaacagcgagagatgtcagggcaggaccgtgcctttggccgtgctgcagctccgggttaaacacgcaaacgaaacttcactcagcatcatgtggcaaacacctgtggctgagtgggagaagtatatcatcagcctggctgaccgggatctgctcttgattcataaaagcctgtccaaagacgctaaggaatttacatttactgatctggtacccgggagaaagtacatggccacggttacaagcatcagtggagaccttaaaaatagttcctcagtaaagggaaggaccgtgccggcacaggtgacagatctccacgtggccaaccaagggatgacatcatcactcttcacaaactggacacaggctcaaggcgatgtcgagttctatcaggtgctgcttatccatgaaaacgttgttataaagaatgaaagcatcagcagcgaaacctcaaggtacagctttcacagtttgaagagcgggagcctgtacagcgtagtcgtcacgacagtaagcggcggcatctctagtcggcaagtagttgtagaaggccgcacagtaccatcatctgtgtccggggttacggttaataacagcggacgtaacgattacttaagcgtgagctggcttctcgcccctggagacgtcgacaattatgaagtcaccctgtcgcacgatggcaaggttgtacaatccctggtaatagccaagagtgtgcgggagtgctctttctcctcactgacacctgggcgtctgtatactgttactatcactacccgcagcgggaaatacgagaatcacagcttctcacaggagaggaccgttcctgacaaagttcagggagtgtctgttagcaactccgctcgaagtgactatctgcgggtgagctgggtgcatgcaacaggcgacttcgatcattacgaggtgaccatcaagaacaagaacaactttatccagactaagtcgatccccaagtccgagaacgaatgcgtcttcgtacagctagtgcctggcaggctctactccgtgactgtgacgaccaagagcggtcagtatgaagcgaatgaacaagggaatggacgtactattccagaaccagtgaaagatcttacactaaggaaccggagcaccgaagacctccacgtgacttggtcaggggcaaacggggatgtcgaccagtatgaaatacagctcctgttcaacgatatgaaggtcttccccccgttccaccttgtgaataccgctaccgaatatagatttacctccctcactcctgggcgtcagtataagatccttgttctaacaatttccggggacgttcagcagtctgcttttattgaaggctttacagtacctagcgcagtgaagaatatccatataagccctaacggtgcaacagactctcttactgtgaactggactcctggaggaggcgacgtcgattcctataccgtgagcgcctttagacacagccagaaagttgattctcagaccattcccaaacacgtgtttgagcacacatttcataggttagaagcaggcgaacagtatcagattatgattgcctctgtctccggatccctcaagaatcagataaatgtcgtgggacgtacagtccctgctgccgtcaccgacctgcggatcaccgagaattctacgcggcacctgtcttttcggtggactgcaagtgaaggggagctgtcctggtataacatctttttatacaatccagatggtaacttgcaggagcgggcgcaggtggatccactggtgcaaagtttcagttttcagaacttgttacaaggaaggatgtacaagatggtgatcgtgacacatagtggcgaacttagcaatgagtccttcatattcgggcgcacggtgcccgctagcgtatcacaccttaggggcagtaatcgaaacactactgactccttgtggttcaactggagcccggcatcaggcgactttgatttctatgaactgattctctacaatcccaatggcactaagaaggaaaactggaaggataaggatctgacggaatggaggtttcaaggactggttcctggacggaagtacgtcctctgggtcgtcactcactccggggatctgagcaataaggttacagccgagtcacgaaccgcacctagtcctccatctttgatgtcatttgctgacatcgccaacacctctttggctatcacctggaaaggccccccagattggacagactacaacgatttcgaactccagtggctgcctcgtgacgctctcaccgttttcaacccctacaacaaccggaaatcggagggccgtattgtttatggtctgagaccgggccgtagttaccagttcaacgtgaagacggtgagcggggactcatggaaaacctattctaaacccatcttcggcagcgtccgcactaaaccggataagatccagaacctgcactgcagacctcaaaatagtacggctattgcctgctcatggatccctcctgactccgactttgacggctactcgattgaatgtcggaagatggacacccaggaggtggaattcagtagaaaattagagaaagagaagagtctgctgaatataatgatgctggtcccccataagcgttacctcgtgtccatcaaagtgcagtcggctggaatgacctctgaagtggtggaggattcaacaatcactatgatcgatcgaccacccccgccaccaccgcacatacgcgtgaatgagaaggacgttctcatttcaaaaagttctatcaatttcacggttaattgtagttggttctctgatacaaacggcgctgtcaagtactttaccgtggtggtgagggaggctgatggatcagacgaactcaaacctgagcagcagcatccactcccgagttatttggagtatcgacacaacgcgtcgatcagggtttaccaaaccaactactttgcctcaaagtgcgccgagaatccaaactccaattccaaatccttcaatataaagcttggagccgaaatggagtccctggggggaaaatgtgatcctactcaacagaagttctgcgatggacccctgaaaccccacaccgcctacaggatctcaattcgagccttcacacaactttttgatgaggacctgaaggagttcaccaagcccctgtattcagacaccttctttagtctgcctatcacaacagagtccgagccactttttggggccattgagggcgtatccgccggactctttttaatcggcatgttagtagctgtggttgccctactcatatgccgccaaaaagtgtcccacggccgagagaggccaagcgccagactgagcatccggagagacaggccgctaagtgtgcacttgaacctggggcaaaagggtaaccgaaaaaccagctgccccattaaaattaatcagtttgagggtcacttcatgaaactgcaggctgacagtaactatctattgtccaaggagtatgaagaactgaaggacgtcggccgaaaccagtcatgcgacatcgctctgctcccggagaaccgcggcaagaataggtataacaacattctgccctatgacgccaccagagtgaagttgtcgaacgtcgatgacgatccatgcagcgactatattaatgcttcttacattccgggcaacaattttcgccgggaatatatcgtcacacagggacccctccctggcaccaaagacgatttttggaagatggtttgggaacagaacgtccacaatatcgtcatggttacccagtgcgtcgagaagggacgagtgaagtgcgaccactattggcccgcagatcaggacagtctctactacggcgacctgatcttacagatgctcagcgaatccgtactacccgaatggactatcagggagttcaagatctgtggagaagaacaattagacgcgcaccgtttgatccggcacttccattacaccgtctggccggatcacggcgtgcccgaaaccacacagagcctgatccagttcgtgcgcactgtgagggactacattaatcgctcccccggggctgggccaaccgtcgttcactgttccgcaggggtcggcagaacagggacttttattgctctcgacagaatcttacagcagttggacagcaaagatagcgttgatatttatggcgccgtacacgatttaaggttgcatcgagtgcacatggtccagacagagtgccagtatgtttatttacatcagtgcgttcgcgacgtactgcgcgcacggaaactgcggtctgaacaagagaatccactctttccaatctacgagaatgtcaaccccgagtaccaccgggaccccgtgtacagtcggcattag

SEQ ID NO: 130845 - DNA, 4518 bp, Artificial Sequence
  Description of Artificial Sequence: Synthetic coding sequence
atggtgcatgtggccaggctcctgctcttattgctgaccttttttctgcgcaccgacgccgaaacgccacccagattcacgcgcactcctgtggatcagaccggcgttagtgggggtgtagcgtcattcatatgccaggccacaggcgacccacggccaaaaatcgtttggaataaaaaagggaagaaggtcagtaaccagcgttttgaggtcatagaatttgacgacgggtcgggttcagtgcttcgcattcagccgctccgaactccccgagatgaggccatctatgaatgcgtagcatcaaataatgtcggcgaaattagcgtttcaacaagactgactgtgttacgtgaagaccagatcccacgcggatttccaacaattgacatgggcccccagctcaaggttgtagagcggacccgcacggcaacgatgctctgtgccgcgagtggcaacccagaccctgagattacctggttcaaggatttcctccccgtcgacaccagcaataacaatggcagaataaagcaactgaggagcgagtccattggagctttacaaattgaacagagcgaggagtccgaccagggaaaatacgagtgtgtcgccaccaatagtgctggcacgcgatatagcgccccggctaacctgtatgtccgtgtccgcagagtcccccctcgcttttctatcccccccacaaaccacgaaataatgcctggaggttctgtgaacatcacctgcgtggctgttggctccccgatgccgtacgttaagtggatgcttggggctgaagacctgaccccggaagatgacatgccaataggccgtaatgtactcgaactgaacgacgtgcggcaatccgcaaattatacctgtgtggctatgtccacactcggtgtgatagaagctatagcccaaatcaccgttaaagcactgcctaagccccccgggacccccgtagtgactgaaagcactgcgaccagtataactctgacctgggacagcggcaaccccgagccagtgagttactacataatccagcacaagcctaagaatagtgaagagttgtataaagagatagacggagtggcaaccacccgctattctgtggcggggttaagtccctatagcgactatgagttccgcgtcgtcgcagtaaacaacatcggccgaggtcccccttctgaaccagtgctgactcagacttccgaacaagctccaagctcggcaccgagagacgtacaggcacggatgttatccagtacaaccattcttgtgcaatggaaggaacctgaggagcctaacggccaaatacagggctaccgagtatattatacaatggatccaactcagcatgtgaataattggatgaaacataatgttgccgattcgcagataaccaccataggaaatctggtaccccaaaaaacctacagtgtgaaggtgctagctttcacctccattggggacggcccactatctagcgacatccaggtcatcacacagacaggcgtgccagggcagcctctgaacttcaaagctgaaccagaaagtgaaacatccatactgcttagttggactccaccccggtcagatactattgccaactatgagctcgtttataaggatggtgaacacggggaagagcagcgcatcactatcgaaccaggcactagttatcgacttcagggtctcaaaccaaatagtttgtactactttcgactggccgctcgttcacctcagggacttggcgcgtcaacggctgaaatcagtgctcggaccatgcagagtatgttcgccaagaatttccacgtgaaagccgtgatgaagacatcggtacttctcagctgggagattcctgagaattataactcggccatgccctttaagatcctctacgacgatggtaaaatggtcgaggaagtcgacggaagggccacacagaagttgatagttaacttgaagcctgagaagtcctacagtttcgtattgacaaatagagggaactctgctgggggcctgcagcatcgggttaccgcgaagaccgcccccgacgtgttgcggaccaagcccgcattcatcgggaagactaaccttgatggcatgattactgtgcagctgcctgaagttccggcaaacgagaatataaaaggttattacatcatcatagtgccgttgaaaaaaagccgcggaaagtttattaagccctgggaatcccccgacgagatggagctcgatgagctgttgaaggagatatctaggaaaagaaggtcaataaggtacgggcgcgaagtagagctgaagccatacatagcagctcatttcgatgtgctccctaccgagtttaccctgggggacgataagcattatggagggttcaccaacaagcagctgcaaagcgggcaggagtatgtgttcttcgtactagctgtgatggagcacgccgagtcaaaaatgtatgcaacttccccctactcggaccccgtggtatccatggatttagatccccagccaatcaccgacgaagaggagggactaatttgggtcgtgggacctgtgctggcagtggtgttcattatttgcattgtgatcgcaattttgctctacaagaggaaacgagccgaatctgactccagaaaaagcagtattccgaacaacaaagagatcccatcacaccacccaacagaccccgttgaactgagacgtctcaattttcagacccccggttctgatgacagcggatatcctggcaatttgcactctagctcaatggcctcacatccccctattcccattttggagcttgccgaccatattgagagattaaaggcaaacgataatctgaaattctcccaagaatacgagtccattgatccagggcaacagttcacctgggagcattccaacctggaagtcaacaagcccaaaaaccgctatgccaacgtgatcgcgtacgatcactcacgagtgcttctgtccgccattgaaggcattcccggaagcgattatgtcaatgccaactacattgatgggtacagaaagcagaacgcttacattgcaacacagggtagtctacctgaaacgttcggagatttttggaggatgatatgggagcagaggtccgcaacagttgtaatgatgacgaaactcgaggagagatccagggttaagtgcgatcagtattggccttcccgaggtactgaaacccatggactggttcaggtgaccctgcttgacaccgtggagttggccacctactgcgtgagaacgttcgcgttgtataagaatgggagctccgagaagagggaagtaaggcagttccagtttactgcctggcccgatcatggagtcccggagcacccgacaccttttctggcctttctccggagggtcaagacttgtaatcctcctgatgcaggtcccatggttgtgcactgctcggccggtgttggcaggactggttgtttcatcgtaatcgacgctatgcttgagcgtattaaacatgaaaaaacagtggacatctacggccatgtcactttgatgcgggctcaacgcaattatatggtgcagaccgaagaccagtatatctttatccacgatgccctgttggaggcagtaacctgtggtaacacagaagtgccagcccggaacctatacgcctacattcagaagctgacccaaatcgagaccggcgagaacgtgaccggcatggagttagaatttaaacggctagcctcttcaaaagctcatacttctcgattcatttctgcaaacctcccttgcaataaattcaagaatcgtctcgtaaatatcatgccatatgaatccacgagggtatgtttacagccaattaggggggtggaggggtctgactacatcaacgcatcatttattgatggatacagacagcagaaggcatatatcgcaacccaggggccattggcagagactaccgaagacttttggcgaatgctttgggagcataactcgaccattgtggtgatgctgaccaaactcagggagatgggtagggagaaatgccaccagtactggcctgccgaacggtctgcccggtaccagtatttcgttgtggatccaatggctgagtacaatatgccccagtacatcctcagagagttcaaagtaaccgacgcacgcgacgggcagtcccgtacagtgcgccagttccagtttactgattggcccgaacaaggggtccctaagagcggcgagggcttcatcgatttcatcggtcaggtgcacaagactaaggagcagttcgggcaagacggtccaattagtgttcactgttccgccggagtagggagaactggagttttcatcaccctgtcaatagtcctagaaaggatgcgctacgagggggtggttgacattttccagacagtcaaaatgctgcggacccagagacccgcaatggtacagacagaagatcagtaccagttctcttatcgcgcagctctcgaatatttggggagcttcgaccattatgctacttag

SEQ ID NO: 130846 - DNA, 4398 bp, Artificial Sequence
  Description of Artificial Sequence: Synthetic coding sequence
atgaggggattaggcacatgtttggccacgctggcaggactcctgctgaccgcagcaggagagaccttctcaggtggctgcctgttcgatgaaccttattcaacctgcggatattcccagagtgagggggacgattttaattgggagcaggtgaatactctgaccaagccgacatcagacccctggatgccctcgggatccttcatgctggtgaatgcctctggcagacccgaggggcaacgcgcccaccttctcctccctcagcttaaggaaaatgatacccactgtatcgatttccactacttcgtctcatctaaaagcaatagcccgcctggcctgctgaacgtttatgttaaggttaataacggacctcttggaaaccccatctggaatatctcgggggaccccacaagaacttggaacagagctgagcttgctatcagcacgttctggccaaacttttaccaggtgatttttgaggtgatcacctctggccaccagggctacctggccatagacgaggtgaaggtcttaggtcacccatgcacacgaacgccccatttcctgcgtattcaaaacgtggaagttaatgccgggcaatttgcaacttttcaatgttccgctattggccgcacagttgccggcgatagattgtggctgcagggtatagacgtgcgtgacgccccactaaaggagattaaggtcacctcttcaagaaggtttatcgcttcattcaatgtggtgaataccacaaaacgagatgcgggtaagtataggtgtatgattcgtaccgagggaggagtgggcatttccaattatgcagaactggtcgttaaggagccacccgtccctattgcaccaccccagctcgctagcgtcggcgccacgtatctgtggattcagttaaatgctaattcaatcaacggcgacggtcccattgtcgccagagaggtggaatactgtacagcgtccggctcgtggaatgatcggcagcctgttgactccactagttacaagatcggtcatctggaccctgataccgaatatgagatatcagtactattgactcggccgggcgagggggggacgggaagcccaggccccgccctaagaaccagaactaaatgcgctgaccctatgagagggcctcgcaaactggaggtggtggaagtcaagagcaggcagattaccataagatgggagccgtttggctataacgtcacccggtgtcatagctacaatctcaccgttcactactgctaccaagtaggcggtcaggagcaggtgagggaggaagtgtcttgggacacagagaactcccatcctcagcataccattaccaacttatccccgtacaccaacgtctccgtcaagctgatcctgatgaatcccgaaggtcggaaagaatctcaggaactgattgtgcagaccgacgaggacctcccgggagctgttccaacagaatccatacaggggagtacttttgaagagaagatcttcctgcaatggcgggagccaactcagacatacggtgtcattaccctgtatgaaatcacctacaaagctgtatcgagtttcgacccagagattgatttatccaaccaaagcggccgcgtaagtaagctgggtaacgagacccactttctgttcttcgggttgtaccccggaaccacctacagcttcaccattagagccagtaccgcgaaaggtttcgggccaccggcaacaaatcagtttacaacaaagatttctgcccccagcatgccagcctacgagctggaaacaccgctcaatcagaccgacaacacggttacagtgatgctgaagcctgcacattccaggggtgcacctgtgtctgtgtatcaaatagtcgtcgaggaagagagaccccgtcggactaagaagactacggagattttgaaatgctaccctgtaccaattcacttccagaacgcatctctgttgaattcccagtattatttcgctgcagaattcccagcggactctctccaggcggcgcaacccttcaccatcggcgataataagacatataatggctattggaacacccctctgctcccttataagagctatcggatttacttccaggccgccagcagagctaacggtgagaccaaaatagactgcgtgcaagtggcaaccaagggcgctgctactcccaaacccgttcccgagccagagaagcaaactgatcatactgtaaaaatcgcgggggttatcgccgggattcttctgttcgtcatcatcttcttaggcgtggttctggtcatgaaaaagcggaagcttgctaaaaagagaaaagaaaccatgtcttcaacaagacaggaaatgacagtgatggtcaattctatggataaaagttacgccgaacagggaacaaattgtgatgaagcctttagttttatggacacacacaatctcaacgggcgatccgtgtcatccccctcctcgttcaccatgaagacaaacacgctgtccacctctgtgcccaactcctattaccccgatccatttgtccccactgcaattctggttcctatcaatgacgagacccacacgatggcatcagacactagttccctggtccaatcacatacctacaaaaaaagggaacccgctgatgtgccataccaaacaggccagctgcaccccgccattagagttgccgatctcttacagcacatcactcagatgaaatgcgcagagggttatggctttaaggaagagtatgaatctttttttgaaggacagtcagcgccttgggatagtgccaagaaagacgagaatcgcatgaaaaacaggtatggcaacatcatcgcgtacgaccatagtagagttcggctgcagaccatcgagggcgatacaaacagcgactacatcaatggtaattatattgacggatatcatcggccaaaccactacattgctacacaaggtcccatgcaggagaccatttatgacttttggaggatggtgtggcatgaaaataccgcctccatcatcatggtaaccaacctggtggaggtgggtagggtaaaatgttgcaaatattggcctgacgacactgagatctataaggatatcaaagtgacgcttatcgagactgagctgctggcagagtacgtgatccggaccttcgccgtggagaagcgcggggtacacgaaatccgcgaaatccgccagtttcacttcacagggtggcctgaccatggagtgccctatcatgcaacagggctcttgggcttcgtgcgtcaggttaagtctaagtccccaccgagtgcaggacctcttgtggtgcattgttcagcgggagctggacggactggttgcttcatcgtgattgacatcatgcttgatatggccgagagagaaggtgtagtggacatctataattgcgtaagggagctgcgctccaggcgggtaaatatggtccagactgaagagcagtacgtgttcattcacgacgcaatccttgaggcctgtctctgcggggacacaagcgtcccagcctcccaggtgcggtccctgtactacgacatgaataaactcgatcctcaaaccaactctagtcagatcaaagaggagtttcggacactcaacatggtgactcctactctccgagtggaagactgctcgatagcactgctaccccgcaatcatgagaaaaatcggtgtatggacatcctgcccccagatcggtgcctgcctttccttatcaccatcgatggcgaaagctctaactacatcaatgccgccctcatggactcctataaacagccatcagctttcattgtcactcagcatcctttgcctaacactgtgaaggatttctggcgcttggttctggattaccattgcacctcggtcgtgatgttgaatgatgttgacccggcacagctgtgtccacagtactggcctgagaacggggtccatcggcatggacccattcaagtggagtttgtgagtgccgatttagaggaagatattatatcccggatttttcgtatttataacgctgctcggccgcaagacgggtacaggatggtgcagcagtttcagtttctaggctggccgatgtacagggacacacctgtttctaagaggagctttctcaaactaatcaggcaagtggacaaatggcaagaagaatataatggtggtgaaggcaggaccgttgtgcactgtctcaacgggggcgggagaagtggtacattttgcgcaataagcattgtttgtgagatgctgcgtcaccagcgcaccgtggacgtgtttcacgctgtgaagacactgcgaaataataagcccaacatggtggaccttctcgaccaatacaagttttgctatgaggtagccctcgaatacctcaatagtgggtag

SEQ ID NO: 130847 - DNA, 4323 bp, Artificial Sequence
  Description of Artificial Sequence: Synthetic coding sequence
atggcacgagctcaggctctggtgctcgcccttacttttcagctctgcgccccagagactgaaacccctgccgccggctgtacattcgaggaagcttccgatccagccgtcccatgtgagtactcccaggctcagtacgatgattttcaatgggagcaggtacgaatccatccagggacacgtgctccagccgatctcccgcacggcagttatcttatggtgaacacatctcagcatgctccaggccagagggcacatgtcattttccagagtctgtccgagaacgatacccattgtgtgcagttcagctacttcctgtacagcagagatggtcatagcccaggtacacttggtgtgtacgttagagttaatggaggacctctgggctcggctgtgtggaacatgactggctcccacggcagacagtggcatcaggcagaacttgcagtgtcaaccttctggcccaatgagtatcaagtactcttcgaagccctgattagccccgatcggcgcggctacatggggctggacgacattcttcttctttcatatccctgcgccaaggctccacatttttcccggttgggcgacgtggaagttaacgctggccagaatgccagctttcaatgtatggccgcagggagagcagcagaggcagagaggttcttgttgcagaggcaatctggcgctcttgtcccggctgccggggttcggcatatcagtcaccgacggttcctcgcaaccttcccgctcgccgcagtctcaagagcagagcaagacctttaccggtgtgtatcacaggcaccaaggggcgccggagtatccaactttgcagaactcatcgtaaaagagccgccaacacctattgctccaccccagctgcttagggcaggacctacctatttgattatccagctcaatacgaactctattatcggcgacggccccatcgttcgaaaagagatcgagtaccgcatggcgcgaggaccttgggccgaagtgcacgctgtttcactccagacctacaagttatggcacttggatcctgacactgaatatgagataagtgtgttgctgaccaggcccggtgacggcgggactggtcgaccgggccccccccttatctcccggaccaagtgtgctgagccaatgcgggcacccaagggcctggcctttgccgaaatacaggcccgacagctcacactgcagtgggagccgctcggctataatgttacacgctgtcacacatacaccgtgtcactgtgctaccactacactctcgggtcttctcacaaccaaactattcgtgagtgcgtaaagaccgagcagggcgtgagccgatatactataaagaacctactgccatatcgcaatgtgcacgtgcgtctagttctcacaaaccccgaggggcgaaaagaggggaaggaggttacatttcagacagacgaggacgtcccttccgggatcgccgcggaaagcctcacatttacccccttggaggatatgatattcctaaaatgggaagagccacaggagccgaacgggttaattacacaatacgaaatcagttatcagtctatagagagttctgacccggctgtgaacgtgcctggcccaagacggacaatctctaaacttcgaaatgagacctatcatgtcttctccaacctgcatccaggaacaacttacctcttttctgtacgcgccagaaccggaaagggcttcggtcaggctgcgcttacagaaattactaccaacatttctgccccctccttcgactatgccgatatgccgtcccctctgggtgaaagcgagaacactattacggtactgcttaggccagctcagggtcgcggagcgcccatcagcgtgtaccaggtcattgtggaggaagagagggctcgcaggctgcggcgggagccgggtggccaggactgttttccagtgcccttgacgtttgaggctgcgctggctagaggcctcgtccactatttcggggccgagctcgccgcctcctctctgcccgaggctatgcctttcaccgtcggggacaatcagacctaccgaggcttctggaacccaccgctagagccaagaaaggcttacctgatctacttccaggccgcctcccatctgaaaggagagactagactgaactgcattagaattgcaaggaaagccgcttgtaaggagtccaaaaggcctctggaagtatctcagagaagtgaagaaatgggtttgatcctggggatttgcgccggggggttagctgtgttaatcttgttgctaggtgccatcattgtaattatcagaaaagggaagcccgtgaacatgacaaaggcaacggtgaattataggcaggaaaagacacacatgatgagcgccgtggaccgcagctttaccgatcagagcacactacaggaagacgagcgcctgggcctgagcttcatggacacgcatggatatagcactaggggagaccagcggtccggaggggtgactgaggctagttcattgctgggtggaagccctcgccggccatgtggacgcaaggggagcccgtatcacacagggcaattacaccccgccgtcagggtcgctgacctgttgcagcatattaatcagatgaaaactgccgaaggctatgggtttaagcaagaatacgagtccttcttcgagggatgggacgccactaagaagaaggataaggtaaagggaagtcgacaggaacccatgcctgcgtacgaccgacacagagttaaacttcatcccatgctcggcgacccgaacgccgactacataaacgccaattacatagacatccgtatcaatcgagaggggtaccacagatccaaccactttattgctacacagggtccaaagccagagatggtttacgatttttggagaatggtttggcaagagcattgtagctccattgttatgatcaccaagctggtggaagtaggtcgggtcaagtgcagccgatattggccagaagattccgatacctacggagatatcaagatcatgttagttaaaactgaaacactggctgagtacgtggtgcgcactttcgccttggaacgacggggatactccgccagacacgaagttaggcagttccatttcaccgcttggccggaacacggcgttccttaccacgccaccggcctgctcgcctttatcaggcgagtcaaagcctctaccccacccgacgctgggccaatcgtcattcactgttctgcgggtaccggtagaaccgggtgctatatcgtactcgatgtgatgcttgacatggcagagtgcgaaggggtagtggacatttacaactgcgttaagacattgtgtagtaggcgagtgaatatgattcagacagaagagcagtatatctttatccatgacgcgatcctcgaagcttgtctttgcggagagaccacgatccctgttagtgagtttaaagccacttacaaagagatgatcagaatcgatccacaaagtaattcttcacagctgagagaagaattccagaccttgaacagtgtgaccccaccccttgacgttgaggaatgctctattgccctcttgccccgaaaccgggataagaaccgctcaatggatgtgctcccccccgatcgttgcctcccgttcctgatctccaccgatggcgactctaacaattatattaatgcggccctgactgattcctatacgagaagcgccgcttttatcgtgaccctgcatccacttcagtcaacgactccagatttctggcggctggtgtatgattacggttgtactagcatcgtgatgctgaatcaattgaatcagtccaatagtgcctggccttgtttgcagtattggccagagcccggtagacagcagtatggcctaatggaggtggaatttatgagcgggacagccgacgaagatctcgtcgctcgcgttttcagagttcagaacatttccagggagggccatctcctcgtccgccattttcagtttctccgctggagtgcttaccgggacactcctgattccaagaaagctttccttcatttgcttgcagaggttgacaaatggcaggcagagtccggtgacggccgaaccatcgtgcattgtctcaacggtggcgggaggtccggcacattttgcgcctgtgctactgtgctggagatgatccgctgccacaatctcgtcgacgtgttcttcgctgccaagaccctcagaaactacaagcccaatatggtggaaacaatggatcagtaccacttctgctacgacgtggctcttgagtacctggagggtttggagtctcgttag

SEQ ID NO: 130848 - DNA, 4347 bp, Artificial Sequence
  Description of Artificial Sequence: Synthetic coding sequence
atgcgaatcctgaaacgctttttagcttgtatccagctgctgtgtgtttgcaggctcgattgggcgaatggctactacagacaacagcggaaactcgttgaggaaatcggatggagctataccggtgccctgaaccaaaagaattggggaaagaaatacccaacctgcaattcaccaaagcagtctcccataaatattgacgaagacctgacgcaggtgaacgtcaacctcaagaaattgaaatttcagggctgggacaagacctctctggagaatactttcatccacaatactggaaaaacagtcgagatcaatctcacaaatgattatagagtaagtggaggcgtgtcagaaatggtgtttaaggcaagtaaaataacttttcactggggaaagtgcaatatgtcatcggacggctctgagcatagtctagaggggcaaaagttccccttggagatgcaaatctactgcttcgatgctgatagattcagcagctttgaagaagcggtgaaggggaaggggaaactgagagccttgagtatcttgtttgaagtcggaaccgaggagaaccttgacttcaaggccatcattgatggcgtagaatccgtgagcagattcgggaagcaagccgccctggaccccttcattctgctgaatctcctgccaaactccaccgataaatactatatttataatggaagcctcacatcaccgccctgtaccgacaccgttgactggattgtgttcaaagacacagtgtccatctccgagtctcagctggcagtattctgcgaggtcctcacaatgcagcagtctggatacgtgatgctaatggattatttacaaaataactttagggaacagcagtataagttttcaaggcaagtctttagcagctataccggaaaggaagagatccacgaagccgtgtgctccagtgagccagaaaatgtacaggccgatccggagaactacacttctttgctcgtgacatgggagcgccctcgcgtggtctatgatactatgattgaaaagtttgctgtgctataccaacagctggacggcgaggaccagacaaagcatgaattcctgaccgacgggtatcaggatctaggggctattcttaataacctcctgcccaacatgtcctacgtattgcaaatcgttgctatctgtaccaatggcctgtacggaaaatacagtgaccagctaatagtggacatgcctactgacaacccagaacttgatctgtttcccgaattgatcggaacggaggagatcatcaaagaagaagaggagggcaaggatattgaggagggtgctatagtcaatcctggccgtgactcagccactaaccaaattaggaagaaggaaccccaaattagtaccacaacacactacaaccgaattgggactaaatataacgaggccaagacaaacagatcaccaacaagaggaagcgaattcagtgggaaaggggacgtgccgaatacttccctgaactcaacctcacagcccgttacaaaactcgcaaccgagaaagacatcagtctcacttctcaaaccgtcactgagctgcctccgcatacagtagagggcacctccgctagtctgaacgacggcagcaaaactgtacttagaagtccccatatgaacttgagtgggactgccgagagcctcaacacagtgtcaatcactgagtatgaagaagaatctcttctcacttcgtttaagcttgacacgggggcagaagattcatcaggcagtagtcccgcgacttccgccattcccttcatctccgagaacatctcacaggggtacattttctcctctgaaaatccggaaaccatcacatatgatgtactcatccccgagtctgcgcgcaacgctagtgaggatagcacatcttcagggtccgaggagtccctgaaggatccttctatggagggtaacgtatggttcccaagctctacagatatcactgctcaacccgatgtgggaagcggtcgggaatctttcctccagaccaactacacagagatcagagtcgatgagtcagagaaaacaaccaagagcttcagcgcgggtcccgtgatgagccaagggccaagtgttaccgatctcgagatgccgcactatagtactttcgcctacttccctacagaggtgacaccccacgctttcactcccagctcacgacagcaggacctcgtgtcgaccgtaaatgtggtctatagtcaaactacacagcctgtgtataacgaagcctctaattcttctcacgagtcaaggattggcctggctgagggcctggaatccgaaaagaaggccgtgattccactcgtaatagtctccgctcttactttcatatgtctggtagtcctggtcggaattctgatctactggagaaagtgctttcaaaccgctcatttctatcttgaggacagcaccagcccgcgcgtcatctccaccccaccaaccccaattttccccatctcagatgatgtaggtgccatacccataaaacatttcccgaaacacgtggctgacttacacgcaagttccgggtttactgaagaattcgaagaggtccagtcatgtactgtcgacttaggcatcactgcagactcatccaatcatcccgataataaacacaaaaaccgttatatcaatatcgtcgcttacgaccacagtagggtcaagctagcccagctagccgagaaggatggtaaattaacagattacatcaatgcaaactacgtggatggatacaataggcccaaagcctacatcgctgcccagggacctctcaagtccaccgctgaggatttctggagaatgatctgggaacataacgtagaagtcattgtgatgatcacgaatttagtggaaaaaggcagacgcaagtgtgaccagtattggcccgctgatggcagcgaggagtatggcaacttcctggtcacacaaaaaagtgtccaggtgcttgcctattatacggtccggaattttaccctgcgtaatacaaagattaagaagggttcacaaaaagggcgcccatctggccgggtggtaacacagtatcactatacacagtggccagatatgggggttcccgaatatagcttgccggtgttaacttttgttcgcaaagcagcgtatgcaaagagacatgcagtgggccctgtggtggtccactgttccgcgggggttggcagaaccgggacgtatatagtgttggactctatgttgcaacagattcagcacgaggggactgttaacatctttgggttcctcaagcacattcggagccagagaaattacctggtccagaccgaggaacaatacgtatttatacatgacaccctagttgaggctatcctgtcaaaagaaaccgaggttttggacagtcatatacacgcttatgtgaatgcgttgctgataccagggcccgcaggtaaaacaaaacttgagaaacagttccaactgttgtcacagagcaatatccaacaatctgactactctgccgccctgaagcaatgtaaccgggaaaaaaacaggaccagtagcatcatcccagtcgagaggagtcgagtcggcatttcgtcactatccggggaaggcactgattacatcaatgcctcatacatcatggggtattaccaaagtaatgaattcatcatcactcaacaccctctgttacacactattaaggatttttggaggatgatctgggaccataatgcccaactggtcgtgatgatccccgacgggcagaacatggctgaggatgaattcgtctactggccaaataaggatgaacccatcaactgcgagtcattcaaggtaactcttatggccgaggagcataagtgtctgtctaacgaagaaaaactgattatccaggactttatactggaggccacacaggatgattatgtgctggaagtgcggcactttcagtgcccgaagtggcccaatcccgactccccaatctccaagacattcgagcttatctctgtaattaaagaggaggctgccaatcgggacggccctatgattgtgcatgacgagcatggcggtgttaccgcagggaccttttgtgcactcaccacactcatgcaccagctggagaaggagaatagtgtggatgtttatcaggtcgcaaaaatgattaacctgatgcggcccggcgtctttgcagatattgagcaatatcagttcttatacaaagtcatcctgtctctcgtcagtacgcggcaggaagagaacccttctacaagcctggactccaatggcgccgcattgcctgacggtaacatcgccgaatctctggaatccttagtgtag

SEQ ID NO: 130849 - DNA, 504 bp, Artificial Sequence
  Description of Artificial Sequence: Synthetic coding sequence
atgaaccggccagctcctgttgagatctcatatgagaacatgcgctttctgattacgcacaatcctaccaacgcgactctgaacaagtttacagaagagcttaagaagtacggcgtgaccacgcttgtgcgagtgtgcgatgcaacctacgataaagcacctgtagagaaggaaggtatccatgtgctcgattggcctttcgatgatggtgcaccgcctccaaatcagattgtggacgattggctcaatctgcttaagaccaagtttcgggaggaacctggatgttgcgtagcagtccactgtgtcgcgggccttggacgagcacccgtgctggtcgccctggccctcattgagtgtggaatgaagtacgaggatgccgtgcagtttatacgccaaaagcggcgaggagcctttaattccaagcaactcctttacctcgaaaaatatcgacccaagatgagactcagattcagggacaccaatggacactgttgcgttcaatag

SEQ ID NO: 130850 - DNA, 249 bp, Artificial Sequence
  Description of Artificial Sequence: Synthetic coding sequence
atgaatcgcccagcaccagtggaaatctcttatgagaacatgagatttcttatcacacacaaccctactaacgctaccctcaataaatttactgaggaactcaaaaagtatggcgtcaccaccttggtacgcgtatgcgacgccacctacgacaaagcgccagtggagaaagagggaatccacgtcctaaagaagaagggtagtgtgcagttccaaacagcagcgctgtttggcgagatcccgacatag

SEQ ID NO: 130851 - DNA, 411 bp, Artificial Sequence
  Description of Artificial Sequence: Synthetic coding sequence
atgaatcgtccagctcccgtggaaattagttacgagaacatgaggtttctcatcactcataatcctactaacgcaactcttaacaagttcacagaagattggccctttgatgatggtgcacctcccccaaaccaaattgtggatgattggttgaacctgttaaagacaaagttccgggaggagcctggatgttgtgtggcggtgcattgtgttgccggtctgggacgcgccccggtgctggtcgctctggccctcattgaatgcggcatgaaatacgaggatgccgtgcagttcatccgccagaaacggcggggggccttcaattcaaagcagttgctgtatctcgagaagtaccgccccaagatgcggctccggtttcgggataccaacggtcactgttgcgtgcagtag

SEQ ID NO: 130852 - DNA, 192 bp, Artificial Sequence
  Description of Artificial Sequence: Synthetic coding sequence
atgaatcggccggcgccagttgaaatatcatacgagaatatgcgttttcttattacccacaacccgacaaatgctacgctgaataagtttaccgaagagctgaaaaagtacggagtaaccaccttagtgagggtgtgcgatgctacctacgataaagctcctgtagagaaagaagggatccacgttctgtag

SEQ ID NO: 130853 - DNA, 69 bp, Artificial Sequence
  Description of Artificial Sequence: Synthetic coding sequence
atgaataggccagctcccgtggaaatttcttacgagaatatgcgcttcctgatcactcataacccttag

SEQ ID NO: 130854 - DNA, 522 bp, Artificial Sequence
  Description of Artificial Sequence: Synthetic coding sequence
atggcacgcatgaatagaccagctcctgttgaagtgagctacaaacatatgagatttctgattacacataatcctactaatgccacactttcaaccttcatcgaagaccttaagaagtacggagcaaccacggtggtgcgcgtgtgcgaggtcacctacgataagacacctcttgagaaagacggaatcacagtagtggactggcccttcgacgacggggcccccccccctggaaaagtcgtggaagattggctatcgttggtgaaagcgaaattttgcgaggcgccaggatcatgcgtagccgtgcactgtgttgccggattggggcgcgcgcccgttttggtagccttagccttaatcgagagcggcatgaagtatgaggacgccatccaattcattagacaaaaacgaagaggcgccattaactctaagcagttaacttatctcgaaaagtacagaccaaaacagagattaaggtttaaggaccctcacacacacaaaacaaggtgctgcgtgatgtag

SEQ ID NO: 130855 - DNA, 447 bp, Artificial Sequence
  Description of Artificial Sequence: Synthetic coding sequence
atggcaaggatgaacaggcctgctcccgtggaggtgtcctataagcacatgcgcttcctgattacacacaatcctaccaacgcgactctgtcaactttcatcgaggacctgaagaaatacggcgccaccaccgttgtacgagtatgtgaggttacctacgacaagacgcctctcgagaaggacggtataaccgtggtggactggccgtttgacgatggcgcacccccccctggtaaagtggtggaggactggcttagcctggttaaagccaaattctgcgaggctcccgggtcctgcgttgccgttcattgtgttgctggcttgggacggaagcggcgtggcgcaatcaactcaaaacagttgacatatttagaaaagtatcgccctaaacagcggctgcggttcaaggatcctcacacccacaaaactcggtgttgcgtgatgtag

SEQ ID NO: 130856 - DNA, 447 bp, Artificial Sequence
  Description of Artificial Sequence: Synthetic coding sequence
atggcccgcatgaaccgtccagctcctgtggaggtctcctacaagcacatgaggtttctgattactcacaatcccacaaatgccaccctcagcacctttatcgaggatcttaagaaatatggggcaaccaccgttgtccgggtctgcgaagtgacctacgataaaaccccccttgagaaagacggcatcaccgttgtggactggcccttcgacgacggggccccgccacccgggaaagtagtggaggattggctgagtctggtaaaggcaaaattctgtgaggcaccgggctcctgcgtggcagttcactgcgttgcggggcttggacggaagcgtcggggggccatcaatagcaagcagttgacttacttagaaaagtaccgacctaagcagcgcctccggtttaaggatccgcatacccacaagacccgctgctgtgtgatgtag

SEQ ID NO: 130857 - DNA, 522 bp, Artificial Sequence
  Description of Artificial Sequence: Synthetic coding sequence
atggcccggatgaatcgacccgctccagtggaggtgagttacaagcacatgcgctttttgattacacacaatcccactaacgccactctgtctacctttatagaagacctgaagaagtatggggctacaacagtggtgcgggtgtgtgaggtgacctacgacaagaccccattagagaaggatggcataacagttgtggactggccgttcgacgacggagcccccccgcccggcaaagtcgtcgaggattggttgtctctcgttaaagccaaattttgcgaagctcctggttcttgcgtagcggtccattgcgttgctgggctgggtagagcccccgttctcgtggctctggccctgatagaatcaggcatgaaatacgaggatgctatacagtttatccgacagaagcgacgaggggccattaactccaaacagctaacttatctggagaagtacagacctaaacaaaggctccggttcaaggaccctcacacacataagaccaggtgttgtgtgatgtag

SEQ ID NO: 130858 - DNA, 213 bp, Artificial Sequence
  Description of Artificial Sequence: Synthetic coding sequence
atggcccgcatgaatcgacctgctccagtcgaggtgtcttataagcacatgaggtttttgatcactcataatccaactaacgccactttgtccaccttcatcgaggacctgaagaaatatggtgccaccactgtcgtgagagtgtgcgaggtcacatacgacaaaactcctcttgagaaggatgggataactgtagtggactggcccttctag

SEQ ID NO: 130859 - DNA, 2343 bp, Artificial Sequence
  Description of Artificial Sequence: Synthetic coding sequence
atggaacaggtggagatccttcgtaaattcattcagcgtgtgcaggcgatgaagtccccggatcataatggtgaggataactttgcacgggattttatgcgactgagacgactcagcacaaaatataggactgagaagatttacccaacggctacgggcgaaaaagaggagaacgtgaagaaaaaccgctataaagacatcttgccgtttgaccactccagggtcaaacttactctcaagacccccagtcaggactccgactatattaacgcaaatttcatcaaaggcgtctacggccctaaagcttacgtggcaacacaaggccctctcgctaatacagtgatcgacttctggcgtatgatttgggagtataacgtcgtgataatcgtgatggcatgtagggagttcgagatgggacgaaagaaatgtgagagatactggccgctttacggggaggacccgataacctttgccccattcaagatttcttgtgaagacgagcaggcccggaccgactattttatccgaactctgctgctcgagtttcaaaacgaaagccgaaggctgtatcagtttcattatgtgaactggccggatcacgacgtgccttcctcatttgactccattctggacatgatctctctgatgcgaaaatatcaggagcacgaggatgtgccgatctgcatacactgttcagccgggtgtggccggaccggtgccatatgcgctatagactacacatggaatctcctgaaagctgggaagattcctgaagagtttaacgtatttaatctgatccaggaaatgaggacccagcggcactctgcggtgcagaccaaggagcagtatgagctcgttcatagggcaatcgcccagttgtttgaaaaacagctccagttatacgaaatccacggagcacagaagatagccgacggagttaatgagatcaataccgagaatatggtctctagcattgagcctgagaaacaagactctcctccccccaaaccgcctaggacaagatcatgtctcgtcgagggcgatgcgaaggaagagatcctgcagccccctgagccacaccctgtccctcctatcctgacccctagcccaccaagtgcattccccaccgtgacaaccgtgtggcaagataacgatagatatcatcccaagcccgtgcttcatatggtgtcttcggagcagcactccgctgacctaaacaggaattacagcaagagtacagaactgccagggaaaaatgagtctacaattgagcagatagacaagaagctcgagaggaatctgagcttcgaaatcaagaaagtcccacttcaggagggcccgaagagcttcgatgggaacaccctattgaatagaggccatgcgattaagattaagtccgccagtccatgcatcgccgacaagatatcaaaaccccaggaactttcatcggatcttaatgttggtgatacaagtcaaaactcatgcgtcgactgctccgtgactcagtctaacaaggtatccgtgacacctcccgaggagagccagaacagcgatactccaccccgcccagacaggcttcccctcgatgagaaggggcatgttacttggagctttcacggccccgaaaatgccattccgattcccgacctgtccgagggaaacagcagcgatattaactaccagactcgcaaaaccgtatccctgacgccatccccaaccacccaggtggaaacgcccgatctagtggatcatgacaacacgagccccctgttccgtactcctctctcctttaccaatcccttgcattcagatgacagcgattcagacgaacgtaattccgacggcgccgtgactcagaacaagactaacatctccaccgcctccgccaccgtgtctgcagccacaagcaccgagtctatctctaccagaaaggtgctgccaatgtctatagcacgtcacaacatagccgggaccacacacagtggggccgagaaggacgtggacgttagtgaagactccccacctccactgccagagcgcaccccagagagcttcgtcttggcttccgaacataacacccccgtgcgcagcgagtggagcgagctgcaaagccaggagcggagcgagcagaaaaaatccgagggactgatcacgagcgagaacgaaaagtgtgaccaccctgcggggggtatccattacgagatgtgcattgagtgtccacctacgttttctgataaaagagaacaaattagtgaaaatcctacagaagcgacggatattggcttcgggaatcgctgcgggaagcctaagggaccaagggatccgcctagtgagtggacatag

SEQ ID NO: 130860 - DNA, 1986 bp, Artificial Sequence
  Description of Artificial Sequence: Synthetic coding sequence
atgatctgggagtataacgtggtcattatcgtaatggcgtgtagagagtttgagatgggcagaaaaaaatgcgagcgatactggcccctgtatggtgaggatccaatcactttcgctcctttcaaaatttcctgtgaggacgagcaggccaggaccgattacttcatccgcacccttttgcttgagtttcagaacgagagccgcaggttgtatcaattccattatgtgaactggccagatcacgatgttcctagtagctttgactcgatcctcgacatgattagcctcatgagaaaataccaggagcacgaggatgttcccatctgcatacactgctctgcgggctgtggccgcacgggagcaatctgtgccatcgattacacatggaatttgctgaaagctggcaaaatccccgaggaattcaatgtttttaatctgattcaggagatgagaacgcagaggcattccgctgtccagacaaaagagcagtacgagctagtgcatcgggccattgctcagttgttcgagaagcagctccagctgtatgagatccacggcgctcagaagattgccgatggcgtgaatgagataaataccgaaaatatggtgtccagcattgagcctgaaaagcaggactctcctccaccaaagcccccacgcacccgcagttgcctagtggaaggtgacgccaaggaggaaatcctccagcctccagaaccacacccggtccctccaatcttgactccgtcccctccttccgcctttccgactgtgaccactgtttggcaggacaatgacagataccaccccaagcccgtcctgcacatggtttcatccgagcagcacagcgctgacctgaaccgaaattactcaaagtcgaccgaactccctggtaaaaatgagtcaacaattgaacaaatcgataaaaagctggaaagaaacctgtctttcgaaatcaagaaggtcccgttacaggaaggccccaaatccttcgacggcaacaccctcctcaaccgcggtcatgcgattaagatcaaatcagccagcccatgtatcgctgacaagataagtaagccgcaggagctgtcctctgatttgaacgtgggggacacgtcacagaattcttgcgttgattgctcagtgacgcagagcaacaaagtcagcgtcacaccaccagaggaatcccagaacagtgacacccccccacggcccgatagacttcctcttgatgaaaaaggacacgtgacatggtcatttcacggccccgaaaacgcaattcccatacccgacctcagcgaggggaactcctcagacatcaattaccagacgagaaagacagtctctctgacaccatccccaaccactcaagtggaaacgccggaccttgttgaccacgacaatacatctccattgttccgcaccccactgagctttactaacccactccattccgatgattcagactcagatgaacgaaactcggacggcgccgtgacccaaaataagacaaatatttcaaccgccagtgccacggtgtctgcggcaacttcaaccgagtcaatcagcacccgcaaagttttaccaatgtccatagcccgccacaacattgccggcaccactcactcgggagccgagaaagatgtagatgtgagcgaggattccccccccccactgcctgagagaacacctgagagtttcgttctcgcgtcagaacataatacacccgtgaggtcagaatggagcgaactgcagtcccaagaacgttcggaacagaaaaagtctgagggactcatcacgtctgagaatgaaaagtgtgatcatcccgccgggggaatacattatgagatgtgcattgagtgcccacctaccttctcagacaaaagagaacagatctcggaaaacccgactgaggctactgatatcggatttggaaatcgttgcgggaagcctaagggcccacgcgaccccccgtctgaatggacatag

SEQ ID NO: 130861 - DNA, 1632 bp, Artificial Sequence
  Description of Artificial Sequence: Synthetic coding sequence
atgatctgggagtataacgtcgttatcatcgtcatggcgtgccgagagttcgaaatgggacggaagaagtgcgagcgatactggcccctttatggcgaagatccaataacttttgctccctttaaaatctcttgtgaagatgaacaggcacggaccgattatttcatacggactctcctgttagaattccagaatgaaagtagacgcctgtaccagttccactatgttaattggccagatcatgacgtaccctcctcttttgactctatcctggacatgatctctctcatgcggaaataccaggagcatgaggatgtcccaatctgtattcattgttccgccggctgtgggcgtaccggggcaatctgcgcaatcgactatacatggaacctgctgaaggccggtaaaataccagaagaattcaacgtgtttaatctgatccaggagatgcgaacccagagacactccgctgtccaaaccaaagaacaatacgaactggtccaccgagccattgcacagctcttcgaaaaacagttgcaattgtatgagatccatggagcgcagaagatcgccgatggcgtaaatgaaatcaatacagaaaatatggtgagctccatagaaccggagaagcaggattctcctccgccaaaaccaccacgtacacgctcttgtttagtggaaggggatgctaaggaagaaatactgcagcctccggagcctcaccccgtgccgcccattctgaccccaagccctccttccgcctttcctacggtaaccactgtgtggcaggataacgacagatatcacccgaagcccgtgctacatatggtcagctccgagcagcattcagctgatcttaatcgaaattattcaaaaagcaccgaactgccaggaaaaaacgaatccaccattgagcagatcgataaaaagctcgaaaggaatctctcttttgagattaagaaggtacccctgcaagaaggcccaaagtcctttgatgggaacacgttgctgaatcggggccatgcgataaagataaaaagtgcaagcccatgcatcgctgataaaatatccaagcctcaggagctcagcagtgacctgaatgtcggggacacaagccaaaattcctgcgtagattgtagcgtgacacagagtaacaaagtgagcgttacaccgcctgaggagtctcagaactcggatacaccaccccgtcccgaccgtctgcccttggacgaaaagggccacgtgacatggtcatttcacggtccggagaacgccatcccaatcccagacctctccgaaggcaattcgagtgatatcaattatcaaacacggaaaacagtgagcctgactcctagccctactacccaggtagagacaccagacctagtggatcacgataacacgtctcctctgttccggacaccattgtctttcacgaacccgctgcactcagatgatagtgacagcgatgaacgcaattccgatggcgcagttactcagaataaaaccaacatctctaccgcctcggctactgtgagcgccgcaaccagtacagagtccatttcaacgagaaaggtgctgccaatgagtattgcccgccacaacagcagaaataacacttttcgatgttag

SEQ ID NO: 130862 - DNA, 6885 bp, Artificial Sequence
  Description of Artificial Sequence: Synthetic coding sequence
atgcacgtctccctcgcagaggccctggaagtaagaggcgggccgcttcaggaggaagaaatttgggccgtgctgaaccagtcggcagagagcctacaggagctgttccgtaaggtgtcactggccgacccagccgcactgggcttcatcatatccccatggtctctgctgctgctgcctagtggctcagtgtcctttacagatgagaatataagtaaccaggatctgcgagcttttaccgccccagaagttctgcagaaccaatcccttacgagcctctccgacgttgagaagatacatatttactcactggggatgacactatactggggggccgactatgaggtaccacagagtcaacctatcaaactcggcgaccacctgaatagtatccttctgggcatgtgtgaggatgttatttacgcccgggtgtccgttcggactgtcttggacgcttgctccgcccatatcaggaattccaattgtgccccttccttcagctatgtcaagcatctggtgaaactcgtgctggggaatctgtcgggaactgaccagctgtcctgtaacagcgaacagaagcctgatcggagccaggccattcgcgatagactcaggggtaaggggcttccaactggaagaagttctacgtccgatgtgttagatattcagaaaccacctctcagccaccagacctttctgaacaaaggactgagcaagagcatgggtttcctaagtattaaagatacccaggatgaaaattattttaaagacatcttatcagataacagtggtcgggaggacagcgaaaatacgttcagcccttaccagtttaagaccagtggacccgagaaaaagccaattcctggtatcgatgtgttgtctaaaaagaagatctgggccagtagcatggacctgttgtgcactgccgatcgagacttttcatctggagaaacagctacctatagacgctgtcatccagaagccgtaacagtgagaaccagtaccactccccgcaagaaggaagcgaggtacagcgatggctcaatcgcactcgatatcttcggccctcagaaaatggaccccatctaccatacaagagagctgccaaccagctcagcaataagtagtgcactcgatagaataagggaacgccaaaaaaagctgcaggtgctacgtgaggcgatgaatgtcgaggagcctgtgcgtcggtataaaacatatcacggagatgtctttagcacctcctctgaaagcccatcaattatcagttccgaaagcgatttccggcaggtgaggaggtccgaagcttccaaacggtttgagtcttcctcaggtctgcctggggttgatgaaacactgagccaaggccagtcccagcgcccaagccggcaatatgagactccctttgaaggcaacctcatcaaccaagagatcatgttgaagcgccaggaagaagagctgatgcaacttcaagccaaaatggcgcttcgtcagagtagactaagcctctaccccggagacaccattaaggcttccatgctagatattacacgagacccgctgagagagattgccttggagaccgccatgacccagagaaagctccggaacttctttggacctgagttcgtaaagatgaccatcgaaccctttatatctctggaccttccaaggagcattctgaccaagaagggaaagaacgaagataaccgcaggaaggttaatattatgttgcttaatggccagcggctggaactcacctgcgatacgaagactatctgcaaggatgttttcgacatggtggtggcccacattggccttgtggaacaccacctgttcgcgttggcaacacttaaggataacgagtacttctttgttgaccctgacttaaagctgaccaaggtagcaccagagggctggaaagaggagcccaaaaagaagaccaaggcaaccgtgaactttactctattctttaggataaagttctttatggatgacgtcagcttgatccagcatactctcacatgccaccagtactatctgcaactccggaaggatattctggaggagcggatgcattgtgatgacgagaccagcctgttgctggcctcacttgcgctacaggcagagtatggggactatcagcccgaggtacacggggtgagctacttcaggatggaacattatctgccagctagggtaatggaaaagctggacttgtcatacatcaaagaagagctcccaaagctgcacaatacatacgtgggcgcctctgaaaaggagaccgagctggagtttttgaaggtctgtcagcgacttacagaatatggtgtccacttccacagagtacatcctgagaagaagtcgcagactggtattttgctcggcgtctgttcaaagggggttttagtgttcgaggtgcataacggagtgcgcaccctggttctacgcttcccctggagagagactaagaaaatttcattctcaaaaaagaagattacactacagaatacctcagatggcattaagcacggcttccagactgacaattccaagatttgccagtatctcctgcatctttgctcctaccagcataaattccagctccagatgagagctcgccagagcaaccaggatgctcaggatattgatgtgctgcataagcgctggagtatagtcagctcacccgaacgggagatcaccctggttaatctgaagaaagacgcaaagtacggtctcggattccagatcattgggggggaaaagatggggaggctggatctgggaatcttcatatcttcagtcgcacccggcggccctgcagatcttgacgggtgcttgaaaccaggcgacagactcatatctgtgaatagtgtttctctggaaggtgtgtcccaccacgccgccattgagattctgcagaatgcgcctgaagatgtgacactggtgatatcccaacccaaggagaaaatcagcaaggtgcccagcacaccggtccacctgacaaatgagatgaagaattacatgaaaaagtccagctatatgcaggactctgctattgacagctcttcgaaagaccaccactggagccggggtacgctgaggcatatctctgaaaacagcttcggtccgtctggagggctacgtgaaggttctctttcaagtcaggattctcgaacggagagtgctagcttatcacaatcccaagtaaatggcttttttgcctcccacctgggggaccagacctggcaagagtcccagcatggcagcccttcccccagcgtcatctccaaggccacggagaaggaaacgttcaccgactcgaaccaaagcaaaactaagaagccagggatcagcgatgtgaccgactattccgaccgaggggatagcgatatggacgaagccacgtacagttcctcacaggaccaccagacaccaaagcaggagtcctcttcctcagttaacacttccaataaaatgaattttaagacctttagtagcagcccccccaagccaggcgatatcttcgaagtggagctggccaagaacgacaactcactgggcatttcagttaccggtggggtgaacacaagcgtgagacacggcgggatctacgttaaagcggttattcctcagggcgctgccgaatcagacggccgaatccacaaaggcgacagggtgctcgcggtgaatggagtctctctggagggagcaacacacaaacaggctgtcgaaacgctacgtaacactggccaggtggtgcatctcctcctggaaaagggccagtctcccacttcaaaagagcacgtgccagtaacgccacagtgcacacttagtgaccagaacgcccagggtcagggacctgagaaggtcaagaaaacgactcaggtcaaggattactcattcgtgactgaggagaatacattcgaagtaaagctgtttaagaatagctctggcctggggttcagctttagtcgtgaagacaatttgattcccgagcagatcaacgcgagcattgtgcgggtcaagaagttgttccctggtcagccagctgcagagtcagggaaaattgacgtgggggacgtgatcttaaaagtcaatggcgcctctctgaaggggttatcgcagcaggaggtgatttccgccctgcgtggaacagcccccgaggtgtttctgcttctgtgccgcccaccacctggagtgctgccggagatcgatacggccctgctgacacctctgcagtccccagcgcaggtcttgccaaacagcagtaaggacagttcccagccctcctgtgtggaacagtcaacttcgagcgacgagaacgaaatgtccgacaagagtaagaaacagtgtaaatcacctagtcgccgagactcttattccgatagttctggcagcggtgaggacgatcttgtcacggcccctgctaacatttctaactccacgtggagctccgccctccaccaaacactgtctaatatggtgagtcaggctcaatctcaccacgaggcccccaaaagccaggaagacaccatatgcactatgttttactacccacagaaaatcccgaataagccggagttcgaagattccaacccttcacccttacctcccgatatggcacctgggcaaagctaccagccgcaaagtgaatccgcttcatcatcgtctatggataaataccacatccaccacatctccgaaccaacgagacaagagaactggacaccacttaaaaacgacctggaaaatcacctggaagactttgagctggaagtggagctactaatcactctcattaaatctgagaagggctccctcggatttacagtgaccaaaggaaatcagcgcataggatgctatgtccacgacgtgatacaagaccccgctaagtcagatggcaggctgaagcctggtgaccggttgattaaggtcaacgacactgatgttacaaacatgacacatactgatgctgtcaacctgctcagagctgcatctaagactgtgagattggtgattggccgcgtgctcgagctgccccgcatcccaatgctaccgcatctgctcccagatattacgctgacctgcaataaagaggagctgggcttcagcctgtgcggcgggcatgattcgctttaccaagtggtgtacatcagcgatatcaatcccagatccgtagctgccattgaagggaatctacagctcctggatgtgattcactacgtgaatggagtttctacacaagggatgacccttgaggaggtgaaccgggccttggatatgtcgctgcccagtcttgtgctgaaagctacaaggaacgatttacccgtcgtgccctctagcaagaggagcgctgtgagtgccccgaaaagtactaagggaaatggtagttattccgttggtagctgctctcagccagccctcacaccaaacgacagtttctccaccgtggctggtgaggagatcaacgagatctcctatcccaagggcaagtgtagcacatatcaaatcaaagggtcaccaaacttgactcttcccaaagagtcgtatatacaggaggatgacatatatgacgacagtcaggaagcggaggttatccaaagccttctcgacgtggtggacgaggaagcccagaaccttcttaatgaaaataatgcggcagggtattcctgcggccccggcacactgaagatgaatggcaaattgagcgaagagaggacagaagacaccgactgtgacggtagtcccctgccagaatatttcactgaggccactaagatgaatgggtgcgaagaatactgcgaagaaaaagtgaaatctgagagcctgattcaaaaaccccaggagaagaaaaccgatgatgacgagatcacctggggaaacgacgaacttccaattgagcggacaaatcacgaggactccgacaaagaccattcattcttgacaaacgatgagctggccgtgctccctgtagtgaaagtccttcccagtggaaagtataccggggctaacctgaagtctgtgattcgggtcctgaggggtttactggaccagggaattcccagtaaagaacttgagaacctgcaggagctgaaacctctggatcagtgtctgatcgggcagaccaaggagaatagacgaaaaaatcggtacaagaacatattaccttatgatgccacccgagtccctctgggggatgaaggggggtatattaatgcctcttttattaaaatacctgtggggaaggaagaattcgtctacatcgcttgtcagggccccctgcctactacagtgggagatttctggcaaatgatctgggaacagaagtcaacagtcatagccatgatgacccaagaggtggagggcgaaaagatcaaatgtcagaggtattggccaaacattctgggtaagaccaccatggtatccaatcgtcttcggctggctcttgtgaggatgcagcagctcaagggctttgtggtgcgtgcaatgactcttgaagacatacagactcgggaagtgcggcacatttcccacctgaacttcaccgcctggccggaccatgacactcctagccagccagatgacctccttacttttatatcgtatatgagacacatacataggagcgggcctattataacccattgctcagcaggcattggtcggtcaggcacgctgatctgcattgatgtcgttctcgggctcattagtcaagatctggactttgatatatccgatttggtgaggtgcatgcgcctgcaaagacacgggatggtccaaactgaggaccagtatattttctgttaccaggtgatactgtatgtgctgacccgcctccaggctgaagaggaacagaagcagcagcctcagctgctgaaatag

SEQ ID NO: 130863 - DNA, 7305 bp, Artificial Sequence
  Description of Artificial Sequence: Synthetic coding sequence
cagttcctctttaccaaagtgtcactggctgatcctgctgccttgggattcattatcagtccatggagcctactcttactccccagcggctcagtcagcttcactgatgagaacatttcaaatcaggacctcagggcatttacagcaccagaagtccttcagaatcagtcgttgacctccctcagcgatgtggaaaagattcacatttattccttaggaatgactctttattggggagccgactatgaggttccccagtcccaaccgatcaaactgggtgaccatctgaattctatcctgctcggtatgtgcgaggatgtcatttacgcccgggtctccgtgaggacagtgctcgatgcctgtagcgctcatatccgcaacagcaactgtgccccatccttcagctacgtgaaacacctcgtgaagctggtcctcggcaatctcagcgggacagatcagctcagctgcaattctgagcagaaaccagatcggagccaggcaatcagagaccgccttaggggaaagggactccccacggggcggagctcaacctccgacgtgcttgacatacagaaacccccactctctcatcagacattcctgaacaagggcctgtccaagagtatggggtttctgtctattaaagacacccaggacgagaattatttcaaagatattttgagtgacaactccgggagagaggactcagaaaatacattttccccataccagttcaaaacctccggaccagagaaaaaaccgatccctgggatagacgtgttatccaaaaagaagatatgggcatcgtcaatggacctcctctgcactgcggacagagatttcagtagcggcgaaaccgcaacctatagaaggtgccatcctgaggcagtaactgtacggacctctacgaccccaagaaaaaaggaagcccgatacagtgacggatctatcgcattagacatcttcgggccgcaaaagatggatcccatataccacaccagggaattgcccacctcttcggccatctcaagcgcattagacaggattagagagcgacagaaaaaacttcaggtgctgagggaagccatgaatgtcgaagagccagttaggcggtataagacctaccatggcgacgtattctcaacgagctcagaatctccttcgattatctccagcgagtcagactttcggcaggttcgtaggagcgaagcttcaaaaagattcgaaagctcttccgggcttcctggcgttgacgaaaccctgtcccaggggcaaagccagcgccccagcaggcagtacgaaacgccctttgagggcaatcttatcaatcaggagatcatgctgaagagacaggaggaggaacttatgcaactgcaggctaagatggccttgaggcagtcccggctttccctatatcccggcgacaccattaaagcctctatgttagacatcacccgagaccccctacgcgagatcgccctggagacggctatgactcagcggaagttgagaaacttttttggacctgagttcgttaagatgaccattgagcccttcatttccctggatctgccccggtctattctgaccaaaaagggaaaaaatgaagataatcgacgaaaagtgaacataatgctgttaaacggacaaagactcgagctgacctgcgacactaagaccatatgcaaggacgtttttgatatggttgttgctcacatcggtctcgtggagcatcacctctttgctctggctaccttgaaggacaatgagtatttttttgtggatcctgacctcaagctgactaaggtggctccagaggggtggaaggaggagcctaaaaagaagacgaaagcaacagtcaactttactctgttttttaggattaaattcttcatggatgatgtcagcctcatacagcacacccttacttgccatcaatactatctgcagcttcggaaggacattttagaggagaggatgcattgcgacgacgagacatccctgcttctcgcttctctggctctgcaagctgaatatggagattaccagccagaagttcacggagtctcctactttcggatggaacactatctgcctgccagagtgatggagaagctggacctatcttatattaaggaggaactgccaaaacttcacaatacctatgttggagcatcagaaaaggagacagagctggagtttctaaaggtttgtcaaaggttaacggagtacggcgtgcatttccatcgcgtgcacccggagaagaaaagtcagaccggaatcctgctgggagtttgttctaagggcgtgctggtgtttgaggtgcacaacggggttcgcacactcgtgctccgattcccttggagggaaaccaagaaaatctcttttagcaagaaaaagataactctccagaatacttccgacgggattaaacatggatttcagaccgacaacagcaagatttgtcagtatctactgcacctgtgctcgtaccaacacaaatttcaactgcagatgcgcgcgagacagtctaaccaggacgcacaggatattgagcgcgcctcgtttaggagcttaaatctccaggccgaatccgtgcgcggatttaacatgggcagggccatatcaacaggatccttggccagtagcactttgaataaactcgccgttcggcccctgtctgttcaggcggaaattctcaagcggctcagttgtagcgaactatccttataccagccactgcagaacagttcaaaagagaaaaatgacaaggctagttgggaggaaaaaccaagagaaatgtctaaaagttaccatgatttgtcccaagccagcctttaccctcacagaaagaacgtaatagtcaatatggaaccaccccctcagacagttgctgaactggtcgggaagccaagccaccaaatgtcccggtccgacgccgaatctctcgccggcgtgacaaagttgaataattcaaaatctgtggcttcactgaatcgaagtccagagcgtcggaaacacgagtcagatagctcttctatagaagacccaggtcaagcctatgtactggatgtgctccacaagcgttggtctattgtttcctcacctgaacgagagatcactctggtgaatctgaaaaaagatgcaaagtatggactcgggttccagataatcggaggggagaaaatgggtcgcctcgacttaggtatttttatttcatctgtagcacctggcggaccggctgatcttgatggatgtctgaaacctggcgataggctgattagtgtcaattccgtgagtttggagggtgtgtctcaccacgctgcaattgagattctgcagaacgcacctgaagatgtgaccctcgtaatcagtcagcctaaggaaaagatatcaaaggtgcccagcacccccgtgcacttgaccaacgagatgaaaaattatatgaaaaagagcagttatatgcaagactcagccatcgacagcagctctaaagaccaccattggagccggggcacgcttcgccatatcagcgaaaattcgtttggccccagcggcggcctgcgggagggcagcctgagctctcaagacagcagaacggaaagtgcctctctcagccagagccaggttaatggctttttcgctagccaccttggtgatcagacctggcaggagtcccaacacggcagcccctctccatcggtcatttccaaagccaccgaaaaggagactttcacagactcaaaccaatccaagacaaagaagcccggcattagtgacgttaccgattacagcgaccgcggtgactccgatatggatgaagccacctacagcagttctcaggaccatcagacccctaagcaggaatcatcatccagtgtcaacacttcaaacaaaatgaactttaagacctttagctcctcaccaccaaaacctggggacatttttgaggtggaactggctaaaaacgacaactcattgggaattagtgtaacggggggagtgaatacaagtgttcgccatggcgggatatacgtgaaggctgttatcccccagggtgcagcagagagcgatgggcgcatccacaaaggagatcgcgtcctggccgttaacggcgtgagcctcgagggtgctacccacaagcaggccgtagagaccttaaggaataccggccaggtagtccatctgttgttggagaaggggcaatcacccacgtccaaagaacatgtgcctgtcactccacagtgcaccctgtctgaccagaatgcacaagggcagggccccgaaaaggtgaaaaagaccactcaggtgaaagactactctttcgtgacggaagagaatactttcgaggtgaaattgttcaagaactcttctgggctcggattttcattcagcagggaggacaatctcattcccgaacagattaatgccagcatcgtccgtgtaaaaaagttgttccctggacagcccgctgctgagtccgggaagattgatgttggcgacgtaatattgaaggttaatggggctagcttgaaaggcctgagccagcaggaggttatcagcgcgctcagaggaacggccccagaggtgtttttattattgtgtcgcccaccccctggagtgctcccagagatcgataccgcgctgctgacgccactgcagtcaccagcgcaggtcctccccaattcttctaaggactcatcacagcctagttgtgtggagcagagtacctcgagcgatgagaatgagatgagtgacaagtctaaaaaacagtgtaagtcgccatcccgacgtgacagctacagtgactcttcggggagtggagaggacgacctcgtcacagcccccgccaatatatcgaatagcacctggagcagtgcccttcaccagaccctcagcaacatggtcagtcaagcccagtcacatcacgaggcccccaagagtcaagaggatacaatctgtacaatgttctattacccacagaaaatccctaataagccggaattcgaggacagcaaccctagtcctcttccaccagacatggcaccaggacagtcttatcaaccccagtcagaatccgcctctagcagctccatggataagtaccatatccatcatatctctgagcccacacgccaggagaattggacccctctgaaaaatgacctcgagaaccatttggaggattttgaactcgaggtagagctgttaatcacgttaatcaaaagcgagaagggaagtctgggctttaccgtgaccaaaggaaaccagcggattggctgctacgtccacgatgtaatccaggatcctgccaaatccgatggacgacttaaaccaggcgatcggctgatcaaggtaaacgacacagatgtcaccaatatgacccacacagacgccgtaaatttactgcgagctgcgtccaagaccgtccggctcgtgataggccgggttttggagttgccgcgaatccctatgctgcctcacctactccctgacattaccctgacgtgcaacaaagaagaactgggcttttcattgtgcggaggacatgattcgctgtaccaggtggtttacatcagtgacattaatccacggagcgtagcagctatcgaggggaatctccaattgctcgatgtcattcactatgtgaacggcgtgagcacccagggcatgacgctggaagaggtcaaccgcgctttagatatgtccctgccttctctcgttttgaaagcaacccgcaatgacctgccagtcgtcccaagtagtaagaggtcggccgtctctgccccaaagtccacgaaaggaaatggcagctactctgttgggagctgttcacagcctgccctgacacccaatgactcgttttccaccgtggcaggggaggagatcaatgaaatttcctaccctaagggtaaatgctcgacataccagatcaaggggtccccaaatctcacattaccaaaggagagctacatccaggaagatgacatctacgatgatagccaggaggccgaagtcatccagtctttgttggacgtcgtggacgaggaggcccagaatcttctcaatgagaataatgcggcggggtactcatgtggccccggaacactgaaaatgaacggtaagctgagtgaagagcgcactgaagataccgattgtgacggcagtccccttcctgagtatttcaccgaggcaacaaagatgaacggatgcgaagaatactgcgaagagaaggtaaagtccgagtcactaattcaaaaaccgcaggagaaaaagactgacgatgacgaaattacatggggaaatgatgaactccccatagagaggaccaaccacgaggattctgacaaggatcattccttcttgacgaacgatgagttggccgtccttcctgtggtgaaagtgctgcctagtggcaagtacactggagccaacctcaagagtgtgataagagtgctgcgtgggctgctcgatcagggcattccttccaaggagcttgagaatctgcaggagttgaagcccctggaccaatgcctgatcggacaaaccaaagaaaatcgccgcaagaatcgatacaaaaatatcctgccatatgatgcaacaagggtcccgcttggcgatgagggcggatatatcaatgcatctttcattaagatcccagttggcaaggaggagttcgtctacattgcatgccagggtcccctaccgacgaccgtgggggacttctggcagatgatctgggagcagaagagcaccgtcattgcaatgatgacacaggaggttgagggagagaagatcaagtgccagagatactggcccaacatcctgggcaagacaaccatggtcagcaacagactgagattggccttggtgaggatgcagcaacttaaggggttcgtggtgagagcaatgacgctggaggacatccagacccgggaggtaagacatatcagccatctgaattttacagcctggcctgatcatgacacaccttctcagcctgatgacttgcttacattcatcagctacatgaggcatatacacaggtccggaccgataatcacccactgttcagctggcatcggcaggagcgggacactgatctgtatagacgtggtgctgggattgatctcccaggatctcgacttcgacatctccgaccttgtgcggtgcatgaggctgcagcggcacggaatggtgcagacagaggatcaatatattttttgctaccaggttatcctctacgtgctgaccaggctccaggctgaggaggagcagaaacaacagccccagcttctcaagtag

SEQ ID NO: 130864 - DNA, 7458 bp, Artificial Sequence
  Description of Artificial Sequence: Synthetic coding sequence
atgcacgtgagcctggcagaagcactcgaggtcaggggcggaccacttcaggaggaagaaatatgggccgtgcttaatcagagcgccgagagcctgcaggagctgtttcggaaggtaagcctggcagacccagcagccttggggttcattattagcccctggtctctgcttctacttcctagcggatctgtgtcctttactgacgagaatatttctaatcaagacctccgggccttcactgcgcccgaagtccttcaaaaccaatctctcaccagcctgtccgatgtggagaagattcacatctattctctgggaatgaccctttactggggcgccgactacgaggtccctcagagtcagccaatcaagctcggggatcacctgaatagcatactcctcggcatgtgcgaggacgtaatctacgctagagtctcagtccggaccgtgctggatgcctgtagtgcacatatccgaaattccaactgcgccccctcttttagttatgtgaaacatctggttaagttggttctgggcaacttatccggaacagaccagttgtcttgtaattcagagcaaaagccagaccggtctcaggctatccgtgacagattgagaggaaagggcttgccaaccggtcgatctagcacttctgatgtcctggacatccagaagccccctctctcacatcagacctttctgaataagggtctttcaaagagcatggggtttctctctataaaagatacacaggatgagaactattttaaagatattttatcagacaattcaggacgcgaagatagcgagaatactttttctccataccagtttaagacatcagggcccgagaagaaacccatcccgggcatagatgtcctatctaaaaagaagatctgggcatcttccatggatctgctctgtactgccgatcgggacttcagctctggcgaaactgccacttatagacgctgccaccctgaagctgtgacggtaaggacaagcacaactcccaggaagaaggaggcccgttattccgacggatccatcgctctcgatatatttggcccacagaagatggacccgatttaccacacccgcgagctacccacatcctccgccatatcttccgccctcgatcgcattcgggaaagacaaaaaaaattgcaggtactgcgggaagcaatgaacgtggaagagcccgtacgcaggtacaaaacttaccatggagacgtgtttagcacatcttctgaatccccttccataatttcaagcgagagtgactttcggcaggtgaggagaagcgaggcgtcaaagcgcttcgagtcttcttctgggctaccaggagtggatgagaccctctcacagggccaaagtcaacgaccctctcggcaatatgagacgccattcgaggggaacttgattaaccaggaaattatgcttaaacggcaggaggaagaacttatgcagctgcaggccaagatggccctacgacagagccgcttgtcattgtaccctggggacacaatcaaagctagcatgctggacatcactagagaccctttgagggaaattgctttggagaccgccatgacacagcgaaaattaagaaacttcttcggcccagaatttgttaagatgaccattgagcctttcatttccctggatcttcctagatccatcttgaccaaaaagggaaaaaatgaggacaaccgccggaaggtaaacatcatgttgttgaacgggcagcgcttggagttaacttgtgacaccaagacaatctgtaaggacgtctttgatatggtggtggctcatattggactggtggaacaccatctgtttgccctggctaccctaaaggataacgaatacttcttcgttgaccccgatctaaaactgaccaaagtggcccctgaaggctggaaggaggagcctaaaaaaaagaccaaggccactgtaaacttcactctgttttttcgaattaagttcttcatggatgacgtgagcctcatccagcacacgcttacctgccatcagtactacctgcagctgagaaaggacatccttgaggagcgcatgcattgcgacgacgagaccagtctgctgctagcctcactggccttacaggcggagtacggggactatcagcccgaagtccacggagtgagttacttcagaatggagcactacctccctgcgagagtgatggagaagctggacctaagctacatcaaggaggagctgccaaagttgcacaacacttacgtgggcgcctcagaaaaggagacagaactagagtttctgaaagtatgtcaacggctcacggagtacggcgtacacttccatcgcgttcaccctgaaaagaaatcccagaccggcatattgctcggggtgtgctccaaaggcgtgttagtttttgaagtgcataatggggttcgcactctggtactgagattcccatggcgcgaaaccaagaaaatcagcttcagcaagaagaaaatcacattacagaatacttctgatggaatcaagcacggatttcagactgataactcaaaaatttgccaatatctgctgcatctttgctcttaccagcataagtttcagctgcagatgcgggcccgacagtccaatcaggatgctcaggacatcgagcgggccagcttcaggtccctcaacctgcaggccgagtcagtccgcgggttcaacatgggccgcgctatcagcacaggtagtcttgcaagctccaccctgaacaagctggcagtgcgcccactctctgtgcaagcagaaatcctgaaaaggttgtcttgcagtgaactgagtttatatcaaccactgcaaaattcaagcaaagagaaaaatgataaagctagctgggaggagaaacctcgcgaaatgagtaaatcttatcacgacctatcgcaggcttctctgtatccccatcggaagaatgttatcgttaacatggagccacctccacaaactgttgccgaacttgttggcaagccaagccaccaaatgtccagaagcgacgccgagtccctcgctggcgttacgaaattgaataatagcaagagcgtcgccagtctcaatcgaagtcctgaacggaggaagcacgagtccgacagtagctcaattgaggacccaggacaggcctacgtgctcggaatgacgatgcactcttccggcaacagctcttcccaagtacctctaaaggagaatgatgtgctgcacaagcgatggtccatcgtatctagtccggagagagagatcacattagttaacctcaaaaaggatgctaagtatggccttggctttcaaatcattggcggtgaaaaaatggggagactggatctaggtatcttcatcagctccgtagcgccgggagggccagccgacttggacgggtgcttgaaaccaggcgataggctgatatctgtgaattcagtctctctggaaggggtgagccaccatgcagccattgagattctccagaatgcacctgaggacgtgactctcgttatcagtcagcccaaggaaaaaatatcaaaggtgcctagcactccagtccacctcactaacgaaatgaagaactacatgaagaagagcagttatatgcaggactcagctatagactcatcttctaaagaccatcactggagtcgggggactctgagacacatatccgagaactccttcggcccctcggggggactcagagagggcagcctatcgagtcaagacagtcgcaccgaaagcgccagtctttcccaaagtcaagtgaacgggttctttgctagtcacctgggagatcagacctggcaggagtcccagcacggctcccctagtccatccgttatctccaaagcaaccgagaaagagacatttactgatagcaatcaaagcaagaccaagaagcccgggatctccgatgttaccgattacagcgatcggggcgactctgacatggatgaagcaacctacagctccagtcaggatcaccagacaccaaaacaggagtcttcatcttctgtgaacacctctaataaaatgaatttcaagacctttagcagcagtcctccaaagcctggagacatcttcgaagtggagcttgcaaagaacgacaattcgctgggcatctccgtgacaggcggagtcaacacgagcgtgcgccacggtgggatctacgtgaaggccgtgatcccacagggcgcggcagagagcgacggccgaatccacaaaggggacagagttttagctgtgaacggcgtgagtctggaaggtgcaactcacaaacaagcagttgaaactcttaggaatacgggtcaggtcgttcatctcttgctggagaaggggcagtcccccacgtccaaagagcacgtgcctgtcacacctcagtgtaccctctctgaccaaaatgctcaagggcaggggccggagaaagtaaagaagacgacccaggtgaaagactattcattcgtgaccgaggagaacaccttcgaagtgaagctctttaagaactcatccggtctgggtttcagcttcagtcgagaggataatctgatccctgaacaaattaacgctagcatcgtgcgcgtcaagaaactattcccaggtcagcctgccgccgaatcgggaaagatcgacgttggtgacgttatcctgaaagtaaatggtgcatccctgaagggactctcccagcaggaagtcatctctgcgctgaggggaaccgccccggaggtgtttctgttgctctgccgcccgcctcctggcgttctgcccgaaatcgacaccgctctcctgaccccactacagagtcctgcccaagtgctgcctaactccagtaaagacagcagccagccatcatgcgtagagcagagtacgagttctgacgagaatgaaatgagcgacaaatcaaaaaagcagtgcaaatctccatccagaagagatagctacagtgatagctccggctccggggaggacgatcttgtgacagctccagcgaatatctcaaatagtacttggtcatccgcactacaccagactttatcaaacatggtgtcacaggcccagtcccatcatgaggcaccaaagagtcaggaggacacgatttgcactatgttctactatcctcagaagatccctaacaagccagagttcgaagattccaacccctccccactgccaccggatatggcgcccggccaatcttaccaacctcaatccgagagtgctagtagtagctctatggacaagtaccacattcatcatatttccgagccaacgcgtcaggaaaattggaccccactgaaaaatgatctggagaatcacttagaagatttcgagcttgaagtagaattactgataacactgatcaagagtgaaaaaggaagcctaggcttcacggtgactaagggaaaccagagaataggatgctatgtacacgacgttatccaggacccagctaagagcgacggtagattgaagccaggtgatcgtctgattaaggtgaatgacacggatgtaaccaatatgacccatactgacgccgttaatctgctgcgagctgctagcaaaacagtgaggttggtgatcggtagggttctggagttgcctcgcattcctatgctgccacacctgttaccagacattactctgacatgtaataaggaggagctcgggttctccctgtgcggcggccacgatagcctgtaccaagttgtgtacatctcggatattaatccccggtccgtcgcagccatcgagggtaacctacaattgctggacgttatccattacgtcaatggggtgtcaacccaaggaatgaccctggaagaggtgaaccgagctctggacatgtctctgcccagcctggtcttgaaggcgactcgcaacgatttacctgtggttcccagctcgaaacgaagcgctgtgagcgccccaaagagcacgaagggtaacggctcttactctgtggggtcctgctcccaacccgccttgacacctaacgattccttttctacagtagcaggcgaagagattaacgaaatttcgtaccccaaagggaaatgctcaacataccagatcaaggggtccccaaatttgacattgcccaaagagagctatatccaggaagatgatatctatgacgatagccaggaggccgaggtgattcagtcactattagacgtcgtggacgaggaggcccagaacctcttaaacgagaataacgctgctggctacagctgcggaccaggaaccctgaaaatgaatgggaaactgtctgaggagcggacagaggataccgactgtgacggatctcctctccccgagtacttcaccgaggccaccaagatgaacggctgcgaggagtattgcgaagagaaggtgaagtctgaatccctgatccagaagccacaagaaaaaaagacagacgacgacgagattacctggggcaacgatgagttgccaattgagcgaacaaatcacgaggattcggacaaggatcattcatttttgactaatgatgaattggcagttctgcccgttgtgaaggtgcttcccagcggcaagtacacaggtgctaacctaaagagcgtgatcagagtgcttagaggactactggaccaaggcatccccagcaaagaactcgagaatctacaggagctgaaaccccttgatcagtgcctaatcgggcagaccaaagaaaatcgcaggaaaaaccgatataagaatattctgccttacgacgcaacaagggtacccctcggcgacgaagggggctatatcaacgcaagctttatcaagatcccagtgggaaaagaagagtttgtatatatcgcctgtcaaggcccgttacccaccacagtgggcgacttttggcagatgatttgggagcagaagagtaccgtgattgcaatgatgacgcaggaggtggagggggaaaagattaagtgccagagatactggccaaacatcctgggaaagaccacaatggttagtaacagattgagattggccttagttaggatgcaacagctgaaggggtttgtcgtacgtgcaatgacgctagaggacatccaaacaagagaggtgcgccatatatctcatctgaactttactgcatggccagatcatgatacccccagccagccagacgaccttttaacgtttatctcttatatgcgtcatattcacaggagcgggcctattattacccattgttcggcgggcatcggacggtccggcacactgatttgtatcgatgtagttctcggactgattagccaggacctcgatttcgacatcagcgacctggtcagatgcatgcggctccagcggcacggcatggtccagacagaggatcagtatatcttttgctatcaggtgattctatacgtcctaacccggcttcaagccgaagaggagcagaagcaacagccacagctgcttaaatag

SEQ ID NO: 130865 - DNA, 7401 bp, Artificial Sequence
  Description of Artificial Sequence: Synthetic coding sequence
atgcatgtttctctggcggaggcattagaagtcaggggagggcctttgcaggaggaggaaatctgggctgtgttaaatcagagtgcggagtcactccaggaacttttccgcaaagtcagccttgccgatcccgccgctctaggcttcattatttctccgtggagtctgctgctgctaccttctggcagcgtaagctttaccgatgagaacattagcaaccaggacctgagggctttcactgctccagaagtgttacagaaccagagtctgacttctctgtccgacgtggaaaagattcacatctactctcttgggatgaccttgtactggggagcagactatgaagtgcctcagtcacagcccatcaaattgggggaccacctgaattccatattgttgggcatgtgcgaagatgtgatctacgcacgggtcagtgttcggaccgtgttagacgcgtgcagcgcccacatccggaatagcaactgtgccccttcttttagttacgtgaaacacctggttaagttagtccttgggaatctgtccggcacagaccagctgtcttgcaattctgagcagaagcccgacagatcacaggctatacgtgatcggctgagggggaagggcctgcccaccggacgctcctcaacctctgatgttctggacatacagaaaccccccctttcccaccagaccttcttaaataagggcttgtctaagagcatgggattccttagtatcaaagacacccaggatgagaattacttcaaggatatcctgagcgacaacagcggccgcgaagacagcgagaacaccttttctccatatcagtttaagacttcaggacctgagaagaaacctatacccggcattgatgtgctatccaagaagaagatctgggcaagcagcatggacctcctgtgtactgcagacagggacttttctagcggcgaaactgctacctacaggcgttgtcaccctgaggctgtgacagtgcgaacttctacaactcctcgcaagaaagaagctcgatattctgatggaagcatagccctcgatatattcggaccacagaagatggaccctatctaccacacccgggaactcccgacatcatccgccatcagcagcgccctggaccgcatcagagaacgccagaaaaaattgcaggtcctccgggaagcgatgaatgtggaagaacccgttcgccggtataagacatatcacggcgacgtctttagcaccagcagcgaaagccctagtatcataagttcagaaagcgatttccgacaggtgcgccgctctgaagcatccaagaggttcgaatccagttctggtttgcctggggtagatgagacactgagtcagggtcagagccagcgtccctctcggcagtacgagacgcccttcgagggaaatctgattaaccaagaaatcatgctcaagcggcaggaggaggagctgatgcaattgcaggctaaaatggcgctgcgtcaaagcagactatctttgtatcctggagatacaatcaaggcatccatgctggatattacacgcgacccgctcagggagatcgcgctagaaactgctatgacacagcgcaagctcagaaactttttcggcccggaattcgtaaagatgactattgaaccgtttatcagcttggacctgcctcgttctatcttgactaagaagggcaaaaacgaggacaaccggagaaaagtcaatatcatgctccttaatggccagagactcgagttgacctgtgacactaaaaccatttgtaaagatgtgtttgacatggttgtcgcacatattgggctcgttgaacaccacctcttcgcactagctacattgaaggacaacgagtacttctttgtggacccggatcttaaactgacaaaggtggccccagaaggatggaaagaggaaccaaaaaaaaaaactaaggcaactgtgaacttcacccttttttttcgcattaagttcttcatggatgatgtttctctaatccagcatacgcttacatgtcatcagtactacttgcagctgcgaaaggatattctcgaggagcgcatgcactgtgacgatgagacctcccttctgttggcaagcttagctctgcaggccgaatacggcgattaccagccagaggtccacggcgtgtcatacttcaggatggagcactacctcccagcccgggtaatggaaaaactggatctctcttacatcaaagaagaacttccgaaactgcacaatacctacgttggcgccagtgagaaagagactgagctcgaatttttgaaagtgtgccagcggctgacagagtatggggttcactttcatagagttcatccagagaagaaatcgcagaccggcatcttactcggggtatgctctaaaggcgttttagtcttcgaagtgcataacggagtgcggactctggtattacggttcccctggagggagaccaagaaaatcagcttcagtaaaaagaaaattacactccaaaacacgtctgatggcataaaacacggcttccagactgacaacagcaagatctgtcaatacctactgcacttgtgttcataccagcataagttccagctgcagatgcgggcccggcagtctaatcaggacgcacaggatatcgagagggcctcgttcagatcgctgaacctgcaggctgaaagcgtgcgcggcttcaacatgggtcgggccatatcaacaggcagtcttgcgtcctccaccctcaataaactggctgtgagacctctctccgtgcaggcggagatcctcaaaaggctcagttgtagcgagcttagcctctaccagccgctccagaactcatctaaagagaagaacgacaaggcaagctgggaagagaaacccagggagatgagcaagtcctatcacgacctgtctcaagctagcttatacccacatcgaaaaaatgtcattgtcaacatggaaccccctccacaaaccgtggctgaattagttggcaaaccaagtcatcagatgtccagaagtgatgcagagagtctggccggagttacaaagttaaacaactcgaaatcagtggcttcgctgaacaggtcgccagagagacgcaaacacgagtcagactcgtcaagtattgaggatcccggccaagcgtacgtgttagatgtgctgcataaacgctggagcattgtctcctctccagaaagagaaattaccttggttaatttaaagaaggatgccaagtacggccttggtttccagataatcggaggagagaagatggggcgactggacctgggtatcttcatttcaagtgtagcccccggtggacctgctgacctggacggctgcttaaaaccaggcgaccgtttaataagtgtcaatagcgtctcgctcgagggtgtcagtcaccacgccgccatcgagattctccagaatgccccggaagatgttaccctagtgatctcgcagcccaaagaaaaaatttcgaaggtgcctagcacccccgtacacctaacaaacgagatgaagaactacatgaagaagagtagctacatgcaggattctgcaattgacagttcttccaaagaccaccattggtcccggggcacccttaggcacatctctgagaacagcttcggaccaagcggggggctgagagaaggcagtcttagctcacaggattcaagaacagagtccgcctccctctcccaatcccaggtgaacggtttcttcgcttctcaccttggcgaccaaacgtggcaggaatctcagcatggttcaccgtcaccctccgtgataagcaaagcaacagagaaggagacttttactgactctaaccagagtaaaacgaaaaagccaggcatctctgacgtcactgactacagtgatagaggagactcggacatggatgaggccacatattcaagctcccaagatcatcagactcctaaacaggagtcttcatcctccgtgaacaccagcaataagatgaatttcaagacctttagcagctctcccccaaagcccggtgacatatttgaggtagagctggcaaagaatgataattccctggggatctcagtgacgggtggggtcaacacatccgttcgccatggcgggatctatgtaaaagccgtgatacctcagggtgccgcggaaagtgatggtagaatccataagggggaccgggtccttgccgtcaacggggtgagtctggagggagctacacacaagcaggcggtagagaccttgcgcaataccggacaggtcgtgcacctgctgcttgagaaaggccagtcccccacgagcaaggagcacgttccagtgaccccccagtgcacattgtctgaccagaacgcacagggacaaggccctgaaaaggtcaagaaaactactcaggtcaaggattattctttcgtcactgaagaaaatacctttgaggtgaagctcttcaagaacagctccggcctggggttcagcttctcccgcgaggacaatctgatacccgaacaaataaacgcatctatcgtccgcgttaagaagttgttccctggccagcccgctgccgagagcggcaagattgatgttggcgatgtgatcctaaaggtcaatggcgccagcttgaaggggctgtctcagcaggaggtcatctctgcgcttagggggaccgccccggaggtgtttctgcttctgtgccggcctccaccgggcgtgctgcccgaaatagacaccgcactcctgactccgctccagtctccagcacaggtactcccaaactccagcaaagactcctctcaaccctcctgcgtggagcaatcgacttcctccgacgagaatgagatgtccgacaaatccaaaaagcagtgtaaatctccctctagaagggatagctactcagacagcagcggatccggagaagacgatctcgtgaccgcccctgctaacatcagtaattccacctggagctccgctctgcaccagaccctgtctaacatggtttcacaggcccagtcacaccacgaagctcccaagagtcaagaggacacgatctgcaccatgttttactatccccagaagattcccaacaagccagagttcgaagatagcaatccaagcccgttacctcctgatatggctcccggacagtcttaccaaccgcagtcggaatccgcctcaagctcatcaatggacaaataccatatacaccatatctccgaacccacacgccaggagaattggacgcctctgaagaacgatctagagaatcacctcgaagacttcgagctagaggtggagctcctgattactttgatcaaatccgagaagggcagcttggggtttacagtgaccaagggaaaccaacgaatcggctgctacgtgcacgacgtgatccaagaccctgccaagtctgacgggcgtctgaagccgggagacagattgataaaagtgaacgatacggatgttactaacatgacccatacagatgccgtaaatttactgcgggcagcctccaaaaccgtacggttggttattggacgggtgctggagctcccaagaatacctatgctgccacacctgctgcccgatatcaccttaacatgcaataaggaagaattgggctttagtctgtgcggcggccacgacagcctttatcaagtcgtgtatattagtgatatcaatccccggtctgtggcggcaattgagggcaacttacagctgttagatgtgatccactatgtgaacggagtgtccacccagggtatgacattggaagaagtcaatagagccctggatatgagcctcccaagtctggtgttaaaagctacacggaacgatttgccagtcgtaccgtctagcaagaggagtgctgttagcgctcccaaatctacgaaagggaacggttcctacagtgtcggtagttgctcgcagccagcactgactccaaatgatagcttctccaccgttgccggcgaggaaattaatgaaattagttaccccaaaggcaagtgttcaacttatcagataaagggctcccccaatctaacactgcccaaggaatcatatatacaggaggatgacatctacgacgacagccaggaggcagaagtaattcagagcctcctagatgttgtcgacgaggaggctcaaaaccttctcaacgaaaacaacgcagcagggtactcttgcggtccagggaccttgaagatgaacggaaaattgtctgaggagcggactgaggacacagactgcgacggttcaccactgccggagtactttacagaggctacaaagatgaacgggtgtgaggaatattgcgaagagaaagttaagtcagagtcactcatccaaaagcctcaagaaaagaagacagacgacgatgagattacttgggggaatgatgagctccctatagaaaggactaaccacgaagactcagacaaggaccactcgtttttaaccaacgacgagttggcagtcctgcctgtcgttaaagtcttgccttctggtaaatataccggtgccaatcttaagtcagtaatcagggtgctgaggggcctgctggaccagggcataccttctaaagagttggaaaacctccaggagctcaagccattggaccagtgtctgatagggcagaccaaggaaaataggcggaagaacaggtacaaaaacatccttccttatgatgcaacccgggtcccactcggcgatgagggaggatacatcaatgcaagtttcatcaagataccagtgggcaaagaggagttcgtgtatattgcctgccagggccccctccccactacggtgggcgacttctggcagatgatatgggagcagaaatcaaccgtgatcgccatgatgacacaggaggtcgagggcgagaagattaaatgtcaacggtactggccaaatatccttggcaagacaactatggtatcaaaccgacttcggctcgctctcgtgagaatgcagcaactgaagggcttcgtcgtccgggccatgaccctcgaggacatacagacgagggaagtcagacacatctcacatctgaactttaccgcatggccagatcacgatacaccctcccagcccgacgacctgttaacttttatatcttacatgcgtcatatccatcggtccggacctataattacacactgctccgcggggatcggtcggtccggaacacttatatgcatcgacgtcgtgttaggcttaatatctcaggacctggatttcgacatcagcgacctggtgaggtgcatgaggttgcagaggcacgggatggtgcaaaccgaggaccaatacatcttctgttatcaggtcattctctacgtgcttaccaggctccaagcagaagaggaacagaagcagcaacctcagctgcttaaatag

SEQ ID NO: 130866 - DNA, 7473 bp, Artificial Sequence
  Description of Artificial Sequence: Synthetic coding sequence
atgcacgtatccctggcagaggcactcgaggtaagggggggaccactccaagaagaagagatttgggccgtgctaaaccagtcagcagagagtctccaggagctgttccggaaggtgtcactcgcagatccagctgccctgggctttattatttccccatggtcactactgctgctcccgtccggcagtgtgtcctttacagacgagaatattagcaaccaggatctgcgtgcattcaccgctccagaagttctgcagaaccagagcttaacgtctttatccgacgtggagaaaatccacatttactcgctgggcatgacgctctactggggcgccgattatgaggtgcctcagagtcagcctattaagctgggcgatcatctaaatagtatattgctcggaatgtgcgaggatgtgatctacgcccgcgtgtccgttcgcacagtactcgacgcttgctctgcccacatccgaaacagcaactgtgcccccagctttagctacgttaaacacctggtaaaactagtgctgggcaatctatccggaacagatcagctgtcgtgtaactctgaacaaaaaccagaccggagtcaggcaatccgcgacaggcttcggggaaagggcctcccgaccggccgcagctccacgtcagacgtgcttgatatccaaaagccccctttgtcccatcaaactttcttaaataaaggactaagtaagtctatgggttttctgtccatcaaggacacccaggacgaaaattactttaaggacattttgtccgataatagtggccgggaggatagcgagaacacgtttagcccttaccagttcaagacctccgggcctgagaaaaaaccgattcccggcatagacgtcctttcaaagaagaaaatttgggcatcctccatggacctcctgtgtactgcagaccgggatttcagcagtggcgaaaccgctacctaccggagatgccacccagaagctgtcactgtgagaacctccacaacgccaagaaagaaggaggccagatatagcgatgggtctatagcacttgatatttttggtccacagaagatggatccaatctatcacaccagagagctccctacttcatccgccattagttccgccttggatcgcattcgggagcgtcaaaagaagctgcaagtgctgagggaggcaatgaatgtagaggagccagtccgtagatataagacctatcacggtgacgttttcagcacatctagcgaatccccctcgattatttccagcgaatcagacttcagacaggtgcgacgcagtgaggcatctaaaaggtttgaatccagcagtggcctccccggcgtagacgaaactctctcgcaaggccagtcccagcggccttctcgccagtacgagaccccattcgagggaaacctgataaaccaggaaataatgctgaaaagacaggaggaagagctgatgcagctacaggcaaagatggccttgcgacaatctcggctgagcctttatccaggcgacactataaaagccagtatgctggacatcactagggatcctctgcgagagatcgctctggaaacagctatgacgcagaggaaacttcgcaacttcttcggcccagagttcgtcaaaatgacgatcgaaccctttatcagcctggacttaccgcgcagcattcttacgaagaaggggaagaacgaggacaaccggcgcaaggtaaatataatgttgttaaatggccagcgtctggaactgacctgcgacacgaaaactatttgtaaggacgtgttcgacatggtggtagcacacatcggtctggttgaacaccatctttttgccctggccactcttaaagataatgagtacttttttgtcgatccagacttgaagttgactaaagtggcacctgaggggtggaaggaagaacctaaaaaaaaaaccaaggccactgtgaacttcactttgtttttccgcataaagttcttcatggacgatgtatcattgattcaacacacacttacctgtcaccagtactacttgcagcttcgtaaggacattctggaggaaagaatgcactgcgacgacgagaccagtctcctgctagcctccctggccctgcaggccgagtatggagactaccagcccgaggtgcatggggttagctacttccgtatggaacattacctgccagctagagtcatggaaaagctagacctgagttacataaaggaagagttacccaagctccacaacacctatgtgggcgccagtgaaaaggaaactgaactcgaattcctcaaggtgtgccagcgtctaactgagtacggcgtgcactttcaccgcgtacacccagagaaaaagtcccagaccggcattctgctgggcgtgtgcagtaagggagtgcttgtattcgaggtccataatggggtgagaaccctcgttctgaggtttccctggagggaaactaaaaagatctccttttccaaaaagaaaattactctccagaatacctccgacggaattaaacacggtttccagactgacaacagtaagatttgccaatatttactgcatctatgtagttaccagcataagtttcaattgcagatgagggctagacagtcaaatcaggatgcacaggatatagagagagcttcttttaggtcactcaatctgcaggccgagtcagtgcgcgggtttaacatgggacgggcgatttccaccggcagtctggcgtcgtctaccctcaataaactggccgtgcggcccttgtctgttcaggccgaaatccttaaaaggctgagctgttcagagctgtctctgtatcaaccgctacagaattccagtaaagaaaagaatgataaggcctcgtgggaggagaaaccccgtgaaatgtccaagtcataccatgatctgtctcaggcttctctgtaccctcatcgtaagaacgttattgttaacatggagcccccgcctcagacagtggcagagctggtgggcaaaccatcccaccaaatgtctagaagtgatgctgagtccctggccggggtgacgaaactgaacaattcaaaatctgttgcaagcctcaaccgctctcccgaaagaaggaaacacgaaagcgatagctcgagcattgaagaccccggccaagcctacgtcctagggatgactatgcattcttcgggaaattcgtcaagtcaagtccctctgaaggagaatgacgtcctccacaaaaggtggtccattgtaagtagccccgagcgggaaatcacactcgtcaacctgaagaaggacgctaaatacggcttggggttccaaattatcggtggagaaaaaatgggccgccttgatctgggcattttcatatcctccgtggcccctggggggcccgccgacctggatggatgccttaagcctggggataggctcataagcgtgaatagcgtctccctcgagggggtgtctcaccacgctgcaatagaaattctccaaaatgcccccgaggacgtaaccctggtaattagccagcctaaagagaaaattagcaaagtccctagcacccctgttcatctaacaaatgagatgaagaactatatgaaaaagtcaagttatatgcaggacagcgcaattgactcttcctcgaaggatcatcactggtcacggggcaccttaaggcatatcagtgaaaatagctttggccccagcggaggcctgcgcgaaggatccctgtcttcacaggatagtcgtacagaatctgcatccctgagccagtcccaggtgaatggctttttcgcatctcacctgggggaccagacgtggcaagaatcacagcacggatcaccaagcccctctgtaatctcaaaggccacagaaaaagagaccttcacagattctaaccagtctaagaccaaaaagccagggatctctgacgtcactgactattcagatcgaggcgactcagacatggacgaggctacttactcctcaagccaagaccatcagactcctaaacaggagagctccagctctgtgaacacctcaaacaaaatgaatttcaagacattttcaagctcacctccaaagccaggggacatcttcgaggttgaattggcaaaaaatgataattctctgggaatctcagtgaccgtactctttgataaaggaggagttaacacctccgtgaggcacggcggcatatacgtgaaagccgtcatacctcagggagccgctgagtcggacggacgaattcacaaaggtgatagagtgcttgccgtcaatggggtgagccttgagggggccacacacaagcaggccgtcgaaactctccggaacactggacaggttgtacatctgttgctggaaaagggccagtcccccacatccaaggagcatgtgcctgtgacccctcagtgtacattatctgaccaaaacgctcagggacagggcccagaaaaagtcaagaagaccacgcaagtgaaagattactcctttgtgacagaagagaatacatttgaggtgaaactcttcaagaattctagcggtctcggattctcttttagccgagaggacaacctgattcctgaacagattaacgcctcaattgtccgggtgaaaaagctgtttccgggccagcctgcagcagagtccggtaaaatcgacgtgggcgacgttatcctcaaggtaaacggagcttcgttaaaaggactcagccagcaagaggtgatctctgccctgcgcggtaccgccccagaagttttcctcctgttgtgtcgtcctccccctggcgtgctgcccgaaatcgacaccgccttgctgaccccattgcagtcgcctgctcaggttctgccaaacagctctaaagattcttctcagcctagctgcgtggagcagtctacttcaagcgatgaaaatgagatgagtgataagagcaagaaacagtgcaagtctccttcaaggagggactcttactccgactcctcggggtccggagaagatgatctggtcacagccccagccaatatcagtaatagtacgtggagcagcgcgctgcaccaaacactgtcgaacatggtaagtcaggcacaatcccatcatgaggcacccaagagtcaggaggacacgatttgcactatgttctactaccctcaaaaaataccaaataaaccagagttcgaggacagcaacccatcgcctctgcccccagacatggccccaggacagtcatatcagcctcagagcgaatcagcctcttcgtccagcatggacaaatatcatatccaccacattagcgaacccactaggcaggagaattggacaccactaaagaatgacctggagaatcatctggaggacttcgaactagaggtggaacttctgatcacactgatcaaatcggagaaaggctcattgggttttacagtgactaaggggaatcaacgaatcggctgttatgtccatgacgtaattcaagatcctgccaagagtgacggcagactgaaaccaggggaccgcttgatcaaggtgaatgatacagatgttacgaatatgacacacaccgatgctgttaacctgttgcgagccgcctccaagactgttcggctggtgatcggaagagtactcgagttgccacggatcccaatgttgccacacttgctgcccgatatcacccttacatgcaataaagaggaacttggcttttctttgtgcggcgggcacgattctttgtaccaagtcgtgtacatcagtgatataaacccacggtccgtggctgccatcgaagggaatctgcagctcctggacgtaattcattatgtgaatggggtatccactcaaggcatgacactggaagaggtgaaccgggccctggacatgtctttacctagccttgtgctaaaagcaacccgaaacgacctgcctgtagtgccttcctcaaagcgatccgccgtgtctgctccaaagtcaacaaaaggtaatggatcctacagcgtcggcagctgcagtcaaccagccctcactcctaatgatagtttttctactgttgccggggaagaaatcaatgaaatctcctatcccaaaggtaaatgcagcacttaccagataaagggctctccaaacctgactttaccaaaagagtcctacattcaggaggatgacatctacgatgacagtcaggaggctgaggtcatccagagtctgctggacgttgtcgacgaggaggctcagaacttgcttaatgagaataacgccgccggatattcctgtggtccgggaaccctaaagatgaatggcaagcttagtgaggaaaggaccgaagacactgactgcgatggctcccccttacccgagtatttcactgaggccacgaaaatgaacggatgcgaggagtattgtgaagaaaaagtgaaatccgagtccctcatccaaaaacctcaagaaaaaaagacagacgacgatgaaataacgtggggaaatgacgagctcccaattgaacgtacaaaccacgaagacagcgataaagaccattctttcttgacaaatgacgaactggcagttctgccagtcgtgaaagtcttacccagcggcaaatatacaggggcaaacctgaaatcagtgatccgggtcctgcgggggcttcttgatcaaggtatcccttcaaaagagctcgagaacctgcaggaactgaaacctctagaccagtgcctgatcggccagacaaaagagaaccggcgaaaaaatcgctataaaaacatactgccttacgatgccacgcgagttccccttggagacgaaggcggatatatcaacgcctctttcattaagatcccggttggcaaggaggagtttgtctatatcgcttgtcagggcccactgcccactacggtaggcgacttttggcagatgatatgggagcaaaagagtactgtgatcgccatgatgactcaagaggtcgaaggtgaaaaaatcaaatgtcagcgctactggcctaacattctggggaagaccactatggtatctaaccgactccggttggctctggttcggatgcagcaacttaagggtttcgtcgtgagagcaatgacactggaagacatacagacgagagaagtgcgacacatcagtcacctgaatttcaccgcctggcctgaccatgatacacccagccaacccgatgatctactcacctttataagctatatgaggcacattcatcgtagcgggcctataattactcattgcagcgcgggaataggccgcagcggcactctgatatgtatcgatgtggtgttgggcctgatcagccaggatcttgacttcgacatctctgatctggtgaggtgcatgaggctgcaacggcacggtatggttcagactgaagaccagtacatcttctgctatcaagtgattctgtacgtgttgacgcgactgcaagccgaagaggaacagaagcaacagccgcagttactgaaatag

SEQ ID NO: 130867 - DNA, 420 bp, Artificial Sequence
  Description of Artificial Sequence: Synthetic coding sequence
atgcatgtgagtttagccgaggctttagaggtaaggggcgggccgctgcaggaggaggaaatttgggcagtgctgaaccaaagtgcagagtctctccaagagctgttcaggaaagtgagtctagccgaccctgctgccctcgggtttatcatttctccctggagcctgttactgttaccctctggaagtgtaagctttacggatgagaatattagtaatcaagacttgagggccttcacagcacctgaggttctgcagaaccaatccctcaccagtctgagcgatgtcgagaagatacacatatactctttgggaatgactttgtactggggagcggactatgaggtgccacagagtcagcctattaagcttggggatcatctgaactcaatactgttaggcatgtgtgaggatgtgtag

SEQ ID NO: 130868 - DNA, 7473 bp, Artificial Sequence
  Description of Artificial Sequence: Synthetic coding sequence
atgcacgtcagcctagccgaggccctggaagtaagggggggtcctcttcaagaagaggaaatttgggctgtcttgaatcaaagcgcggagagcttgcaagagttatttcggaaagtgtcgctggcagaccccgcggccctcggattcatcatctcgccttggtccctgctgttgctcccatcaggatccgtgagctttacagacgagaacatttccaatcaggacctaagagccttcacagcacctgaggtgctgcagaaccagtcactcaccagcctcagcgacgtggaaaagatccacatttactcgctcggaatgaccctgtactggggagctgactacgaagtgccccagagccaacccattaaattaggtgatcacctgaacagtattctcctcggaatgtgtgaggacgtcatctatgccagagtcagcgtcaggaccgtgctggacgcttgctcagcccacattcgaaacagcaactgtgccccttccttttcatacgtgaagcatctggtaaaactcgttctaggcaacctgtcaggaactgatcagctcagctgtaattcagaacagaagcccgacagaagtcaggccattcgcgataggctgagaggaaagggcctgcccacaggtcggagcagcacgagcgacgtgctggacattcaaaagccccccctctcccaccaaacctttctgaataaggggctgtctaagagtatggggtttctgagcataaaagacacacaagacgagaactactttaaagatatcttgagcgacaatagtgggcgcgaagattcagagaatacatttagcccttatcagtttaagactagcgggcccgagaagaagccaatccccggaattgatgtgctttccaagaagaagatctgggcgtcatccatggatctcctctgtacggccgacagggatttcagcagtggtgaaactgccacatatcggagatgtcatcctgaagcagtgacagtgagaactagcacgaccccgcgaaagaaggaggctagatattctgatggttccattgctctcgacatcttcggaccacagaaaatggatccaatttatcacaccagagagttgcctacaagctcggcaatctcttctgcattggacagaattagagagcgtcagaagaaactccaggtcttaagggaggctatgaacgtggaggagcccgtgcggcgatacaagacttaccacggtgatgttttttctacctcttcagagtcgccatctatcatttcaagtgaatctgactttcgacaggtgcgacggagcgaggcctctaaacggttcgaatctagtagtggactgcccggcgttgatgagacccttagccagggccaatcccagcggcccagtagacagtatgagacgcctttcgaggggaatctgatcaatcaggagattatgttaaagcggcaagaggaagagctcatgcagctccaggccaagatggcacttcggcagtccaggttgtcactatatcctggcgacacaattaaagcctcaatgctagacattacccgcgaccctttaagggaaatcgccctagaaaccgctatgacacagcggaaactgcgaaattttttcgggccagaatttgtaaaaatgacaatcgagccctttatttctctggatctccctaggtccatactcaccaagaagggtaaaaatgaggacaatcggcggaaagttaatattatgcttctgaatggacagcgactggagctcacgtgtgatacaaagactatctgcaaagacgtgttcgatatggtggtcgctcatatcggtctggtggaacaccacctttttgccttggctacactgaaggataatgagtacttcttcgtggaccccgacctcaagctcacaaaggtggccccggagggttggaaagaagagccaaagaaaaagacaaaggccacagttaattttactctgttcttccgtataaaattctttatggatgacgtgagcctcattcagcatacgctaacatgtcaccagtattatctgcagcttcggaaggatattctagaggagaggatgcattgcgacgatgagacttcactcctgctagcaagccttgccctgcaggccgaatatggcgactaccagccagaagtccatggcgtttcctatttccgaatggagcactatttgcctgcacgcgtgatggaaaagctggatctgtcttatatcaaagaagaacttccgaagttgcacaacacgtatgtgggcgcgagcgagaaggagactgaactagaattcctgaaggtttgccagcgtctgactgaatacggtgtccatttccaccgggttcatcctgagaaaaaatctcagactggtattcttttaggagtgtgtagcaaaggcgttctggtttttgaggttcataatggtgtgaggactcttgtgcttcgtttcccttggagagaaaccaaaaaaatctctttttccaaaaagaagataacccttcagaatacatcggacggtattaaacacggatttcagaccgataatagcaaaatctgtcagtaccttttgcatttgtgttcctaccagcataagttccagttgcagatgcgggctagacaatcgaatcaggacgcccaggacattgagagagccagttttcgctccctgaacttgcaggctgagtctgtgaggggtttcaatatgggccgggcgatcagcacaggctccctagctagttccaccctcaacaagctggcggttaggccattatccgtccaagcggagattttaaagcgtctctcatgtagcgagttgtccctataccagccactccagaacagctcaaaggaaaagaatgacaaagccagctgggaggagaaacctcgggagatgagtaaatcctaccacgacctgagtcaggcctccctttacccccataggaagaatgttattgtcaatatggagccgcccccgcagacagtagctgagctggtggggaagccctcccaccagatgagcaggtccgatgctgaatcgctggcaggcgtgactaagctaaacaactcaaagagcgtggcttctctcaatagatctcccgagcgtagaaaacatgagtcagactcatcgtccatcgaggatccggggcaggcttacgttttggggatgaccatgcactctagcgggaatagctcgtcgcaagtgcccctgaaagaaaacgatgtcttgcacaagagatggtccattgtaagcagccctgagcgcgaaattactcttgtgaatttaaagaaggacgccaaatacggcctcggatttcagatcatcgggggcgagaaaatggggcggttggacttaggtattttcatcagctcggtagctcctggtggccctgcagacctggacgggtgcctgaaacccggggataggctgatctccgtgaattcagttagcttggaaggagtgagtcatcatgctgctatcgagatccttcagaacgctcccgaagacgtcacgctggttattagccagccaaaggaaaaaatcagcaaggtcccctcaaccccagtgcaccttactaacgaaatgaaaaactatatgaagaagtcttcatatatgcaagatagcgcaattgactcatccagcaaagatcaccattggtccagaggaactctccgacacatctctgagaacagcttcggtccatctggaggactgagggagggctctttatcctcccaggacagcagaacagagtctgcatctctctcccagtcccaggtcaatggcttttttgcatcacatctgggcgaccaaacatggcaggagagccagcacgggtcaccgtcacctagtgtcatttccaaggccacggagaaagaaacgtttaccgattccaaccagagcaagacaaaaaagccaggcatttctgacgtgacagactattctgacagaggcgatagcgatatggatgaggctacctacagttcctcgcaggaccatcaaacaccgaaacaagagtctagctcctctgtgaatacctctaacaagatgaattttaaaaccttttccagcagtcctccaaaacctggcgacattttcgaagttgaactcgcaaagaacgataactccctgggcatatccgtaaccgttctgttcgataagggaggggtgaatacatcggtgaggcatgggggcatttacgtgaaggcggtgatcccccaaggtgctgccgagtccgacggcaggatccataagggcgatagggtcctggccgtgaacggagtcagtctggagggagccacccataaacaagcagtggagaccttaaggaatacaggccaggtagtgcatctgctactggagaagggacagagccctacttctaaagagcacgtgccggtaaccccccaatgcacgttgtctgaccagaacgcccagggccagggtcctgaaaaggtaaagaagaccactcaggtcaaagactattccttcgtcacagaagaaaatacatttgaggttaagctatttaagaacagttccggactagggtttagctttagcagggaagataacctcatcccagagcagataaatgccagcattgtgcgcgttaaaaagctgttccccggccagcctgccgcggagtccggtaagattgatgtgggagacgtgatcttgaaagtcaatggggcctcgctgaagggtctcagccaacaggaggtgatcagcgcccttagggggacagctccagaggttttcctcctgttgtgcaggcccccgccaggtgtattgccagagatcgacaccgcccttttaacacctttgcagtcgcccgcacaagtcttgcccaacagctcgaaagattcctcacaaccgtcatgcgttgagcagtccacctcgtcagacgaaaacgaaatgagcgataagtctaagaagcagtgtaagagcccgtcacgacgggattcctactccgatagctctggatccggggaagacgaccttgtgacggctcctgcaaacatctctaattcgacgtggtcctccgccctccaccaaaccctctcaaacatggtgtcccaggcacaatcacatcatgaagcccccaagtcccaagaggacacaatttgcacgatgttctattacccccaaaaaatcccgaacaagcccgagttcgaggattccaatcccagtccgctgccaccagacatggcccccggacagagttaccaaccgcagtctgaaagcgcctcttcatccagtatggataagtatcatattcaccacatatccgaacccacccgccaggagaattggacacctctgaaaaacgatcttgaaaaccatttggaggatttcgagcttgaggtggagttactcattaccctgataaaatccgagaaagggtctcttgggtttacggtcaccaagggaaaccaacggattgggtgctatgtgcacgatgtcatccaagaccccgctaaaagcgacgggcgactcaagccaggcgatcgacttataaaggtaaacgacactgatgtgacgaacatgactcacacagacgccgttaacctcctgcgggcagccagcaagacggtgaggctggtgatcggtagagttttggaattgccacggatccccatgctgcctcacctactgccagacattaccttaacatgcaacaaggaagagctcggtttctctctttgtggtggccatgattctctgtaccaggtggtctatattagcgacataaatcctagatcagtggccgccatagagggcaatctgcaactgctggacgtcattcattatgtcaatggcgtgtctacccaggggatgacgctcgaggaggtgaaccgagcccttgacatgtctttgccttccctggtgctcaaagccacaagaaacgatcttcccgtggtgcccagctcaaagcggtcagccgtatcagcccccaaatctacgaagggaaacggcagctactcggtggggtcctgcagccagcccgcactgacaccaaacgactcattcagtacagtcgctggagaggagatcaacgaaattagctacccaaagggtaagtgctccacgtaccaaatcaaggggagccctaacctcaccctgccgaaggaaagctacatccaggaagacgatatctacgacgattcacaggaggccgaagtcatacaatccctgctcgacgtggtggatgaggaggctcagaatctgctgaatgagaataatgcggctggttattcctgcgggccaggcacactgaaaatgaacggcaaactgtcagaagagcgcacagaagataccgattgcgacggttcgcccttgcccgaatacttcaccgaagccacaaaaatgaatggttgcgaggaatactgtgaagaaaaagtgaaatctgagtccctgatccagaagccgcaagagaagaaaacagacgacgatgaaattacgtggggcaacgacgagcttcctatcgagcgtaccaatcacgaggactctgataaagaccactcttttctgacaaacgatgaactggccgtgctgcctgttgtcaaagttctgcctagcggtaaatacacaggtgccaatcttaagagcgtcatcagggtgctgcgagggctgcttgaccagggcataccaagcaaagagctggagaatctccaggaactgaagccactggaccaatgcctgatcggccagacaaaggaaaaccgacggaaaaatcgatataagaatatcctgccgtacgatgcgaccagggtgccccttggagatgagggggggtacatcaacgcctccttcatcaaaatcccagtgggcaaagaagagtttgtgtacatcgcatgccagggaccattgccaactacagtgggcgacttctggcagatgatatgggaacagaagtccaccgtaatagccatgatgactcaagaggtggaaggcgagaagattaaatgccagaggtactggcccaacatcctggggaaaacaacaatggtgagcaaccgcctccggctggccctcgttcgcatgcagcagctcaaagggtttgttgtgcgggctatgaccctggaggatattcagacacgagaagtgaggcacatctctcatcttaattttacagcctggcccgatcacgacaccccatcccagcccgacgatcttctgacatttatttcctacatgcgccacatccataggtcgggaccaattatcacccattgtagcgctgggataggcagatcaggtacactgatttgcatcgatgtagtgttggggctcatttctcaggacttggactttgacattagtgatctggtgcggtgcatgagactccagaggcacgggatggtccagacagaagatcagtatatattctgttatcaggtgatcctgtacgtgcttacgaggcttcaggctgaagaagaacagaaacagcagcctcagctgctgaaatag

SEQ ID NO: 130869 - DNA, 3564 bp, Artificial Sequence
  Description of Artificial Sequence: Synthetic coding sequence
atgcctttcgggctgaagctgcgacgcacccgaaggtacaatgtcttatcgaagaactgttttgttacccgcattaggctgctcgattccaatgtgattgaatgtactctgtccgtagagtcaacaggtcaggaatgcttagaggccgtcgctcagcggctcgaactacgcgagacgcattattttggtctttggttcctctccaagtcccagcaggcacggtgggtggagcttgagaaaccactgaagaaacatttggataaatttgctaatgagccacttctgtttttcggcgtgatgttctacgtcccgaatgtgtcgtggttgcagcaagaggctacccgatatcagtactatctgcaggtaaaaaaggacgtgctcgaggggcggttaagatgtaccttggatcaggtgatcaggctggcaggattagcagtccaggcagatttcggagattacaatcaatttgatagccaggactttttaagagaatacgttctcttccccatggatttagcccttgaagaggccgtcctagaggagttgacgcagaaggtggcacaagaacataaagcccattccggcatcttacccgccgaagctgagctgatgtacattaacgaggttgagaggcttgacggcttcggccaggagatctttccagtgaaggacaaccacggcaactgtgttcacctcggcatattcttcatgggaatttttgtgagaaaccgcatcggaaggcaggccgtgatatatcgatggaacgatatgggaaatatcacacacaacaaatccacaatcctcgtggaattaattaacaaggaagaaaccgccctattccatactgacgacattgaaaacgcaaaatacataagtcgactgttcgcaacccgtcacaaattctacaaacaaaataaaatttgtaccgaacagagcaactctcctccccccattcggcgtcagccgacgtggagccgcagttccctgcctcgccagcagccctacattctcccaccagtgcacgttcagtgcggagaacactattctgaaactcacacgagccaggactccatttttcatgggaatgaagaagcgctgtattgtaacagtcataattctttggacctcaactatctgaacggcaccgttacaaatgggtccgtgtgctctgtacacagcgtcaatagtctgaattgcagccaatccttcattcaggctagtcccgtgtcaagcaatctctccattcctggatccgacattatgcgggctgattacattccgagccatagacacagcgctattatcgtgccaagctaccgcccgaccccagactacgaaacggttatgcgacaaatgaaaagaggaattctgcataccgatagccagtctcagtcgctgcgcaatcttaacatcatcaacacccacgcctataaccaaccagaggatctggtctactcacagcctgagatgcgggaacgtcacccttatacagtaccgtatgggccgcaaggcgtgtacagcaacaaacttgtgtccccctccgatcagagaaatccaaagaataacgtggtgccatcaaagccaggcgcctcagcaataagccacacagtgagtacacccgaactggcaaatatgcaattgcaaggctcacataactattccactgcacatatgctcaagaactatctatttaggcctccacctccgtacccgcgacctcggcccgctacatcaacgccagaccttgcctcccatcgacacaaatacgttagtggatcctcccctgacctggtaacccgaaaagtgcaactgagtgtcaaaacatttcaggaggactcttcccccgtggtacatcagagcctacaggaggtcagcgagccactcacagcaaccaaacaccatggaaccgttaataagagacactctctggaagtcatgaactccatggtgcgcggcatggaagctatgacgctgaaaagtctccatttgcccatggcgcgtagaaacaccctccgggagcagggtccacccgaagagggatccggctcacacgaggtgccccagctccctcagtatcaccacaaaaaaacattttccgacgccaccatgttgatccattcctctgaatccgaagaggaggaggaggaggcccctgagtccgtgccacaaatcccaatgctccgggagaagatggagtatagcgcgcagctccaggcagcgttggcaagaatccctaacaagccaccgcccgagtaccctggaccccgcaagagcgtgtccaatggcgcgttgcgtcaggaccaggcatcattgcccccggccatggccagagctcgcgtgcttcggcatggtccagcaaaggctatctcgatgagccgtacagaccctcctgccgtgaatggagcttctttggggccctcaatatccgagccggacctcacaagcgtaaaggagagggtcaagaaagaaccggtgaaggaaagacccgtttccgaaatgttttctttagaggattccatcatcgagcgggagatgatgatcagaaatctggagaagcagaagatggccggcctggaggcacaaaaacggcccctgatgttagctgcgcttaacgggctgagcgttgcccgggtctccggtcgcgaagaaaacagagtcgacgccacccgcgtccctatggatgagagatttcggacccttaaaaagaagctggaggaagggatggttttcaccgaatacgaacagatcccgaagaagaaagccaatggtatattcagtacagcagccctgccagagaacgccgaaagatccaggattcgtgaagttgtgccttacgaggagaaccgcgtggaactcattccaactaaggaaaacaataccggctacatcaatgccagccacatcaaggtcgtagtggggggcgccgagtggcattacattgccacacaggggcccctgccacacacctgccacgatttctggcaaatggtgtgggaacagggcgtgaacgtgatcgctatggttaccgccgaagaggagggcgggaggacgaagtcacaccgctattggccaaagctgggaagcaaacacagttctgcaacgtacggcaagttcaaggtcactacaaagttccgtaccgattctgtctgctacgccacaacagggctgaaagtgaagcatctgctgtcagggcaagagagaacggtgtggcacctgcagtacaccgattggcccgatcacggctgcccagaagacgtccagggattcctgtcatacctcgaagaaatccagtcagtgcgacgccatacaaactcaatgctcgaaggaacaaagaaccggcatccacccatagttgtgcattgcagcgcgggggtcggtagaaccggagtattaatcctgagtgagctgatgatctattgtttggagcacaacgaaaaggtggaggtgcccatgatgttaaggctccttcgtgagcagagaatgtttatgatacagacaattgcccaatacaaattcgtttatcaagtgctgatccagttcctgcagaactcaaggctgatctag

SEQ ID NO: 130870 - DNA, 636 bp, Artificial Sequence
  Description of Artificial Sequence: Synthetic coding sequence
atgccattcggtctaaagctgagacggaccaggcggtataatgttctttccaagaactgtttcgtgactaggattcggttactggactcgaacgtcattgagtgtacactttcagttgaatccaccggtcaggagtgtcttgaagccgtcgcacagcgactggaactgagggaaacccactacttcggcctgtggttcctgtctaagtcccagcaggcccgctgggtggagcttgaaaagcctttaaagaaacatctggataagttcgctaacgaacccctgctgttctttggagtaatgttctatgtgccaaatgtgtcatggctccagcaggaggcgacaaggtaccagtattacctacaagtgaagaaggatgttcttgaggggcgcctgcgctgcacactcgatcaggtgattcgcctcgccggcctcgccgtgcaggccgacttcggtgactataatcagttcgacagtcaggacttcctgagagaatacgtgctatttcctatggacctcgcactggaagaggctgttctggaagaactgacccagaaggtggcgcaagaacataaggctcaccgtaccatcatggagaccgtctacacattagctttctctttgtggggcttttcgtag

SEQ ID NO: 130871 - DNA, 1383 bp, Artificial Sequence
  Description of Artificial Sequence: Synthetic coding sequence
atgtctaggtccctggacagcgcgagatctttcctggaacgattggaagcgcggggaggccgcgagggcgctgtcctcgccggtgaattctcagatattcaagcctgctctgctgcgtggaaggcagacggcgtatgctccaccgtagccggcagtcggccagagaacgtgcgcaaaaatcgctacaaggacgtactcccatatgaccagacacgtgttattctctctctgctccaagaagagggtcacagtgattatatcaatgggaactttattcggggcgtggatggcagtttggcgtatattgctactcagggtccgttgccacacactttgctggacttctggcgcttagtgtgggaattcggggtgaaggttatcctgatggcctgccgcgaaatagaaaatggccgtaagcggtgcgagagatattgggctcaggagcaggagccccttcagaccgggctgttctgtataactttaataaaagaaaaatggttgaacgaggatattatgctgcgcacgctcaaggtcaccttccagaaggagtcccgttctgtgtaccagttacagtacatgagctggcctgacagaggcgtgccgtcctctccagaccacatgcttgctatggtcgaggaggcacgtaggctccagggatccggacctgagcccctgtgtgtccactgcagtgctggatgcggacgcacgggcgtcctgtgcacagttgattacgtccgccaactgcttctgacccagatgatccccccagacttctccctttttgatgtggtcttaaagatgcggaaacagcggccagctgcggttcagacagaggaacaatatcggtttctgtaccatacagtggcacagatgttttgttccactttacagaacgcttcacctcactaccagaatatcaaggagaactgtgccccattgtatgacgacgcgctcttcttgagaacccctcaggctttgctcgccatcccgcgacctcctggaggggtgctgaggtccatctccgtccccgggagtccaggtcacgctatggcagatacctatgctgtcgtccagaaacggggcgcccctgcgggagccggctcgggaacccagaccggtaccggcaccggaacaggcgcgcgatctgccgaggaggcccctctgtattcaaaggtgacaccccgggcccagaggcctggagcccatgccgaggatgccagggggacacttccaggacgtgtgcccgcggaccaaagcccagccggctcaggggcctatgaagatgtggctgggggggctcaaacagggggcctcggctttaacctccgcatcggcagacctaaaggcccccgggacccgcctgctgaatggactagggtctag

SEQ ID NO: 130872 - DNA, 1248 bp, Artificial Sequence
  Description of Artificial Sequence: Synthetic coding sequence
atgcccacaacaatcgagagggagttcgaagaactcgacacacagcgtagatggcagcctttgtacttggagataaggaacgagtcccatgactacccccaccgcgttgctaaatttccagagaaccggaacagaaaccggtaccgcgatgtctctccttacgaccactcccgagtgaaactgcaaaatgctgagaatgactacatcaatgcgtccttagtggacatcgaagaggctcaacgctcctatatcctgacacaaggccctttacccaacacctgctgtcacttctggctgatggtctggcagcagaagacaaaggctgtcgtgatgctcaacaggattgttgaaaaggaaagcgtaaaatgcgcacagtattggcccactgatgaccaggaaatgctgttcaaagaaacaggattcagcgtgaaactgctgtccgaagacgtgaagagctactataccgtccatctgcttcagttggagaatatcaacagcggagagaccagaaccatatctcactttcactatactacgtggccagattttggggtgccagagtccccagcatctttcctcaacttcctgtttaaagtgagggagagcgggagcctcaatcccgaccatggcccggcagtgatccactgtagtgctggtatcggccgctcaggcacctttagcctcgtggacacgtgtctggtgctgatggagaagggcgacgacatcaacattaaacaagtcctgcttaatatgcggaaatatagaatgggattgattcagactccggaccaactgagattctcttatatggccattattgaaggcgctaaatgcattaagggagattcatcaattcagaagaggtggaaggagctctccaaagaggacttgagtccagccttcgaccattctcccaataagataatgacagagaagtacaacgggaatagaattggcctggaggaagaaaaactgacaggcgacagatgtacgggactgtcatcgaagatgcaggataccatggaggagaactctgagagtgcccttcgcaaaaggattcgggaagatcgcaaggctaccaccgctcaaaaagtgcagcagatgaaacagcgactgaatgagaatgaacggaaacggaaacggtggttgtactggcaaccgatcttgactaaaatggggtttatgtcagtgattctggtaggagctttcgtgggatggacgctgtttttccaacagaacgccttgtag

SEQ ID NO: 130873 - DNA, 1164 bp, Artificial Sequence
  Description of Artificial Sequence: Synthetic coding sequence
atgcctactacaatagaacgggagttcgaagagttggacacacaaagacggtggcagccactgtatctcgagattagaaatgagagccacgactacccccaccgcgtggccaagttccctgagaaccggaacagaaaccggtatagagacgtgtcaccatacgaccattccagggtgaaactgcagaacgccgagaatgactatattaacgcatctctggtcgatatcgaagaggcccagaggtcttacattcttactcagggtcccctgcccaacacctgttgtcacttctggctaatggtatggcagcagaagacaaaggccgttgttatgttgaaccgtatcgtcgagaaggaatcggtaaaatgcgctcagtattggcccactgatgaccaggagatgctcttcaaagagacaggattcagcgttaagctgctcagcgaggacgtgaaaagctattacaccgtccatctgctgcagttggagaacattaactccggcgaaacccggacaatcagccattttcactataccacatggccagacttcggcgtgcctgaaagcccagcctccttcctcaatttcctgttcaaggtgcgcgaatctggctctctgaaccctgatcacgggccagcagtgattcattgcagcgcaggtattggaagatcaggaaccttctctctggtagatacatgcttggtgctgatggaaaagggtgatgacattaacatcaagcaggttctgcttaacatgagaaagtacagaatgggactgatccaaactcctgatcaactgcggtttagttatatggcaatcatcgagggtgctaagtgtattaaaggagactccagtattcagaagcgatggaaagaactgtccaaagaggacttgtcgccagcctttgaccattctcctaacaaaatcatgacagaaaaatataatggcaaccgtattggcctggaggaggagaagctcacaggagatagatgtaccggattgtcatccaagatgcaggataccatggaagagaattctgagtcagccctgcggaaaaggatccgagaggatcgaaaagccactactgcccagaaagtgcagcagatgaaacagcgattgaacgagaatgaacggaaaagaaagcggcctcggttgacagacacatag

SEQ ID NO: 130874 - DNA, 1179 bp, Artificial Sequence
  Description of Artificial Sequence: Synthetic coding sequence
tgtcagcaggagttcaggatgtatggtaaggacggcaagggcacaaactggatggatcaaggcgatatggagtgtagaatgcaggagattgacgaccacagccgagtcaagctgcaaaatgccgaaaacgattacattaacgccagcctcgtcgacattgaggaggctcagcgaagctatattctgacccagggccctctgcccaatacatgctgtcatttctggctgatggtatggcagcagaagactaaagcagtggtaatgctcaaccgaattgttgaaaaagagtccgttaagtgtgcacagtactggccgacagacgatcaagagatgctattcaaagagacaggctttagcgtcaagctgcttagtgaggatgttaaatcatactatacagttcacctcctgcaattggaaaatatcaactctggagagaccagaacgatctcacactttcactatactacttggccagatttcggcgtccctgaatcaccggcatccttcctgaacttcctatttaaggtgagggaatcagggagcctcaatccagatcatggacctgcagtgattcactgttcagcaggaattgggaggagtggtactttctccctggtggatacgtgtcttgttctcatggaaaaaggagacgatataaacatcaaacaagtacttctaaatatgagaaaatatcgaatgggcctgatccaaacaccggaccaactgaggttcagttacatggctattattgagggagcaaaatgcataaagggagattcttcaattcaaaaacgttggaaggaactgtcaaaagaagatcttagcccagcctttgaccattctcctaataagatcatgaccgagaagtataatgggaatagaatcgggctcgaggaggagaagctgaccggcgacagatgtaccggcctgtcttcaaaaatgcaggacacgatggaggagaattccgagagcgccctgcgtaagcggatcagagaagaccgaaaggccacaactgcccagaaggttcagcagatgaagcaacgcctcaatgagaatgaaaggaagcgaaaacgatggctgtactggcagcctatactgacaaagatgggcttcatgagtgtgatcctggtaggggcgttcgtgggatggactctgttcttccaacaaaatgcgctgtag

SEQ ID NO: 130875 - DNA, 1062 bp, Artificial Sequence
  Description of Artificial Sequence: Synthetic coding sequence
atgcccaccaccattgaacgcgaattcgaagaattggacacccagcgacggtggcaacccctgtatctggagatcaggaacgaaagccacgactatccacatcgagtagccaagttccctgaaaaccggaaccgcaacaggtatcgtgatgtatctccgtacgaccactcacgcgtgaagctgcagaacgcagagaacgactatatcaatgccagtctggtggacatcgaagaggcccagcggtcctacatcttgacccagggaccactgcctaacacttgttgtcacttctggctcatggtgtggcagcagaaaaccaaagccgtggtgatgctcaatagaatcgtggaaaaggagtcagttaagtgcgcacagtattggcccactgatgaccaggaaatgctgttcaaagaaaccgggttcagcgtgaaactgttgtccgaagatgttaagagctactataccgtacatttactccagcttgaaaacattaatagcggcgagacacggacgatctcacatttccactacacaacgtggccagatttcggtgtgcctgagtcacccgcctcctttctaaatttcctgtttaaggtgcgagaaagtggaagtctgaatcccgaccacggcccggctgtcatccactgcagtgccggaatcggacgctctggcacgttctcattggtggatacttgcctggtgttgatggagaagggggatgatattaatattaagcaagtgctgttgaacatgaggaaataccggatgggtttgatccaaacccccgaccagctccggttctcttacatggccattattgagggcgccaagtgcattaaaggcgatagctccatacaaaaaagatggaaagagttatctaaagaagatctctctcctgctttcgaccattcgccaaataagattatgacagaaaaatacaacggaaaccgtattggcctcgaggaagagaagctcacaggcgataggtgtacgggtctatcctcaaaaatgcaggacacaatggaagagaactcagagcgcccacgcttgacagatacctag

SEQ ID NO: 130876 - DNA, 2424 bp, Artificial Sequence
  Description of Artificial Sequence: Synthetic coding sequence
atggaccagcgagagatcctgcagaagtttttagacgaagcacagagcaagaagattacgaaggaggagtttgcgaacgagttcctgaagctcaagaggcagtctacaaagtataaagctgacaagacatatcctactaccgtggcagaaaagccaaaaaatatcaaaaaaaatcgctataaggacatactgccatacgactactcccgagtcgagctaagcttaatcacgtccgatgaagatagcagctacatcaacgcgaattttatcaagggcgtgtacggacccaaggcatacatcgccacgcaaggaccgctgagtacaacgctcctcgacttctggcgtatgatctgggagtacagtgtgctcattattgtcatggcatgtatggaatacgaaatggggaagaagaagtgcgaacgctattgggcagagccgggagagatgcagctagagtttggtccgttctccgtgtcgtgtgaagctgagaaacggaagtccgactacattatacggaccctaaaagtgaaatttaacagcgagacgaggactatttaccagtttcattataaaaactggcccgatcatgacgttccctcttccatcgatcccattcttgagctcatttgggacgtgcggtgctaccaggaagatgacagtgtccccatatgtatccattgttcggccggctgtggtcgcactggtgtcatatgtgccattgactatacatggatgctccttaaggatggtattatccctgagaactttagcgtcttctccctgatacgcgagatgcgcacacaaaggccatcactcgtgcagacccaggagcagtatgaactcgtctacaatgccgtactggaactatttaagcggcagatggatgtcattcgggacaaacactctggaactgaaagtcaggccaaacactgcattccggaaaagaatcacacactccaagcagactcttattcacctaatctacccaaaagcacaactaaggccgccaaaatgatgaaccaacaacgaacaaaaatggagatcaaagagtcgtcaagcttcgacttcaggacctccgaaatcagcgccaaggaagaactcgtgcttcatcccgctaaatcttcaaccagctttgatttcctggaactcaactattccttcgataagaatgctgataccaccatgaagtggcagacaaaagccttccctattgtgggagagccacttcagaagcaccagtctttggatctgggaagcctgcttttcgaaggctgcagcaattctaaaccagtcaacgcagcaggccgatatttcaactccaaggtgcccatcacgaggaccaaaagtaccccctttgagctgatccagcaacgggaaaccaaagaggtggattccaaggagaactttagctatctggagtcccagcctcacgactcatgcttcgtggagatgcaggcccagaaagtgatgcatgttagcagtgcagagctcaactattctctaccatatgacagcaaacatcagatcaggaacgcatctaatgtgaagcatcacgactcctcggctctgggtgtgtacagttacattcctctcgtggagaatccctacttcagttcatggccgccctcaggcacaagcagcaaaatgagtttagaccttcccgaaaaacaggacggcaccgtcttcccgtctagcctcctgcctacctcgtccacatcattatttagctactataacagtcatgatagcctttcactgaactcaccaacaaatatcagctcccttctgaatcaggagtctgcggtgctggctaccgcaccacggatcgatgatgaaatcccaccgccgctacccgtgtggacaccagaaagttttatcgtcgtggaagaagccggtgaattttctcccaacgtgccaaaatccctgagctctgcggttaaggtgaaaatcggtacctccctggagtggggcggaacatcagaacccaagaagtttgacgattctgtgatattgagaccttccaaatctgtcaaactgagaagtcctaaatccgagctgcatcaggatcgatcaagcccaccaccccccctgcctgaacgcacactagagagcttttttcttgcagatgaagactgtatgcaggcccagagcatcgagacatactccactagctaccccgacactatggagaattctactagcagtaagcagacactgaagacgcccggcaagagctttacaaggagtaagtctttaaagatcttacgcaatatgaaaaagtcgatttgcaacagctgtcccccaaataaacccgcagaatctgttcagtccaataattcctcttccttcctgaacttcggcttcgccaatagatttagtaagccaaagggccctcgaaatcctccccctacttggaacatctag

SEQ ID NO: 130877 - DNA, 1692 bp, Artificial Sequence
  Description of Artificial Sequence: Synthetic coding sequence
atgttgctgaaggatggcattattcctgaaaacttcagcgtgttttctctgatccgagaaatgaggactcagagaccctctttggtccagacacaggaacagtatgagctagtgtataatgcagtgctggagttgtttaagcgtcagatggatgtcatcagagataaacatagcggaaccgagagccaggccaaacactgtattccagagaagaaccacaccttgcaagcggactcctatagcccaaatttgcctaagagcaccacaaaggctgccaaaatgatgaatcaacagagaaccaagatggagatcaaagaaagctcaagttttgacttcaggaccagtgaaatttcggctaaggaagaactggtgctccacccagccaaaagcagcacttcgttcgacttcctcgagctgaactactctttcgataagaatgcggacaccacaatgaaatggcagactaaagcattcccaatcgtgggcgagccacttcagaaacaccagtccctcgatctcgggagtctcctatttgaggggtgttcgaactctaagcctgtaaatgcagcagggcgctattttaattccaaagtgcctatcacccgaacaaagagtaccccttttgagctgattcagcagcgggagacaaaagaagtcgacagtaaagagaacttttcttatcttgaaagtcaaccccacgactcatgcttcgtagaaatgcaagcccagaaggttatgcatgtgtcttctgctgaactgaactactctctaccttatgactcaaaacaccagatccgaaatgcctcgaacgttaagcatcacgatagtagtgcacttggggtatatagttatataccactcgtggaaaacccatatttctctagctggccacctagcgggacaagctctaagatgagtctcgatctgcctgagaagcaggatgggaccgtgtttcctagcagtctactgccaacttctagcacaagcctgttctcttattacaatagccacgattccctgtccctgaattcacccactaatatctctagtcttctgaaccaggaatccgccgttctggcgaccgcaccacggatcgacgatgagatcccaccccctctgcccgtctggactccagagtcttttatcgtagtggaagaggctggggaattctcaccaaacgtgcccaagtctctctcctctgcggtaaaggtaaaaatcggcacgagtctcgaatggggagggacctcagaaccgaagaaatttgatgactcagtaatcctgaggccctccaagtctgtgaagctccggagcccaaagagtgaacttcaccaggatagaagcagtccacctcctcctcttcctgagcggacccttgaaagttttttcctcgctgacgaggactgtatgcaagcgcaatcaatagaaacctattccacaagttaccccgacacaatggagaacagtaccagttccaagcagacgctgaagacacccggtaagtcgtttacgaggtcaaagtcactcaagatcttacgcaatatgaagaaaagtatttgtaactcgtgtccacccaacaaacccgccgagagcgtccagtcaaacaattcctcttcctttctgaatttcggattcgccaatcgtttcagcaaaccgaagggaccccgaaaccccccaccaacgtggaacatttag

SEQ ID NO: 130878 - DNA, 4911 bp, Artificial Sequence
  Description of Artificial Sequence: Synthetic coding sequence
atggaggcagttcctcgcatgcccatgatttggttagacctaaaagaggccggtgatttccactttcaacccgccgtgaagaaattcgtgctcaaaaactacggcgaaaatcctgaggcctataatgaggaactgaagaagctcgaactgttgaggcagaatgccgtgagggttccccgggacttcgagggctgtagcgttttgcggaaatacctgggccaacttcattacctccaatcaagggtgcccatggggagcgggcaggaagctgcagtccctgtgacatggacagagattttcagcggaaaaagcgtggcccacgaggatatcaagtatgaacaggcctgtatcctgtataatctgggcgccctgcacagtatgctgggcgctatggacaaaagagtttcagaggaaggcatgaaagtctcctgtacccacttccagtgtgccgcaggcgcatttgcgtatctcagagagcacttcccccaggcatactcagtcgatatgtcaagacagatcttgacactcaatgtgaacttaatgctggggcaggctcaagaatgcctccttgaaaaatccatgctcgataaccgcaagtccttccttgtcgccaggatctccgcccaggtggttgattattacaaagaggcctgtagagcactggaaaatcccgacactgcaagtctgctcgggagaattcagaaggattggaaaaagttggtgcagatgaagatttactatttcgcggctgtggctcacttgcacatgggaaagcaagccgaagagcaacagaaattcggggagagagtggcctacttccaatctgcattagacaagttaaatgaagctatcaagcttgccaaagggcagcctgacaccgtgcaagacgccctacggttcacgatggacgtcatcgggggaaagtataactctgccaagaaagataacgactttatctaccacgaagctgtgccggccctggataccttgcagcctgtcaaaggagctccactggtaaaaccgttgcccgtgaatcccacggatcccgcagtgactggcccagatatcttcgccaaattggtacctatggcagcccacgaagccagttccctgtactctgaggaaaaagcaaaactgcttagggaaatgatggcaaaaattgaggacaagaatgaggttttggatcagttcatggattccatgcaactcgacccagagaccgtggataacctggacgcctactcccacatcccaccccagctcatggaaaagtgcgctgccctgagtgtgcggccagacaccgtaaggaatctggtccagagcatgcaggtgctatcaggagtgttcactgacgtggaggcatccctgaaggatattcgagacttactcgaggaggatgagctactggagcagaaatttcaggaggccgtcgggcaagcaggagccatctccataacctctaaggcggaattagctgaagtgagaagggaatgggcgaaatatatggaggtgcatgagaaagcttcctttactaactctgaactacaccgcgcaatgaatttacatgttggcaacttgaggttgctttcaggtcctctggatcaggtgcgcgccgcactgccaacgcccgcactctccccagaagacaaggccgttctgcagaatctcaagcgcattctcgccaaagtgcaagagatgcgcgatcagcgggtttcccttgagcagcagctgagggagctcattcagaaggacgatatcactgcaagtctggttaccaccgatcacagtgagatgaaaaagctttttgaggaacagttaaagaagtacgaccagctgaaagtttacctcgaacagaaccttgcagctcaggatagggtgctgtgcgctctcaccgaagctaatgtgcagtacgcagcagtcaggcgggttctctctgacctagaccagaaatggaattctaccctgcagaccctggtcgcttcttacgaggcttacgaggatttaatgaagaagtcccaggaggggcgcgatttctatgcagatctggaatctaaagtcgccgccctcctcgaacggactcagagcacttgccaggcccgcgaggctgctaggcagcagctacttgacagggagctgaaaaaaaaaccgccccctagacctaccgcccctaagcccctgctgcctagacgcgaagaatctgaggcggtggaagctggggaccctccagaggagctgaggtccctccccccggatatggtggccggacctagactgcccgacacattcctcggctccgccaccccactgcactttccccccagtccttttccgtcttccaccgggccaggtcctcattaccttagtggcccattaccacccggaacgtattcaggacctacccagctgatccaaccgagagcccccggcccacacgctatgcccgtggctcctgggcctgcactctaccccgcccctgcttacactccagagcttggactggtgcctagaagctctccacaacatggggtcgtatccagcccttacgtgggcgtcgggccggcaccccccgtggccgggctgccatccgcgcctccacctcagttttctgggcccgagcttgccatggcggtccgacccgccacaacaaccgtggattctatacaagcaccaatcccctcccacacagcgcctagacccaatcctacaccagcccctcccccgccatgtttcccagttccacctccacagccccttccaaccccttatacgtaccctgccggggccaagcagccaattccggcccaacatcacttttccagtgggatcccagcaggtttcccagcccctaggatcggcccacagcctcagccccacccccaaccgcaccccagccaagcctttgggccacagcccccccaacagcctctgcccttgcaacacccccacctatttcccccacaggcgcccggcttacttcctcctcagtctccctacccttacgcgcctcagccaggtgttctcggacagcccccgcctccactgcacactcagctctatcccgggcctgcgcaggacccacttccagcacactctggcgcactgcccttcccctcgcctggacctccccaacctccacatccccctctcgcctatggacccgccccatcgacgcggccaatggggccacaggcagcacccctgacaatccggggcccatctagcgccggccagtcaacgccatcccctcatctagttcccagcccagccccatccccgggacctggtcccgtcccaccacgccccccagccgcggaaccccccccttgccttcgtcgcggtgccgcggctgcagatttactgtcttccagtccggaatcacaacacggcggtacccaatcccctggcggcgggcagcccttgctgcagccaacaaaggtcgatgccgcagaagggcgtagaccacaggcgctgcgtctaattgaaagagatccctatgagcaccctgagagactgcggcagcttcagcaggagctcgaggccttcagaggacaactgggagacgtgggggccttggacactgtgtggagggaacttcaagacgcccaagagcatgacgctagaggaaggtcgatcgccatagcgaggtgctactccctcaagaaccgccatcaagatgtgatgccgtacgactccaaccgggtggtcctgcgtagtgggaaggacgattacattaatgcctcatgtgtggaaggactatccccttactgccctcctctcgttgctactcaggctcccctgcctggcactgccgcagatttttggctgatggttcacgagcaaaaagtgtccgtgatagtcatgctggtgagtgaagccgagatggagaaacaaaaagttgcaaggtattttcccaccgagcgcggacagcctatggtgcatggtgctctcagtctagcgttgtcgtccgtgcgctcaactgaaacccatgtagagagggtactgagcctccagtttagagaccaatccctgaaaaggagtctggtgcacttgcactttccgacttggccagagctcggactccctgactccccatctaatctcctgcggtttatacaggaggtgcatgcccactacctgcatcagcggcccttgcacactccaatcatcgtccattgcagctcgggcgtcggccggactggcgcctttgccctgctgtacgccgctgtgcaagaagtggaggccggcaacggtattcctgagttgccacagctggttcgcaggatgcggcaacagcgcaagcacatgctgcaggagaagctacacctcagattttgctatgaagccgtggtaagacacgtagaacaagtgctgcagcgacatggcgtgcccccaccttgcaaacctctagcttccgccagtatctctcagaagaatcacctgccacaggacagccaggacctggtgttggggggggacgtgcctatttcctctatccaagcgacgatcgccaagctgagcattcggcctccgggaggactagagtccccggtggcctcactgcctgggccagcggagccgcccgggctcccaccagcctcgcttcccgagtctacgcctattcctagttctagtccccctccccttagctctccgctgcctgaggcccctcaacccaaggaagaaccaccagtgccagaggccccaagttccgggccaccctcaagctcactggagctcctagcatccttgacacctgaggcattttcacttgactcctcactgaggggcaagcagcgtatgtctaaacataacttcttgcaagctcataatggccagggactgcgggccacgcgtccttcagacgaccctctgtccttactggatcccctgtggaccttgaacaagacctag

SEQ ID NO: 130879 - DNA, 2739 bp, Artificial Sequence
  Description of Artificial Sequence: Synthetic coding sequence
atggaagcagttcccagaatgccaatgatttggttagatctcaaggaagcaggagactttcatttccagcctgctgtgaaaaagaatgccgtgcgtgtgcctagagactttgagggttgtagtgtgcttcggaagtaccttgggcaactacattacctgcagtctcgcgttcctatgggcagcggacaggaagctgccgtacctgtgacgtggacagagattttctcagggaagtcagtggcgcatgaagacatcaaatatgaacaagcatgtatcctgtataacctgggggctctgcacagtatgcttggcgcaatggacaagcgagtcagtgaggagtgtgctgctggtgccttcgcatacctgagggagcatttccctcaagcttacagcgtagacatgtcacggcagatcctcacactcaacgtgaatcttatgttggggcaggctcaggagtgtctgctcgagaagagcatgctggacaacagaaaaagctttttggtggctcggatttctgcccaggtggtggactattataaagaggcttgccgtgcgctggaaaatcctgatactgcaagcttactcgggcggatccagaaggactggaaaaagctcgtacaaatgaagatatactatttcgccgctgtcgcccacctgcacatggggaaacaggcagaagagcagcagaagtttggagaacgagtcgcttatttccagtccgcactggacaagttgaatgaggccattaaactcgccaaaggccaacctgataccgtgcaagatgcgctgaggtttacaatggacgtgattggaggaaagtacaattctgcaaagaaggataacgactttatttaccacgaagctgtgccggctctggacacattgcagcctgtcaaaggcgctcctctggttaagcctttaccagtcaacccaaccgatcccgctgtgacgggccccgacatcttcgccaaattagtcccgatggcagctcacgaagccagcagcctgtacagcgaggagaaggcaaagttactgagggagatgatggctaaaatagaagataagaacgaggtcttggaccagttcatggactctatgcaactggacccggagaccgtggacaatttggacgcatactcacatattcccccacagctcatggagaagtgcgcagcactctctgtgcggcctgacaccgtgagaaatctggtgcagagcatgcaggtcctgagcggggttttcacagacgtggaggcttctttgaaagatatacgagacctcttggaggaggacgaactcctcgagcaaaagttccaggaggcagtgggccaggccggcgccatttccataacgtccaaggccgagctggcggaggtgagaagagagtgggcaaaatatatggaggtccatgaaaaggcctcctttacaaattctgagctgcatagggctatgaatctgcacgtcgggaatctccggttgctttccggtccattagaccaggtgcgggccgccttgccaaccccagccctctcacctgaagacaaagctgttctgcagaatcttaagagaatcttagccaaggtgcaggaaatgcgagaccagcgggtctcgttggagcagcagctgagggagctcattcagaaggacgacattacggcctctttggtcaccactgaccattctgagatgaagaaactttttgaggagcaactgaaaaagtatgaccagcttaaagtgtacctcgagcaaaacctagcagctcaggacagggttctgtgtgccctgactgaagcaaatgttcagtatgctgcggttcggcgggtgctaagcgacctggatcagaagtggaactccacacttcaaacccttgtcgccagctatgaggcttacgaggatctgatgaaaaagagtcaggaggggcgggatttttatgcggacttagagtctaaagtggccgcacttctcgagcgaacccaatctacctgtcaggccagggaagccgcgaggcaacaattgctggaccgagaactgaagaagaagccccctccccgtcctacagccccaaagcctttattaccccggcgcgaagaatccgaagctgtggaagccggggaccctccagaggagttgcgttcacttcctcctgacatggttgccggacccagactgcccgatacttttctggggtctgctacccctctgcattttcccccgtcaccttttccatcaagtactgggccagggccacattatttatccggaccattacctcctgggacctactctggtcccactcaattgatccagccacgggcacccggcccccacgcaatgcccgttgcacccggtcccgccctctaccctgcaccgtcctctgcaccgtcttttacgtccgtttgggcgtcggcaccaacggctgcgccctccactccagcatcaacaagtctgcccacgcctggtcctaggaccccaacacctaccattcctctgccactctgtcccagcgcgtggggacccggggccgcagcaacgccaccaacgcaccctgctctgccacgttcacgctcccgtccctctgcctcacccttaaggggcagtgcattccctcagccttgggcacctagcgccagcccttctccaaccgggatttggagctgccctttctatcagacacatggacctcccgggagtccatcctaccactctagggctctggtgtgttggccagtccacccatag

SEQ ID NO: 130880 - DNA, 1698 bp, Artificial Sequence
  Description of Artificial Sequence: Synthetic coding sequence
atgaattacgagggggcaaggagtgagcgagaaaatcatgcagccgacgattctgagggtggcgcccttgacatgtgctgtagcgagcggctgccaggcttgccgcagccaattgtcatggaagcactcgatgaggcagagggcctgcaggatagtcagcgggagatgcccccccctccccccccaagcccaccaagcgacccggctcagaagcccccaccgcgaggtgctggctcccactccctcaccgtgcggtccagtctctgcttgttcgctgcttctcaattccttctggcctgtggggtgctctggttctcaggttacggacacatctggagtcagaacgccaccaacctcgtgagcagtttgcttaccctgctgaaacagctggagccgactgcatggctcgattctggcacttggggagtgccgtcccttctgctggtgttcctgtcggttggcctggtattggtaacgacactagtttggcatctgttgcggacacctcctgaacctccaacccccctgccacctgaagacaggcgacagtccgtgagcaggcagccgagctttacatattcagagtggatggaggaaaaaattgaggacgatttcctggacctagatccggtacctgagacacctgtcttcgattgcgtgatggatataaaacccgaggccgaccctactagtctcaccgtaaagtctatggggcttcaggagcggcgaggcagcaatgtgtctcttaccctcgacatgtgcactcccgggtgcaacgaagaagggtttggctaccttatgtcccctcgggaagaatccgcacgggaatacttgttgtctgctagcagagtgttacaggccgaagagttacacgaaaaagctctggacccattccttctgcaggccgaatttttcgagataccaatgaatttcgttgaccccaaggagtacgatattcctgggctcgtgcggaagaataggtacaagaccatactgccaaatccccatagccgggtctgcctgaccagccccgatccagatgaccctctgtcctcatatatcaatgctaattatattcgcgggtacggtggtgaagaaaaagtatatattgcaacccagggtcctatagtgtccaccgtcgctgatttttggcgtatggtctggcaagagcacactccaattatcgtaatgattactaacattgaggagatgaatgaaaaatgtacggaatactggcccgaagaacaggtggcctacgacggcgtggagattaccgtccagaaagtaattcatacggaggactatcgacttcgcctcattagtctcaagtctggtactgaagaaaggggactaaaacactactggttcacaagctggcctgaccagaagacaccggatagggcgcctccattgctacacctggttcgggaggtcgaagaggcggctcaacaggaagggcctcattgtgccccaatcatcgtgcattgctctgcagggatcggcagaacaggttgcttcattgccacctccatatgttgtcagcagcttagacaggagggggtggttgatattctgaaaaccacttgtcagctgcgacaggatcggggcggcatgatccagacgtgcgaacagtatcagttcgtccaccatgttatgagcctgtatgaaaagcaactcagccaccaaagcccagaatag

SEQ ID NO: 130881 - DNA, 1602 bp, Artificial Sequence
  Description of Artificial Sequence: Synthetic coding sequence
atgaactacgaaggggccagaagcgagcgcgagaatcacgcggcggacgactctgagggaggtgcccttgatatgtgttgtagtgaacgcctgcccggcttgccacagcccatcgtcatggaagccctagacgaagcggagggtctgcaagactcacagagagagatgcctcccccgccgccaccctcaccaccctctgatccggcccagaagccccccccccgaggcgcgggcagccacagcctcacggttcggtctagcctctgcttgtttgccgcatcccaatttctcttggaaccaacggcttggctcgattctgggacctggggagtgccatccctcctcctcgtctttctctcagtcggtctggtactagtgacaaccctagtctggcatcttctcaggaccccccccgaacctcccacaccattacctcctgaagatcggcgacaatctgtctcccgacaaccgtccttcacttactctgagtggatggaggaaaaaatcgaagacgacttcctggatttggatcccgttcccgagactcctgtatttgattgcgtcatggacattaagccagaagccgaccccacaagcttaacggttaaaagtatgggtttacaggagaggcgggggagtaacgtgtcccttacactcgacatgtgtacacccggatgtaatgaggagggcttcggctacctcatgagcccacgggaggaaagcgcccgcgaatatctgctttccgccagccgggttctgcaggcagaagagttgcatgagaaagctcttgatccgtttcttctccaggcagagttctttgagatcccaatgaactttgtggatccaaaagaatatgatattcctggcctggtgaggaagaataggtataagacgatattgcctaacccgcactctcgtgtctgcctgacaagccctgatcccgacgatcctctgagtagttatataaacgcaaattatattcgtgggtatggcggtgaagaaaaggtgtatatcgccactcagggcccaatcgttagcaccgtggctgatttctggcggatggtgtggcaagaacacactcctatcattgtcatgattacaaatatcgaggaaatgaatgagaagtgtacagaatattggcccgaagagcaagtggcctacgacggggttgagattaccgtgcagaaggtgatccacactgaggactaccgcctgcgtctgattagcctgaaaagtgggaccgaggagcggggcttgaagcattactggttcacctcatggcctgatcagaagacacccgacagggctcctcctctgctacatctagtgcgggaggtcgaagaggccgcacagcaagagggacctcattgtgctcctattatcgtgcactgcagtgctggaatcggacgtaccgggtgtttcatagccacatctatttgctgccaacaattgcgtcaagagggagtggtggacatcttaaaaactacctgccagctgcgtcaggatagaggtggaatgatacagacatgcgagcagtatcagttcgtgcaccatgtgatgagcctctatgagaagcagctcagccaccagtcccccgaatag

SEQ ID NO: 130882 - DNA, 1698 bp, Artificial Sequence
  Description of Artificial Sequence: Synthetic coding sequence
atgaactacgaaggcgctagatctgaaagagagaaccacgccgctgacgacagtgaaggaggggctctggacatgtgttgttccgagagactgccaggactgcctcagccgattgtgatggaagccttggatgaagccgagggtctgcaggactcgcaacgcgaaatgcctcctcctccccccccatcaccaccttctgaccccgctcaaaagcctccccctaggggcgccggatcccatagccttaccgtacgctcgtccctctgcctcttcgccgcatctcaattcctcctggcctgcggtgtcctgtggttcagcggatatggccacatctggagtcagaacgccaccaatcttgtcagctcgctgctcaccctattaaaacagctcgaacctacagcatggctggattctggtacttggggcgttccctccttgctgctggttttcttgtccgttggcctcgtgctggtgactacactcgtctggcatcttctgcggacccctcccgagcctccaacgccactccctccagaggatcggagacagagcgtcagtaggcagccgtctttcacatattcagaatggatggaggaaaagatagaggacgacttcctggatttggatccggtacctgaaacaccggtgttcgactgtgtgatggacattaagcccgaggccgatcccacaagtctgacagtgaagagtatgggactgcaggagcgcagggggtcgaacgtcagtctgacactggacatgtgcacccctgggtgcaacgaggaggggttcggctaccttatgtctccgcgagaggagagcgctcgcgaataccttctgtccgcaagccgggtgcttcaggccgaggaattgcacgaaaaagcactcgatccctttctcctgcaggccgaatttttcgagattcccatgaactttgtggacccgaaggagtatgacattcccggtttggttcgcaagaaccgctacaaaacaatcctccccaaccctcacagtcgcgtctgcttaacctcacccgacccggacgatcctctttcctcatacatcaatgctaattacattcggggctacggcggtgaggagaaggtatatatcgctacacaaggccctatagtgagcacagtcgctgacttttggagaatggtgtggcaggaacatacgcccattatcgtgatgataacgaacatcgaggagatgaatgaaaagtgtacggagtattggcccgaagaacaggtcgcctatgacggtgtggaaataacagtacagaaagtaattcacaccgaggattacagactgaggctgataagtctcaaatctggcactgaagaacggggactcaagcattattggttcacgtcttggcccgaccagaaaactcccgatcgcgcaccccctcttctccacttagtccgcgaggtggaggaggctgcccagcaggaagggcctcactgcgcacccatcatagtgcactgctctgccggaattgggcggacaggttgtttcattgctacaagtatctgttgccagcagctgcgccaggagggggtggtggatattctcaaaacgacttgccaactgcgtcaggataggggtgggatgatccagacctgtgagcagtaccaattcgtgcatcacgtgatgtcgttgtacgagaagcagctatcgcaccaaagccctgagtag

SEQ ID NO: 130883 - DNA, 1788 bp, Artificial Sequence
  Description of Artificial Sequence: Synthetic coding sequence
atggtgcgctggttccaccgagatttgagcggcctggacgcggaaactcttctgaagggacgcggcgtgcacggctccttcttggctcgacccagcagaaagaaccagggcgacttctctctgagtgtcagagttggagaccaggtgacccacatccggatccaaaacagtggtgacttctacgacctctacgggggcgaaaagttcgcgaccttgacggaactggttgagtattatactcagcagcagggtgttttacaagacagggatggaaccatcattcacctaaagtatccattaaattgctcagaccccacttccgagcgctggtaccacggacacatgtctggcggacaggccgaaacgcttctccaagcaaagggcgagccctggacctttcttgtgagggaaagcctgagccagccgggtgatttcgtgctgtcagtgctttccgaccaaccgaaagctggacctgggagtcctttgcgcgtcacgcacatcaaggtcatgtgtgaaggcgggcggtatactgtgggcggtctcgaaacatttgattccttgacggacctcgtggagcacttcaagaagacggggattgaggaagcttccggtgcgtttgtgtacctgcggcagccctattacgctacaagagtgaatgcagccgacatcgaaaacagagtcttggagttgaacaagaaacaggaaagcgaggacacagccaaagcagggttttgggaggagtttgagtcactccaaaagcaggaagtgaaaaatttgcaccaacgactggagggccaaagacccgagaataagggcaagaaccggtataaaaatatcctcccattcgaccattcccgtgtgattctccaggggcgcgactccaacatcccgggtagtgactacatcaacgccaactacattaagaatcagctcctgggacccgacgaaaatgcaaagacctacatcgcatctcagggatgtcttgaggcaaccgtgaatgacttttggcaaatggcatggcaggagaattcacgggttattgtcatgacaacccgggaagtagagaagggccgcaacaaatgcgttccgtattggcccgaggtagggatgcagcgagcatatggcccttattcagtaacaaactgtggagaacatgacaccaccgagtataaacttcggaccctacaggtatccccccttgataatggagacctcattagggagatatggcactaccaatacctgagctggcccgaccatggggtgccgtcggagccggggggagtcctgtcatttttggaccagatcaatcagcgacaggagtccttgccgcatgcgggacccatcatagtgcattgttccgcaggtatcggcagaacagggaccattatcgtgatcgatatgctcatggagaacatcagcaccaaggggctggattgtgacattgacatccagaagacaatacagatggtgcgtgcacaaagatcaggtatggtccagactgaagctcagtacaaatttatctacgtggctattgcgcagttcatcgaaactaccaaaaagaagctggaagtcttgcagagccagaaaggccaggagtcagagtatggcaatatcacgtacccgcctgccatgaaaaatgcacatgccaaggcaagccgcacctcatcaaagcacaaggaagacgtctatgaaaatcttcacaccaagaacaaacgtgaggaaaaagttaaaaagcagaggtccgcggacaaagaaaagtcaaagggaagcctaaagcggaaatag

SEQ ID NO: 130884 - DNA, 1794 bp, Artificial Sequence
  Description of Artificial Sequence: Synthetic coding sequence
atgttgagccggggctggtttcatagagacctgtcagggttagacgctgaaacattgctgaaaggaagaggcgtgcacggctcttttcttgcaagaccatcacgtaaaaatcagggagacttctctctgtcagtgcgagtcggcgatcaagttacacacatccggatccagaatagcggagacttctacgacctgtacggcggcgagaaattcgccaccctgactgaactggtcgagtattatacacaacagcagggagtactgcaggacagagacggtactatcatccatctgaaatatcccctgaattgttctgaccctaccagtgaacggtggtatcacgggcacatgtccggaggacaggctgaaacacttctccaagccaagggagagccctggacatttctcgtgagggaatccctctcccagcctggggactttgtcctgagcgtgttgtccgaccagcctaaagcgggacccggaagccccctgcgggtgacacacatcaaagtgatgtgcgagggcggacgctataccgtgggcggcttagaaacttttgattccctgaccgatctcgtggagcactttaaaaagacagggatcgaggaggcctccggggccttcgtctatctccgacagccctattatgcaacccgggtgaatgccgccgacattgaaaaccgtgtcctggaactgaacaagaagcaagagagcgaggatacagccaaggccggattttgggaggagtttgaatcactccagaagcaggaggttaagaatcttcaccaaaggcttgagggccagaggccagaaaacaagggcaaaaataggtataagaacatactgccatttgaccattcccgggtgatccttcagggccgagatagtaacataccaggatctgactatatcaatgcaaactatataaagaaccagctcttaggccccgacgaaaacgccaagacctatattgcttctcagggttgtctcgaggccacggtgaacgacttctggcagatggcttggcaggagaactcacgggtgattgtgatgaccactagggaagtggaaaaagggaggaacaagtgcgtaccatattggcccgaagttggcatgcagagagcttacggaccatacagtgttacgaattgtggcgagcacgacacgacggagtataaacttcggaccctgcaggtgtccccactcgataacggcgacttaattcgggaaatctggcactaccagtatttgtcatggcccgaccacggggtcccttcagagccaggcggcgtgttgtcatttttagatcagatcaatcagcgacaagaaagcctgccacatgccggacccatcatcgtgcactgttctgctggtattggtcgaacaggaacaattatagtaattgatatgctcatggagaacatttctaccaaaggactggactgtgatatcgacattcagaagacaatccagatggtgcgagcccagcggtcaggcatggtccaaaccgaagcccagtacaagtttatctatgtagccatcgcacagttcatcgagactacaaagaagaaattagaagtgctgcagagccaaaaggggcaggagtctgaatatgggaatattacctacccacccgcgatgaaaaacgcacacgccaaggcttcaagaactagcagtaagcacaaggaggacgtttatgaaaatctgcatacaaaaaacaagagggaggaaaaagtgaaaaaacagagaagcgcagacaaggaaaagtctaaagggagcttaaagcgtaaatag

SEQ ID NO: 130885 - DNA, 1671 bp, Artificial Sequence
  Description of Artificial Sequence: Synthetic coding sequence
atgctctcacgcggggtgggcgatcaagtcacccacattaggatccagaattctggagacttctacgacctttacggcggtgagaaattcgctacgctgacagagctggttgaatactatactcagcaacaaggagttctgcaggaccgggacggcactataatccacctgaagtacccgctgaattgtagcgaccccacctcagaacgctggtatcacgggcacatgagtggaggccaggcggaaacgttgctgcaggcgaaaggcgaaccatggacatttctcgtacgggaaagcttgtctcaacctggagattttgtcttgtcggttctcagtgatcaacccaaggccggtccagggtctcctttgcgcgtgacgcatattaaagtaatgtgtgaaggggggaggtatactgtgggcgggctggagaccttcgacagcctcacagatctggtggagcatttcaagaagacagggatcgaagaagctagtggggcgtttgtttatttgaggcagccgtattacgctacaagggtgaatgctgccgatattgagaaccgagtcttggaactcaacaaaaaacaggagtctgaagacacagccaaggccggcttctgggaagaatttgagtcccttcagaagcaagaggttaagaacctgcatcagaggcttgagggccagaggcctgaaaataagggaaagaatcggtacaaaaatattctgccctttgatcactcgcgggtgatcctccagggacgcgactccaatattccaggaagtgattatatcaacgcaaattacataaaaaaccagcttcttgggcccgacgagaatgccaaaacttacattgccagccagggctgccttgaagccactgtcaacgatttttggcagatggcctggcaggagaatagccgggtgatcgttatgactactcgggaggtggaaaaaggcaggaataagtgtgtgccttattggcccgaggtaggaatgcagcgcgcctatggaccctactccgtcacaaattgcggggaacatgacactactgaatataagttgagaacccttcaggtgagcccattagataatggtgacctgattcgagaaatatggcactaccagtatctgagctggccggatcacggtgtcccttctgagccaggtggcgtcctaagctttctggaccagattaatcagagacaagagtcactgccacacgccggacccatcatcgtgcactgctcagccggtattggccggacagggaccattatagttattgatatgttgatggaaaacattagtaccaaggggctcgattgcgacatcgacatccagaaaaccatacagatggtcagggcccaacggagtggaatggtccagaccgaagcgcagtacaaatttatatacgtggctattgctcaattcatagagaccactaaaaagaaactggaagtgctgcaaagccaaaaagggcaagagtcagagtacggaaacattacctacccgccagccatgaagaatgctcatgcgaaggccagtcgcacatcttcaaaacataaggaggatgtctatgaaaatctgcataccaaaaataagcgggaagagaaggtgaaaaagcaacggtctgcagataaagaaaagtccaagggatcactgaagcgaaagtag

SEQ ID NO: 130886 - DNA, 1875 bp, Artificial Sequence
  Description of Artificial Sequence: Synthetic coding sequence
atggtcagatggtttcatcgcgatttatctggcctagacgccgagacgctgctgaagggccgcggcgtgcacggatcctttttagcacggcccagccggaagaatcaaggtgatttcagcctgtcagtcagggtgggtgaccaggtgacccatattcgtatccaaaattccggagacttttatgatctgtacggaggagaaaagttcgccacccttaccgagctcgtggagtactatactcagcagcagggagtgcttcaggatagagatggaactataattcaccttaagtaccccctgaactgtagcgatcccacctctgagagatggtatcacggacatatgtcgggaggacaggccgagactctcctgcaagccaaaggcgaaccctggacatttctggtgcgggagtccctctcgcaaccaggcgattttgtcctcagcgtgctgtctgaccagccaaaggctggccccgggagtccactgcgggtgactcacattaaagtgatgtgtgaaggggggaggtatactgtgggcggcctggaaaccttcgatagcctcaccgatctggtggagcatttcaaaaaaacggggattgaggaagcttctggtgcattcgtgtatttacgccagccatactacgcgaccagagtgaatgcagcagacattgagaatcgcgttctggaacttaacaaaaaacaggagtcggaggacactgccaaggccggtttttgggaggagtttgagtcactgcagaagcaggaagttaaaaatctgcaccagcgcctcgaagggcagcggccagagaataagggaaaaaaccgctataagaatatactgccatttgaccattctagggtgatactccagggccgagactcaaacattccagggagtgattacatcaacgccaactacattaaaaatcagctgctcgggccagacgagaatgctaagacctatattgcgagccaaggatgcctcgaggccaccgtcaatgacttctggcagatggcttggcaagagaatagccgagtaattgttatgactacccgtgaagtggagaagggcagaaataaatgcgtcccctattggcctgaggtgggaatgcagagggcatacggcccctactccgtgaccaactgtggtgagcatgatacaacagaatataagttgcgaactctccaggtgtcacctttggataatggcgatctgatacgagagatatggcactatcaatatctgagttggccagatcatggggtaccaagcgagcccggcggcgtgttgtccttcctcgaccagatcaaccagagacaggagtctctgcctcatgctggacccataatagttcactgctccgccggcattggccgaactgggaccatcattgttatagacatgctcatggaaaatatttctaccaaaggcctggattgcgacatcgatatccagaaaactatccaaatggtgcgggcacaacgttcagggatggtccaaacagaggctcagtacaaattcatatacgtcgccatcgcccagtttatcgagaccacaaagaagaagctggaagtgctccagtctcagaaaggccaggagagtgaatacggcaacattacatacccccccgccatgaagaatgcgcacgctaaggcgtctcgaaccagcagcaagtcgctggagagctccgcaggcacagtggccgccagtcccgtgaggagggggggacagcgagggctccccgtcccgggccctccagtactgtcacccgacttgcaccagctgcccgttctggctcctctccatccggccgctgacacccgacggatgtgtatgcgtacctgcactttgagaacccgcggaagacgaaagtag

SEQ ID NO: 130887 - DNA, 1083 bp, Artificial Sequence
  Description of Artificial Sequence: Synthetic coding sequence
atggtgcaggcccacggaggaagaagtcgggctcaacccctgactctgtccttgggcgcagctatgacacagccaccaccagaaaagacccctgccaaaaagcacgtcaggctgcaggagaggcggggatcaaacgtggccctgatgctggacgttcgatctcttggggcagtcgagccaatctgcagcgtgaacactccccgggaggttaccctgcactttcttagaacagccgggcacccactcactagatgggcactgcagcgccaacctcccagtcccaaacagctggaggaggagttcctgaaaattcctagcaattttgtgtctcctgaggaccttgacatcccaggccacgcttctaaggaccggtacaaaaccattctgcccaacccccaatcccgagtgtgcctcggaagagcccaatctcaagaagatggagactatatcaacgcaaactacatccgcggatatgacggtaaggagaaagtgtacatcgcaacgcagggcccaatgcctaacactgtttctgacttttgggaaatggtctggcaggaagaagtttcactcatcgtgatgcttactcagctcagagagggaaaggagaaatgcgttcactattggccaaccgaagaggaaacttacggcccattccagatccgcatacaggacatgaaagagtgccctgaatacacggtccggcagctaacaatccagtatcaggaggagagacggtcggtgaaacacattctatttagcgcctggcctgaccaccagactccagaaagtgcgggcccactgttgcgcctggtcgctgaggtggaggagagccctgaaaccgccgcccatcccggccccatcgtggtccactgtagtgccggtatcggaaggactgggtgcttcatagcgaccagaatagggtgtcagcagctgaaagcgcgaggtgaggtggacattctgggcattgtgtgtcagctgaggctggatagagggggtatgatccaaaccgcggaacagtaccagtttttacaccataccctggccctctacgctggacagctgcctgaggagcctagtccctag

SEQ ID NO: 130888 - DNA, 1398 bp, Artificial Sequence
  Description of Artificial Sequence: Synthetic coding sequence
atggttgggaaggcttggcccttgacgcacagtcagggcaccggaccttgggcccccgaggggcacagacgcgaggctgcagacccatggtggcaaagacagcaagcccaggaggggcggatgcaactaggatgcgcctgggttgcagccagacgcggtggaggtagaaaactggcatcctggagcctgctgtcaccgcagcgtcagacagaccgccagaccgattcatggcaggaagccgcttggggacctcagctcctccagcagaccagctggctgagtgagcctcctctgggccctgcaccgcacctttctatggtgcaggcccacggaggacggtcaagggctcaacctctgacactgtccctcggtgccgccatgacacaaccacccccagaaaagaccccggcgaaaaaacacgtacgtctgcaggaacggagaggttcgaacgtggccctgatgctggatgtgaggtcactcggagcagtggagccgatctgttcagttaatacccccagagaagtgacccttcactttctgcgtaccgcaggccacccattaacccgttgggctctgcagcgccagcctccatctcctaaacagctcgaagaagagtttctgaaaattcctagcaattttgtgtcccctgaggatttggatatccccggccatgcttctaaggatcgctataaaacgatattacccaatccccagagcagggtgtgcctagggcgggcccagtcacaggaggacggggattacattaacgccaattatatccggggatatgacggcaaagagaaggtctacatcgctacccagggccctatgccgaatactgtgagtgacttttgggagatggtctggcaggaggaggtttctctgattgtaatgctgacccagctgagggaaggcaaggaaaaatgcgtccactattggcccactgaagaagaaacatatggaccttttcagatccgcattcaggatatgaaggagtgccccgagtacactgtcagacagttaacgatccagtatcaggaagaacgccggagtgtaaaacacattctattcagtgcttggccggatcatcagaccccagagtcggcagggcccctgctgaggttggtggccgaagtggaggaatcccctgaaactgccgcccaccccggaccgatcgtcgttcactgttccgcaggcattgggcggacgggctgtttcatcgccacccgcattgggtgccagcagctgaaggcccgcggcgaagtggacatccttggcattgtatgccagctgcgcctcgacagggggggcatgatccagactgcagagcagtatcagttcctgcaccatacattggccctttacgccggccagctgccggaggagccttccccctag

SEQ ID NO: 130889 - DNA, 1200 bp, Artificial Sequence
  Description of Artificial Sequence: Synthetic coding sequence
atgggggcaagcttctggccaatccggcaggctagggaacagcaacgccgggctcttagctttcggcagacatcttggctgagtgagcctccattaggccccgctccccatctatcaatggttcaggcccacggaggcagaagtcgcgctcagcccctgaccctgagtctcggcgctgctatgactcagccacccccggagaaaacacctgctaagaaacatgtgagactacaggagaggaggggttctaacgtcgccctgatgttggacgtccgtagtctgggggcagtcgaacccatctgtagtgtgaacaccccacgcgaagttaccctccacttcctccgcacagcaggccatccactgacgcgctgggctcttcagaggcagccgccttccccaaagcagctggaagaagagttcctcaaaatccctagtaatttcgtaagtccggaagatctcgatatccccgggcacgcatcaaaggaccgctataagactatacttccaaatcctcaaagccgagtctgcttgggtagagctcaatcacaggaggacggagactacatcaacgccaactacatccggggatacgacggtaaggaaaaggtgtacatcgctacgcagggccccatgcccaatacagtgtccgacttttgggagatggtctggcaggaagaggttagccttatcgtgatgctcacccagctccgagagggcaaagagaagtgtgtgcactactggcccactgaggaggaaacctatggtccctttcaaatacgaatccaggatatgaaggagtgtccagagtacaccgtgcgacagctgaccattcagtaccaggaggaaaggcggtcggtcaagcacattctgtttagtgcctggccagaccatcaaactccagaatccgctggacccctcctgagacttgtcgccgaggtggaggagtctcctgaaactgccgcccacccaggtcccatcgtcgttcattgttccgccgggataggtcgcaccgggtgcttcattgcaacccggatcggctgccagcaattaaaggccagaggcgaagtggacattctgggcatcgtgtgtcagttacgtctagatcggggagggatgatacagacagccgagcagtaccagtttctacatcacactctagctctgtacgccggtcagctccctgaagagccttccccttag

SEQ ID NO: 130890 - DNA, 465 bp, Artificial Sequence
  Description of Artificial Sequence: Synthetic coding sequence
atggtgcaggctcatggggggcgcagcagagcacagcccttaaccctgagcctaggtgctgccatgacccagccgccaccagaaaaaactccggcaaaaaagcatgtcagactgcaagagaggagaggctcaaacgtagccttgatgctggatgtgaggagcttgggcgctgtggaacccatttgttctgtgaatacgcctagggaggtgaccttgcattttctgcgcacagcagggcatcccctgacccgttgggctctgcaaagacaacccccaagtcctaaacaacttgaggaagaattcctgaaaatcccttcaaactttgtaagccccgaagacctggacataccaggtcacgcctccaaagatcggtacaagaccattttacccaatccccagtccagagtgtgtctaggtcgggcccagtcacaagaggacggagattacatcaacgccaattattag

SEQ ID NO: 130891 - DNA, 1326 bp, Artificial Sequence
  Description of Artificial Sequence: Synthetic coding sequence
aagcggcgtcgggctgctagcatgaaccgcctgggttgctggcctgcccgtagtctgccaagaagcgggcgcgggtccggtcaacgctccctgggcctgggcggacatccgagcgggccccgtcatcccggaacccccgctgctaaaagaacctgggagtcccccggagtgagggctcgggactgcccgctttccacgtcatggctgtccgagccgcccctcggccccgccccacacttgtcaatggtacaagctcatggagggcgttcccgagcccaaccccttactttgagcctcggagcagccatgacccaacccccgcctgaaaagacgcccgcgaagaagcatgtacgactgcaagaaagaagaggatctaacgtcgcgttgatgctggatgtgaggtcgctgggagctgtcgaacctatttgttcagtgaatactcccagagaggtcaccttacactttctgcggactgccggacaccctctgactcgctgggccctccagcgccagccgcctagtcctaaacaactggaagaggagtttttgaagatcccgagcaacttcgtgagtccggaggaccttgacatccccggccatgcctcaaaggaccgctacaaaaccattttacctaatcctcagtcccgcgtgtgtctggggcgagcgcagtcccaagaggacggcgactatattaatgctaactacatccgcggatacgacggaaaggaaaaggtttatattgccactcaggggccgatgcctaacacagtcagtgatttctgggaaatggtctggcaagaagaggtttcactgatcgtgatgctgactcagcttcgggagggcaaagaaaagtgtgttcattactggcccactgaggaggagacctacgggccttttcagattaggattcaggatatgaaggagtgtccagaatatacagtgaggcagctaacaattcaatatcaggaagagagacgctccgtcaaacatatcctcttctctgcatggcctgaccaccagacccccgagtcagccggccccctgctcaggctagtggctgaggtggaagaaagcccggagaccgccgcccaccctgggcctatagtggtgcattgtagcgcaggaattgggagaacagggtgctttattgcaaccaggatcggatgccaacagcttaaagcacgtggggaggttgatattttgggcattgtgtgccagctacgtctcgataggggtggtatgattcagacagcagagcaatatcaatttctccatcatactctggctctatacgctggccagcttcccgaggagccctctccctag

SEQ ID NO: 130892 - DNA, 423 bp, Artificial Sequence
  Description of Artificial Sequence: Synthetic coding sequence
atggtgcaagctcacggagggcggagtagggcacagccattaaccctgtctctcggagccgcgatgacacagcctccacccgagaagacccctgcaaagaagcacgtgagactccaggaaagaagggggagtaacgtggccctcatgcttgatgtccgcagtttgggtgccgttgagccgatctgctctgtgaacacccctcgggaggtgacactccactttctgcggacagctggccaccccctgacacgatgggccttgcagcggcagccccccagcccaaaacaactggaggaggagttcctgaagatccctagtaacttcgtttcacctgaagatctggacattccaggccatgcctcaaaagaccggtacaaaactattctgcccaacccccaatcgcgagtctgtctgggccggtag

SEQ ID NO: 130893 - DNA, 1083 bp, Artificial Sequence
  Description of Artificial Sequence: Synthetic coding sequence
atggtgcaggcccacggggggcgatcccgcgctcagcccctcaccttgagcttgggcgccgcgatgacccagcccccacctgagaagacccccgctaaaaaacatgtgaggctccaggagcggagaggcagcaacgttgctcttatgctggacgttcgctcactcggagcagtggaacccatctgtagtgtgaatactccaagagaagtcacactgcattttctgaggaccgccgggcaccctctgactaggtgggccttacagaggcagcccccgtctccaaagcagcttgaggaggagttcctcaaaattccttccaacttcgtgtcccctgaggatctggatattcctgggcatgcctccaaggaccgctacaagactattcttcccaacccacagtcacgagtgtgtctgggacgggcgcagtctcaggaagatggagactacatcaatgctaattatatcagaggttacgatggaaaagaaaaagtttatattgctacccagggcccaatgcccaatactgtttctgatttctgggaaatggtgtggcaggaggaggtgagcctcatcgtgatgctgacacagttgagagaaggcaaggagaaatgcgtccactactggccaacagaagaagagacatatggacctttccagatcagaatccaggatatgaaggagtgtcctgagtataccgtgcggcagttgactattcagtatcaggaagaacgccgcagcgtaaaacatattctgttcagtgcttggcccgatcatcagaccccagagtctgccggacccctcctgcgcctggtggccgaggtcgaagagtccccggagaccgccgcccaccctgggccaattgtggttcactgtagcgctgggatcgggcgcaccgggtgtttcattgctacgaggattggctgccagcagcttaaagctcgcggcgaggtggatattttggggatcgtgtgccaactgaggttagaccgcggagggatgatccaaaccgccgagcagtaccagttccttcaccatacactggccttatacgcagggcagttaccagaggagccatctccgtag

SEQ ID NO: 130894 - DNA, 570 bp, Artificial Sequence
  Description of Artificial Sequence: Synthetic coding sequence
atgcccaacacggtttctgatttttgggaaatggtgtggcaggaggaggtgtcactcatcgtgatgctgacccaactgcgggaaggcaaggaaaaatgtgtccattactggccgaccgaagaagaaacatacgggcctttccagatcagaatccaggatatgaaggaatgccccgagtacacagttcgccaattaacaattcagtaccaagaagagcggcgaagcgtaaagcatatcttgttctccgcctggcctgaccaccagactcccgagtccgctggccctctgctgagactcgttgcagaagtggaagaaagtccagaaactgccgcacacccagggcctatcgtggttcactgcagcgccggcataggacgcaccggatgctttatcgccactcgtatcggttgtcaacaactgaaggcccggggagaagttgatatcctggggatagtgtgccaactcagacttgaccgagggggcatgatccaaaccgccgagcagtaccagttcctacaccataccctcgccttatatgcaggacaacttcccgaggaaccgagcccttag

SEQ ID NO: 130895 - DNA, 411 bp, Artificial Sequence
  Description of Artificial Sequence: Synthetic coding sequence
atgaaggaatgccccgaatataccgtgcgacagctcacaatccagtaccaagaggaacgtcgaagcgtgaagcacatattgttttcagcctggcctgaccatcaaactcccgaaagcgccggccctttactccgcctcgttgccgaggtagaggagtccccagagactgccgctcaccccggaccgatagtggtgcattgttcggctggcattggacgcacagggtgcttcattgccacacggattgggtgccagcagttgaaagccagaggcgaggtggatatcttaggaattgtgtgtcagcttaggttggatagggggggtatgatccagactgcagaacagtatcagtttctgcaccacacccttgcgctgtacgccggacagctcccagaggaaccgtcgccctag

SEQ ID NO: 130896 - DNA, 1545 bp, Artificial Sequence
  Description of Artificial Sequence: Synthetic coding sequence
atgtcgtctccgatctccaaatcaaggtcccttgctgcttttttacagcagctccgcagccccagacaaccacccaggctcgtgacttcgaccgcctacacctccccacagccgagggaggttcccgtgtgtcctcttacggccggtggagagacccagaacgcagccgcgctacccgggccaacatcatggcctctattgggcagcttgctgcaaatactgtggaagggaggattaaagaagcagcatgacacgctcgttgagtaccacaagaagtatggtaagatttttcggatgaagctgggaagcttcgaatccgtccatctcggctccccttgtctgctcgaagccttatacagaaccgaatccgcctacccccagaggctcgaaattaagccatggaaggcgtatcgagattatcgcaaagagggatacggactcctaatcctggagggcgaggactggcaacgagtgaggagcgcattccagaagaagctgatgaaaccaggggaagtcatgaaactcgacaacaagatcaatgaagtactcgccgacttcatgggaaggatcgacgagctgtgcgatgagcgcggacacgtcgaagatctttactccgaactgaacaagtggagcttcgagagcatctgtctggtgctctacgaaaaacgatttggcctgctccagaagaacgcaggtgatgaggccgtaaacttcattatggcaataaagaccatgatgagcactttcggtagaatgatggtgaccccagttgagcttcataaatccctaaacacgaaggtctggcaggatcacactctggcctgggatactattttcaagtcagtgaaggcttgtattgacaaccggcttgaaaaatattcacagcaaccctccgccgatttcctgtgcgacatttaccaccagaacaggctcagcaagaaggagttgtacgccgccgtcactgaactgcagctggccgcagttgagaccacggcaaacagtctgatgtggattttgtataatctgagtcggaaccctcaggtgcaacaaaagctgctgaaggagattcagtctgtgctacctgagaaccaggtgccacgggctgaagacctgcgtaacatgccttatttgaaagcatgccttaaagagtccatgcgcctcaccccctctgtgccatttactacccggaccctggacaaagcgaccgtactgggcgagtacgctttgcctaagggaactgtcctcatgctgaatactcaggttctggggagtagtgaagataacttcgaagacagcagtcagtttagacctgagcggtggctgcaggaaaaagagaaaatcaacccctttgcacatcttccatttggggtcgggaaacgaatgtgtattggtcggagacttgcggaactgcagctgcatcttgcactgtgctggatcgtgcgcaagtatgatatccaggcaaccgacaatgagcctgtggagatgctacattctggaaccctggtgccaagtcgggagctgcctatagccttctgccagaggtag

SEQ ID NO: 130897 - DNA, 2382 bp, Artificial Sequence
  Description of Artificial Sequence: Synthetic coding sequence
atggattcttggtttatcctggttctgctcggttccggtctgatatgcgtttccgctaacaacgcaacaaccgtggcgccaagcgttggcatcactcgtctcatcaactcctccacagctgagccagtcaaagaggaagcaaagacatcgaatcccacctccagcctcacctccctttccgtcgcacccacgttctcccccaatatcactcttggtcccacctatttgactactgtgaattcaagcgattctgacaatggcacaacacgaacagcctcgaccaatagcattggtattacgatctcaccgaacggcacttggcttcccgataaccagtttactgacgcaaggaccgagccttgggaaggcaatagttccactgctgcgacaacacctgagacttttccaccctctgatgagactccaatcatagccgtaatggttgcactttccagcctactggtgatagttttcattatcattgtcctgtacatgctgaggttcaaaaaatataagcaagcaggcagtcactcaaactcgtttagactgtctaatggtagaactgaagacgttgagcctcagtccgtgccgctgctcgccagaagcccctccaccaacagaaaatatcctccactgccagtagataagctcgaggaagagatcaataggagaatggccgatgataacaagctgtttcgggaagaatttaatgcgctcccagcttgcccgatccaggctacttgcgaagcagcctccaaagaggaaaataaagaaaaaaaccgctacgtgaatatcctgccttatgaccacagtagggttcacctcacccctgtggaaggcgtcccagatagcgattacattaatgcgtcattcattaatggctaccaggagaaaaacaagtttattgccgctcagggaccaaaggaagagacagtcaacgatttttggcgaatgatctgggaacaaaacacagccaccatagtcatggtaactaacttaaaggaacgcaaggagtgcaagtgtgctcaatactggcctgatcaaggttgctggacatatgggaatatccgagtgtcagtggaggacgtgacggtgctcgttgattacactgtcagaaaattctgcatccagcaggtgggtgatatgaccaatcgaaagcctcaaagacttatcactcaattccacttcacctcttggccagatttcggagtcccctttacacccatcggcatgttgaagttccttaagaaggtcaaggcatgtaatccgcagtacgccggggccatcgtggtccactgttcggcaggagtaggcaggactggaactttcgtggttatagacgccatgctggacatgatgcatactgaacgtaaagtcgacgtatacggcttcgtttctaggattagagcacagcggtgccagatggtgcagacagatatgcaatacgtgtttatatatcaagctctcctggaacattacctatatggtgacaccgaactggaagtgacttcattagagacccacctccagaaaatttacaataagatacccggtacctcaaacaatgggttggaggaggagttcaagaagctgacttcaattaagattcagaacgacaaaatgcgtacgggtaaccttcccgcgaatatgaagaagaacagggtgctgcaaattatcccctatgaattcaatcgggtgattatccctgtcaagcgcggtgaagaaaacacagactatgtcaacgcttcctttatcgatggttatcgtcaaaaagactcctatatagcgtcccaaggcccgctgcttcacacgatcgaggacttctggaggatgatctgggagtggaaatcttgtagtattgtgatgctaacagaactggaagaacggggccaggaaaaatgtgcccaatactggcccagcgacggactggttagttacggtgacatcaccgtggagctgaaaaaagaggaagagtgtgagtcttacactgttagagacctgttagtgaccaataccagagaaaataaaagtaggcaaattagacagtttcactttcatggctggcccgaagtgggcatcccgtcagatggcaaaggaatgatcagtatcatcgcagcagtgcagaagcaacagcagcagtccggaaatcatcccatcactgtccactgttcggccggagccggtaggacaggaacattctgcgccctcagcactgtgttggagcgagtcaaggccgagggaattctggatgtgttccaaaccgtcaaatctctcaggctgcagcggcctcatatggtgcagaccttggaacagtatgagttttgctataaggtggtacaggagtatatcgacgcctttagcgattatgctaattttaagtag

SEQ ID NO: 130898 - DNA, 2382 bp, Artificial Sequence
  Description of Artificial Sequence: Synthetic coding sequence
atggatagctggtttattcttgtcctgttgggcagcgggttaatatgtgtcagcgctaataatgcgacaaccgtggccccttcagtgggaatcacccggctcatcaactctagcacagccgagccagtcaaagaggaagccaagacttcaaaccctacttccagcctcaccagcctttcagtggcacccactttcagtcccaatatcacattggggccaacctacttgacgactgtgaattcatcagattctgataatggcactacacggacagcctcaacaaattctatcggaatcacaattagccccaacggaacgtggctacccgataatcagtttaccgatgctaggaccgaaccgtgggagggtaactccagcaccgctgccaccacccctgagacctttccaccctccgacgagacacccattatcgccgtgatggtcgcactttcctctctcctcgtgatcgttttcataattattgtcttatacatgctcaggtttaaaaagtacaagcaagctgggtcacactcgaacagtttcagacttagcaacggccgcacagaagatgtcgaacctcagtcagtccctctgcttgctaggtctccgtccacaaatcgtaaatacccgccccttcctgttgacaaactggaggaggagataaacagaagaatggctgatgataacaaactcttcagggaggaattcaacgcactgccagcctgtccaatccaggctacgtgtgaggccgccagcaaggaagagaacaaggagaagaaccggtacgtcaacattctgccgtacgaccacagtcgtgttcacctgactccggtggagggcgtccctgactccgactatataaacgcctcttttatcaacggctaccaagagaaaaacaaatttattgccgcccaaggaccaaaagaagagaccgtcaacgatttctggcggatgatttgggagcagaataccgcaactattgtgatggtgactaacctcaaagagcggaaggagtgtaagtgcgcccagtactggccggaccagggctgttggacttacgggaatatccgagtcagcgtggaagacgttaccgtcttagttgactacacagtgagaaagttctgcattcagcaggttggcgatatgaccaatcgcaaaccacagcggttaattactcagtttcacttcacaagttggcctgacttcggggtgccttttacaccaatcgggatgttgaaatttctgaagaaagtgaaggcctgcaacccccagtatgcaggcgcgatagtggttcactgctcagccggggtgggacgtacaggtactttcgtggtgattgacgctatgctggacatgatgcatactgaaaggaaggtggatgtttacgggtttgtgtctcgaatccgtgcccaaaggtgtcaaatggtgcagacggatatgcaatatgtattcatataccaggccctgttggagcattatctatatggcgacacagagctggaggtcacctccctggagacccatctgcagaagatttacaacaaaattcccggcaccagcaataacggccttgaagaggaattcaaaaaactgacaagtatcaagattcaaaatgacaagatgaggaccggcaacttgccggccaacatgaagaagaatcgtgtgctgcagattatcccctacgagtttaaccgcgtcataattccagttaaaagaggggaggagaataccgactatgtcaacgcctctttcatagatggatatcggcagaaagactcctatatcgctagccaagggcctctgctgcacactattgaagacttctggagaatgatttgggaatggaaatcatgctcaatagtcatgctcactgagctcgaagaaagaggacaggagaaatgtgcccagtactggccatccgacggtctggtgagctacggtgacattactgtggaacttaagaaggaggaagagtgcgagagctataccgtgagggatcttctggtgacaaataccagggaaaacaagtctaggcagatccgacagtttcacttccatggatggccagaagttggaattcctagcgatggcaaaggcatgatcagcatcattgctgctgttcaaaagcagcagcaacaaagcgggaatcaccctattacagtccactgcagtgcgggggcaggacgcacaggcaccttttgcgctctgtccacagtcttagaacgtgtgaaggcagaggggatcctggacgtattccagacggtgaagtcactgcgactgcagaggccccacatggtacaaaccctggagcaatatgagttttgttacaaggtggtacaggaatacatcgacgcctttagcgattatgccaatttcaaatag

SEQ ID NO: 130899 - DNA, 1977 bp, Artificial Sequence
  Description of Artificial Sequence: Synthetic coding sequence
atggttgccttgagcagtctgttggtcattgttttcatcattattgtcctgtacatgctgcgacgcttcagaaaagctgagctgatgagcagaaataccgaaaagtacaaacaggcgggcagtcacagtaattctttcaggctaagcaacgggcgaacggaggatgtcgaaccgcagagtgttcctctgctcgctcgatctccctccaccaaccggaaatatccgcccctgcctgtggataaactcgaagaggaaataaatcgaagaatggcagacgataacaagctttttcgcgaggaattcaacgctcttcccgcttgcccaatccaggccacctgtgaggctgccagtaaagaggagaataaggagaagaatcgctacgtgaatatcctgccatatgatcactctagagtgcatctcacccccgtggaaggagtcccagatagtgattacataaatgcatcgtttataaacgggtaccaggagaagaacaaatttatcgccgcccaaggaccaaaggaggagacggttaatgatttctggcggatgatatgggagcagaatactgctaccatcgtgatggtcacaaatctgaaggaaagaaaggagtgcaagtgcgctcagtattggcctgatcagggatgctggacgtacggtaatatccgcgtgagtgtcgaggacgtgacagtgctcgtggattacaccgtgagaaaattctgtattcagcaggtgggagacatgacaaatcgtaagccacaaaggctgataacacagttccacttcacatcgtggcccgatttcggagttccgttcacgcccatcggaatgcttaagtttcttaaaaaagtgaaggcctgtaacccccagtacgccggggcaattgtagtgcactgttcagcaggggtcggcagaacgggaacttttgtcgtcattgacgctatgcttgacatgatgcatacagaaagaaaagttgacgtctatggctttgtctctaggatccgcgctcagcggtgccagatggtacagactgacatgcagtatgtcttcatctaccaggcactgctggagcactacttatacggggatacagagctcgaggttacctcgctggaaactcacctgcagaagatatacaataaaatccccggaacttccaacaatgggcttgaggaagagtttaaaaaacttacatcaatcaagattcagaatgataaaatgcgcacaggaaatctgcccgcaaatatgaagaagaatcgggtgttgcagatcatcccgtacgagtttaaccgggtcattattccagttaagcggggggaggagaacacagattacgttaacgctagttttatcgatggttacaggcagaaggacagttatatcgcttctcaagggcccttactgcacaccattgaggacttttggcgaatgatctgggaatggaaaagctgtagcatcgttatgctgaccgaactcgaggaaaggggtcaggagaaatgtgcccagtattggccctctgacggtctggtttcctacggggacattacagtcgagttaaagaaagaagaggagtgcgaaagctacaccgttagagacttgctcgtgactaacaccagagagaataagagccggcagatacgccaattccacttccacggctggcctgaagtgggcataccttctgatggaaagggcatgatcagtattatcgcagcagtgcagaagcaacagcagcagtccggaaatcatccaataaccgtgcattgcagcgctggagctggtcgcaccggaacgttctgtgcattatctactgtgcttgaaagagttaaagcagaggggatcctggacgtttttcagacagtgaaaagtctcaggctccagcgcccacacatggtccagacactcgaacaatatgagttttgttacaaggtggtccaggaatatatcgatgcctttagcgattacgcaaattttaagtag

SEQ ID NO: 130900 - DNA, 2409 bp, Artificial Sequence
  Description of Artificial Sequence: Synthetic coding sequence
atggactcgtggtttatactcgtcctccttgggtccggactcatatgcgtttcagccaataacgcaacgaccgtagctccatccgtagggatcacacgcctgattaatagcagcaccgccgagccggtaaaggaagaggccaagacgtccaacccaacttcgtcccttacatcactttccgtggcacccacatttagccctaacattacactgggacctacataccttacaactgtaaactcctccgattctgataacgggaccactcgcacagcatcgacaaattccatcggaattaccatttcacccaacggaacctggctccctgacaatcaattcactgatgcacgtaccgaaccttgggagggaaactctagtactgccgctactacccccgagactttcccaccgtcaggtaactctgacagcaaagatcggcgcgatgaaaccccaattatcgccgttatggtggcattatcgtcactcctggtgatagtgttcatcatcatcgtgctgtatatgcttaggtttaagaaatacaaacaggctgggtcccacagtaactcttttcggcttagcaatggcagaaccgaagacgtggaaccccagtccgtgccgttgttggctaggtcaccaagcaccaatcggaagtatccgcctctccctgtggacaagctggaagaggaaatcaatcgccgaatggccgacgacaacaaactcttccgggaggagtttaacgctctgcctgcgtgtccaatccaggcaacctgcgaggcagcttcaaaagaagaaaataaagaaaagaataggtatgtgaatatactcccatatgaccactctagggtacacctgacccccgttgaaggagtgcccgactccgactatattaacgctagctttatcaacggttatcaggaaaaaaacaagttcatcgcagcccaaggacctaaggaagagacagtgaacgacttctggaggatgatttgggaacagaatactgcaaccatagtcatggtaactaacctgaaagagaggaaggaatgtaaatgtgctcaatattggcctgatcagggatgctggacttatggaaatattagggtttctgtagaggacgtgacagtactggtcgactacacagtgcggaagttctgtatccagcaggttggagatatgaccaaccggaaaccccagaggctcatcacacaattccacttcacaagttggccggacttcggggtaccattcacccccatagggatgttgaagttcctgaagaaggtgaaggcctgtaaccctcagtacgccggcgccattgtagttcactgttctgcgggagttggaaggaccgggacgttcgtcgtgattgatgccatgctggacatgatgcacacagaacgtaaggtcgacgtgtacggcttcgtatctcgaatccgagcccagagatgtcagatggtccaaaccgatatgcagtatgtgttcatttatcaggctctgctcgaacattatctgtatggggatactgaactcgaagtgacctcccttgagacccacctacagaagatctataataaaatcccagggacgagcaataacggcttagaagaagagtttaaaaaactgactagtatcaaaatccaaaatgataaaatgcgcacaggcaacctgccggcaaacatgaaaaagaacagagtcttgcaaattatcccctacgaattcaatcgggtgattatccccgtgaagcgtggggaagagaacacggattacgttaacgcaagcttcattgacgggtaccgtcagaaagatagctacatcgcatctcaggggcctttactgcacactatagaagacttttggagaatgatctgggaatggaagtcatgttccatcgtgatgttaacggagctggaagaaaggggtcaagaaaagtgtgctcagtactggccttcagacgggcttgtgtcatacggagatatcactgtcgagctgaagaaggaagaggagtgtgagtcctacacagtccgcgacttgctggttaccaacacacgggaaaacaaatctcgacagattcgacagttccatttccatggttggcctgaagtgggaatccccagcgatggaaagggaatgatcagtataattgctgccgtgcaaaagcaacagcagcagagcggcaatcaccctataaccgtgcactgttccgccggagcaggaagaacagggaccttctgtgctctgtcaacggtactcgagcgcgtgaaggcagagggcatcctcgatgtgttccagaccgtgaagtctttgaggttacagcggccacacatggttcagacacttgaacaatatgagttttgctataaagtggtccaggaatacatcgacgctttctccgactacgctaattttaaatag

SEQ ID NO: 130901 - DNA, 2409 bp, Artificial Sequence
  Description of Artificial Sequence: Synthetic coding sequence
atggactcctggtttatccttgtcctcctggggtctggcctgatttgcgtgtcagcgaataacgctaccactgtggcccctagtgttggcattactcggctcatcaactccagcacagcagagcccgtgaaggaggaagcaaagacttccaatcccactagttccctgacaagcctgtctgtggccccaactttcagtcccaatataactctaggccccacctacctgactaccgtgaactcctctgattcggacaacggcacaacacgaaccgcctctacgaactcaatcggcatcacaatttccccaaacgggacatggctccccgataaccagttcaccgacgctcgcactgagccctgggagggcaattcctctacagcggccacaacccccgagactttcccgccgagtggcaactcggacagcaaagatcggcgagatgaaacacccataatcgcagtaatggtggccctatcatccctgctggtgatagtgtttataattattgtgctctacatgctgagatttaaaaaatacaagcaggccggctcacatagtaacagctttcgattgtcaaatggccgcacagaagatgtagaaccccagtccgtgccactcctggctcggagtccaagcacaaatcggaagtatcctcccctgccggtggacaagcttgaagaggaaatcaacaggcggatggcagacgataacaagctgttcagggaggaattcaatgcgctgccagcctgtcccatacaggccacgtgcgaggcagcctctaaagaagagaacaaagagaagaatagatacgtgaatatccttccgtacgatcattccagggtccacctgacacctgttgagggggtgccagattcggactatataaacgccagctttataaacggatatcaggagaagaacaaatttatcgcggctcaggggcctaaggaagagaccgtgaacgatttctggaggatgatttgggagcagaacacggccacgattgtaatggtaacaaacctaaaagaacgcaaagaatgcaaatgtgcccagtactggccagaccaggggtgttggacctatggcaatattagagtgtcagtggaggatgtgacggtgctcgtggattacaccgtccgaaaattttgtattcaacaagtcggagacatgaccaaccggaagcctcagcgactgatcacacagtttcatttcactagttggccggacttcggtgtcccatttaccccaattggaatgctcaagtttcttaagaaagtcaaggcctgcaacccccagtatgcaggggctatcgtcgtgcattgctcagccggcgtcgggaggacaggcacctttgtggtgatcgatgcaatgctcgacatgatgcacactgagcgcaaggttgacgtctatggtttcgtgtcgcgcatccgggctcaacggtgtcagatggtgcagaccgatatgcagtacgtgtttatctaccaggctctcctcgagcactatctctatggcgatactgaactggaagtcacttctctggaaacccacctacaaaagatttacaacaagatccccgggactagtaacaatggcctggaagaagagttcaaaaagctcacctctataaagatccagaacgataaaatgcgcactggcaatctgcccgctaacatgaaaaaaaaccgcgtgttgcaaatcatcccatacgagtttaacagggtgatcattccagtgaaacggggcgaggagaacactgactacgtgaacgccagttttatcgacggataccggcagaaggactcctatatcgcctcacagggtccactccttcatactattgaggatttttggagaatgatttgggagtggaagtcatgttccattgttatgttaacagaacttgaagagcggggacaagaaaagtgtgcccagtactggccctcagacggattagtaagctatggggacatcacagtcgagcttaagaaggaggaagagtgcgagtcatatactgttagagatctgttggtgactaacaccagagaaaacaagtctagacaaataaggcaatttcacttccacggatggcccgaagtaggcattccaagtgatgggaaaggaatgatcagcatcattgccgcagtgcaaaagcagcaacagcaatccgggaaccatccaataaccgtgcactgtagcgccggcgccgggcgcaccgggactttctgcgccttatctacagtgctggagcgggtgaaagcggaggggattctcgacgtattccagaccgtgaagtctctgcgattgcagcgcccacatatggtgcagactctggaacagtacgaattctgctacaaggtcgtccaggagtatatcgacgctttcagcgactacgcgaatttcaagtag

SEQ ID NO: 130902 - DNA, 603 bp, Artificial Sequence
  Description of Artificial Sequence: Synthetic coding sequence
atggattcctggttcatcctggtcctgctgggatcaggcctgatttgtgtgtcagccaacaacgcaacgacagttgcccctagcgtgggtattacgagactgatcaattcgtccaccgccgagcctgtcaaagaagaagcaaagacttccaatccaacctcttccctcaccagtctgtccgttgcaccaacgttcagccccaatatcactctcggtccaacctatttaacaacggtgaattcctctgacagcgataacgggaccacccgaacagcctcgacaaattcaattggcatcaccatctccccgaacggaacctggctccctgacaaccagtttaccgacgcaaggacggaaccatgggaagggaacagctccactgctgccaccacaccggagactttccctccgagcggcaatagcgattctaaggatcgccgcgatgaaactcccattattgctgtaatggttgctctttcatcattgctcgtgattgtattcatcatcatcgtgctgtacatgttgaggttcaagaagtataaacaagcaggtagccactcgaattccttcagactgtccaacggccgcacagaggacgtctag

SEQ ID NO: 130903 - DNA, 2442 bp, Artificial Sequence
  Description of Artificial Sequence: Synthetic coding sequence
atggatgatgccgttcagattactaagatctccatggattcctggtttatactggtcttgctcggcagcggccttatttgcgtctccgccaataatgctaccacggtggccccgtcagtggggataacgaggctgattaactcttctactgccgagcctgtgaaagaggaggctaaaacttcaaatcctacttccagcctcacttcactgtccgtggcccccaccttcagccccaacattacccttggcccaacttacttaacaactgtgaactccagcgacagcgacaacgggacaactcggacggcctcaaccaacagcatcggcatcacaatctctcctaacggtacatggcttcccgacaaccagtttaccgacgcaaggacagaaccctgggagggcaattcttccacagctgcaacaacccccgaaacctttcccccctcagggaacagtgattcaaaggataggcgggacgaaacaccgatcatagctgtcatggttgccctgagttcacttctcgtcattgtcttcattataatagtgttatatatgctgcgctttaaaaaatacaaacaagccggctctcacagcaatagtttcaggctgtcaaatggacgcaccgaagatgtcgagccacaaagcgtgcctctgttggcccgctccccctccactaatcgcaaatatccgcctctgcctgtggataagctggaggaggagatcaacagacggatggcggacgacaataaactatttcgcgaggagttcaatgccctgcccgcatgtcccattcaagcgacctgtgaggcggcgtccaaggaagagaacaaagagaagaatcggtacgtgaatattttaccctatgaccacagtagggtacacttgacacccgttgagggcgtaccagactccgattacatcaacgctagctttattaacggttaccaggagaaaaacaagttcatcgcagcacagggccccaaagaggagaccgtgaacgacttctggaggatgatatgggagcaaaataccgctacaattgtgatggtgaccaatctgaaggaacgcaaagagtgtaagtgtgcccaatattggcccgaccaggggtgctggacctacggcaatatccgagtgagcgtcgaggatgtcaccgtgttagtggattatacagtaaggaaattctgtatccagcaagttggcgacatgactaatcggaaaccccagaggctgatcactcagttccactttaccagttggcccgacttcggtgtgccattcacacctatcggaatgctcaagtttttaaaaaaagttaaggcctgtaacccacagtacgctggcgccatagtcgtacattgttccgcaggcgttggccgcaccggcacatttgtcgtgatcgatgccatgctggacatgatgcatacagaacgtaaggtggacgtatatggatttgtgagtagaattcgcgctcagcgctgtcaaatggtgcagactgatatgcagtacgtcttcatttaccaagcactcctcgaacactacctctacggggacacagaacttgaagtaacaagtcttgagacccaccttcagaagatctacaataagattcctggtacctctaataatggcctagaagaagagttcaaaaaacttacatccatcaaaatccaaaacgacaaaatgcggaccgggaatcttcccgcgaatatgaaaaagaatcgtgtcctgcagatcatcccatacgagtttaacagagtcatcatccccgtaaaaaggggggaagagaatactgactatgtgaatgcaagctttattgacggatatcgacagaaggattcttacatcgccagccaaggaccactgctgcacacaatcgaggacttctggaggatgatctgggaatggaagtcctgtagtatcgttatgctcactgagctggaggagcgtggtcaagagaagtgcgctcaatactggcccagcgatggtttggtgtcatacggagatataaccgtagaacttaaaaaggaagaggagtgcgagtcctacactgtgcgcgatctactggtgaccaacacgagagagaacaagagtcgccaaattcggcagttccacttccacggctggccggaggtaggtatcccctccgatggaaagggtatgatttctatcatagcagccgtgcagaaacagcagcaacagagtggaaatcaccctattacagtgcactgtagtgccggcgccggcaggaccggtaccttttgtgccctgagcaccgtcctggagagagtgaaggcagaggggatacttgacgttttccagaccgtcaagtccctacgacttcagcgcccccacatggtgcaaaccttagagcagtatgaattttgttacaaagtggtgcaggaatatatcgacgcattttccgattacgccaacttcaagtag

SEQ ID NO: 130904 - DNA, 528 bp, Artificial Sequence
  Description of Artificial Sequence: Synthetic coding sequence
atggattcttggtttatcctcgtactgctcgggagcgggttgatctgcgtctctgctaacaacgccacaactgtggctccatcagtcgggatcactcggctgattaatagctctacagccgaacccgtgaaagaagaggctaagactagtaatcccacctcctctttgacctctttgtcagtggccccgactttttcacctaacattacattgggtcccacttacctgacaaccgtgaattcctccgacagtgataatggcactacacgtacagcgtcgacaaactctatcgggatcacaatttctcctaacgggacttggctgcccgataatcagttcaccgacgcaagaaccgaaccatgggagggcaattctagcactgccgccactacgcctgagacatttcccccgtccggcaactcagacagtaaggacagaagggatgaaacacctattatcgccgtcatggttgccctgagttctttgctcgtcatcgtgtttatcatcatcgtgctgtacatgctgtag

SEQ ID NO: 130905 - DNA, 417 bp, Artificial Sequence
  Description of Artificial Sequence: Synthetic coding sequence
atggactcgtggttcatactagttctgcttggatctggcctgatctgtgtttccgctaacaatgctactacagtcgctccgagtgttggaattacccgtcttatcaactcttcaactgctgagccagtcaaggaggaagctaaaaccagtaatcccacctcaagtctcacatcgctgagcgtcgctcccactttctcaccgaacattactctgggaccaacttatctcaccactgtgaactcatctgatagtgataacgggactacccggactgcctcaaccaactccatcggtattacaatcagccccaacggtacctggttgcctgacaaccagtttacagacgcacgcacagaaccctgggaaggaaattccagtaccgccgctactactccagaaacttttccaccctcttag

SEQ ID NO: 130906 - DNA, 762 bp, Artificial Sequence
  Description of Artificial Sequence: Synthetic coding sequence
atggactcctggttcatactggttttactgggttctgggttgatttgcgtgagcgctaataatgccacaaccgtggcgccctcagttggtataactcgactaattaactcttctacagcggaacctgtcaaagaagaagctaaaacaagcaaccccacttcatctctgacatcattgtctgtcgcacccaccttcagcccaaatattaccttgggacccacatatttgaccactgtgaacagctcagactccgataatgggacaacaaggacagcctctactaactctatcgggattacgatttccccaaacgggacatggctacccgataaccaattcaccgacgcccgaacagaaccctgggaagggaactccagtactgccgccacaacccccgagacctttccaccatctgacgaaacacctatcattgcggttatggtggctctaagttcccttcttgtaattgtgttcattattatagtcttgtatatgctacgcttcaaaaagtacaagcaggcaggcagtcacagcaatagcttccgtctatccaacgggcggaccgaagatgtcgagcctcaaagcgtgcctctactagcccggtctcccagcactaatcggaagtatccaccccttcctgtggacaaactggaggaggagatcaatcgtcggatggctgatgataacaagttgttccgtgaggagtttaatgctttgcccgcctgtcccattcaggccacatgcgaagctgcgagcaaatag

SEQ ID NO: 130907 - DNA, 1239 bp, Artificial Sequence
  Description of Artificial Sequence: Synthetic coding sequence
atgactaatcggaagccgcagaggctaataacccagttccatttcacctcctggcccgacttcggagtcccgttcacaccgattggaatgctgaaattcttaaagaaggtcaaagcctgcaacccacagtacgccggtgcgatcgtcgttcactgtagcgctggggtaggtcgcacaggaacgtttgtggttatcgatgctatgctggatatgatgcacaccgaacgtaaggtggatgtctacgggtttgttagtaggattagagctcagagatgccagatggtccaaactgatatgcagtatgtgtttatataccaggcactgttggagcactacctgtacggcgatacagaattggaagtaacatctttggaaacccatctgcagaagatatataataagattccagggacttcgaataatggtctggaagaagaattcaagaagttgacgtccattaagatccagaatgacaagatgcggaccggcaatctgccagctaatatgaagaaaaacagggtccttcagattatcccatatgaattcaaccgggtgatcataccggttaagcgtggcgaagaaaacaccgattatgtgaacgcatccttcattgatggttatcggcaaaaggacagctacatcgcttcccagggacctctgctgcacacaattgaggacttctggcgaatgatctgggaatggaaaagctgcagtattgtgatgctgacggagcttgaagaacgaggccaagaaaagtgcgcgcagtactggccatcggacgggctagttagctacggggatataactgtcgaactgaaaaaggaggaagaatgcgagagttataccgtgagggatctgctggtgacaaacactagagaaaataagtcaagacagatacgccagttccatttccacggatggcctgaggtggggatcccatctgacggcaagggcatgatctccatcattgccgccgtgcaaaaacagcaacagcagagtggcaatcatccaattaccgtgcactgctctgcaggcgcaggcaggaccgggactttttgcgctctttccactgtgctggaacgcgtgaaagccgagggcattcttgacgtcttccagactgtcaagtcactcagattacagcgtccgcatatggtacaaactctcgaacagtatgagttttgttataaagtggtacaggagtacattgacgctttctccgactatgcgaactttaaatag

SEQ ID NO: 130908 - DNA, 5994 bp, Artificial Sequence
  Description of Artificial Sequence: Synthetic coding sequence
atgctgagtcatggggccggactggctttgtggattacgctatctttgctgcaaactggcctggccgaaccggagagatgcaatttcaccttggcagagtccaaggccagcagtcacagcgtttcgatccagtggcgaatactcgggtctccatgcaacttttcactgatttactctagcgatactctgggcgcggctctgtgtcccacatttcgaatcgataatacaacctatggttgtaatctgcaagatttgcaagctgggacgatttacaacttcaggattatctcactcgacgaagagaggacagtggtgttacagaccgacccactgccccccgctcggtttggcgtctccaaagaaaaaactacgagcacttcacttcacgtctggtggaccccctcctccgggaaggtgacctcttatgaagttcagttattcgatgaaaataaccagaagattcagggggtgcaaatacaggagtctacttcttggaacgaatatacttttttcaacttaaccgccggatcgaaatacaatattgcaatcaccgctgtgtcagggggcaagcgctcattcagcgtatacaccaacggcagcactgtgccaagcccagtaaaagacattggtatctcgactaaggccaacagtcttcttatctcatggtcacatggatccggcaacgtcgagcggtaccgcctgatgctgatggacaagggaatactggtacacggcggtgtggtggacaaacatgcaacaagttatgccttccatgggttgacaccagggtacttgtacaatctcacagtaatgactgaggccgcgggtttacagaattaccggtggaaactggtgcggacggcaccaatggaggtgtctaacctcaaagtgactaacgacggctcactcactagtctcaaggttaagtggcagcggcctcctggcaacgtggacagctacaacattactctgtcacataagggcaccatcaaggaatctagagtactggcgccgtggatcacagagacgcacttcaaggagctggttcctgggcgcttgtaccaggtgactgtgtcatgtgtgtcgggtgagctatccgctcagaaaatggcggtgggtcgcacatttccagataaggtcgcaaatttagaggctaacaacaatggacgtatgcgatcactcgtggtgtcctggagcccaccagcaggggactgggagcaataccgcatccttttgttcaatgattccgtagtgctcctgaatatcaccgtgggaaaagaagaaactcagtatgtcatggacgacacaggccttgtgccggggcggcagtatgaagtcgaggttatagtcgagagcggcaatcttaagaattctgaaaggtgccaggggagaaccgttcctttagccgtgctgcagttacgggtcaagcacgctaatgaaactagcctttccattatgtggcaaacccctgtggccgaatgggagaagtacatcatctcactggccgatagagacctgctgctgatacacaaaagcttatctaaggatgctaaggagtttacattcaccgatcttgttccaggaaggaagtatatggcaacggtaacaagcatttctggcgatttaaagaactcaagttcagtaaaggggcggacagtgcctgctcaggtgacagatctgcacgtggctaaccaaggcatgacttcttctctgttcacaaattggacccaagcgcaaggggacgtagagttttaccaggtcttactgatccacgagaacgtagttatcaaaaacgaatctatttcatccgagacatctcgatatagtttccactcccttaagtccggatcattgtactctgtcgtggtgactaccgtgtctggagggatctcttcaagacaggttgttgtggagggcagaacagtcccctcaagcgtgagcggagtcacagtgaataacagtggccggaatgattaccttagtgtgagttggctgctggccccgggcgacgtagataactatgaagtgactctgagtcatgatggcaaggttgtgcagtccctcgtgatagctaagtccgttcgcgagtgtagtttctccagcctgacacctggccgcctgtacactgtgacaatcacaactagatccggtaagtacgaaaatcactctttttcccaggaaaggacagtccccgacaaggttcagggagtgagcgtgtcgaattcagcacgatcagactatctccgagtgagctgggtccacgctactggagattttgaccactatgaggtcacaattaaaaacaaaaacaatttcattcaaaccaagtcaataccaaaaagcgagaacgagtgtgtatttgtacaactagtgcctggacgcctctattctgtgaccgttactactaagtccggccagtatgaggcgaacgaacaggggaatggccgcactatccccgaaccggtgaaggatttgacactgagaaatcggtccacagaggacctccatgtgacgtggagtggggccaacggtgacgtggatcagtacgagattcagctgctgttcaacgacatgaaagtctttccaccgttccacctggtgaacactgcaacagagtaccggttcacctctttgacgccagggagacagtacaaaatcctggtacttaccatttccggggacgtccaacagtctgcgtttattgaggggttcacggtccccagcgcagtaaaaaacattcatatttccccaaacggagcaactgattcgctgacagtgaactggacaccaggaggaggcgacgtcgactcatatactgtgtcggccttccgccattctcagaaggtggatagtcaaactattcctaagcacgttttcgaacacacattccacagacttgaagccggcgaacagtaccagataatgatcgcctcggtctccgggagtctgaagaaccagatcaacgttgtcggacgaacagttcctgcctcagtgcagggcgtgattgccgataatgcctatagttcttattccctcattgtatcctggcaaaaagccgccggcgtggccgagagatatgacatcctcctgctgaccgaaaatggcatcttattgcggaatacaagcgagccagcaaccacaaaacagcacaaatttgaagatttgacccccggcaagaagtacaagattcagattctgactgtcagcggtggtctgttctcgaaggaagcacagacagaaggcagaacagtgcccgccgctgtcacagatcttagaatcactgaaaatagcactagacatttaagcttccgctggaccgcttccgagggcgaattgagctggtacaatatatttttgtacaacccagatggaaacctgcaagaacgggcccaggtcgacccactagtgcagagtttctctttccagaacctactgcagggcagaatgtacaagatggtgattgttactcatagcggcgaactgagtaatgagagtttcatttttggtaggactgtccctgcatctgtttcccaccttcggggttctaaccgcaatactacagattccctgtggtttaactggtcccctgcaagcggagattttgacttctacgaactgattctatataaccccaacggaactaagaaggaaaattggaaggataaggacctgaccgaatggcgtttccagggcctagtgccaggtaggaagtacgtgctctgggtggtaactcattcaggtgacttgagcaataaggttactgccgaatccaggacagctccctccccacctagcctgatgagctttgctgacattgcaaacacttcgcttgccattacctggaagggtccaccggattggaccgattataatgatttcgaactgcagtggctgccaagggacgcacttactgtctttaatccgtacaacaatcgcaaaagcgaaggccggattgtatacggtttgcggcctggcaggtcctaccagtttaatgtcaagactgtcagcggcgattcctggaaaacatatagtaaacccatcttcggttcagtgagaaccaaacctgataagattcagaacctgcattgtaggccccaaaactcaacggccattgcctgttcatggattccgcctgattccgatttcgacggatacagtatagaatgcaggaagatggacacacaggaggttgagtttagtagaaagctggaaaaagaaaagagcctactgaacattatgatgctggtcccacacaagcgttaccttgtcagcatcaaagtgcaaagcgcaggcatgacttcggaagtagtcgaggatagtaccatcactatgatcgatcgcccacctcctccacctcctcatattagggtcaatgagaaggatgtgttgatcagtaagtctagtatcaattttactgtgaattgttcatggttttccgatactaacggagctgttaaatattttacagtagtggtacgcgaggcggacggaagcgacgaacttaagccagaacagcagcaccctctgccttcatacctggagtataggcacaatgcttctatcagagtataccagacaaactactttgcttctaaatgtgcagaaaatcctaactccaactcaaaatcttttaacatcaagcttggtgccgagatggaaagcctcggaggcaagtgtgacccaacccagcagaaattctgcgatgggccactgaaaccccacacagcctaccgaatctctatcagggccttcacccaactgtttgatgaggacctcaaagagttcacgaagcctctctacagcgacacattttttagcctgcctattactaccgaaagtgaaccactgtttggcgcaatcgagggcgtctccgctgggttgttccttattggaatgcttgtcgccgtggtggctctgctcatatgccgccagaaagtgtctcacgggcgcgaacgtccgagcgccaggctgtccatccgccgagacagacctctgagtgtgcacctaaatctgggacagaaaggcaatcgcaaaacctcatgtcccatcaagataaatcagtttgaaggacatttcatgaagctccaagccgacagtaattacctgctttccaaggagtacgaggagctaaaggacgttgggagaaatcagagctgcgacatcgctctcctcccggaaaatcgtggcaagaatcgatacaataacatcctaccttacgacgctacccgagtaaagttaagcaacgtggatgacgatccctgtagtgactacatcaatgcatcatacatacccggcaacaactttcggcgagagtacatcgtgacgcaggggccgctgccgggcaccaaggatgacttctggaagatggtgtgggagcaaaatgtacacaatatagtcatggtaacgcagtgtgttgagaaggggcgggtgaagtgcgaccattattggccggctgatcaagacagcctctactatggcgatcttattctgcagatgctgtccgagtccgtactgcctgaatggacaatccgggagtttaagatttgcggggaagagcaactcgatgcccaccgtctcattagacacttccattacacagtgtggcctgaccatggggttcctgagacaacccagtcactgattcagtttgttagaactgtgagggactacatcaacaggtcacccggagccggcccaacagtggtccactgcagcgccggggtcgggagaactggcacgtttattgctttggatcgaattctgcagcagctggatagcaaagactcagttgacatttatggagccgtgcatgatctgcggttgcatcgggttcacatggttcagacggagtgccagtacgtgtatttacatcagtgtgtccgagatgtattgcgggcccgcaagctgagatctgagcaggagaatccactgtttccaatctacgagaatgtcaaccctgagtaccaccgggatcccgtctattccagacactag

SEQ ID NO: 130909 - DNA, 6648 bp, Artificial Sequence
  Description of Artificial Sequence: Synthetic coding sequence
atggaggcggaattctacatggtgatcctgacgtgtctgattttccgaaactcagaaggcttccaaatcgtacacgtccaaaaacaacagtgcttgtttaaaaatgagaaggtggtcgtcggaagttgcaaccggacgatccaaaatcagcaatggatgtggacagaggatgaaaagcttctgcatgtcaaatccgcactgtgtctcgccatctctaatagctctcgcggtccctcgaggtctgcaattttagacagatgtagccaggcaccgcgctggacttgttacgaccaggagggattcctggaagtcgagaatgcctcactcttcttgcagaagcaagggagcagggtcgttgtgaaaaaggctcgcaagtacctgcactcctggatgaagattgatgtgaataaggaggggaagttagtgaatgaatctctgtgccttcagaaggccggcctcggggctgaagtgtccgtgcgatcaacacggaacaccgctcccccacagattctaaccactttcaacgctgtcccagacggattggtcttcttaatccgtaatacaacagaggcttttattcggaacgcagctgaaaactacagccaaaactcctcggagcgccaacacccaaacctgcatatgaccggcatcactgacactagctgggttttgtctaccactcaaccattcagtagtaccacagaggaaactggtcttgcagagcctgagcggtgtaatttcacactagccgagagcaaagcctcctctcattcagtgagtatccagtggaggattctagggtcaccttgcaatttctctctcatctactcctctgacacgttgggagcggcactgtgcccaacattccgcattgacaacaccacctacggatgcaatctgcaggacttgcaggcaggcaccatctataacttcagaataataagcctggacgaggagcgcacggtcgtccttcaaactgatccgctcccacctgcccgcttcggcgtttcaaaggagaaaaccacaagcactagcctgcatgtctggtggactccttctagcggaaaggtgactagctatgaggtccaactgttcgacgagaataatcagaagatccaaggcgtccagatccaagagagcacaagctggaacgaatacacgttctttaatctgaccgccggatctaaatacaacatcgctatcacagcagtgtccgggggtaaacgcagtttctccgtgtacaccaatgggtcgaccgtcccctctcccgtgaaggacatcggaataagcacaaaggcgaattccctgttaatttcatggagccacggcagcgggaacgtggaacgataccgtctcatgttgatggacaagggcattctcgtccatggaggtgtggtagataagcacgccactagctacgcatttcatggactcactcccggctatctatacaatctgactgttatgacagaagctgccggactgcagaattacaggtggaaactggtgagaacagcgccaatggaagtctctaacctcaaggtgactaacgacggctctcttacctctctcaaagtgaaatggcagcgcccgcctggaaacgtcgattcatataatataactttgagccacaaggggactattaaagaaagtagggtcttagcgccctggatcaccgagacccacttcaaagaactggtgcccggaaggctgtatcaagtgacagtgagttgcgtgtccggagagctatctgcacagaagatggctgttggtcgaacattccctgacaaggtagctaacctggaagccaataataatgggcgcatgcgctcattggttgtttcctggagccccccagctggggactgggagcagtaccgaatccttttgtttaacgacagcgtggtgctactgaacatcactgtgggtaaggaagagacacaatatgttatggacgataccggcctggtgccaggtcgacagtacgaggtcgaggtcatcgttgagtcgggtaatcttaagaattcagagcgctgtcaaggcaggaccgtgcccctggctgtactacagctacgggttaaacacgcaaatgagacaagcctgagcattatgtggcagacacccgtcgctgagtgggagaaatacatcatcagcctggccgaccgggacctccttttaatacataagagtctgtctaaagatgcaaaggaattcaccttcaccgatctggtgccaggaaggaagtacatggcaaccgtgacctctatttccggtgaccttaaaaattcctcctccgtgaaaggaagaaccgtccccgctcaggtaacagatttgcacgtggccaaccagggtatgacctccagcttgttcacaaactggacccaggcccaaggggacgtcgaattttaccaggtgctacttattcacgagaatgtggtgattaaaaacgagagcatttcatcagaaaccagtagatacagcttccactcactgaaatccgggtcactgtactcggtcgtagtcaccaccgtcagtggaggcatctcctccaggcaggttgtcgtcgaggggcggaccgtgccgagcagcgtgtctggggtgacagtcaataattctggaagaaacgactatctgagcgtgagttggctgctggcacctggcgatgtcgacaactatgaggttaccttgtcacacgacggcaaggtggtgcagagtctggtgattgccaagagcgttagagaatgctctttcagcagtttaaccccaggccgactctacacagttacaatcaccacccgctcaggcaagtacgagaaccatagtttttctcaggagcggactgtgccagataaagttcagggtgtgagcgtctcgaacagcgcccgcagtgattatctcagggtgtcatgggtccacgccacgggagacttcgatcactacgaggtcacaatcaaaaataaaaacaattttatccagacaaagtctatccccaagtcagaaaatgagtgcgtatttgtccagctggtgccgggccgcctgtattccgtgacagtaaccacaaaatcaggccagtacgaggctaatgagcagggcaatggtaggacaatcccggaacctgtaaaggacctcactctgaggaatagaagtaccgaggatctgcacgtcacctggagtggcgccaatggcgacgtcgatcagtatgagatccagcttctgttcaacgacatgaaagtgttcccacctttccatctagtgaacaccgcaactgagtaccgctttaccagccttacacctggccgccagtataaaatcctggtgctgacaatttcgggagatgttcaacaatcagcctttatcgaagggttcacagtgccatccgctgtcaaaaacatccacatctcaccaaatggggctacagacagtctcacggtcaactggacccctggtggaggcgatgtggacagttataccgtgtccgcattccggcactcacaaaaggtcgacagccagacgattcccaagcatgtctttgagcatacatttcatcgactggaggccggggagcagtaccaaatcatgattgctagtgtctctggatccctgaagaatcagatcaacgtcgttggccggactgtgccagcctcggtgcagggagtaatcgctgataacgcctactccagttatagcctcatcgttagttggcagaaggctgccggggtcgctgaacggtatgatatactattgctgactgaaaacggtatcttattaaggaacacatctgaacctgctacgacaaagcaacacaaattcgaggacctgacccctggaaagaaatacaaaatccagatcctgacagtcagcggggggctgttttccaaggaagcacaaacagaaggaagaacggtgcctgccgcagtgactgatctccgaattaccgagaactcgacaaggcacttgtctttcagatggaccgcgagcgaaggcgagctgagttggtataacatctttttatataaccctgacggcaacctgcaagagagagcccaggttgatcctctggtgcagagtttctcttttcagaacttgctgcaaggacggatgtataagatggtgatagtgacacactccggcgaactctcaaacgagtccttcatctttggtcggaccgtgccagccagcgtctcacacctgcggggcagtaaccgaaatacgactgattccctgtggttcaactggtcccctgcttcaggcgatttcgacttctacgagctgatactgtataacccaaacgggaccaagaaggagaattggaaggacaaagatctgaccgagtggcgattccaagggctggtccctggaagaaagtacgtgctatgggtggtcacacactccggtgatctcagtaataaggtgactgctgagtccaggacggctcctagtccaccatctttgatgagtttcgccgatatcgccaacacgagcctggctattacctggaaaggcccacctgactggactgattacaacgatttcgagctccagtggctgccgcgggatgccctgaccgtgtttaacccgtataataacagaaaaagtgaaggccgaatcgtttacggactgagacccggaaggtcctaccagttcaacgtcaaaactgtgagcggagattcctggaagacctattccaaaccgattttcggaagcgtcaggacaaagcctgataagatccagaacctccattgtcgcccacaaaactccacagccatcgcctgtagttggattccacccgacagcgactttgacggatattcaatagaatgtaggaagatggacactcaggaggtagagttcagtcggaaactggagaaagaaaaaagtcttcttaatataatgatgttagtgccacataagcgttaccttgtgtccattaaggtgcaatccgccgggatgacatccgaagttgtcgaagacagcaccattacaatgattgaccgcccaccacctccccctccccacatccgagtgaatgagaaggatgtattaatctcaaaatcctccatcaacttcacagtcaactgttcctggttcagtgacacaaacggggcagtcaagtactttactgtggttgtccgcgaggctgacgggtccgacgaattgaaacccgagcagcagcaccccttgccctcttatcttgagtacagacataatgcctctattcgggtctaccaaacaaactatttcgcaagcaagtgtgctgaaaacccaaacagcaatagtaaaagctttaacatcaagttgggcgctgagatggaatcactgggtggcaagtgcgaccccactcagcagaaattttgcgacggccctctgaagccccacaccgcctacagaatctctattcgtgccttcacacagctgtttgatgaagacctaaaggagttcactaaacccctgtactctgatacattttttagcctgcctatcaccacggaaagcgagcctctcttcggtgctatcgaaggcgtgtccgcaggcctgtttctgatcgggatgctagtggcagtggtcgccctgctaatatgcagacagaaagtatcccacggacgagaaagaccctctgcaaggctcagcatccggcgcgatcggccattaagcgttcatcttaaccttggacagaaggggaacaggaagactagctgccccattaaaatcaaccagttcgagggccactttatgaagcttcaggctgactccaactatctcttgagcaaagaatacgaagagctcaaggatgtggggagaaatcaatcctgtgacatcgctctcttgcctgagaatcgtggaaagaacagatataacaacatactgccctacgacgcgactcgagtcaagctgtccaacgtcgacgatgacccttgcagcgactatattaacgcaagttatatacctgggaataactttcgcagagaatacattgtgacccaggggccactgccaggcacaaaagacgatttctggaagatggtttgggagcagaatgttcacaatattgtcatggtaacacaatgcgtggagaagggaagggtcaagtgcgaccattactggcccgcagatcaggacagcctgtattatggggacttgatcctgcagatgttgtcagagagcgtgttacccgagtggaccatcagggagtttaaaatttgtggcgaagagcaactagatgcacatcggttaataagacactttcactacacagtttggccagaccatggcgtgcccgaaaccactcagtccttgattcagtttgtaaggacagtgagggattacatcaatagaagtccaggcgccggccctactgtggtgcactgttctgctggcgttggcagaaccgggacatttattgcacttgatagaatcctccaacagttggattccaaagactccgttgacatatatggagctgtccatgatttgaggctgcacagggtgcatatggtgcagaccgagtgtcagtacgtgtacctccaccagtgtgtccgggacgtgctgcgagcgaggaagcttcggtccgagcaggagaaccctctatttcctatatacgaaaatgttaatccagagtaccatcgcgatccggtgtactcccggcattag

SEQ ID NO: 130910 - DNA, 5724 bp, Artificial Sequence
  Description of Artificial Sequence: Synthetic coding sequence
atgctctcccacggagctggtctggccctgtggattaccctctcactgctgcagacggggcttgccgaacctgagagatgtaacttcacactcgccgagtctaaagcatcctcacattcggtttccatccaatggcgaatcctggggagcccctgcaatttcagcctcatttacagttccgacaccctgggggcagcgttgtgcccgaccttccggatcgacaacacgacctatggatgtaatctccaggatctacaggcaggcactatttacaactttcgtataatctctctggacgaggagagaaccgtcgtcctgcagacagatccactgcccccagccaggttcggagtctcaaaggaaaaaacgacctccacctctctccacgtctggtggacaccttctagtggcaaagtcacatcatatgaagtgcaattgtttgatgaaaacaaccagaagatccagggcgtccagatacaggaaagcaccagctggaatgaatatactttttttaacctgaccgccggcagtaaatataacattgcgatcacagcagtaagcggaggaaagcgaagcttctcagtctatacaaatggtagcaccgtgcccagtcctgtaaaggacataggcatatctaccaaagctaactcacttctcatttcatggagccatggctctggtaacgttgagcggtaccggctcatgttgatggataagggcattttagttcatgggggagtcgtcgataagcatgctaccagctacgcatttcatggcctgactccaggttacctgtataacctcaccgttatgactgaagccgctggcctgcagaattaccgatggaagctggtcaggacggcgcccatggaggttagtaatctcaaggtgactaatgacgggagtctaactagtctaaaggtgaagtggcaacggccccctggtaacgtagactcttacaacatcaccctatcacataagggcacaatcaaggagtctcgggtgttagcaccctggatcaccgagacccactttaaagaactggttccaggtcggttgtaccaggtgactgtgtcatgcgtatccggcgagctgagtgcgcagaaaatggccgtggggaggactttcccgttggctgtgctgcagttaagggtcaagcatgcaaacgaaacttccctttccattatgtggcagacgccagtggccgagtgggagaaatacattatatctcttgctgaccgggacctgcttctgatccacaagagcttgagtaaggatgccaaggagtttactttcacagacttggtgccaggacgcaagtatatggccactgttacaagtatcagcggagacttgaagaactcaagttctgtgaaaggccgaacagtgccggcccaagttacagacctccacgtcgccaaccaaggaatgaccagcagcctatttacaaactggacccaggcacagggcgacgtagaattttaccaggtactgctgatccacgaaaatgtggtcatcaagaacgaatcaataagttcggagacctcccgatacagcttccatagcctgaaatctggcagcttgtactcagttgtcgtgactacagtctcgggtgggatctcatcacgtcaggttgtcgtagaaggccgcacagtaccgtcaagtgtgagcggggtgaccgtcaacaattctggaagaaacgactacctgtccgtcagttggctgttggcccccggggatgtcgataattacgaggtgaccttgagccacgatggaaaggtggtccagagtctagtaattgctaagtccgtccgcgagtgttccttttccagcctcacccccgggaggctgtatacagtgaccattacgacccgatctgggaagtatgagaaccattcctttagccaggaacgcactgttccagataaagtccagggagtctccgtctctaacagcgcgagatccgactacctgcgcgtgagctgggtccacgcaacgggggactttgaccactacgaagtgaccattaagaacaagaacaacttcattcagaccaagtctattccaaaatcggaaaacgaatgcgtctttgtgcagcttgtgccaggaaggctgtacagcgtgaccgtcacaaccaagtctggacaatatgaagccaacgaacaggggaatggacggactattcctgaacccgtgaaagatcttacactgcgtaaccgctcaactgaggaccttcacgtcacctggtccggagccaatggcgacgtggaccagtacgaaatccagcttctgtttaacgacatgaaggtgtttcccccatttcatctggtgaataccgccacggagtaccgttttacatctcttactcctgggcgacagtacaaaatcctggtgctgactatatccggggatgttcagcaatctgcctttattgagggcttcacagtgccaagtgctgtcaagaacatccacatcagccccaatggagccaccgatagccttactgtcaactggacacctgggggcggtgatgtcgactcttacacagttagcgccttccgccatagccagaaagtggatagccagacgatcccaaagcacgtcttcgaacacacgttccacaggctcgaagcgggagagcagtaccaaattatgattgcttctgtgagtggatcgcttaagaatcagattaacgtagtgggtagaactgtgcctgcgtccgtgcagggggtgatagcagacaacgcctatagctcatatagtctcatagtgtcctggcagaaagctgccggtgtggccgagaggtacgacattctgctcctcactgagaatggtatcctgttgagaaacacttcggaacccgccaccacgaaacagcacaaatttgaagacctgacgcctggtaagaaatacaaaattcagatcctgaccgtatcaggtgggctgttttccaaggaagcacagaccgaaggcaggactgtcccagccgcggtgaccgacctacgcataaccgagaatagtactcgtcacctatccttccgttggaccgcaagcgagggtgaactgtcttggtacaatatattcttgtataatcctgatgggaatctgcaggagcgggctcaggttgatcccttggtgcaaagtttttcattccagaatttgttgcaggggcgcatgtataagatggtaatagtgacccactctggggagctatcgaacgagagcttcattttcggccgcacagtgcccgccagcgtgagtcacctccggggatccaataggaacaccacggactccctgtggttcaattggagtccagcatccggggacttcgacttttacgagctgatcctctacaatcccaacggcacaaagaaagaaaactggaaagacaaagacctgaccgaatggcggttccagggcctcgttcccggaaggaaatatgtcctctgggtcgtgacacacagtggggacctgtccaacaaggtgacagcagaaagtcggaccgctccctcgcccccaagcctgatgtcatttgcagatatagccaacacgtctcttgctattacttggaaaggtcccccagattggaccgactataacgactttgagttgcagtggctgcccagagacgccctgaccgtattcaacccctataataaccggaagtcggaagggcgcattgtatacgggcttcgcccaggcaggtcttaccaattcaacgtgaaaacggtctccggtgatagttggaagacctactctaagcccatctttggctctgtaagaaccaagcctgacaagattcaaaatctacattgtcgcccacagaactctactgccatagcgtgcagctggattcctcccgattcggacttcgacggttatagcatagagtgcagaaaaatggatactcaggaggtagagtttagtagaaagctggaaaaggagaagagcctgcttaatatcatgatgctggtcccgcacaagagatatcttgtgtctattaaagtgcaatcggccgggatgacatctgaagtcgtggaagattcaaccattacaatgattgaccggccgccacctcctcctccccacatccgagtgaatgaaaaggacgtgctgatttccaagagcagcattaattttaccgtcaactgctcctggttttcagacaccaacggtgctgtaaagtactttaccgtcgtggtgagagaggctgatggtaacgacgagctcaaaccagagcagcagcacccacttccatcctatctggaataccgccacaacgcaagcatcagagtataccagacaaattatttcgcatcaaaatgcgccgaaaaccccaattctaacagtaagagttttaacataaaactcggagccgagatggaaagtctggggggtaagtgcgacccaactcagcagaagttttgtgacggaccgctcaaacctcacacggcctaccgtatcagcatccgggccttcacacagttgtttgatgaggacctgaaggagtttacaaagccgctgtactcagataccttctttagcctccccatcaccacagagagcgagccactttttggggcaatagagggtgtgtcagctgggttattcctcatagggatgttggtcgctgtcgtggctctgctgatctgtagacagaaggtgagtcacggcagggaaaggccatccgcccgtctgagtattaggcgggaccgtccgctgagcgtccatctcaacctgggccaaaagggcaataggaagaccagttgtcccatcaagattaatcagtttgaaggccattttatgaagctgcaggccgacagcaattatctcctgagcaaggaatacgaggagctcaaggatgttggtaggaaccagtcttgcgatattgccctactaccagaaaacaggggcaagaacaggtacaataatattcttccttatgatgccacccgcgtgaaactctctaatgtcgatgacgatccttgtagcgactacattaacgcttcctatatccctggaaataattttcgaagagaatatatcgttacccaggggcctttgcctgggaccaaggacgacttttggaaaatggtctgggagcagaatgtacacaacatcgttatggtaacacagtgcgttgagaaaggacgcgttaaatgcgaccactattggcccgccgatcaggattccctatattacggggatctcatcctgcagatgctgtctgagagtgtgctacccgagtggaccattcgggagtttaaaatctgtggggaggaacagctcgacgcccatcgcttgattagacacttccattatactgtgtggcctgatcatggagtccccgagactactcagtctctcatccagttcgtgaggacggtgcgggattatattaataggtccccaggcgcagggcccacggtggtgcattgttctgccggagtggggagaacgggaacattcattgccctggatcgtatactgcagcagctggactccaaggacagcgttgacatctatggcgccgtacacgatctgcggctccacagagtccatatggtgcaaacggaatgtcagtacgtgtatcttcaccagtgtgttcgcgatgttctgagggctcgcaaactgcgtagcgagcaggagaatcccctctttccgatttatgaaaacgtgaatcccgaatatcaccgtgatcctgtgtattccaggcattag

SEQ ID NO: 130911 - DNA, 2760 bp, Artificial Sequence
  Description of Artificial Sequence: Synthetic coding sequence
atggaggccgaattctatatggtcatcttaacctgtcttatttttcggaactcggaaggcttccagatagtccacgtccaaaagcagcaatgtttgttcaaaaatgagaaagtggttgtaggttcttgcaacagaactatccagaatcagcagtggatgtggacggaagatgagaagctgctccatgttaaatctgccctgtgtctggcgatttctaattccagcagaggcccatcccgaagcgcgatcctggaccgttgctcccaggccccacgctggacctgttacgaccaagaaggatttcttgaggtcgagaatgcctcgctgttcctgcaaaagcaggggtctcgcgtcgtcgtaaaaaaagcgcggaagtatctgcacagctggatgaagatcgatgtgaataaagaagggaagctggttaatgaatcactgtgtctgcaaaaagctggactcggtgccgaggtgtcagtgcggtcgacaagaaacaccgccccgccccagatcctgactacctttaatgcagtgccggatggcctggtctttctgatcagaaatactacagaggctttcatccgcaatgccgccgagaattacagtcagaactcttctgagcgacaacacccaaacctgcacatgaccgggattactgatacctcctgggtcctgagcacaacccaacctttcagcagcactaccgaggagactgggctggccgagcccgagagatgcaactttactctcgccgaatccaaagcatcatcccattctgtttcaatccagtggaggattcttggttccccttgcaacttttcgctcatttattccagtgacacactgggtgctgccctctgcccgaccttcaggatcgacaatactacatacggatgtaacctgcaagatttacaagcaggtacgatatataacttcaggatcattagtttggacgaagagcgaactgtagttctccagaccgatcccctgccccctgcccggttcggtgtctctaaggagaagacaacttcaacttctctgcatgtgtggtggacaccatcctcagggaaagttacatcttatgaagtgcagctcttcgatgagaataaccagaaaatccaaggggtacagatccaggaatctacatcatggaatgagtatacttttttcaacctgacagcgggtagcaagtataacatcgccataaccgcggtgagtggcggtaaacggtcattctcggtctatacaaatggctccactgtcccttccccggtgaaggacatcggcatatcgacaaaggcaaatagcttattgatatcatggagccatggctccggaaacgtcgaacggtatcggctcatgctgatggataagggtattttagtccacggcggcgtggtagataaacatgccacaagctatgcatttcacggattgaccccagggtatttgtacaacctcaccgttatgacagaagcagcaggactccagaactatcgctggaagctggtgcggacagcgccaatggaggtgagtaatctgaaggtgactaatgacggaagccttacaagcttgaaagtgaagtggcagcgccctccgggaaacgtggattcctacaacataactcttagccacaaaggaacaatcaaagaaagcagggtccttgctccctggatcacagaaacccatttcaaagagctggtgccaggaaggctataccaggttaccgtctcctgcgtctcgggcgagctatccgcgcaaaagatggccgtcggcaggaccttccctgacaaagtggcgaatctggaggccaacaataacggcagaatgaggagcttggtcgtgtcgtggagccccccagccggggattgggaacagtatcgtatactgctgtttaatgattcggtcgttctgctgaacatcacagtgggtaaggaagaaacacagtacgtgatggacgacactggtctggtgccaggccgtcagtatgaagtggaggtgatcgtggaatccggaaatctcaagaacagtgagcgctgccagggccggaccgttcctctggcagtactacagttgcgggtgaagcatgccaacgagacaagcctctccataatgtggcagactcccgtcgccgaatgggagaaatatatcatcagtctcgctgaccgggatttgttgttgatccacaaaagcctgtctaaggacgccaaagaattcacctttacggacctagtgcctggaaggaaatacatggcaacagtcacctccatttcaggagatttaaaaaactcctccagcgtgaaagggcggacggtgcccgcacaagtaaccgacttgcacgtagccaaccagggcatgacttcgagcctttttaccaactggacccaggcccagggagatgttgagttctaccaggtccttctgatccatgagaatgtggtgatcaaaaacgaatcgattagctccgaaacctcacgctactctttccattcattaaagagcggatctctttacagtgtggtggttaccaccgttagtggcggcatctcctcacggcaagtggtggtagaggggcgtacggtcccagacaaagttcagggtgtctcggttagcaacagtgccaggtccgactacctgagggtgtcttgggttcacgctaccggcgatttcgatcactatgaagttaccattaagaataagaacaatttcatccagaccaaagctttcccatcacagaagactaacgtgtaccttttctcctag

SEQ ID NO: 130912 - DNA, 5724 bp, Artificial Sequence
  Description of Artificial Sequence: Synthetic coding sequence
atgctgagtcacggcgctggcctagcactatggataacactgagcctgctgcagaccggcttggctgaacccgagcgttgcaactttacacttgcagaatcaaaggctagctctcactctgttagtatccagtggcgcattttaggttccccatgcaacttcagcctgatctattccagcgatacccttggggctgccctgtgccccacattccgcatcgacaacacaacatacggatgcaacctgcaggacctgcaggcggggaccatttacaacttccgcattatctccctcgatgaagagaggactgtggtcctacagacagatccattacctccagctcggttcggcgtgtctaaggagaagaccacttctacatcgctacacgtgtggtggacccccagcagcggcaaggtgactagctatgaagtgcagctctttgacgagaataatcagaaaattcaaggagtgcagatccaggaatccacaagctggaatgagtacacctttttcaatctgaccgccggttccaaatacaatatcgcaatcacagcagtgtctggcggaaaacgctcattctccgtgtataccaacggcagcactgtcccttcccccgttaaggacatcgggattagcaccaaggctaatagtctgctgatcagctggagccatgggtcagggaacgtcgagcgctacaggttgatgctgatggataagggcatcctggttcacggtggagtcgtggacaagcatgctacaagttatgccttccatgggctgacacccggctacctttacaaccttaccgtcatgaccgaagcagccggactgcagaattaccgctggaagctggttcggacagctccaatggaggtttcaaacctgaaggtaaccaatgatggatcccttacatcactgaaggtcaaatggcaacgcccccccgggaatgtggacagttataacattactctttctcacaagggaactattaaggaaagcagggtcctcgctccttggataaccgagacccatttcaaggaactcgttcctggtcggctgtatcaggtgactgtatcatgtgtgtcaggtgagctgagcgctcaaaaaatggctgtgggtagaacctttcctcttgccgtcctccagctccgtgtcaagcacgctaacgagacctcactaagtataatgtggcagacacccgtggctgagtgggagaagtacattatctcccttgcggatagagatttactactcatccataagtccttaagtaaggatgcaaaggagttcaccttcacggatctcgtgcctggacgtaagtatatggccaccgtgacatctatatccggagatctgaaaaattcttcatccgttaaaggcaggacagtgccggctcaagtcacagaccttcatgtggccaatcagggcatgacgtcatcattgtttacaaattggacgcaagcacagggcgacgtggagttctatcaggtcctgcttattcacgagaacgttgtgataaagaacgaatctatttcaagcgagacctctcggtactcttttcactccttgaagtcaggctccctgtatagcgtcgtggtgacaacagtgtcaggagggatttcttctagacaggtcgtcgtagaggggcgaactgtgccatcatcagtgagcggggtcacggtgaataattccggccgtaacgattatctctccgtgtcttggctgctggcccccggagacgttgataattatgaggttactctgtcccacgacggaaaagtagtacaaagtctcgtaatagcaaagtcagtcagagagtgctctttctcctcgctgacaccaggacggctgtatactgtaaccatcaccactagaagtggtaaatatgagaaccactctttctcacaggagaggacagtgcccgacaaagtccaaggcgtgagtgtgtcaaattccgcacggtcagattacttgagagtctcatgggtgcacgccactggcgattttgatcactatgaagttaccattaaaaataagaacaacttcattcagactaaatccatccccaagtccgaaaatgagtgtgtgttcgtccagcttgttccaggtagactctactccgtgaccgttaccactaagagcggacagtatgaggctaacgagcagggcaatggtaggaccatacccgagcctgtgaaggacctcacactgcgcaaccgaagcacagaggatctgcacgttacctggtctggagcaaatggtgacgttgatcagtacgagatccaactcttgtttaacgacatgaaggtgtttcctcctttccatttagtgaataccgcaaccgagtatcgattcacctccttaactcctggccgccaatataaaattcttgtcttgaccattagtggagacgtccagcaaagcgcttttattgaggggttcacagtgccaagcgctgtgaaaaacattcacatcagcccgaatggggctacagactcactcacagtaaattggacgcccgggggtggtgatgtggacagctacaccgtgtccgccttcagacactctcagaaggtggactcacagacaattcctaagcacgtgtttgaacacacatttcatcgcctggaggctggagaacagtaccagatcatgattgctagtgtctccggctccttaaaaaaccagatcaatgtggtaggccggacggtaccggcctctgtacagggggtgatagccgataacgcctacagcagctactccctcattgtaagttggcagaaagctgccggcgtggctgagcgctacgacattctccttctgaccgaaaacggtatcctcctgaggaacacctcggaacctgcaacgaccaagcagcacaagtttgaagatcttacacccggcaaaaagtataaaatccagatcctcacggtctcagggggactattctctaaagaggcccaaactgaggggaggactgttcctgcggcggtgaccgaccttcggatcaccgaaaacagcacgaggcacctatccttccggtggacggcatccgaaggagaactgagctggtataacatcttcctgtataatcccgacggaaatctgcaggaacgagctcaagtcgaccccctggtccaaagtttctcttttcagaacctgctgcaaggacgcatgtacaagatggtgatagtcactcactccggagaactaagcaatgaaagctttatctttggaaggaccgtccccgcctctgtttcgcacctgaggggaagcaatcgcaacaccacagattccctttggttcaactggagtcctgcatctggggatttcgacttctacgaactgatactctataaccccaacggtacaaaaaaggaaaactggaaggataaagatttgacagagtggcgcttccaggggctcgtgcccggacgaaagtacgttctctgggtggtgactcatagtggggatctaagtaataaagttaccgctgagagcaggacagccccttcccctcctagtctgatgagcttcgctgatattgcgaataccagcctggctattacatggaaaggtccccccgactggactgattacaatgactttgagctgcaatggctccctagggacgctctgaccgttttcaatccatataataatcggaagtcggagggtcgaatcgtgtacggcctgcggcctggtaggtcataccagtttaatgtcaagactgtgtctggcgattcctggaaaacctacagcaaacctatatttggctcagtgcgtaccaagccagacaaaattcagaacctgcattgtagaccccagaatagtactgctattgcttgcagttggattcctccggattccgacttcgacggctactcaatcgagtgtaggaagatggacacacaggaagtcgagttttctaggaagttggagaaggagaagtctcttctgaatataatgatgctggtgccacacaagaggtacttggtgtccatcaaggtgcagtcagccggaatgacaagcgaggtagtcgaagacagcacaattacaatgatagacagaccacccccccccccaccccatatacgcgtcaatgagaaggacgtgctcatcagtaagtcaagcattaattttactgtcaattgtagctggttcagtgatacgaatggtgctgttaagtattttaccgtggtggtcagagaggcagacggtagtgatgagcttaagcccgaacagcagcaccccctgccaagttatctcgagtaccgtcacaacgcgtccatccgagtgtaccaaaccaactacttcgcctctaagtgcgctgagaatccaaactcaaatagcaaatcttttaatataaaacttggtgccgagatggaatcactggggggtaaatgcgatcctacccaacagaagttttgtgacgggcctctcaaaccgcacactgcctaccgcatcagtatcagggcttttacacagctttttgacgaggatcttaaggaatttacaaagcctctgtacagtgatactttcttctctttgcccatcactacagaaagcgagcctctgttcggcgccatagaaggtgtgtccgcaggcctttttctgatcggcatgcttgtggctgtcgtggcgttgttaatctgcaggcagaaagtttctcatggccgtgagcggccttctgccagactttctatccgcagagatagacctctgagcgtgcatctgaatctggggcagaaaggaaaccgtaagacctcctgtccaatcaagatcaatcagttcgagggccattttatgaagttacaggcagactccaattatttactgtccaaggaatacgaagaacttaaagacgtgggcaggaatcagagttgcgatatcgccctcctaccggagaatagaggcaagaacagatacaataacattctgccttatgacgccacccgcgtaaagctgtctaacgttgatgacgacccctgtagcgattatatcaacgcttcttacatcccaggaaataactttaggcgcgaatacattgtcacccagggccctttgcccggtactaaagacgacttctggaagatggtgtgggaacagaacgtccacaacatcgtgatggtgacccagtgcgtcgagaaggggcgcgtaaaatgtgaccattattggccagcagaccaggattctctgtattacggagacttaattctccagatgctgtcggagagcgtgctcccggagtggactattagggagtttaaaatctgtggagaggagcagctggacgcccatcggctgatcaggcactttcactataccgtatggcctgaccacggcgtgcccgagaccactcaatctctaatccaattcgtgcggacagtgcgtgattatatcaacaggtctcccggcgccgggccgacggtcgtgcattgctctgccggggtaggccggaccgggacttttatcgcactggatcggatcctgcagcagcttgactcgaaggattcggtggacatatacggcgccgtccacgacctaagactccatcgggtgcatatggtccaaacggaatgtcaatacgtgtatctgcaccagtgcgtgagagatgtgttgagagcgagaaaactgcggagcgaacaagaaaaccccctctttccgatttatgaaaacgtgaaccccgagtaccaccgcgatccggtgtatagtcgccactag

SEQ ID NO: 130913 - DNA, 621 bp, Artificial Sequence
  Description of Artificial Sequence: Synthetic coding sequence
atggctctaccttgcaccctaggattaggcatgctgctggccctgcccggggcactaggcagtggcggctctgctgaggattcggtgggcagttcttctgtgacagtagttctacttctgctgctgctcctcctactcgctacaggtctcgcccttgcctggagacgtctttctcgtgatagtggtgggtattaccatccagctcgcttaggcgccgccctctgggggaggaccagaaggttgctgtgggcatcgccccctggccgttggctgcaggctcgcgctgaactgggaagcacggataacgacctggagagacaggaagatgaacaggataccgactacgatcacgtggccgatggcggtctgcaagcagatcctggggagggcgagcagcaatgcggggaggcctcctctccggagcaggtccctgttagggcagaggaagcccgcgactcagacaccgagggagatctcgtgctgggctctccagggcctgcctctgccggcggctccgccgaagccctcctgtctgacctgcatgcattcgctgggagcgcggcgtgggacgacagcgcacgcgccgccggaggccaagggctgcatgtgaccgccctgtag

SEQ ID NO: 130914 - DNA, 4152 bp, Artificial Sequence
  Description of Artificial Sequence: Synthetic coding sequence
atggtacacgtcgcgaggctcttgctgcttctcctaacctttttcttgcgaactgacgctgagacgccccccagatttacacgaacaccagtcgaccagactggggtgagcggcggagtggcctcttttatttgtcaggctactggggacccccgcccaaagattgtgtggaataagaaaggcaagaaagttagtaaccagaggtttgaagtgattgaatttgacgacggatctggtagtgtcttacggattcagccactgcggacacccagagatgaagctatttatgagtgcgtggcctcaaacaacgtgggagagattagcgtgtctactcggcttacggtcctgagagaagaccaaatccctagagggtttcccacaattgatatgggtccacaactgaaggtggttgagcggaccagaactgcaaccatgctgtgcgccgcatcagggaacccagaccccgaaatcacctggtttaaggactttctgcccgttgatacttccaataataacgggcgcataaaacagctgcgctctgtcagtgtttgcgcaacttatcacactggtgccctgcagattgaacagtccgaggagtctgatcagggaaaatacgaatgcgtggccacgaactctgcagggacacggtacagcgcgcctgccaacctatatgtgagagtgaaccggaaggtaaggagagtccctccgcggttcagcataccacccacaaaccacgagataatgccgggcggatcggtcaacataacatgcgtggctgtcggatctcccatgccctatgttaagtggatgctgggggcagaggacttgacacccgaagacgatatgcccatcggtcgcaatgtcctcgaactcaacgatgtgcggcaatcggccaactacacttgtgttgctatgagcaccctgggggtaattgaagccatcgctcagatcactgtcaaagcacttcccaagccgccaggcacgcccgttgtaacagagagcaccgcgacttccattaccctgacttgggactcaggaaatcccgagccagtgtcctactatatcatacagcacaagccaaaaaattccgaggagctctacaaggagattgacggagttgctaccacccgctattctgttgccggattgtctccgtattctgactacgagttccgggtggtggctgtgaacaacatcggccggggccctccaagcgagccagtcctgactcagaccagtgaacaggccccatcttcagcccccagggatgtacaggccagaatgctaagttctacaaccattctcgtccagtggaaagagcccgaagagcccaatggccagatacagggatatcgagtttactatactatggatccaacccagcatgtcaacaactggatgaaacacaacgtggcggattcgcaaatcactaccattgggaacctggtgcctcaaaaaacttatagcgtcaaggtcctggcattcacaagcattggggacggcccgctgagcagcgatatccaggtgattacccaaacgggagtgcccggccagccactgaactttaaggccgagccagaatccgagacctctatcctcttatcctggactccgccgagaagcgacacaattgcaaattatgagctggtttacaaggacggagaacacggggaggagcaaaggatcacaattgagccgggaacttcttataggcttcagggattgaagcccaatagcctctattacttccgcctcgcagcgcgcagtccccagggccttggagcctctacagccgagatatctgccaggacaatgcagtcttccaagggttactacatcattattgtgcctctgaaaaagtcccgcggcaagttcattaaaccatgggaatctccagacgagatggagctcgacgaattgcttaaggagattagccgcaagcggcggagcattcgttatggaagggaggttgaactgaagccctacattgctgcacatttcgatgtgctgcctaccgagtttactcttggggatgataagcactatggagggtttacgaataagcaattgcagtccggccaggaatacgtgtttttcgtgcttgctgtgatggaacatgctgagtcaaagatgtatgccactagtccttacagcgacccagtagtgagcatggacctcgatccacaacccatcacagacgaagaggaaggcttgatctgggtcgtcggccccgtgctcgcagtcgtttttattatttgcattgtcattgccatcctgctctacaaacggaagagggccgaaagtgacagtcgcaaatcgagcatccccaacaataaagagatcccatcccatcatccaacggatccagtggaacttcgacggcttaatttccaaacacctgggatggcaagtcaccctcccatccctattctcgagctcgctgatcacatagagcggctcaaagctaatgacaatctcaaattttctcaagagtatgagagcattgatccgggacaacagttcacttgggaacacagtaacctggaggtgaacaagcctaaaaatcggtacgcaaatgtaatagcgtatgaccactcgcgagtgctgctgtccgctatcgagggcattccagggagtgactacgtcaacgccaattatattgacgggtacaggaaacagaacgcctacattgctacacagggcagcctcccagagactttcggcgatttttggcggatgatctgggaacagagaagcgccacagttgtcatgatgaccaagttggaggaaagaagtagggtgaaatgcgaccagtattggccgagccggggtaccgagacacacggcctggtgcaagtgaccctgctggacactgtcgagctggccacctactgtgttcgcacatttgctctgtacaagaacgggtcctccgaaaaacgggaggtgagacagtttcaattcaccgcgtggccagaccacggtgtacccgaacacccaactcctttcctggccttcctcagacgagtgaaaacttgcaacccaccagatgccggtccaatggtggtgcactgtagcgcgggcgtgggccggactggatgttttatagtcattgatgccatgcttgaaagaatcaaacatgagaagacggtcgacatttacggtcacgtaacactcatgcgagcacagcggaactacatggttcagacagaggaccaatatatattcatacacgatgccctgctggaggctgtcacctgcggcaatacagaggttcccgcacgaaatttatatgcctatattcagaagctcacacagattgagacaggcgagaatgtgacaggcatggagctggagtttaaaaggctggcttcctcaaaggcacacactagcaggtttatcagtgcaaacctgccttgcaacaaattcaaaaaccgcctagtgaacatcatgccatatgagtctaccagggtatgcctgcagccaatcagaggagtggagggaagtgactacatcaacgcgtctttcatcgatggttatcgacagcagaaggcatatatagctactcaagggccattagcggagactaccgaagatttctggcggatgctgtgggagcacaattccaccatagtggtcatgttaacaaaactacgagagatggggagagagaagtgtcaccagtattggcccgccgagaggtcggcacggtaccaatactttgttgtagacccaatggctgagtataatatgccacagtatattctacgagagttcaaggtgaccgacgcccgagacggacagagccgtaccgtgcggcagttccagttcacagactggccggagcaaggcgtgccaaagagcggagagggattcatcgattttattggtcaggtgcacaagacaaaagagcaattcggtcaggatggacctatatccgtgcattgctccgccggcgtgggtcgtacaggtgtgtttattacgttgagtatcgtgctcgagcgcatgagatatgagggcgtcgtagacatatttcaaaccgttaaaatgcttcggacccagcgtcctgccatggtacagaccgaagatcagtatcagttcagttatcgggcggccctagagtacctggggtccttcgatcactatgcaacctag

SEQ ID NO: 130915 - DNA, 4521 bp, Artificial Sequence
  Description of Artificial Sequence: Synthetic coding sequence
atggtccatgtggcacgcctgctgctccttctactcacttttttcctgaggaccgatgctgagacacccccaaggttcacgaggaccccagtcgaccagaccggagtgagcggaggcgttgccagctttatctgccaagccaccggcgatcctagacccaagatagtctggaacaagaaaggaaagaaagtgtccaaccagagatttgaggtgattgagtttgatgacggttcaggctcagtgctgcgaatacagcctctccggaccccccgagatgaggcaatatacgaatgcgtggccagtaacaacgtcggggagattagcgtgtcaaccaggttaaccgtgctaagagaggatcagatcccaaggggatttcctactatcgacatgggtccccagctcaaggtagtggagagaactaggaccgctactatgctgtgtgccgcttccggcaatcccgatccagaaatcacctggttcaaagacttcctcccagtggacacgagcaataacaacggtcggataaagcagttaaggagcgaatccataggcggaacccccatccgcggcgcgctccaaattgagcagagtgaggaaagtgaccaggggaaatatgaatgcgtggctacgaacagcgcaggcactcggtacagcgcacctgcgaatttatatgtgcgggaactgcgcgaggtgcgcagagttccacctagattcagtatccctcccactaaccatgaaataatgcctggaggtagtgtcaacatcacatgtgtcgctgtgggcagtcctatgccatatgtcaaatggatgttgggagcggaggatctgactcccgaagatgacatgccgatcggacgcaacgtcttggagctcaacgacgtaaggcagtccgctaattacacttgtgtcgctatgagcactcttggcgtgatagaggccatagctcagataaccgtgaaggctctgcccaagccccccggcacacccgtagtgactgagtcaactgcgacatcaattactctgacctgggattcaggtaaccctgaacctgtgtcatattacatcatccagcataagccaaagaactctgaggaactctacaaggagatagacggggtggctaccacaagatatagcgtcgcgggcttgtctccatacagcgattacgaattcagggtagtggcagttaataacataggcagaggacccccttctgagcctgtgctaacacagaccagcgagcaggcaccttcttccgccccccgggatgtgcaggcaagaatgctcagctccaccacaattctcgttcagtggaaggagcctgaggagccaaacggacagattcagggctaccgagtatactacaccatggaccctacccagcacgtaaataactggatgaaacacaatgtggcagacagccaaataacaacaattggcaatctggtacctcagaaaacgtacagcgtaaaggtcttggcttttaccagcatcggcgacggtcctcttagctctgatatccaggtgatcacacagacgggagtccccggccagcctctgaattttaaagcagagcccgagagcgaaacctccatcctgctttcatggaccccccctcggtctgacacaatcgctaactatgagctcgtatataaagatggcgagcacggagaggagcagaggattaccatcgaacctggaacgtcctatcggcttcaagggctcaagccaaactccctctattactttcgccttgccgcccggtcaccacaaggactgggcgcctctacagccgaaatctccgccagaacaatgcagtctatgttcgccaaaaacttccatgtgaaggccgtgatgaaaaccagcgttctcctgtcatgggaaattcccgagaactacaattccgccatgcccttcaagatcctatacgatgatggtaagatggtggaagaggtggacgggcgggcaacacagaaactcattgtgaatctcaaacccgagaagtcctacagttttgtgttgacaaatagaggtaacagtgcaggcggacttcagcaccgcgtaacggccaagaccgcaccagatgtgttgcgcactaagcccgcatttattggaaaaaccaatctggacggaatgataaccgtccagctccctgaggtacccgctaacgagaatatcaagggatactacattatcatcgttccactcaagaaatctcggggcaaattcatcaagccatgggagtcaccagacgagatggagctcgacgaactgctgaaggagatatccaggaagaggagaagtattcgatacggcagggaggtggaactcaagccatacatcgcggcacactttgatgtcctgcctactgaattcacgctgggcgatgacaagcactatggcggatttacgaacaaacagttacaatcaggacaggagtatgtattcttcgtcctcgccgtcatggaacacgccgagagcaagatgtatgctaccagcccatactccgatcccgtagtctccatggacctcgaccctcaaccgatcaccgacgaggaggagggactgatttgggtggtcggacctgtgctggccgtggtgttcattatttgtatcgtgattgccatattgctgtacaaatcctccaaaccagatcgaaagcgagcggaatccgatagccggaagagctcaatccctaacaacaaagagataccgtcccatcatcccactgatcctgtagaactcagacgcttgaacttccagaccccaggtatggctagtcacccccccatccctattctggagctggccgaccatatcgagcgtcttaaggctaacgacaatcttaagttttcccaggagtacgagtccatcgacccaggacaacagttcacctgggagcatagcaatctggaagtcaacaagccgaagaacaggtatgccaatgtaatcgcatacgatcactcgagggtcctcttatcagccatagaaggtatccctggttcagattacgtgaacgccaattacatcgatgggtaccggaaacagaatgcatacatcgccacacaaggaagcttaccagaaacgttcggcgacttctggagaatgatctgggaacagcggagtgcaaccgtggttatgatgaccaagctagaggagaggagtagagttaagtgcgatcaatattggccatcgagaggcacagagactcacggtctcgtgcaagttaccctcctggacacggttgagctggccacctactgtgtgagaacatttgctttatacaagaatggtagcagcgagaaacgcgaagtgaggcagtttcagtttactgcctggccggatcacggggtgcctgagcatccaaccccgttcttggcgtttctcagaagagttaaaacctgtaatccgcctgacgccggcccaatggttgtgcactgttctgcaggggtaggccgaaccggttgtttcatcgtgatagatgccatgctcgaacggattaagcacgagaaaacagtggatatctatggtcacgtcaccctgatgcgcgctcaaaggaattacatggtccagacagaggatcagtacatctttatccacgacgcactgctagaagcagtgacctgcggaaacacggaagttccagctcgtaatttgtatgcttacatccaaaagctgacacagatagagaccggtgaaaatgtcacaggaatggaactggaattcaagaggctggcttccagcaaagcccatacctcccgattcatcagtgccaacctgccttgtaataaattcaaaaatagacttgtgaacattatgccttatgagagcactagagtctgccttcagcctatccgaggtgtcgaggggagtgactatatcaatgcaagctttatagacggttataggcagcagaaggcctacatagcaacacagggtccactggccgaaacaaccgaggacttctggcggatgctgtgggagcacaacagtacaatcgtggtaatgcttactaagttgcgagaaatgggccgagaaaagtgccaccagtactggcccgcagagcgaagcgcccgttaccagtactttgtggtcgatccaatggccgagtataacatgccccagtatatcctacgagaatttaaggttactgatgccagggacggacaatcacggacagtgcggcagtttcaatttactgactggcccgagcaaggcgtgcctaaatccggagagggctttatcgattttatcggacaggttcataagactaaggaacagtttggacaagatggccccatcagcgtgcattgcagcgctggggtggggaggacaggggtgttcattacgctcagcatcgtgttggaacgcatgaggtacgaaggagtggtcgacatttttcagaccgtgaagatgctaagaactcagcgccccgctatggtgcagacagaagaccagtaccagttttcttaccgcgctgccttggaatatctgggtagctttgaccattatgctacctag

SEQ ID NO: 130916 - DNA, 5739 bp, Artificial Sequence
  Description of Artificial Sequence: Synthetic coding sequence
atggtgcatgtagcccggctcctgctgctcctgcttacattttttctacgaacagatgccgaaacaccccccaggtttacccggacaccagtggaccaaaccggtgtttcaggtggagtggcttccttcatctgccaggcgaccggcgatcctcgccccaagattgtctggaataagaaaggcaagaaagtgtccaatcaacgcttcgaggtaattgaattcgacgatggctctggctccgtcctccgcatccagcctctcaggacgccccgagacgaggctatatatgaatgtgttgcctccaacaacgtgggcgaaatttcagtgtctacccgattgacagtgctgcgggaggaccagatccctcgcgggttccccaccattgatatgggcccacaacttaaggtggtggaacgcacgcgcaccgctactatgctgtgtgcagcatccgggaaccccgacccagaaataacttggttcaaagacttcttacctgtagatacttccaataacaacggccgcattaaacaactgaggagcgagtctatcggggggacccctattaggggagcccttcagatagagcaatcagaagaaagcgatcagggaaagtatgaatgcgtggccaccaatagtgctgggacccggtactcggccccagctaacctctatgtacgcgaattacgggaggtgaggcgagtgcctccccggttttccattcccccaactaaccatgagattatgcctggcgggtcagtgaacattacttgcgtggcagtcgggtcaccaatgccttatgtgaaatggatgctcggcgccgaagacctgactcccgaggacgacatgccgataggtaggaacgttcttgagctgaatgatgtccgtcagtctgctaattacacttgtgttgcaatgagtacgctgggcgtgatagaggcaattgcccagatcacagtaaaagctctgccgaagcccccgggaaccccggtcgtgaccgagtccactgccaccagcatcaccctcacatgggacagtggcaatcccgagcctgtgtcatactacatcattcagcataagcctaaaaactctgaggagctctacaaagaaatcgatggggtggctaccacacggtatagcgtcgcaggcctgtcgccatactccgattacgagtttagggtggttgctgtgaacaacataggcagagggccccccagcgaacccgtgctcactcagacatccgagcaagccccttcctctgcaccacgcgacgtgcaggccaggatgctgagttccactactattctggtccagtggaaagaaccggaagagcccaacggccagatccagggttatcgcgtctactacaccatggatccaacccagcacgttaacaattggatgaaacacaacgtggcagactcccagataaccacaatcgggaatctagtgccacagaagacgtactcggtaaaagtcctcgccttcaccagcatcggtgatggccctctgagtagcgatatccaggtgatcactcaaaccggcgtgcctgggcaacctctaaattttaaagccgaaccggagtctgaaacctccatcctcctgagttggacgccccctcggtctgacacaattgccaactacgagctggtttacaaagacggggagcacggagaagaacaacgaattaccattgagccggggacctcttatcgcctccagggactcaagcccaactcgctttactattttcgcctcgctgctcgctccccccagggtctcggtgcttcaacagcagagatatccgcacggacaatgcaaagtaaaccttcagcccctcctcaagatatctcatgtacttcccctagctctaccagtatcttggtgtcatggcagccccccccagtggagaaacagaacggcattattactgaatatagcattaagtatacagccgtcgacggtgaagatgacaaacctcacgaaattctcggcatccctagtgataccactaaatatttattggagcagcttgaaaagtggactgagtatcgcattaccgttaccgctcataccgacgtcggaccaggccccgaaagtctttccgttttgatacgaacaaacgaggatgtcccctcaggtccgcctcggaaagtcgaggtagaggctgtgaactctacatctgtcaaggtcagctggcgctctccggtcccaaacaagcagcacgggcagatacgcgggtatcaggtccactatgtgcggatggaaaacggcgaacctaaaggccagccgatgctgaaggacgtcatgcttgcggatgcccagtgggaattcgacgacactactgaacatgatatgatcatttccgggctacagcccgaaaccagctatagccttaccgtgactgcttacaccactaaaggtgacggcgccaggagtaagccaaagttggtatctactactggagcagtgccaggtaagccccgtctggtcatcaaccatacccagatgaatacagcactgatccagtggcacccgcccgtggacacctttgggcccctccaaggctatcggctgaaatttggtcggaaggacatggaaccgttaacaaccctggaattctcagaaaaagaggaccattttaccgccaccgacattcataaaggcgcatcttacgttttccgactctctgcacggaacaaagtgggctttggcgaggaaatggtcaaggaaatttccataccagaggaggtgcccactggctttcctcagaatctgcatagtgagggaaccacttctacgtccgtacagctctcatggcaacctcccgtgctggccgagagaaatggcatcatcaccaagtatactctcctatatagggacatcaatatccccctgctcccgatggagcaacttatcgtccctgcggatacaacgatgactctgacaggtctaaagccggataccacatacgatgtaaaagtgcgggcccatacctcaaagggaccgggtccttattcgccaagcgtccagttccgcaccctcccggtggatcaggtgtttgctaagaattttcacgtcaaggccgtcatgaagacttcagtcctgctgagttgggagatcccagagaattataattccgccatgccctttaagatactgtacgatgatgggaagatggtggaggaggtggacggaagagccacacagaaactgatcgtcaacctcaaacctgagaagtcgtacagtttcgtcctgaccaaccgcgggaacagtgctggtgggctccagcatagagtgacagcaaagacagctccagacgtactccgaacaaaaccagcctttatcgggaaaacaaatttagacgggatgataacagtgcagctcccagaagtccctgcaaacgaaaatataaagggttattacattataatcgtcccgctcaagaagtcacgagggaaattcattaaaccatgggagtcgcccgacgagatggaactggatgagttgttaaaagagatctctagaaaaaggagatcgattaggtacggtcgggaagtagaactcaaaccctacatagctgcgcactttgacgtccttccaaccgaatttactctcggagacgacaaacactacggcggtttcacaaataagcaactgcagagtggacaggaatacgttttcttcgtgctggcggtcatggagcatgccgagagtaagatgtatgccacctccccgtactctgacccagtcgtctcaatggatcttgatccacagccaattaccgatgaggaagagggattgatttgggtagtcggtccggtgctggccgtggtatttataatctgcattgttatcgcgatcctgttgtataaacgcaaacgggcagagagcgactcgcggaagtcttcaatcccaaataacaaggagatcccctcacatcaccccactgatccagtggagttgagacgcctgaacttccaaacccctggcatggctagccacccgccaatccccatcctggaactggccgaccacatcgagcggctcaaagcgaacgataatcttaaattctcacaagaatatgagagcatcgatccaggacaacaattcacatgggaacattccaatctggaagtgaacaagcctaaaaacaggtatgccaatgtgatcgcctatgaccacagccgagtcctactttctgctattgaaggcatcccaggtagcgactacgtgaacgcgaattacatcgatgggtaccggaaacagaatgcctacatcgcaacccaaggtagcttgccagaaacgttcggcgatttctggcgcatgatttgggagcagcgttcagcaaccgtggtaatgatgactaaattggaggagaggtcccgtgtgaagtgcgatcaatattggcctagtaggggcaccgaaactcatggccttgtgcaggtgaccttgctggatacggtggaactcgccacttattgcgtcaggaccttcgcactttacaagaatgggagctccgagaagcgggaggtcagacagtttcagttcacagcatggccagaccatggagtgcctgaacaccccactccctttctggcattcctcagacgcgtgaaaacgtgtaatccacctgacgctggcccgatggtagttcattgcagcgcaggcgtgggcagaacaggatgctttatagttatagacgctatgctcgaacggatcaagcatgaaaaaacagtggacatttatggacacgttacgctgatgagagcacagcggaattacatggtgcagaccgaagaccaatacattttcatccatgacgcactgctagaggcagtgacttgtggcaatacagaagtgcccgctcgaaatttgtacgcttatattcagaaacttacccagatcgagacgggcgaaaatgttactggaatggagctggaatttaaacgactcgctagctcaaaagcccacacatcgagatttatctcagccaatctcccctgtaacaagttcaagaatcgccttgtgaatataatgccctatgaatccaccagggtctgcctgcagcccattcgaggggtggaggggtccgattatatcaacgcgtcattcattgatggctacagacaacagaaagcctatatcgccacgcagggtccgctcgccgaaactaccgaggacttctggcggatgctatgggagcacaattctaccatcgtggtgatgctgaccaaacttagagaaatgggacgcgaaaaatgccaccaatactggccagccgagcgctctgcccgttaccagtactttgtggtagacccgatggccgaatacaacatgcctcagtacatcttacgtgaatttaaagtgactgacgcaagagatggtcagtccaggaccgtgcgtcaattccaatttacagattggcccgaacagggggttccaaagagtggggagggcttcatcgattttattgggcaagtgcataaaaccaaggagcagttcggtcaggacgggccaatcagcgtccattgcagcgctggagttggcaggaccggagtgttcattactttatcaattgtgcttgaaaggatgaggtatgaaggcgtcgtcgacattttccagaccgtgaagatgctgaggactcaaagaccagctatggtccaaactgaggaccagtaccaattttcgtatcgagcagctctggaatatctgggatctttcgatcactacgccacatag

SEQ ID NO: 130917 - DNA, 5673 bp, Artificial Sequence
  Description of Artificial Sequence: Synthetic coding sequence
atggtccacgttgctaggctgctcctgctgctacttacgttcttcctcagaacagacgcagagacgccacctaggttcacaaggacgccggtggatcaaaccggggtttccggcggagtggcgagcttcatctgccaagccaccggcgatcctagacccaagatcgtctggaacaagaagggcaaaaaggtcagcaatcaaagatttgaagtgatcgagtttgatgatggctcagggtcagtgctgcgtatccagcctctgaggacaccccgcgacgaagccatatatgagtgtgtggcatccaataacgtgggcgaaattagcgtttcaacacgcctgacagtcttgcgtgaagaccagattccccgtggatttcctaccatcgacatgggaccccagctgaaggttgtagaacggacgaggacagccaccatgctgtgcgcagcttcaggcaatcccgaccccgagataacttggttcaaggatttcctgcctgtcgacacctctaacaataatggcagaatcaaacagctaaggtcaggagctctccagatcgagcagtccgaagaaagtgatcaaggcaagtacgagtgcgtggctacaaattccgccggcacacgatattctgccccagctaatctctacgtgagggtgaggagagtcccgccaagattctctatccctccaacaaaccatgaaataatgccaggtgggagtgtaaatattacatgcgtcgccgtgggatcgcctatgccttatgtgaaatggatgctaggcgccgaggatctgacacccgaggacgatatgcccatcgggaggaatgtcctggagctcaacgacgttcgacagagtgcgaactacacgtgtgtagccatgtcaaccctcggagtcatagaggcaatcgcccagataacagttaaagccttgcctaagccaccgggtacacccgtggttacagagagtacggccacaagcataacacttacctgggattccggtaaccccgagcccgtgtcctattacattattcagcataaaccaaagaattcggaggagctctataaggaaatcgatggggttgccacaaccagatattctgtggccggactgtcaccttactccgattatgagttccgcgttgttgccgtgaacaacatcgggcgaggtccacctagtgaaccggtgctaacacagacatcggagcaggccccgtcgtctgccccgcgtgatgtccaagctcggatgctgtccagtacaaccatcttggttcagtggaaggaacctgaggagccaaatggccaaatccaggggtacagggtctattacactatggacccaactcagcatgtgaacaattggatgaagcacaacgttgctgactcccagatcactaccataggcaatctagttccccaaaaaacgtactcggtgaaagtgctggccttcaccagcatcggagacggtccactgtcaagtgacattcaggttattacacagacgggcgtgcccggtcaaccactcaacttcaaggccgagccagagtcagaaacttccatcctattgtcctggacgccaccaaggagtgacaccatcgcaaactatgagctagtctacaaagacggagaacacggcgaggaacaacgtattactatcgagccgggtactagctatcgactccaggggcttaaaccgaatagtttatattactttaggcttgctgcaaggtcacctcaaggtcttggagctagtactgcggagatatctgcacggacaatgcagtctaagcccagcgcccccccccaagatatctcatgtaccagccctagcagcacctccattttagtgtcttggcagcctcctcctgtggagaaacaaaatggcataattaccgagtatagcatcaaatacactgccgttgacggagaggatgacaagccacatgaaattcttggaattccaagcgatactaccaaatatttactagagcagttggagaagtggactgaatataggatcactgtgaccgcacacaccgatgtaggccccgggccggagtccctgtcagtcctgattcgcaccaatgaggacgtcccgagtggccctcctcgtaaggtggaagtggaggccgtgaacagcacctccgtgaaggtgagctggagatcacccgtgcccaacaaacagcatggccagatcaggggatatcaagtgcactatgttcgcatggagaatggcgagccaaagggacagccaatgctgaaggacgttatgcttgccgacgcacaggacatgatcattagtggtctccagcctgagaccagctattcattaactgttaccgcatacaccactaagggcgatggtgctaggtcaaaacctaagctcgtttctacaactggagccgtgcccggcaagccacggctggttatcaatcacacacagatgaataccgcccttatccaatggcacccccctgttgatacctttggcccactgcagggttatcgactgaagtttggcaggaaagatatggaacctctgaccacactggagttcagtgaaaaggaggatcatttcacagccacggacatccataagggggcctcctacgtcttccggctgagtgctaggaacaaagttggatttggcgaagaaatggtgaaggaaatcagtatccccgaggaagttccaacaggattcccgcagaaccttcattcagaaggcactacctcaacgagtgtacaactttcctggcagcccccagtgcttgctgagcgaaacggtatcatcactaaatatactctgttgtacagggacattaatatcccactgcttccaatggagcaattgattgttcccgccgacacaacaatgacgcttactggcctgaagcccgacaccacatatgacgtcaaggtgagggctcacacatccaaaggccctggtccatacagtcctagcgtgcaattccgcacgctgcctgtggaccaagtctttgcaaagaattttcatgtaaaggcggtgatgaagacgtccgtgctactcagctgggagatccccgaaaactacaactctgctatgccattcaaaatcctgtacgatgatggcaagatggtggaggaagtagatgggcgagccacacagaagctgatcgtgaatctcaagccagaaaaatcctactccttcgtgttgacaaacaggggtaacagcgctggagggctccagcacagagtcacggccaagacagccccagatgttctgcgtaccaagcctgctttcatcgggaagaccaacttagacggaatgatcactgtccagttgcccgaggttcccgcaaacgagaatatcaagggctattacattattattgtgcccctgaaaaagagtaggggaaagttcatcaaaccatgggaatcgcctgacgagatggaacttgatgagctgctaaaagagatttcccggaagagaaggtccattcggtatggtagagaggtggaactaaagccatacatagcagcacactttgacgttttacctactgagtttaccctgggagacgacaaacattacggcggcttcaccaacaagcagctgcagtccggccaagagtatgtattcttcgtgctcgccgtgatggagcatgcagagtccaagatgtatgctacttccccctactctgacccagtagtttccatggatctcgacccccaacctataactgatgaagaggaaggactgatctgggtcgtaggacctgtactggccgtggtgttcatcatttgcattgtgatcgcaatcctgctgtataagaggaagcgcgccgaaagtgattcccgaaagagttctatacctaacaacaaagagatacccagccaccaccccacggatcctgtggaacttagacgcttgaatttccagacccccggcatggcctcccaccctccaatcccaatcctggagctcgcagaccatattgagcggttgaaagctaacgataacctgaaattcagtcaggagtacgagtccatagatcccggacagcagttcacctgggaacactccaatttggaggtgaacaagcccaagaaccggtacgctaacgtgatagcttacgatcacagtcgagtcctgctttctgcaatcgaaggcataccaggatctgattatgtcaatgccaactatatcgatggctatcgaaagcagaatgcctacatcgccacacagggctctctgccagaaacctttggagacttctggaggatgatttgggagcagaggtccgcaaccgtcgtaatgatgacaaaactagaggagcgatcccgggtaaagtgcgatcagtactggcctagcagggggacagagactcacggacttgttcaagtcacacttttagataccgttgaactcgctacctactgcgtgcgcacattcgctttgtacaagaatggctcttccgagaagagggaggtccggcagttccagttcacagcttggcctgaccatggtgtgccggagcacccaactccattcctggcattcctccggagggtcaaaacctgcaaccccccggatgccgggccaatggttgtacactgttccgccggtgtaggccgcacgggatgcttcattgtgattgatgcaatgcttgaacgaataaagcacgagaagaccgtcgacatatacggacacgtgacactgatgagggcacagcggaattacatggtccagaccgaagatcagtacattttcattcacgatgccctgcttgaggcggtcacatgtggcaataccgaagtgccggcgcgtaacctgtacgcgtacattcagaaactgactcagatcgaaacaggcgaaaacgttacaggtatggagctggaattcaagcgacttgcatcctccaaagcccataccagtcggttcatctccgccaacctcccctgcaataagtttaagaacaggctggtgaacattatgccgtacgagtcaacacgggtctgtctccaacctattcggggtgtggaggggtcagactatattaatgcgtctttcatcgatggttacagacagcaaaaggcttatattgccacacagggaccactcgcagagactacagaagatttttggaggatgctttgggaacataattctacaattgtcgtgatgttaactaagctacgtgagatgggccgagagaaatgccatcaatactggcccgcagaaaggtccgcccgctatcagtatttcgtcgttgaccccatggctgagtacaatatgccccaatacatcttgcgcgaattcaaagtgaccgatgctagagacggtcaatcaagaaccgtgagacaatttcagtttactgattggccagagcaaggcgtccccaaatccggtgaaggctttatcgatttcatcggacaagttcacaaaaccaaggagcagttcggacaggacggccctatcagcgttcattgttcagctggagttggccgcaccggagtgtttattactctcagtattgtcctggagagaatgcggtacgagggggtggtggatattttccaaacagtgaagatgcttcgaacacagcgccccgctatggtccagacggaggaccaatatcagttttcttatagggccgccttggagtacctaggctccttcgaccattatgctacatag

SEQ ID NO: 130918 - DNA, 5700 bp, Artificial Sequence
  Description of Artificial Sequence: Synthetic coding sequence
atggtgcatgtcgcaaggcttttgctcctgctgctaacattttttctccgcacagatgcagaaaccccaccaaggtttacgcgtaccccggtggaccaaacaggcgtgtcaggaggagtggcttcattcatctgtcaggctactggagaccctcgaccgaagatcgtctggaacaaaaaagggaagaaggtgagtaaccagcggtttgaggtcattgaatttgatgacgggagtggttccgtgctgagaatccaacctttgagaactccgagggacgaagcaatttacgagtgcgttgcttctaataacgtgggtgagatatcagtctctacccgccttacagtgctgcgggaagatcagattccccgaggttttccaactatcgacatggggccccagcttaaagtggtcgaaagaacaaggaccgccacaatgttgtgcgctgcaagtggaaacccagacccagagattacatggttcaaagatttcctgcccgtggatactagcaacaacaacggccgcataaagcagctacggtctggagcactccagattgaacaatctgaggaaagcgatcagggcaaatacgagtgtgtggccacgaactcggctggcactcggtatagcgctccagctaatctgtacgtgagagttcggcgtgtccctccacgcttttccattcctccaacaaaccatgagattatgccggggggcagcgtgaatattacgtgcgtggccgttggaagtcctatgccctatgtcaaatggatgttgggcgcagaagatctgacacctgaagacgatatgcccatcgggcggaacgtgctggagttaaatgacgttcgtcagagtgccaactacacgtgcgtcgccatgagcacactcggagtgatcgaagccattgcccagattactgtgaaagctttgcctaaacctccgggcacacccgttgtgacagagtctacagctactagcataactctgacttgggacagtggcaatccggaaccagtcagctattatatcatccagcacaagcccaagaactccgaagagctgtacaaagaaattgatggtgtggccacgactcgatattcagtggcaggcctcagcccctactccgattatgagttcagggtggttgccgtcaacaacataggccggggtccgccatctgaacccgtcctgacgcagaccagtgagcaggcaccatcttctgcgccgagagatgtacaagcacggatgctgtcatccacgaccatactagtgcaatggaaggaaccagaagaacccaacggacagatacaaggttatcgggtgtactacactatggatcccacccaacacgtcaacaattggatgaaacacaacgtggcagacagtcaaattaccaccatagggaatctcgttccccaaaaaacgtattcagtcaaagtgcttgcattcacatccatcggagacggacctttgagtagcgacattcaggtgatcacccagactggtgtgccaggccaacctctcaactttaaggcagaacccgagagcgagacttccatcctgctgtcatggactcctccacgttctgacaccatcgcaaactatgagctagtttacaaagacggcgagcacggggaggagcagaggattaccatcgaaccgggaacttcttacaggctgcaggggctgaaaccaaattcattgtattactttcgactcgccgcacgttctccacagggcctcggcgccagtaccgcggaaataagcgcaagaaccatgcagtcgaaaccttctgctccccctcaggacatctcttgcactagcccctcatccacaagcatccttgtttcctggcaaccgccccctgtggaaaagcaaaatgggataataaccgagtactctattaagtatacagccgttgatggtgaagatgataaaccccacgagatattaggaattccctccgatacaactaaatacctgctggaacagctcgagaaatggacggagtatcgtataactgtcacggctcacaccgatgtgggcccagggccagagtcattgtccgtgctaatccgtacaaatgaagatgtcccaagcggacctcccaggaaagtggaggtcgaggcggttaactctacatccgtgaaagtttcctggagatccccggtccctaacaaacagcacggccagatccgggggtaccaagttcattacgtccgcatggaaaacggcgaaccaaagggacagccaatgttgaaagacgtaatgttggctgatgcccagtgggaattcgacgacacaacagagcacgatatgatcatctctgggctgcagccggagacttcctacagcctgacggtgaccgcatatacaactaagggggatggcgcacgctcaaagcctaaactggtgagtactactggggctgtccctgggaaaccacgcctggtgatcaaccacacacagatgaatacagcactaattcaatggcatccccctgttgacacatttggcccattgcagggctacaggctgaaattcggcagaaaagacatggaaccacttactactttagagttctccgagaaggaggatcacttcacggccacggatatccacaagggcgcctcctacgtgttcaggttgtctgccagaaacaaagtcggatttggcgaggagatggtgaaagaaatatcgattcccgaagaggttcccaccggcttccctcagaatctgcattcagaggggacaacaagcaccagtgtgcagctcagttggcagcctcctgtcctggcagaacgcaacgggattatcaccaagtacacattgctttatcgagacatcaacatccctctgctacccatggagcagctgatagtacctgcagatactacaatgacactgactggcttgaagcctgatacaacttacgatgtaaaggttagggctcacacaagtaaaggcccaggcccctacagcccgtcagtgcagtttcgaacactgcctgtggaccaggtgttcgcaaagaacttccatgtgaaggctgttatgaagacaagtgtactgctgtcgtgggagattcctgagaattataactccgcaatgccctttaagatactctatgatgacggcaaaatggttgaagaggttgacggtcgggctacccagaagctcatagttaatcttaaacctgagaagagctattcattcgtcctgacgaacaggggaaatagtgcaggtggcttacaacaccgggtgaccgcaaagacagcacccgatgtcctgcggaccaaacctgccttcattgggaaaacaaacctggacggcatgatcacagttcagctgcctgaagtgccagcaaacgaaaatataaaggggtactatatcatcattgttcctctaaagaaatcacggggcaaattcattaaaccatgggaaagccccgatgagatggaactggacgaacttctgaaggagatatccaggaagaggaggagcatcaggtacggtcgggaagtcgaacttaaaccctatatagccgcacatttcgacgtgctccctactgagtttacactcggggatgacaagcactacggaggcttcactaacaagcagctccagagtggacaggagtacgtgttcttcgtgttggcggtgatggaacacgcagaaagcaaaatgtatgcaacgtccccgtacagtgatccggtggtgtcaatggatctcgacccacagcccattacggacgaagaggagggtcttatatgggtggttggcccagtccttgcggtggtattcatcatctgcattgtcattgccatattactttataaacggaagagggcagaatccgattctcgcaagtcaagtatcccgaataacaaggagattcccagtcaccatccaacagacccagtcgagctgagaagactgaactttcagactccagggatggcttcccacccgccaatccccatcttggagctggccgatcacatcgagaggctgaaagccaacgataatttgaagttttctcaggaatacgaaagcattgaccccggccagcagttcacatgggagcactcaaaccttgaagtgaacaagcccaaaaatcgatacgcaaatgtcattgcttatgatcacagcagagtgttactgagcgcaattgagggcatacctgggagcgattatgtgaatgccaattatattgacgggtatcgtaaacaaaatgcctacatagctacccagggctcattacccgagacctttggagatttctggaggatgatctgggagcagagaagtgctacagtggtgatgatgaccaagctggaggaaagatctcgagttaaatgtgatcaatactggccaagtagaggtacagagactcacgggctggttcaggtcacacttctggatactgtcgaactggctacctattgtgtgagaaccttcgctctgtacaaaaatggctctagtgagaaacgagaggtaaggcagttccagttcaccgcctggcctgatcacggcgtgcctgaacatccaactcctttcctggcatttctaagaagagtgaaaacctgtaatccacctgacgctggcccgatggtggtgcactgctctgccggagtaggccggacaggctgttttatcgtgattgatgccatgctggaaaggattaagcacgagaagacagtcgatatttatggccacgtgacgcttatgcgggcacaaaggaattacatggttcagaccgaggatcaatacatcttcattcatgatgctctcttggaggccgtgacttgcggcaatacagaagtgccagctcgcaacctttatgcctatatccagaagcttacgcaaatcgagacaggtgagaatgtgacaggcatggagctcgagttcaaaaggctcgcttcctctaaagctcacacaagcaggtttatctcggccaatttgccatgcaacaaatttaagaacaggcttgtgaatatcatgccctatgaatctaccagggtgtgcctgcaaccaatacgcggggtcgaaggatccgactacattaatgcttcttttattgacgggtatcggcagcagaaagcgtatattgccacgcaggggcccctggcagagactacagaggatttttggcgtatgctgtgggaacacaactccacaattgtggttatgctgaccaaattgcgggagatggggcgcgagaaatgccaccagtattggcctgctgagcggagcgctagataccagtattttgtggtggatcctatggcagagtacaatatgccccagtatatcctgcgcgagtttaaagttacagatgcacgagatggccagagccggacagtccgccaatttcagttcacggattggcccgagcaaggcgtccctaagagcggagagggcttcattgacttcatcgggcaggtgcacaagaccaaggagcagtttggacaggatggacctatctcagtccattgctccgccggggtggggagaacgggggtttttataactttgagcatcgtgctggagcgaatgcggtacgagggagtggtagacattttccagactgtgaagatgctgagaacacagcggcctgccatggtgcagactgaggatcagtaccagttcagctaccgcgccgctctggagtatctcggatccttcgaccattatgcgacctag

SEQ ID NO: 130919 - DNA, 5739 bp, Artificial Sequence
  Description of Artificial Sequence: Synthetic coding sequence
atggtccacgtggcccgtctcctcctgctgctgctaacgtttttccttaggacagacgctgagacgcctccaaggttcaccagaactcctgtagaccaaaccggggtttctggcggggttgcgagcttcatctgtcaggcgacaggcgacccacgacctaagatcgtatggaataagaagggaaagaaagtttcaaatcaacgattcgaagtcattgagttcgacgacggatctggatccgtgctgcgcatccaacctctgaggaccccacgagacgaggccatctatgaatgtgtggcttccaataacgtgggagagattagcgtctcaactagactgactgtgcttcgggaggatcagattccaaggggattccccacaatagacatgggccctcagctgaaagtggtggagcgtacacgtacagccaccatgctctgtgcagcctccggaaatccagacccggagatcacgtggttcaaggattttctccccgtggacactagcaacaacaacggcaggatcaaacagctgagaagtgagagtataggcggtacacccattagaggtgctctacaaatcgagcagagtgaagagtccgatcagggcaagtacgaatgtgtcgctaccaattccgccggtacacgctacagcgcacccgccaacctgtacgtccgagagcttcgcgaagtgaggagagtaccaccgagattctctatacccccaactaatcatgagataatgcccgggggctccgtgaacataacttgtgtggccgtaggctctccgatgccatatgttaaatggatgttgggggctgaagatctgacccccgaggatgatatgccaattggtcggaacgttctggagcttaacgatgtacgtcaatccgccaattacacctgcgtcgcaatgtcgaccttgggtgtcattgaagccatagcccaaattacagtgaaggctctgcccaagcccccagggaccccagtggtgaccgaaagcacagccaccagtatcaccctgacatgggattctggaaaccccgaacctgtttcctattatattatccagcataaaccaaaaaactctgaagagctgtacaaggagatagatggcgtcgcaacaacacggtatagcgttgccggcctttcaccttactctgactatgagttccgggtggtcgcggtgaataatattggaagggggcctccatctgagcccgtgctgacacagacatccgagcaggctccgagcagtgcgcctcgagacgtccaggcacgcatgctctcttctaccaccatcctggtacagtggaaagaacctgaagagccgaatggacagattcagggatatagggtctattacaccatggatccaactcagcacgtgaacaactggatgaagcataacgttgctgactctcagataacaacaatcggcaacctcgtgcctcagaagacttactccgtgaaagtgcttgcattcacatctataggagatggtccgctgtcttccgatatccaagtgatcacccaaacaggggttccagggcaacctctgaactttaaggccgaacccgaaagcgaaacgtcaatcttactgtcatggactccccctcggtccgataccatcgccaattacgaactggtgtataaagatggagagcatggcgaggagcagcgtattacaatagagccgggaacatcatatcggctacaggggttgaaacctaacagcttatattacttccggttggcagcccggtctcctcaaggactgggcgcatcgacagccgagatcagcgcgcggaccatgcagtccaaacccagcgcccccccccaggatatttcctgcacctcacctagcagcacaagcatcctcgtgagttggcaaccaccccccgttgaaaagcagaacggaataattacggaatactctattaaatatacagccgtagatggagaagacgataaaccccacgagatcctcggcatcccaagcgacaccaccaaatacctcctggaacaactcgagaagtggaccgagtatcgtattaccgtgacagcccatacagacgttggtccaggcccagaatcactatctgttcttataagaaccaacgaggatgttccaagcgggccgccccggaaagttgaggttgaagcggtgaattcaacatctgtcaaagtgagctggagatcgcccgtcccaaacaaacagcatggccagatcagaggctatcaggtgcattacgtgcgaatggagaatggtgagcctaaagggcaacccatgctgaaagatgtgatgttagccgatgctcagtgggagttcgatgacaccacagagcacgacatgatcatcagcggcctccaacccgaaacttcttatagccttactgtgaccgcttatactacgaagggagatggcgccaggtccaagcctaaactggtgtctacaactggcgccgtcccaggtaagcccagacttgttattaatcacactcagatgaacactgcactcattcagtggcatccacctgtggataccttcgggcccctccaggggtaccgcctaaaatttggaagaaaagacatggagccactcaccaccctggagttttccgagaaggaggatcatttcacagccaccgacattcacaagggcgcctcttatgtttttagactgtcagcgcggaacaaagtggggttcggggaagagatggtgaaggagatatccatccccgaggaggttcctaccggcttccctcagaaccttcactcagaggggacaaccagcactagcgtacagctgtcttggcaaccgcctgtgttggctgaacgtaacggtattataacaaagtacaccctcctttatcgcgatattaatatccctctactccccatggagcaattgatcgtcccagcggacacgactatgaccctgaccggactgaagcccgacacgacttatgacgtaaaagttcgggcgcacaccagtaagggcccagggccatactcaccatcagtgcaattcagaacgttacctgttgaccaggtctttgccaaaaattttcatgtcaaggccgtaatgaagaccagtgtgcttctctcttgggagatcccggaaaattacaacagcgcaatgccctttaagatcctctacgatgatggtaaaatggtggaagaggtggatggcagggccacccaaaaactcattgttaacttgaaacctgagaaatcttacagcttcgtgttaacaaataggggaaactctgcgggggggctgcagcatcgggttaccgccaagaccgcgccagatgtacttcgcacaaagccagctttcatcggaaagaccaaccttgacggtatgatcactgttcagctccccgaggtaccagcgaacgaaaatatcaagggctactatattatcattgtgcccctaaagaagagtagaggtaagtttataaaaccttgggaatctccagatgagatggaactggacgaactacttaaggagatctctaggaaacgacggagcattcggtacgggcgagaggtggagctgaaaccttacatagccgcacactttgatgtgcttccgacggagttcacacttggagatgataaacattacggcggtttcaccaataaacagttgcagtccgggcaggaatacgtgtttttcgtgctcgctgtaatggaacatgctgagtcaaagatgtacgcgacctcgccttacagcgacccagtggtatcgatggatctagatccacagcccatcaccgacgaagaagagggactgatatgggtagtcggaccggtgctcgccgtggtattcataatctgtattgtcatcgccatccttttatacaagcgaaagagagcagaaagtgactcacgcaaatcatcaatccctaacaataaagaaattccttcacaccatccaaccgaccccgtggagcttaggagactgaattttcaaacacccggcatggcttcacatccacctatacccatcttggaattagccgatcatatcgaaaggctgaaagcaaatgataatctgaaatttagtcaggagtatgagagcattgacccaggccaacagttcacatgggagcacagcaatctggaggtcaacaagcccaagaatagatacgccaacgtgattgcttatgatcattcacgcgtgcttctgagcgctatagagggaataccgggttctgattacgtcaacgcaaactatatcgacggctacaggaaacagaatgcttatatagcaacacaaggaagtctacctgaaacatttggggatttttggagaatgatctgggagcaaaggagcgctactgtggtcatgatgactaagctggaggagcggtctcgagttaagtgtgatcagtattggcccagccgcggcaccgagacacacggcctagtccaggttacgttgttggacacagtggaattggctacttactgcgtccggacattcgctttgtacaaaaacggctctagcgagaaacgcgaggttaggcaattccagtttacagcttggccagatcacggggtccctgaacaccccacccccttcctcgcttttctgaggcgagttaagacctgtaaccctcccgatgcagggccaatggtcgtgcattgctccgcaggagtgggaagaacgggttgttttatagtcatcgatgcaatgctcgagagaataaagcacgaaaagacagtagacatttacgggcatgtcaccctgatgcgagcccagagaaactacatggtgcagaccgaggatcagtatatattcatccatgatgcactcctcgaagcagtgacctgtgggaatacagaagtgcccgcccgaaacctgtatgcctatatccagaaacttacacagatagagacaggagaaaatgtgacaggtatggagctggaattcaagcgcctggcctcgtccaaagcacatacttcacggttcatcagtgcgaatctcccatgcaacaagtttaagaatcgcctcgttaatattatgccctacgaatcgacgcgcgtgtgcttacagccaattcgcggcgtggaggggtcagactatatcaacgctagcttcatcgatggatacagacagcagaaggcatatatcgccacccagggcccattggctgagaccactgaagacttttggaggatgctgtgggaacataacagcactattgtggtaatgctgaccaaattgcgcgaaatggggcgggagaagtgccaccaatattggcctgctgagagatcagccaggtaccagtactttgtggtcgatcctatggccgagtacaatatgcctcaatacatcttaagagaatttaaagtcacagacgccagagatggccagtctcgcaccgtgcggcagtttcagtttaccgattggccagagcaaggcgtgccaaaatcaggcgaaggatttattgatttcattggccaggtgcacaaaaccaaagagcaattcggtcaggatggccctatctctgtgcattgctcagcaggagttggccggacaggagttttcataacattgtcaatagtgttagagcgaatgagatatgagggagtggttgatatcttccagactgtgaagatgctcaggacacagcggccggcaatggttcagactgaggatcagtatcaattcagttatcgcgctgccctagaatatctcggcagcttcgatcactacgccacatag

SEQ ID NO: 130920 - DNA, 4509 bp, Artificial Sequence
  Description of Artificial Sequence: Synthetic coding sequence
atggtgcatgtggctaggcttctccttcttttactcacgttcttcttgagaactgacgctgaaacaccaccacgctttaccagaacacccgtggatcaaactggagtgtctggaggagtcgccagttttatctgccaggccacgggtgatccgcggcccaagatcgtgtggaacaagaaggggaagaaggtgagcaatcaaaggtttgaggtcatcgaattcgacgatggttccggttcagttttacgaatccaacctctccggacaccgagggacgaggcgatttacgagtgcgttgccagtaacaacgtcggtgaaatctcagtttcaacaagattgacagtgctgagggaagaccagatccccaggggttttcctactatcgatatgggaccccaactgaaagtggtggaacgaactaggacagctacaatgttgtgtgctgcatcaggcaatcctgaccctgagatcacatggtttaaggacttcctgccagtggatacatctaacaataatggcaggatcaaacagctccgttccggtgggactcccattagaggcgccctgcagatcgagcaaagtgaagagagtgaccagggcaagtacgagtgcgtggccaccaacagcgcagggactcgatatagcgccccggctaacctgtatgtgcgcgagctcagggaggtgagaagagtcccgcctcggttcagcattcctccgaccaatcacgagattatgcctggcggatccgtcaacattacgtgcgttgccgtgggctccccaatgccttacgtgaagtggatgctgggagccgaagacctaaccccagaggacgatatgcccatcggacgcaatgtcctcgagttgaacgatgttaggcagtccgccaattatacctgtgtcgctatgtccacccttggcgtgattgaggccatcgcccagattaccgtgaaggccctcccaaaaccccctggcactcctgtggtcacagaatccaccgcaacatctatcactctcacctgggattcaggcaatcccgaacccgtatcctattacataatacagcataaacctaagaactctgaggagctctataaggagatagatggggtcgcaacaacaaggtactccgtggccggtctgtccccttacagcgattacgaattccgagtcgtggcagtgaacaacattgggcggggtcccccttctgagcctgtcctcacccagacgtcagagcaggccccgtcttccgctccacgggacgtgcaggccaggatgctgtcttctaccacaattctagtgcagtggaaggaacccgaggaaccaaatggacaaatccagggttacagggtctactacactatggaccccacgcagcacgttaataattggatgaagcacaacgtcgcagactcccagattaccactatcggcaacctcgtgccgcagaagacttacagtgtgaaggtgcttgcatttacaagcattggagacgggccgctgagctctgatattcaggtaataacgcagaccggtgtccctgggcaacctctcaacttcaaggctgagccagagagcgaaacgagtatcctgctcagctggacccctccgagatctgatacaattgccaattacgagctggtgtataaagacggcgaacatggcgaagaacaacgtataacaatcgaacctgggacttcttacaggttgcagggcctcaagcctaattcactctattactttagattagccgcgagatcacctcaaggcctgggtgcctctacggccgagatctccgccaggacaatgcagagcatgttcgcaaaaaatttccatgtgaaagctgttatgaaaacgtctgttttgctctcttgggagatacctgagaattataatagcgcaatgccctttaaaattctctatgacgatggcaaaatggtggaggaagtggacggaagggccacccaaaaactcatcgttaaccttaaacctgaaaagtcttactcgttcgtgctcacgaacagagggaacagcgcaggaggactgcagcacagggtcactgcaaaaaccgcacccgacgtgctccggaccaagcccgcattcatcgggaagacaaacctagacgggatgatcaccgttcagcttccagaggtgcctgcaaacgaaaacattaaaggctattacattataattgttcccctgaagaagagtcgtgggaagttcatcaagccttgggagtcacctgatgagatggagctggatgaactactgaaggaaatctcaagaaagcggcgatccatcagatatggaagggaagtggagctgaagccgtatatcgccgcccattttgacgtcttgcccaccgaattcactctgggggatgacaagcactacgggggttttactaacaagcaactgcagagtggtcaagaatatgtattcttcgttctggccgtgatggagcatgcagaaagtaagatgtacgctaccagtccgtactccgatcctgtcgtgtcgatggacctggatccccaacctatcacggatgaggaagaaggcttgatctgggtggtcggtccagtcttggccgtggtgtttattatttgtatagtaattgctattctcctctataagtctaagcctgatcgcaagcgtgccgagtccgatagccgaaagagtagtatcccaaataacaaagaaatcccaagtcaccaccccacagaccctgttgaacttcgccggttgaatttccagactcccggcatggccagccacccgccaataccaatcctggaattggccgatcacattgaacggctgaaagccaacgacaacctcaagttttctcaagaatatgagagtattgaccctggccaacagtttacctgggaacattcaaacttggaagttaacaagcccaagaatcggtacgccaatgtgattgcctacgatcacagccgagtgctcctctcagccatcgagggcatccctggtagtgactatgtgaacgcaaactacattgacggatatagaaagcaaaacgcctacattgctacccagggatccctcccagagacctttggggatttttggcgcatgatctgggaacagcgatctgccacggtggtaatgatgaccaagttggaagagaggagccgcgtgaagtgcgaccagtattggcccagtcgcggcactgaaacacacggtctggtccaggtcactctgttggacacagtggagctcgctacttactgtgtccggacttttgcgctctataagaatgggagttctgagaaacgggaggtgagacagtttcaattcaccgcctggcctgaccatggggtgcccgagcacccaactccttttttggcctttctgcgaagagttaagacctgcaaccccccagacgccggacctatggtggtgcattgctctgccggcgtgggaaggacaggttgtttcattgtaattgacgcaatgctggagaggatcaagcatgaaaagacagtggacatctatgggcacgttacactcatgcgggcacagcggaattacatggtgcaaaccgaagaccagtatatttttattcacgatgccctgttggaggccgtgacatgtggaaatacggaggtgccggccaggaacctctatgcttatatccaaaagttaactcagatcgagacaggggaaaatgtaaccggtatggagctggagttcaagcgcctggccagcagtaaggctcacacatcccgattcatctccgctaatctgccttgtaacaagtttaagaaccggttagttaatattatgccgtatgaatccaccagagtttgtctccagcccatccgaggcgtggagggctccgattacattaatgcctcctttatcgacggataccggcagcagaaagcgtacatcgcaacacaaggcccgctggcagaaacgacagaagacttttggaggatgctctgggagcacaacagtacgattgtggtgatgctgaccaaactgagagagatgggacgcgaaaagtgtcaccaatactggcccgctgaacgttctgcacgttatcagtacttcgtggtggatcccatggctgagtacaatatgcctcagtacatcctgagggagtttaaagtgaccgacgctcgcgatggacaatctcgaactgtccgacagtttcagttcaccgactggccagagcagggcgtgccaaagagtggagaggggtttattgattttatcgggcaggtgcataaaacaaaggagcagttcggacaggacgggcccatttccgtacactgttcagccggcgtgggtcgaactggtgtgttcattacacttagtatagtcctggaaagaatgcgatatgaaggagttgtggatatctttcagacagtgaaaatgttacgaacgcagaggcctgccatggtccagacggaggatcagtatcagttctcgtatagggctgccctggaatatctggggtcttttgaccactacgcaacatag

SEQ ID NO: 130921 - DNA, 4518 bp, Artificial Sequence
  Description of Artificial Sequence: Synthetic coding sequence
atggttcatgtcgcacgactgctcctgctgctcctcaccttcttccttcgaactgatgctgaaacaccaccgagatttacaaggactcctgtcgaccagaccggtgtctccggtggggtcgcgtcttttatatgccaggccacgggcgatccaagaccaaagattgtgtggaacaaaaagggcaaaaaggtgtctaaccagaggtttgaagtgattgagtttgatgacggctccgggtcggtcctcaggatacagccgctcaggactccccgcgacgaggccatctacgaatgcgttgccagtaataacgtaggcgaaatcagtgtttccacacgtctcacagtcctgcgcgaggaccagattccacggggattccccacgatagacatggggccacaactaaaagttgttgaaaggactagaacagccacgatgctctgcgcggctagtggaaaccctgacccggagatcacgtggttcaaggactttctgccagtggatacatccaataataatggcagaattaaacagctgaggagcgtgagtattggcgctcttcagattgagcagagcgaagaaagtgaccagggcaagtacgagtgtgtcgccacgaactcagcggggacaagatatagtgctccggctaacctctacgttagagttagacgggtgcccccgcggttcagcattccgcccactaaccatgagatcatgccaggtgggagtgtgaacattacgtgtgtcgccgttgggagcccgatgccctacgtgaaatggatgcttggcgcagaagacctaactcctgaggacgatatgccaattggccggaatgtcttggagctgaacgatgtccgccaatccgctaactacacctgtgtggcaatgtctaccctgggagttatagaagccattgcacagatcacagtgaaggctttaccaaagccccccgggacaccggtcgtaaccgaatccaccgccacgtccataaccttgacttgggacagcgggaatccggaaccggtatcctattacattatacagcacaaaccgaagaattccgaggaactatacaaagagatcgatggagtggcgaccactcgctattccgttgcagggctaagtccttacagtgactacgaatttcgcgtcgtcgccgtgaataacatcggacgcggaccgccctctgagcccgtgctcacgcagacttctgaacaggcaccctctagtgcacctcgagacgtgcaggcgcggatgctgtcgtcaaccaccatacttgttcagtggaaggagcctgaagaacctaacgggcagattcagggctatcgcgtttactataccatggaccctacacagcacgtaaacaattggatgaaacacaatgtggcggacagccagatcaccacaataggcaatctggtgccccaaaaaacttattcagttaaggtcttggctttcacgtccatcggggacggacccctatcgagcgacattcaagtcatcacccaaactggcgttcctggacagcctttaaattttaaggcggaacccgagagcgagaccagtatccttctgtcctggactcctccgagaagtgacaccatagctaactacgaactggtgtacaaggacggcgaacatggagaggagcagcggatcacgatcgaaccgggtaccagttaccgcttgcaaggattgaagcctaatagcttgtattattttagactcgctgctagatcaccacagggcctgggagcatctacagcagaaatatctgcccggaccatgcagtccatgtttgccaaaaattttcatgtaaaggccgtcatgaaaacctcagtgctgttgagctgggaaatcccagagaattataactcggccatgccattcaagatcctctacgacgacggaaagatggtagaggaggtggatgggcgcgccactcaaaagctcatcgtgaatttaaagccagagaagtcatacagcttcgtgctcacaaaccgaggcaactctgccggcggcctgcagcacagggtcactgctaagacagcaccggacgtgctgagaacgaaacccgctttcataggcaaaaccaacctcgacggcatgatcaccgtccagctgccagaagtccccgcgaacgaaaatattaaaggctactatattatcatcgttcccctcaagaagtcgcgcggcaagtttatcaaaccctgggaaagtccagacgaaatggagctcgatgaactcctaaaggagataagtcggaagcgccgcagtatccggtatggaagggaggtggaactgaaaccttacatcgcagcccacttcgatgtgctccctaccgaattcacacttggggatgacaagcactacggcggcttcactaacaaacagcttcaatcgggccaggaatacgtctttttcgttctggccgtgatggagcacgccgaaagcaagatgtatgcaacctccccttacagtgacccagtggtgtctatggacctggatccccagcccatcactgacgaggaagagggcttaatctgggtggtgggcccagtgctggcagtggtgtttattatatgtatcgttatcgcaatccttctgtataaacgcaaaagggcggagagcgatagcagaaaaagctcaatcccaaacaacaaagaaatacccagtcaccaccccaccgatcccgtcgagctgagaagattgaattttcagaccccaggatctgatgactcggggtaccccggtaacctgcatagttcatctatggcatctcatcctcccatccccatcctcgagctggccgaccacattgagaggctgaaggcgaacgataacctgaaattctctcaagaatacgaaagcatcgacccaggccaacaatttacttgggaacacagcaatctagaggttaacaaacctaaaaatagatacgcgaacgtaattgcttacgaccattctcgggtgttgctgtctgctatcgaaggcattcctggatcagattatgtaaatgccaattatattgacgggtatcggaaacagaacgcgtatatcgctacacagggctccctgcctgaaacctttggagacttttggagaatgatctgggagcaaagatcagcaacagttgtgatgatgacaaagttggaggaacggagccgcgtgaagtgcgatcagtactggcccagcagaggcacggagacacatgggttggttcaagtgaccttgctggacacagtcgagctggctacctactgtgtgagaacatttgccttatacaaaaacgggtcaagtgaaaaaagagaagtacggcagttccagttcactgcgtggcctgaccacggagtccccgaacaccctaccccatttctcgctttcctgcgcagagtgaaaacttgcaaccctccggatgcgggaccaatggtcgtccattgctcagcaggtgtcggcagaactggctgtttcatcgtgatcgatgccatgctggaaaggatcaaacacgaaaaaaccgtggacatctatggccatgtgaccctcatgagggcccagaggaactatatggttcaaactgaggaccagtatatcttcatacatgacgccctgctcgaggccgttacatgcggtaacactgaggtgccagcacggaacctgtatgcatacatccagaaattgacacagatcgagactggggagaacgtgactggcatggagctggaatttaagaggctcgcctcctctaaggctcatacaagcaggttcatcagtgcgaatctcccatgtaacaagttcaaaaaccgactggtaaacatcatgccttacgagtctaccagggtgtgtctccagccaattcgaggcgtggaagggtcagattatataaatgcatccttcatcgacggctatcgccagcagaaggcttatatcgccactcagggacctttggcagaaacaaccgaagatttttggaggatgctgtgggaacataattctactatcgttgtcatgcttaccaaactccgtgagatgggccgggagaaatgccatcaatattggccggccgagcggtctgcacgctaccagtacttcgtcgtggatccgatggcagaatataatatgccccagtacatcttgcgcgaatttaaggtaaccgatgcaagggacggccagtccaggaccgtgagacagttccaatttaccgattggcccgaacagggagtccccaagtccggcgaaggctttattgactttattggccaggtccataagacaaaagagcagttcggacaagacggacccatttcagtgcattgttcggcaggagtgggccgaacaggcgtgttcatcaccctcagtatcgtgttggaacggatgaggtacgagggggttgtcgacattttccagacggtaaagatgttacggacacagagacccgctatggtgcaaaccgaggatcagtaccagttctcttaccgtgcagccctggaatatctgggaagcttcgatcattacgctacctag

SEQ ID NO: 130922 - DNA, 282 bp, Artificial Sequence
  Description of Artificial Sequence: Synthetic coding sequence
atggtgcacgtggcgcggctactgctcctgctcttgactttcttcctccgaacagatgctgagacccctccacggtttactagaacccccgtggatcagactggtgtctcaggtggcgttgcttccttcatttgtcaagccactggagaccctagacccaaaatcgtgtggaataagaaaggtaaaaaagtgagcaaccaaaggtttgaagttattgagtttgacgacggttccgggtctgtgctcaggatccagccactgagaactcccagagatgaatag

SEQ ID NO: 130923 - DNA, 4518 bp, Artificial Sequence
  Description of Artificial Sequence: Synthetic coding sequence
atggttcatgttgcacggctactgctgcttcttctgaccttcttccttaggactgatgccgaaacccctccgaggttcaccaggactcctgtggatcaaaccggagtctccgggggtgtcgcctccttcatttgccaggcaaccggcgatccacgcccaaagattgtatggaacaaaaagggcaaaaaagtgtcaaatcagagattcgaggtaattgagttcgatgatggttccgggagtgttctcagaattcagccgctgagaacaccacgagatgaggcgatatatgaatgcgtcgctagtaacaacgttggcgagatcagcgtcagcacacgactgaccgtgctgagggaagatcagattccacgcggctttcccacgattgacatgggaccacagttgaaagtggtggagcgaacacgtacggccacgatgttgtgtgccgcgtccggcaatccggaccccgagataacctggtttaaggatttcctgcctgttgacacatccaataataatggccggatcaaacagctgcgaagcgagtcaatcggggggacccctattcgtggcgcattacagatcgaacagtcagaggagtcggaccagggtaagtacgaatgcgtggccaccaattctgcaggcacccgttatagcgccccagcgaacctgtatgtccgcgaactcagagaggtgaggcgcgttcctccccgtttttcaattcctcccacgaaccacgaaatcatgcctgggggaagcgtgaatatcacctgcgtcgccgttggcagtcccatgccatatgtgaaatggatgctgggtgctgaagatttaacacctgaggatgatatgcctattgggaggaacgttctggaactcaacgatgtccggcagagcgctaattatacctgtgtagccatgtctaccctcggcgtgatcgaggccatagcccagatcacagtgaaagccctccccaaaccaccagggacccccgtggttactgaatctacagccacgagtatcactctgacatgggacagcggcaatcctgagccagtgagctattatattattcagcacaaacccaagaattcagaggaactgtacaaggaaatcgatggcgtggccacaaccaggtatagtgttgcaggactctccccgtattcagactacgaatttcgggtggtggcagtaaataatatcggcagaggtcccccctcagagcctgtgctgacacagacctccgagcaggcgccttccagtgctccacgcgatgtgcaggctcgaatgctgtcttcaacgacaattttagtgcagtggaaggaacctgaggaaccaaatggccagatccagggctatcgtgtctattatacgatggaccctacccagcacgtgaataactggatgaagcacaacgtcgccgatagtcaaatcactacaatcggaaatctcgtcccccaaaagacctatagcgtcaaagtgttggcatttacctctatcggcgacgggcccttgtctagtgacatccaagtgattacccaaaccggggtacccgggcaaccgctgaatttcaaggccgaacctgagtcagaaactagcattctgctcagttggactccacctagatcagataccatcgcaaattacgaactggtctataaagatggcgagcatggcgaagagcagaggattacaattgagcccgggacatcgtatcgcctccagggactgaaaccaaacagcctgtattacttccgtctggctgcgcggagtccccagggcctgggggctagcacggccgagatttccgctagaaccatgcagagcatgtttgcaaaaaatttccacgtgaaggcagtgatgaagacctccgtgcttttgagctgggaaattccggagaactataactctgctatgccgttcaagattctgtacgatgatgggaagatggtagaggaagtggatggtagagcaacccagaaactaattgtcaacctcaagcctgagaaaagctacagtttcgtccttaccaacagaggcaacagcgctgggggcctccagcaccgtgtcacggcgaagacagctccggatgtgctccggacgaaaccggccttcatcgggaagactaatctggatggcatgataaccgtgcagctgcctgaggttcctgccaatgagaatattaaaggctattacatcataatcgttccactgaagaaatctcgcggcaaattcataaagccctgggagagtccagacgaaatggagcttgacgaactgctgaaggagatttcacgaaaacggaggtcaatcaggtatggaagggaagtagagttaaagccttatattgcagcccattttgatgtgctccccaccgaattcacactaggcgacgacaaacattacgggggattcacgaataagcagctccaatccggccaggagtacgtcttcttcgtcctggcggtcatggaacatgccgaatccaagatgtacgctacttctccctacagcgacccagttgtcagcatggatctggacccccagcccatcaccgacgaagaagaaggcctgatctgggtggtcgggccggtgttagcagtcgtgtttataatttgtatcgtaattgcgattctgctgtacaagagtaagcccgaccggaagagggctgagtcagatagccgcaagagttctattccgaacaataaagagatcccttcgcaccaccctaccgaccctgtagagctcaggcggctgaatttccagacccctggaatggcaagccaccctccaatccccatactcgaattggccgaccacatcgaacgtctcaaggctaatgataatctcaagttctcacaggaatatgaaagcattgatcctggtcaacagttcacatgggaacattcaaacctagaggtgaacaaacccaaaaaccggtatgcaaacgtgatcgcgtacgatcatagcagggttctcctgtccgcgattgaaggcattcccggatctgactacgtaaacgccaactatattgacggctacagaaagcaaaacgcatacattgcgacacagggctctttgcccgagacatttggtgatttctggagaatgatctgggaacagcgctccgctacagtggtcatgatgacgaagctcgaggaacgcagtagagtgaaatgcgaccagtactggccaagcagaggaactgaaacccacggacttgtgcaggtgaccctgctggatacagttgaactagccacctactgtgttagaaccttcgcactctataaaaacggttcctccgagaaaagagaggttaggcagtttcagttcaccgcttggcctgatcatggcgtgcctgagcaccccactcccttccttgcatttctccgccgagtgaagacgtgtaatcctcctgacgcgggtcccatggtggtccattgttctgccggcgtggggcgcactggatgcttcattgtcatcgatgcaatgttggaaaggatcaaacacgaaaagacagtggatatttacggccacgttacccttatgagggcccagcgcaattacatggtgcagactgaggaccagtatatttttattcacgacgctctgctcgaagccgtgacctgcggaaataccgaagtccctgcacgaaatctgtacgcatatatccagaaactcactcagatcgaaactggcgaaaacgtcactggaatggaactcgagtttaaaaggctggcttcaagcaaagcacacacatctcgcttcatttcagcaaacctgccatgtaataaatttaaaaaccgcctagtgaatattatgccatacgaatccactagggtgtgccttcagccgatcaggggtgtggaaggtagtgactacattaacgcgtcgttcattgatggctatcggcagcagaaggcttatattgcaactcaggggcctctcgccgaaacaactgaggatttctggaggatgctgtgggagcacaattcaacgattgtggtgatgttgactaaactccgcgaaatgggccgagagaagtgtcatcagtactggcccgccgagcggtccgctcgctatcagtactttgtcgtagatccgatggcggagtacaacatgccccagtatatcttgagagagttcaaagtgacggatgcgagagacggtcaatctcgaacagtccgccaatttcagttcacagattggcccgagcaaggcgtgccaaagtctggcgagggatttattgatttcattggccaggtccataagaccaaagaacagtttggccaggatggccccatcagtgtccactgctctgccggcgtagggagaacgggcgtctttattacactaagcatcgtccttgagcggatgaggtacgagggcgtggtagacatctttcagaccgtcaagatgctgcgcacacagcggccggccatggtgcagaccgaagaccaataccagttctcataccgggccgcgcttgaatacctgggaagcttcgatcactatgccacctag

SEQ ID NO: 130924 - DNA, 4509 bp, Artificial Sequence
  Description of Artificial Sequence: Synthetic coding sequence
atggtccacgtggcgaggctgctgctgctgctgctcaccttcttcctgagaacggatgccgaaacaccccctcgtttcacgcgcactcccgttgatcagaccggagtgtccggcggggttgcatcttttatctgtcaggcaacaggagaccctaggccaaagattgtatggaacaaaaaaggcaagaaggtaagcaaccagagattcgaagtgatcgagttcgacgatgggagcggcagtgttctcaggattcagcccctgcgtacccctcgggatgaggcaatctatgaatgcgtggcttccaacaatgtcggcgaaatctctgtctcaactagacttaccgtgctgagggaggatcaaatacctcgaggattccctacaatcgacatgggcccccagctcaaagtcgtggagagaacgagaacagccacgatgctgtgcgccgccagcggcaatccggaccctgaaattacctggttcaaggactttctgcctgtcgatacaagcaataataacggaaggatcaagcaactgcgctcggggcgtgtgttccacacaggcgccctgcagatcgagcaatccgaggagtccgatcaaggaaagtacgaatgcgtcgctactaattctgccggcacccgctattcagcccccgctaacctttatgtgagagtcaatcggaaagttagacgcgtgcctcccaggttctctataccccctacaaatcacgagatcatgcccggaggctcagtgaatattacatgtgtcgcggtggggtctccgatgccatacgtcaagtggatgctaggtgctgaggatctgacaccagaggatgatatgccaattgggagaaatgtgctggagctgaatgacgtcagacagtcagctaattatacctgcgtcgcaatgtctacactcggtgtaattgaggcaatcgcccagataaccgtgaaggcgttaccgaaacctccaggcactcctgttgtcaccgagtctacagctacttctattaccttgacctgggactctggtaatcctgagcctgtgagttactacattatccagcataaaccaaagaactcagaagaactttacaaagagatcgacggggtggccacaacacgatattctgtcgctggcctgagcccctactccgattacgagtttcgggtggtggccgtgaacaacatcggtaggggcccccccagcgagcccgtcctaacacagacatccgagcaggccccctcttctgcaccgcgcgatgtgcaggcccgcatgctctcatcgacaacaatcctggtccagtggaaagagccagaggagcctaatgggcagatacaaggctatcgggtgtactacacaatggaccccacccaacacgtcaataactggatgaagcataatgttgcagatagtcagataacaaccataggcaacctggtcccacagaaaacatactctgttaaagtactggcattcaccagtataggagatgggcccttgtctagcgatattcaggtgatcacgcaaacaggagtgccaggacaaccacttaactttaaggccgaacccgagagcgaaacatctatcttgctttcctggaccccccccagatctgataccatagcaaattacgagctcgtgtataaggacggtgagcacggcgaagaacaaagaattaccattgagccgggaacctcctaccgcctgcagggcctgaagcccaattccctctactatttccggctcgctgctcgatcgccccaaggtctgggggcctccaccgccgagatcagtgcgcgcacaatgcagagtatgttcgccaaaaatttccatgtgaaggctgttatgaagacgagtgtgctcctgtcatgggagattccagagaactacaatagcgccatgcccttcaaaatcttatatgacgatggtaagatggtagaagaagtcgacggacgggccacacagaaactgatagtgaatcttaagccagagaagtcgtactcatttgtgctgaccaatcggggcaattccgcgggtggcttgcagcaccgcgtgacggccaagacggcacctgacgtgctgagaacgaagccagctttcatcggtaaaaccaacctggatggcatgatcacggtccaactgcccgaggtccctgcgaatgaaaacattaaaggatactacattataatagtgcccctcaaaaaatcaagaggcaagtttatcaagccctgggagtctccggatgagatggaattagacgagctgttgaaggagatcagccggaagcgccgctccatccgctatgggcgggaagtcgaactcaagccatatattgctgctcacttcgatgtactgcccactgagtttaccctcggggacgacaagcactatggagggtttaccaataaacaactgcagtcaggccaagaatacgtgttcttcgtattggccgtcatggaacacgcagaatctaagatgtacgccacaagcccatactctgatccagtggtaagcatggacttagacccgcaacctataacagatgaagaagaaggactgatatgggtggtgggtccagttctggccgtggttttcattatatgtattgtgatagcgattctcctctacaaaaggaaaccatatagaaaaagagcggagtccgactcccggaagtcatcaatccctaataataaggagatccctagtcaccacccgaccgatccagtagagcttaggaggttaaatttccagacacctggcatggcttcacatcctcccattccaattctggaactggccgaccatattgagaggttaaaagctaacgataacttgaagttttcacaggagtatgagagtatagatcctggacagcagtttacatgggaacatagtaacctcgaggtgaacaaaccaaagaataggtacgccaatgtgattgcgtacgatcactctcgggtgctgttgtccgccatcgagggaatcccaggctctgactatgtcaatgcaaattacattgatggataccgcaaacagaacgcctacatcgccacgcagggctcactccctgaaacctttggtgatttttggcgcatgatatgggaacaaaggtctgcaacggttgtaatgatgacaaaacttgaagagagaagtagggttaagtgcgaccaatactggccatcacgcggcaccgaaacccacggtctggtgcaagtgaccctgctggatactgtagagcttgctacctactgcgtaagaacattcgcactgtacaaaaatggctcaagcgagaagcgagaggttaggcagttccaatttaccgcttggcctgatcacggagtgcccgaacacccaacaccattcctcgcattccttcgccgtgtgaaaacttgcaacccacccgatgcggggccgatggttgttcactgttcggctggggttggacggacaggctgctttatcgtcattgacgccatgctggaaagaatcaaacatgaaaaaacagtagacatatatggccacgtgacactgatgagagcccagcgcaactacatggtccagacagaggatcaatacatcttcatacacgacgccctgctcgaggccgtcacctgtgggaacacagaggtgcccgcccgcaacctctatgcctacatccagaaactgactcagatcgaaactggggaaaacgtgacaggcatggagctggaatttaagcgcctcgccagttctaaggctcatacaagcaggtttatcagtgcgaacttgccttgtaataagtttaagaacaggctggttaacatcatgccatacgagagcaccagagtgtgccttcaaccaatccgtggcgtcgagggaagcgactatatcaatgcttccttcattgatgggtatcgccagcagaaggcatacatcgcgacgcaggggccattggccgagaccacagaagacttctggcggatgctatgggagcataatagcaccattgtggtcatgcttaccaaactgagggaaatgggaagggagaagtgccatcagtattggccagcagaaagaagcgcccggtatcagtactttgtggtggacccaatggccgagtacaacatgccccagtatatactacgggagttcaaagtgacagacgcaagggatggacagtccagaaccgttaggcagtttcagttcacagactggccagagcagggcgtccctaaatccggagaaggcttcattgacttcatcgggcaggtgcacaagacaaaagagcaatttggacaggatggacctatttctgtccactgcagcgccggggtggggaggacaggcgtctttattacattgagtatagtgctggagcgcatgcgatatgaaggtgtggtggatatttttcagacagtcaaaatgctccgtacccagcgacctgctatggtccaaactgaggaccagtaccagttcagctatcgcgccgcactcgagtatttaggatcttttgaccactatgccacttag

SEQ ID NO: 130925 - DNA, 5739 bp, Artificial Sequence
  Description of Artificial Sequence: Synthetic coding sequence
atggtgcatgtggccagattactactcttactgctaacattcttcctacggactgatgctgagacacccccccgttttaccagaaccccagtggatcaaacgggggtgtctggtggggtggcttcgttcatctgccaggccaccggggacccacgccccaaaatcgtctggaacaagaagggtaaaaaggtctcgaaccagcgttttgaggtgatcgagttcgatgatggctccggatccgtcctgagaatccagccgctcaggacaccccgcgacgaagctatttatgaatgtgttgcatccaataacgttggtgagatttcggtgagcacacgtctgactgtgttacgcgaggaccagattccgagaggctttcccacaatcgacatgggacctcaactgaaggttgtggaacgcacacggaccgctactatgttatgtgccgcctcaggcaaccccgatccagaaatcacttggttcaaggatttcttaccagtggacaccagcaacaataatggacgaattaagcagctgcgctccgagagtataggcggaacccccattcgcggcgcgctgcagatcgaacagagcgaagagtctgaccaaggaaagtacgagtgtgttgctacaaattcagccggaacgaggtattccgctcccgctaacctgtatgtgcgcgaactgagagaggtgcggcgggtgccgcctaggttttccatcccccctacaaaccatgagatcatgcctggtgggagcgttaacatcacttgtgtggctgtgggatcccctatgccttacgtgaaatggatgcttggggccgaggatcttacacccgaggatgacatgccaatcggccgcaatgttctcgagttgaacgatgtgcggcagtcggcaaactacacctgcgtcgccatgagcacactgggtgttattgaggcaatagcccagatcaccgttaaagccctgccaaaaccgccaggtactcccgtcgtcactgaatcaaccgcaactagtatcaccctgacctgggactccggcaaccccgagcccgtatcctattatatcatacaacacaaacccaagaatagcgaggagctgtacaaggaaattgacggtgtggcaaccacccgctattcagtcgccgggctgtccccctattctgactatgagtttcgggttgtggcagtgaacaatatcggcagagggcctcctagcgaacccgtgctgacacagacaagcgaacaggccccatcctccgctccgagagatgtgcaggcgcgcatgcttagcagcacaaccattttggtgcagtggaaagagcctgaagagccgaatggacaaatccagggatacagagtttactacaccatggaccctacgcagcatgtgaacaactggatgaaacacaatgttgcggactcgcagattactaccatcgggaatctcgtgcctcagaagacatatagcgtaaaagttcttgcatttacatccataggagatggccccctcagttcagacattcaggttatcacccaaacaggggtccctggacagcctctaaacttcaaggccgaaccagagagcgagactagcatcttgctatcgtggacacctccacgcagtgatacaattgccaattatgaactcgtatataaagatggcgaacacggcgaagaacagagaattacaatcgagcctggtacatcatataggctgcaggggctcaaacctaatagcctgtactactttcgccttgcagccaggtcacctcagggcctgggcgcctcaaccgccgagatcagcgctagaacaatgcaaagtaaaccctccgccccaccacaggacatttcttgcacatcaccttcttccactagtatcttagtttcgtggcagcctccccctgttgaaaaacagaatggaatcatcactgaatattctattaagtacaccgctgttgatggcgaggacgataagccacacgaaatcttggggatccctagtgataccactaaatatttacttgaacaactcgaaaagtggaccgaatatcgaatcaccgtcaccgcccatactgatgtcggacccggaccggagtccttatcagttctgattcgaaccaacgaagacgtgcccagtgggccaccgagaaaggtcgaagtggaggcagtgaattccacaagcgtcaaagtctcttggcggagtccagtgccaaacaaacaacacggacagattcgcggctaccaggtgcactacgtccgtatggaaaacggagagccaaagggccagcctatgcttaaagatgtgatgctggctgatgcccaatgggagtttgacgatacaactgaacacgatatgatcattagtggtctccagccggagacttcttattctctgaccgtgactgcatataccactaaaggtgatggagcccgttctaagcctaaactcgtcagtactacgggcgccgtacccggtaagcccagacttgttattaaccacactcagatgaacaccgctctgattcagtggcaccccccagtggacaccttcgggccattgcagggctatagactgaagtttggaagaaaagatatggagcctcttactacactggaattctctgagaaggaggaccatttcaccgccactgatatccataagggcgcctcatacgtcttccgactttcagcccgcaataaggtcggttttggggaagagatggttaaagagatctcaatacctgaagaagttcccactggattcccccaaaatctgcattcagaagggacaacttccacctccgtgcagctgagttggcagcctccagttctcgccgagaggaatggaatcatcaccaaatatactttgctctaccgcgatattaacatccctctcctgcccatggagcagctgatagtaccagcagatactaccatgactctgactggcctgaaaccagataccacctatgacgtgaaggtgagagctcatacctctaagggaccaggtccctactcaccaagtgtgcaattccggacgctgcccgtggatcaggtgtttgcaaaaaactttcacgtcaaagctgtgatgaaaaccagcgtcctgctctcgtgggagatcccggaaaattacaactccgcaatgccatttaagattctgtatgacgatggcaaaatggtagaagaggtcgacggccgggcaacccagaaactgattgtcaatctgaaacccgagaaaagctattcatttgttctaacgaaccgcggtaactccgccggaggtcttcagcaccgcgttactgctaagaccgctccggacgtgctgcgtaccaaaccggcgttcatcggcaagacaaaccttgacggaatgattacagtgcagctcccagaggtcccagctaatgaaaatatcaaaggatattacatcattattgtgcccctgaaaaagtctcgagggaagtttatcaagccctgggaatcacctgatgagatggagctggatgaacttctcaaggaaatttctcgcaaaagacggtccatacgctacggcagagaggttgagctgaaaccctacattgccgcccacttcgatgtgctgccaactgagtttactctgggggacgacaagcactatggaggtttcaccaacaaacaactgcagtccggacaggaatacgttttctttgtcttagccgtcatggaacatgccgagagcaagatgtatgccactagtccgtactcagaccctgttgttagtatggatctggacccacagccaatcaccgacgaagaggagggactaatctgggtcgtgggccccgtcttggccgtggtcttcattatctgcattgtgattgccatcctgttatacaagaggaagcgcgccgaatcggactcaagaaaatctagcatccccaacaataaggaaattccctcacatcatccaaccgacccagtcgaattgagacggcttaactttcagacacctggtatggcttctcacccaccgatcccgattctcgaacttgccgaccacattgagcggctgaaagccaacgacaatctgaaattcagccaagagtacgaatcaatcgatcctgggcagcaatttacctgggaacactcgaatcttgaagttaataaaccaaagaaccggtacgcaaatgtgattgcctacgatcactctcgagttctcctaagtgcaatcgaaggcattcccggctccgattatgtgaacgccaactatatcgatggctatcgcaaacaaaacgcatacattgcaacccagggaagccttcctgaaacgttcggagacttttggcggatgatttgggaacagaggagcgccacagtggtgatgatgacaaagctagaagagaggtcacgcgtcaagtgtgaccagtattggcccagccggggcacagaaacccacggattggtacaagtgactctgctggacacagtggagctcgcaacctactgtgttagaacgtttgctctctataagaacggctccagtgaaaagagggaggtgagacagttccagttcacagcctggcctgaccacggtgtgccggagcatcctacaccctttcttgcctttctgcggagggtcaagacttgcaaccctcctgacgctgggcccatggtggtgcactgcagcgccggcgtcggcagaaccgggtgtttcattgtgatcgatgccatgctagaaaggattaaacatgagaagaccgtagatatttatggacacgtcacattgatgcgagcacagcgcaactacatggttcagactgaggatcaatacatcttcatacacgatgccctgctggaggctgtcacctgcggaaacactgaagtaccagccaggaatctgtacgcctatattcagaaactgacacagattgagaccggagagaatgtcactggtatggaactggagtttaaacgcttggcgtcctctaaggcacacacgtctagattcatatccgcaaatctgccgtgcaataaattcaaaaataggcttgtgaacattatgccatatgaatctacccgtgtttgccttcagcccatcagaggcgtggagggaagtgactatatcaatgcgtcttttattgatgggtatcggcagcagaaggcatacattgccacccaggggcctttggccgaaaccacggaagacttctggaggatgctttgggaacacaattctaccattgtggtcatgcttacaaagctgcgtgagatggggagagaaaagtgtcaccaatactggcctgcagaacggagcgcccgctaccaatacttcgtcgtggacccaatggccgaatataacatgccccagtacatcctgagagagtttaaagttaccgatgcgcgggacggacagtctaggacagtccgccagttccaattcaccgattggcccgagcagggagtacccaagtctggggaggggttcattgatttcatcggtcaagtgcataagactaaagagcaatttggccaagacgggcccatctctgttcattgcagtgccggcgtgggtagaacaggtgtgttcattaccctgtccatcgtcctcgaaagaatgagatatgaaggcgtggtggacatctttcagacagtcaagatgttaaggactcagagaccagcgatggtccagacagaggaccagtaccaattctcctatcgtgcagcgctggagtacctgggctctttcgatcattacgcaacgtag

SEQ ID NO: 130926 - DNA, 2103 bp, Artificial Sequence
  Description of Artificial Sequence: Synthetic coding sequence
atggaaccactctgcccacttctgctcgtaggctttagtttacccctggctcgcgccctgcgtggaaacgaaactaccgctgatagcaatgaaacaacaacaacaagtgggccgcctgaccctggtgctagccagcctctactggcctggctcctattgccactgctattgctcttactggtcctactgcttgccgcctattttttcaggttccggaaacaaaggaaagctgtggtctccacctccgataaaaagatgcccaatggcatactagaagagcaggagcagcagagggtgatgctgctgtcccgtagccccagtggtcccaagaagtattttcccattcccgtggaacacctagaagaggagatccgaattcggtccgccgatgattgcaaacagtttcgagaggaatttaactctctcccatcaggtcacatccaaggcacttttgaattggccaacaaagaagaaaatagagaaaagaacaggtatcctaacatcctgccaaacgatcatagcagagtgattctttcccaactcgatggcattccctgcagtgattatattaatgcctcctatatcgatggctataaggaaaaaaacaagttcatcgcggctcagggaccaaagcaggagaccgtgaacgacttctggcgcatggtgtgggagcagaaatccgctaccatagtaatgcttacaaacttgaaagagcgcaaagaagagaagtgtcaccagtattggcctgatcagggatgttggacctacgggaatattagagtctgcgtcgaggactgtgtcgtgttagtggactacacgatccggaaattctgcattcaaccacagctgccagatgggtgtaaagctcccaggctcgtatcacagttgcattttacgagctggccagattttggggtcccctttacacctatagggatgctgaaattcctgaagaaagtgaaaaccctcaaccctgtgcacgcgggccccattgtagtgcattgcagtgctggggtgggacggaccgggactttcattgtgattgacgcgatgatggcaatgatgcatgcagagcaaaaagtggacgtcttcgaatttgtcagtcgcatccgtaatcagcggcctcagatggttcagacggatatgcaatacacctttatatatcaagccctcttggagtactacttatatggggacactgagcttgatgtgagttcgctcgaaaagcacctgcagaccatgcacggaaccactacccactttgacaaaatcggtttggaagaagaatttcggaaactcacaaacgtgcggatcatgaaggaaaacatgaggacaggcaatctgccggctaacatgaagaaggccagggttattcagataataccctatgattttaaccgcgtgatcctgagcatgaaacggggccaggaatataccgattatattaacgcttccttcattgacgggtaccgacaaaaggattactttatcgccacacagggccccctggcccataccgtggaggatttttggcggatgatctgggaatggaaatcccacacaattgtgatgcttactgaggtgcaagagagagaacaagataagtgctaccaatactggccaaccgaaggctcagtcacacatggggagattaccatcgaaataaagaatgatactctgagcgaggcaataagcatcagagattttttagtgactctgaaccagccacaggcacgtcaggaggagcaggtgagggttgtgcgacaatttcattttcatggatggcccgagattggaatcccagcagaaggtaagggaatgatcgacctcatcgccgccgttcaaaagcaacagcagcagaccggcaaccatcctatcacagtgcactgctcagctggcgccggccgcacgggaactttcatcgcactcagtaatatcctggaaagggtcaaagcggaaggtttgctggatgtgttccaggccgtaaagtcactgcggttgcagaggccccacatggttcagaccctggagcagtatgaattttgttacaaggtcgtacaagactttattgatatcttttcagactatgccaattttaagtag

SEQ ID NO: 130927 - DNA, 1929 bp, Artificial Sequence
  Description of Artificial Sequence: Synthetic coding sequence
atgtccaatagatcgagcttctccaggttaacttggtttcgaaaacagaggaaagccgtggtatctacatccgacaaaaagatgcctaacggaattctggaggagcaagagcagcagcgcgtcatgctattgtctcgaagccctagtggccctaaaaagtacttccccattcccgtcgaacatctggaggaggagataaggattagatcggccgatgactgtaagcaatttagggaggagttcaactctctcccgtccggtcacattcaagggacattcgaattggccaacaaggaggaaaatagggaaaagaatagataccccaatattctgccaaatgaccactctagagtcatactgagccagctggatgggatcccctgtagcgattacattaatgccagctacattgatggctacaaagaaaagaataagttcatcgccgcccagggacccaagcaggagacagtgaatgacttctggcggatggtctgggagcaaaagtctgccacaatcgtgatgctgaccaacctgaaggagcgcaaagaggagaaatgtcatcagtactggcctgaccagggatgctggacatacgggaatatacgggtttgtgttgaggattgtgttgtactggttgactatacgatccgaaagttttgcatccagccccaacttcccgacgggtgcaaggctccacgtctggtcagtcagctgcactttacctcgtggccagacttcggagtgccattcactcctatcgggatgttgaaattcctgaaaaaagtgaagaccctaaatcctgtacacgctgggccaatagttgtgcactgtagcgcaggcgtcggccggactggtaccttcatcgtgattgacgccatgatggcaatgatgcatgctgagcagaaggttgatgtgttcgagttcgtcagtcggatcaggaatcaacggccccagatggtccagaccgacatgcagtatacctttatctatcaggccctcctggagtactatctgtacggtgacacagaactcgacgtctcctccctggaaaagcacttgcaaaccatgcacggcactacaacccactttgacaagatcgggctggaggaggaattcagaaagctcacgaatgtcaggataatgaaggaaaatatgagaaccggtaacctgccagctaatatgaagaaggcccgggtcatccaaatcatcccttatgacttcaatcgcgtcattttgtccatgaaaagaggacaagagtacaccgattacataaatgcctcgttcattgacgggtatagacagaaggactacttcatagctacacagggcccactcgcacatactgtggaggatttttggaggatgatttgggagtggaagagccacactatcgtgatgctgaccgaagtgcaggagcgcgagcaggataagtgctatcagtactggcctaccgaggggtcagtcactcacggcgagatcactatagagatcaaaaacgatacacttagtgaggccatttccatcagggattttctcgtgactcttaaccagccccaggcccgtcaggaagagcaggtccgggtggtgaggcagtttcattttcatgggtggccagaaatcggcatccccgctgaaggaaagggtatgatagatctgattgccgctgtgcagaagcagcaacagcaaaccggcaatcatccaatcaccgtccattgtagtgctggcgcgggaagaactggcacttttatcgctctgagtaatattttggagagggtgaaagctgagggcctgctggacgtcttccaggctgtgaagtccttgcgcctccaaagaccccacatggtgcagaccctggagcagtacgaattctgttataaggtggtccaggacttcatcgatattttttctgattatgctaatttcaaatag

SEQ ID NO: 130928 - DNA, 2103 bp, Artificial Sequence
  Description of Artificial Sequence: Synthetic coding sequence
atggaacctctttgcccactcctactcgttggtttctccctacccctggccagggcccttcgaggaaacgaaacaactgctgatagcaacgagactactacaacaagcggccctcctgacccaggcgcctcacaaccgctgttagcctggttgctgctacctctgctacttctcctgctagtgctcttactggcagcatacttctttcgatttaggaagcaacgaaaggcagtggtttctaccagcgataaaaagatgcccaacggcatactggaggagcaagaacagcaaagagtgatgctcctgagccggagtccgagtggacccaaaaagtactttccaattcccgtcgaacatttggaggaagaaattcggataagatctgcagacgactgcaaacaatttcgcgaagaattcaacagcttgcccagcggacatatacagggcaccttcgagcttgcaaacaaggaagagaacagggaaaagaaccggtaccccaacattctccctaacgaccacagtcgcgtgattctcagtcaactggatgggatcccatgctcagattatataaatgcaagttatatcgacgggtacaaagagaaaaacaaatttattgccgcccaaggtcctaagcaggagacggtcaatgacttttggcgaatggtctgggagcagaaatcagcaacaattgtcatgctgaccaacctgaaggagcggaaggaagagaaatgtcaccagtactggccagatcaggggtgctggacgtatggcaacatcagggtttgcgtagaagactgcgtggtgctggttgactacactatccgaaaattctgcatccagccccagttgcccgacggctgcaaggcgcccaggttggtttcccagcttcacttcacctcttggcccgactttggggtgccatttactcccattggcatgcttaaatttctgaaaaaagtcaaaactcttaacccagtccatgccggacctatcgttgtgcactgttctgctggggtcggacgaacaggcacttttattgtcatagatgccatgatggctatgatgcatgcggagcagaaggtagatgtgtttgagtttgtcagtcggatccgaaatcaaaggccacagatggtgcagactgatatgcagtatacttttatatatcaggcgctgcttgaatactatctgtatggggatactgaactcgatgtaagtagcctggagaagcacctgcagacaatgcacggaactacaactcactttgacaagataggactcgaggaagagtttagaaaactgactaatgtgagaatcatgaaggagaatatgaggaccggcaatctgcctgcaaatatgaagaaagctagagtcattcagatcatcccttacgacttcaatagagtgatcttatcaatgaagagaggtcaggagtatactgactacattaatgcaagcttcattgacgggtatcgacaaaaggactacttcatagcaacacagggcccactggcgcacaccgttgaagacttttggcgaatgatatgggagtggaagtcccacactattgtgatgctgacagaggtgcaagaaagagagcaggataagtgctaccaatattggcctacagaaggctcagttacccacggcgagattacgattgagattaagaatgatactctctccgaggcaatctccattcgcgactttctagtcacacttaaccagccacaggctaggcaggaagagcaggtcagagtggttcggcagtttcacttccatggatggcctgaaatcggtattcccgctgaagggaaaggcatgatagatctgatcgctgccgttcaaaaacagcagcagcagacgggtaaccaccctatcacagtgcactgttctgcgggagcaggtcggacagggacatttatcgctctgtcgaacatactcgagagggtcaaggccgagggcctcctcgatgtattccaggcggtcaagtccttaaggcttcagaggcctcacatggttcagaccctggaacagtatgagttttgttataaagttgtgcaagatttcattgacatcttttcagactacgccaatttcaagtag

SEQ ID NO: 130929 - DNA, 438 bp, Artificial Sequence
  Description of Artificial Sequence: Synthetic coding sequence
atggagccgctatgtccgttattattggtcggcttcagcctcccactggcacgtgcgctgcgaggtaatgaaacgacagccgactccaacgaaacaaccacaacatccggaccaccagatccaggagcctctcaacctctgttagcctggctgctcttgccactgctgttactgcttctcgtgctgttgttggctgcctatttctttaggttcagaaagcagcggaaggcagttgtgtccacctctgacaaaaagatgccaaatggaattttggaagagcaggagcagcaacgcgtgatgttgctcagcagaagtcccagcggacccaagaaatattttcctattcctgtggagcatctggaggaggagatcaggatcagatcagctgatgattgcaaacaatttagggaggaattcaacatgactattttaggttag

SEQ ID NO: 130930 - DNA, 2010 bp, Artificial Sequence
  Description of Artificial Sequence: Synthetic coding sequence
atggtgagccagagactgccccgtaagacaagggggcctccctggtccccttgcgtccacagctgttggtgggtgttagcgtgccggagccctggcctgagcggagccacccgccccctacctacagcgacccgccagccacgacctcaggctctgcgcacccgcgctccgccttcaaggtgttggcccggatgctactgccgctgttgcagcagttcaagctgttcattctccccacccaccagtagcggttcaggcccaaagaagtacttccccattccagttgagcatttggaggaggagattcgcatcaggtctgctgatgactgtaagcagtttcgcgaagagttcaatagtctcccctctggccacatccaaggtaccttcgagttggcaaacaaggaagaaaacagagagaagaatagatatcctaacatattgccgaacgaccactcacgggtcatcctctcccagcttgatggcattccctgttctgattacatcaatgcctcctatatcgatggctacaaagagaagaataaattcattgcagcccagggtccaaagcaagaaacagtgaacgatttctggagaatggtgtgggagcagaaatccgccaccatcgtgatgctgaccaacctgaaggagcgcaaggaggagaagtgccaccaatactggccagatcagggctgctggacctatggcaacatcagagtctgcgtggaggattgtgttgtgctcgtggactacactatacggaagttctgcatccagccacagttaccggatgggtgcaaagcacctaggctggtgtcacagctccacttcacttcctggcccgatttcggggtgccttttactccaatcggcatgctcaaattcctgaagaaagtcaagactcttaacccagtccacgccggccctatcgttgtgcattgctcagccggtgtgggccggacagggactttcattgtcatcgacgccatgatggcaatgatgcacgcggaacagaaagtcgacgtgttcgaattcgtttctcgcattagaaaccagaggccacagatggttcaaaccgacatgcagtatacctttatctaccaggccctgctggagtattatctctacggggatactgagctcgatgtgagtagtttggagaagcatcttcaaacgatgcacgggaccaccactcacttcgacaaaataggcctcgaagaagagtttcgaaaattgacaaacgtccggatcatgaaagaaaatatgcgcacgggcaacctacccgccaatatgaaaaaagctagagttattcagattatcccttatgatttcaacagagttatcctgagcatgaaacgcgggcaggaatacacagactacatcaacgcgtcatttatagatgggtatagacagaaggactactttattgccacccaaggtcccttggctcacacagtggaggacttctggcgcatgatatgggaatggaagagccatactatagtcatgctcaccgaagtccaagagcgggagcaagataagtgttaccagtactggcccacagaaggtagtgtcacacacggtgaaataaccattgaaatcaaaaacgatactctttctgaagccatatcaatcagagatttccttgtcactttgaaccagcctcaggctagacaggaagagcaggtgagagtggtgagacagtttcactttcacgggtggccagagattggcatacccgcagaagggaaagggatgattgacttaatagcggctgtgcagaagcagcagcagcagacaggcaaccatcctatcactgtgcactgccgcaacagcatgaactcagccacaaaatggtacaagatattgctcatctactttcttataatgctcatctccaatgaagacagctgcctgaaaatctttttcaatttgatggagcaacgcagaagccacttcccccaggatgctcggctgtccccacccctgtcaggtaccgcatttgccctatag

SEQ ID NO: 130931 - DNA, 423 bp, Artificial Sequence
  Description of Artificial Sequence: Synthetic coding sequence
atggaacccctgtgtcctttgttgcttgtgggtttctcccttccactcgcaagagctttgagggggaatgagaccactgccgacagcaatgagaccactacaacaagcggtcctcctgaccctggggctagtcaacccctcctggcatggctgctgcttcccctgctcctgcttctgttggtactgctcctagcagcctatttcttcaggttcagaaagcaacgcaaggctgtcgtaagtacttcggacaagaagatgcccaacggaatacttgaggagcaggagcagcagcgagtaatgttgttatctaggtccccctcaggccctaaaaagtactttcccatcccagtcgagcacttagaggaggagatcaggatcaggtctgcagacgattgcaaacaatttagggaggagtttaattag

SEQ ID NO: 130932 - DNA, 465 bp, Artificial Sequence
  Description of Artificial Sequence: Synthetic coding sequence
atggaaccactttgcccactgctcctcgtgggcttttcactgccactagctcgggcgctgagaggaaatgagacaaccgctgattctaatgagaccacaacgaccagtggtcctcccgaccccggggcgagtcagccgctgttagcttggctactacttcctttgcttctcctgctcctagtattactgcttgccgcctatttcttccggtttcggaaacaaaggaaggctgtggtgagcacatccgacaaaaaaatgccgaatggaatcttggaggagcaggagcagcagcgtgtcatgttgttatctagatcaccttcagggccaaaaaagtacttccctattcccgtggagcacctagaagaggagataaggataaggagcgcagacgattgcaagcagtttagggaagagtttaattctttaccttccgggcacatccagggcaccttcgagctcgcgtag

SEQ ID NO: 130933 - DNA, 5724 bp, Artificial Sequence
  Description of Artificial Sequence: Synthetic coding sequence
atggccccagaaccagcgcctggccgcacaatggtgccactcgtgcctgctctggtgatgctgggacttgtggccggagctcatggggactctaagccggtgtttatcaaagtacctgaagaccagaccggtttgtctggcggggtggcctcatttgtctgtcaggcaacgggcgaacccaagccacgcattacctggatgaaaaagggcaaaaaagtgagctctcagcgcttcgaggtaatagagttcgacgacggggctggaagcgtgctgaggattcagccccttagggtccagcgggatgaggctatctacgaatgcaccgccactaactcactgggcgagatcaacacatcagccaaactgtcagtactggaggaggaacagctgcccccgggctttccttcaatcgacatgggacctcagcttaaggtggtagagaaggctcggacagcaaccatgctttgcgcagctggcggcaaccctgatccggagatctcatggtttaaggattttcttccggtggaccccgccactagcaatggaagaattaaacagcttcgctccggcgcactacagattgaatccagcgaggaatctgaccaaggcaaatacgagtgtgtggctactaactccgcgggcacccgctattccgcccctgccaatctgtacgtgagagtgcggagggtagcccctcggttttcaataccccctagctcacaggaggtcatgccaggcggaagcgtcaacttgacatgcgtggcagtgggtgcacccatgccctatgtaaaatggatgatgggggccgaagagcttaccaaagaagacgaaatgcccgtggggcggaatgttttggagttatcaaacgtggtccgctctgccaactacacatgtgttgcaatcagcagccttggcatgatcgaagccaccgcccaagtgacagttaaggcactcccgaagccacctatcgacctggtggttacagagaccaccgccacatcagtgacacttacctgggattccgggaatagcgagcccgtgacttattacgggatccagtaccgggctgcaggcacagaaggacccttccaggaggtggatggcgttgccaccacgcgatactccatcggaggcctatctcccttttcagaatacgcatttagagtcttagcagtaaactcaattggccgtggaccaccgtctgaggccgttcgagcaagaactggcgagcaggctccttcctcccccccacggcgagttcaagcaagaatgctgtccgcctcaaccatgctggtgcagtgggaaccaccggaagagcctaacgggctcgtgagagggtaccgcgtctactacaccccagactctaggagacccccaaatgcatggcacaaacacaacaccgatgccgggcttctcactaccgttggtagcctcctacccggtatcacctactcgctgcgggtgctggcctttaccgcggttggggacgggccaccctcacccaccatccaggtcaagacacagcagggggtccctgcccaacccgcggacttccaggctgaggtagagtccgacacgcggatccagctgagctggctgctaccacctcaagagcggataattatgtacgaattggtgtactgggccgccgaagacgaggaccaacagcataaagtaaccttcgaccctacatcaagctatacactggaggacctgaaacccgataccctgtacagatttcagcttgcggcccggagcgacatgggtgtgggcgtgtttacgcctacgatcgaggcacgtacagcccagagcactcctagcgctccaccgcagaaagtgatgtgcgtgagcatgggctccaccaccgtgagagtgagctgggtaccccctcctgcagattcacgcaatggggttataactcaatactcagttgcgtacgaggccgtggatggtgaagacagaggacgacacgttgtggatggcatatctcgggaacacagcagttgggacttggtggggctggagaaatggacagaatacagagtgtgggttagagcccataccgatgtgggcccgggaccagagagtagtcctgttttggtgcggaccgacgaggacgtgccttcggggcctcctcgtaaggtggaggtggaacccttgaactccaccgccgtgcatgtttactggaaactgcccgtaccctccaaacaacacggtcagatccggggatatcaggttacctacgtacggcttgagaatggggagccaagaggcctgcccatcatacaggacgtgatgctcgctgaagcacagtggcggccagaggagtccgaagattatgaaaccaccatcagcggcttaactcccgaaaccacttacagcgtgacggtcgcagcatacaccaccaaaggcgacggcgcaagaagtaagcccaagatcgttaccaccaccggagccgttcccggaagacccacgatgatgattagcaccacagccatgaacacagctcttcttcagtggcacccacccaaggagctgcctggtgaattactgggctatcgactccagtactgtcgagcagatgaggctcgccccaatacaatcgatttcggcaaggacgatcagcatttcacagtaacaggcttacataagggaaccacttacatctttcgactcgctgccaagaatagagctggcctgggtgaagagttcgagaaagaaatccggactcctgaagatctgccctcagggttcccccagaacctgcacgtgactggactgacaacttctactacagagttggcctgggatccccccgtcctcgccgaacgcaatggtcgcatcatctcatacacggtggtgtttagagatattaactctcagcaggagctgcagaatataaccacggatacgcggttcacactcacaggattgaagcctgacacaacctacgacatcaaagttcgtgcctggacttcgaaagggtccggccccctgtcccctagcatccaaagcaggacgatgcccgtggagcaggtgttcgccaagaatttcagagtggccgctgccatgaaaaccagcgtgctgctatcatgggaagtaccagatagttacaagagcgccgttccgttcaaaattctgtataacggacagtcagtcgaggtggatggccattccatgagaaagctgatcgctgaccttcagcctaacactgaatattcatttgtcttgatgaacagagggtccagcgctgggggactacagcatctggtgagcattagaacggctccggacctactgccacacaagcccttaccggctagcgcctacatcgaagacggacggttcgacctctctatgccccatgtacaggacccttctttagtgaggtggttttacattgtggtggtcccaattgaccgcgtaggcggatccatgctaacaccgaggtggagcacgccggaggagctggaactggacgagctccttgaggcaatagagcaggggggagaggaacaacggcggcggcgcaggcaggccgaacgtcttaagccttacgtggcagcccagctcgatgtcttgcccgagactttcaccctaggagataaaaagaactatagaggtttctataaccgccctctgagcccagaccttagttatcagtgcttcgtactagcttcattgaaggagcccatggatcagaagcgctatgcttcctctccttatagtgacgagatcgttgtccaagtaactcccgcccagcagcaggaggaaccggagatgctctgggtaaccggcccagtgctggccgttattctcatcattttaattgttatcgccatcttactgtttaagagaaagcggacccactctccctctagtaaggatgaacagagcatcgggctcaaggacagtctgttagcccacagcagtgatcctgttgaaatgcgccggttgaactaccagacacctggcatgcgcgatcatccacctatcccaatcaccgatttggccgacaatatagaacggcttaaagcgaatgacggcttgaagttcagccaggagtacgagtctatagacccaggtcagcagttcacttgggagaattccaatctggaggttaataagcctaagaacagatacgctaatgtgatcgcctacgatcactcccgggtcattctgacttctatcgacggggtgccgggcagcgactacattaatgctaactatatagacggatatcgtaagcagaacgcttatatcgcaactcaggggccactgccagagaccatgggagacttctggaggatggtctgggaacaaaggacagcgactgttgtgatgatgacacgcctggaggagaagagtagggtgaagtgcgaccagtattggcctgcaaggggaacagagacctgtgggctcatccaggtcacactgcttgacaccgtggagctggccacttacacggtgagaacttttgcactgcacaaaagcggctcgtcagagaaacgagaactgaggcagtttcaatttatggcatggcctgatcacggtgtaccagaatacccaacccctatcctggctttcctgagacgtgttaaggcctgcaaccctttggatgccgggcccatggttgttcactgctctgcaggtgttggcaggactggctgctttatcgtgatcgacgctatgcttgagagaatgaagcacgaaaagaccgtagatatctatgggcacgtgacctgcatgcggagtcaaagaaattacatggtgcagaccgaggaccagtacgtgttcattcatgaggcgctgctggaagccgcaacctgtggccacaccgaggtgcccgctcgcaacctgtacgctcacatacagaagttgggccaggtcccaccaggtgagtctgtcaccgccatggaacttgagttcaagttactggcctcgagtaaggcccatacatcaagattcatatcagcaaatctgccatgcaataaatttaagaacagactcgtgaacattatgccgtacgagctgaccagggtatgtctgcagccaattcgcggagtggagggcagtgattatatcaatgcctccttcttagacggatacaggcagcagaaggcgtacatcgccactcagggtcctttggccgagagcacggaggatttctggaggatgctctgggagcacaattctactatcattgttatgctcacaaaattgcgggaaatgggccgtgaaaagtgtcaccagtattggccggccgagagaagcgcaagataccagtacttcgttgttgatccgatggcagaatataacatgccacagtacattctgcgcgaattcaaggtgacagacgcacgagatggacaatcccggactattcgccagtttcagtttactgactggccagaacagggtgtacctaaaaccggtgaggggttcatcgacttcattggtcaggtgcacaaaacgaaagaacagtttggccaagatggacccattacagtacattgcagtgctggggtgggtcgtaccggagtctttatcactctgtccattgtcttagaacggatgaggtacgagggggttgtcgatatgtttcaaacagttaagactttaagaacccaacgcccggccatggtacaaaccgaagaccaataccagctatgttatcgggcggcgttggaatatctgggcagcttcgatcactacgcgacgtag

SEQ ID NO: 130934 - DNA, 5697 bp, Artificial Sequence
  Description of Artificial Sequence: Synthetic coding sequence
atggcacctgagcccgcccccgggcgaacgatggtgccgctggtccctgcactggtgatgttgggcctagtcgccggggctcacggggactcgaaaccagtcttcattaaggtgcccgaggaccagactggtctgtcaggaggagtagctagtttcgtctgtcaggccactggcgagcctaagccgagaatcacctggatgaagaaagggaaaaaggtttccagccagcgcttcgaggtgattgagttcgacgatggagctggctctgtgctgcggattcagcctctccgcgtgcaacgtgatgaggccatctacgaatgcacagccaccaactccctgggcgagatcaatacatccgcgaaactgtctgtgctggaggaggagcagctcccacccgggttcccttcaatagacatggggccacagctcaaggtggtggaaaaagcacgcactgcaacaatgctgtgtgcagcgggaggaaatccagaccccgaaatatcctggttcaaagactttctgccggtggatcccgccacgtccaatgggagaatcaagcagctgcggtcaggggcgcttcagatcgagagctctgaagagtccgatcagggtaagtatgagtgtgttgcgacgaactccgcaggaactcgctatagcgcacctgctaatctgtatgtgcgtgtgcggagagtggccccccggttttccatacccccatcatcacaggaagttatgcccgggggcagtgtgaaccttacctgtgtggccgttggggccccgatgccatacgtgaagtggatgatgggcgctgaagagcttaccaaagaagacgaaatgccggtggggaggaatgtgctggagctgagcaacgtggttcgatctgcaaattacacgtgcgtggccataagtagtttaggcatgatcgaagctactgcccaggtcacagtgaaagctctacccaagccacccatcgaccttgttgtgacggagactactgctacatccgtgacccttacctgggattctggcaatagcgaacctgttacttattacggtattcagtacagagccgctggaacagagggcccgttccaggaagtggatggagtggccaccactaggtattcgattggcggcctcagtcccttttctgaatatgccttcagggtgcttgcggtcaatagcatcggccgcggacctccatcagaggcagtccgtgcccgtactggggaacaggcccccagctcaccacctaggagggtgcaagcccgcatgctctctgccagtactatgctagttcagtgggagcctccggaggaacctaacggtctggtccggggttacagagtttattacacccctgactcccgtcggcccccaaatgcctggcataagcacaacacagacgccggcctgctaacaactgtggggtctctgctgcccggaataacctactccttaagagtgctggcttttaccgccgtgggggatggtccaccttcaccaaccattcaagtgaaaacacagcaaggagtgcctgcccagccagccgacttccaggcagaagttgagagcgacactaggattcaattgagttggctgcttccaccccaagagagaataatcatgtatgagcttgtgtattgggcagctgaagacgaagatcaacaacacaaggtgacctttgaccctacgtcatcctatacactggaagacttaaaaccagacaccttgtaccgctttcagctcgccgctagatccgatatgggtgttggcgtgtttacaccaacaattgaggctcggacagctcagtcaaccccatcagctccaccacaaaaagtgatgtgtgtgagcatgggctcaactaccgtgcgagtatcctgggtgccacccccagccgacagcaggaatggggtgattacccagtatagtgtggcgtatgaagctgtggacggtgaagatcgggggcggcatgtggtggacggcatctccagggagcacagctcatgggatctggtcgggctggagaaatggacagaatatagagtatgggtcagggctcacaccgatgtcgggcctgggccggagtcctcacccgtcctggtccgtacagacgaagacgttcctagcggaccgccaaggaaagtggaggtggagccattaaacagcacggccgtccatgtttattggaagcttccggtcccatccaaacagcacggccagatccgaggttaccaagtgacatacgtgcggttagaaaatggggaacctaggggactcccgatcattcaggatgtgatgctcgctgaagcccaggaaaccaccataagcggcctcactcccgagacaacatattctgttactgttgccgcctacaccactaaaggcgatggcgccaggagcaaacccaagatagtgaccaccacaggcgcagtgcctgggagacctaccatgatgatctctaccacagccatgaatactgctcttctccagtggcacccccccaaagagttacctggcgaattgctgggatatcggttgcaatattgtagggcagatgaagccagacccaacacgattgacttcgggaaggacgatcaacatttcaccgtcactggtctgcataaggggacaacatacatatttaggttagccgcgaaaaatcgggctggccttggagaggagttcgagaaggaaatccgcacccccgaggatctgccatctgggttcccccaaaacttacacgtgacagggctgacaaccagcaccaccgagcttgcctgggatcccccagtcctggctgaacgaaatggcaggatcatcagctataccgtcgtcttccgtgacatcaattctcagcaggaactccagaatattactacagacacccgcttcacgcttacaggcttaaagccagataccacttatgatattaaggtgcgcgcttggacctctaaaggctctggtcctctttcgcctagcatccagtcaagaacaatgccagtggagcaggtgtttgcaaagaactttcgcgttgccgccgccatgaagacctcggtgctgttgagttgggaagtcccagactcatacaagtctgcagtcccttttaaaatcttgtacaacggacaaagcgttgaagtggacggacatagcatgcgcaagctgatcgccgacctgcaacctaacactgagtattcctttgttctaatgaaccggggaagtagtgccggaggtctccaacatctcgtgagcatccggactgcccccgacctgctgccccacaaaccgctcccggcatcagcctacatagaggatgggcgattcgacctgtccatgcctcacgtgcaggaccctagcctggtccgctggttctacattgtggtggtacccatagaccgcgtggggggatccatgcttactcctagatggtctactccagaagagctggagcttgatgagcttctagaagcaattgaacaagggggtgaggagcaacggcggagaaggaggcaagctgagcggctgaagccctatgtggccgcccaactggacgtgctgccagaaacattcacattgggtgacaaaaaaaactatcgtggcttctataacaggcccctcagccccgatctgtcttatcagtgtttcgtcctggcctccctgaaagaacctatggaccagaaacggtatgcgtcctccccttattcggacgagatcgtggtgcaggttacccccgcccagcagcaggaagaaccagaaatgctttgggtgaccgggccagttcttgcggttatcctgatcatcctcatcgtcatcgcaattctactgtttaaaaggaaaagaacacattcgcccagtagcaaagacgagcagtcgatcggacttaaggactctcttcttgctcattccagcgaccccgtcgagatgcggaggcttaactaccagaccccgggaatgagagatcacccaccaattcccattaccgacctcgccgataatattgaaaggctgaaggcaaacgatggcttgaagttcagtcaagagtacgagagcatcgacccaggtcagcagtttacctgggagaatagcaacctagaggttaataagccaaaaaatcgttacgctaacgtcatcgcatacgatcactcccgtgtgatcctcacctccattgatggtgtgcctggcagtgactacattaatgctaattatatcgacgggtacagaaaacaaaacgcctacatagcaactcagggacctctccccgaaacaatgggcgacttttggcggatggtgtgggagcaaagaaccgcaacagttgttatgatgaccaggctggaggaaaaatcacgcgttaaatgcgaccagtattggcccgccagagggacagaaacctgcggtctcatccaggtgaccctgctggataccgtcgagttggcaacctacaccgtacgcactttcgccctccacaaatccggatcctcagaaaagcgcgagcttaggcaatttcagtttatggcctggccagatcacggcgtaccagagtaccccacgccaatcctcgcatttcttaggagggtgaaggcatgcaaccccctggatgcaggacccatggtcgtacactgctccgcaggtgtgggccgtaccggatgttttatcgtcattgatgctatgctagagcgtatgaaacatgaaaaaacagtcgatatctacggccatgtaacatgtatgcgctcccaaagaaattacatggtgcaaactgaagaccagtatgtattcattcacgaagccctgctggaggcggccacttgcggacatacagaggttccagcgcgtaatttgtacgcccatattcagaaacttggacaggtgccgccaggagaatctgttaccgcaatggagcttgaattcaaattgctcgccagtagtaaagcacacacatcacgctttatatctgccaatcttccctgcaataagttcaagaacaggctcgtgaatataatgccatacgaattaactcgcgtatgtctgcagcctattcgaggggtggagggaagcgattacattaatgccagcttcttggacggctaccgccagcagaaagcgtacatcgctacgcagggacctcttgctgaatcaacggaggacttctggcgtatgctctgggaacacaatagcaccatcatcgtgatgctgacgaagctcagagagatgggccgggaaaaatgtcatcagtactggccagcagagcggtccgcccggtatcaatattttgttgtcgatcccatggccgagtacaacatgcctcagtacatcctccgtgagttcaaagttacagacgctcgggatgggcagtcccgaacaattcggcagtttcaatttacagactggccggagcagggcgtcccaaagacaggcgagggtttcatcgactttatcgggcaggtccacaagacaaaagagcagttcggacaagacggcccaataacagtacactgttctgccggggtcggaaggactggcgtttttataacactctcaatcgtgcttgaaaggatgcgctatgagggcgtggtggatatgttccagacagtcaaaacgcttaggacacagaggcccgccatggtacaaacagaagaccagtaccaactttgttacagagctgccctggaatatctgggctcctttgatcactatgcaacatag

SEQ ID NO: 130935 - DNA, 5724 bp, Artificial Sequence
  Description of Artificial Sequence: Synthetic coding sequence
atggctccagaaccggcccctggacgcaccatggtaccactcgtgccggcccttgtgatgttggggctggtggcaggagcccacggagatagtaagcctgtgtttatcaaagttcctgaagaccaaaccggtttgtctggcggggtggccagtttcgtgtgccaggctaccggagagccaaaacccaggatcacctggatgaaaaaagggaaaaaggtatctagtcaacgcttcgaggtcatcgagttcgatgacggcgccgggtcggtgctgcgcatccaaccactgcgggtgcaaagagatgaggctatttacgaatgtaccgccaccaatagcctcggggagattaatacgtctgccaagcttagtgtcctagaagaggagcagctgcctcctggattccccagcatcgacatggggcctcagctgaaggttgttgaaaaggccaggactgcaaccatgctgtgtgccgctggcggcaaccccgaccccgaaatctcttggttcaaggatttcctgcccgttgaccctgccacctccaatggcaggatcaagcagctccgcagcggggcgctgcagattgaatcctctgaggagagtgaccagggtaagtacgagtgtgtagccaccaacagtgccggtacacggtattccgcccccgcaaacctttacgtgcgagttcgccgagttgcaccccgatttagcatccctcccagctcccaggaagtgatgcccggcggctctgtcaatctgacctgcgttgcggtcggcgccccaatgccatacgttaaatggatgatgggcgccgaagagcttaccaaggaggacgagatgcccgtgggacgaaatgtcctggaattgtcgaacgtggttcgctctgcgaattacacatgcgtggccatctcctccctaggaatgatagaagcgaccgcccaggttaccgtgaaggctctccccaaacccccaatcgacctcgtggtcaccgagacaaccgccacatcagtgacactgacgtgggactcaggcaactccgagcccgttacttactatggaatccagtatcgcgcagccggaactgagggcccatttcaggaagtcgacggggtcgctactacaaggtattcaattggtggcctgagcccattttccgagtatgcattcagagtattggccgtgaacagcatcggaagaggtcctccctccgaggccgtgagagcccgtacaggcgaacaagcaccaagcagccccccccgcagagttcaggcgcggatgttgtctgccagcactatgctcgttcagtgggaaccgcccgaggaacctaatggacttgtgaggggctatcgcgtatactatacgcccgattcgcgccggccacccaatgcttggcataagcataatactgacgccgggctgctgaccaccgtgggctcgctgctccccggaatcacttattctctccgggtactagcattcacagcagtgggagacgggccaccctctccaaccatacaagtgaaaacccagcagggtgtgcccgcacagccagccgacttccaggcagaagttgaatccgataccagaatccagctgtcttggctgctcccaccacaggagcgcatcattatgtatgagctagtttactgggcggcagaagacgaagatcagcaacataaggtgacctttgatcctacaagtagctacacactcgaggaccttaaacccgacacactctaccgctttcagctagctgcaagaagcgatatgggggtgggcgtgttcacaccaaccatagaggcccgcactgcccaaagcactccttccgctccccctcaaaaggtgatgtgcgttagcatgggcagcacaacagttagggttagctgggtgcctcctccagccgatagtagaaatggagtgatcacccaatacagcgtggcctacgaggcggtagacggtgaggacaggggacgacacgtagttgatggcatctcaagagaacactcttcatgggacctggtaggcctcgagaaatggacggagtaccgggtttgggtaagggctcacaccgacgtggggcctggacccgagtcatcacctgtcctggtgagaacagatgaagacgtgccgtcaggtccaccgcgcaaggtagaagttgagccacttaattccacggcagttcacgtttactggaaactgccagtgccctccaagcaacatggtcagattcgcggttatcaggtgacgtacgttcggttggaaaacggagaaccacgcggtctgcccataattcaagatgtgatgctggctgaggctcagtggaggcctgaagagagcgaagactacgaaactacgatttcaggcctcacccctgagaccacgtacagtgttacagtcgccgcctacacaaccaagggggacggagccaggtcaaagcctaagatcgttactaccactggcgctgtccctggacgcccaacaatgatgatcagcacaacagccatgaacacagcccttttacagtggcatcctccaaaagaactccctggagagctcctcggttaccggcttcagtactgccgcgccgacgaagcgagaccgaacaccatagattttgggaaggacgaccagcattttacggtgaccggtctgcataaagggacaacctacatctttcggctggccgcaaagaatagggcagggctgggggaggaatttgaaaaggaaattcgcaccccggaggaccttccttctggatttccgcaaaacctccacgtgactggcctgacgacaagcaccacggagcttgcatgggacccacccgtcctcgccgaacgcaatgggcggatcatcagctacaccgttgttttccgggatattaattctcagcaggagctgcagaatattacaactgacacgcggtttacactaacaggtctaaaaccagacacgacctacgatattaaggtgagagcgtggactagtaaaggctccgggccactgtccccatccattcagtcacgaactatgcccgtcgaacaggtgtttgccaaaaactttcgagtggccgctgccatgaaaacatctgtgctgctatcttgggaggtacctgacagctataaaagcgcggtacccttcaaaatcctgtacaatggacaatcagttgaagtcgatggtcatagtatgaggaagcttattgccgatctccagccaaatacagaatacagcttcgtcctgatgaatcgcggcagtagtgcaggaggcctccagcatctggtgagcattaggacagcacctgacctgctaccacacaaaccccttcctgcatccgcgtacatcgaggacgggcgctttgatctttccatgccgcacgttcaggaccctagtctggtaagatggttctatatcgtagtggtccctattgatagagtaggcggttcaatgctcacacctcgctggtctacgccggaagagctggagttggatgaattgcttgaggcaatagaacaggggggggaagaacaaaggcggcgccgccggcaggctgaacgcctcaaaccatatgtggcggctcagttggacgtgctgcccgaaacttttacgctaggcgacaagaagaattatcggggcttttataatcgccctcttagtcccgatctgtcctaccagtgttttgtgctggcctccttaaaagagcccatggatcagaaacgatatgctagctccccatacagcgatgagattgtggtgcaggtgacccccgctcaacagcaggaagaaccggaaatgctttgggtgacggggcctgtcttggccgtgattctgattattctcatcgtcatagcgatcctcctctttaagagaaagaggacacactcccctagttctaaagatgaacagagtatcgggctgaaagatagcttgctggcccacagttccgacccggtcgaaatgcgacgccttaactatcagactcccgggatgagagatcatcctcctatccccattactgacctggccgacaacattgaaaggcttaaagctaatgacggattgaagtttagccaggagtacgagtctatcgaccctgggcagcagttcacctgggaaaatagtaatctggaagttaacaagcccaaaaacagatatgctaatgttatcgcttacgatcactcaagagttattctgacttcaatcgacggtgtgccagggagtgattatatcaatgcaaattatatcgacggatacagaaaacaaaacgcgtatattgctacccagggtcctctgcctgagacgatgggtgatttttggagaatggtctgggagcagaggactgcgactgtcgtgatgatgactcgtctcgaagagaagtcaagggtaaagtgtgatcaatactggcctgctcgcggcaccgagacctgcgggctgatccaggtgaccttgctcgacactgttgaactggcaacatacaccgtcaggacattcgccttacataaatccggctcctccgaaaaaagggaattgcggcaatttcaatttatggcatggcccgatcacggagttcccgaatacccaactcccattctggcgtttctgcgcagggtcaaagcttgtaatcccctcgatgccggacccatggtcgttcactgctccgctggcgtgggtcgcaccggatgctttatcgttatcgatgctatgctggagaggatgaaacacgaaaaaaccgttgacatctatggccacgtcacctgtatgagatcccagagaaattatatggtgcagacagaagaccagtacgttttcatccacgaggctctgctcgaagccgccacttgtggccatacagaggtgcccgcccggaacctttacgcacatatccagaaactaggacaggttccccctggtgagtccgtaaccgcaatggaactggaatttaagctactcgccagctcaaaagctcacaccagcagattcatcagtgccaatctgccatgcaacaagtttaaaaaccgtttagtgaacatcatgccctacgaactcactcgcgtgtgcctgcagcccatccgcggggtggaagggtctgattatatcaacgccagctttctggacggctatcgccagcagaaagcatacatcgccactcagggccccctggcagagagtactgaagacttttggagaatgctgtgggagcacaactcaaccataattgtcatgttgacaaaacttcgtgagatgggaagggagaaatgccatcagtactggccagcggaacgaagcgctagataccagtattttgttgtggaccctatggccgagtacaatatgccccagtatattctcagagagtttaaggttacagatgcgagagatggacagagcaggacaattcgccagttccaattcacagattggcctgagcagggcgtgcctaagaccggtgaggggttcattgactttattgggcaagttcacaagacaaaggaacagttcggacaagacggacccatcaccgtccactgcagcgccggggtcggtcgcaccggagtgtttatcacgctgagtatagtcctggagcgcatgagatacgagggtgtggtggacatgtttcagactgtcaagacattgcgtactcagaggccggccatggttcagactgaggaccagtaccagctgtgttacagggctgcgcttgaatacctggggagctttgatcactacgccacctag

SEQ ID NO: 130936 - DNA, 3801 bp, Artificial Sequence
  Description of Artificial Sequence: Synthetic coding sequence
atgtatgagttagtgtactgggcagcagaagacgaggatcaacagcacaaggtgacattcgacccgaccagctcctacacactggaggacctgaagccagatacactgtaccggtttcagctcgcagcaaggagtgacatgggagtaggcgtgttcactccaacaatagaagctagaactgcccaatctatgccaagtgggcctcctagaaaagtggaagtcgaacctctgaactcaacagctgtacacgtgtattggaaattacccgtaccgtctaagcagcatggccaaatcaggggctaccaggtcacttatgtgcggttagagaatggagagcccagagggttaccaataatccaagacgtcatgctggctgaagcacaagaaacaacaatatcgggacttacacccgagaccacatattctgtgacagttgccgcctataccaccaaaggagacggagctagatcaaaaccaaaaatagtcactacaacaggagccgtccccggccgacctactatgatgatctctaccaccgccatgaatacagccctgctgcagtggcatccccccaaggaacttccaggggaactgttgggataccgtttacagtattgcagggctgatgaggcccgccccaatacaatcgactttggcaaggatgaccagcattttacagtgaccgggctccacaagggaaccacatatatctttagattagcggccaagaatcgggcaggtctaggggaggagtttgaaaaggaaatcaggacgcctgaggatctgccctcaggctttccccagaatctgcacgtgaccgggctaactactagcacaaccgaactggcgtgggacccccccgtgttggcagagcgcaatggaaggataatctcatacacagtggtgttcagagacatcaattctcagcaggagcttcagaatatcacgaccgatacacgtttcacactcacaggactgaagccagataccacatatgatattaaagtccgtgcgtggacatcgaaaggctctggccctctcagcccgtcaatccagtctagaaccatgcctgtggagcaagtttttgccaagaatttcagagtggctgccgccatgaaaacttccgtgctcctgtcttgggaagtccccgattcttacaagtcagccgttccattcaagatcctgtataatggacagagtgttgaagtggacggccacagtatgcgaaagcttatcgccgatcttcagccgaacacagaatattcattcgtccttatgaaccgcggcagcagcgccgggggtctacagcacctggtttctatcaggacagcccctgacctgctgcctcacaaacccctcccagctagcgcctacattgaggatggaaggttcgacctctccatgccccatgttcaggacccatcactcgtccggtggttctatattgtggtggttcccattgatcgcgttggtggctctatgctcacccctaggtggagcactccggaggagctcgaactggatgagctgcttgaagcaattgagcaaggcggcgaggaacagagacgtaggcgccgccaggcagagcggttgaagccttacgttgcagcccagctcgatgtgttacccgagaccttcaccttgggagacaaaaagaactaccgcggattttacaaccgcccactgtcacccgacctgtcttaccagtgtttcgtgctggcctcactgaaggagcccatggaccagaagcgctacgcaagtagcccatattctgacgaaattgtggttcaggtgacccccgctcagcaacaggaagagccggaaatgctctgggtgactggaccagttctggctgtgattcttatcattctcatcgtgatcgccatcttgctgtttaagagaaagcgtacccactccccctcttccaaagatgagcagagtattggcctgaaagactctctcttggcgcactcgagtgatcctgttgaaatgcggcgcttgaattatcagactccagggagctctgtgccctcttgtccaaatacttccagtatgcgcgaccatccgcccatcccaattacggatctggctgacaatatcgaaaggctgaaggccaatgatgggctcaagtttagccaagagtacgagtctatagaccccggacagcaattcacttgggagaacagtaacctggaggtcaataaacctaagaaccggtacgcaaacgttatcgcttacgaccactcacgagtaatcctgacttcaatcgacggcgtcccagggtccgactacattaacgcgaattacattgacggctatcggaagcagaacgcgtatatagctacacagggccctcttccagagacaatgggagatttctggcgtatggtatgggagcagagaactgcaacagtcgtgatgatgacacggctggaagaaaagagccgcgtgaagtgtgaccaatattggcccgcccgaggtactgaaacctgcggtctcattcaagtgaccttgctggacacagtggagctcgcaacgtataccgtccgcacttttgccctccacaaatctggctctagtgagaagagagagttgcggcaatttcaatttatggcttggccagaccacggagtgcctgagtaccccacacctattctcgcttttcttcgcagagtcaaggcctgcaatccgcttgatgccgggccaatggtggttcactgctccgcaggagttggtcgtaccggttgctttatcgtgatcgacgccatgctggagaggatgaaacacgaaaaaaccgtagacatctacgggcacgtcacatgcatgcggagccagaggaattacatggtgcagaccgaggaccaatatgtttttatccacgaggccctgctggaggctgcgacctgtggacacaccgaggtgcccgcccgcaacctgtatgcccacatccaaaaactcggacaagtgcctccaggcgaatcggtgacagccatggaacttgagtttaagctgttggctagctcgaaagcacatacctcaagattcatctcagcaaatctcccatgtaacaagttcaaaaataggcttgtgaacataatgccatatgaattgacaagagtctgcctccaacccatacggggcgtggagggcagtgactacatcaacgccagcttcctagatgggtaccgtcagcaaaaagcgtatattgctacgcaaggccctctcgcagaatccaccgaggacttttggagaatgctgtgggagcataacagtacaataatcgtgatgcttactaaactgcgggagatgggacgcgagaagtgtcaccagtattggcccgccgagaggagtgccaggtatcagtacttcgtggtggaccctatggccgaatataatatgccgcagtatatcttgcgggagttcaaagtcaccgacgccagggatggccagtcaagaacaatcagacagttccagtttaccgattggcctgagcagggggtgccaaaaaccggcgaaggtttcattgacttcatcgggcaggtgcacaaaacgaaggagcaattcgggcaagacggaccaatcactgtgcactgtagcgctggagtggggcggactggggtctttatcaccctatctatcgtgctcgagcgcatgcgctacgagggggtagtcgatatgtttcagacagtcaagaccctgcgcactcaacgccccgccatggtgcagaccgaagatcagtaccagctctgctatagagctgccctggaatatcttggatctttcgatcactatgcgacatag

SEQ ID NO: 130937 - DNA, 5697 bp, Artificial Sequence
  Description of Artificial Sequence: Synthetic coding sequence
atggccccggagcctgccccaggaagaacaatggtgccgcttgttcccgccctggtgatgctcggactggtagctggcgcacatggagactcaaaaccggtgttcatcaaagtgccagaagatcagaccggcctaagcggaggcgtggcctcgttcgtatgccaggcaacgggcgagcctaagcctaggatcacgtggatgaaaaagggaaagaaggtctcctctcagaggttcgaggttatagagtttgatgatggcgctgggtccgtgttgcgtatccagccactaagagtccagcgagatgaagcgatttacgagtgcactgccacaaactcgcttggcgagattaatacatccgccaagctgagtgtgttggaagaagagcagctgcctcccggattcccctctattgacatgggcccccaactgaaggtggtcgaaaaggcgcgaacagccacaatgctctgtgctgccggcggaaatcctgatccagagatttcgtggttcaaggacttcctgcctgtggatcccgctaccagcaatggacgaataaagcagttgaggtccggagcactgcagattgagagcagtgaggagtctgaccagggcaagtatgagtgcgtcgccacgaactcagctggtacccggtactccgctcccgcaaatctgtacgttcgcgtgcgcagagtggcaccccggttctcaatacctccttcctcccaggaagtgatgccaggtgggtccgtgaaccttacatgcgttgctgtgggagccccaatgccctacgtcaaatggatgatgggtgccgaggagctgaccaaggaagatgaaatgccagtcggccggaacgtgctggaattatccaatgttgtgaggtccgccaattatacttgtgtagccatttcctcattagggatgattgaagccaccgctcaagttaccgtaaaagccctgccaaaaccacccatagacctggttgtcacagagactacagcaactagtgttactctcacatgggatagcggaaacagcgagccagtgacctattacggcatccaataccgagctgcgggcaccgagggtccctttcaggaagtagacggtgtggctacaacccgttatagtatcggtggtctgtctccgttttctgaatatgccttcagagtgctggccgttaactccatcggtcggggaccccccagtgaggcagtgcgcgctcgcaccggcgaacaggcaccgtcttctcctccacgaagagtgcaagcacggatgctgagcgcatccactatgctggtacagtgggagcctccagaggaacccaacggtcttgttcgggggtacagagtctactatacacctgatagccgacgccctcccaacgcctggcacaagcataatacagacgccggtctgctgactactgtcgggtctctgctcccaggcataacttatagcttgcgtgtcctggcattcactgctgtcggcgatggtcctccctcacccactattcaggttaaaacgcaacagggagtccccgcacagcctgccgatttccaggcagaagtggaatctgatactagaatccagctctcttggctgcttccacctcaggagaggattatcatgtatgagctggtttactgggccgcagaggatgaggaccagcagcataaggtaactttcgatccaacgagctcatatactctcgaagacctgaaaccggacactctctacagatttcagctggccgcccgctctgacatgggcgtgggggttttcactcccactatcgaggccaggaccgcgcagtcgacacctagtgctccacctcaaaaagtgatgtgcgtcagtatgggctcaactactgtgagggtgtcctgggtaccaccaccagccgattccaggaacggggtaattacacagtacagtgtcgcatatgaagctgtcgatggagaggatcgggggagacacgtggtggacgggatcagcagagaacacagcagctgggatcttgtaggcctggaaaagtggaccgagtatcgcgtgtgggtgagggcccacactgatgtgggtccaggtccagagagcagcccagtgctggtgcggacagacgaagacgtgcctagcggccccccccgcaaggtggaagtagagccactgaattctaccgccgttcatgtgtattggaaactccccgttccatcgaaacaacacggacagataaggggatatcaggtgacgtatgtgaggcttgagaacggagagcccaggggcctccctatcatccaggatgttatgctagctgaggcacaagaaacgacaatttccggtcttacacccgagacaacctattcagtgaccgtggccgcctatactacgaagggggacggcgcaagatcaaaaccaaaaatcgttacaactaccggagccgtcccaggccggcccactatgatgatctccactacagcgatgaacaccgccttattacagtggcatccgccaaaggagttgcctggggagttattgggatacagactgcaatactgccgagcagacgaagcacgaccgaatacaatcgattttggcaaggatgatcagcattttaccgtcactgggttgcacaagggcaccacatacattttccggctggcagctaaaaatcgggcaggcctgggagaggagttcgagaaggaaatccggactcctgaagacctaccatccggttttccacagaatctgcatgtaacggggcttacaacgtcaacaaccgagttggcctgggatcctcccgtgctagctgagagaaacgggcgaattatcagctacactgtcgtcttccgagacataaattcccagcaggaactccagaatataaccacagacacacgattcacactcactgggctgaagccagacaccacgtacgacataaaagtgagggcatggacttcaaagggcagtggacccctatctccaagcatccaaagccggacaatgcctgtggaacaggtctttgcgaagaactttcgcgtggccgctgccatgaaaacttctgtactgctgtcttgggaagttcccgattcatacaaatcagccgtgcccttcaaaattttgtacaatggtcagagcgttgaagtggacggacacagtatgagaaagctaattgcagacctccagcctaacactgaatacagttttgtcctgatgaaccgcgggtcctcagccggtggcctccagcacctggtaagcatcaggaccgcacccgatttgttgccacacaagccccttccagcgtctgcttacatcgaggacgggaggtttgacctctcaatgccccatgttcaggatccgagcctcgtacgatggttttacattgtggtggtgcccattgaccgagtgggtgggtcaatgttgaccccgcgctggtctacacccgaagagttggagctggatgagctactggaagccatcgagcagggtggtgaagagcagaggaggaggcgcagacaggcggagcgactaaaaccgtatgtcgccgcccaactggacgtgctccctgagacgttcacactcggagataaaaaaaattatagagggttttacaatcgtcccctcagccccgatttgagttatcaatgctttgtgctggcaagcctgaaggagcccatggatcagaaacggtacgcctcttctccgtatagcgatgagatagtcgtccaagtgacaccagcacagcaacaggaagaaccggagatgctatgggtgaccggacccgtgctggccgtgatacttatcatcctgatcgtgatagctattctgcttttcaagcgaaagcggacccattcaccctccagcaaagacgaacagagcataggcttaaaggacagccttttagcacatagctcagaccctgtcgagatgagaaggcttaattaccagacacctgggatgagggaccacccccccatcccaataactgatctcgccgacaacatcgaacgcctcaaagccaacgatggcctgaagttttcacaggaatacgaatcaatagatcccgggcaacagttcacgtgggaaaatagtaacctggaggtcaacaaaccgaagaatagatatgcaaacgttatcgcttatgaccatagtcgcgtgatcttgactagtattgatggagtgccaggatcggattacataaatgctaactatatcgatggttaccggaagcaaaacgcatatattgcaacacagggacccctgcccgagactatgggggatttttggcggatggtgtgggagcagcgcactgcaaccgtcgtaatgatgacacgcctcgaagagaaatcacgcgtgaagtgcgaccagtactggcccgctcgtggtaccgagacctgcggcctcattcaggtgacccttctcgacaccgtcgaactagcgacctatacggttaggaccttcgctctccacaagtcaggctcctctgagaaacgtgaacttagacagttccaattcatggcttggccagaccatggcgtaccggagtatcctaccccaatcctggctttcctcagacgcgtgaaagcctgcaatcccctcgatgctggcccaatggtggtgcactgtagcgccggcgttgggcgtaccggatgtttcatcgtaatagatgcaatgctggagcggatgaagcacgaaaaaacagtagacatttacggccacgtcacgtgcatgcgatctcagcgtaactacatggtgcagactgaagatcagtacgtattcatccatgaagccttactagaggcggccacttgcggccatactgaggtccctgcgcggaatttgtacgctcatattcagaagctggggcaagtgccacctggggaatccgttacagcaatggagctcgagttcaaactgctggcctctagtaaagcgcatactagtcgatttatctctgcaaacttaccatgcaacaagttcaagaatagactggtcaatatcatgccatatgagttgacacgcgtctgcctgcaacccatacgcggcgttgagggctctgactacatcaacgcttcgtttctggacgggtacagacagcaaaaggcctacatcgcaacccagggccccctggcggagagcactgaggatttttggagaatgctttgggagcataattctacgataatcgtcatgctgaccaagctcagagaaatgggcagggagaagtgtcaccagtattggcccgctgaacgcagcgcccggtaccagtacttcgtggttgatccaatggccgagtacaatatgccccagtatatacttcgtgagttcaaggtaaccgatgcgagggacggccagtccaggacaatccgtcagttccagttcactgattggccggagcagggtgtccctaaaacaggtgaagggtttattgatttcattgggcaagttcacaaaaccaaggagcagttcggtcaggacggccccataacagtacactgcagtgctggggtcggacggacgggcgtgtttatcacactctctatcgtgttagagcggatgaggtacgaaggagtggtagacatgtttcagacagtgaagacactaagaacacagcgacctgccatggtccaaaccgaggatcagtatcagctctgttatagagcggctctcgagtacctcggatctttcgaccattacgccacttag

SEQ ID NO: 130938 - DNA, 3609 bp, Artificial Sequence
  Description of Artificial Sequence: Synthetic coding sequence
atgatgtgcgaagtgatgcctactatctccgaagcagagggtccacctggagggggaggcgggcatggatccggttctccctcacaacccgatgctgattcccactttgaacagctcatggtgtctatgctggaagaacgtgatcgacttctcgatacactccgggaaacacaggaaacgttggccctaacacagggcaagcttcatgaagtcgggcatgaaagggattcccttcagagacagctaaataccgcattaccgcaggaatttgctgcccttactaaggagctgaatgtttgccgggagcaactgctggaaagggaggaggaaattgcagaactgaaagcagaacgcaacaacacaaggctccttcttgagcatttggagtgcctcgtgagccgccatgagagatcactccgaatgacagtcgttaagcgccaggcccagtcccctgccggtgtaagttcagaggtggaagtgcttaaggcattgaaatccctgttcgagcaccacaaggctctggatgagaaagtgagggagcggctgcgcgtggctctagaaaggtgctctctgctggaggaagaattgggggccacacataaggagctgatgattttgaaagagcagaataatcagaaaaagacactcaccgacggtgtcctagacatcaatcacgagcaggaaaacactccatcaacgagtgggaagagatcgtctgacggatctctcagccacgaagaggacttggccaaggtcatcgaactgcaggagattatatctaaacagtcgagggagcagtcccaaatgaaagagcgccttgcttctttgtcaagtcacgtgacagagttagaggaagatctggatactgccagaaaagatctaatcaaatctgaagagatgaatactaagctccagagagacgtacgcgaagctatggcccaaaaggaagatatggaggagcgcatcacaacgctggagaaaaggtacctggccgctcagcgcgaagctacctctgtgcatgacttaaacgataaactagaaaacgaaattgcaaataaggactcaatgcacaggcaaaccgaggataaaaacaggcaacttcaagagcgcctggagctggccgaacaaaaattacagcagacccttcgcaaggccgagacactccctgaggtcgaagccgagttagctcaacgcgttgccgcgttgtccaaggccgaggaaaggcacggtaatatcgaggagcgtttacgccagatggaggcacagctcgaggaaaagaaccaagaactccagagagcgagacagagggagaagatgaacgaggagcacaacaagagactgtcagacaccgttgacaaactcctaagcgaatccaacgagcgactgcagctgcaccttaaggaaaggatggctgctctcgaagataagaactccctgttgcgcgaagtggagtcagctaagaaacagttggaggaaacccagcacgataaggaccaactggttctaaacatcgaagcccttcgggcagagttggatcatatgcgcttgagaggcgcgagcctccaccacgggaggcctcatctcggttcggtgccggactttcggtttcccatggcagatggtcacacagactcctatagcacgtctgcagtcctgagacgacctcagaaaggtagactcgccgccctgagggacgaacctagcaaggttcagacccttaacgagcaggattgggagagagcacagcaggcctcagtgctggccaacgtggctcaggcttttgagtctgacgccgacgttagtgatggagaagatgatagagataccctgttgagtagtgtggaccttctttcaccctcgggccaggccgacgctcacacattggctatgatgctgcaggaacaacttgatgccataaataaggagattcgcctgatccaagaggagaaagagaacactgagcagcgggcagaggagatcgaatctagggtaggcagcggttcgctagacaacctgggcaggttcaggagcatgagttccataccaccatacccggccagctccctcgcgtcctcctctcccccgggcagcggacgctctactcccaggcgcatcccacactcacctgcgcgcgaggttgaccggttaggtgtcatgacactacttcctccatctagggaggaggtccgcgatgacaaaacaacaattaaatgtgagactagccccccgagtagcccacgtgcactgcggctggacagactgcacaagggagcactgcatacagtgtctcatgaagacattcgagacatccggaattcaaccggctcgcaagacggccccgtcagtaatccatcctcctcaaatagctcacaggactcgctccacaaagcccctaagaaaaaaggcatcaagtcctccatcggtagactgttcggcaagaaagaaaagggacgaccaggccagaccgggaaggaggccttaggccaagcgggcgtgagcgagacagacaactcaagccaggacgcactgggcctctctaagctgggcggccaggccgaaaaaaatcggaagctacagaagaagcacgagctgctggaggaggcccgcaggcagggccttccgtttgctcagtgggatgggccaacggtcgtggtgtggctcgagctctgggtgggcatgcctgcctggtacgtcgccgcctgcagggcgaatgtcaagagcggagcaattatgtctgccctgtccgatacagaaattcagcgagagattgggatttcaaacccactgcacaggctcaagcttcgcttagccattcaagagattatgagcctcacttcgccttccgcgccccctacaagtcggacaaccctggcctatggggacatgaatcacgagtggatcggaaacgagtggctccctagccttggtttacctcagtacaggagctatttcatggagtgtctggtcgatgccaggatgttggaccacctgacgaagaaagacctgcgaggccagcttaagatggtggactctttccatcgaaacagcttccagtgcgggatcatgtgcctcagaaggctcaattacgataggaaagagctggagcgtaaacgggaggagtcgcagtccgagattaaagatgttctggtgtggtcaaacgaccgggtgattaggtggatcctcagtattgggctcaaagagtacgctaataatttaatcgaaagcggtgtgcacggcgcgctgctagcactcgacgagacattcgactttagcgccttggcgctgttattacagattcctacacaaaacacgcaggcaagggcagtgctcgagagagagttcaataatcttttggtcatgggcactgaccgaagattcgacgaggacgacgataagagcttccgtcgtgccccttcttggagaaagaagtttcgacccaaggacattagagggctggccgctggctctgcggaaacgttgcccgccaacttcagagtgacctccagcatgagctcccctagtatgcaacctaagaaaatgcagatggacggcaatgtcagtggcacccagcgtctggattcagcaacagtgagaacatactcttgctag

SEQ ID NO: 130939 - DNA, 3558 bp, Artificial Sequence
  Description of Artificial Sequence: Synthetic coding sequence
atgatgtgtgaagtaatgcccacaatctccgaggcggagggacctccagggggcggcgggggacacgggtctggatcgccctcccaaccagatgccgatagccacttcgaacagctgatggttagcatgctcgaggagcgcgacagactgctggacaccctcagggagacgcaggagacactggctttgactcagggcaagcttcacgaggtgggccatgagagagattctttacagagacagctaaacactgcacttccacaggagttcgccgccttaacgaaagagttgaacgtctgccgcgaacagctgcttgaacgggaggaggagatcgccgagctgaaagcagaacgcaacaacacgagattactgttggaacacctggagtgtctcgtgtccaggcacgaacgttcactccgaatgaccgtggttaagcggcaggcccagagccctgctggggtgtcctccgaagtggaggtcctcaaggcactgaagagcttattcgagcaccacaaggcactggacgagaaagtcagagagaggctccgcgttgctttagaaaggtgttctctgctcgaggaggaattgggcgccacccataaagagctgatgatccttaaggagcagaataatcagaaaaaaactctcaccgacggagtgctcgacatcaaccatgagcaagagaatactccttctacttccggaaaacgatcatcagacgggtccctgagccacgaagaggacctggcaaaggtgatcgagctgcaggaaatcattagtaagcaatctcgagagcagagtcaaatgaaagagcggctcgcctctctgagttctcatgtgactgaactcgaagaggatcttgacactgccaggaaggacctgattaagagtgaggagatgaacactaaactacaacgtgacgttcgtgaagcgatggcccagaaggaggacatggaagaaagaattacgacattagagaaaagatatcttgccgcccagcgggaggccactagcgtgcatgacttaaacgacaagctggaaaatgagattgcaaataaggactccatgcaccggcaaacagaggataagaacagacagctccaagagcggctggagctcgctgagcagaaattgcaacagaccctgcggaaggcagagacgctgccggaggtggaagccgagctggcccagcgtgtggccgccttgtccaaggcggaggaaagacatggaaacattgaagagaggcttaggcagatggaggcccagctggaggaaaagaatcaagagttgcaacgggcgagacagagggaaaagatgaatgaggaacacaacaagcgactctctgatacagtagacaaactactgtccgagtctaacgagcgcctgcagctgcacctcaaggaaaggatggccgcacttgaggacaagaattcattgctacgcgaagtggagtccgctaaaaagcaactggaggagacgcagcatgataaggaccagttggtattgaatatcgaagctctcagggccgaacttgaccatatgcgcctacgaggcgcatcgcttcatcacggtagacctcacctcgggtcagttcctgactttcgattccctatggcagacggccataccgactcttattccacgtcagctgtgctgaggagaccccagaagggccggcttgccgctctgcgagacgaacctagcaaggtgcaaacgcttaacgagcaggattgggagcgggcccaacaggcatccgtcctggccaatgtggctcaggcttttgagtctgacgcagacgtaagcgatggcgaagatgatagggacaccctgctatcctcggttgatttactgagccctagtggccaagctgacgctcacacactggccatgatgcttcaagagcagctggacgccatcaacaaagaaatcagactgattcaggaggagaaagaaaacacagaacaacgagccgaggagattgaaagcagagtcgggagtggcagcctagataacctcggacgcttccgatctatgtcgagtatccccccctacccagcctcttccctggcatcgtcttctcccccaggctccggaagaagcacgccccgaagaattccacactctccagcccgcgaggtcgatcgattgggcgtcatgaccctgctccccccgtctagggaggaggtgagggacgataaaaccaccatcaaatgtgagacctcacctccttcctcaccccgcgctctgcgccttgatagactgcacaagggggcccttcacaccgtctcccacgaagatataagagacattcgtaattcgaccggcagtcaagatggtcctgtgtcaaacccttctagctctaattctagccaggacagcctgcacaaggcacctaagaaaaaagggatcaagagctcaatcggcaggctttttggtaagaaggaaaaaggccggcctgggcagactgggaaggaggccctcggccaggccggtgtatctgaaacagacaactcatcgcaagatgcacttggcctgtctaaactgggggggcaggccgagaagaatcggaagctccagaagaagcatgaattgctggaggaggcccgaaggcagggactgcctttcgcgcagtgggacgggcctacagtggtagtgtggttagagctctgggtcggaatgcccgcgtggtacgtagcggcatgtcgggcgaacgtgaaaagtggcgccattatgtctgcactaagcgacacagaaatccagagagagatcggaatctccaatccgttgcataggcttaagctgagactggctatacaggagatcatgtcactgactagcccatccgctccgccaacctcgagaaccaccttggcttatggggatatgaaccatgagtggataggaaacgaatggttgccgtccttgggactgccccaatatcgaagttatttcatggagtgcctggtggatgctcgcatgcttgaccacttaactaaaaaagatcttcgcggacagctgaagatggtggactcgtttcaccgcaatagcttccagtgtgggatcatgtgcttgagaaggctgaactatgatagaaaagagctcgagcgcaagagggaagagagccagagcgagataaaggacgtcctcgtgtggtctaacgatagggtgatcaggtggattctgtcaatcgggcttaaggaatacgccaataatctgatagaatcgggtgttcacggggccctcctggccctggacgagacctttgatttcagtgccttggcactactgctgcagattcccacacaaaatacccaggcccgagccgtcctggaacgcgagtttaataacctgctggttatgggcacagaccggaggtttgacgaggatgacgacaagagttttaggcgggctcccagctggcggaagaaatttcggcccaaggatattcggggcctggcagccggttccgccgaaacactgcccgcgaactttcgagtcacttcaagcatgtcctctccaagcatgcagccaaagaagatgcagatggatggcatgtag

SEQ ID NO: 130940 - DNA, 477 bp, Artificial Sequence
  Description of Artificial Sequence: Synthetic coding sequence
atgatgtgcgaggtgatgcctacaattagcgaagctgaaggcccaccaggtggtgggggaggacacggatctggctctccctcccaaccggacgctgattcccacttcgaacagcttatggtgagtatgctagaggagcgcgaccggttgctggacaccctacgggagacacaagagactctggcactgactcaggggaaactgcacgaagttggccatgaaagagactcccttcagaggcagctcaacaccgcccttccacaggagtttgccgcgctgactaaggaactaaacgtatgtcgggagcagttgttagaacgagaggaggaaatcgccgaactgaaagccgagaggaataatacacgactgcttctggaacacctcgagtgtctagtaagtcgacatgagagaagtctccggatgaccgtggtaaagcgccaggctcaatctccagctggtgtatctagtgaagtctag

SEQ ID NO: 130941 - DNA, 300 bp, Artificial Sequence
  Description of Artificial Sequence: Synthetic coding sequence
atgatgtgcgaagtgatgccaactatctctgaggctgaaggccccccgggaggcggaggcgggcacgggtccgggtccccctctcagcccgacgcagattcccatttcgaacagcttatggtatctatgctggaagagcgcgacagattattggacacgctccgggaaactcaggagacccttgcgctcacccaaggcaagctgcacgaggtgggccacgagcgtgacagccttcagaggcaacttaacaccgctctgccccaggagtttgctgccttgacgaaagaacttaatgtgtag

SEQ ID NO: 130942 - DNA, 2100 bp, Artificial Sequence
  Description of Artificial Sequence: Synthetic coding sequence
atgcgcttgcgcggtgcttccttgcaccacgggcggcctcatttgggaagcgtacccgattttaggtttccaatggcagatggtcatactgactcatatagcactagcgcagtgttgcgcaggccccagaagggccgcctagctgctttgcgtgacgagccatcaaaggtgcaaaccttgaacgagcaggattgggagcgcgcccagcaggcctcggttctcgccaatgttgcccaggctttcgagagcgacgcagatgtgtcagacggggaagacgacagggacacactcctctcttccgtggacctgttgtctccttcaggccaggccgatgctcacacattggcgatgatgcttcaagaacagctggatgctattaacaaagaaatcagactgatccaggaagagaaagagaatacagagcagagagcagaagaaattgagtcacgcgtcggcagcggaagtttggataatctggggaggttccgcagcatgtcatccattccaccctaccccgcaagttctcttgcctccagttcccctccagggtctggcagatccactccgaggagaatcccgcactcacccgccagggaagtggaccgcctgggcgttatgacattgccttctgatctgagaaagcaccgccggaagttgccgccctcacgcgaggaggtccgagatgacaagactactatcaagtgtgaaaccagtccaccttcctcgccccgggctctgcggctcgaccggctacacaagggggctttacacacagtgtctcacgaagacatcagggacatcagaaactccacaggctcccaggatggccccgtatccaatccttctagctccaacagcagccaagactccctacataaagcccccaaaaagaaaggaataaaaagctctatcggccgcctgtttgggaaaaaggagaaggggcgccccggacagactggcaaggaggctctgggccaggccggcgtgagcgaaaccgacaacagttcccaggatgccctgggtctatctaagctgggcggacaggccgaaaaaaatcgcaagctgcagaagaagcacgaactactggaggaagcccgccgccagggcctccccttcgctcaatgggacggccctacagtcgtggtctggctggagctctgggtgggaatgcctgcatggtatgtggccgcttgccgtgctaacgttaagtcaggggcgattatgtctgctctgagcgatacagaaatccagagggaaataggtatcagcaacccattgcatcgattaaagctgcgcctcgctatacaggaaatcatgagtctgacatcccccagcgccccccctacatccagaaccactctcgcctatggcgacatgaatcacgaatggatcggcaacgaatggttaccaagccttggcctcccacagtatcgttcttactttatggagtgcctggtggacgcccgtatgctagatcaccttaccaaaaaagatctgagggggcagctcaagatggtggatagtttccacaggaattctttccagtgtggcattatgtgccttcgcagactgaactacgacagaaaggagctggagcgaaagcgcgaggagagtcagagtgagattaaagatgtccttgtgtggtcaaacgatcgcgtgatcagatggatcttatctatcggactgaaggaatacgccaacaatcttatcgagtcaggagtgcacggggccctgctagctctggatgaaacattcgactttagtgcgctggcactcctcctccagattcctactcagaacacacaggctagagccgtgctcgaacgtgaattcaacaatctcctcgttatgggcacagaccgaaggtttgatgaagacgacgacaagagttttaggcgcgccccaagttggcggaagaagttcaggccaaaggacatccgtgggcttgctgcggggtccgctgagactctcccagccaatttccgcgtcacgtcttccatgtcctctccttctatgcagcccaaaaagatgcagatggatgggaacgtatcaggcacacagcgactagactctgccacagtgcggacctacagttgctag

SEQ ID NO: 130943 - DNA, 3585 bp, Artificial Sequence
  Description of Artificial Sequence: Synthetic coding sequence
atgatgtgtgaggtaatgcctacaattagtgaggacggacgccgtgggtccgccctcggccccgatgaggctggcggcgagctggagagactgatggtcaccatgttgactgaacgggagcggttgctcgaaacattgagagaggcacaggacggcctggctactgcccaactgcgactcagagagctaggccatgagaaggattctctacaaaggcagttgagcatcgcactcccgcaagagttcgccgcattgacaaaagaactgaacctatgcagggaacagctattggagcgagaagaggaaatcgcagaacttaaagccgaaagaaacaacactagactgttgctggagcaccttgagtgtctagtgtctagacacgagcgttcccttcgaatgaccgtggtgaagaggcaggcccaaagtccaggcggcgtcagcagcgaagtggaggtcttaaaagctctcaaatcactgtttgagcatcataaggctttggatgaaaaagtgcgggagagactgagaatggcactggaacgggtggccgtcctggaggaggagctggagctctcaaaccaggagaccctgaatctgcgggagcagctgtcgaggaggaggagtggcttagaggagcctggtaaggatggggacggtcaaaccctcgctaacggtcttggccctggaggcgattctaacagaagaacggccgaactcgaggaagccctcgaaagacaaagagctgaggtgtgtcagctgagagagagactagccgtattatgtcggcagatgtcacagttagaggaagagctggggacggctcatagagagctgggaaaagccgaagaggcgaacagcaagttgcaacgcgacctaaaggaggccctggctcagcgggaggatatggaagaacgcatcacaacgctcgaaaaacgatacctgtcagcacagagggaggcaacatccctccatgatgctaatgataagttggagaatgagttagcatccaaggagagtctctatcgccaatccgaagagaagtcccgacagctcgcggaatggctagatgatgccaaacagaagctgcagcagacccttcagaaggccgagacacttccagagatagaggcccagctcgcccagcgtgttgccgccctaaacaaagcggaggagaggcatggcaacttcgaggaaagactcagacagttagaggctcagctggaagagaaaaaccaggagttgcagcgtgctcggcagcgagagaagatgaacgatgaccacaataaacgcctgagtgagaccgtggacaagctattgtccgagtcaaacgaaaggctgcagttacatctcaaagagcgcatgggtgcactggaggaaaagaactcgctgtctgaagagatcgccaacatgaagaaattgcaggacgagctcctgctcaataaggagcagctcttagctgagatggaacgcatgcaaatggaaattgaccagctgagaggccgtcccccgtcaagctactcgaggagcctgccaggctcagcccttgagctgagatattcccaggcccccaccttgcctagtggggcgcatcttgacccttacgtggcaggcagcggtagagcagggaaaagaggcagatggtccggagtgaaagaggagcccagcaaagattgggaacggagcgccccagccggtagcattcctcccccctttccgggcgaacttgacggcagtgacgaggaagaagcagaagggatgtttggagccgaactcctttctccctccggccaggctgacgtacagactctggctataatgctccaggagcagcttgaggccattaataaggagataaagctgatccaagaggagaaagagaccactgagcagcgggcggaggagctggaaagcagggtgtccagctcaggtctcgattctctagggagataccggtcctcatgctctttgccgcctagtctcactaccagtactctcgctagtccaagcccacccagtagtggccatagcaccccacgacttgctccaccttcacccgcgagagaaggtacggacaaagcaaaccacgtgccaaaggaggaggctggggccccgcgtggtgaagggcccgcaatccccggggacacaccaccacccactccacggtcagcacgtctggagcgcatgacacaggctctggcgctgcaagcaggcagcttggaggacggcgggccgccccgggggtcagaggggacacccgattccttgcacaaagcacctaagaagaaatcaattaagagttctattggacggctattcggcaaaaaggaaaaggggcgcatggggccacctggcagggatagcagctctctcgccggcaccccatctgatgaaacactagccaccgacccactcggtctcgccaaactgacaggtccaggcgataaggatcgacgcaacaagcgtaaacacgaactgctggaggaggcttgtagacaaggcctcccatttgctgcatgggacggccctacggttgtgtcatggctcgagttgtgggtgggcatgcccgcttggtatgtggctgcttgtagggctaacgtgaaaagcggtgcaataatggctaacctgagcgacactgaaatacagagagaaattggaatttcaaatcccctgcataggctgaaactgcgcctggcaatacaggagatggtgagtttgaccagtccctcagcccctgcctcctcgcgaacttccaccggcaacgtgtggatgacccatgaggagatggagtccctgaccgcgacaacaaagccagagacaaaagagattagctgggagcagattttagcctatggagacatgaaccatgaatgggtggggaatgactggcttccttccctgggattgcctcagtaccgctcctatttcatggagtcgctcgttgatgcgaggatgctagatcacctgaataagaaagaacttagaggacagctgaagatggtcgacagtttccacagagtttctctgcactacggtatcatgtgcttaaagagactgaattacgataggaaggatctggaaaggcggcgggaggaatcacaaactcagatacgagacgttatggtctggtccaacgaaagagtcatgggctgggtgtcagggctgggtttaaaagagtttgcaaccaatttaaccgagtcgggagttcacggggcattacttgcacttgacgaaacgttcgattattcagacctggccctccttctacagattcccacccaaaacgcccaggccagacagttactggaaaaagaattcagtaatttgatcagtttgggaaccgacaggcgcttggatgaggattcagctaagagcttcagtaggtccccgagttggagaaaaatgtttagggagaaggaccttcgcggcgtgactcccgactcagcagaaatgctacctcccaactttaggtcggcagctgccggggccctcgggtctcccgggcttccccttcgaaagctgcagcctgaaggccaaacctcagggagcagccgcgccgatggggtcagcgttcgcacctactcctgctag

SEQ ID NO: 130944 - DNA, 1731 bp, Artificial Sequence
  Description of Artificial Sequence: Synthetic coding sequence
atgtctggacaggaatttgctgcactcactaaagagctaaatttgtgtcgggaacagctactggagcgcgaggaagaaatcgcagagctcaaggcggaacgaaataacacaaggctgctactggaacaccttgagtgtctggtaagtagacacgagagatccctgaggatgactgtggtgaaaaggcaggcccagtcacccggcggcgtatcttccgaggtcgaagtgctgaaggctcttaagtccttgtttgaacatcataaggccctggatgagaaggtgcgagaacgccttagaatggcacttgaacgggttgccgttctggaggaggagctggaactgtccaaccaggagacgctgaatctgcgagagcagctttcccgccggagatcaggcctcgaagagccagggaaggatggcgacggacagacactggctaacggtttaggcccaggaggcgactctaacagacgcacagccgaactggaggaagcgcttgagagacaacgggcagaggtgtgtcagcttcgggagagacttgccgtattatgtcggcagatgagtcagcttgaagaggaacttggcacagcacatcgagaactcggaaaggctgaggaggccaattccaaactgcagcgggacttgaaagaagcgcttgcacagcgagaggacatggaagagaggatcaccactctcgaaaaacggtacctatctgcgcagagagaggcaacatcgttacacgatgcaaatgacaagctggagaatgagctcgcttctaaagaatccctttacagacagagtgaggagaagagcagacagctcgccgaatggctggatgatgctaaacaaaaactccagcagacgctgcaaaaggccgaaaccctacctgagattgaagcacagttggctcaaagagtggccgcactcaacaaagcagaagagcgccatggcaatttcgaggagagacttcggcagctggaagcacagctggaggaaaagaaccaggagctccaacgagcgcgtcagcgggagaaaatgaacgacgaccacaacaaacgcttatctgagaccgtggataagctcctctccgaaagtaacgagagactgcaactccacctaaaggagcgaatgggggctctagaagaaaaaaattcccttagtgaggaaatcgcaaacatgaagaagctccaggacgaattgcttcttaacaaagagcagctgctggctgagatggaacgcatgcagatggaaatcgatcagctgcgtggccgtcccccttcttcctacagccgctcactcccaggcagcgctctggagctacggtatagtcaagcccccaccttaccctctggggctcaccttgacccgtacgtggccggtagtggaagagccggcaagcgcggccgttggagtggggttaaagaagagccgtctaaagactgggagcggtctgctccagccggaagcattccacctccattccccggagagctcgatggatccgacgaggaagaggcagagggaatgtttggagccgagctgctgtccccatccggccaagctgacgtgcagacattggctatcatgctccaagaacagctggaggctatcaataaagaaatcaagattatgtcactacggcggaaactagagctacacgaaggccgcggaaggccaagccaggagactccccatcatcccttaccagctcttcccgtcctcagagagtag

SEQ ID NO: 130945 - DNA, 4338 bp, Artificial Sequence
  Description of Artificial Sequence: Synthetic coding sequence
atgcgccggcttcttgagccatgttggtggatcctgtttctaaagattacaagctcagtactccactacgtcgtgtgtttcccagccctgactgagggctatgtgggagccttgcacgagaatcggcatggctctgccgttcagataagacgtaggaaagctagtggagacccctattgggcttattcaggcgcctacggacctgaacactgggtgaccagtagcgtgtcgtgcggcgggagacaccagtcacctatcgatatccttgatcagtacgcacgagtgggagaggagtatcaggagctgcagcttgatggttttgataacgaaagctctaataaaacctggatgaagaataccggaaagaccgttgcgattctcctgaaggatgactattttgtttccggagctgggctacctggtcgtttcaaagctgaaaaggtggaattccactggggccatagcaacggctcggccggtagtgaacatagtataaacgggcgtcggttcccagtggagatgcagatattcttctataatccggatgactttgattcctttcagaccgccatctccgagaataggatcattggagcaatggctatcttcttccaggtatcaccccgagacaatagcgcactggaccctataattcacggactcaagggagtggtgcaccacgaaaaggagacattccttgacccgttcgtgctgcgagatctactccccgcatccttagggagttactacagatacacaggaagtcttaccacaccaccatgctctgagatagtggagtggatcgtgttcagaagacctgtgcccatcagttaccatcaactggaggcattttattctatctttacaacagaacagcaggatcatgtgaagtccgtggaatacctgaggaataattttcgaccacaacaaagactgcatgatagagtggtgagtaagtccgcagtgcgcgactcttggaaccacgacatgaccgacttcctcgaaaaccccctgggaaccgaagccagcaaggtgtgctcatcaccacctatacacatgaaagtgcaacccctgaaccagaccgctcttcaggtgtcttggagccaacccgagacgatataccatcccccaatcatgaactacatgatcagttactcctggactaagaacgaagacgaaaaggagaagacctttaccaaagacagcgacaaggacttgaaggcgactatttcacacgtgagcccggattcactgtatttattccgtgtgcaggcagtctgcagaaacgacatgcgatccgacttcagccagacaatgctgttccaggcaaacaccacccgtatctttcagggtactagaattgtcaaaactggcgtgcccaccgcaagccccgctagctccgctgacatggctccaatttcctccggcagttccacgtggacctctagtggaatcccattctcattcgtctccatggccacgggaatgggtcccagcagcagcgggtcacaagccacggtggcctcagtggtgacctctactttgctcgctggtctgggcttcggggggggtggtatcagctcatttccctccactgtgtggccaacgcgactcccaacagctgcctccgcctccaaacaggccgctagacctgtattggccactactgaagccctggccagccctgggcctgatggagattcctcccccactaaagacggcgaagggaccgaagaaggcgagaaagacgagaagagcgagtctgaggacggagaaagggagcacgaagaggatggagagaaggattcagaaaaaaaagagaaatctggcgtgacccacgctgctgaagagagaaaccaaacagagcccagtccaacccctagtagccccaaccgtacggctgagggaggccatcagacgatccccggccacgaacaggatcatactgccgtacccaccgaccaaactggcggcagaagggacgccggaccaggcctggatccagatatggttacgtccacccaggtgccaccgaccgccacggaagaacagtatgcgggttccgaccccaaacggccagaaatgccgtccaaaaagcccatgtcaagaggggataggttctccgaggactccagattcatcactgtcaacccggctgagaagaatacctccgggatgatctcacggcccgctcccggacgcatggaatggattatccctctcatagtggtgagcgcattaacatttgtgtgtctgattcttcttattgccgtgctagtgtactggaggggctgcaacaagatcaaatccaagggattcccccgacgctttcgggaggtgcccagcagcggggaacggggagagaagggcagcaggaaatgtttccagacggctcatttttacgttgaggatagctcttccccccgtgtggtgcctaatgaatctatccccataataccaatacccgatgatatggaagccatccccgtgaaacagtttgtgaagcacattggcgaactgtattctaataaccagcacggattcagcgaagacttcgaagaggtgcagaggtgcacggctgatatgaatatcacagccgaacatagcaatcatccggaaaataaacacaagaacagatacataaatattctagcctacgatcattcccgtgtgaagctgcgcccattgcctggcaaagattcgaaacactccgactacataaatgctaattacgtcgatggctataacaaggcaaaggcctacatcgccacgcagggcccattgaagtctacgtttgaggacttctggagaatgatttgggaacagaacaccggtattattgtcatgataacaaatctcgtggagaaagggcggagaaagtgcgatcagtactggccaacagaaaattctgaggaatatggaaacataatcgtcacattgaaatctacaaagatccacgcgtgctataccgtccgccggttctccatacggaatacaaaagtgaaaaaagggcagaaaggtaatcccaagggcagacagaatgagcgggtggtgatccagtaccactatactcaatggccagatatgggcgttcctgagtatgccctgccagtcttaacgttcgtgagacggtccagcgcagcccgcatgccagagaccggccccgtcctggtccactgtagcgctggcgtgggcagaactggaacgtatattgttatcgactccatgctgcagcagattaaagacaaatcgacggtcaacgtactggggtttctcaaacacattagaactcaacgcaactacctggtccagactgaggagcaatacattttcatacacgatgcactgttagaagccatccttggaaaggagactgaggtcagcagtaatcaactacactcttacgttaatagcattcttatccctggggttggcggcaaaacacgcctggagaagcagttcaagttggtgacccagtgcaatgccaaatatgtggaatgcttctccgcacaaaaggagtgcaataaagaaaaaaaccggaatagttcggttgtgccttcagaaagggcccgggtaggtctggcccccctcccaggcatgaagggaacagattacatcaacgcctcttatattatggggtactacagatcaaacgagtttataattacccaacatccactgccccatacaaccaaggacttttggaggatgatctgggatcacaatgcccagatcatcgttatgctcccggataaccagagcttggccgaggacgaatttgtgtactggccatcgcgcgaggagagcatgaactgtgaagctttcaccgtcactctgatctctaaggatcgcttatgcctttctaacgaggagcagattatcatacacgattttatcttagaagcaacacaggacgattacgtcttggaagtgcgccactttcagtgccccaagtggcccaaccctgacgcacctatatcatccacattcgaactcatcaacgtaataaaagaggaagccctgactcgcgatgggcctactatcgtacatgatgaatacggagctgtaagcgctggaatgctatgtgcacttacaaccctgtcccaacaactggaaaacgagaatgctgtagatgtctttcaggtggcaaaaatgataaacctgatgcggcccggggtgttcactgatatcgagcaatatcagttcatatataaagcaatgctgagtctagtgtcaactaaggagaacgggaacgggcccatgacagttgacaaaaacggtgccgtgctgatcgcagatgagtccgatccagccgagtccatggaatccctggtatag

SEQ ID NO: 130946 - DNA, 309 bp, Artificial Sequence
  Description of Artificial Sequence: Synthetic coding sequence
atgcgccgcttgttggagccgtgctggtggattcttttccttaagatcacatcgtcagtcctgcattacgtcgtatgcttccctgcattaacagaaggctacgtgggtgccctccacgaaaaccgacacggcagcgccgtgcaaatccggcgccgcaaagcctcaggagacccatactgggcttactcaggcaagagtagctgcagtaatggcgaccataccggccaactgacctcccattccacacatttaaaggcccacttcgagagcctcctgtgtctatcctctgtctgtagtaatctcagttag

SEQ ID NO: 130947 - DNA, 2814 bp, Artificial Sequence
  Description of Artificial Sequence: Synthetic coding sequence
atggctggagcggggggcgggcttggtgtgtgggggaacctggtgctgctcggcctgtgtagctggaccggagctcgcgctcccgctcccaatccgggtaggaatttgacggtggaaactcagacaacttcctctatctcgctgtcatgggaggtgcctgacggtctagattctcagaacagcaattactgggtacagtgcacaggagacggaggcacaactgaaactcgcaataccactgccactaatgtgactgtggacggcttggggccaggatctctgtatacttgttcggtgtgggtggagaaagacggtgtaaactcgtctgtaggaacagtgacaacggcaaccgcccctaatccagtcagaaacctaacagtcgaagcccaaacgaattcatcaattgctctgacttgggaggtccccgatgggcccgaccctcagaattcaacctacggcgtggagtacactggcgacggcgggagggcagggacccggtcaactgcccacacaaatatcacggtagaccgcctcgaaccaggttgtctgtacgtgttctcagtctgggtgggtaagaacgggatcaatagctcgcgtgagacacgcaatgccaccacagcccctaatccagttcggaacctgcacatggagacacaaacgaattcctcaatcgctctctgctgggaagtgcccgacggcccctacccccaagactatacttattgggtggaatatacaggagacggcggagggacagagactaggaacacaaccaacacctcagtgaccgccgagagactggagccaggcacactgtatacgttttcggtctgggccgagaaaaatggggcacgcggctcccggcaaaacgtgagcatctcgaccgtcccaaatgcagtgacgtcactgtcaaagcaggattggaccaatagtaccatcgctctccgctggacagctccccagggtccaggacagtcatcatactcttattgggtttcctgggtgcgggagggtatgacagatccccgaacacagagcactagtggaacagatataacactgaaagaattagaagccggaagtttgtatcacctcacagtgtgggccgaacgaaacgaggtacgcggatataactcaactcttaccgcagccactgcccccaacgaagtgacggatcttcagaatgagacgcaaaccaaaaattcagtgatgctgtggtggaaagccccaggggaccctcactctcagctctacgtgtactgggtgcagtgggcctccaaggggcacccccggaggggacaagaccctcaagctaactgggtcaatcaaactagcagaactaatgagacctggtataaggtcgaagccctggaaccaggaacgctgtataactttacggtgtgggccgaacgcaacgacgtggcctcctccacccagtcactatgtgcctcaacttaccctgacactgtgaccatcacctcgtgcgtgtccactagcgctggctacggcgtgaatctaatttggagctgtccccagggcggatatgaggcgtttgagctggaagtcggaggccaaagagggagtcaggacagatcctcttgcggtgaggctgtgagtgtgctgggtctcgggcccgctagatcttacccggccactatcactactatttgggacggtatgaaggttgtgagccactccgtggtgtgtcatacagagtcagccggagtgatcgccggggcgttcgttggcattctgttattcctgatactggtcggacttctgatcttctttctgaagcgaagaaataagaagaaacagcaaaaacctgaattacgggacctggttttttctagtcccggagatataccagctgaagacttcgcagaccatgtgcgaaaaaatgaacgcgactcaaattgcggattcgcagataagtatcagcagctgtcgcttgtaggtcacagccagagtcagatggttgcctcagcatccgagaataatgctaagaaccgatatagaaatgtgctgccttacgactggtctagagttccactaaagcctattcatgaggagccaggctcagattacatcaacgcctctttcatgccaggactttggtctccacaagagttcattgccacccagggcccactcccccagaccgtgggcgacttttggcggctggtatgggagcaacagagccacacactcgttatgcttactaattgcatggaagccggccgagtgaagtgtgagcactattggcccctggacagccaaccctgtacacacgggcacctcagggtgaccttggtcggagaggaggtgatggaaaactggaccgtaagggaactcttactgctccaggtcgaggaacagaaaacgttgagtgtccggcagttccactatcaggcctggcccgaccacggcgtaccatcttctcccgacacactcttggccttttggaggatgcttcgacagtggttagaccagaccatggaaggaggccctccaatagtccattgctccgcaggcgtaggaaggacgggaacgctcatagcccttgacgtccttctgaggcagcttcagagcgagggtctgctcggtcctttcagcttcgtccgcaagatgagggaatcccgccccctcatggtgcagaccgaagcccagtatgtgttccttcatcaatgcattctgagatttctgcaacagagcgctcaggctcccgccgagaaggaggtcccctatgaagatgtggagaacctaatttatgagaatgtagctgcgatccaggctcataaactggaggtgtag

SEQ ID NO: 130948 - DNA, 3348 bp, Artificial Sequence
  Description of Artificial Sequence: Synthetic coding sequence
atggcaggcgccggcggtggattgggagtgtggggtaaccttgtgttgttgggactatgctcatggaccggggcaagggcacccgccccaaacccaggacgcaacctaacagtggaaactcaaactacctcttcgatctccctcagttgggaggtgcctgatggactggattcccagaactctaattactgggtgcagtgcacgggtgatggggggacaacagagaccaggaacacaaccgccaccaacgtgactgttgatggcctgggaccagggtccctgtacacctgctcggtctgggtcgagaaggacggtgttaactcaagcgttggcaccgttactactgccaccgcccccaatcctgtgagaaatctgagagtcgaggcgcagacaaattcctcaattgcactgacttgggaagtgccagacggccctgacccgcagaatagtacttacggagtggagtataccggggatggcggccgagcaggaacacgaagtaccgcccatacgaacattacagtggatgggttggagccagggtgtctctacgcttttagcatgtgggtgggcaagaatggtatcaactccagcagggagacaaggaacgcaaccactgcgcacaaccctgtgcgaaatttacgggtggaggcccaaactaccagtagcatttctctgtcctgggaggtccctgacggaacagacccgcaaaactcaacttattgtgtccaatgcaccggagatggcggccggactgagactcggaacaccactgacacaagagtgacagtcgacggcttgggccccggcagtctctacacgtgcagcgtgtgggtggagaaggatggcgtgaattcttccgtggaaattgtcacttccgctacagcccctaaccctgtgcgcaacctgactgtcgaggctcaaaccaactcctcaattgctctgacatgggaagtccccgatgggcccgacccccagaacagtacctatggggtcgaatacaccggcgacgggggtagagcagggacgaggagtactgcccataccaacataacagtcgacaggctggagccaggttgtctgtatgtctttagtgtgtgggtgggcaaaaacggaatcaatagttcccgggaaacaagaaacgctaccactgccccaaatcctgttcgaaacctgcatatggagacgcagacaaattcttccatcgccctctgctgggaggtaccggacggaccctatcctcaagactatacatactgggtagagtatacaggcgacggaggtgggacggagactaggaacacaacgaatacttccgtgacagccgaacgactggagcccggtactctgtatacgtttagtgtctgggctgagaagaatggtgctcggggctccagacaaaatgtgtccatttcaacagttcctaatgcggtgacttctctcagtaaacaggattggacaaactccaccattgctctacggtggaccgctccacaaggcccgggccagtcttcctacagctactgggttagctgggtgagggaggggatgactgaccccagaacacagtcaacaagtggcacggatatcactctgaaggaactcgaggccggctcactttatcacctgacagtctgggctgaacgcaatgaagtgcgaggctataatagcactcttaccgcggctaccgctcctaatgaagtcacagatctccaaaatgagacacagactaaaaatagcgtcatgctgtggtggaaagcaccaggcgacccgcattcacagctgtatgtgtactgggtccaatgggcatccaaaggacatccacgtcgggggcaggatccacaggccaactgggtgaaccaaacctcccgaaccaatgagacttggtataaagtcgaggccttagaacccgggactctgtacaacttcactgtttgggccgaacgtaacgatgtggcctccagtacacagtctctgtgcgcttctacataccctgataccgtaaccattacctcctgtgtgtcaacatctgccgggtatggtgtgaacctgatctggagctgcccccagggcggctacgaggcattcgagctggaggtgggtggtcagcggggtagccaggaccgctcaagttgcggtgaagcagtttccgtcctgggactgggtcccgcgaggagttatcccgccactattaccacaatttgggatggcatgaaggtggtctcccatagtgtggtttgtcataccgagagtgccggtgtgattgcgggcgcattcgtgggaatccttttgttcttaatactggtggggctgcttatcttttttctgaaacggagaaataaaaaaaagcagcagaaacctgagctacgggatctcgtgttcagctcacctggcgatatacccgctgaggatttcgcggatcatgttcgcaaaaacgagcgggatagcaattgtgggtttgccgacaagtatcagcagctgtccctggtcggccacagccagtctcaaatggtggcaagtgccagtgagaataatgcaaaaaacaggtaccgcaacgtgctcccatatgactggagtcgagtgccactcaagccgattcacgaggaacctgggtctgactacatcaatgccagcttcatgcctggtctctggagcccacaagaattcatcgctactcaggggcctttacctcagaccgttggcgacttctggcgactcgtctgggaacagcagtcccatacgctggtaatgttgacaaattgcatggaagctggcagggtaaagtgcgagcactactggccactggacagccaaccatgtacccatggacatctccgggtgaccctcgtgggagaggaggtgatggaaaactggacagtgcgggaactgttgcttctccaggttgaggagcagaagacactgagcgtgagacagttccactaccaagcctggcccgaccacggtgtcccttcaagcccagatacattgctggccttttggcgtatgctaaggcagtggctcgatcagaccatggaggggggacctccgatcgtgcactgctccgccggcgttgggagaaccggcacacttatcgcattggatgtgctgctgcggcagctccagagtgaagggctgctgggacccttctccttcgtgagaaagatgcgggagtcccggcctctgatggtgcagactgaggcccagtatgtttttttgcaccagtgtatcttgcgattcctgcagcagagcgcccaggctccggccgagaaagaagtcccttatgaagatgtggaaaacttgatatatgaaaatgtggccgctatccaagcccataaattggaggtgtag

SEQ ID NO: 130949 - DNA, 1278 bp, Artificial Sequence
  Description of Artificial Sequence: Synthetic coding sequence
atgaaaccagccgcgcgggaggcgaggcttccaccacgcagccccggtctgagatgggccctgccattactgctcctgcttctccggttgggccagattctgtgcgctgggggcacccctagtcccatccccgatccatcagttgctactgttgctacaggggagaacggaattacccagattagttctactgccgagtcatttcacaagcaaaatgggaccgggactccgcaggtggagaccaatacctcagaggatggtgagagctctggagcaaatgacagcctgagaactccggagcagggctcgaatggcaccgatggggcttctcagaaaacacccagcagtacgggcccgtctcccgtgtttgatatcaaggcagtaagcatctcaccaacaaatgtaatcctcacctggaagtctaacgacactgcagcctcagaatataaatacgtggtcaagcacaaaatggaaaatgagaaaacaataactgtggtgcaccaaccctggtgcaacattaccgggctgcgccccgctacaagctacgttttctctattacccctggaatcggaaatgaaacctggggagacccaagggtgattaaggtcatcacagagcctatccctgtgtcagacctcagggtggctctcaccggcgtacgaaaagcggccctctcatggagtaacggtaatggcactgctagctgtcgggtgctgttggagagcatcggcagccatgaggagcttacccaagacagtcgtctgcaggttaacatctcagggctaaagcctggagtgcagtacaacatcaatccttatctattacagagcaacaaaacgaaaggcgacccacttggcactgaggggggactggatgcttctaataccgagcgctctcgcgccggaagtcccactgcccctgtacacgatgagtctctggtgggcccagtggatcccagcagcggccaacagtctagggacactgaagttctcctggtgggcctcgagcccgggacccggtataacgccacagtgtactctcaggccgctaatggaaccgaagggcagccacaggccattgaatttagaaccaacgccatccaagtgtttgatgtgactgccgttaatatttcagccacgtccttgacactgatatggaaggtgagtgataacgagtcctctagcaattatacatacaagattcatgtggcaggcgagacggattcctccaatctgaacgtgtccgaacccagagccgtcattcctgggctacgctag

SEQ ID NO: 130950 - DNA, 4014 bp, Artificial Sequence
  Description of Artificial Sequence: Synthetic coding sequence
atgaagcctgcagcccgagaggctcgactccctcctcgatccccgggtctccggtgggcactgcccttgctgctgctccttctacgactaggacagatactgtgcgcaggagggacacccagtcctattcctgacccctccgttgcgactgtagcaacaggggagaacgggattactcagatctcaagcactgccgagagcttccacaaacaaaacggcaccggtaccccacaggtcgagaccaacacaagcgaagatggagaatctagtggcgctaatgactcccttcggacacctgaacagggttccaacggtaccgatggtgcatcccagaagaccccctcttcaactgggcctagccctgtctttgatatcaaggcagtgtctatcagccccacgaacgtgattctgacatggaagtcaaacgataccgccgcatccgaatataagtatgtggttaaacataagatggagaacgaaaagacgatcactgttgttcaccagccttggtgcaacatcactggcctgaggcctgccacctcctacgttttctccatcacgcctgggatagggaatgaaacctggggggatcctcgggttatcaaggtgattacagagccaattccagtatccgacctgcgcgtggcactgaccggcgtgcggaaagccgctctctcttggtcaaatggtaatggaactgcctcctgtagggtcctgttagagtctataggctcccatgaggaattaacccaggattcgagactgcaagttaacatttccggattgaaaccgggggtgcagtataatattaatccatatctgctgcagtctaataagacaaagggagaccctttaggcacggagggggggctggacgcttccaataccgagcggtcccgcgcaggttcgcccaccgcaccggttcacgacgaatcgctggtcgggccagttgatccttccagcggccagcaatccagagataccgaagtgctgcttgtcggcctggagcctggcactcggtacaatgccacggtgtattcacaagctgcaaacggaaccgaaggccaaccgcaagctattgaatttcgcacaaacgccatccaggtgtttgacgtaaccgccgtgaatatctcggccacctccttgacactcatctggaaggtgtcggataatgaaagcagcagcaattacacttacaaaatccacgttgctggtgaaaccgactcgagtaatctaaacgtctcagagcctcgcgcggttatcccaggccttagatcgtcaacgttctacaacatcacagtttgccccgtgctgggagacattgagggtactcccggattcctacaggtccacactccacctgtccctgtctctgacttcagggtgactgtggtcagcaccactgaaattggactcgcttggagttcccacgatgccgagagctttcaaatgcacattacccaggagggagccggcaactcacgggtggaaattaccacaaaccagagcataataatcggcggcctctttcctgggactaagtattgttttgaaatcgtgccaaaagggcctaatgggacagaaggagcttccagaacagtgtgcaacagaacggttccttcagccgttttcgacattcacgtggtgtacgttaccaccaccgagatgtggttagactggaaaagccctgacggagcaagtgagtacgtttatcacctggtgatcgagagcaaacacggcagcaaccatacatccacctatgataaagctattacactgcagggtcttattcccggaaccctttataatatcaccatttcccctgaggtggaccacgtttggggagaccccaactcaacggcgcagtatacaaggccaagcaacgtttccaatatcgacgtgagcaccaacacgaccgcagccaccttaagttggcagaactttgacgatgcgagccctacctattcatactgtcttctgattgaaaaagccggtaactcaagcaacgctactcaggtggtgaccgatatcgggatcaccgatgcgactgtgacggaactgatccccggcagtagctacacggtggagatcttcgcacaggtcggggacggtataaagagtctcgaacctggacgaaaatccttctgcaccgatcccgccagtatggccagttttgattgtgaagttgtgccaaaggagcctgcactggtcttgaagtggacttgtcctcctggggcaaatgcagggttcgaactcgaagtctcttcgggggcgtggaacaacgcaacccacctggagtcctgctctagtgaaaatggcacagaatataggaccgaggtcacctatctgaacttctccacatcttacaatatctccattaccaccgtctcctgcggcaaaatggcagctcccactaggaatacctgtacgactggaatcacggatcccccaccccctgacggttcacccaatattacgtcagtaagccataacagcgttaaagttaaattctccggcttcgaggctagtcacggcccaatcaaggcgtatgctgtaatattaaccaccggggaggccggacacccaagtgccgatgtgctgaaatacacttatgaagacttcaagaaaggcgccagtgatacctatgttacgtatctgatccggaccgaagagaagggaaggagccaaagcctgtcggaggtgctcaagtatgagatagacgtgggcaatgagtcaacgacacttggttactacaatggaaaacttgagccgctgggctcttatcgcgcatgtgtcgctggttttacgaatatcaccttccatccacagaataaaggactcatcgacggggctgagtcctacgtgtctttcagccgctactccgacgcagtctccctgcctcaggatcccggagtcatatgcggtgccgtgtttggctgtatttttggagccctggtaatcgtgaccgtgggaggtttcattttctggagaaagaaaaggaaagacgctaagaataatgaagtgagtttcagtcagatcaaaccaaaaaaatcgaaacttatcagagtcgagaacttcgaagcttatttcaaaaagcagcaagccgatagtaattgtggttttgccgaggagtacgaggacttaaaactggtgggcattagccagcccaagtatgcagcggagctcgctgaaaacagggggaaaaaccgatacaacaacgttttgccctacgatatttctcgggtgaagctgtcagtgcagactcattctacagacgactacatcaacgcgaattacatgcccggctaccacagtaaaaaggacttcatcgctacacagggtccccttcccaataccttgaaggatttttggcgaatggtttgggagaagaacgtctacgctattataatgttgactaagtgcgtagagcaaggacgaacaaaatgcgaagaatattggccatccaaacaagcgcaggactacggagatattacagttgccatgacatcggagattgtcctaccagaatggaccatccgcgatttcaccgtaaaaaacatacagacaagtgaatcacatcctcttcggcagttccattttacctcgtggcctgatcacggagtgccagatacaaccgatttgttaataaactttaggtacctggtccgcgattatatgaaacagagtccacctgagtcccccatacttgtgcactgctccgccggagtcggccggacagggacgtttattgcaattgatagactgatttatcagatcgagaacgagaacaccgtggatgtatatggcatcgtgtacgatttgagaatgcaccgtcccctcatggtgcagaccgaagaccagtacgtctttttaaaccagtgtgtacttgacattgtccggtctcagaaggattccaaggttgatctcatctatcaaaatacaactgccatgacaatctacgaaaatcttgcccctgtcactacatttggaaaaacaaatggctatattgcttag

SEQ ID NO: 130951 - DNA, 1620 bp, Artificial Sequence
  Description of Artificial Sequence: Synthetic coding sequence
atgaagcccgccgcccgggaagcaaggttgccaccccggagccccggtttgcgctgggcactccctttgttgttgttgcttctcagactcggccagatactctgtgccgggggtacccctagtccgattccagacccctctgtggccaccgttgcaaccggagagaacggcattacccagattagcagcacagcggaaagtttccataaacaaaatggaaccgggacgccccaggtggagaccaatacaagcgaggatggggagtctagcggcgccaacgactccctaaggactcctgaacaggggtccaacgggacggacggagcatctcagaagaccccctcttctacagggccttcacctgtcttcgacattaaagctgtgagtatttccccaacaaacgttatcctgacctggaaatccaacgatactgccgccagcgagtataagtatgtagttaagcacaagatggagaacgagaagaccatcactgtggtccatcaaccatggtgtaatatcactggactgcgaccagcgacaagttacgtgttcagcatcaccccaggtatcggcaatgagacatggggagatcccagggtgatcaaggtgatcaccgaaccgatccccgtgtccgatcttagagtagcattaaccggcgtgagaaaggcagccttgtcgtggtcaaatggtaatggtacagcctcatgtcgagtgctgctcgagtcaataggatctcacgaagaactgacacaggattcccgcttgcaggtcaatatttccgggcttaagcccggagtgcagtataatatcaacccctatctcctgcagagcaacaagaccaaaggcgaccccctgggcaccgaaggagggctggacgcctctaacaccgaacggtccagagccgggtcccctaccgctcctgtacacgacgagtcactcgtgggtcccgtggatccctcatctggacagcagtcccgcgacactgaggtgctgttggtgggactggaacccggcacacgttataacgcaacagtgtactcccaggctgcaaatggaactgaggggcagccgcaggccatcgagtttcggaccaacgcaatccaggtctttgatgtaactgctgtgaacatttccgccacctccctgactttaatttggaaggtcagcgataacgagagttcatcaaattatacctataaaattcacgttgctggcgagacagattcctcaaatctgaacgtgtctgaacctcgcgcagtcattcccggcctgaggagttccacattctataatataactgtgtgtcccgtgctgggagacattgagggcacacccggatttctacaggtgcacacgccacccgtccctgtgtccgactttcgcgtgaccgtggttagcaccactgagattggccttgcctggtcaagccatgacgcggagagctttcagatgcatataactcaggaaggtgcgggaaattctcgcgtggagattactactaaccaaagcattattattgggggcctttttcctgggacgaagtattgctttgaaattgtgcccaagggacctaacgggactgagggggcatcccgaaccgtttgcaacagaacggggtag

SEQ ID NO: 130952 - DNA, 4419 bp, Artificial Sequence
  Description of Artificial Sequence: Synthetic coding sequence
atggatactaccgccgccgccgcccttccagcattcgttgcactgctgctgctgtccccctggccactactggggtctgcacaaggtcagtttagcgccgggggctgtacatttgatgacggtcctggggcgtgtgattaccatcaggacttgtacgatgacttcgagtgggttcacgtatcagcccaagagccccactacctgccgcctgagatgccccaaggaagctacatgatcgtcgattcttccgaccacgaccctggggaaaaagcccgtctgcagctacctacaatgaaggagaatgatacccattgcattgactttagctatctgctctattcccaaaaaggccttaatcccgggactctgaatattctggtgcgcgtgaacaaaggcccactcgccaatcctatctggaacgtaaccggatttacggggcgcgattggctcagggcggagttggcagtatccaccttctggcctaacgagtaccaggtgatatttgaagccgaggtgtctggagggcgctctgggtacatcgcaatagacgatatccaggtcctttcttatccgtgtgataagtcccctcactttttgcgattgggcgacgttgaggtgaatgccggacagaatgctacctttcagtgcatcgcaaccggacgggacgcagtccataataaactgtggctccagaggagaaacggcgaagacattcctgtggctcagacaaaaaacataaatcaccgacgttttgcagccagcttccgtctgcaggaagttactaaaactgatcaagatttatatagatgtgtcacacagtccgaaagagggagtggcgtttcgaacttcgcccagctgatcgtgcgggagcctcctcgacccatcgctcccccccagctgctcggcgtggggcccacttatctgctgatacagctgaatgcaaattcaattatcggggacggccctattatcctaaaagaggtagagtataggatgacctcgggatcttggacagagacacacgcagtgaacgccccaacctataaattgtggcacctagatcccgacaccgaatacgagatacgtgttcttctcactaggcctggtgagggtggcaccggcttgcctggccctccactcattacccgcaccaagtgcgcggaacctatgaggaccccgaagactctaaagatcgccgaaattcaggcccgtcgcatcgccgtggattgggaatccctcgggtataatatcacaagatgccacacctttaatgtcaccatctgttaccattactttagaggccacaacgagtccaaagcagattgtctggacatggatccaaaggcaccccagcatgtggtgaatcacctgcctccctataccaacgtgtcacttaaaatgatactgacaaatcctgaggggcggaaggaatccgaggaaaccataatccagacagatgaggacgtaccaggcccagtccccgttaagagtctgcaaggcacatcttttgaaaataagatttttctcaactggaaggaacccctcgaccccaacggtattatcactcagtatgagatctcctactctagcattcgctctttcgacccagccgttcccgtggcaggtccgcctcagaccgtcagcaacctgtggaactcaacccatcatgtgtttatgcacctgcaccccggcacgacatatcagttttttatccgtgccagtacagttaagggttttgggcctgccaccgccatcaacgtcaccaccaacatttcagccccgaccttgcctgactatgaaggagtagatgcgtccctgaacgaaacagctaccacaattacagtcctgctgcgacctgcacaagcaaagggggcccctataagcgcgtatcagattgtggttgaggagctgcaccctcatagaaccaagagagaggctggtgccatggaatgctaccaggtgcctgtgacgtaccagaacgccatgagtggcggagccccctactatttcgccgccgagcttccacctgggaatctcccagagcccgcgcctttcactgtaggagacaatagaacataccagggcttttggaatcctcctttggcgcccaggaaaggctacaacatctacttccaggcaatgagtagtgtggaaaaagagaccaagacacagtgtgtcagaatcgccaccaaggccgcagcaaccgaggagccagaagtgattcctgatccagctaagcagaccgatcgcgtggtgaaaatcgccgggataagcgcaggcattctggtgtttattttgcttttgctggtggtgattttaattgtgaaaaagcggcgcagctactactcatattcatattacctcaagctagctaaaaaacgcaaggacgctatggggaatactcgccaagaaatgacccatatggtgaatgccatggacaggagttacgctgaccagagtaccctgcacgcagaggaccctctttctatcacttttatggaccagcacaacttcagcccccgcttacccaacgatccacttgtgcccactgcagtgctagtgcctatcactgacgagaaccactccgctacagccgaatctagccggctgctggacgtgccgagatacctgtgcgaggggacggagtctccttaccagactggacagctgcacccagcgatacgggtggctgatttgttgcaacatattaatttgatgaaaacttcagatagctatggatttaaagaggagtatgagtccttttttgaaggacaatctgccagttgggacgtcgccaaaaaggaccagaatcgcgcaaaaaatcgttacgggaatatcattgcttacgatcatagcagagttattttacaaccagtggaagacgatccctcttccgattacatcaatgcaaactacattgatatatggctgtatcgcgatgggtaccagagacccagtcactacatcgctacccaaggacctgtacatgagacggtctacgacttttggaggatgatttggcaggaacagagcgcctgcatcgtgatggtgactaacctggtcgaggtgggaagagtcaagtgttataagtattggcctgacgacaccgaggtatatggagacttcaaagtcacttgtgtcgagatggagcctctggcagagtatgttgtgcgcacctttactttggagagacgcggctataatgagatccgagaggtcaaacaattccacttcaccggatggcccgatcatggggtcccttatcacgctactggcctcctgtcctttattcggagggtcaaactgtctaacccaccctctgcgggtccaatcgtagtgcattgctccgccggtgctggtagaaccgggtgctacattgtaattgacattatgttggatatggctgaaagagagggagtggtcgacatctacaattgtgtgaaggccctgaggagtaggaggatcaacatggtacagactgaggagcaatacatattcatacatgatgcaatccttgaggcatgcctgtgcggcgaaacagcaattccagtctgcgaattcaaggctgcatattttgatatgattcgaattgactctcaaacaaattcttcccacctgaaggatgaattccaaactctgaacagcgttacccctagactccaagctgaagattgttctattgcttgtctgcctcgcaatcacgataagaatcgtttcatggacatgctccccccagaccgttgtctgccattcctcattaccatagacggcgagagcagcaactatatcaatgctgctttgatggatagctaccgtcagcccgcggcttttatcgttactcagtatccactgcccaacaccgttaaggatttctggcgcctggtgtacgactacggttgtacatctatcgttatgcttaatgaagttgacttatcccaaggctgtccacaatactggcctgaagagggcatgttacgctatggtccgattcaagtagagtgcatgagttgcagtatggactgcgacgtcataaaccgcatttttcgtatttgcaatctcaccaggcctcaagaaggctacttaatggtgcagcagttccagtacctgggttgggccagtcacagggaggtccccgggagtaagagatcctttttaaagttaattttacaggtggaaaagtggcaagaggaatgtgaagagggtgaagggaggacaatcatacattgcttgaatggagggggccgctctggcatgttttgtgccattggaatcgtcgttgagatggtgaaacggcagaatgtggtggatgtgttccacgctgttaagacgctgagaaattcaaagccaaatatggtcgaagctcccgagcagtaccgcttctgctacgacgtggccctcgaatatttggagtccagctag

SEQ ID NO: 130953 - DNA, 4377 bp, Artificial Sequence
  Description of Artificial Sequence: Synthetic coding sequence
atggacacaaccgcagccgcagccttacccgcctttgtcgcgctgctgctcttaagtccatggccgctactgggatccgcgcaaggacaattttcggcaggagggtgtacatttgacgatggccctggagcatgtgactaccaccaggatctttacgacgattttgagtgggtgcacgtgtcagctcaggagccccactatttgccccccgagatgccacagggatcatacatgattgtggattcatctgatcatgacccaggcgagaaggctagacttcagttgccaacaatgaaggagaatgatactcactgcatcgacttcagttatctcttatattcgcaaaagggcctgaatccgggcactctaaacatactggtccgggtcaataaaggacccctggctaatcccatatggaatgtgacaggatttaccgggcgcgactggctgagggcagagcttgccgtctccacgttctggcccaacgagtatcaggtgatcttcgaggcagaagtatccggtgggaggtcaggttacatagcgatcgatgacatacaggtgcttagctacccgtgcgacaaaagcccacatttcctgcggctgggcgatgtggaggtcaatgccggccagaatgctacctttcagtgtattgccacaggccgggacgccgtacacaacaaactctggttgcagcgccggaatggcgaagatatcccagtggcccagaccaagaatatcaatcacagaaggttcgcagctagctttcggctgcaggaggttacaaaaactgatcaggacttgtatcgatgtgttacccagagtgaacgggggagcggtgtatccaactttgcccagctcatcgtcagggaaccacccaggccaattgctcccccgcagctgttgggcgtggggcctacatacctgttgatacaactaaatgctaacagcatcataggggacggcccgatcatcctaaaagaagtggagtacagaatgaccagcggttcatggactgaaactcatgctgtaaacgcccctacatataagttgtggcacctggatcccgacacagagtacgaaatcagggtactcctgacacgccctggagaaggtggcacaggactgcccggtccccccctaatcactcgaaccaaatgtgctgagcctatgaggacaccaaaaacgctgaagatcgccgagattcaagcgcgccgtattgcggtggactgggaatcactgggctacaatatcacccggtgtcacacgtttaatgtgactatatgttaccactatttccgtgggcacaatgagtctaaggctgattgcctggatatggatcccaaagcgccgcaacacgtggtgaaccacctgcccccctacacaaacgtgagtcttaagatgatactcaccaaccccgaggggcggaaggagtctgaggagactatcattcagactgatgaggacgtgcccggcccagttccggtgaaaagtctgcagggaaccagctttgaaaataagatctttttgaactggaaggagccactggaccctaacggcattatcacccagtacgagatatcttattcatcaattcgctcctttgacccagcagtcccggtggcaggcccaccacagaccgtgagcaatctgtggaattcaactcatcatgtgttcatgcacctacatcctgggacgacataccagtttttcattagggcctcaaccgttaaaggatttggtcctgccacggccattaatgtcacgactaatatcagtgcgcccactctccccgactacgagggagtggatgccagtctaaacgagaccgctaccactattacggttttgctccgcccagcccaggccaaaggcgctccaatctccgcctaccagattgtggtagaagagttacaccctcatagaaccaagagggaggcaggcgcaatggagtgctaccaggtgcctgtgacataccagaatgctatgtccgggggtgcaccatattattttgcggcggagttgcctcccggcaacctacccgagcccgctcccttcaccgtgggcgacaatcggacctaccaggggttctggaacccacctctcgctccccgaaaaggttacaacatttacttccaagctatgagcagcgtggaaaaagagaccaaaacgcaatgcgtgcgaatagccaccaaggccgctgctaccgaggaacctgaggtaatcccggatcccgccaagcagaccgacagagtggtcaaaatagccggcatctcagccggtattctggtgtttattctcctcctgctcgtcgtgattcttatcgtcaagaaatctaaactggctaagaagagaaaagatgcaatgggcaataccaggcaggagatgacacacatggtgaatgcaatggacaggtcttacgccgatcagtctacactgcatgctgaggatccgcttagcataacctttatggaccagcacaattttagtccaaggctgccgaatgatcctctagtgccaaccgctgtgctggacgaaaaccactcggccacagcagaaagctctaggctgctagatgtacccaggtatctgtgcgaggggactgagtccccatatcagacgggccagctgcatcccgccatcagagtagctgatctcctgcaacatattaacttgatgaagaccagcgactcctatggcttcaaagaagaatacgaaagtttttttgaaggacagtctgcctcctgggatgttgccaaaaaagatcagaatcgtgccaagaatcgctatggcaatattattgcctacgaccattctagggtgatactccaaccagtggaggatgacccatcatctgattacattaacgcgaactacatcgacatctggctgtatcgcgatggataccagcggcctagccattacatcgctacacaaggtcccgtgcacgagaccgtgtacgacttctggcgaatgatatggcaagaacagagtgcttgcattgttatggtgactaacctcgtggaagtcggacgagtgaagtgctataagtactggcctgacgatacagaggtttacggcgatttcaaagtgacgtgcgtggaaatggagcccttggccgagtacgtggtaagaaccttcaccctggaacgacgcggatacaatgagatcagggaggtgaagcagttccatttcaccggatggcccgatcacggcgtaccctaccacgccaccggactgctttctttcattcgccgagtgaagttgagcaatcctccatctgcaggccccatcgtagtgcactgcagtgctggagcagggcgtaccggatgttacattgtgatagacatcatgttggatatggccgaacgagagggtgtagttgatatatacaactgcgtgaaggccctgagatctcggcggataaacatggtccagacagaggagcagtacatattcattcacgacgccatccttgaggcatgtctgtgcggggagaccgccatcccagtctgtgaatttaaggcggcctactttgatatgattcgaattgacagccagaccaattctagtcacctgaaggatgagttccagactctgaacagcgtgacccccaggctgcaggctgaagactgctctatagcctgtctcccccgtaatcacgacaaaaaccgcttcatggatatgctgccgcccgatcggtgtctgcccttcctgatcaccatcgacggggagtctagcaattacatcaacgcagcgctgatggatagttaccggcagcccgccgccttcattgtgactcaatatcccctccccaacacagtgaaggatttctggcgtttggtttatgattatggttgtacgtctattgtgatgctgaacgaagtggatttatctcaggggtgtcctcagtactggccagaggaaggcatgcttcgttatggtcctattcaggtcgaatgtatgtcctgtagcatggattgtgatgtgattaataggatatttaggatatgcaacctgacccggccccaggagggatacctcatggttcaacagttccaatatttgggatgggctagtcaccgagaagtgcccgggtcaaagaggtcttttctgaaactcatattgcaggtggagaagtggcaggaagagtgcgaggagggagagggtcgtactataattcattgtttgaacgggggcgggcgctccggaatgttttgcgctatcggaatcgtggtggagatggtgaaaaggcagaacgttgtggatgtattccacgccgtgaaaacactccgcaactccaagcctaacatggtggaggcaccagaacaatataggttctgctacgatgtggctttggaatatctggaaagcagctag

SEQ ID NO: 130954 - DNA, 4341 bp, Artificial Sequence
  Description of Artificial Sequence: Synthetic coding sequence
atggacacaactgctgccgccgccctcccggcttttgtggctctactgctcttgtccccttggcccctgctcgggtctgcacaggggcagttctccgccggaggttgcacatttgacgatgggcccggagcctgtgactaccaccaggatttgtacgacgatttcgagtgggtgcatgtgagcgcccaagagccccactacctgcctcctgagatgccacaggggtcctatatgatcgttgattcgtcagaccatgaccccggggaaaaggctagactccagctgcccacaatgaaggagaacgacactcattgcatcgacttcagctacctgctgtatagtcaaaagggtctgaaccccggtacacttaatatactggttcgtgtgaacaaaggcccactcgcaaacccaatttggaacgttaccgggtttactggccgggactggcttcgggcagaactggctgtgtctaccttttggccaaacgagtaccaggtgatatttgaggcagaggtgagcggtggcaggtccgggtacatcgctatagatgacattcaggttctcagttacccgtgcgacaagagtcctcactttctgcgactgggcgacgtagaagttaacgcgggccagaacgccacgttccagtgtatagccaccggtcgtgacgccgttcacaataaactttggctgcagcgtagaaatggtgaggacatacctgtcgcgcagaccaagaacatcaatcatagacgcttcgccgcgtcctttcggctgcaggaagtgactaagactgaccaggacctctaccgttgtgtgacacagtctgaacgcggcagtggggtttccaatttcgcacagctgatcgtgagggaaccaccccgacccattgccccaccccaacttctcggggtgggcccgacctaccttcttatccagctgaacgccaactcgattatcggagacggacctattatactgaaggaagttgaatatcggatgacatctggatcctggacggaaacgcacgccgtgaacgcccccacctacaaactgtggcacctcgacccagacaccgagtacgagattcgcgtcctgctgaccaggcccggcgaggggggcacaggcttgcccggaccgccactgattactaggacaaagtgcgctgaaccgatgcgcacacctaaaacactgaaaatcgccgagatccaagctcggagaatcgccgttgactgggagagccttggatacaacattacccgctgtcataccttcaacgtgaccatctgttaccactatttccgtggtcataatgaaagtaaggccgattgccttgatatggatcccaaagctccgcagcatgttgtcaatcaccttcccccctatacaaatgtcagcctgaagatgatcttgactaacccggaggggcgcaaggaatccgaagaaacaattatacagaccgacgaggatgtgcctgggcccgtccccgtaaaaagtctgcagggtacctctttcgagaataagatttttctgaactggaaagaacctcttgacccaaatggcatcattacacagtacgaaatctcatatagttctatccgctcattcgaccctgccgtgcctgtagcaggacccccccagaccgtgtcaaacctctggaatagcacccaccatgtcttcatgcaccttcacccagggacaacatatcagttcttcatccgggcgtctactgtgaaagggttcggacctgccacagcaataaacgtgacaaccaacatctctgcccctacgctgccggactacgaaggcgtggatgcgagccttaatgaaacagccactactatcactgtgctgctcaggccagcccaggccaaaggcgcccccatcagtgcttaccagatagtggttgaggaattgcatccccatcggactaagcgagaggccggtgccatggagtgctaccaggtccccgttacttaccaaaacgccatgagtgggggggctccctactacttcgctgctgagctcccccccggcaacctgcctgagccggctccattcacagttggcgacaataggacctatcagggcttttggaacccacccctggcgcctcgcaaaggttacaacatttattttcaagctatgagcagcgtagaaaaggagacaaagacacaatgcgtgcggatcgccacaaaggctgctgcgacagaagaacccgaagtgattcccgatcccgcaaaacaaacagatcgcgtagtaaaaattgcaggtatttccgctgggattctcgtcttcatactattgctgttagttgtgattttaattgttaagaagagcaagttagccaagaagaggaaggacgccatgggcaacacgcggcaagaaatgacccatatggtgaatgccatggatcggtcttatgctgatcagtctacactacatgctgaggatcctcttagcataacctttatggatcagcacaacttctccccgcggtacgagaaccattccgccactgcggaaagttctaggttgttggatgttccccggtacctctgtgaaggtacagagagtccgtatcagacggggcagctccatccggccatccgtgtggcggacctgttacagcacatcaacttgatgaagacatctgatagctatggtttcaaggaggagtatgaatcctttttcgaagggcagtccgcaagctgggatgttgctaaaaaggatcaaaaccgcgctaaaaaccgctacgggaacattatagcttacgaccacagcagagtcattttacagcctgtggaggacgatccttcttcagactatattaacgctaattacatcgatatctggctctaccgagatggctatcaaagaccaagccactacattgcgactcagggcccagtacatgagacagtgtatgacttttggcgcatgatctggcaagaacagtcagcctgcattgtgatggtgactaatcttgtagaggtgggcagagtgaagtgctataagtattggcctgatgatacagaggtgtacggagatttcaaggtgacctgcgtggaaatggaaccacttgcagaatacgtggtaagaacctttacccttgagaggcggggatacaacgagatacgggaagttaaacaattccacttcactggatggcctgatcatggcgtgccgtaccatgctaccggattattgagttttatacggcgagtcaagctgtctaatccccctagtgcgggacccatcgttgtccactgttctgctggtgcaggccgaacagggtgttatattgtgatcgacattatgctcgacatggcggaacgcgagggcgtggtagatatctacaactgcgtgaaagccctccgttcccgcagaatcaacatggtgcagacagaggaacagtacattttcatacacgacgccatcctcgaagcttgtctatgtggggaaaccgccatccctgtctgcgagttcaaggctgcttacttcgacatgatcaggatagactctcaaaccaacagttctcaccttaaggacgaatttcaaacactcaattccgtgaccccccgactgcaggctgaggattgcagcattgcatgtttacctagaaatcacgacaagaataggttcatggacatgcttccccctgatcgatgtctgcctttcctgattactatcgacggggaatcatctaattacataaatgccgccttgatggacagctatagacaaccagcggcctttatcgtaacacagtacccgctgccaaacaccgttaaagacttctggaggcttgtgtacgattatgggtgcacatccatcgttatgctcaatgaggtggacctctctcagggctgtccccagtactggcccgaggaaggaatgctcagatacgggccgattcaggtggaatgcatgtcctgctctatggactgcgacgtaattaatcgcatctttaggatttgcaacctgacacgtcctcaggaagggtacctaatggtgcaacagttccagtatcttgggtgggccagccacagggaggtgcccgggtccaaaaggagctttctgaaactgattctacaagtagagaagtggcaggaagaatgcgaagagggcgaaggtaggacaattattcattgtcttaatggcggaggcaggagcggcatgttctgtgcaatcgggatcgtggtggagatggtcaaacggcagaacgtggtggacgtgtttcacgcagtaaagacactcagaaactccaaacctaatatggtggaggctcctgaacagtaccgattctgctatgacgtggccctcgaatacctggagtcttcttag

SEQ ID NO: 130955 - DNA, 4320 bp, Artificial Sequence
  Description of Artificial Sequence: Synthetic coding sequence
atggataccactgccgctgccgccctcccagcctttgtcgcactgctgctactgagcccttggcctctgctcggctccgcccagggtcaatttagcgccggcggctgcacctttgatgatggccctggcgcctgtgattaccaccaggacctgtatgacgatttcgaatgggtgcacgtttctgcccaggaacctcactatcttcccccggagatgccgcaagggagctacatgatcgtggattcttctgaccatgatcccggagaaaaagcccgccttcagttacccactatgaaggagaacgatacccattgcatcgattttagttatctgctgtactctcagaaaggcctcaaccccggtaccctcaacatcctggtgcgcgtcaacaagggacctctggcaaatcctatttggaacgtaacaggttttaccggccgggattggctgagggccgagttagcagtttctactttttggcctaacgaataccaagtgatctttgaggccgaggtttcaggcggcaggtccggctacatcgcaatcgacgatattcaagtgctgagttacccctgcgataagtccccacactttctcagacttggagatgtggaagtaaatgccgggcaaaacgccacattccaatgtatcgcaaccgggagagatgccgttcacaataaactgtggctgcagcggaggaacggggaagacatccctgtcgcccagacgaaaaacatcaatcataggagattcgccgccagcttccgcctacaggaggtaactaagactgatcaggatttgtacagatgcgtaacccagtccgaacgaggatccggggtgagcaatttcgctcagctcattgtgcgcgaacccccgcggcccatcgccccaccacagctcctgggcgttggcccaacatatctcctcattcagctcaacgccaattccattattggcgacggccctatcattcttaaggaggtggagtatcggatgacttcaggttcgtggaccgaaacccatgccgtgaacgccccaacctataaactgtggcacttagacccagatacagagtatgagatcagggtgttattaacgagacccggtgagggcgggacaggcttaccaggaccacccctgatcaccagaaccaagtgtgctgaacccatgcgcacaccaaagacactcaaaattgccgagatacaggcgcgccggatcgccgttgactgggagtccctcggctacaacattactcgatgtcacacatttaatgtgacaatatgctaccactacttccgggggcacaacgaatctaaggccgactgtctggatatggatcctaaagctcctcagcatgtggtgaaccatctcccaccgtacaccaatgtctcactgaagatgattctaacaaacccagaagggcggaaagagagtgaagagaccattattcagacagacgaggatgtccccggccccgtgcctgtcaaaagcttacaggggaccagttttgaaaacaagatcttcttgaactggaaagagcctctcgatcccaatgggatcatcacccaatacgagattagttactcaagtatccggtcttttgacccagcggtgcccgtggccgggccgccccagactgtaagcaacctttggaattctactcaccacgtttttatgcatctgcaccctggcaccacatatcagttcttcattagagcatccactgtgaagggattcggtcccgccaccgccataaatgtgactacaaatataagcgctcccacattacccgactatgagggggtggatgccagcctgaacgagactgccaccacgattacggtactgctgaggccagctcaggccaagggagcccctatctcggcttatcagatagtcgtcgaggaactacatcctcatcgcactaagagggaggcaggagctatggaatgttaccaagtccccgtgacctatcagaacgcaatgtctggaggggctccatattactttgccgctgagttaccccccggcaacctgcccgaaccagcccccttcacagtcggcgataataggacataccaagggttttggaatccccctcttgctccaaggaagggatacaatatatatttccaggcaatgagctcagtagaaaaggaaacaaaaacccagtgtgtgagaattgcaaccaaagctgctaccgaagaacctgaggtcatcccagacccagccaagcagacagacagagttgtcaagatcgccggcattagtgcaggcattctggtgtttatactgctactgctagtggttatccttatcgtaaaaaaaagtaagctggccaaaaaaagaaaagacgcgatgggcaatacacggcaggagatgacacatatggtaaacgccatggaccgctcctatgctgaccaatccactctgcacgccgaagatcccctgagcattacctttatggatcagcacaacttcagtcctcgctatgagaatcactccgcgacagctgaatcatctcggttgctggacgtaccccggtacttatgcgagggcaccgagtccccctatcagaccggccagttgcatcccgccataagagtggctgacctgctccagcacatcaatctgatgaaaacctccgattcatatgggttcaaagaggagtatgaatccttctttgaggggcagtcggcatcatgggatgtggcaaaaaaagaccagaatagagcgaaaaatcggtatggcaatatcattgcttacgatcactctcgagtgattctccaaccggtggaagatgacccatctagcgactatataaatgctaactacatagacggatatcagagacctagccattatatcgccacccagggaccagttcacgaaactgtttatgacttctggcgcatgatttggcaggaacaatctgcctgcattgtcatggtgactaatctggttgaagtcggaagggtgaagtgttacaaatactggcccgatgataccgaggtgtatggcgactttaaggtgacgtgcgtcgaaatggagcccctggccgagtatgtcgtcaggacctttacgctggagagaaggggatacaatgagattcgggaagtaaagcagtttcacttcaccgggtggcctgatcacggggtaccatatcacgctactggcctgctgtcattcattaggagagtgaagctcagcaacccgccgagtgctggccccattgtggtgcactgctccgcaggcgcaggccggaccgggtgctacatagtcatcgacattatgttggacatggccgaacgggagggcgtcgtggacatctataactgtgttaaagctctccggtctcggagaattaatatggtgcagacagaggagcagtatatcttcattcacgacgcgattttggaggcgtgtctttgtggcgaaaccgcaatccctgtgtgtgagttcaaggccgcttatttcgacatgattcgtattgactctcagacaaacagttctcacttaaaggacgaatttcagacgctcaattcagtgacaccgcgtctccaggctgaagattgtagcattgcctgcctccctagaaatcatgacaagaatcgctttatggatatgcttcccccagatcgttgtcttccgttcctcattactatcgacggcgagagttcaaactacatcaatgctgcacttatggattcttatcggcagcctgcagcattcattgttactcagtaccctctgcccaatacggttaaagatttctggaggctggtgtacgactacggttgcacctcaattgtgatgctgaacgaagtggacctttcccaaggttgtccgcagtattggcccgaggagggtatgcttaggtatgggcctattcaggtagagtgcatgtcatgctccatggactgcgatgtgattaaccgaatcttccgaatttgtaatctcacgcgccctcaggaaggctaccttatggtccaacagttccagtacctgggctgggcatcgcacagggaagtccccgggagcaagcgctcatttctcaagttgattctacaggtggagaagtggcaggaggaatgtgaggagggcgaagggcgcacaataatccactgcttgaacggaggggggcgcagcggaatgttttgtgccatcgggattgtggtggaaatggtgaaaaggcagaacgtggtcgacgtttttcacgccgtaaaaacactccggaatagcaaacccaacatggtcgaagctccagagcagtacagattttgttatgatgttgccctggagtacttggagtcatcatag

SEQ ID NO: 130956 - DNA, 4323 bp, Artificial Sequence
  Description of Artificial Sequence: Synthetic coding sequence
atggacactactgctgcagccgctctgcctgccttcgtggccttactactgctttccccctggcccctccttgggagtgcacagggtcagttcagcgcgggcggctgcaccttcgatgacggccctggggcatgcgactatcatcaggacctctacgatgatttcgagtgggtgcatgtgtctgcccaggagccccattaccttcccccggagatgcctcaagggagttacatgatcgtagacagctccgaccatgaccctggagaaaaagctaggctgcaattaccaactatgaaggagaatgacacacattgtatcgactttagctatctcttgtatagccaaaaagggctgaaccctggtacactgaacatactcgtcagagttaataaaggacccttagctaaccctatatggaatgtcaccggcttcacaggtagagactggttgcgcgcggaactggccgtctccacgttctggccgaacgaataccaggtgatcttcgaagcagaggtctccggtggtagatctggttacatcgcaattgacgacattcaggttctctcatatccctgcgataaaagcccacattttctcaggcttggcgatgtggaggtgaacgctggccagaacgcaaccttccagtgtatcgcaaccgggagagacgccgttcacaataaactgtggctacagagaaggaatggggaggatattcccgtggcccagaccaaaaacattaatcaccgtcggtttgctgcttcctttcgactgcaggaagtgaccaagactgatcaggatttgtaccgctgtgtcacacagtctgagcgcgggtcgggggtgtctaacttcgctcagttaatcgtgagggaacctccccggcccatcgcgccgccccaattattgggcgtaggccctacctaccttttaattcagctgaacgccaattcaatcattggagatggcccaatcatcttaaaagaggtggagtacaggatgacaagtgggtcttggaccgagactcacgctgtaaacgctcccacgtataaactgtggcatctagaccccgacactgagtatgaaatacgtgttctgctgacccgccctggtgagggtggaacgggtctgcccggtccacctttgataaccagaacaaagtgtgccgaacctatgagaacacccaaaacactgaagattgccgagatccaggcacggagaatcgccgtggactgggaaagcctaggctacaacattacccggtgtcacacatttaacgtgactatttgttatcactattttcgcggccacaacgaatcaaaggccgattgcctagacatggaccctaaagccccccagcacgtggtaaatcatctgccaccttacacaaacgtcagcttgaagatgatactaactaatcctgagggcagaaaagaatccgaggagaccataatacagactgacgaagacgtgcccggccctgtccctgtgaaatcgctgcagggcaccagctttgaaaacaaaattttcctgaactggaaggagcccctggaccccaacggaatcatcactcagtatgagatttcgtacagtagcatcaggtcctttgacccagccgtaccagtggctgggcctccacagacagtaagcaatttatggaatagcactcatcacgtgtttatgcacttgcacccgggaaccacgtaccagttttttatcagggccagtaccgtcaaaggattcggaccagccacagcaattaatgtgaccaccaatatttccgctcctacattgccagattacgagggtgtcgacgccagccttaatgagacagccactacgataacagtcctcttgagacctgcgcaggccaagggagcgcccattagcgcataccaaatagtggttgaggagctccaccctcataggacgaaacgcgaggctggcgccatggaatgttaccaggtgcccgtgacataccagaacgccatgtctggcggagccccctattacttcgctgcagagcttccccccggcaatctcccagagccagccccgttcaccgtgggagacaaccgcacttaccaaggcttctggaatcccccactggctccaagaaagggatataatatctattttcaagcgatgagcagtgtggagaaggaaactaaaacccaatgcgtccgaatcgccacaaaggcagctgccactgaggagcctgaagttattccggatcctgctaagcagaccgacagggttgttaaaatcgccggaatatctgccggaatactcgtgtttatcttactgctgctggttgttatcttaattgtaaagaaaagcaagctggccaaaaagaggaaggacgcgatgggtaacactaggcaagaaatgacccatatggtgaacgctatggatagaagttacgccgatcagtcaactctgcacgccgaggatcctctcagtatcacgtttatggaccaacataacttctctccaaggtacgaaaaccactctgccacagcggaatcatccaggctgttggatgtgccacggtatttgtgtgaaggtaccgaaagcccgtaccagactggccagctgcatcccgcaatcagggtggccgacctgttacagcatattaatctgatgaaaacttctgatagttacgggtttaaggaagaatacgagagtttcttcgaagggcagtcggcaagctgggatgtagccaaaaaggatcagaatcgtgccaagaaccggtatggcaatattattgcatatgatcattccagagtgattctacagcctgtggaagacgaccctagttcagattatattaatgccaattacatagacggttatcaacgcccaagccactacatcgcgacacagggacccgtgcatgaaacagtgtacgatttttggagaatgatctggcaggaacaaagtgcctgtatcgtgatggtcaccaacttagtagaagtcggaagggtaaaatgctataagtactggccggatgatactgaggtttatggtgactttaaggtgacatgcgtcgagatggaacccctcgccgaatacgttgtaaggacatttactctggaacggcgaggatataatgaaatccgggaagtgaagcaattccatttcaccggatggcccgatcacggcgtcccataccacgctacaggcctcctttctttcattcgaagggtgaagttatccaaccctccatctgctggcccgatcgtggtacactgcagcgccggagcaggacgcaccggctgctatatagtgatcgacatcatgctcgacatggctgagagggagggcgtggtggacatttataattgtgtgaaggctttgcgatcccgcagaatcaatatggtgcagacagaggagcaatacatcttcattcacgatgcaatcctggaggcatgcttgtgcggagagactgccatccctgtgtgtgagttcaaggcagcatattttgacatgatacgcatcgacagccaaaccaactcctctcatttgaaggacgagttccagaccctgaattctgttaccccccgcctgcaggccgaggattgttcaatcgcctgtctgccccgaaaccatgacaaaaaccgtttcatggacatgctcccaccggatagatgcttgccttttctgatcaccatagatggcgagtccagcaattatattaacgctgccctcatggacagttacaggcagcctgcagcattcatcgtaacacagtaccctctaccaaacaccgttaaggatttctggagactggtgtacgactatggctgtaccagcattgtgatgctcaatgaggtggacctgagtcagggatgcccgcagtactggccagaggaaggtatgttaaggtatggcccaattcaagtggagtgcatgtcttgctccatggactgcgacgtgatcaacaggatctttcggatatgcaaccttacaaggcctcaggagggctacctaatggtgcagcagttccaatacctggggtgggcaagccacagagaggttcctggatcaaaaaggtctttcttaaaacttatcctgcaggtggaaaagtggcaggaagaatgtgaggaaggggaaggcaggacaataatccactgtctgaatggtggcggtaggagcgggatgttctgtgcgattggtattgttgtggagatggttaagaggcagaatgtagtcgacgtgttccatgccgtgaagacgctgcgaaacagtaagcctaatatggtggaggcgcccgaacagtatagattttgctacgacgtggcgctggagtacctggagagctcatag

SEQ ID NO: 130957 - DNA, 4374 bp, Artificial Sequence
  Description of Artificial Sequence: Synthetic coding sequence
atggacaccactgccgcggcagctttacccgcattcgtcgcattgctgctcctatcaccctggcccctcctcggcagcgctcagggacagttctccgccggaggctgcaccttcgacgatggtcccggcgcctgtgactaccatcaggatctgtatgacgatttcgagtgggtgcacgtctctgcccaggaaccacactatttaccgcccgaaatgccccagggaagttatatgatcgtcgattcctctgatcatgatccaggagaaaaggcgagattacagttgcctaccatgaaagaaaacgatactcattgtatcgacttttcttatctgttgtacagtcagaaaggcttgaaccctggcactctaaatatcttggtccgtgttaataagggccctctggcaaaccctatctggaacgtgacaggtttcacgggtcgagactggctgcgagcagaactggcagtgtcaacattctggcccaatgagtaccaggtcattttcgaggcggaagtaagcggcggaagatcgggctatatcgcgattgatgatattcaggtcctgagttatccatgcgacaagtcaccccatttcctgcgtttgggcgatgtggaggtgaatgctggccaaaacgccacctttcaatgcatcgcaactgggagggacgccgtccacaacaagctgtggctgcagcgccggaatggtgaagacatacctgttgcccagaccaagaacattaaccatcgacggttcgctgcttcttttcggttgcaggaagtgacaaaaactgaccaggacctgtaccgctgcgtcacacaatccgagaggggatccggcgtgtcgaattttgcccaactgattgtgcgcgagcctccacggcccattgctccacctcagttgttgggtgttgggcctacttatctgttaattcagctgaacgcgaactctatcataggagacggtccaatcattctgaaagaggttgagtacaggatgacaagtggctcttggacagagactcacgcagtgaatgccccaacctataaactctggcatctcgaccccgataccgaatacgaaattagagttctgctgacccgccctggagagggaggcactggactgccagggcccccattgatcacacggacaaagtgtgccgagccaatgaggactccgaagaccttgaaaatcgccgagatccaagccaggcggatcgctgttgactgggagtctctagggtataacataactcgctgccacactttcaatgtgaccatttgttaccattattttcgcggccacaacgagtctaaggctgactgcttagatatggaccccaaggcccctcagcacgtggtaaaccacctcccaccatacaccaatgtgtccttaaagatgatcctgacaaaccccgaagggcggaaagagtccgaggagacaatcattcaaacagatgaggatgtgcctggacctgtgcccgttaagagtcttcaagggacaagcttcgagaataagattttcctgaactggaaagagcctcttgatccaaacggcatcatcacacagtacgagatcagctattcatccatccgctctttcgacccagccgtgcccgtggccgggccaccacagaccgtcagtaatctgtggaattcaactcatcatgtctttatgcacctgcaccctgggaccacgtaccagtttttcatccgagcatcaactgttaagggcttcggacccgctacagctatcaacgtgacaaccaacatcagcgctccaacgctgccagattacgagggggtcgacgctagtctgaacgaaactgcaactacaattaccgttctcctgaggccagcccaagcgaaaggcgctcccatatcagcctatcaaattgtagtggaagaactccatccacaccgcactaaaagagaagctggagccatggagtgctaccaggtgcctgtgacataccagaacgccatgagcgggggggccccttactactttgctgcagagctcccccccggcaatctgcctgaacccgctcccttcaccgtgggtgacaaccgcacctaccaaggcttctggaaccctcctctggctcccagaaagggttataatatttactttcaagccatgagctctgttgagaaggaaactaagacacaatgcgtcaggattgctacaaaggcggcggcaaccgaggaaccagaggtgattccggaccccgccaaacagacggatcgcgtcgtaaagattgccggaattagtgcggggatactagtctttatccttttgctgctggttgtcattttaattgtgaaaaagagcaagcttgccaaaaaacggaaggacgcaatgggaaatacccgacaggaaatgactcatatggtgaacgcaatggataggtcttatgcagatcaatcaacattgcatgctgaggaccctctatcaattacattcatggaccagcacaacttttcccccagactccccaatgaccctttggtgcccaccgccgtgctcgatgaaaaccactctgccaccgctgaatcatcacgtctgcttgatgtgccaagatatctttgcgaaggtacggaaagtccttaccaaaccgggcaactccacccagctattagagtggccgatcttttacagcacattaacttgatgaagacgtcggacagctacggcttcaaggaagagtacgagtcattttttgaggggcagtcagctagctgggacgtggctaaaaaggatcagaacagggccaagaatcggtacgggaatattatcgcctatgaccacagcagggtcatcctgcagcctgtggaggacgacccgagttctgactacatcaacgccaactacatcgatgtgtccatattcatcggctatcagcgcccttctcactatatagccacgcagggccccgtgcacgaaaccgtctacgacttttggcgtatgatctggcaggaacagtctgcctgtattgttatggtcaccaatctggtcgaagtcgggcgcgtgaaatgttataaatactggcccgacgacaccgaagtctatggggacttcaaggtgacttgcgtcgagatggagcccctcgccgagtatgttgttcggacgttcactttggaacgcagaggatataatgaaatacgggaagtaaaacagttccattttactgggtggcctgatcatggagtgccataccacgcgacggggttattgtcctttattcgacgggtaaagctgtccaatcctccttctgctgggccaatcgtggtgcattgttcagccggggccggacgaaccgggtgctatatcgtcatcgacataatgctggatatggctgagagggaaggagtcgtggatatttataattgcgtcaaggctttgcggtcacgtcggatcaatatggtgcagacggaagaacaatacatttttatccacgacgccattctggaagcctgtctatgtggcgagaccgcgatccccgtttgcgagttcaaggcggcttactttgatatgatccgtattgacagtcaaactaactcatctcacttgaaggatgagttccagaccttgaacagcgtgacaccccggctccaggctgaagactgcagcatcgcctgcctgccacgaaatcatgacaaaaatcgttttatggacatgctgcccccagaccgatgtcttcctttcttgatcacgatcgacggtgaatcttcgaactatataaacgcagctctgatggacagctatcgacaacctgctgcttttatcgtgacgcagtatcccctccccaacaccgttaaggacttctggagactggtgtacgattacggttgcacaagtattgtcatgctcaatgaggtagacctatctcagggttgtccacagtactggcccgaagaagggatgttgcggtatgggcctattcaggttgaatgtatgtcatgctccatggattgcgacgtgataaatcgaatatttcgaatatgtaatctgactcgaccgcaggaggggtatctaatggtgcaacagttccagtacctgggctgggccagtcaccgggaggtccccggatctaaaaggagcttcctgaaactgatccttcaagtcgaaaagtggcaggaggagtgcgaggagggggaagggagaacaattatacattgccttaacggggggggccgcagcggcatgttctgtgcgattgggattgtggtagaaatggttaagagacaaaacgtggtggacgtgtttcacgcagtcaagaccctgaggaatagcaagccgaacatggtggaggcccccgaacagtatcggttttgctatgacgtcgccttggaatacctggaatcctcgtag

SEQ ID NO: 130958 - DNA, 2244 bp, Artificial Sequence
  Description of Artificial Sequence: Synthetic coding sequence
atgacactgaacggttgcatgcttgtattaaagtccctgattatctatcacccccgttgtcccaaagtgatatttgaggctgaggtttctggcggtagatccgggtatattgctatcgacgatattcaagtcctgtcctatccctgtgataaatctccgcactttctcagactgggagacgtggaggtgaacgcgggccagaacgcgactttccagtgcatagccacgggtcgcgacgccgttcataataaattatggctccagcggaggaacggggaggatataccagtcgcccagaccaagaacatcaatcatcggagattcgctgcctccttcaggcttcaggaggttactaagacagatcaggatctatacaggtgtgtcacacagagcgagcgcggcagcggagtctcaaatttcgcgcagttaattgtcagggaacctccccgcccgatcgctccccctcagctgttgggggtgggacccacatatctgctaatccagctgaacgctaactccatcatcggcgacggacctattatcctgaaagaggtggagtaccgtatgactagtggctcctggacagagacacatgcggtgaatgctcctacctataagctgtggcatctcgacccagacactgaatacgagatccgggtccttctgacacgcccaggagaggggggtaccgggctccccggcccaccccttattactagaacaaaatgcgctgagcctatgaggacaccgaagacactgaagatcgcggaaatacaggctcgacgaattgctgtggattgggaaagcctgggctataatatcaccaggtgccatactttcaacgttaccatctgctaccattactttcggggacataatgagagcaaagcggactgtctggatatggatcccaaagccccgcaacacgtcgtgaaccacctcccaccttacaccaacgtgtcacttaagatgatattaaccaatcccgaaggacgcaaggagtctgaggagaccatcatccaaacagacgaggacgtacctggtccggtgcctgtgaagtctctccagggtacctccttcgagaataaaatattcctgaattggaaagaacctctggaccctaacggtatcatcacacagtacgaaatatcttattcatctatcaggagcttcgatcccgcagtacccgtagccgggccacctcagaccgtctcaaatctttggaattccactcaccacgtctttatgcatttgcacccagggactacctaccagtttttcattcgggcgtccactgtgaaagggtttggccccgcaaccgctataaatgtgacaactaacatttctgctcctacactgcccgactacgagggagtagacgcatctctgaacgagacagctacaactattactgttctgctgaggcccgcgcaggccaaaggggctcccatttctgcttaccagatagtagtggaggaactccatcctcatcggacgaaaagggaggccggagcaatggaatgctatcaggtgcctgtcacctaccagaatgctatgagtggcggggctccatactatttcgctgccgaacttccccctggtaacctgcccgaacctgcaccctttacggtgggcgacaaccgtacgtaccagggcttttggaaccctccactcgctccccggaaagggtacaatatttattttcaggccatgtcgagtgtggagaaagagaccaagacccaatgtgtgcgcattgctacaaaggctgcagctacagaggagcctgaggtaattccagacccagccaagcagacagaccgggtcgtgaaaattgcgggcatcagcgcagggattttggtgttcatcttgttgctcctggttgtcatcttgattgtgaaaaagaggtacatctgttggcgacggcacatatgcattagaaatatccggcggtcttattattcttatagttattacctcaagctggcgaaaaagcgaaaggatgccatgggaaacacgaggcaggaaatgacacatatggttaacgctatggaccggtcatacgctgatcagagtaccttgcacgccgaagatcccctgtccattacctttatggatcagcataatttttctcctcgcctccctaacgacccacttgtacccaccgcagtcctcgtgccgagcccaggaaggaagaatgtttaccacggggataataattcattctttgccattagctacctctag

SEQ ID NO: 130959 - DNA, 4389 bp, Artificial Sequence
  Description of Artificial Sequence: Synthetic coding sequence
atggacaccactgccgccgcagctctccccgccttcgtggctctcttgctactgtcgccatggccccttttaggtagtgcacagggtcaatttagcgcaggcggctgcactttcgacgacggaccaggagcgtgcgattatcaccaagacctgtacgacgatttcgaatgggttcatgttagcgcccaggaacctcattaccttccccctgaaatgccccaagggtcttatatgatagtcgacagtagcgatcatgacccgggagaaaaggccagattgcagctgcccaccatgaaggagaatgatacccactgcatcgatttctcctacctgctttactcacaaaagggattaaatcccgggacattgaacatattggtacgggtgaataaggggcccctggctaacccaatttggaacgttactggtttcactgggcgagactggctgcgggccgaacttgcagtgagtacattttggccaaatgaatatcaagtgatctttgaggccgaagttagtggaggaagaagcggctacatcgccatcgacgatatccaagtgctctcctatccgtgtgacaaatctccacactttttgcgcttaggagacgtggaagtgaacgctggccagaatgccacatttcagtgtatcgccaccggtagggatgctgtccataataagctgtggcttcaaaggcgcaatggagaggacatccccgttgcccagaccaaaaatatcaatcacaggaggtttgcagcctcatttcggcttcaggaggtgacaaagaccgatcaggatctgtatcggtgcgtgacccagtccgaacggggcagtggggtgtctaacttcgcacaactcatcgtccgtgagccgcctaggcccatcgcccctcctcaactcctcggagtgggacccacctacctcctcatacagttgaacgccaatagcatcatcggcgatggtccaattattctgaaggaagtggagtatagaatgactagcggttcgtggaccgagactcatgcggttaatgcacccacatataaattatggcatctggaccccgacaccgaatacgagattcgcgtcctcttaacccggcctggggaaggtggcaccggcctgcctgggcctccactgatcacccgtacaaaatgtgccgaacccatgcggactcctaaaacactgaagatcgccgagatacaggctaggagaatcgctgtggattgggagagcttaggttacaacatcacccgctgtcacacatttaatgtcactatttgttatcattatttcagagggcacaatgagtccaaggcggattgcttagatatggatccgaaggcccctcagcatgttgtgaaccatctccctccctataccaatgtgtcgcttaagatgattctcaccaatccggaaggccgcaaggagtccgaggaaactatcattcagaccgacgaagatgttcccggcccggtccccgtcaagtccctgcaggggacgtcatttgagaataagatcttcttgaactggaaggaaccacttgatccgaatggaattatcactcagtacgagatatcctattcatccatccgatccttcgaccccgctgtccccgtagcggggcctcctcagaccgtctccaatctgtggaactctactcaccatgtttttatgcacttacatcctggtacaacttaccagtttttcattagggccagtaccgtgaagggctttggcccagctacagccatcaacgttacaactaacataagtgcccctaccctaccagattatgagggcgtggacgccagtttgaatgaaaccgctacaactatcaccgtgcttcttcgaccagctcaagccaagggggcccccatttccgcctaccagattgtcgtggaagaactccatcctcatcgaacgaagcgggaagcaggcgccatggaatgttaccaggtcccagtgacttatcagaatgcgatgagcggaggcgctccctattattttgcagcagagctcccacccggaaatcttccggagcctgctccttttaccgtgggggataataggacttaccagggattttggaaccctcctctggcccccaggaaaggttacaacatctactttcaggcgatgtcgtctgtggagaaggagacgaaaacacaatgtgtgagaattgctactaaagccgcagccacggaggagccggaggttatccctgatcctgccaagcagaccgaccgagtcgtgaagattgctggcataagcgctggtatactagtgtttatcctcctgttgcttgtcgtaatcctgattgtgaagaagagtaaactggcaaagaagagaaaagacgctatgggcaacactagacaggaaatgacccatatggtgaacgcgatggatagatcctacgcagatcaatctacattgcacgctgaggatccactgtctatcaccttcatggatcagcacaacttctcaccccgattgccaaacgatccgctcgtgccaaccgctgtccttgtgccgataacagatgaaaatcacagcgccactgcagaatcctcccgcctcctggacgtgcctcgatatctgtgtgaaggaaccgagtccccgtaccagaccgggcagttacatccggctatacgcgtcgccgacctgctgcaacacatcaacctgatgaagacttccgattcatacggttttaaagaagagtatgagagtttctttgaaggacagtccgcatcctgggatgttgctaagaaggatcaaaaccgagctaagaatagatatggcaatatcatcgcctacgaccattcaagagtgatattacagcccgtagaagacgacccttccagtgactacatcaatgccaactatatcgatatctggctgtacagagatgggtaccaaaggcccagccattatattgccacccaaggccccgtgcatgaaacagtctatgacttctggcggatgatatggcaggaacagtcagcgtgcatcgttatggtgactaatttagttgaggtcgggcgagtgaagtgttataagtactggcccgacgacactgaggtgtatggagacttcaaggtgacatgtgtagagatggaaccccttgcggaatacgtggttaggaccttcacgttggaaagacggggatataatgagatcagagaggtgaagcagttccattttacaggatggccggaccatggtgtgccttaccacgccactggattgctgtcatttatccgacgcgtgaagctaagcaatcccccaagtgccggcccaatcgttgtgcattgctcagcgggagccggccgcacagggtgttacattgtcatcgatatcatgctcgacatggctgagcgcgagggcgtcgttgatatatacaactgcgtgaaggcattgagaagcaggcggatcaatatggtgcagaccgaggagcagtacatctttatccatgatgccatcctggaagcctgcctgtgcggggaaacagctatacctgtatgcgaattcaaagccgcctattttgatatgattcggatcgatagtcagaccaatagcagccacctgaaggatgagtttcagactctgaactccgtcacacccagactgcaggctgaagattgcagcatcgcctgtctgcctcgaaatcatgacaagaatagatttatggatatgttgccacccgatcgctgtcttccctttctcatcaccatagacggcgagtccagtaattacatcaacgctgccttgatggatagctatagacagcccgccgccttcatcgtcacccaatatcccctgccaaacactgtgaaagacttctggagacttgtctatgattatggttgcacctcaatcgttatgttgaacgaggtggacctgtctcaaggatgcccacagtactggcctgaagaagggatgctaagatacggaccaatccaggttgagtgtatgtcctgttcgatggattgcgatgtgattaatagaatctttagaatatgcaatttgacaaggccacaggaaggatatctgatggttcaacagtttcagtacctcgggtgggcctcgcaccgtgaggttcccggcagcaaacggtcctttctgaagctgatcctgcaagtcgagaagtggcaagaggaatgtgaggagggtgaggggagaacaattattcactgtctgaacgggggtggccgatccggtatgttttgtgctattggcattgtcgtggagatggttaaaagacagaacgtggtggatgtctttcacgctgtaaaaactctgaggaactctaagcccaacatggttgaggccccagaacagtatcgcttctgctacgatgtggcgctggagtatctggagagctcctag

SEQ ID NO: 130960 - DNA, 4359 bp, Artificial Sequence
  Description of Artificial Sequence: Synthetic coding sequence
atgcgcggactgggtacgtgtttggccaccctcgctgggctcctactaaccgcagctggagagacatttagtggaggctgtctcttcgacgagccctactcaacatgtgggtatagtcagtctgaaggggacgattttaactgggagcaagtgaataccttgaccaagccaacatccgacccctggatgcccagcggttcctttatgctggtgaatgcatcaggacgccccgagggacagagagcccacctcctacttccacagctgaaggaaaacgatacgcattgcatagatttccattatttcgtgagctccaaaagcaattcgcctcctgggctccttaatgtatatgttaaggtcaacaatggcccgttaggaaacccaatttggaacatctctggcgaccctacacggacgtggaaccgcgctgaactggccatcagtaccttctggcctaatttttatcaggtgatatttgaggtcattacctccgggcatcagggctaccttgccattgacgaggtgaaggttctcggtcatccctgcactagaacccctcacttcctcaggattcagaatgtcgaagtcaacgctgggcagttcgccacattccaatgctccgctattggcagaacagtggctggggatcggctctggcttcagggcatcgatgtacgggacgcacccctcaaggaaatcaaggtgaccagtagccgcaggttcattgcatcctttaatgtcgtgaatacaactaagagagatgctgggaaataccgctgtatgattagaacagagggtggcgttggaattagtaattacgccgagctggtggtcaaagagccgccagttcccatcgcgcctccacagctggcctccgttggtgcaacctacctttggatccaactgaatgccaattctattaatggcgatggcccaattgtggcacgcgaggtggagtactgcacagcttctggaagctggaatgacaggcaacctgtggatagcaccagctataaaattggtcaccttgaccccgatacagagtacgagatttccgtgctgctaactcgacctggcgaaggcggtaccgggtcccccggccccgcgttgagaacaagaacaaaatgtgctgaccccatgcgagggccgcggaaactggaggtggtcgaggtcaagagcaggcaaataactattcggtgggaaccgttcggatacaatgtgacgaggtgtcattcctataacctgacggtccactactgctatcaagttggcggccaagaacaggttcgcgaagaggtttcctgggacaccgagaactctcacccacaacacacgataacaaacttgtcaccttacaccaatgtgtcagtcaagctgatcctcatgaatccagaaggtaggaaagaatctcaggagctgatcgtccaaacagacgaagacctgcccggcgccgttcctaccgaatctattcagggctcgactttcgaagagaaaattttcctgcagtggcgggagccaacacagacctacggagtgatcaccctgtatgaaatcacatacaaagcagtgtcatctttcgatcctgagatagatctgagtaaccaatccggaagggtatccaaattgggaaatgagacgcatttcctcttcttcggattgtaccctgggacaacttactccttcactattcgtgctagcacagcaaaggggttcggcccccctgccacaaaccagtttactacgaagatcagcgccccaagcatgcctgcgtatgagctggagacacctctcaatcagactgacaatactgtgaccgtgatgcttaagccagcacactcgcgtggcgcccccgtctctgtttaccagatagtggtggaggaagaacggccacgccgcactaaaaaaacaacagagatattaaagtgctatccagtgccaattcatttccagaatgcaagtctgcttaactcacagtattacttcgctgcagaatttcccgcagattcgctgcaggctgcccagccattcactattggggacaacaaaacatacaacggatattggaacacccctctgctgccctataagagctatcggatttactttcaggctgcatctagagctaacggtgagacaaaaatcgactgcgttcaggtggcgactaaaggtgccgctactccgaaaccggtgccagagcctgagaagcagactgaccacactgtcaaaatcgccggggtgatcgctgggattttacttttcgtgatcatatttcttggcgtggtcctggtaatgaagaagcggaagcttgccaagaagcgaaaagagacgatgtcatcgactagacaggaaatgactgtcatggtcaactcgatggacaagtcatacgccgaacagggaactaattgcgatgaagccttcagttttatggacacccacaaccttaatggcaggtcagtttcctcaccaagctctttcaccatgaagaccaatactctgagtaccagtgttcctaactcatactatcccgacgagactcacacgatggcatcggacacctcctcccttgtacagtcccatacatataagaaaagggagcctgcagatgtgccctaccaaacaggacaacttcatccagccatcagagtggcagacctgctccagcatattacacagatgaaatgcgccgaggggtacggtttcaaggaggaatatgagagcttcttcgaggggcaatccgcgccatgggattcagctaagaaagatgagaataggatgaagaacagatacgggaacatcattgcctatgatcactccagagttaggctgcagaccatcgagggggacaccaattcggattacattaacggcaactacatcgacggataccaccgacctaaccactacattgccacgcagggccccatgcaggagactatctatgacttctggcgaatggtgtggcatgagaacaccgcaagcatcatcatggtaacaaacctggtggaagtgggccgtgtgaagtgctgcaaatattggcctgacgacaccgagatttacaaagacattaaggtaaccctcatcgagaccgaactgctggccgaatacgtgattaggacatttgctgttgagaaacgcggtgtgcacgaaattcgggagatcaggcagttccacttcacaggatggcccgaccatggtgtcccttaccacgcgaccggtctgttaggattcgtgaggcaggtgaagagtaagtcacctccatctgccggccctctggtcgtccactgcagtgccggggccggacgaactggttgctttatcgtgattgatatcatgctcgacatggcggaaagggaaggggtggttgacatctataactgcgtgagagaactgcgatcaaggagagtcaatatggtgcaaaccgaggagcaatatgtcttcatacacgatgctattttggaagcatgcctctgtggcgacacttctgttcccgcaagccaggttcggagcctgtactatgatatgaataaactcgatccgcagactaactcatcgcagataaaggaagaatttagaacactaaatatggttaccccaacgctgagggtggaggattgctcaatcgcgcttctacccagaaaccatgaaaaaaacagatgtatggatatccttccaccggatcgttgcctcccctttctgatcacaattgatggcgaaagctcgaactatataaacgccgcgctgatggattcctacaaacaaccttcagctttcatagtgacacagcaccctctgccaaacactgtgaaggacttctggaggctggtcctggactaccattgtaccagcgtggtgatgctgaacgatgtggaccctgcccagctgtgcccacaatactggccagagaatggcgtccaccgtcatggaccaatacaggtagagttcgtgagcgcggatttggaagaggatatcatatctcgtatctttcggatatacaacgctgcaaggcctcaagatggctaccgcatggtccaacagtttcagttcctgggttggccgatgtatcgagatacccctgtcagtaaacggtcgttcctgaaattaattcgtcaagtggacaaatggcaggaagaatacaacggcggcgaagggcgaacagtggtccactgtttgaatgggggaggtcgttccggaacgttctgtgccatttccattgtctgtgagatgttgcgtcatcagaggaccgtggacgtctttcacgccgtgaagactctgagaaataacaaacctaatatggtggacttgctcgaccagtacaaattttgctacgaagtggccctggagtatctgaatagcggctag

SEQ ID NO: 130961 - DNA, 4173 bp, Artificial Sequence
  Description of Artificial Sequence: Synthetic coding sequence
atgccgtcaggatccttcatgctggtgaatgctagtggccgaccagagggtcagcgggcccacttgctcctgccccagttaaaggagaacgatacacactgcatcgactttcactactttgtgagctcaaagagcaatagccctccaggtctcctgaacgtctacgtgaaggtgaacaacggaccactagggaatcctatctggaacatatccggggaccccacaaggacctggaatcgagctgaattagctatttccacattctggcccaacttctaccaagtgatttttgaggtcattacaagtggtcatcagggctatctagccatcgacgaggtcaaagtgctgggacacccgtgtacccggaccccccattttctgcggatacaaaacgttgaggtgaatgctggacagtttgccacctttcaatgctccgctatcgggcggaccgttgcgggtgatcgcctgtggctgcaggggattgatgtacgcgacgctcccctcaaagagatcaaggttaccagctctcgcagatttatcgcctcctttaacgtagtcaacaccaccaaacgagacgcaggaaagtacagatgtatgatccggaccgaaggcggcgttgggattagtaattacgccgaattggttgtgaaggagccccccgtcccaattgccccaccccaacttgcctcggttggggccacttacctatggatccaattgaatgctaacagcatcaatggtgatggaccgattgtcgcccgagaggtcgaatattgtaccgcttccggctcatggaatgataggcagcctgtagacagcaccagttacaaaatcgggcacctggaccctgataccgagtacgagatcagcgtgctgctgactaggccgggagaaggcggtactggatctcctggtccagcgctccgcactagaaccaagtgcgctgatcccatgagggggccgcgcaaactagaagtggtagaagtgaaatcacgccagattaccataagatgggaacctttcgggtacaacgtgaccaggtgtcactcttataacttaacggtgcactattgctaccaggtgggcggccaagagcaggtgcgagaggaggtttcttgggacaccgagaacagccacccgcaacacactattacaaatttgagtccttatacaaacgtatctgttaagttgatcctgatgaaccccgagggtaggaaagaatcccaggagctgatcgtccagactgacgaggatctccccggagccgtccccaccgaatcaattcaaggctccacctttgaggaaaaaattttcctacagtggcgtgagcccacacagacatatggagtgatcacactgtatgagattacctataaggcggtgtctagctttgaccccgaaattgatttgtctaaccagtcaggccgagtctccaaattgggtaacgagactcacttcttgttcttcggcctgtatcccggcacgacgtactccttcacaattcgcgcctccacggctaagggttttggtccccctgccacgaaccagttcaccaccaaaatctctgccccatccatgcccgcttatgagctggagactcctttgaaccagacagataacaccgttacagtgatgttaaagcctgcccatagcaggggtgcccccgtgtctgtataccagattgtggtcgaggaggagagaccaaggcggaccaagaaaaccactgagattctgaaatgctacccagttccaatccatttccagaacgcctctttattgaactcgcagtactacttcgcagccgaatttccagccgattccctacaggcagcccaacccttcacaatcggggataacaagacttacaatggctactggaacacacctctgttaccctataaatcgtaccgaatttatttccaggcagcatcccgcgctaacggggagacaaaaattgattgcgtgcaggtggccaccaagggggccgctacccccaagcccgtcccagaaccagaaaagcaaacagatcacactgtgaaaattgcaggcgtgatcgccggcatactcctgtttgtgattattttcctgggagttgtgctggtgatgaagaaaaggaaactggctaagaagaggaaggagacaatgtcgagcacaagacaagaaatgaccgtcatggtgaatagcatggataaatcatatgccgaacaaggcacgaattgcgacgaggctttctcattcatggatacccacaatctcaatggcagatccgtgagctccccatcaagcttcacaatgaaaacaaataccctttcaacctctgttcccaacagctactatccagatgagactcacaccatggcctctgacactagctcccttgtgcaaagccacacctataagaaacgcgagccagcggacgtcccctatcagacgggtcagctgcaccccgcaattagagtggctgaccttcttcaacacatcacacagatgaaatgtgccgagggctatgggttcaaagaggaatatgagtctttctttgagggccaaagcgcaccttgggatagtgccaagaaggatgagaatcgaatgaaaaataggtacgggaacattattgcatatgatcattccagagttagacttcaaaccattgagggagacaccaattctgactatattaatggaaactatattgatgggtatcacagacctaaccactacattgctactcaggggccgatgcaggagactatctacgacttttggaggatggtgtggcatgagaataccgcctcgatcataatggtaaccaatcttgtcgaggtcggacgcgtgaagtgctgtaaatactggcccgatgatactgaaatctacaaagatatcaaggtcacactgatcgaaaccgagctgctggctgagtatgtgataagaaccttcgccgtcgaaaaacggggagtgcacgaaatccgggagattcgtcaattccacttcacagggtggcccgatcacggggtgccctaccatgcaactggactcttgggttttgtgcgtcaagttaaaagcaaaagccctccctccgcaggtccattggtagttcactgctccgcgggggctgggcgtaccggctgtttcatagtcatcgacataatgctggacatggccgagagagaaggagtagtggacatatacaattgtgttagagaattacgatcaagacgagtcaatatggtgcagacagaagagcagtatgtttttatccatgacgctatcctggaagcctgtctctgtggtgacacctccgttcccgccagccaggtgagatctctgtattacgacatgaacaaactggacccacaaaccaattctagtcagataaaagaagagtttcgaacactgaatatggtaacaccaacactaagagttgaagactgctccatcgccctgctgccacggaaccacgaaaaaaacaggtgtatggacatcctaccccccgacaggtgtctgccctttctgattactattgatggtgaaagctccaactacattaatgcagcactgatggactcgtataaacagccatcagccttcattgtcacacagcatcccttgcccaataccgtgaaggacttttggagactcgtactagattatcattgtaccagcgtagtgatgctgaacgacgtagaccctgcgcagctttgtcctcagtattggcctgagaacggtgtccaccggcacggacccatccaggtcgagttcgtctcggccgatctggaggaagacattatctcaagaatctttcggatctacaacgccgctcgcccacaagatggataccggatggtgcagcagtttcaatttctcggctggccaatgtatcgcgacactccggtttctaagcgcagtttcctgaaactgattcgacaggtggataaatggcaggaagagtacaatgggggcgagggtaggaccgtcgtccactgtttgaacggaggcggcagatccgggaccttctgcgcaatatccatcgtctgcgaaatgctgaggcaccagcggaccgtggatgtcttccacgctgtgaagacactgcgcaacaataagcccaatatggtggatctcctggatcagtacaaattctgttatgaggtcgccttggaatacctaaatagcggatag

SEQ ID NO: 130962 - DNA, 4401 bp, Artificial Sequence
  Description of Artificial Sequence: Synthetic coding sequence
atgcgtggactcgggacatgcctcgccacgttagccggcctgctgttgaccgccgcaggagagaccttctcaggcggatgtctgttcgacgaaccatatagtacttgtgggtactcacagagtgaaggcgacgactttaattgggagcaggtaaacaccctcacaaagcccacttccgacccctggatgccttctggctcttttatgctcgtcaatgcttcagggaggcctgagggccagagggctcacttgcttttgcctcaactgaaggaaaatgatacccactgcatcgacttccattacttcgtgagcagtaagtccaatagcccaccagggctgttgaacgtttatgtgaaagttaacaatggaccccttggcaatccaatctggaatatcagcggcgaccctacccgtacgtggaatagagcagaactggcaatttcgacattttggcctaacttctatcaggtgattttcgaggtaatcacatcgggccaccaagggtatcttgctatcgatgaggttaaagtgctcgggcacccttgtaccagaacacctcatttcttacgcatacagaatgtcgaggtcaacgccggacagttcgccacctttcagtgttctgccatcgggcggaccgtggccggtgaccgcctgtggttacagggcattgatgtcagagacgcacctttgaaagaaattaaggtgacatccagccggcgcttcatcgcgtctttcaatgtggtgaatacaactaaacgggacgccggcaaatatcggtgcatgattcgtactgaagggggggtggggatctctaattacgcggaactcgttgtcaaggagccccccgtaccaatagcaccgcctcagcttgcttcagtcggagccacttatctttggatccagctgaacgccaatagcatcaatggtgacggacccatagtcgctagagaggtggagtactgtactgctagtggaagctggaatgataggcagcctgtggattctaccagctacaagatcggccatttggaccccgacaccgagtatgagattagtgtgcttctgaccagacctggagaaggaggcaccgggagcccaggaccggcactccggaccagaactaagtgcgctgatcccatgagggggccgagaaagcttgaggttgtggaggttaaatctcgtcagatcaccatccgctgggagcctttcggctacaatgtgactaggtgccacagttataaccttactgttcactattgctatcaagtcggaggccaggaacaggttagggaagaagtaagttgggatactgagaactcccacccacagcatacaatcacaaacctctctccttacacaaacgtatccgttaaactcatcctcatgaaccctgaaggaagaaaagagagccaggaactaatcgtacagacagatgaggacttgccgggcgcagttcctactgagagcattcaaggcagcacgttcgaggaaaagattttcctgcagtggcgcgagccgacacagacctatggagttattactctgtacgagattacgtacaaagccgtgtcctcctttgacccggaaatcgatcttagcaatcagtctggaagagtttcaaaacttgggaacgagacgcacttcctatttttcggtctgtatcccggaacaacatatagcttcacaatcagggcaagtacagccaagggatttgggccccccgctaccaaccagtttacaaccaagatctctgctccctctatgccggcctatgaactggagacccccctgaatcaaacagataacacggtgacagtgatgctgaaaccagcccacagtagaggcgccccagtctcggtttaccagattgtcgttgaggaggagcgccctcgacggactaaaaagactaccgaaattctcaaatgctaccctgtgcctattcacttccaaaatgcctcacttttgaactctcagtactattttgctgctgagtttccggcggattctctgcaggctgcacaacccttcactatcggcgataacaaaacttacaacggttactggaacacacctctgcttccctataaatcctatcgcatttactttcaggctgcctcccgcgcaaacggggagactaaaatcgactgcgtgcaggtagcgacaaaaggagccgcgacacctaagcccgtgccagagcctgaaaagcagacagatcacactgtgaagattgctggtgtcatcgctggaatcttgctgttcgtgatcatcttcttaggcgttgtgctggtcatgaaaaagcggaagttagccaagaagcgcaaagaaacaatgagcagtacccgacaggagatgactgtcatggttaactcaatggataagagttacgcagagcagggaactaattgtgacgaggcattctcatttatggacacacataaccttaacgggagatctgtcagctctccatccagttttacgatgaagaccaatacgttgtccacctccgttcctaatagctattatccggacccattcgtgccaactgcgatactcgacttttctctgaacaatgagacccataccatggcttctgacacttctagcctggtccagtctcacacctacaaaaaacgggaacccgccgatgttccctaccagactgggcagctacaccccgcaatcagagtggccgacttgttgcaacacattactcagatgaaatgcgccgagggctacggcttcaaagaggaatatgagtcattctttgagggtcagagcgccccctgggatagcgctaaaaaggacgaaaacaggatgaaaaatcgctatggcaatattattgcctacgatcactcccgggtgagactgcagacgattgaaggcgataccaatagcgactacatcaacggcaactacattgacggatatcaccggcccaaccattacattgctactcagggacccatgcaagaaacaatatacgacttctggaggatggtttggcatgagaatacagcgtccattattatggtgacaaacctggtcgaggtcggcagggtgaaatgctgcaagtattggcccgatgataccgaaatctataaagatattaaggtgacgctcatcgagacagagctgttagcggaatatgtgattcgcaccttcgccgtggagaaacgcggagtccacgaaatccgagaaatacgacagttccacttcacggggtggcctgatcacggagtgccctaccatgctacaggactgctagggtttgtgagacaggtaaagtccaaatcacctccttccgccggaccgttggtcgtgcactgtagcgcgggcgccgggagaactggctgcttcatagtgatcgacattatgttagacatggcagagcgggagggtgtcgtggacatctataattgtgtgcgcgagttaagaagtcgacgggtgaacatggtgcagacagaagagcaatatgtgttcattcacgatgccatattggaggcttgcctttgtggtgacacatctgtgcctgctagtcaggttaggtcactctattacgacatgaataagctggacccccagactaactcaagccaaattaaggaggagttcaggacgctgaacatggtcaccccaacactgcgggtggaggattgctctattgctcttctcccacggaatcatgagaagaacaggtgcatggatatcctgcccccagacagatgcctccccttcttgatcaccatcgatggggagtcctcaaactacattaacgcagccctcatggactcttacaaacaacctagtgctttcatagtcacacagcatcccctgcccaatacagtgaaagatttctggcggctagtgctggattatcattgtaccagcgtcgtgatgctaaatgacgtcgaccccgcacagctgtgcccccagtactggccggaaaatggagtgcaccgtcatgggcctatccaggtcgagtttgtatccgccgacctggaagaggacattattagtaggattttcagaatttataatgctgctcgccctcaggatgggtaccgcatggtacagcagttccaattcctggggtggccgatgtaccgagacacacccgtgtcgaaacgaagtttcttgaagcttatacggcaggtggacaaatggcaggaagagtataacggcggtgagggacggaccgtcgtgcattgtcttaatggtggaggccggtccggcaccttctgtgccatctccattgtgtgtgagatgctgcgtcatcagagaaccgtcgacgtcttccatgccgtgaagacactgagaaataataaacctaatatggtggacttattggatcaatacaagttttgctatgaggttgcgctggagtatctgaattccgggtag

SEQ ID NO: 130963 - DNA, 3720 bp, Artificial Sequence
  Description of Artificial Sequence: Synthetic coding sequence
atgggtaccctgagtttgcatcccggaattgacgtccgtgacgccccccttaaggagattaaggtgacctcatctcgcaggttcatcgccagctttaatgtcgtgaacacgacaaaaagggatgctggcaagtacaggtgtatgatcaggaccgagggtggggtcggcatctccaattacgccgaactagttgtgaaggaacctcccgtgcccatcgcaccgccgcagctcgcttctgtcggagccacttacctttggatccagctgaatgccaattccatcaatggcgatggccctattgtggcaagggaggtcgagtactgcacagcgagcggcagctggaacgacagacaaccagtggatagtacatcatataagatcggccacctagacccggataccgaatacgaaatatctgttctgttgacaagacctggtgaaggtggaactggctctccaggccctgccctaaggaccagaacaaaatgtgcagatcccatgcgcggacctaggaagttggaggtagttgaagtcaagtcccggcaaatcactatccggtgggagccattcggatataatgtgactcgatgccactcttacaacctgactgtgcattactgttaccaagttggcggccaggaacaggtgcgcgaggaggtgtcttgggataccgagaatagtcatccgcagcacaccattactaacctctcaccctacaccaacgtatcagtgaagcttatactgatgaatcccgaagggcgtaaagagagccaggagcttattgtccaaacagatgaggacctgccgggcgccgtccctaccgaatccatccagggctctacatttgaggagaagatcttcctgcagtggcgtgagcccacacagacatatggagtgataacactgtacgagattacttataaggccgtctcttcgtttgacccagaaatcgacctgtctaaccagagcgggcgcgtgtcaaaactcgggaatgaaacccacttcctgttttttggactctatcctggcactacatactctttcaccatcagagccagcacagcaaagggcttcggacccccagccaccaatcagttcactaccaagataagcgcacccagtatgcccgcctacgagttagaaactcctctcaaccaaaccgacaacaccgtgaccgtgatgctgaaaccagcccactctcgcggtgcacctgtttctgtgtatcagattgtggtggaagaggagcgcccacgccgaacaaagaagacaacagagatccttaagtgctatccagtacccatccactttcaaaatgcctccctactgaacagccagtactacttcgcagctgagtttccagcagacagtttacaagctgcccagccattcaccataggcgataataagacttataacggatactggaacacaccattgctgccctacaaatcataccgcatctatttccaggccgcctcaagggcaaacggggagacaaaaattgattgtgtccaagtggccaccaagggagcagcgacccccaagcctgtaccagagcccgaaaaacagaccgatcataccgtgaaaatcgcgggagtaattgccggtatcttgctttttgtcataatcttcctcggagtggtgctggttatgaagaaaagaaagttggcaaaaaagagaaaagaaacaatgtcaagcacacggcaggaaatgacagtgatggtgaattcaatggacaagagttatgctgagcagggtacaaactgcgatgaagccttctcttttatggacacccacaacctgaatggcagatccgtttcctcaccaagctcgttcactatgaagactaatacactgtctacttcggtgcccaatagttactatccagatgagacccacacgatggcgtctgatacttcgagcctggtgcagagccatacatataagaagagagagcccgcagacgtcccctaccagactggacaattacaccctgctattagagtcgcagatctcctgcagcatattacccagatgaagtgtgccgaggggtatggtttcaaggaggaatatgaaagctttttcgaaggacagagcgctccctgggactccgccaaaaaagacgaaaacaggatgaaaaatcgatatggaaatatcatcgcttacgaccacagcagagtccgcctacagacgatcgagggtgacactaattccgattacattaacggcaattacatcgatggatatcatcggccaaatcactacatagctacgcagggacccatgcaggagacgatctatgacttctggcgcatggtttggcatgagaacactgcctcaattatcatggtgaccaacctcgtggaagtgggaagagtgaagtgttgcaaatactggcctgacgacaccgagatctataaggacatcaaggtgaccctgattgaaaccgaacttttagccgaatacgttattcggacattcgcagtcgagaaacggggcgtccacgaaatcagggagatccgccagtttcattttacgggttggcctgatcatggcgtaccataccacgcgaccgggctgctgggattcgtcaggcaggtgaagtccaagagtcctccttcagccgggccactcgttgtgcattgctcggccggcgctggtagaactgggtgtttcatcgtgattgatatcatgctcgacatggcggagcgagagggtgttgtcgacatttacaattgcgttcgagagctgcgatcccgtagagttaatatggtacagactgaagaacagtacgtcttcattcatgacgcaattctcgaggcctgtctgtgtggagatacatctgtacccgcctcccaggttaggtccctgtactacgacatgaacaaactcgacccccagacgaatagctcacagatcaaggaggaattcagaaccctcaatatggtgacaccaacgctgagggtcgaagactgctccattgctctactgcctcggaaccacgagaaaaatcgctgtatggacattctgccccccgatcggtgcctccctttcttgataacgattgatggagagtccagcaattacatcaatgctgctctaatggattcctataaacaaccaagtgcctttatagtgacccagcatccactgccaaacactgtgaaggacttttggaggttagtgttggattatcactgtacctccgtggtaatgttaaacgacgtcgacccagcacaactctgcccacagtactggcccgagaacggggtgcatagacacggccctatccaagtcgaattcgtgagcgccgatctagaggaggatattatttcccggattttccgcatttacaacgccgcccgtccacaggacggctatcggatggtgcaacaattccagttcctcggttggcctatgtatcgagatactcccgtcagcaaaaggtctttcctgaagctcatcagacaagtggataagtggcaggaagagtataatggtggcgaaggccggactgtcgtccattgcttaaacggaggaggaaggagcggcactttctgtgccattagtattgtgtgcgagatgctgcgtcatcagcggaccgtcgatgtgttccacgcggtcaaaacactgagaaataataagccgaatatggtggatctgctcgaccagtacaagttctgctacgaagttgccctggagtacctcaactcgggctag

SEQ ID NO: 130964 - DNA, 2940 bp, Artificial Sequence
  Description of Artificial Sequence: Synthetic coding sequence
atgagaaggccgcgaaggcctgggggcctggggggcagcgggggcctccgtttactcctctgtttgctgctgctgagctccagacctgggggatgcagcgctgtcagcgcacacgggtgtctgtttgacaggcggctgtgcagccacctcgaagtctgcatccaggatggcctctttggccaatgtcaggtgggagtggggcaggcaagacctttgcttcaggtgacctcccctgtactgcagcgtctgcagggggtgttaaggcagctgatgagtcaggggctgagttggcatgatgacttgacccagtacgtgataagccaggaaatggaaagaatacctcgactccgtccaccagagccacgcccacgcgacaggagcggccttgcacccaagaggcctggacccgccggagaacttctgcttcaggatatacccacaggttctgctccagcagcgcagcaccgtctccctcaacctccagtgggcaaagggggtgcaggggcctcttctagcctttccccactccaggccgagctgctgccacccctactagaacacttgctgctgccaccacagcctccgcatccttcactctcttacgagcctgccctcctgcagccttacttgtttcaccagtttggctctcgcgatggctctcgggtttccgaaggatcacctgggatggtttctgttggccctctgccaaaggccgaagcccctgcgctcttcagccgcacagcaagcaaggggattttcggggaccatcccggccactcttacggggaccttcccggtccttcccctgcgcagctatttcaagatagtgggctgctttaccttgcccaggaacttccagccccctcccgcgctagagtgccacgtctccctgagcaggggtcgagctcacgggccgaggatagccccgaggggtacgagaaagagggactgggcgacaggggagaaaagcctgcttcccctgccgtgcagcctgatgctgctctccagagactcgctgctgttctagcaggatatggcgtggagctgaggcagctcacacctgaacagctttcgactttgctgacgttattgcagctgctgccgaaaggcgctggaaggaatcccgggggtgttgtgaacgtgggggctgatatcaagaagactatggaaggccccgtggaaggccgggatacagccgagcttcctgccagaacttccccaatgccggggcatccgaccgctagtcccacgtcttcggaggtccagcaggtgccctctccggtgtcttccgagccaccaaaagctgctcgccccccggtgactccggtgctgctggaaaagaaatctccgctcggccagagtcagcccacagtggccggacagccaagcgcgaggcctgctgccgaggaatacggatacatagtgaccgaccaaaagcccctcagcctggccgcaggcgttaagctactggaaattctcgcagaacatgttcacatgagtagcggatccttcatcaacatttccgtggtcggtccagcacttacattccggatcagacataacgaacagaacctctctctagccgatgtgacacaacaggcaggtctggtgaagtcggaactcgaggctcagacagggctgcagattctgcagaccggggtcgggcaacgcgaggaggctgcggctgttctgccacagacggctcacagtaccagtccaatgcgctcggtgctcttgactcttgtagctctcgctggggtggccggactcctcgtggccctggcagtcgccctgtgcgtgaggcaacatgcacgacagcaggacaaagagagattagcagccctcggtccggagggtgcccatggcgatacgacgtttgaatatcaggatctctgtcggcagcatatggctacgaagagcttgtttaacagggctgagggccccccagagccgtcccgcgtttcttcagtgtcaagccaattcagcgatgcagcacaagcatcccctagctcacactcctcaacgccctcttggtgcgaggaaccagcacaggctaacatggacatttccaccggacacatgatacttgcttatatggaagaccacctgaggaaccgggatcgcctggctaaggagtggcaagccttgtgtgcttaccaagcagaacccaacacctgtgctacggcacaaggcgagggcaatattaagaagaacaggcacccggactttttgccgtatgatcatgcacgtatcaaacttaaagttgaaagctccccgtcccggtctgattacatcaacgcttctcctatcattgaacacgacccaagaatgcccgcctacatcgctactcaagggcccctgtctcataccatcgcggatttttggcagatggtatgggagtctgggtgcaccgtgatcgtgatgttgacccccctggtggaagacggggtaaagcagtgtgaccgctactggccagatgagggggccagcctttatcatgtctatgaagtaaacctggtgtcagaacatatatggtgtgaggattttctggtcagatccttctatttgaaaaacgtccagactcaggaaactcgtactctgacccagtttcattttctttcatggcccgccgaaggcactcctgcttccaccagacccctacttgatttccggcgaaaggttaacaaatgttacagaggacgctcctgtcctatcatagtgcactgcagtgacggggcaggacgtactggcacttatattctcatcgatatggtgctcaataggatggcaaaaggcgtcaaagaaattgacatagcagccacgcttgagcacgtgcgcgaccagcggccaggcctggtgcggtctaaagaccagttcgagtttgctctaactgctgttgccgaggaggtcaacgctatactaaaagccctgccgcagtag

SEQ ID NO: 130965 - DNA, 2853 bp, Artificial Sequence
  Description of Artificial Sequence: Synthetic coding sequence
atgcgaaggcctcgtcgacccggcggcctgggcggcagtggcggactcagactgcttctgtgtctcctcttactcagcagccgacccggcgggtgttccgcggtgtccgctcatggttgcctgtttgatcgcaggctgtgctcacacttggaagtgtgcatccaggacggtctgttcggtcagtgtcaggttggtgttggacaagccagacctctgttacaggtgacttcacccgtgttgcaaaggctgcagggtgtgctgaggcagctgatgagtcaaggactgagttggcatgatgacctgacccagtacgtgatttcgcaggaaatggaacggataccacgcctcaggccgcctgagccacgtccccgtgacagaagcggtctggcccctaagagaccaggcccagcgggggaactacttctccaggatatacctacaggaagcgcaccagccgcccaacaccggctccctcagcctccagtcggaaagggcggcgccggagcttcttcatctctgagtccactgcaggctgagctcctgccccccttgcttgaacacctgcttttgccaccccaacctccccacccttctttgagttatgagcccgcgctgctgcaaccatacttgttccaccagttcggttctagagacggcagtcgcgtgtcagagggtagcccaggaatggtgtccgtggggcccctaccaaaggccgaagctcctgctcttttttccagaaccgcatctaaaggaatattcggggatcatcccggtcactcatacggggacttgcccggtcctagtcctgcgcagctgttccaagactccggactgctgtatctagcccaggagctgcccgccccatccagagcaagggtgccacgattgcccgagcaggggagctcgagcagagcagaggactcgcctgaaggctacgagaaggagggcttgggtgatcgcggtgaaaaacccgcaagccctgcggtgcagcccgacgccgccctgcaacggctcgcggcagttctggcagggtatggcgtcgagttgaggcagctcacaccagagcagctgtcaactctgctcacgctcttgcaactcctgcccaaaggggccggacggaaccccggcggagtagtgaatgtgggcgcagacataaagaagactatggaagggcctgtggagggaagagatactgccgagttgcccgcacggaccagcccaatgcccggccatccaacggctagcccgactagttcggaggtgcagcaagtgccaagccccgtgagttccgaacccccaaaagcagcgcgtccccccgtaacgccagtgcttctggagaagaaaagtccgctcggccagtcccaacccaccgttgccggccagccatccgcccgccccgccgccgaggaatatggatacattgtcaccgaccagaatgtggttggtcccgcactgacattccgcattagacacaatgaacagaatttgtcacttgccgacgttacccagcaggccggtctcgtgaaaagcgaacttgaggcgcagactggactgcaaattttgcagacaggcgtcggtcagcgggaagaagccgctgcagttctgccgcaaactgcgcactccaccagtcccatgcgcagcgttctgctcaccctcgtcgccctggcaggagttgcaggcctgttagtggctctcgctgtggcactctgcgtcagacagcatgctcggcagcaggataaggaaagacttgctgcactaggaccagagggcgctcacggggacactactttcgagtatcaagacttatgcaggcagcatatggccacaaaaagtcttttcaacagggccgaggggccccccgaaccctcccgggtgtcatccgtcagttctcaattcagcgatgctgctcaggcatctccctcttcccacagcagcaccccctcttggtgcgaagaaccagcacaggccaacatggatatttccacaggccacatgattcttgcgtacatggaggaccacctcagaaatagggaccggctggcgaaagagtggcaagccctatgtgcttaccaggcggagcctaatacatgcgcaactgcccagggggagggcaatatcaagaagaatcgacatccggatttcctcccatacgaccatgcccgtatcaaactgaaagttgagtctagcccttcacgatcagactatataaacgcctcccctatcatcgaacatgatccgcgcatgcccgcatatatcgcgacccagggacctttgtcacatactatcgcagacttctggcaaatggtgtgggagagcgggtgcactgtgatcgtgatgctgacccccttagttgaggacggcgttaaacagtgcgatcgctattggcctgatgaaggcgcttctctgtatcatgtgtacgaagtgaacttggtgagcgaacacatctggtgcgaggactttttggtccgtagcttctaccttaagaatgtgcaaactcaggagactcgaactctgacccagttccattttttgtcctggccagctgagggaacacccgctagcacacggccactcttggatttcagacggaaagtcaacaaatgctaccgagggcgcagctgtccgataatcgtgcattgcagcgatggggccggccggacaggcacatacatactaatcgatatggtgcttaaccgcatggcgaagggcgtcaaggaaatcgatatcgcagcaacactagaacatgtgagagatcaacggccaggcttggtccgatctaaggaccagttcgaatttgcgcttacagccgtcgcagaagaggtcaacgcgattttgaaagctttaccccaatag

SEQ ID NO: 130966 - DNA, 489 bp, Artificial Sequence
  Description of Artificial Sequence: Synthetic coding sequence
atgagacggccaaggcgccccggaggtctaggtggaagtggcggcctccgcctgcttctctgccttctccttcttagttcacggcccggcggctgctctgcagttagcgcccacggttgtctgtttgataggcggctttgctcacacctggaggtgtgtattcaagatggactgtttggacaatgtcaggtaggggtagggcaggctcgcccactgctccaggttaccagcccagtgcttcagcgtctgcagggcgtgttacggcagctcatgtctcaaggattaagttggcacgatgacctgacacagtacgtgatttcccaggagatggagcgaataccgaggctgcggcccccagaaccccgccccagagatcggagtggcttggcgcccaagcgtcccggccctgcaggcgaactcctcttgcaggacatccccacaggctctgctcccgccgcccagctgctctccgtgccttcagcaggttag

SEQ ID NO: 130967 - DNA, 2670 bp, Artificial Sequence
  Description of Artificial Sequence: Synthetic coding sequence
atgtcacaggggctgtcttggcacgatgacctgactcaatacgtcatcagccaggagatggagaggattcccagactgcggccccctgaacccagacctagagacagaagcggccttgcacccaaaagacctggcccggcaggggagctcctattgcaggatattcccactggcagcgcccctgccgcgcagcaccgcctgccccagcctcctgtcggaaaggggggggctggagccagcagcagtctcagtcccctacaggcagagcttctgccgccgctgctcgagcacctcctcctgcccccccaacctccacacccatcattgtcctatgagcccgcgctactacagccctatttgttccatcaattcggcagcagagacggatcgagggttagcgagggatcccccggaatggtctccgttggcccactgcccaaggcagaagctccggcactgttctcacgaactgctagcaaaggcatcttcggcgatcaccccggacacagctatggagacttgccaggcccttcccccgcccagctctttcaggacagcgggttactttaccttgcacaggagcttcctgctccgagtcgcgcccgagtcccaagactgcccgagcagggctcctcctccagggcggaggactctcccgagggctatgagaaggaaggactgggggacagaggggaaaaaccagcttctcctgcagtgcagcccgacgccgccctccaacggctggcagctgtgttagccggttacggcgtagagctgcggcagttgacgccagaacagctgtcaacactattgacattgcttcagctgctgccaaaaggggccgggagaaatccgggtggcgttgtgaacgtgggagccgatattaagaaaacaatggaggggccagttgagggtagagataccgcggaactcccagcacggacatctcctatgccggggcatcccacggcttcccccacatcctccgaggtgcaacaggtcccaagtccagtgtccagcgaacctcctaaggctgccagaccccctgtgactccagtactgttagaaaagaagtctccgctcgggcagagccagcccacagttgctggacagccatccgcccgccctgcagccgaggagtacggatatattgtgactgaccagaagcccttaagtctcgctgctggagtaaaattgctggagatacttgctgagcacgtacacatgagctcagggtcatttattaatatttccgtggtgggacccgccctcaccttcaggattcgccacaacgaacagaatcttagcctggcagatgtaactcagcaggctggcctcgtgaagtcagagttagaagcccagacaggattgcaaatcctgcagactggagttggccagcgtgaggaggctgctgctgttcttccgcagactgcacacagcaccagcccaatgagatccgtgctccttactcttgtcgccctggcgggggtcgctgggttgctcgtggcccttgccgttgccctgtgtgtccgccaacacgcacgacagcaggataaagagaggctggccgccctaggccccgagggggcccatggtgacacgacattcgaataccaggatctgtgcaggcaacacatggccaccaagagcctgttcaaccgcgctgaagggccgccagagccgagcagagtctcatcggtgagctcacagttttctgacgccgcgcaggcctccccgtcatcgcatagctccaccccttcctggtgcgaagaaccggcacaggcaaacatggacatttccacgggacacatgatactggcctacatggaagaccatctgcggaaccgcgaccggctggctaaggaatggcaggctctctgcgcatatcaagcggagcccaatacctgcgcgacagctcagggtgaaggcaatatcaagaaaaacagacaccccgactttctaccctatgaccatgcccggattaagctgaaagttgagagcagtccatccagatcagactacatcaacgcttcaccgattatagaacatgacccccgtatgcccgcatatattgccactcagggcccgctgagccacacaatcgcggacttctggcaaatggtatgggagtccgggtgcactgttatagttatgttaacacccctcgttgaggatggcgtgaaacagtgcgataggtattggccagacgaaggcgccagcttgtatcacgtttatgaggtcaatctcgtgtctgagcacatttggtgtgaagatttcctggtgaggagcttttatcttaagaatgttcagacccaggagactagaacactgacacagttccattttctatcctggcccgcagagggaactcctgcttccacaagaccgttactggacttccgccgcaaagtgaataagtgctacagaggaagaagctgtccgattattgttcattgctctgatggggcgggccggacaggcacatatatactcatcgacatggtattgaataggatggcgaaaggagttaaagagattgatattgctgctacgctggagcatgtacgtgaccaacgacccgggctggtgagatctaaggatcagttcgagttcgctctgactgctgtggctgaggaggttaatgctatcctcaaggcactcccccagtag

SEQ ID NO: 130968 - DNA, 2853 bp, Artificial Sequence
  Description of Artificial Sequence: Synthetic coding sequence
atgcgcaggcccaggcggcctggcggcttgggtgggtcaggtggcctccggctactgctctgcttactgctcttgtcgagccgacctggtggatgctcggcggtgagtgcacacggttgccttttcgatcgccggctgtgctctcacctcgaggtgtgcatccaggatgggcttttcggacagtgtcaggttggcgtgggtcaggctcgaccccttctgcaggtcacttccccagtgctacagaggctgcagggagttctgcgacagttaatgagccaggggctttcctggcatgacgaccttactcagtacgtcatatcacaagagatggagagaatccccaggctcaggcccccggagccccgcccacgcgaccggtctgggcttgccccaaagagaccaggccccgccggggagctgttgttgcaagatatcccaactggctccgcacccgcagcccaacaccgcctgccccaacctcccgttgggaaaggaggagccggggccagctcttcactgtctccccttcaggcagagctgctcccaccactgctggagcacctcttactcccgcctcagccacctcacccctcattgtcatatgagcccgccctgcttcaaccatacctcttccaccagtttggctcgagagatgggtcacgggtgagcgaaggcagccctggcatggtgtccgtgggtcctctcccaaaagcagaagcacctgccctgttcagtaggaccgcttctaaaggcatcttcggtgatcaccccgggcactcatacggagatctaccagggccgagtcccgcccaactcttccaggattcaggattgctttacttagctcaagaactgccggccccatcgagggccagagtgccgcgactgcctgagcagggcagctcgtcccgggctgaagacagcccagagggatacgaaaaagaaggactgggagaccggggtgagaaaccagcatccccggctgtccaacccgacgctgctttgcagcgcctggcggctgttttagctggctatggggttgaactgaggcagctgaccccggagcagctgagtacactcctcaccctgctccagctcctgccaaagggagcgggtcgaaatccaggcggcgttgtcaatgtgggcgccgatatcaagaagactatggaaggccccgtggagggcagggacaccgctgagttgcctgcaagaacttctccaatgccaggccatccgacagctagtcccacctctagcgaggttcaacaggtccccagcccagtttcaagtgaaccaccaaaagcagcccgcccccccgtcacaccagtgcttctcgagaaaaaaagtcccctcgggcaatcccaaccaaccgtggctggtcagccgtctgcaagacctgccgccgaggagtatgggtatattgttacagaccagaatgttgtcggacctgccctcacgttcaggatccgacacaatgaacagaatctgtccctcgcagacgttacccagcaggccggtctggtgaagagcgaactggaggcccagaccggcctccagatactgcagacaggagttggacagagggaagaggctgctgccgttctgccacagaccgcccactcaacaagccctatgcgctcagtgctgctaactctagtggccctcgctggggtagcagggctattagtcgcgctggccgtggccctctgtgtcaggcagcatgctagacagcaggacaaagagcggctggctgcactgggccctgagggggctcatggcgacaccactttcgaatatcaggacctatgtagacagcacatggccaccaagagcctttttaacagagcggaaggcccgcctgagccctctagggtgtcttccgtgtcgtctcaattctccgacgccgcccaagcttcaccatcctcacattcaagcaccccaagctggtgcgaagagcctgcacaggctaacatggacatatccacaggccacatgattctcgcttatatggaagaccatttacgcaaccgggatcggttggccaaggaatggcaggcgctttgcgcttaccaggctgagccaaatacctgtgctacagcccaaggagagggcaacattaaaaaaaatcggcaccctgacttcctcccatacgaccacgctagaattaaacttaaggtcgaatcatcccccagccgcagcgactatatcaatgcgtcacccattatcgaacacgacccccggatgccagcctatatcgcgacgcaggggccactgagtcacaccattgctgacttctggcagatggtgtgggaaagtggatgcacggtcatcgtcatgctgacacccctcgtggaagacggggttaagcagtgtgatcgatactggcccgacgaaggagcatccttgtatcacgtgtacgaagtcaacttagtcagcgaacacatctggtgcgaggattttctggtgagaagcttttatctcaaaaatgtgcagacccaggagacacggacccttactcaattccactttctaagttggccagccgaggggactcctgcttccactcgtcctctgctcgacttccggcggaaagtgaataagtgctatcgcggccggtcctgtccaattatcgtgcattgctccgatggggcaggaagaacagggacgtacattctgatcgacatggtgctcaacaggatggccaaaggcgtcaaagagatcgacattgccgctactctcgaacacgtgcgggaccagagaccaggtctcgtgagatcaaaagaccagttcgaattcgcattgacagcggtggccgaagaggttaacgcaatccttaaggctctgccacagtag

SEQ ID NO: 130969 - DNA, 2961 bp, Artificial Sequence
  Description of Artificial Sequence: Synthetic coding sequence
atgggacctccgttacccctcctcctcctgttactgctcctcctaccccctcgcgtgctccccgccgcccccagttccgtcccgagggggcgccagctccccgggcggctggggtgcctgctggaggagggcttatgcggggcgtccgaggcctgtgttaacgacggagtgtttgggagatgtcagaaggtgcctgccatggacttctatcggtatgaggtctcacctgtcgcacttcagcggctgcgagtggctctacagaaactgtctggtaccgggtttacatggcaggatgattacactcaatatgtgatggaccaggaactcgccgacctgcctaagacatacttaaggagaccggaggcttcctctccagctcggcctagtaagcacagcgtgggctcggagcgcaggtattcccgtgagggcggcgcagcactcgccaacgcattgcgtcgccatctgcctttcctggaagccttgagtcaggcaccagcatccgacgtcttggctcggactcatactgcccaggacagaccgcccgcggagggggatgaccgcttcagcgagtctatacttacctatgtagctcatactagcgcattgacgtatcccccaggcagcaggacacaactgcgcgaagatctgctgcctcgtaccctgggccagcttcagcccgatgagctgtcccctaaagttgattcaggggtcgacaggcaccatcttatggctgcattgtccgcctacgccgcacagaggccaccagccccaccaggtgagggatccctggaacctcaatatctgcttagggccccatctcgaatgcctcgcccactactggcccccgcagcgcctcagaagtggcctagccctttaggcgactctgaggacccaagctctactggcgacggggcacgcatccacactctcctcaaggatctgcaacggcagcctgctgaagtacgtgggctctcagggctggaactggatggaatggctgagctgatggccgggctaatgcagggcgtcgatcacggcgtggcgcggggctcccctgggagggccgcactgggtgagtctggcgaacaagctgatggtcccaaggctacattgaggggagactcattcccggatgatggcgtccaggacgacgacgaccgactctatcaggaagtgcacagactgagcgctaccctgggaggcctacttcaggatcacggcagcagattactacccggtgcattgccctttgctcggcctctggatatggaaaggaaaaagagcgaacacccagagagctctctgtcgtccgaagaggagactgcaggcgtagagaacgttaaaagccagacgtattctaaggatctgcttgggcagcagccacactccgaacccggcgccgccgcttttggagaactccaaaatcagatgcccgggccctccaaagaggaacaatccctccctgcaggagctcaggaagccctgagcgacggacttcagctggaggtgcagccctctgaggaggaagcccggggctatatagtgaccgacagagaggtgttaggacccgctgttacatttaaagtctctgcaaacgtgcagaatgtgacaaccgaggacgttgaaaaagccactgtggataataaagacaaactcgaggagacctctgggctgaaaatcctgcagaccggtgtgggcagcaagtctaaactcaagtttcttcccccacaagcggaacaggaagactctaccaagtttatagcactgactcttgtgagcctggcctgcattctgggtgtcttgctagccagtggccttatttactgcctgcggcatagcagccaacatcgcctcaaagagaaactgtccggccttggcggggacccaggcgctgatgctacggccgcctatcaggaactatgcagacagaggatggcaactaggcccccggacaggccagaagggccacacactagcagaataagtagtgtttctagccagttttctgacggtcccatccccagtccctcggcccgcagttctgcctcgagctggtctgaggagcccgttcagagcaatatggacattagcactgggcacatgattctgagctatatggaggatcatctgaaaaacaaaaatcgtctggagaaagaatgggaagcactgtgcgcttatcaggcagaaccaaattcctcattcgtcgcacagcgggaagagaacgtccctaagaatagatccttggcagtgctcacctatgaccacagtagggtcctgttaaaggcagagaattcccatagccacagcgattacatcaatgcatctcccatcatggatcacgatccaaggaatcctgcatatattgctacacaggggcctcttcctgcaacagtggctgatttctggcaaatggtatgggaaagtggctgtgtggtgattgtcatgttgacacctctggcagagaacggggtcaggcagtgctatcattactggcctgacgagggatctaatttgtaccacatctatgaagttaacctagtctccgagcacatctggtgtgaagacttcctggtgcgctctttttacctgaagaacctgcagaccaatgaaactcggaccgtaactcagttccatttcctgtcttggtacgaccgaggcgtgccatcatcgagcagaagcctgctggactttcggaggaaagtaaataagtgttatagagggcggagttgccccattatagtgcattgcagtgacggtgccggccgtagtggaacctatgtgcttatcgatatggtcctcaacaaaatggccaagggggcaaaagaaatagacatcgcggcgacccttgaacacctcagagaccagcggccaggtatggttcagaccaaggagcagtttgagtttgccctgacagctgtggcagaggaggtgaacgccatacttaaggccctgcctcaatag

SEQ ID NO: 130970 - DNA, 2997 bp, Artificial Sequence
  Description of Artificial Sequence: Synthetic coding sequence
atgggaccccctctgcccctgctcctgctcctcttgctgctcttgcccccccgagtcttgcctgcagctccttcaagcgtgcctcgtggtagacagctgcctgggcgtctggacggcgtttttgggagatgccaaaaggtgcctgcaatggacttttacagatacgaagtctccccagtggctctgcagcggctccgcgttgccttgcagaaactcagcggcactggttttacctggcaagacgactatactcagtacgtgatggatcaggagttggccgacctgcctaaaacttatctcagacggcccgaggccagcagcccggccaggccaagcaaacactccgtggggtctgagagaaggtactcgcgggagggcggagccgcacttgctaacgccttacggcgccatctcccttttctagaagcactgtctcaggcccccgcctctgacgtgcttgctcgtacacacaccgcacaagatagaccccctgccgaaggcgatgacaggttctccgagagcatactgacctatgtcgcccataccagcgcattgacttaccctccgggatcgaggacccagctgagggaggatctcctccctaggacccttggccagctgcaacctgatgaattatccccaaaagtcgattcaggggtggaccgccatcatctgatggctgcattgtccgcttatgccgctcaacggcctcctgctccacccggtgaaggctcattagagcctcaatacctactccgcgcaccctcacgcatgccgaggccactgttagctcctgctgccccccaaaagtggccgagtcctcttggtgattccgaagaccccagtagcactggcgacggtgcacgtatccacactctgctgaaggacctccagagacagcccgcggaagtgcgaggactcagcggtctggagctggatggtatggccgagcttatggccggactgatgcaaggcgttgatcatggggtggctagaggttcacccggaagagctgccttgggcgaatcgggtgagcaggctgatggacccaaggctacccttagaggcgattcctttcccgacgatggcgtacaggacgacgacgatcgactctatcaggaggtacatcgtctgtcagcaactttggggggcttactacaagatcatgggtctcgactgctgcctggcgcactgccctttgctaggcctctggacatggagcgtaagaaaagcgagcatcccgaaagctctctctctagcgaagaggaaacagccggcgtcgagaatgtgaagtcacagacatattcgaaggatctccttggccaacagccacactctgagccaggcgccgcagcttttggcgaattgcaaaaccagatgccaggaccctcgaaggaggaacagtcacttcctgccggcgctcaagaagccctgagcgacggacttcagttagaggtccaaccgagtgaagaggaggccagaggatatatagtgaccgacagggaccctctgaggcccgaggagggtcggcgcttggtggaggatgttgctaggctcctgcaagtgcctagctctgcctttgcagacgtggaggtccttggccccgccgtgactttcaaggtgagcgccaacgtgcagaacgtgacaaccgaagacgtcgagaaagccaccgttgataataaggataagctggaggaaactagtggtttaaagatactgcaaaccggggtgggcagtaaatctaaattgaagtttctacctccgcaggccgaacaggaggactctacgaagtttattgccctcacactggtcagcttggcctgtatactgggcgtcctccttgccagcggcctgatctactgcctacgacacagttcccagcatcggctgaaggagaagttaagtggtctgggcggcgatccgggtgctgacgctacagccgcataccaagaactctgccgacagagaatggcaacccggccacccgaccgcccagaaggtccgcatacatcaagaatttcatctgtatccagtcagttcagcgatgggccaatcccaagtccttccgcgaggagtagtgctagttcatggtccgaagagccagtgcagtcaaacatggatatctcaaccggacacatgatcctatcctacatggaggatcaccttaaaaacaaaaatcgcctggagaaggaatgggaggccttgtgtgcataccaagccgagcctaacagcagcttcgttgcacagcgggaggagaatgttcccaaaaatagaagccttgcggtattgacctacgatcactcccgagtgctccttaaggctgaaaattctcacagccacagtgactacattaacgctagcccaattatggatcatgaccctagaaatccagcttacatagccacgcaggggccactgccggcgactgtggcggacttttggcaaatggtgtgggagtctggctgcgtggttattgtgatgttaactcctctggccgagaacggcgtgagacaatgctaccactactggccagatgaggggagtaatttataccacatctacgaggtaaacctggtctcagaacatatctggtgcgaagactttctggtccgcagcttctaccttaagaacttgcaaacaaatgaaactcggacggtgacccagttccatttcctttcatggtatgatcgcggggtccccagctccagccgatcattgctggacttccggagaaaggtcaataagtgttatagggggcgttcgtgcccaatcatcgtacattgttctgatggggctgggcgtagtggaacttacgtgctgatagatatggttctgaataaaatggccaagggcgctaaggagatcgacattgcggcgaccctggaacacctcagggatcaaaggccagggatggttcagactaaggagcagtttgagttcgctttaacagcggtggctgaggaggtgaatgccattctcaaggccctgccacagtag

SEQ ID NO: 130971 - DNA, 3048 bp, Artificial Sequence
  Description of Artificial Sequence: Synthetic coding sequence
atgggtcctccattacccctgctgctgctgctcttgcttctactgcctccacgagtgttacctgccgccccctcatctgttccaaggggcagacaactgccaggtcgtttgggctgcctcctggaagaaggtctctgcggagctagcgaggcttgtgtcaatgacggtgttttcgggaggtgtcaaaaggtacccgctatggacttctacagatatgaagtgagccctgtggcgctgcagcgcctgagggtggctctgcagaaactgtctgggaccggttttacctggcaggacgactacactcaatatgtgatggaccaagagctggctgatcttccgaagacctaccttagacgccccgaagcctcctctcccgccaggcctagcaaacactcagtcggtagcgagcgaagatactctagagaaggcggtgcagccttggccaatgccctaaggaggcacctgccctttctggaagccttgagtcaagcaccggcatccgatgttctagcacggacacacactgcacaagatagacctccagcagagggcgacgatagattcagcgagagtatcctcacatatgtggcacacacctcagctctgacttacccacccgggtcgcggacacagctgcgggaggatcttctgcccaggaccttgggccagcttcagcctgacgagttgtctccaaaagtcgactctggagttgacagacatcacctcatggctgctctttctgcatatgccgcccagagaccgcccgccccccccggcgagggatcactggaaccccagtacctgcttcgcgccccctctcgaatgcctaggccactcctggcccccgccgccccacagaaatggccaagtccactaggcgacagcgaggatccctctagtactggtgatggcgctaggatccacaccttacttaaagatctgcaaaggcagccggccgaagtccggggacttagcggcttggaacttgatggcatggctgaactcatggcaggtctgatgcagggggtggaccatggtgtggcgagaggatcaccaggacgagcagccctaggggagtcaggagagcaagcagacggacccaaagccacgctaaggggggactccttccctgacgatggagtacaagacgatgatgaccgtctgtaccaggaagtgcatcgactgtcagcaacgctcggcggactcctgcaggaccacggatccagactgttgccaggagcgctgcccttcgcgcgtccgctggacatggagagaaagaagagcgagcaccctgagtcatctctgagctcagaggaggaaacagcaggagtagagaacgtgaagtcccagacatattccaaggatctcctcgggcagcagccccacagtgaaccaggggcagcagccttcggcgaactgcagaatcagatgccaggacccagtaaggaagaacagtctctgccagcaggtgcccaagaggctctgtcagacggcttgcagctggaagtgcagccatctgaagaagaggccaggggttacatcgtaacagacagggacccgctgagacccgaggagggtcgcaggttagttgaagatgtcgcacgcctgctgcaagtgccttcaagtgccttcgccgacgtggaggtcctggggccagctgtaaccttcaaagtttccgctaacgtgcagaatgtaactacggaagacgtggagaaggctaccgtggataataaggacaagttggaagaaacttcaggattgaaaatccttcagacgggggtgggttcaaaatccaagcttaaattcctccccccacaagcagagcaggaggactccaccaagttcatcgcattaacattagtcagtctcgcttgcatcctgggcgtgctactcgcttccgggctgatttactgcctgcggcattccagtcagcatagattgaaagaaaaactgagcgggttgggaggcgaccctggcgccgatgctactgctgcttaccaggagctctgtcgtcagcgaatggctacccggccgccggatcggccagagggaccacatacctctcggatttcgagcgtgtcgtcacagtttagcgacggacctattccatctccctccgctagatcttccgcgagctcctggtctgaggagcctgtccaaagtaacatggacataagcaccggccacatgatcctgagctatatggaggaccacctaaagaacaagaataggctagagaaggagtgggaagccctgtgtgcatatcaagctgagcccaatagctccttcgtggcgcaacgcgaagagaatgtgccaaagaatagatcgcttgcggtactcacatacgatcactctcgggtgctgctgaaggcagagaattctcattctcacagcgattatattaatgcttcgcccattatggatcatgaccctagaaatcctgcctacatcgcaacacaggggccccttcctgccaccgtggccgatttctggcagatggtttgggaatctggctgcgtcgtgatcgtgatgctcacccctctggcagagaatggtgtccgacagtgctaccactactggccagacgagggaagcaacctttaccatatctacgaggtcaacctagtctccgagcacatctggtgtgaagactttctggtgaggagtttctatctcaagaacttgcagactaacgaaacccggacggtcacacagtttcatttcctgtcgtggtacgacaggggagtgccctcctcttccagatctctgctagattttaggcgcaaggtaaataagtgctaccgtggacgctcttgtcctataattgtgcattgttcagacggcgcagggcgaagtgggacgtacgtcctgatcgacatggtcctgaataagatggccaagggagctaaagaaattgatattgccgccactttagaacatctcagggaccaacggccaggcatggtccaaaccaaggaacagttcgagttcgccttgacagcagtagccgaggaggtgaacgccatcctcaaggctctccctcagtag

SEQ ID NO: 130972 - DNA, 3117 bp, Artificial Sequence
  Description of Artificial Sequence: Synthetic coding sequence
atggctgttgaaagtgaatactcccttctgcggaccgaggcttcatttccaacgatgaagatgttttgcgtgtctcacactctgccgagagtcgaggtcatgtttgtctccggcccacagacgcgcgaacgaactgagcccgtggacccacggtggcaatgcttggtgcagatgtgggcagggtgtctgcttgaagagggtctgtgtggggcttctgaagcctgcgtcaacgatggcgttttcggccgctgtcagaaggtaccggctatggatttctaccgatatgaggtaagccccgttgcactccaacgtttgagggtagctctccagaaattgagtggaactggcttcacctggcaagatgactatactcagtacgtgatggaccaggaattagcggaccttccaaaaacctacctgcgaagacctgaggccagctcacctgcgaggccatcaaaacattctgtcggcagtgagaggagatactctcgcgaaggaggagccgcccttgccaacgctctgcgacgccacttgcctttcctcgaggctctctcacaggcgccagcttccgacgtcttggcgaggacgcacaccgctcaggatcggcctcccgccgagggtgacgatcgcttctccgaatctatcctaacttatgtcgcccataccagtgcccttacttatcctcctgggtctagaacgcagctacgagaagatctgctacctcggacactcggtcaactgcaaccagacgaactgagccccaaggtcgacagcggcgtggatcgacatcacctcatggccgcactctcagcatacgctgcccagaggcccccagcaccccctggcgaggggtcactggagcctcaatatctgctgagagctccatcacggatgccacgccccctgttagcccctgctgcccctcagaagtggcccagccctctgggtgattccgaagaccccagcagtaccggcgacggtgcccgaatccacactctcctaaaggacttacaacggcagccagccgaggtgagaggactgagcggcctggagctagatgggatggccgagcttatggctggactgatgcagggcgtggaccatggggtggcgagagggtcacccgggcgggctgcattaggggagagtggcgagcaagcagatggacccaaggccaccctgaggggtgatagcttccctgacgacggggtgcaggacgatgacgaccgcctgtatcaggaagttcataggctaagcgccacactcggcggactgctccaagatcatgggtcccgcctgctgcctggagctttaccttttgcaagaccgctcgacatggagcggaagaagagcgagcaccccgagtcctccctatcctccgaggaagaaacagctggagtggagaacgtcaagagccaaacatattcaaaagatctcttggggcaacaaccccattcagaacctggggctgctgctttcggcgaactgcagaaccaaatgcccgggcccagcaaagaggagcagagcctgcctgccggtgctcaggaggctctatccgacggcctgcagctcgaggtccagcctagcgaagaggaggccaggggctacattgtcacagacagagatccgttgcggcccgaggaggggagacgccttgtcgaggatgttgcacgtctactgcaagttccaagcagtgcgttcgcagacgtggaggttctggggcccgcagttacatttaaggtctcggcgaacgttcagaatgtgacaaccgaggacgttgagaaagctacagttgacaataaggataaactggaggaaacgtctgggctgaaaattctgcagactggcgtagggtcaaagagcaaactcaaattcctgcccccacaggctgagcaggaagattctacaaagttcatagctttaacgctagtgtcccttgcttgtattctgggggttctgttggcttctgggttgatctactgcctgcgacacagcagccaacatagacttaaggagaagctttcgggcctcggaggggacccaggcgccgatgccacagctgcgtaccaggaactctgccgccagcggatggctactcgccctcctgatcggcccgaagggccccacacctccaggatatcgtctgtttccagccagtttagtgatggccctataccttcgccgagcgcgagaagctccgcttcctcctggtccgaagagccagtgcagtcaaacatggatatctccactggacacatgatcctctcttacatggaggatcacctcaagaataaaaatcgattagagaaagaatgggaagcattatgtgcctaccaggccgaaccaaattcttctttcgtggcccagagggaggagaatgttcctaagaatcgcagtctggccgtgcttacctacgatcatagccgcgtattactgaaggctgagaattcgcactcacattctgactacatcaatgcttcccctattatggaccacgatccgagaaaccccgcttacatcgcgactcagggaccactccctgctaccgtggcggatttctggcagatggtgtgggaatcaggatgcgtcgtcatagtgatgcttactcccctggctgagaacggcgttcgccagtgttaccactattggcccgatgagggatccaacctgtaccatatctacgaagtgaacctagtcagtgagcatatctggtgtgaggatttcttagtgcgctccttttacctgaagaacctccagaccaacgagacccgaacggtgacccagttccactttctttcttggtacgataggggcgtgccctcatcctccagaagcttgctcgatttccggcggaaagttaataagtgttacagaggtaggtcctgccctataatcgtgcactgttctgacggggccggcagatccgggacctacgtgctcattgacatggtgctgaataaaatggccaagggagcaaaggagattgacatcgcagcaaccctggaacatcttagagatcaacgccccgggatggtccagaccaaagaacagttcgagttcgcgctgaccgccgtcgcggaggaggtgaacgctattctcaaagcactgccccagtag

SEQ ID NO: 130973 - DNA, 2934 bp, Artificial Sequence
  Description of Artificial Sequence: Synthetic coding sequence
atgggtccccctctgccacttttactgctgctccttctcctgctgcccccacgcgtattgccagctgccccttccagcgtgcctagaggccggcagctcccaggcagactgggctgtttactggaggagggactgtgcggtgcctccgaggcatgcgtgaacggattcacatggcaggacgattacactcagtatgtaatggatcaggaattggcagatctgccgaagacttatcttagaagacctgaggcatcatcaccagcccggccttccaagcattctgtggggagtgagcggcggtattcacgcgagggtggagcggctttggctaatgctctgcggagacatctgcccttcctggaggctctttcccaggctcccgcgagcgacgtcctggcacggacccatacagcccaggatcgcccaccagctgagggggatgatagattctccgagtctatcctcacttacgtggcccacaccagcgctttgacatatccccccggctcaaggacacagttacgtgaagacttgctgcctaggaccctgggtcagcttcagcccgatgagctctccccaaaagtggattcgggagtggaccggcatcaccttatggcggctctcagcgcgtacgcggcacagaggccacccgcgccgccgggagaaggcagcctggaaccccagtacctcttgagggctccctccaggatgcccaggccactactcgctcccgcagccccacagaaatggccctccccactgggcgattcagaggacccctcatctaccggtgatggcgctcggatccacacactgcttaaagatctgcagcgacaacccgcagaagtaagaggtctttctggtttggagctggacgggatggcagagcttatggccggcttgatgcagggagtcgatcatggcgtagccagggggtctcctggaagggccgctttaggggagagcggagaacaagccgacgggccgaaggccactttaaggggagacagcttccctgatgatggcgtccaggacgatgatgaccgactctatcaggaggttcatagactcagtgctactctcggtggtctgcttcaggatcacggcagccggttgctgccgggcgcgctgcctttcgcccgtccactagatatggagcgtaaaaagtctgagcacccagagagctccctgtcctccgaagaggagaccgctggtgttgagaacgtaaagtcacaaacctattctaaggatctactcggacagcagcctcacagcgagccaggcgccgcagctttcggggagctgcagaaccagatgcctgggccctctaaagaagagcaatctctccctgccggagctcaagaagctctgagcgacggactgcaactggaagtgcagccgtccgaggaggaagctagagggtatatcgtcacagaccgggacccgttgaggcccgaggaagggcggcgactcgtggaggatgtggcccgcctgcttcaggtgcctagctctgcatttgccgacgtcgaagttctcggccccgccgtgacattcaaggtatcggcaaatgtccagaacgtgactactgaggacgtggaaaaagctaccgtcgacaataaagataagctggaggagacatcgggactgaaaattctacaaactggggtgggtagcaagtcaaaactgaaattccttcccccacaggcagaacaagaggacagtacgaagttcatcgctctgactctggtgagcctcgcctgtattttaggcgtcctgttggcctcgggcctgatctattgcctgagacacagtagccagcatcggcttaaggagaaactctctggtctgggtggagaccctggcgccgatgccactgcagcctaccaagagctgtgtcgacagcgcatggccactcgacctccagatcgcccggaaggtccgcacaccagcaggattagttctgtcagctcacagttctccgatgggcccatcccttccccaagtgcgcgaagttcagcctccagttggtctgaggagccagtccaaagcaatatggatatctccactggacatatgatactctcttatatggaagaccatctcaagaacaaaaatcgcctcgaaaaagaatgggaggcactttgtgcttaccaggccgagcccaacagcagcttcgtagctcagcgagaggagaacgtcccgaagaatcgtagtctggctgtgctgacttatgatcacagcagagtgctcctcaaagccgagaatagtcactctcattcagattatattaacgccagtcctattatggatcatgatcctaggaatcccgcttacattgccacccaggggcccctgccggccacagtggctgatttttggcagatggtctgggagtccggctgtgtagtgatagtgatgctgacccccctggcagagaacggtgtgagacaatgttaccactactggcccgatgagggttccaatctttatcacatttacgaagtgaatttggtttccgagcacatctggtgtgaggactttctggtgaggagcttctatctaaaaaatttgcagacaaacgaaacccgcacagtgacccaatttcatttcctgtcatggtatgatagaggagtaccctcatcatcaagaagcctgctagatttcagaaggaaggttaacaaatgctaccggggcagatcttgccctatcatcgtgcactgcagcgatggagccggcagatctggaacttacgtgctgatcgacatggtcctgaataagatggctaaaggagccaaggagattgatatcgcagctaccctcgagcatctgagggaccagcgacccgggatggtccagacaaaggagcaatttgaattcgccctgacggcggtggccgaggaagtgaacgctatactgaaggcgctaccccagtag

SEQ ID NO: 130974 - DNA, 3651 bp, Artificial Sequence
  Description of Artificial Sequence: Synthetic coding sequence
atgggacatttgcccacaggaatccacggagcccgcagattgctgcccttgctgtggctgtttgttctgttcaaaaacgccaccgctttccacgttaccgtccaagacgacaataatatagtcgtaagcctggaggcatcagatgtgatctctcccgcatcagtgtatgtggtaaagattactggagaaagcaagaactattttttcgagttcgaagagttcaacagtacactgccccccccggtgatctttaaggccagttatcacggtctctattacattatcactctcgtcgtggtcaatggcaatgtcgtgactaaaccctcacgtagtataaccgtgcttaccaagcccctccctgtaacgagcgtcagcatatacgactataaaccgtcccccgaaacaggcgtgttgtttgaaatccattatccggagaaatataacgtcttcacaagagttaatatttcatattgggaggggaaagatttccgcacaatgttgtacaaagatttcttcaagggaaagacagtatttaatcactggctgcccgggatgtgctactccaacataacttttcagctggtcagcgaggcaacattcaacaagagtacactggtcgaatattccggcgtgagccatgagccaaagcagcatcgtaccgcgccctaccctccgcagaatatttcagtccgcattgtgaatctcaacaagaataattgggaggagcaatccggcaacttccctgaagaatcttttatgcggagccaggatacgattggaaaggagaagctgtttcacttcactgaggaaactcccgaaattcctagcggaaatatatcctcaggatggcccgactttaactctagtgactatgaaaccacaagccagccctattggtgggactcagctagcgctgccccggagtccgaagatgagtttgtgagcgtgctgccaatggaatacgagaacaactcaacccttagtgagaccgagaagtctaccagcggctccttctcctttttccccgttcagatgattttgacctggctgccacccaaaccccctacagcctttgatggctttcatatccacattgaacgtgaggagaacttcaccgaatatctgatggtggacgaggaggcgcatgaatttgtagctgagctgaaggagcccggtaaatacaaactgtcagtgaccacgttcagttcgtcaggatcctgtgagacaaggaaaagccagtcagcaaagagtcttagcttttatatctctccatctggtgagtggatcgaggagctgacagagaagccacagcacgtgtcagtgcatgtgctgtcgagtactaccgccctgatgagctggacatccagtcaggaaaactacaactccaccatagtgtcagtggtttccctgacttgccagaaacaaaaggaatcacagcgattagagaagcagtattgcacccaggtcaacagtagcaaacccattattgagaacctagtgcctggggcacaataccaggtggtgatctatttaaggaaaggcccacttattggccctcccagcgatcctgttacctttgccattgttcctaccggtatcaaagacctaatgctgtaccccctgggccctactgctgtcgtgctgagctggacgcgcccatacctgggcgtgttccgcaaatatgtcgtcgaaatgttctattttaatccagccacgatgacatctgagtggacaacatattacgaaattgcagcaaccgtgtctctgactgccagtgtccgcattgccaacctgctgcccgcttggtattacaattttcgagtcactatggtgacctggggcgatccagagctgtcttgctgtgattccagcactatctctttcatcaccgcccccgtggctcccgagattacttccgttgagtatttcaattccctgctgtacattagttggacctacggcgacgatacgacagatctgtctcattctcgtatgcttcattggatggtggttgccgaagggaagaaaaagatcaagaagagtgtcacacggaacgtgatgactgcaatattatctctacctcccggggacatttacaatctgtccgtgacagcttgcaccgagcggggtagcaatacctccatgctgcggcttgtaaaactggaacctgccccccccaagtctctctttgctgtgaacaagacccagacgtctgtgacccttctctgggtggaagaaggagtggccgattttttcgaggtattttgtcagcaggtgggtagctcgcagaaaaccaaactgcaggaacccgttgctgtctcctcccacgtcgtgactatctcgagtctgctgcctgccacagcatacaattgctctgtgacctccttttcccacgactccccttccgtgccgaccttcattgccgtatcaaccatggtgacggaaatgaaccctaatgtcgtggtcatctcagtcctagctatactgtcaaccctgctgatcggcctgctcttggtaactctcataatcctgcggaagaaacatttacaaatggctcgagagtgtggcgccggcaccttcgttaatttcgccagcctcgaacgcgatggcaagctgccgtacaattggagacggagcattttcgcctttttaacactccttccaagctgtctgtggactgattatctcctggctttctacattaatccttggtcaaagaatgggcttaagaagcgaaaactgactaatcccgtccagttagacgactttgacgcctatatcaaagatatggcaaaggattctgactacaagttttccctgcaattcgaagaactgaaactaatcggcctggacatcccacactttgctgctgacctccccttgaaccgatgcaaaaataggtatactaatattctcccctatgatttctctcgtgttcggttggtgtctatgaatgaagaggaaggtgccgattacatcaatgctaactatatacctggctataactctccccaggagtatattgctacacagggcccactgccagagaccagaaacgacttctggaaaatggtgcttcagcaaaagagtcaaataatcgtgatgttgacccagtgcaacgaaaagagaagagtgaagtgtgaccactattggcccttcactgaggaaccgatcgcttacggcgacatcactgtcgagatgattagcgaagaggaacaggatgattgggcttgcagacacttccggatcaactatgccgacgagatgcaggatgtgatgcactttaactacaccgcttggccagatcacggggtgccaactgcaaatgccgcagaaagcatactgcaatttgtccatatggtacgccagcaggccacaaaaagcaaaggtcccatgatcatccactgctccgcaggcgtcggtaggaccggaaccttcattgctctcgacagactgctccaacatatccgagaccatgaattcgtagatattttaggcctagtgtcagagatgaggtcttaccgcatgtcaatggtgcagactgaggagcagtatattttcattcatcaatgtgtgcagttgatgtggatgaaaaagaaacaacagttttgcatttctgatgttatttacgagaacgtaagcaaatcctag

SEQ ID NO: 130975 - DNA, 3567 bp, Artificial Sequence
  Description of Artificial Sequence: Synthetic coding sequence
atgggccacctgcctaccggcattcacggggcccgcagacttttgcctcttctctggctctttgttctattcaagaacgctacagctttccatgtgacggtgcaggatgataacaacatcgtggtctcccttgaggcgagcgacgtgatatccccggcgtccgtttacgtagtgaaaattaccggagagagtaaaaattactttttcgagttcgaagaattcaactctactctccctccacctgttatcttcaaagcttcttaccatggactatactacatcattactctggtggttgtcaatggcaatgttgtgacgaagcccagtaggtccataacagtgctgacaaagccccttccagtgacttcagtcagcatttatgactacaagccctcccctgaaaccggcgtgctgttcgagattcactacccagagaagtataacgtatttacgagagtgaatatcagttactgggaaggaaaagattttcggaccatgctttacaaggacttcttcaaaggaaaaactgtgtttaaccactggctgccaggcatgtgctatagtaatataaccttccaactggtgagtgaggccaccttcaacaaaagtaccctcgtagagtatagtggcgtgagccacgaacccaagcagcaccgtaccgcgccctacccgccgcagaacatcagcgtaaggatagtcaatctgaataagaataactgggaagagcagtccgggaacttcccggaggagtcattcatgcgttcccaggataccataggaaaagagaaactcttccatttcactgaagagaccccagaaattccgtcaggaaatatctcaagcggatggccagattttaatagtagtgattatgaaacaacctcccaaccctattggtgggactccgcttccgcagctcctgagtccgaggatgagttcgtgagtgtgttaccgatggaatacgaaaataactctacactgagtgaaaccgaaaaaagcaccagtggctctttttcattttttcctgtgcagatgatcctgacttggttgccccctaagccccctactgcattcgacggctttcatatccacattgaacgcgaagagaattttaccgagtaccttatggtcgacgaggaggcccacgagtttgtcgcagagttaaaggagcctgggaaatataaactttccgttaccactttcagctcaagcggatcatgcgagactcgcaaatcacagagtgctaagagcttgagcttttatatttctcctagtggcgagtggatcgaggaactcacagagaagccacagcacgtctctgtgcacgtgctgagctctaccaccgctctcatgtcctggactagttctcaggagaattataacagcactatagtaagtgtcgtgtctctgacttgccagaagcagaaagagtcccagcggctggagaaacagtactgcactcaggtcaattcttcaaaaccgattatcgagaacctcgtgccaggcgcccaatatcaagttgttatctatcttcggaaaggtcccctgatcggccccccctctgacccggtgaccttcgctattgtgcctactggtattaaagatttgatgctctatcctcttggtcctacggcggtggtgttgagttggactagaccgtacctgggtgtgttcagaaaatacgtagttgagatgttctactttaaccctgctacaatgacctctgagtggactacatactatgaaatcgccgccacggtgagtctcaccgcatctgtgaggatagcaaacttgttacctgcttggtactataactttagagtgacaatggtaacttggggggaccctgaattaagctgctgtgactcttctactatcagcttcataacggcccccgtggcacctgagatcacctctgtcgagtatttcaattctctcctgtatattagctggacttatggtgacgacactacggatctgtcacatagccgaatgttgcactggatggtcgtcgccgaaggtaaaaagaagataaaaaagagtgtgacccgaaacgtgatgactgccattctatctctgcctccaggcgatatctataacttgagtgtgactgcatgtacagaacggggtagcaatacatctatgttacgcttggtcaagctggagcctgccccgcccaaatctttgtttgccgtgaataaaacccagacatctgtaacccttttatgggtcgaggaaggggtggcggatttctttgaggtcttctgccagcaggttggcagcagccagaaaacaaaactgcaagaaccagtggcagtatccagccatgtcgtgaccataagctctttgctgccagctaccgcctacaactgctccgtgacatcgtttagtcacgacagcccttctgtgcctacattcatcgcggtcagtactatggtgaccgagatgaatccaaatgtagtcgttatatctgtccttgctattctgtccactctgctaattggcttattgctggttactctcatcatcttaagaaagaagcatctgcagatggccagggaatgcggggccggcaccttcgtgaacttcgccagtcttgagagagatggaaagctaccatacaattggtccaaaaacgggcttaagaaaaggaagctcacaaacccagtccagcttgacgacttcgacgcctatataaaagatatggccaaagacagcgactataaattcagcctgcagtttgaggagctcaagctgattgggttggacatccctcattttgctgccgatctgccccttaatcgctgcaagaatagatacaccaatatccttccttatgacttttccagggtgcgattagtgtctatgaatgaagaagaaggagctgactatatcaatgcaaactatatcccagggtataactctccccaggaatacatagctactcagggccccctgcctgaaacacgtaacgacttttggaagatggtcctacaacagaagagccaaatcattgtcatgctgactcaatgcaacgagaaacggcgcgtcaagtgtgatcactattggcccttcaccgaagagcccatagcttacggggacataacagttgaaatgataagcgaggaggaacaggatgattgggcgtgcagacactttcggatcaattatgcggatgaaatgcaggacgtgatgcactttaactacaccgcttggccagatcacggggtgccaactgcaaacgctgccgaaagtatcctgcagtttgttcatatggtacgacagcaagctaccaagtccaaaggacctatgattattcactgttctgcaggagtgggaagaactggtacctttatcgctttagataggttgttacaacacataagggaccacgaatttgtagatatcctgggtctcgtctctgagatgcgatcatatcgaatgagcatggtgcagacagaagagcagtatatctttattcaccagtgcgtgcagcttatgtggatgaaaaaaaaacagcaattctgtatttcagacgtgatttatgagaacgtgtcgaagagttag

SEQ ID NO: 130976 - DNA, 1218 bp, Artificial Sequence
  Description of Artificial Sequence: Synthetic coding sequence
atggttacagagatgaatcccaatgtcgttgtgataagtgtgttggccatcttgtctactctgctgattggcttgctgctggtgacgctgatcatcctccgcaagaagcacctgcagatggccagggaatgtggagccggcaccttcgtgaactttgcctcccttgagcgtgatggcaagctgccttacaattggcgacgttccatctttgcattcctcacacttttgcctagctgtctgtggaccgattacctgctggccttttacataaatccttggtccaagaacggactaaaaaaaagaaaactgaccaacccagttcagctggacgactttgacgcttatataaaagatatggctaaggattccgattataagttcagcctgcagttcgaagagttgaaattgattggcctagacattccccacttcgccgcagatctgccgctgaatcgatgcaaaaatcgctacacaaatatcctcccctacgacttcagccgagttcggctggtgtcaatgaacgaagaagaaggcgctgattacatcaatgctaattacatcccgggatataacagcccccaggagtacatagcaactcagggccctttaccagagaccaggaatgatttttggaagatggtcttgcaacagaaatcgcagattatagtgatgctgacgcagtgtaatgaaaagcgccgggtaaagtgtgatcattactggccttttacagaagagcccatcgcgtacggcgacattactgtggagatgattagtgaggaagaacaggatgactgggcgtgtagacattttaggattaactatgccgatgagatgcaagacgttatgcactttaattataccgcttggcctgaccatggcgtgccaacagcgaatgccgccgagtcaattctccagtttgtccacatggtgaggcagcaagctacaaagtctaagggacccatgattattcattgtagcgctggtgtgggccgcaccggaacgttcatagctcttgatcggctgctgcaacacattagagatcatgaattcgttgacatcctcggcctagtatcagaaatgcgctcatatcgcatgtcaatggtgcaaacagaggagcagtacattttcatccaccagtgcgttcaactgatgtggatgaagaaaaagcagcagttttgtatatctgacgtgatctacgaaaatgtgtccaagagctag

SEQ ID NO: 130977 - DNA, 1218 bp, Artificial Sequence
  Description of Artificial Sequence: Synthetic coding sequence
atggtgacggagatgaaccctaacgtagtcgtgattagcgtgctcgcaattctgagcacattgctcattggcttgttgctcgtgaccctgatcattctgcggaaaaaacatttacagatggcccgcgagtgcggggctggcacctttgttaacttcgccagcctggaaagagatggcaagctgccatacaattggaggaggagcatatttgcgtttctgacgctgctgccttcatgcttgtggaccgattacctgctggccttctatattaatccatggagcaaaaacggtctcaagaagagaaagctgactaatcccgtgcaactggatgatttcgacgcatacattaaggatatggccaaagactcagactacaaattctccctgcagtttgaggagctgaaattgataggactggacatacctcacttcgcagcggacctgccactgaataggtgcaagaatcggtacaccaacattcttccttacgattttagcagggtgaggctggttagtatgaatgaggaagagggcgccgactacattaatgccaattacatcccgggatacaacagcccccaggaatatattgccacccaaggtccgttgccagagacgcgtaacgacttttggaagatggtgttgcaacagaagagccaaattatcgttatgctgacacaatgtaacgagaagcggagggtcaagtgtgatcactactggccatttaccgaggagcccatagcctacggagatattaccgtggagatgatttcagaagaagagcaggatgattgggcttgccgtcacttccggattaactacgccgatgagatgcaggatgtgatgcactttaattataccgcgtggccagatcacggagtcccaaccgcgaacgctgcagagtctatcctgcagttcgtccacatggtgcggcagcaggccacgaaatccaagggcccaatgatcattcattgttcggccggggtgggacgcacaggtacctttatcgcccttgaccgcctgctgcaacacattagagaccacgaatttgtagacatcttaggtcttgtgtcggagatgcgcagctatcgcatgagcatggtgcagactgaagagcaatatatattcatccaccaatgtgtgcaactgatgtggatgaagaaaaagcagcagttctgcataagcgatgtgatatacgaaaatgtgagcaagtcatag

SEQ ID NO: 130978 - DNA, 1134 bp, Artificial Sequence
  Description of Artificial Sequence: Synthetic coding sequence
atggtaaccgagatgaatcctaacgtcgtggtcattagcgttctggcaatactgagtactcttctaatcggtctgcttctggtcacccttatcatcttacgcaagaaacacctccagatggccagggaatgtggtgcggggacctttgtgaactttgcttctcttgaaagggatggcaagctgccgtataactggtcgaagaatgggctgaagaaacgcaaactgacgaatcccgtgcagctcgacgatttcgatgcatatatcaaagacatggcaaaggactcagattacaagttcagtcttcagttcgaagagctgaagcttatcggacttgacatcccgcacttcgctgccgatctacccctaaatcggtgtaagaataggtatacaaatattctgccatatgacttctccagagttaggctggtttcaatgaatgaggaggaaggcgctgattacattaatgccaactatattccaggatataatagcccccaggagtacattgctacccagggaccccttcccgagacgcgcaatgatttctggaagatggtcctccaacaaaagagccagataatcgttatgcttacacaatgtaatgagaagaggagggtgaagtgtgaccactattggccttttacggaggaaccaatcgcctacggggacatcacggtcgaaatgatctcggaagaggaacaggacgattgggcttgcagacacttcaggataaactatgcggacgagatgcaggatgtcatgcactttaattacactgcttggcccgaccacggcgtgccaacagccaatgccgccgaatctatcctgcagtttgtgcacatggtgagacagcaggctaccaagagcaaaggccctatgatcattcactgctccgcgggtgttgggaggaccggcaccttcatcgctctggatcggctcttacaacacataagagaccatgaattcgtcgatatcctcgggcttgtgtccgagatgagaagctatcgcatgtcaatggtccagaccgaagagcagtatatcttcatacaccagtgtgtgcagctcatgtggatgaaaaaaaaacaacagttctgcatttccgatgtcatttacgaaaatgtgagcaaatcctag

SEQ ID NO: 130979 - DNA, 1134 bp, Artificial Sequence
  Description of Artificial Sequence: Synthetic coding sequence
atggtgaccgaaatgaatccaaacgtggtcgttatctctgtgctagccatcctctcaaccctcttaatcgggctgcttctggtgacgttaataattctgcgaaaaaagcacctgcaaatggctcgagagtgtggggccggcacgtttgtcaacttcgcatcactcgaacgcgacggaaagctgccatataattggtcaaaaaatggtctcaaaaagcggaaactgaccaatccggtgcaactagacgatttcgacgcctatattaaagatatggccaaggactccgactacaaatttagcctgcagttcgaggagctaaagctcatcgggcttgacatcccgcatttcgcggcagacctccctcttaaccgctgtaaaaatagatatacaaatatccttccttatgatttcagcagggtgcgccttgtatcgatgaatgaggaagagggcgccgattacatcaacgctaattatataccgggctataatagccctcaggaatacatcgccacacaaggtccgctcccagaaacaaggaacgatttttggaaaatggtattacagcagaaaagtcagattattgtcatgctaactcagtgcaatgagaaaaggcgagtcaaatgcgatcactactggccctttacagaagaacccatcgcttacggggacatcactgtggagatgatttccgaagaggagcaagatgattgggcttgcaggcactttagaattaactacgctgatgagatgcaggatgtgatgcattttaactatacagcttggcccgatcatggagtaccaacggcgaatgccgccgaaagtatactgcagttcgtgcacatggttagacaacaggcaaccaagagcaaaggacctatgatcatacactgtagcgcaggagtggggagaactgggaccttcatcgcactggatagactccttcagcacatccgcgatcacgaattcgtcgatatcctggggctcgtgtcagagatgagaagttatagaatgtccatggtgcaaacagaggaacaatacattttcatccaccagtgcgtgcagctaatgtggatgaaaaaaaagcagcagttctgtatttccgacgtgatttacgaaaacgtcagtaagagctag

SEQ ID NO: 130980 - DNA, 6888 bp, Artificial Sequence
  Description of Artificial Sequence: Synthetic coding sequence
atggatttcctcatcatcttcctgctgctatttatcggcaccagtgaaacacaagtggatgtatccaatgtggtccctgggacccggtacgacattaccatatctagcatcagtaccacttacacaagtccagtgacaagaattgtgacaaccaacgtgacgaaacccggcccacccgtgttcctagccggggagcgggtggggagtgctgggatcttactgtcatggaatacgccgcctaatcctaacggccggatcatctcttacatagttaaatataaggaggtgtgcccatggatgcagaccgtgtacacacaggtgcgtagtaagcccgactccctggaagtactgctgaccaacttgaatcctggcaccacgtacgaaataaaggtcatcatcctcaacgcaaccaaggtgggatgcctgctatctccaatactactgaacactgtcctggagggacttgcgcgggccatcaatctcaccagagagtgccagactgtcgatgctggccagtgtgttcagtgtgcggttagggagccaaagcagggatcaactagcgggggaagagcccagactaataaaaagaccgccgttactagcgccgacctgaaccataccgccggcgacctccggaccggtaggctccccccgcagccgctgacagcagaacaaccaaattgggaagctcccccatcccggggcaggcttaccccacataaggctggctatagcagcgcaactgcggccggaacacaagctaatagggtgtggtcacggccactggccaagatacagacaacgattcgggagtactataagcatctttatgcaaagaaggaagggatcctgccaaactctttctatgaggcttcaatcatccttatccccaaaccagtacctgaaggaccacctcagaactgcgttacagggaacataacaggcaagagtttctctattttgtgggatccacctacaattgtgacaggaaagttctcataccgggtggaactatacggaccgtctggccgcattcttgataactccacaaaggacctcaagtttgcctttacaaaccttactccgttcaccatgtacgacgtctacatcgcagccgagaccagcgccgggacggggccaaagtctaacattagcgtttttacgccccccgacgtcccgggagccgtgttcgatttacaactcgctgaagtcgaatcaacacaggtacggattacctggaaaaagccaaggcagcccaatgggattatcaatcaatatagagtaaaagttttagtcccagagaccggcattatactggagaatacactgcttacaggaaataatgaatatattaacgaccccatggccccagaaattgtaaatatagtggaacctatggtgggactctatgagggctcagctgagatgagctcggaccttcattcattggcaaccttcatctataactcccaccctgacaaaaactttcctgcgcggaaccgggccgaggaccagacatcccccgtggtgactacgcgcaatcagtacatcaccgacatcgccgcagagcagctgagctacgtaatccgcagactggttcctttcacagagcatatgatctctgtgtccgccttcacaatcatgggagaaggaccgcctactgtgctgagcgtccgcacccgtcagcaggttccgagttccataaagatcatcaattataagaatatttcttccagctccatcctgctctactgggaccccccagagtatcctaacggaaaaattactcattataccatctacgcgatggaattagatactaacagggcatttcaaattacgactattgacaactcctttctgatcacagggctgaagaagtacacgaaatataaaatgagggtggcggcctcaacacatgttggcgagtcctctctctccgaggagaacgatatttttgtgagaacctcggaggatgaaccagagagctcgccccaggacgtcgaggtgatcgacgtaacagcagacgagatacgcctcaagtggtctcccccggagaagcctaacggaatcatcattgcctacgaggtactgtataaaaacattgataccctctatatgaaaaacacctccacaactgatataattcttaggaaccttcgaccccacacgctgtacaacatttcagtgcgttcctacacacgtttcggacatggaaaccaggtgagttctcttttatctgtaagaacgtcagaaaccgtcccagacagtgccccagagaatatcacctacaagaacatttctagcggcgaaattgaacttagctttctcccccccagctcccccaacggaatcatccagaaatataccatttaccttaaacgaagcaatggaaatgaggagcgcaccatcaacacaacaagcctgacacaaaatataaaagttctcaagaagtacacccagtacatcattgaagtgagcgcctcaaccttgaagggagagggagtacgttccgccccaatttctattcttactgaggaggatgccccagattcccccccccaggattttagcgttaaacagctgtctggagtcactgtgaagctgtcctggcaaccccctcttgaacctaatggcatcatcctctactacacggtttacgtgtggaacaggtcaagcctgaagactatcaatgttacagagacctctttggaactctctgatttagattacaatgtggagtattcagcctacgtgaccgcctctacaaggtttggagatggtaagacgcggagtaatatcatttcttttcagacaccagaaggagcaccatcagaccctcctaaagacgtgtactacgctaatctctcaagtagcagcataatactgttttggacccccccatccaagcccaatggaatcatacagtactatagtgtgtactatcgtaacacatcagggacatttatgcagaactttacgctccacgaagtgaccaacgatttcgacaacatgaccgtgtccactattatcgacaagctgaccatcttctcttactacacattctggttgactgcctccacgtccgtaggcaatgggaacaagagcagcgacatcatcgaggtgtacactgatcaggacattccagaaggtttcgtcggaaacctgacctatgagtcaatcagctcaaccgcaatcaacgtaagttgggttccacccgctcagccgaacggtctagttttttactacgtcagtctcatacttcagcagaccccacgacatgtgaggccacctctcgtgacttacgaacgcagcatttatttcgataacttagaaaaatatactgactatatcctcaagatcacacccagcacagaaaagggattttcagacacatataccgctcagctgtacatcaagactgaagaagacgtgcctgaaacttcacctatcatcaacacgttcaaaaacttgagctctacctcagtccttctgtcatgggatccgcccgtgaagcctaacggtgcgattatatcatacgatctgactctgcaggggcctaacgaaaattatagctttatcacgagcgataactatattatcttggaagagctatctccttttacactctactcattcttcgctgcggctagaacccgaaaggggctggggcccagttccatcctgtttttttacacggatgagagcgtcccactggcacccccccagaacctcacacttattaattgcactagcgacttcgtgtggctcaaatggtctcccagcccactccctggcggtatcgtgaaggtttattcttttaaaattcatgagcacgagaccgataccatctactataagaacatctccgggtttaagactgaagctaagctggtggggctggagcctgtaagcacctattcaattcgagtcagcgctttcacgaaggtgggcaatggcaaccagttttccaatgtggtgaagttcaccacgcaggaaagcgtacctgacgtggtccagaatatgcagtgcatggccacaagttggcagtctgtgctggtgaagtgggatcctcctaaaaaggccaacggcataattacccagtatatggtaaccgtcgagcgaaacagcaccaaggttagccctcaggaccatatgtacacattcatcaaactccttgccaacacctcttatgtcttcaaggtccgggcatccacctcagcgggcgagggcgatgagtccacatgccacgtatctacgcttccggagactgtgcctagcgtgccaaccaatatagcgttctctgacgtacagtccaccagcgccactctcacatggatcaggcctgatacaatactgggatattttcagaactacaagattacaacacagttacgggcccaaaagtgcaaagaatgggagtcagaagaatgcgtcgaataccagaagatccagtatttatacgaagcccatctgacggaagagacggtgtatggtctcaagaaattccggtggtaccggtttcaggtagctgcctctactaatgctggctatggcaacgcctcaaactggatatccactaaaacactgcccggtcccccagacggccctcccgagaacgtccacgtcgttgctactagcccatttagcattagcatatcttggagcgaacccgccgtgatcaccggccccacctgctatttgattgatgtgaaaagtgtagacaacgatgagttcaacatcagctttataaagagcaacgaggaaaacaagactatcgaaattaaggaccttgaaattttcacaaggtacagtgtggtgatcactgctttcacgggtaatatatccgcagcttatgtggagggtaaatcaagcgcagaaatgatcgtcacgactcttgagtccgctccgaaagacccacccaataatatgacgttccagaaaattcctgatgaagtaaccaagtttcagctgacctttctgccaccatcccaaccaaacggaaatatccaggtgtaccaggcgctagtttatagggaagacgacccaaccgccgtgcagattcacaatttgtccatcatacagaaaacgaataccttcgtaatcgcaatgttggagggtctcaaagggggacatacttacaatatttcggtttatgccgtgaactcagctggcgcaggtcccaaggtgcccatgagaatcaccatggacattaaggcccctgcgcgccccaaaaccaagccaactcccatctatgacgccacaggtaaacttcttgtaacatccaccacaataactattcgcatgccgatctgttattattctgatgatcacggaccgatcaagaatgtccaggtgctggtgacagagaccggcgcacaacatgatggcaacgttacaaagtggtacgacgcgtatttcaacaaggctcggccatattttacaaacgaaggcttcccgaacccgccctgtactgagggcaagaccaagtttagtggcaatgaagaaatctatatcatcggggctgataacgcctgcatgatcccaggcaatgaagataagatttgcaatgggccactgaagccaaagaagcagtacctgttcaagttcagggccacaaacatcatgggccagttcacagactcggattacagtgatcccgtaaagaccctgggcgagggcctttcggaacgcacagttgagattatcctgtccgttaccctttgtatcctgagtatcattctgctaggcaccgccatattcgcctttgctaggatcaggcagaagcagaaagagggcggaacatattcaccccaggatgccgagatcattgataccaagctgaaactggatcagcttataaccgtggcagacctcgaactaaaggacgagaggctcacaagactgctgtcctatcgcaagagcattaaacccatctccaagaaatcttttctccagcatgttgaggaattgtgcactaataacaatctcaaatttcaggaggagtttagtgaactcccaaaatttcttcaggatctctctagcacagatgccgatctgccttggaaccgcgctaagaacagatttcccaacatcaagccatataataataatagggttaaactgatcgcagacgcatctgtgccgggatctgactacatcaatgctagctacatcagcgggtacttatgccctaatgagtttattgccactcagggcccactcccaggcaccgttggtgacttctggagaatggtttgggagacacgggcaaaaactctggtaatgcttactcagtgttttgaaaaaggccggatccggtgtcaccagtactggcctgaagataacaaacctgtaacagtatttggggatatcgtaattacaaagcttatggaagacgttcaaatcgattggactatcagagacctcaaaatagaacggcatggcgattgtatgacagtgcgacagtgtaacttcacggcatggccagagcacggcgtacctgagaactctgcacctcttatccattttgtcaagcttgtccgcgcttccagggctcatgatacaactccaatgatagtccattgttcagctggcgtcgggcgtactggcgtatttatagcattggaccacctcacccagcatattaacgatcatgactttgttgatatttacggcctggttgcagagctgaggtcggagcgtatgtgcatggtccaaaatttagcacagtacatctttctgcaccagtgcatcctggatctcttgagcaataagggctcaaaccagccaatttgcttcgtcaattatagcgccctgcagaaaatggacagcctggatgccatggagggtgatgtggaactcgagtgggaggaaactacaatgtag

SEQ ID NO: 130981 - DNA, 5787 bp, Artificial Sequence
  Description of Artificial Sequence: Synthetic coding sequence
atggcacctacatggggaccaggaatggtgtccgtggtcggtccaatgggactactagttgtgctgttggtggggggatgcgcggctgaggagccacctcgctttatcaaggagccaaaagatcagataggagtcagtgggggtgttgcgtcattcgtctgccaagctacaggggatccaaaaccccgggttacttggaataagaaaggtaaaaaagtcaactcacaaagatttgagaccatcgagtttgacgagtctgccggggcggtcctgcgaatccagcctctgaggacaccacgtgatgaaaatgtgtatgagtgcgtagcccagaattctgtcggtgagatcaccgttcatgcaaaattgactgtcctccgagaggaccagctgccttccggctttcctaacattgatatgggcccccagctcaaggtcgttgagcggacaaggacagccacaatgttgtgcgctgccagcggtaaccctgaccctgagatcacctggttcaaagattttctgcctgtggatccctcagccagcaatgggaggatcaagcagctacgatctgaccaggctttttcccacctcccgactggagctctccagatcgagtcttcagaagagactgatcaaggtaaatatgagtgcgtcgccactaactctgccggcgtgagatatagcagccctgcaaatttgtatgtgagggtccgccgcgtagcaccacgcttctcaatcttacccatgtcacatgaaattatgcccggggggaacgtgaatataacctgcgtggccgtagggtcgccgatgccctacgtgaaatggatgcagggggctgaagacttgactccggaggatgatatgcccgtcgggagaaatgtgctggagctcacagacgtcaaggactccgccaactacacatgtgtggctatgtccagcttgggcgtcatagaggcagtcgcccagataactgtgaagtctttacctaaagcccccggtactccaatggtaaccgagaataccgctacctctatcactatcacatgggactcaggtaatccagatccagtgtcttattatgtcatcgaatacaagtccaagagccaagatggaccctaccagataaaagaagatattaccaccacacggtattccataggtggattgtcacccaacagcgagtacgagatttgggtcagtgcagtgaactctattggccagggccctccatcggaaagcgtggtgacgcgtacgggcgaacaggccccagcgagtgccccccggaacgtgcaggcccggatgctatccgcaaccaccatgattgtgcaatgggaggaaccggtagagcccaatggtctaatccgggggtacagggtttactacaccatggaacccgaacatccagtgggaaattggcagaagcacaatgtcgatgatagcctcctcactaccgtaggatctttgctcgaagacgaaacctacacggttcgggtactggctttcaccagcgtcggagacggaccgctgagcgatcctatacaggttaagacacagcaaggggttcctgggcagcctatgaatttacgggcagaagccagatcggagaccagcatcaccctgagctggtcgccacccaggcaggagagtattatcaagtatgaactgctgttccgtgagggggatcacggccgtgaagtcggcaggacattcgatcccacaacatcatacgtcgtggaggatctgaagcccaacacggaatacgccttcaggctcgctgcaagaagtccacagggcctgggagcctttacccccgtcgtacgacaacgcacactccagtccaagcctagtgcgcctccacaggatgtcaagtgtgtgagcgtgagatccactgctatcctggtgagctggcggccacctccgccagaaacccacaatggagcccttgtgggatacagcgttcgctaccggcccctaggtagtgaggaccctgagccgaaagaggtgaatgggatcccacctaccacaacccaaatacttctcgaggcccttgaaaaatggacccaataccgcatcaccacagtggcccataccgaggtcgggccaggccctgaaagttcccccgtcgtggttcgcacagatgaggacgtaccatctgcccccccacggaaagtggaggccgaagcgttaaatgctacggccataagggtgttatggcggtcccctgcacccggaagacagcatggccagatccgcggatatcaggtccactacgtgaggatggaaggggccgaggctagagggcctccgcggatcaaggatgttatgctcgcagacgctcaatgggaaacagacgacactgcagagtacgaaatggtcatcactaacttgcagcccgagacggcctactcaattacagtcgccgcctacaccatgaagggagatggtgcccgtagtaagccaaaagtggttgtcactaaaggggccgtgctcggccgaccgaccttaagtgttcaacagactccagaaggatcactgttggccagatgggaacctcccgcgggaacagccgaagatcaggtgttgggctataggctgcagtttgggcgcgaagactcaactcctttggcgactctggagttcccaccatcagaagatagatatactgcttcgggggttcacaaaggtgctacctatgtctttcgcctggccgcccggagtcggggcggcctgggagaggaggccgccgaggtgctgtcaattccagaggatacccccagggggcaccctcagatcctcgaagccgcaggaaacgccagcgctggcaccgtgttactcaggtggctgccaccagtgcctgctgagagaaatggcgcaatagtgaagtatacagtagcagtgagggaggcgggcgcactcggcccagccagagaaactgaactccctgccgctgccgaacccggcgctgagaatgccctcactctgcaagggctaaagcctgataccgcctacgaccttcaggtgcgggctcatactagacgggggccgggtccatttagcccacctgtgagatacagaacattccttagggatcaggtttcccctaagaactttaaagtgaaaatgataatgaaaacctcggtgctacttagctgggagttccccgataattacaactcgccaactccctataaaattcagtataacggcttaacactggacgtggacggtagaacaacaaaaaaactgattacccatctgaagcctcacaccttctataacttcgtcttgacaaatcgagggagtagcctgggggggcttcagcagactgtcactgcatggaccgcttttaacctcctgaatgggaagccatccgtggcgcccaagccggatgctgacggattcatcatggtttacctccctgatggacagtcgcccgtgcccgtgcagtcctactttatcgtcatggtcccactgaggaaatctcggggcgggcagttcttaaccccactgggctctcctgaggacatggacctggaagaactgattcaggatatcagtaggcttcagaggcgatctctccgacactcgcggcagcttgaggtcccaaggccctacatagccgccagatttagcgttctaccccccaccttccacccaggcgaccaaaagcaatacggtggctttgataataggggtttggaacctggccacagatacgtgctctttgtgctggctgtacttcagaagtcagagcctacctttgctgcatcccccttttctgatcctttccagctcgataatccggatccacaacctatcgtggatggggaggagggtctcatctgggtgatcggacccgtgctggccgtggtctttattatttgcatcgttatcgctatactgctgtacaagaacaagccagactcaaagcggaaggatagtgagccgcgcacaaaatgcctgctgaacaacgcagacctcgcaccacatcatccgaaggatccagttgagatgaggaggatcaatttccagacaccaggaatgctgtcacaccctccaatcccgattgccgacatggctgagcatactgaaagacttaaggcgaatgactctcttaaactatcccaggaatacgagtccattgatcctggccaacagttcacctgggagcattctaatcttgaagttaacaaacctaagaaccgctatgcaaacgtgatcgcttacgaccactcccgcgtgatactccaaccaatcgaggggattatgggctccgactacatcaatgccaactacgttgacggttaccgctgccaaaatgcctacatcgccactcaggggccgctgccggagacattcggggatttctggagaatggtgtgggagcagcgctcagccactatcgtaatgatgacccgccttgaggaaaaatccagaatcaagtgtgaccaatattggccaaaccgggggactgaaacatacggattcatccaggtaactttacttgatacaattgaactcgcgactttttgcgtgagaaccttcagcctgcataaaaatggcagctctgaaaaaagagaagtacgtcagtttcagttcactgcttggcccgaccacggtgtgcccgagtacccaacaccattcctggcgtttctgcgcagggtgaagacctgcaacccgcccgacgccggacccatcgtggtccactgttcagcaggtgtgggaaggacgggatgttttatagtcatagacgccatgttagagcgtatcaagcctgagaagacagttgacgtctatggccatgtgacacttatgagatcgcagcgcaattatatggttcaaaccgaggaccagtactcattcatacacgaagccttgctggaggctgtgggttgtggtaatactgaggttccagccagaagcctgtatgcatatattcagaaattagctcaagtcgaacccggagagcatgttactggcatggagctggagttcaaacgtctagccaatagcaaagcccatactagccggttcatcagcgccaatctcccctgcaacaagttcaaaaaccgactggtgaatattatgccatacgagagcacgcgtgtgtgcctgcagcccattagaggagtcgaaggctcggactacataaacgcttcttttatcgatggctaccgtcagcagaaggcttatatcgcgactcagggacccttagccgaaacgaccgaggatttctggaggatgctttgggaaaacaatagcacaatcgttgtcatgctgacaaagctacgggagatgggccgtgaaaagtgccatcagtattggcctgcagaaaggagcgcacgctatcagtacttcgtcgttgaccccatggccgaatacaacatgccacagtacattttaagggagtttaaggttaccgacgccagagacggacaatcaagaacggtcaggcagttccaattcaccgattggcccgagcagggagttcctaaatctggcgagggattcatcgacttcattggacaagtgcataaaaccaaggaacagttcgggcaggatggcccaatctcagtccactgctctgcaggtgtggggagaaccggagtgttcataaccctctcaatagtgttggagcgtatgcggtacgagggggtggtggacatattccagactgtcaagatgctacggacacagaggccagctatggtacagactgaggatgaataccagttctgttatcaagcggccttagaatacctcgggagctttgaccactatgccacgtag

SEQ ID NO: 130982 - DNA, 5733 bp, Artificial Sequence
  Description of Artificial Sequence: Synthetic coding sequence
atggcccccacctggggtcctgggatggtgtccgtcgtgggtcctatgggcctgctagtagtgctcctggttggcggctgtgcggcagaagaaccaccccgctttataaaggaacccaaagaccagatcggagtaagcggcggtgtcgctagctttgtctgtcaagccactggggatcccaaaccaagggtgacttggaataagaaagggaaaaaagtcaattctcaacgatttgaaaccatcgaattcgacgagagcgccggcgctgtgctgagaatacagcccttgaggactccaagagacgaaaatgtctatgagtgtgtagcacagaattccgtgggtgaaattacggtgcacgccaagttaactgtgctgcgggaagatcagcttcccagcggattcccaaacattgacatgggaccgcagttaaaagtggtcgaaagaactaggacagcaactatgctatgtgccgcatccggcaatcccgatcccgagattacgtggtttaaagactttttacccgtcgatccttcggcatcgaatggacgcataaagcaactacggtctggggccttacagattgagtcctccgaggagaccgaccagggaaagtatgaatgtgtagctacaaattcggccggggttcgatatagttcccctgctaatttgtatgttcgggtccgaagggtggctccacggttttccatcctgcctatgtcccacgagataatgccaggtggcaacgtgaacataacatgtgtcgctgtcggtagccctatgccatatgtaaagtggatgcagggggccgaggacctcactcccgaagacgatatgcctgttggcagaaatgttcttgaactgacagatgtgaaagacagtgcaaattatacttgcgtagccatgtcatccctgggcgtgatcgaagcggttgctcaaataaccgtcaaatcactgcccaaggcccccgggacccctatggttaccgagaacacagcaacttccattacaatcacctgggattcgggaaaccccgaccctgtatcctactatgtgatcgaatacaagtctaagagccaggatggcccgtaccagattaaagaggatattactactactcggtattctatcggtggtctgtcacctaattccgagtatgagatctgggtgtctgctgtgaattccattggccagggtcccccaagcgagtcagtagtgaccagaactggcgagcaggctcctgcaagtgcgccgcggaacgtgcaggccaggatgctatcagctaccacaatgattgtgcagtgggaggagccagtcgaaccaaatggtctcattaggggatatagagtttattacacaatggagcctgagcatcccgtgggaaattggcagaagcataacgtggacgactccttattaactaccgtgggcagtttgcttgaagatgaaacctacacagtgcgggtattggccttcacctcagtcggggacggacccctgtccgatcccatacaggtgaaaactcaacagggagtgcccggacagccaatgaacctccgggccgaggctagaagcgaaacttctatcacactctcttggtctcctccacgacaggagtccataattaagtatgagctgctctttcgcgaaggcgatcacggacgggaagtaggacgaacgttcgaccccactacatcatatgtggtcgaggaccttaagccgaataccgaatatgccttcagactcgccgccagatcgccgcaagggctgggggcatttacacccgtggttcgtcagaggacccttcagtccaaaccatctgcacctccacaggatgttaaatgtgttagcgttcggtcaaccgctattcttgtgagttggaggcctcctcctcctgagactcacaatggggctctggtcggatacagcgtcagatacaggcccctgggcagtgaggaccccgagcctaaggaggtgaatggcatccctccaaccaccacccaaattctgctggaggcactggaaaagtggacacagtaccgtattacaaccgtggcccacactgaagtagggccaggtcccgaaagctcacccgtggtggtgcgaaccgacgaggacgttcccagtgcaccacctcgcaaggtggaggcagaagcgctcaacgctaccgcaattcgggttttgtggaggtccccagcacctggtcgacaacatggccagattagagggtatcaggttcactacgtgcgaatggaaggcgcagaagcacgcggccccccccgtatcaaagatgtgatgctcgctgacgcccaggagatggtgataaccaacctgcagcctgaaactgcgtattccattactgtggccgcttacaccatgaaaggggacggcgcccgcagtaaacctaaagtcgtcgtcaccaaaggcgcagtacttggacgaccaaccctcagtgtccagcagacccccgaaggaagcctgctagctcggtgggaaccccccgcaggcacagcggaggatcaagttttgggctaccgactccaatttggtagagaggacagcactcccctagctaccctagagttccccccctctgaagatcgctacaccgcgtcaggcgtccataaaggcgccacatacgttttcagacttgctgcacgctctcgcgggggtctgggagaagaggctgccgaagtactttcaattcccgaggatacccctcgaggtcacccacagatcctggaagctgccgggaatgcttcggctgggactgtgttgctgaggtggctgccacccgtgcccgcagaaagaaacggagccatagtgaaatatacggtcgctgtcagagaagcaggggcattggggccggcccgcgagaccgaactgccggctgccgccgaaccaggggcggaaaacgcgttgactctgcagggactaaagccagatacggcttatgatttgcaggtgcgggcccacacccgtcgcggaccgggacccttttctcccccggttcggtacaggacattcctgagggaccaggttagtcccaagaattttaaagtgaagatgatcatgaaaacgtccgttctgctttcttgggagtttcccgacaactacaactcgccgaccccttataaaatacagtataatgggctcaccctagatgtggatgggcggacgacaaagaaattaataacccacctcaagccacacaccttctataattttgtgctgacgaacagaggctcctctctggggggattacagcagacagtaacggcctggacggcctttaaccttcttaatgggaagccatctgttgccccgaaacccgatgcagacggcttcatcatggtctatctcccagatggtcaatctccagtccctgtgcaatcgtatttcatcgtaatggtaccactaaggaagtcacggggaggccaatttctgacccccctaggatctcccgaagacatggaccttgaggaattgatccaggatatatcacggctgcagaggaggtctcttcgccactctagacagctagaagtaccaaggccttatatcgccgcccgattcagcgtcctgccaccaacatttcatccaggcgaccagaaacagtatggcgggtttgacaacaggggcttggaacctggccaccgctatgtactcttcgtccttgcagtgctccaaaaatcagagcctacattcgcggccagccctttttcagacccatttcagctggacaacccagatccccagcccatcgtagacggcgaggagggacttatctgggtgatcggtcctgtgctggccgtagttttcattatttgcatcgttatagccatcttactctataaaaacaaacctgacagtaaaaggaaggatagcgagcctcgtaccaagtgtttgctcaataatgctgatctcgccccccaccacccaaaagatcctgtcgaaatgaggcgaataaactttcagacacctggtatgctctcacacccccctattccgattgctgatatggccgagcacaccgaaagactgaaggcgaacgatagtctcaaactgtcacaggagtacgagtccattgatcccggccagcaattcacctgggaacatagtaacttagaagtcaataaacctaaaaataggtacgctaacgtgattgcctacgatcattcccgagtgatactgcagccgatcgagggaatcatggggagtgattatattaatgctaattacgtggatggttacagatgccaaaatgcctacatagccacacagggtccattgcccgagacctttggggacttctggagaatggtctgggaacaaaggtccgccactattgttatgatgacaaggttggaagagaagagccgtataaaatgcgatcaatattggccgaataggggaactgagacttacggattcattcaagtaacactcctcgataccattgaactcgccacgttttgtgtgagaactttcagtttacataagaatggcagtagcgagaagcgcgaggtccgacaattccaatttaccgcctggccggatcatggcgtgcctgagtatccgacaccattcctggcttttttgagacgggtcaagacttgtaaccctccagatgccgggcctatagtggtgcattgctcggccggggtaggtcggacgggctgcttcattgtgattgatgcgatgctggaaagaatcaagcctgaaaaaaccgttgacgtgtatggacacgtcaccctgatgaggagtcaaagaaactacatggtccagacagaagatcagtatagttttattcacgaggctctgcttgaagccgtgggatgtggcaacacagaagtgcctgcgcgtagcctctacgcctacatccagaaattagcccaggtggagcctggggagcacgtgacgggcatggagctcgagttcaaacggctggccaactcaaaggctcatacctccagatttatttctgcaaatctgccatgcaacaagttcaaaaaccgactcgttaatataatgccatacgagagtacaagagtgtgcctgcagccgatcagaggggtagaggggtctgattacattaatgcaagctttattgatgggtaccgacagcagaaggcatatattgccacacaagggcctttagccgagaccacggaagatttctggcggatgctttgggaaaacaacagtactatagtggtaatgctcacaaaactgcgtgagatgggccgtgaaaagtgccaccagtactggccagctgagcgtagtgcacggtaccagtactttgtggttgaccccatggctgaatataatatgccccagtacatcctgcgggaatttaaagtgacggatgcaagagatggtcaatcccgtactgtgcgccaattccagttcacagactggccagaacaaggcgtgcctaagtccggagagggattcattgactttatcggacaagtgcataaaaccaaggagcagtttgggcaagatggacccatcagcgttcactgctccgcgggcgtgggccggactggcgtgtttataacactgtccatcgtgctggagcgtatgagatatgaaggcgtggtggacattttccagaccgtaaagatgctgaggacgcagcgcccagccatggtgcagacagaagatgaatatcaattctgctatcaggccgccctggagtatctgggtagttttgatcattatgccacctag

SEQ ID NO: 130983 - DNA, 4506 bp, Artificial Sequence
  Description of Artificial Sequence: Synthetic coding sequence
atggctcccacctgggggccagggatggtcagcgtagtagggccaatgggccttttggtggttctgctggttggcggctgtgcggccgaagagccccccagattcatcaaggagcccaaggaccagattggagtttctggcggggtcgccagtttcgtgtgtcaagctaccggcgacccgaagccccgagtgacatggaataaaaaagggaaaaaggtcaattcacagcgttttgagaccatagaatttgacgagtctgcgggggctgtgttgcggatccagccacttcggacaccgagagatgaaaatgtctatgaatgtgtcgctcaaaactctgttggtgagataacggtccatgcaaagcttactgtgttgcgcgaggatcagctaccctctggatttcccaacatcgacatggggccccagcttaaggtggtcgagcggacccggacagccactatgctgtgcgcggccagtggcaatcccgacccggagatcacgtggtttaaagactttttgcccgtagatccctccgccagtaatggccggatcaaacaactcaggagcggtgcgctgcaaattgagtcttcagaggaaactgaccagggtaaatatgaatgcgtggccacaaacagtgcgggtgttaggtactccagccccgccaacctgtatgtccgggttcgtagggttgcccccaggttcagcatcctgcccatgtctcacgagataatgcctggcggcaatgtgaatatcacctgtgtggctgtgggttctccaatgccttatgttaagtggatgcaaggagcggaggacctgactcctgaagatgacatgcccgtgggaaggaacgtcctcgaactgacagacgtgaaagacagcgccaattacacgtgtgtagccatgtcatcgctcggggttatcgaggctgtcgctcagattactgtcaagagcctgcccaaagcacccggcacccctatggtgacagaaaatactgcgacctccattacaatcacctgggatagcgggaatccagatcccgtgtcttattatgtgattgagtataagagcaaaagccaagacggtccataccagataaaagaagacatcaccacaacacgttactccattggcggcctcagccccaacagtgagtacgaaatatgggttagcgccgtgaattccattggacagggacctccaagcgagagcgtagtcacacgcacaggagaacaggctcctgcctccgccccccggaatgtgcaggcacgcatgctgtccgcaaccaccatgatcgtgcagtgggaggaaccagttgaacctaacggcttaatccggggataccgcgtgtattacacgatggagcccgagcatccggtggggaattggcagaagcataacgttgatgactcactgctcacaacggtcggctctctcctggaagacgaaacatacactgtacgggtgctggctttcacatccgtgggtgacggcccactgtccgacccaatccaggtcaagactcagcagggggtgcctggacagccgatgaacctccgtgcagaagctcgttcagaaacgtccatcacattgtcttggtcccctccaagacaggagagcatcatcaagtatgagctgctgtttcgggaaggtgatcacggccgtgaggtgggtagaacttttgatccaaccacctcttatgtggtcgaagatctgaaacccaatacagagtatgcctttcgtctcgccgcccgttcacctcaaggcttgggcgccttcacacccgtcgtgcggcaaaggactctacagagtatttcccccaaaaacttcaaagtgaaaatgatcatgaaaacgagcgtcctgctgagttgggaatttccggataactacaacagcccaaccccatacaagattcagtataacgggctaaccctggacgtggacggacgcaccaccaagaagttgatcacccatcttaagcctcacacattttacaacttcgtgttgaccaacagaggctcatccctcggcggcctccaacagaccgtgaccgcctggacagcctttaatctgctgaatgggaagccatctgtggcaccaaagcctgatgccgacggtttcatcatggtgtacctacctgacggtcagagtcccgtccccgtccagtcctactttatagttatggtaccacttagaaagagtcggggtggccagttcctcactcccttgggctcccccgaagatatggacctggaagagctcatccaggacatttcccggctgcagaggcgcagcctgagacacagtcgccagttggaggtgcctcgcccttacattgctgcacggttctcggtattaccccctacatttcaccctggcgaccagaaacaatacggcgggtttgacaatcgcgggctggagcccggccaccggtatgtccttttcgtgctggctgtactgcagaagtccgaaccaactttcgctgcttccccatttagtgatccattccaattggacaatcccgatccacagcctatcgtggacggggaagagggcctgatttgggtaattgggcctgtcctagccgtagtcttcattatttgcattgtcattgccatacttctctacaaaaacaaacctgactcaaagcgcaaggatagtgagccccggaccaagtgtctcttaaacaacgccgatctcgctcctcatcaccctaaagacccggtggagatgaggcgcattaatttccagacccctggaatgctcagtcacccacctatcccaattgctgatatggcagagcatactgaacggctgaaagcaaatgacagcttgaaattatcccaagaatatgagtcaatcgaccctggtcagcagtttacctgggagcacagtaaccttgaggtgaataagccaaagaatcggtacgccaacgttattgcatatgatcactcacgggttatactgcagccaatagaaggcataatgggaagcgactacatcaatgctaactatgtagatggctataggtgccagaacgcttatattgccacgcaggggccattgcctgaaacatttggggatttctggcgtatggtatgggaacagaggtccgccaccatcgtcatgatgacccgattggaggaaaaatcgcgtatcaagtgcgatcagtactggcccaatagagggacagaaacctacggttttattcaggtaactcttttagatacaattgaactggctacattctgcgtcaggacttttagtttgcacaagaacggcagcagcgaaaagcgggaagtccggcagtttcagtttaccgcctggcctgatcacggcgtgccggaatatcccactccatttcttgcctttctaaggagagtgaaaacttgcaatcctccagacgctggtcccattgttgtacattgttctgccggagttggcaggacagggtgcttcattgttatcgatgccatgctcgaacgtatcaagcccgagaaaacagtcgatgtgtatgggcacgtcaccttgatgcggtcacagcgcaattacatggtacagactgaggatcaatactccttcatccatgaagccttgctggaggccgtaggctgcgggaacacagaggtacctgcccgaagcttgtacgcctatattcagaaactcgcccaagttgaaccaggcgagcatgtaacagggatggaactggaattcaaaaggctcgccaatagtaaggctcatacatcacggttcatatccgccaatctgccatgcaataagtttaagaatcgattggtaaacattatgccctacgagtctacccgcgtatgtctgcagccgattcgcggcgtggagggtagtgattacataaacgcatccttcattgacgggtaccgacagcagaaggcctacatcgctacacaggggccactcgccgagactactgaggacttctggcgtatgctctgggaaaataatagtacaatcgttgtgatgttaaccaaattgcgtgagatgggacgggagaagtgtcaccaatattggcctgccgagagatccgcacggtaccaatacttcgtggttgaccccatggctgaatacaacatgccccagtatatcctgcgcgagttcaaggtgacggatgctcgtgacgggcaatctcgcacagtgcggcagttccagttcaccgattggcccgagcagggggtgcccaagagtggggaggggtttatcgactttatcgggcaagtgcataagactaaggagcagttcggccaggacggaccaatctccgtgcactgttctgctggggtcggcagaaccggcgtgtttattacattgtctatcgtgttggagcggatgcgttatgaaggagtggtagatatctttcaaacagttaaaatgctacgcacccagaggcctgcaatggtacagacagaagacgagtatcagttctgttatcaggcggccttggaatatttaggctccttcgaccactacgcaacctag

SEQ ID NO: 130984 - DNA, 5847 bp, Artificial Sequence
  Description of Artificial Sequence: Synthetic coding sequence
atggcccccacctgggggcctgggatggtttcggtggtgggtcctatggggctgctggtcgtgctcttagttggggggtgcgccgctgaagagccccccagattcataaaggaacccaaggaccagataggagtttctgggggggtcgctagtttcgtgtgtcaggcgacaggagacccaaaaccccgggttacttggaacaagaaaggcaaaaaggtgaattctcagagatttgagaccatcgagtttgatgagtccgctggggctgtgctgcgaatccaacccttaagaacacccagggacgaaaatgtgtacgagtgcgtcgctcagaacagcgtgggagagataacagttcacgctaagctgaccgtgctgcgggaggaccaacttccctccgggtttcctaacattgatatgggcccccagctaaaggtggtcgaacggacccgcactgctactatgttgtgcgccgcaagtggtaatccagaccccgaaatcacttggttcaaggatttccttcctgttgacccaagtgcttccaatggccggattaaacagctcagatcagatcaggcctttagtcatctcccaaccggagcccttcaaattgaatctagtgaggagactgaccaagggaagtatgagtgcgtcgctactaactccgcaggagtgcgctatagtagcccagcaaatctttatgtcagggtttggaggacggttcgtagggtggctccacgcttctccatcctgcccatgagtcacgaaataatgcctggtggcaatgttaatattacgtgcgttgctgtcgggtcccccatgccctacgttaagtggatgcaaggggctgaggacctgacccctgaagacgatatgcccgtgggaagaaacgtgcttgaactgaccgacgtgaaggacagcgcgaattacacctgtgtggctatgtctagcctaggcgtgatcgaagccgtcgctcagatcaccgtcaagtcccttcccaaggctcctgggacgccaatggtgaccgaaaacacagctacctccattacaattacctgggattctggaaatcctgaccccgtctcatactacgtcatagaatataaatccaagtcccaggatggaccataccagataaaggaggacatcactacaacgagatattccataggcggtctttcccccaactcggagtacgaaatctgggtttctgctgtgaattcaataggccaagggcctccttcagagtccgtagttactaggactggagaacaagctccggcgtccgccccacgaaatgtacaggcccggatgttaagcgcaactactatgatcgtgcagtgggaagagccagtggagcctaatggcctgattagagggtatcgagtttactacacaatggagcccgagcacccagtcggtaactggcaaaagcacaatgtggacgattcattgctgacaactgttgggtccttgctggaggacgagacttataccgtgcgggtcttggcttttacatcagtcggggatggaccactgtccgaccccatccaggtgaagacccagcaaggagtgcctggtcagcccatgaacctccgcgccgaagcacgatcggaaactagcatcacactctcctggtcaccaccaagacaggaatcaattattaaatacgagcttctgtttcgcgagggggaccatggccgtgaggtgggtcgcacttttgatccaacaacaagctatgtggtggaagacttgaagccaaacacggagtatgccttccggcttgctgcgaggtcacctcaagggctgggcgccttcaccccggtcgtgcgacaacgaaccttgcagagcaaaccaagtgcacctcctcaagatgtaaagtgcgtgtcggtgagaagcaccgctatactggttagctggagacctccccccccagagactcataacggcgccctggtcggctactccgtcagatatcggcccctgggcagtgaagaccctgagcctaaagaggtaaacggaataccgccgaccactactcagatccttcttgaggctctcgaaaaatggactcagtaccgaattaccactgtagcccacacagaagtcggccctgggcctgagagttcacccgtcgttgttaggaccgacgaagatgtgcccagtgctcccccccgcaaagttgaagccgaggccctgaatgccacagcaatacgggtgttgtggcgcagtccagcacctggccgccaacatggtcaaatacgtggataccaggtgcattacgtccgcatggaaggagcagaggcgcgcggacccccccgaattaaagatgttatgctcgccgatgcacagtgggagacagacgacaccgctgaatatgaaatggtcataaccaatttacagcctgagacggcctatagtatcactgtggcagcctacacaatgaaaggcgatggggcaaggtccaaaccaaaggtggtggtgactaaaggagccgttctgggcaggccaacgttatccgtgcagcagacccccgagggcagtctgctggcaagatgggaaccccccgcaggcaccgctgaagaccaggtactggggtatagattacagtttggacgagaggactccacacccctcgcgacactcgagttccccccaagtgaagatcgctataccgcctcgggcgttcacaagggggccacatacgtcttccgactggccgcccgtagccgcggaggcctgggcgaggaggccgcagaagttctctctattcctgaagatacaccccggggccaccctcagattctggaggccgccggaaatgcgagtgcgggaactgtccttcttaggtggctgcctccagtacccgctgagaggaacggtgctattgtaaagtacactgtcgccgtgagggaggcaggcgctctgggacccgcaagggaaacagaactgccagccgcagcagagcccggcgcagaaaatgcactgactcttcagggtctaaaacctgacacggcatacgatctgcaggtgcgcgcgcacaccagacgcggtcctgggcccttcagtcctcctgtgagataccgcactttcttgcgcgatcaggtcagccctaagaatttcaaggttaagatgatcatgaagacttcagttctcctgtcttgggaatttccagacaactataattctccaacaccgtacaaaatacagtataacggactgactttagatgtggatggcagaacaacaaaaaaattgatcacacatttgaaaccacacacattttacaacttcgttctcactaatcgaggctcatccctgggcggccttcagcagacggttaccgcctggaccgccttcaatttgctgaatggaaaacccagtgtagcccccaaacctgatgcggacggcttcataatggtgtatctgccggacggccagagtcccgtgccagtgcagtcctacttcattgtgatggtgcctctgcggaagagcagagggggtcagtttctgacccccttggggtccccggaagacatggatctagaggaactcattcaagatatcagtaggctccaaaggcgatcacttaggcacagccgccaacttgaagtaccccggccttatattgccgctagatttagtgttctgcccccaactttccaccctggggatcagaaacagtacgggggatttgacaaccgggggcttgagcccggccaccggtacgtccttttcgtcctggccgtactgcagaaaagcgagcctacatttgccgcctcccccttcagcgaccctttccaactggataaccccgatccgcagcctattgtggatggtgaagagggactcatctgggtgatcgggccagtgctagctgtggtttttattatttgcatcgtgatcgccatacttttgtacaaaaacaaacccgatagcaagagaaaagacagtgaaccccgcactaagtgtcttctcaacaacgcagatctcgcgccacatcaccccaaagatccagtcgaaatgagaaggattaactttcagacacccgatagcggtctcagaagcccactgagagagccaggctttcattttgagagcatgttgagccaccctcccatcccaatagctgatatggccgaacacacagagcgcctgaaggcaaatgacagcctgaaactctcacaagagtatgagtctatcgatcccgggcagcagtttacatgggagcatagtaaccttgaagtaaacaagcccaagaacagatatgctaacgtaatcgcttatgaccacagcagggttatcctgcagcccattgaggggatcatgggctccgattatatcaacgcaaattacgtcgatggctatcgctgccagaatgcctacatcgcaacccagggaccgctccccgagacattcggtgacttttggcgtatggtgtgggaacagcgctctgcaaccattgtgatgatgaccaggctggaagaaaaatctcgaattaagtgcgaccagtactggcccaatcgtgggactgagacttatgggttcatccaggtaacactcctcgatactattgagttagctactttctgcgtgcgaactttcagcctgcacaagaacggttctagtgaaaaacgggaggtcagacagtttcagttcactgcctggcctgatcacggggttcctgaatatccaaccccatttctggccttcctaaggagagttaagacatgcaaccccccagacgctggccccatcgtagtccactgtagtgccggagttggtagaaccggctgcttcattgttatagacgctatgcttgagagaatcaagcccgaaaagacagttgatgtttatggccacgtgactctgatgaggagtcagaggaattacatggtgcagaccgaggatcagtactctttcatacatgaggcactgctggaagctgtgggctgtggcaataccgaggttcccgcacgatccctgtacgcatacattcaaaaactcgcacaagtggagccgggcgaacacgtgactggaatggagctggagtttaagaggttagctaattcaaaagcccacacaagcagatttatctctgccaatctgccatgcaataagttcaaaaatcggctggtaaacattatgccgtatgagtccacaagggtatgccttcaacctatccgcggcgtggagggtagtgactacatcaacgctagcttcattgacggatatcgacagcagaaggcgtatattgccacccagggcccactcgccgagacaacagaggatttttggcgtatgttatgggagaataattccaccatagtagtcatgctcacaaaactgagggagatgggccgcgagaagtgccaccagtattggcccgctgagcggagtgcccgttaccaatactttgtggtggatcccatggccgaatacaacatgccccagtacatccttagagaattcaaggtcactgatgccagggacggacaatccagaacagttcgccagttccaattcactgattggcctgaacagggagtgccaaagtctggagaagggttcatagactttatagggcaggtgcacaagactaaagagcagttcgggcaggatgggcctattagcgtgcattgtagcgccggggtgggccgcaccggtgttttcatcaccctatcaattgtgctggaacgcatgcggtacgagggcgttgtcgacattttccagactgttaaaatgctacggacccaaaggcctgccatggtgcagaccgaggatgagtaccagttttgttatcaggctgcgctggagtacctaggctccttcgatcattatgcgacatag

SEQ ID NO: 130985 - DNA, 4593 bp, Artificial Sequence
  Description of Artificial Sequence: Synthetic coding sequence
atggctcctacatggggcccagggatggtatccgttgtgggacctatgggtttattagtcgtcttgctggtcggcggatgcgccgccgaggagcctcccaggttcattaaagagcctaaggatcagattggggtgtcgggtggcgttgcttctttcgtatgtcaggcaaccggagacccaaagccgcgggtcacctggaacaagaagggaaagaaggtgaacagccagaggtttgagactatcgagttcgatgaatccgctggcgccgttctgagaatccagccactccgtacgccacgtgacgagaatgtgtatgagtgcgtagctcagaattccgtaggtgagataaccgtccatgccaaactgaccgtgctgagggaagaccaactcccaagcggattcccgaatattgacatgggcccacagctgaaagtcgtggagcggacgcggacagccaccatgctttgcgcagccagtggcaatcccgatcccgagatcacttggtttaaggactttctgccagtagatcctagcgccagtaacggccgcatcaagcagttgcgcagcgaccaggctttctctcatctgcctacgggcgcactgcagatagaatccagcgaagagaccgatcagggcaagtacgagtgtgtggccacaaactctgcgggggtccggtatagttctcctgccaacctttacgtacgagtctggcggacagtccgtagagtggccccccggttttccattctgcctatgagccacgaaatcatgccaggaggaaatgtgaatattacttgtgtagcagtaggatcccccatgccttacgttaagtggatgcaaggggccgaggatctcactcctgaggatgatatgccagtggggcgcaatgtgctggagctgacagacgtcaaagacagcgctaattacacctgcgtggcaatgtcctcattaggggttatcgaggcagtagcacagatcacagtcaagtctcttcccaaggcacccggaacccccatggtgaccgaaaataccgctaccagcattacaatcacctgggacagcggaaacccagatccagtttcctactacgtgattgaatataaatccaagagccaggatggtccttaccagatcaaagaggacatcactactacaaggtactctattgggggactgagccccaattcagagtacgagatctgggtgtccgcagtgaacagcattggccagggtccaccttcggaatctgtggtgactcggaccggggagcaggcacctgcttcagcccccagaaacgtccaagcaagaatgttgtcagccacgacaatgatagtccagtgggaagaacccgtggagcccaacggcctgatccgaggttatcgtgtgtattacaccatggaacccgagcatccagtgggcaattggcaaaaacacaatgttgacgacagccttttgacaaccgtcggcagcctattagaggacgagacctacactgtccgggtgctggcgtttacaagcgttggggacggcccgctcagcgatcccatccaagtgaaaacccaacaaggggtccctgggcagcccatgaatttacgcgcagaagcaagatccgagacctctatcactttgagctggagcccccccaggcaggagtcaattataaagtacgaattgctcttcagggaaggcgatcatgggcgggaggtgggtcggacttttgatcctactaccagctatgtggtggaagacctgaagccgaacactgaatacgcatttcgactcgccgcaaggagccctcagggactgggggctttcactccagtagtccggcagcggactttacagagcatctccccaaaaaacttcaaagtcaagatgattatgaagaccagtgtcctgctgtcgtgggagtttccagacaactacaacagccccaccccttacaagatccagtataatgggctgaccctggatgtggacggcagaactaccaagaagcttatcacacacctgaagccacacaccttttacaactttgttctaactaatcgaggaagttcccttggcggcctccaacagaccgtgacggcctggacagcctttaatctgctgaacgggaaaccatctgtggctccgaaaccagatgctgacggttttataatggtgtacctccctgatggccaaagcccagtcccagtccaatcctatttcattgtgatggttccactaaggaaatcccgtggtggacagttcttgacccctttgggcagccccgaagacatggacctggaagagctgattcaggatatttcacggttgcaacgccgttccctgagacactctagacaattggaggtcccccgcccctacatagcagcacggttttccgtgttacccccaacattccatccaggcgaccagaagcagtacggaggatttgataatcgggggctcgaaccaggccataggtacgtacttttcgtgttagccgtgctccaaaaatcagaaccgaccttcgcagcctcaccattttcggaccccttccagctagataacccagacccccagccgattgtggacggagaggaaggcctgatctgggtgattgggcccgtgttagctgtggtgtttattatttgtattgttattgccatcttgctctataaaaacaagccagattcaaaaaggaaagacagcgagccaagaaccaagtgccttctcaataacgctgatttggcaccacatcacccaaaagatcctgtggaaatgcgacggattaatttccaaacccccgactcaggccttaggtcccctcttcgggaaccaggcttccacttcgagtccatgctgagtcatccaccaattccaatcgccgacatggcagaacatactgagaggctgaaagctaacgacagtctcaaactttcccaggaatacgaatccatcgaccccggccagcagttcacatgggaacatagtaacttggaagtgaacaaacccaagaaccggtacgccaacgtaattgcttacgaccactctcgagtgatcctgcagcctatcgaaggcatcatgggcagcgattatatcaatgcaaattatgtggacggatacaggtgtcaaaacgcttatatagcaacgcagggccccctgcctgaaactttcggggatttctggcgaatggtctgggaacaacgcagtgcgaccatcgtgatgatgactcgactagaagagaagtcccgaatcaaatgcgaccagtactggcctaaccgagggacagagacctacggattcatccaggtgacactccttgacaccatcgaattagcgaccttttgcgttaggaccttcagtctgcacaaaaatgggtcttccgaaaaacgcgaggtgcgacagtttcagtttaccgcgtggcctgatcacggcgtacctgaatacccaactcctttcttggcctttctgcggagggtgaagacctgtaaccctccggatgccggcccgatcgtggtgcactgcagcgccggagtagggaggactggttgttttattgtcattgacgctatgctggaacgcatcaagcccgaaaaaaccgtggatgtgtacggccatgtaaccctcatgcgatctcaacgcaactatatggtacaaactgaggatcaatactcttttatccatgaagccttgctggaggcagtgggctgtggcaatactgaggttccagcccgttctttgtacgcctacattcagaaattggctcaggttgaacccggcgagcacgtaacgggcatggagctagagttcaagaggttagccaactctaaagcacatacctcacggtttatttccgccaatcttccttgtaataaatttaaaaatagactggtcaatatcatgccatatgagtcgactagggtctgcctgcagccaattcggggggtagagggtagtgattatatcaacgcctccttcatagatggctatcggcagcagaaggcctacatcgctacccagggaccccttgcagaaaccacagaggacttttggcgcatgttgtgggaaaacaacagcaccatcgtggttatgttgacaaagctgcgggagatgggcagagaaaaatgtcatcagtattggcctgccgagaggtctgccaggtaccagtactttgtggttgaccccatggctgaatacaacatgcctcagtacattctcagagagttcaaggtgactgacgccagagatggacagagcagaacggtccggcaattccagtttacggattggcctgaacaaggagtccccaaatcgggagaggggttcatcgattttatcgggcaagtacataagactaaggagcaatttggacaggacggccccatctcagttcactgctccgctggggtgggacgcaccggagtgttcattactttgagcatcgtactggagcggatgcgctatgagggagtagtcgacatattccagacagttaagatgttgcggactcagaggccagccatggttcagactgaagatgaataccagttttgttatcaagccgctctggagtatcttggctccttcgatcattatgccacatag

SEQ ID NO: 130986 - DNA, 5820 bp, Artificial Sequence
  Description of Artificial Sequence: Synthetic coding sequence
atggcgccaacctgggggcctggcatggtcagtgttgtggggccaatgggactcctggtcgtcttgctcgtcggaggctgtgctgccgaagagccccccaggtttattaaagagccaaaagaccagatcggagtaagtggaggagttgcctcatttgtatgtcaggccacaggggatcctaagccacgcgtgacttggaataagaagggcaagaaggtgaatagtcaacgatttgaaaccattgagttcgatgaatctgctggggcggtcttgcgaattcaacccttgagaactccacgggacgaaaatgtttacgagtgcgtggcacagaattccgtcggagagatcacagttcatgcaaagctgacagtcttacgggaggatcagcttcctagcggctttcctaacatagatatgggcccacagcttaaagtggtggaaagaactcggacagcgaccatgctgtgcgccgcaagcggtaaccccgaccccgaaataacttggtttaaagatttcctcccagtcgacccctctgcgagcaacggtaggattaagcagcttcggagtgaccaagcctttagtcacctgccaacaggggcactccaaatcgagtcctccgaggagacagaccagggtaagtacgagtgcgtggcaacgaacagtgctggagtgagatatagtagccccgccaatctgtacgtacgagtgtggaggactgtgcgccgggtggctcctcgattttcaattttgccaatgtcacacgaaatcatgcccgggggcaatgttaatattacatgcgtcgctgttggaagtcccatgccttatgtgaaatggatgcagggggcagaagatctgacccccgaggacgatatgcccgtcgggagaaacgtgctggagttgaccgatgtgaaagacagtgccaactacacctgcgtggcgatgtcaagcctgggcgtaatagaggccgtagcacagattaccgtgaagtcgcttcctaaggcgcccggcacaccaatggtgacagagaatacggccaccagtatcacaatcacttgggatagcggcaacccggatccagtgtcctattatgtgattgagtacaaaagcaagagccaggacggaccctatcagatcaaggaggatataacaaccacacgctactccataggggggttgtcccccaacagcgaatacgagatatgggtgtcagctgtgaactccataggtcagggacctccttccgagtcagtcgttacgcgaaccggcgagcaagcacccgcgtccgcgccgcggaacgttcaagcccggatgctctccgccacaaccatgatcgtccagtgggaggagccagtagagccgaacggcctgattcgaggatacagggtctactacactatggagccagagcacccagtaggaaattggcagaagcacaacgtggatgactccctcctcacaacggtcggtagccttctggaggacgagacttatactgtgagagtcctggccttcactagcgtgggagacggccccctgtcagaccccattcaggtgaagactcagcagggtgttccaggacaaccgatgaatctgagggccgaagctcgctctgaaacaagcatcactcttagctggagcccacctcggcaagaatctatcatcaagtacgaactgctttttcgcgaaggggatcatggtagggaggtcggtcgaaccttcgaccccaccacctcctatgtagtggaggatctaaaacctaataccgaatatgcattccggttggcggccagaagtccacagggactgggcgcttttacccctgtagtccggcagaggacactccagtcaaagccctctgcccctccccaggatgtcaaatgtgtgagcgtgaggtctaccgccatcctggtgtcttggcggcctcctccacccgagacacacaatggagcactggttggttatagtgtaagatatcggcctctgggctctgaggatcctgagcccaaagaagtcaacggcatccctcccaccacaacccagatcctactcgaagcactggaaaagtggactcaataccgaattacgaccgtggcacataccgaagtggggcctggtcctgaaagcagccccgttgtcgtgaggaccgatgaagacgtcccttcagctcctcctcggaaggtcgaggccgaggctctgaatgcaacagcaatccgggtgctctggcggtctcccgctcctgggagacagcacgggcaaattaggggttaccaggtacactacgttcggatggagggggctgaagcacgcgggccaccccgaataaaagatgtcatgctggctgacgcccaagaaatggtcattacaaacctacagccggaaaccgcctactccatcaccgtcgcagcatatactatgaaaggcgacggagctcgctccaaacctaaagtggtagtgactaagggagccgttcttgggcggccgaccctgtcagtccaacagacccccgagggcagcctgttggctaggtgggaaccccccgccgggaccgctgaggatcaggtgctggggtacaggcttcagttcgggagagaagattctacacccctggcaaccctggagttcccaccctcggaagaccgctatacagcttccggcgttcacaagggagctacatatgtgtttaggttagctgcgagatctcgaggtgggctaggagaagaggctgctgaggttttgtctatacctgaggatacccccagggggcaccctcagatcttggaggctgccggtaatgcgtcggccggaacagtgcttctgaggtggctaccacctgtgcccgccgaacggaacggagctattgtgaaatatacggtcgctgtaagggaagccggagcccttgggccagctcgagagacggagctgcccgctgctgcggagcctggggccgaaaacgccctgaccctgcagggcctgaaaccagacaccgcttacgacctgcaggtccgggcccacacaagaagggggcccggtccctttagtccacctgtaaggtataggacctttctgagagatcaggtctctcctaagaactttaaggtgaagatgatcatgaagacatctgttttgttgagttgggaatttcctgataactataattccccaaccccatacaaaatccagtataatgggctaacgctggacgttgacggaaggaccactaagaaactgataacccacctgaagccgcacacattttataactttgtgttgacgaacaggggcagttcactgggtgggctccagcagacagttaccgcttggacagcctttaatttgctcaacgggaaaccgtccgtggctccaaagcccgacgccgacgggttcattatggtgtatttaccagacggacagtcacccgtgcctgtgcagagctacttcatcgtcatggttccacttcggaagtcccggggtgggcagttcctgacacccctgggttccccagaggacatggatttggaggagttgatacaggacatcagtcggctccagaggcgatccctccgccatagccggcagctcgaagtgccaaggccctatatcgctgcaagatttagtgtgctcccccccacctttcaccccggtgatcaaaaacaatatggaggctttgataaccggggcctggagccaggacaccgctacgtgctgttcgtcctggctgtgctccagaagtccgagccgacatttgctgcctcaccattctcagatccctttcagttggacaacccggatccgcagccaatcgtggacggcgaggaaggtctgatatgggttattggtccagttctcgccgtcgtcttcattatctgtatcgtaatagctatcctcctgtataaaaataagcccgattccaaacgaaaagacagtgagccacggacgaagtgcctgcttaacaacgcagatcttgccccacatcaccccaaggaccccgtggagatgcgacggatcaactttcaaaccccagattcagggctcagatcacccctgcgggaaccaggtttccacttcgagtccatgctgagccacccgccaataccaattgcggatatggctgaacatacagagcgcctcaaggcgaatgattccctgaagctgagtcaggaatacgagtctattgatcccgggcagcaattcacctgggaacacagcaacctggaagtcaacaagccgaaaaaccgatacgccaatgttatcgcatatgatcattccagagtgatcctccagccaattgagggcattatgggcagtgactacatcaacgccaattatgttgacgggtaccgctgccagaacgcctatatcgcaacccagggacctctcccggaaacctttggagacttctggcgcatggtttgggagcaacgcagcgcgaccattgtgatgatgacgcggttagaagagaaaagccgaatcaagtgcgatcagtattggcccaacagaggcaccgaaacctatggtttcattcaagtgacccttcttgacacgatcgagctcgccacattctgtgtgagaacgttctccttgcacaaaaatgggtcctccgaaaagcgggaggtgaggcagttccagtttacagcctggcccgatcatggagttcccgaatatcccacaccttttttggccttccttcgtcgagtcaaaacctgcaaccctccagatgcaggccctattgtggtgcactgctctgcgggagtggggaggaccgggtgcttcatagtcattgacgcaatgctggagcggatcaagcccgaaaaaaccgtggacgtgtatggacacgtgactcttatgcggagccagcggaactacatggtgcagaccgaagaccagtatagctttattcatgaggcactcctcgaggccgtagggtgtggcaataccgaggtccccgccaggtcactttatgcttacatccaaaagcttgcccaagtggaacccggggagcacgtcacaggaatggaactagaattcaaaaggctggcaaactccaaggcacacaccagtaggttcatcagcgccaacctcccttgtaataagtttaagaaccgcctggtgaacatcatgccgtatgagtccacccgcgtatgcctgcagcctatacggggtgtagaagggtcagactacatcaatgccagtttcatcgacggatatagacagcagaaggcctacatagctacacagggcccgctggcagaaaccacggaggacttctggaggatgctgtgggagaataactccaccatagtcgtgatgttaacaaagcttcgagaaatgggtcgcgaaaagtgccaccagtactggcccgcagagcgcagtgcgagataccaatactttgtggtcgaccccatggcggagtataacatgcctcagtacattctgcgtgaattcaaggttaccgacgccagagacggacaaagccgcacggttcggcagttccagtttaccgactggcctgagcagggagttccaaaaagcggggaagggttcatcgactttattggccaggtgcacaagacgaaagagcaattcggccaagacggtcccatcagtgtacattgttccgccggtgtcggacgtacgggggtcttcattactctcagcatagtgcttgagcgaatgcggtacgagggcgtggtagatattttccaaaccgtgaaaatgcttagaacacagagacctgctatggtgcaaaccgaagacgagtaccagttctgttaccaagctgcgttagagtacctgggctctttcgaccactatgcaacgtag

SEQ ID NO: 130987 - DNA, 5847 bp, Artificial Sequence
  Description of Artificial Sequence: Synthetic coding sequence
atggcgcctacttggggcccggggatggtatcggtcgtgggacctatgggactgttggtggtgctcttggttggcggttgtgccgccgaggagcctcccagatttatcaaagaaccaaaagaccagatcggggtgtctgggggggtggcctcattcgtctgtcaggccacaggagacccaaaacctcgggtaacatggaataaaaaaggcaaaaaggtgaactcgcaaagattcgagactattgagttcgacgagtccgccggagccgtgctcaggatccagcccctccgaacaccgcgcgatgaaaatgtgtacgagtgtgtagcacaaaatagcgtcggtgagatcactgtacacgcaaagctgacagttctgagggaggatcaactacctagtggcttccctaacattgacatggggccacagctgaaagttgttgagcggaccagaactgccaccatgttgtgtgcggccagtggaaatcccgaccccgaaataacgtggttcaaggacttcttacctgtggaccccagcgcaagtaatggcagaatcaagcagttgagatcagaaacctttgagtccactccaattcgcggcgccctacagatcgaatccagtgaggagaccgaccagggcaagtacgagtgcgtggctaccaactctgcgggggtgagatactcctccccggcaaatctgtacgtccgggagctgcgagaggtgaggagggtggcaccccgcttcagcatcctacccatgtcccacgaaatcatgccaggcggcaatgtaaacatcacatgcgtggccgtgggctcaccaatgccttacgtcaagtggatgcaaggggccgaggacttaactcccgaggacgacatgcccgtgggacggaacgtgctggagttaaccgatgtgaaagacagtgccaattacacctgcgtggcaatgtccagcctgggtgttatcgaggccgtggcacagatcacggtgaaaagtttgcccaaggcacctgggacaccaatggtaacagagaatacggcgacatcaattacaattacttgggactccggaaatccagatcctgtttcatattatgtcatcgagtataaatcaaagtcacaggatggtccttaccagatcaaagaagatattactactacccgctacagcattggcgggctgtctcctaattcagagtacgaaatctgggttagcgccgttaatagtattggtcagggtcctccatccgaatcagtcgtcaccagaactggcgagcaggcaccggcatcagctccacgtaacgttcaggccaggatgctgagcgctactacaatgatagttcaatgggaagagcccgtagagcccaatggcctcattaggggctaccgggtgtattatactatggaacctgagcaccccgtaggtaattggcaaaaacacaacgtggatgattccctgcttactactgttggctccctgctagaagacgaaacatacaccgtgcgggtcctggctttcaccagcgtcggtgacggtcctctgagcgaccctatacaggtcaagacacagcagggcgtgccgggacagccaatgaatctcagagcggaggctcggtctgagacttccattaccctaagttggagccctccaaggcaggaatctatcatcaagtacgagctcctgttcagagagggagatcatggaagagaagtgggcagaacatttgatcctacaaccagctatgtagtggaggatctaaaaccaaatacagagtatgccttccgattagccgcaagatcccctcagggcctcggtgcgtttacacctgtagtgaggcagcggactcttcagtctaaaccttcagcacctccacaggacgtcaaatgcgtgtccgtgcggagcaccgcgatactggtgtcttggagaccaccaccacccgaaactcacaacggcgcccttgttgggtattcggtccggtaccgaccccttggctcggaggatccagagccaaaggaagtgaacggaatcccaccgacaaccacccaaatcctcctagaagctctggaaaagtggacccagtaccgaataacaacggttgcgcacaccgaggtcggaccaggccccgaatcaagccctgtggttgtgcgcactgacgaagatgttccatccgcaccacccaggaaagtcgaggctgaggctcttaacgccactgctataagagttctctggaggtctccagccccgggcaggcaacacggacagatacgggggtaccaagtgcactacgttcggatggaaggagctgaagctagaggacctcctcgaatcaaggatgtaatgctagccgacgcacaatgggaaacggatgataccgcagagtatgagatggtgattactaatctgcagccggaaaccgcctacagcatcacagtggccgcttacaccatgaaaggcgatggcgctcgaagcaaacctaaagtggtggtgaccaagggggctgttttgggaagacccaccctgtctgtacagcaaactccagaagggtccctgctggctaggtgggaacctcccgcaggcacggcagaggaccaagtcctggggtacaggcttcagttcggtagagaagacagcaccccacttgcaactttggagtttccacccagcgaagataggtatactgcttcgggcgtgcacaagggagcgacctatgtgttccgcctcgccgcccgttcgcgaggcggcttaggggaggaggccgcagaggtcttgagtatcccagaagacacgcctaggggccatcctcagatcttagaggctgccggaaacgctagcgcgggcactgttctcctgagatggcttcccccggtgcctgccgaaagaaacggggctatagtgaagtacaccgtcgcagttagagaggccggtgccctgggcccggcacgagaaactgaacttccggctgctgctgaacccggagcggagaacgcattgaccctccagggacttaaacctgacacagcctatgatctgcaggtcagagcccatacccggcgcggccctgggcccttctcacctcctgtgaggtatcggaccttccttagagatcaagttagccctaagaacttcaaggtaaaaatgattatgaagacttccgtgctgctgtcctgggaattcccggataactataattcacctaccccttataagatccagtataacggtctgacactggatgtggatggacggaccactaagaagctcatcacacatctcaagccacataccttctacaactttgtgctcacaaacaggggcagctcactgggcgggctgcagcaaactgtcacggcttggaccgcattcaacctccttaatggcaagccttcagtagcgcccaagcccgatgcagacggattcatcatggtttatttgcccgacggacaatctcccgtccccgtgcagtcctacttcatcgttatggtgcctctcagaaaatctcgcggagggcaatttctgactccactggggagccccgaagatatggatctcgaagaactgatccaagacatctcccgtctccagcgtagatcattgcggcacagccgccagttggaggttcccagaccatacatcgctgcccggtttagcgtgctcccccctacctttcaccctggggatcaaaagcagtatggtggattcgacaacagaggcctggaacccggtcaccgttacgtgctttttgtcctggctgtactgcagaagagcgagcccacatttgccgcttcaccgttcagtgaccccttccagctggacaaccccgaccctcagccaattgtggacggggaggaaggcttgatttgggtcatcggcccagtcttggccgtggtgttcattatctgtatcgttatcgccatcctgctgtataagaacaaacccgattccaagcgcaaggattcagaacccagaactaagtgcctcctgaacaacgccgatctagcccctcaccatcccaaagaccccgtcgagatgagacgaattaattttcaaaccccagatagtggcctgcggtctccactgagagagcccggttttcattttgagtcaatgctgagccacccacccatacctatcgccgatatggcagagcataccgaacgacttaaggcaaacgattcccttaagttatcccaggagtatgaatccatcgacccgggccaacagtttacgtgggagcacagtaatctagaggtgaataaaccaaagaacaggtatgcaaacgtaatagcctatgaccatagccgggtcatccttcagcctatcgagggaattatgggaagtgactatatcaatgctaactacgtcgatggttacagatgtcagaatgcctatattgcgacgcagggcccgctgccagagaccttcggggacttttggaggatggtttgggagcagcggtctgccaccatagtgatgatgaccagactggaggagaagtctagaataaagtgtgaccagtattggcccaatcgggggacggagacttatggcttcatacaagtgactcttctggacactatagagctggccacattctgtgtgcgcaccttttccttgcacaagaacgggtcgagtgagaagcgtgaggtgcggcagttccaattcaccgcatggcctgaccatggggtgcctgagtatccgacacctttcttagccttcctgcgtagagttaaaacctgtaacccacccgacgctggccctatcgtcgttcattgctcagcgggcgtgggtagaacagggtgtttcatcgtaatcgacgctatgctggaaaggataaagcctgaaaaaaccgtggacgtgtacggccatgttacattaatgcgaagtcagagaaattacatggtgcagaccgaggatcagtactcctttattcacgaggcccttctggaagccgtgggctgcggcaatactgaggtgcctgccagatccctgtacgcttacattcagaagttggcccaagttgagccaggcgagcacgtgactgggatggaattggaatttaagcgcttggccaactctaaggcccataccagtaggtttatcagcgccaatcttccatgtaacaaatttaaaaatagacttgttaatattatgccttatgaatctacgcgcgtctgtctccaaccgattcggggggtcgaggggagtgactacatcaatgcaagtttcatcgatgggtacagacaacagaaagcctacatcgccacccaagggccactggccgaaacaaccgaagacttctggaggatgttgtgggaaaacaacagtacaatcgttgtgatgctcacgaagctccgcgagatggggcgtgagaagtgccaccagtattggcccgcagagcgcagcgcccgctatcagtacttcgtagttgaccccatggcggagtacaacatgccccagtatatcctgcgcgaattcaaagtgaccgacgctagagatggccaaagtcggactgttcgtcaattccagtttaccgattggcctgagcagggggtccctaagagtggagaagggttcattgattttatcggacaggtgcacaaaacaaaagaacaattcggccaagatggcccaatctcagtgcattgtagtgctggcgtcggccgaaccggcgttttcatcaccctgtcaatcgttctcgagcggatgagatacgaaggcgtcgtcgacatcttccagaccgtgaaaatgctcaggactcaaaggcctgcaatggttcagaccgaggacgaatatcaattctgctatcaagcggccctggagtacttgggatcatttgatcactatgccacctag

SEQ ID NO: 130988 - DNA, 5850 bp, Artificial Sequence
  Description of Artificial Sequence: Synthetic coding sequence
atggctccgacgtggggacccggaatggtatccgtcgtggggcctatgggcttgctggtcgttctccttgtaggcggttgcgccgctgaggaaccgccaaggttcatcaaggagcctaaggaccagatcggggtgagcggcggagtggctagcttcgtatgtcaggcaacgggcgaccccaagccacgggtgacgtggaacaagaaaggaaagaaggtgaatagccagcggtttgaaacaatcgaatttgacgagtcggcaggcgccgtgctgaggattcaaccgctgaggaccccccgcgacgagaacgtttatgaatgtgtggcgcagaatagtgtgggggagattacagtccatgctaaactcactgtattgagagaggaccagctgcccagcgggtttcctaacattgatatgggcccccaactgaaggtggtggagcgaactcgaaccgccacaatgctgtgcgccgcctctgggaaccccgaccccgagattacgtggttcaaggactttctgcccgtcgatccgagcgcgtccaacggaaggatcaaacagctccgcagatctgagacttttgagagtacacccatcaggggggctctgcagattgagagttcagaggaaaccgaccagggtaagtacgagtgcgtggctacaaactccgccggcgtgcgatattcttcccctgcaaatctgtacgtccgcgaactgagagaggtgcggcgcgtggctccccgtttttccattctccctatgtcccatgagattatgccaggcgggaacgtcaacattacctgcgtggctgtggggtcccccatgccttacgtcaagtggatgcaaggagcagaagatctgactccagaagatgacatgccggtggggaggaacgtgttggagctgactgatgttaaagacagcgcaaattatacttgcgtggcaatgtctagtctgggtgtaatcgaggccgtcgcacaaatcacggtcaagtcccttcccaaggccccgggaacccccatggtgacagaaaatacagccacaagtattaccattacatgggattccgggaaccctgatcctgtttcctactatgtcattgaatacaaaagtaaaagccaagacgggccctaccagataaaagaagatatcaccacaacacgttatagtataggaggtctgtctcctaactccgagtacgagatttgggtgtctgcagtaaatagcatagggcagggccccccttcagaaagcgtggtgacacgtacaggggaacaggcccccgcatctgccccaaggaatgtgcaagccagaatgctgtctgctactaccatgatcgtgcaatgggaggagccagtagagccaaatggccttattaggggataccgggtttactacaccatggagcctgaacacccggtgggaaactggcagaagcacaatgtggatgactctctgttgacgaccgtaggatccctgctcgaagacgagacttacacggtccgtgtactggcttttactagcgtcggggacgggcctctgtccgatccaatccaggtcaagacccagcaaggagttccaggccagcctatgaatctgagggctgaagcacggtccgagactagcattaccctttcatggagtccccctcgtcaggagagcatcatcaagtatgaactacttttcagggaaggcgaccatggcagagaagtggggcgaacttttgatccaactactagttacgtcgtggaagacctcaaaccaaacacggagtacgcatttagactcgccgcccggagtcctcagggcctaggggcgttcactccagttgtacggcaaaggactctccaatcgaagcctagcgctccccctcaggatgtcaaatgtgtgagcgttcggagcaccgcgatcttggtgagctggcggccacccccacctgaaacacacaacggagctctggtggggtacagcgtgaggtataggcctctggggagcgaagatcctgaacccaaagaggtcaacggaatcccgcccacgacaacccagatacttctggaagccctggagaaatggacacagtacaggattaccacggtcgctcacacagaggtcggaccagggccggaatcgtctcccgtcgttgtcagaacagatgaagacgtgccaagcgccccaccacggaaggtcgaggcagaggctttgaacgccacagccatcagggtgttgtggcgaagcccagcgcctgggcgacagcacggacagatcaggggttaccaggtgcactacgtgaggatggagggagccgaagcccggggaccacccaggatcaaagacgtcatgttggcagacgcgcaatgggagactgatgatacggctgaatatgaaatggtgattacgaacctccagcctgagacagcatactctattactgttgccgcctatacaatgaagggcgacggcgccaggagcaagcccaaggtggtggtaacaaagggagccgtcctcggcaggccaactctgtctgtacagcagaccccagagggttccctcctcgcccgctgggagccgccagccggtactgcagaagatcaagtgctgggataccggctccagtttgggcgggaagattccactcctctggccacccttgaatttcctccaagcgaagaccggtacaccgcctcaggggttcataaaggcgcaacctacgtgtttcgtctggccgctcgttctcgcggtggcttaggggaggaagccgccgaggtactatcaatacctgaggacacgccaaggggccatcctcaaatattagaggctgccggcaacgcatccgccggcactgtgctgttgagatggctgccccctgtccccgctgaaagaaacggggccatagtaaaatacacagttgcagtgcgggaggcaggcgctttaggacccgcacgtgagactgagctccccgcggcagctgaaccaggtgctgagaacgccctgactcttcagggtctgaagccagacactgcctacgacttgcaggtgagggcccatacacgtaggggccccggcccatttagccctcctgtgaggtatcggaccttcttaagagaccaggttagccctaaaaactttaaagtgaagatgatcatgaaaacttccgttctgctaagttgggagttcccggacaattacaactcccctactccttataagatccagtacaacgggttaacgcttgatgttgacggccgcaccaccaaaaaacttattacacaccttaaacctcataccttttataactttgtgctcacaaataggggctcttcgctcggaggcctgcagcagacagtgaccgcctggaccgcgttcaacctgctcaacggcaagccctcggttgctcccaaaccggacgccgatgggtttatcatggtgtacttgcctgacggtcaatcacctgtgccagtgcaaagctactttattgtgatggtgcccctgcgcaaatcaagaggcgggcagtttctgactcccttagggtcaccagaggatatggatcttgaagaattgatccaggacatctccagactgcaaaggcggagtcttaggcacagtagacagcttgaggttccacggccttacattgctgcaagattctccgtccttccaccgactttccaccccggtgaccagaaacagtacggcggattcgataacagggggttggagccaggtcacaggtatgtgcttttcgtcctggctgtacttcagaagtccgagcccacgttcgcagcttctccttttagcgatccatttcagctggacaatcctgaccctcagcccatcgtggacggggaagaggggcttatctgggtcatcggacctgttctggccgttgttttcatcatctgcattgtgatcgcaatcctattatacaaaaaaaaaccacactccaagcgcaaggactccgagccccgcaccaaatgtctgttaaacaatgcggatctggccccacaccatcctaaagacccggtggaaatgagacgtattaatttccagaccccggatagtgggttgaggtctccacttagagaacctggatttcactttgaaagtatgctctcacatcctcccatccctattgccgacatggccgagcatacagagcgattgaaggctaatgacagcctgaaactgagccaggagtatgaatccattgacccaggccagcaatttacctgggaacatagcaatctggaagttaacaagcccaagaaccgctacgccaatgttattgcctacgaccactcacgcgttattcttcagcccatcgaagggattatggggtctgactatataaatgcaaactacgtggacgggtatagatgtcaaaatgcatatatcgccacacagggccccctgcctgaaacctttggagatttttggcgcatggtctgggagcagcggagtgccaccatagtgatgatgactcgcctggaggaaaagtctcggatcaaatgtgatcagtactggccaaatcgcggcactgaaacttacgggttcatccaggttacactgctggacacaatagagctggctaccttctgcgttcggacattttccctgcataagaatggcagcagtgagaagcgtgaggttcgccagttccagttcaccgcctggcctgatcatggcgttcccgagtacccaacaccattcctggctttcctcaggcgggttaagacctgcaatcctccagacgctgggcctatcgttgtgcattgtagcgccggagtgggacgaacagggtgctttatagttattgacgctatgctagagcgtattaagccagagaagactgtcgacgtgtacggccatgtaacattgatgcgctcacaacgcaactacatggtgcagaccgaagatcagtatagttttatacacgaggctctcctcgaggccgtcggctgtgggaacaccgaggtgccagctaggagcctgtacgcctacatacagaaacttgcccaggtggagcctggagagcatgttacggggatggaactggagtttaaaagactggccaattccaaagcacacacttctcgcttcatctccgctaaccttccatgtaacaaatttaaaaataggctggtaaatattatgccctatgagtcaactagagtgtgcttgcagcccattcgcggcgtcgagggctctgactacatcaatgcctcctttatagacggttacaggcaacagaaggcttatatcgccacacagggcccattagctgaaactactgaggacttttggagaatgctctgggaaaacaatagcaccatcgtagtcatgctcacaaagctgagggagatggggcgcgagaagtgtcaccagtactggcctgcagaaaggagcgcccgttatcagtatttcgttgtggatcctatggcagaatataacatgccccagtacattttacgcgagttcaaagtaaccgacgctcgagacgggcagtcgcgcacagtgcgccagttccaatttactgattggccggagcagggagtgccaaaatcaggtgagggcttcattgacttcattggccaggtgcacaaaaccaaggagcagttcggacaggatggccctatctccgtacactgttctgccggcgtgggtcggacaggtgtattcatcacactaagtatcgtgcttgaaaggatgagatatgagggtgtggttgacatttttcagaccgtgaagatgctgagaacccagaggccagcaatggtacagacggaggacgaataccaattttgttaccaggccgctttggaatacctgggatctttcgatcattacgcaacctag

SEQ ID NO: 130989 - DNA, 4683 bp, Artificial Sequence
  Description of Artificial Sequence: Synthetic coding sequence
cgtagcgccagaggcctgagcgtcagggaccgcggagcaattccactgcagggcggcgatcgtagatccctcccatccatggctcctacctggggtccaggaatggttagcgttgtcggtccaatgggactgttggtggtgctgctagttggcggttgcgctgccgaagagccccctcgcttcataaaggagcccaaggatcagattggagtatcaggaggcgtggcaagttttgtgtgccaggcgacaggcgatcctaagccacgcgttacatggaataaaaaaggaaagaaggtgaattcacagagatttgaaacaattgagtttgatgaaagcgccggcgcagtgcttcggatccagcccctcaggactccccgtgacgaaaacgtctacgagtgtgtagcccagaactctgtgggagagatcaccgtccacgcaaagttgactgtgttacgcgaggatcaactcccgtctggatttcccaacattgacatgggaccccaactgaaagtcgtcgaaaggacacgaacagctaccatgctgtgtgcagcttccggtaacccggaccccgagatcacatggttcaaagactttctgccggttgatccaagtgcctctaatggaaggatcaaacaattgcggtctggcgccctgcaaatcgagtcgtcagaagaaaccgatcagggtaagtatgaatgcgtggcgaccaactctgccggagtgcgatattcctctcccgcaaacctgtacgtgcgggtgcggagggttgccccaagattttctattttgcccatgagtcatgagattatgccagggggcaacgttaatatcacatgcgtcgctgtaggcagtcccatgccttatgtgaagtggatgcagggagccgaagatctgaccccagaagatgatatgcctgtgggaagaaatgtgttagagctgactgatgtcaaggattccgccaattacacctgtgtggctatgagcagtctgggggtaatcgaggctgtcgcacagattaccgttaagagcctgcctaaggcaccaggcacacctatggttaccgaaaacaccgccaccagcattactattacatgggattctgggaaccccgatcctgtgtcgtactacgttattgaatataaatcaaaatcacaagatgggccctatcaaatcaaggaagatatcactaccactagatacagcatcggcgggctcagcccaaactctgaatacgagatctgggtctccgccgtcaacagcattggccaaggcccacccagcgaatccgtagttacaaggaccggggaacaggcccccgcttccgcaccccgcaatgttcaggcccgaatgctgtctgccactacaatgatcgttcagtgggaggagccggtcgaaccaaatggtctgattcgggggtatcgagtctattacacaatggaaccagaacaccctgtggggaactggcagaagcacaacgtcgacgacagccttctcacgaccgtcggatctctgcttgaagacgaaacatacaccgtgcgggttctggctttcactagcgtcggcgacggcccactttcagaccctatccaagtaaaaacacaacaaggggtgcctgggcagcctatgaacctgagagccgaagccaggtctgaaaccagtatcacattgtcttggagccctcctcggcaggaatctatcattaagtacgaactgcttttcagagagggtgatcacggtcgcgaggtgggccgcactttcgacccgaccacttcttatgtggttgaagacctgaagccaaacacagagtatgccttccgtctggccgctcgcagccctcagggactgggggccttcaccccggtggtgaggcagagaaccctgcagagcatctcccctaagaactttaaagtcaagatgataatgaaaacttcagtcctactttcctgggagttcccagacaactacaattctccgaccccctacaagattcagtacaacggtctgaccctcgatgtcgacgggcggacaactaagaaacttattacgcatctgaagccacatactttttataacttcgtgctgactaacaggggcagctccctaggcgggctgcagcaaaccgtcaccgcctggacagcattcaatttactcaatggtaaacctagcgttgctccgaagcctgacgcagatggattcattatggtttatcttccagacggccaatcgcctgtgccagtccagtcctactttatcgtgatggtgcctctacgcaaaagcagaggcggccagttcctcacccccttggggtcccctgaggacatggacttagaggaattgatccaagatatctctcgactgcagcgccgaagcctaaggcattctcgacaactggaggtgccccggccatacatcgcggcgaggttttcagtgttaccccccaccttccaccccggagaccagaaacagtacggagggttcgacaaccggggtctcgagcctggtcacaggtacgtgttattcgtgctggctgtgctgcagaagagcgagccaactttcgccgcctccccttttagcgatccattccagctggacaacccggaccctcagcccattgtggatggtgaggaaggacttatttgggtgatcgggccagtgctggctgtagtcttcatcatctgtatcgtgattgctattcttctgtacaagaataaaccagattccaaacgcaaggattcagagccaaggacaaaatgcctgttgaataacgctgatctggctccccaccatccgaaagatcccgtggaaatgcgaaggattaattttcagacgcccgactctggattgagatcaccccttcgtgagcctgggttccattttgagagcatgctgtcccatcctcctatcccaattgctgatatggcggaacacactgaaaggctgaaggcgaacgactctcttaagctgtcacaggagtacgaatccatcgatcccggacagcagtttacatgggagcatagcaatttagaggtgaacaagccaaagaaccggtacgccaacgttattgcctatgaccacagccgcgtgatcttgcaaccaatcgagggtatcatggggagtgactacattaatgccaactatgtggacggatatagatgccagaatgcctatattgctactcagggtccgctgcccgaaacctttggtgatttctggcgtatggtctgggaacagaggtcggccaccattgttatgatgaccaggcttgaggaaaaaagcaggatcaagtgcgaccagtactggcccaatcggggcactgagacatacggatttatccaggttacactgcttgacactatcgagctagccacgttctgcgttcggacttttagcctccataagaatggttcttccgaaaagagggaagtgcgtcagttccaattcacggcttggccggaccatggtgttccagagtatccaaccccctttctggcttttctgcgacgtgtcaaaacctgcaaccccccggatgccggccctattgtggtgcactgcagtgctggagtgggccggaccggatgcttcatcgtgatagatgctatgctagaaagaattaaacccgagaagacggtcgatgtgtatgggcatgtcaccctcatgcgaagtcagcgaaactacatggtccagaccgaagaccagtacagcttcatccacgaagccctcctagaggccgtgggctgcggaaacacagaagtccccgcgaggtctttgtacgcgtatatccagaaattagcacaggtcgagccgggggaacacgttacaggtatggagctggagttcaagcgcctggctaactcgaaggctcatacatcacgattcatcagtgctaacctgccctgtaacaaattcaagaaccggctagttaacattatgccgtacgagagcacccgagtgtgcctccagcccatacggggcgtggaaggcagtgactatattaatgcgagcttcatcgatggctacagacaacaaaaagcatacatcgccacccagggaccacttgcagagacaacagaagatttctggcgtatgctgtgggaaaacaattccactattgtggtgatgctcactaaactccgggagatgggccgcgaaaagtgtcatcaatattggccagccgagaggagtgccaggtatcagtacttcgtggtggatcctatggccgagtataacatgcctcagtacattctaagggaatttaaagtcacagacgcgcgagatggccagtccagaaccgttcggcagttccagttcaccgactggccagagcagggggtacctaagtccggggagggctttattgatttcataggccaggtgcacaaaaccaaggaacagtttggccaggacggaccgatcagcgtgcactgttcagctggggtagggcgcacaggagtattcataacactgtctatcgtgcttgagcgtatgcgatacgaaggtgtggtcgacatctttcagactgtcaagatgctgagaacccagagacctgccatggttcagacagagactgaaagccgaccaggctggtcagctgtcgcccagagtcgcctgacggccagctctgcttcatggattcatgccatcctgctgcctcaaccgcccgaatggttaggcctccaggtctag

SEQ ID NO: 130990 - DNA, 4518 bp, Artificial Sequence
  Description of Artificial Sequence: Synthetic coding sequence
atggctcccacatggggccccggcatggtgagcgtggtcggaccgatgggactgttagtcgtgctgctcgttggtggttgcgctgcggaggagcccccgcgtttcatcaaggaacctaaggatcagattggggtgagcgggggtgtggcatcttttgtgtgtcaagctacaggcgatccaaagcctcgggtcacatggaacaaaaagggcaaaaaagtgaactcacagaggtttgagaccatagagtttgacgagagcgccggtgcagtgctgcgcatccagcctctgcgcacacctagggacgagaatgtctacgagtgcgtggcgcaaaatagcgttggcgagatcacagtgcacgccaagctgacagtactgcgtgaggatcagctcccatctggctttcccaacatcgacatgggtcctcagctaaaagtggtggaacggaccagaactgcgaccatgctatgcgccgcttctggcaatcccgatcctgagattacctggttcaaggactttttgcctgttgatcccagtgcctctaacggcagaattaaacagttgagatccggcgcactgcagatcgaatcatctgaggagaccgaccaggggaagtacgagtgcgtggcaaccaatagtgccggagtacgctatagctctccagcaaatctctacgttagagctctgcgcgaggtgcggcgcgtcgcgccccgattttcgatactgcctatgtcccatgagataatgccagggggcaacgtgaatataacctgcgtcgctgtgggatcacccatgccctacgtcaagtggatgcagggagctgaggatctgacacctgaagacgatatgcccgttggtcggaatgtgctggagctgactgacgtcaaagactcggctaactacacgtgtgtagccatgtcctcattaggagtgattgaagcggtagcgcagattacggtaaagtcactgcctaaagcaccaggaacaccgatggtcacagagaatacagcaacgtctatcaccattacatgggattccgggaatccggatcctgtctcttactatgtgatcgaatataagagtaagagccaggatggcccgtaccagattaaagaggatattacgaccacacggtattccattggcggactcagtcctaattccgaatacgagatctgggttagcgcagtcaacagtatcggccagggaccaccaagcgagtcagttgtgacacggacaggagagcaggctcccgcctctgctcccagaaacgttcaggcccggatgctgtcagcaactacaatgatcgtgcagtgggaggagcctgttgagcctaatggccttattcgcggctaccgcgtgtactataccatggagcctgagcatccagttggtaattggcaaaaacacaacgtagatgattctctgctaaccactgtcgggagcctgctcgaagacgagacctacaccgttcgtgtcctggcattcacaagtgttggagacggtcccttgtccgatcctatccaggtgaagacccaacagggcgttccgggccaacccatgaatctgagagccgaggctcggtccgaaacatcgattaccttgtcttggtcacctccacgccaggaatcgatcattaagtacgaactgctgttcagggagggtgatcatggacgcgaggttgggaggactttcgatccgaccacttcctacgttgtggaagacctgaaacctaataccgaatatgccttcaggctggcggccaggtctccgcagggcttaggcgcattcacacccgtggtgcggcaaaggacactgcagtccattagtcctaagaatttcaaagttaaaatgataatgaagacctcagtcttactgagttgggagttcccagacaactacaacagcccgaccccttataagattcagtataacggactcacactagacgttgacggcagaacaacaaagaagttgataactcacctcaaacctcacacgttttataattttgtgcttacgaatagaggcagttctctgggcggacttcagcagacagtgactgcgtggaccgccttcaatctccttaatgggaagcccagtgtggctcctaagccggacgcggacggcttcatcatggtttatctgcctgatggccagtcgcctgtccctgttcagagctactttattgtaatggtgcccctgcgtaagagtcggggggggcaatttctgacaccactcggaagccccgaagacatggacctggaagagctcattcaagatatatccaggttacagaggcgctccctgagacacagccggcaattagaggtaccccggccttatattgcggccagattcagcgtgctgccccccacctttcacccaggagatcagaaacagtacggcggcttcgataatcgcggcctggagcccggtcataggtacgtgctgttcgtgctggccgtgcttcagaagtcggaaccgacattcgcagcgagtcccttttcagatcccttccaacttgataaccctgaccctcagcccatcgtcgacggagaagaggggctaatctgggttatcggcccagtcttagccgtggttttcataatttgcattgtgattgccatcctgttatataagaacaagcctgatagcaagagaaaggactcagagcctagaacaaagtgtttgctcaacaatgctgatttggcaccacaccatccgaaggatccagtggagatgcgccggattaactttcagacgcctggtatgctgagccacccgcccatccccatcgccgacatggccgagcataccgaaagacttaaagctaatgattctctcaagctctcacaagaatacgagtccatagatccaggacagcagtttacatgggaacacagtaacctggaggtaaataaacccaagaacagatatgctaatgtaatcgcttatgaccactccagggtcatcctgcagccaatcgaaggaataatggggagtgactatatcaatgctaactatgtcgacggctaccgctgccagaacgcttacatcgctacccagggcccattgcccgaaaccttcggcgacttctggagaatggtatgggaacagagaagcgccacaatcgtgatgatgacacgccttgaggaaaaatcccgcatcaaatgcgaccagtattggcctaatagaggtactgagacctatggctttatccaagttacgttactcgatacaattgagttagccactttttgtgtgcgaaccttcagcctgcacaaaaatggaagcagtgagaagcgtgaggtgcggcaattccaattcactgcctggcctgaccacggggtacccgaataccctaccccgttcctcgcctttctacgacgtgtcaaaacctgtaatccacctgacgcaggaccaattgtggtgcattgttccgccggtgtgggccgcacaggatgcttcattgtaatcgacgctatgctggagcggattaagcccgagaagacagttgatgtgtatggccacgttacgctaatgcgctctcagcggaattatatggtgcaaacagaggaccagtactccttcatccacgaagccttattagaggccgtaggctgcgggaacaccgaggtacccgcgcggtctctgtacgcgtatattcaaaagttggcccaggtcgagcctggagagcatgtcactgggatggagctagagttcaagcgattggctaactcgaaggcacataccagtagatttatatcggcaaatctaccatgtaacaagtttaaaaaccggctggtgaacattatgccctacgagagcactcgcgtgtgcctacaacctataagaggcgtcgagggcagcgattacatcaacgcatcatttattgacgggtaccgacagcaaaaagcttatatcgctacccagggccctctcgcagaaacgaccgaggacttttggagaatgctgtgggagaacaactctacaattgttgttatgctgaccaaactgagggagatgggccgggaaaaatgccaccagtactggcccgcggaacggtcagctcgctaccagtattttgtggtggatccaatggccgagtataacatgccacagtatattctgcgcgagttcaaggtcactgatgctagggatggccagtcgcgaacggtgaggcagttccagtttacagattggcctgagcagggagttcctaaatccggagaagggtttattgattttattggacaggtacataagacaaaagaacagttcggacaagacgggcccatcagcgtccactgttccgctggagttgggcgaacaggtgtcttcatcaccctgagcatcgtactcgaacggatgagatatgagggtgtggtggacatctttcagaccgtgaagatgttgcgcacgcagagacccgctatggtgcagaccgaggatgagtaccaattctgctaccaagccgccctggaatatctggggagcttcgatcactacgctacctag

SEQ ID NO: 130991 - DNA, 4329 bp, Artificial Sequence
  Description of Artificial Sequence: Synthetic coding sequence
atggcaagggcccaggccttagttcttgcccttacatttcagctgtgtgctccagagaccgagacccccgctgctgggtgcacctttgaagaggctagcgatcctgcagtgccctgcgagtactcacaagcccaatacgatgactttcagtgggaacaggtgagaatccatccaggcacccgggcacctgcggatttgccacatggcagctatctgatggttaacacctcacagcatgctcccggccagcgagcacatgtcatttttcagagcctgagtgagaatgatacccattgcgtccagttcagctacttcctctattcccgggacggtcattcgcccggtacactgggcgtctacgttcgcgtgaatggtgggcccctgggaagcgccgtctggaacatgaccggctcacatggtcggcagtggcaccaggccgagctggcagtttctacattctggcccaatgaatatcaggtcttatttgaggctctgatttcaccagatcgacggggatatatgggcctggatgatatcctgctgctaagctatccatgtgctaaggcacctcacttcagcaggctcggcgacgtggaggttaatgccggtcaaaatgcctctttccagtgtatggctgctgggagagccgcggaggcagagaggtttttactccagcggcagagtggggcgctggtccctgccgccggcgtacgccatattagccataggaggttcctcgcaactttcccccttgccgcagtgagtcgggcagaacaagatctataccggtgcgtatcacaagcgccacgtggtgcaggcgtctcaaatttcgctgagctgatagttaaagaaccgccgacacccatcgctcccccccagctcctgcgcgctggtcctacctacctgattattcagttgaatactaattcaattattggggacgggcctatcgtccggaaggagattgagtatcggatggcaagagggccctgggctgaagtgcacgccgtctcactgcagacctacaagttatggcatctggatcctgatactgagtatgagatttcagttttgcttaccaggcctggtgacggtggaaccggcagaccgggcccgcccttgatcagtcggaccaagtgtgccgagcccatgcgcgcccctaaaggactggcattcgctgaaatacaagcacgccagcttaccctgcaatgggagcctctcggctacaacgttactaggtgccatacatacacggtcagcttgtgttatcactacactttaggatcctcacataaccagaccatccgcgagtgcgtgaagactgagcagggcgtgtctcgatacacgattaagaacctgcttccatacagaaacgtccacgtgcgcctcgtcctgacgaaccccgagggtcggaaggaagggaaagaggtcacgttccagacagacgaggacgttccttccggaattgctgctgagagcctcacatttacccctttggaagacatgattttccttaagtgggaggaaccgcaggagccgaatgggctcattactcagtacgagataagctatcagtctatcgagagctctgatccagccgtgaatgtgcccggccccagaaggacaatctcaaaattaagaaatgagacatatcacgtcttctccaatctccaccctggcacaacctacctctttagcgtgcgggccaggactggaaagggctttgggcaggctgcactcactgagatcaccacaaacatcagcgctcctagcttcgattatgcagatatgccatcccctctgggcgaaagcgagaataccatcactgtccttctgagacctgctcaggggcgcggggcaccgatctccgtgtaccaggttatcgtcgaagaagaaagggcccgaagactgcggcgggaacctggcggacaggattgttttccagtcccactgacctttgaggcagccctggcacgggggctagtgcactacttcggggcagaattagctgccagctccctgcctgaagctatgcccttcaccgtgggagataaccaaacgtatagaggattctggaatccaccactggaaccacgcaaagcctatctgatatatttccaggccgcatcccacttgaagggggaaactcgcttgaactgtatccgcattgctcgcaaagccgcatgcaaggagtctaagcgacctttggaggtgagccagcggtctgaggaaatgggactcattttgggcatttgtgccggcggactcgccgtgttaattctgctgctcggcgcaataatagtcatcatcaggaagggcaagcctgtcaacatgaccaaggcgactgttaactaccgccaggaaaagactcacatgatgtctgccgtggatagatcttttactgaccagtccactcttcaggaagacgaacgacttgggcttagctttatggatacacacggctattcgaccaggggagatcaacgctcagggggtgtcaccgaagcttcctcgttgctcggaggctctcctaggaggccctgcggccggaaggggtctccttaccatactggtcaactccaccccgccgtaagggtcgctgatcttttgcagcacatcaatcagatgaaaaccgccgaagggtacgggtttaagcaggaatacgagtctttttttgaaggctgggatgcgaccaagaaaaaagacaaggtgaaagggagccggcaagaacccatgccagcctacgatcgacaccgcgtgaagcttcatccaatgttaggggaccccaacgccgactacatcaatgccaactatattgatctgcgcggtggaagaacgggttatcaccgaagcaaccacttcattgctacccagggcccaaaacccgagatggtatacgacttttggcgcatggtgtggcaggaacactgttcgtcaatcgtaatgattacgaaactggtcgaggtgggccgcgtgaagtgctctaggtattggccagaggactcagatacttacggcgacatcaagatcatgctggtaaagacggagactttggccgagtatgtagtcaggacattcgctctagagcgcaggggatattctgcccgtcacgaggtaaggcagtttcatttcacggcttggcccgaacacggggtgccatatcatgcaactggtttgctcgcatttattaggagagtgaaagcaagtaccccccccgacgcgggccccatagtgattcattgctcagccggcaccggcagaactgggtgttatattgtgctcgacgtaatgctggatatggctgagtgtgagggcgtggtggacatttataactgcgtaaaaacgctgtgcagtagacgcgtgaacatgatccagaccgaagagcaatatatttttattcacgacgcaatccttgaggcttgcctgtgtggcgagacaacaataccagtgagcgaattcaaagctacatataaggaaatgatcaggattgacccacaatccaatagcagtcaactcagggaagaattccagactctgaattctgtgaccccccctttggacgtggaagaatgttctatcgccctgttacccagaaaccgcgacaaaaacagatccatggacgtcttacctccagacaggtgccttccctttctcatcagcacagacggggacagcaataattacatcaacgccgccttaacagacagttatactcgctccgccgcctttatcgtcactctgcacccacttcaaagcacaacccccgatttttggagactcgtatatgactacggctgtactagcattgtgatgctgaatcagctcaatcagagtaatagcgcttggccctgcctgcaatactggccggagcccgggcgccaacagtacggcctgatggaagttgaattcatgagcggtacagccgacgaggatctcgttgcgagggtgtttcgggtgcaaaatatcagtcggctgcaagaggggcacctgctggtccggcattttcaatttctacgctggtcagcttaccgcgacactcccgattccaagaaggcttttcttcacctgcttgctgaagtggacaaatggcaggccgaatcaggcgacggcagaactattgtgcattgtctcaacggggggggtcgcagcggcaccttttgtgcatgcgcgaccgttctggagatgatccgctgccacaatctggtcgacgttttcttcgctgccaagaccttgcggaactataagcccaacatggtcgagaccatggaccagtatcacttttgctatgacgtggccctggagtaccttgaaggcctcgaatcacgctag

SEQ ID NO: 130992 - DNA, 4341 bp, Artificial Sequence
  Description of Artificial Sequence: Synthetic coding sequence
atggcccgggctcaggctctagtcttggcattgacatttcagctgtgcgcaccagagactgagaccccagccgctggctgtaccttcgaggaagcgtcggatccggctgtaccgtgcgagtactctcaggcacagtatgacgactttcagtgggaacaggtgcgcattcatcctggtacaagggcaccagcagatctgccacacggctcctacctgatggtgaacacatcgcagcacgcccccggccagcgagcccacgtcatctttcagtcattgtctgagaatgatacacactgcgtccagttcagctatttcctctactctcgtgacgggcattctccaggcaccctaggcgtgtatgtgcgagtcaacggtggtcccttggggtccgccgtctggaatatgacaggctcccacggcaggcaatggcaccaagccgaattggctgtgtctactttctggcctaatgagtaccaggtactgttcgaagcacttatatcacctgatcggcgcggttatatggggctggatgatattcttctgttgtcttatccctgtgccaaagccccccacttcagccgcctgggggatgtggaagtgaacgcaggacagaacgcctcctttcaatgtatggccgccgggcgcgccgccgaggccgagcggttcctcctccaacgccagagtggagccctcgtacccgctgcaggagtccgccacataagccacaggagattcctggcgacgttcccactggccgcggtgtcccgcgctgagcaggatctgtaccgctgtgttagccaagccccacggggtgccggcgtgagcaacttcgctgagctgattgtgaaagagcccccgacccccattgctccgcctcagttactacgagcaggtccaacttatttgattattcaactgaacaccaatagcattatcggagatggcccaattgtgagaaaggaaatcgagtataggatggctagagggccatgggcagaggtccacgcagtaagtctccagacctacaaattatggcatttggatcctgacacagagtatgagattagcgttcttctgacacggccaggagacggaggaacaggtcggcccggaccaccactgattagtagaaccaaatgtgccgagccaatgagagcacctaaaggactggcctttgcggagatccaggcgaggcagctgacactccagtgggaaccacttggctacaatgtgaccaggtgccatacttacaccgtgagtttgtgctaccattatactttgggaagttcccacaatcagaccatcagagagtgtgtcaaaacagagcagggagtcagcaggtacacaattaagaaccttctcccctaccgtaatgttcatgtgaggctagttttgacaaaccccgagggcaggaaggagggaaaggaggtcaccttccagaccgatgaggatgtgcctagcggcatcgccgctgagtctttaacgtttacacctcttgaagacatgatttttctgaaatgggaagagcctcaggagccgaatggactcatcacacagtacgagatctcttaccagtcaattgagagcagtgaccctgccgtgaatgtgccaggacctaggcggactatctccaagctgaggaatgagacataccatgtattcagcaatctccatccaggtacaacctacttattctccgtgcgagctagaactgggaagggcttcggccaggcagcgctcacagaaattacaactaatatttctgctccttctttcgattacgccgatatgccttccccacttggcgagagtgaaaacactattaccgtgctcctgcgtcctgctcaaggacggggtgcaccaataagtgtctaccaggttattgtggaagaggaacgcgctcggcgccttcggcgagagcccggcggccaggactgttttcccgtccccctgactttcgaggcggctcttgctcgcggactcgtacactacttcggagccgagctggctgcttcctctctcccagaagccatgccctttactgtgggtgacaaccagacctataggggcttttggaatccacctcttgaaccaagaaaggcctacttgatttattttcaggctgcgagtcatcttaaaggcgaaacccgccttaactgcatccggatcgcccgaaaagctgcatgtaaggagagcaaaaggccactagaagtgtcacaacggagtgaggagatggggctcatcttgggtatatgcgcagggggcctcgcagtgttgatcctcctgctcggagcgatcatcgtgataatacgcaaggggcgggatcattatgcctacagctactacccaaaacctgtcaacatgacaaaagccactgttaattataggcaagaaaagacccacatgatgtccgccgttgatcggagttttaccgaccaaagtacactccaggaagacgagcgcttgggcctctctttcatggatacacacggttattccacgagaggggatcagcgaagcggcggcgtgacagaggcttcctccctcctcggcggtagcccacgacgcccctgcggcagaaaggggagcccatatcacacgggccaactgcatcctgccgtgcgcgtggctgacttgcttcagcacatcaaccagatgaaaacggctgagggatatggtttcaaacaagagtacgagagcttttttgaaggttgggatgccactaaaaagaaagataaagtgaagggctctcggcaagagcccatgccagcttatgaccggcaccgggtgaagttgcacccaatgctgggggaccctaacgccgactatattaatgccaattatatcgatgggtatcaccgttctaaccacttcattgcaactcagggacccaagccagaaatggtctacgatttctggcgtatggtttggcaggaacattgctcctccatagtcatgattactaagttggtggaggttggtcgcgtgaagtgctcacgctattggcccgaggacagtgacacctacggcgatatcaagattatgctcgtaaagacagaaacactggcagagtacgtggtgaggacctttgcgctggagcgccgcggctactcagcacggcacgaggtgcgccagttccactttaccgcctggcccgagcatggagtgccttatcatgcaacaggtctgcttgcatttatccgtcgtgtgaaggcttctactccccctgatgcggggccaatagtcattcactgctctgccgggaccggccgcacagggtgctacattgtactggacgttatgttggatatggcggagtgcgagggggtcgtagacatttataactgtgtgaaaacactgtgctcgcgccgggttaatatgatccagacagaagaacagtacatctttattcacgatgccattctcgaggcttgcttgtgcggagaaactaccattcctgttagtgagttcaaggccacatataaggaaatgatcaggatcgatccccaaagcaatagcagccagctcagggaggagttccagacactgaacagcgtgaccccacctctggatgtggaggagtgtagtatagcactccttcctcgcaatcgcgacaagaatcgcagtatggacgtgttaccccctgatagatgtctcccttttctcatctccaccgacggcgatagcaataattacatcaacgctgcgttgacagattcatacactcgatctgccgccttcatcgtgactctacatcccttgcagagtaccacacctgatttctggagactggtgtatgattatgggtgcaccagcatcgtgatgctgaatcagcttaatcagtccaattccgcttggccttgcctacaatattggcccgagccgggcaggcagcagtacgggctgatggaagtggaattcatgtcggggaccgcagacgaggacctcgtggccagagtatttcgggttcagaacatttcccggttgcaggaaggccatctgctcgttcgacattttcagttcttgagatggtccgcctacagagataccccagactccaagaaagcttttctccacctactggctgaggtggacaagtggcaggccgaaagcggcgacggtcgaacgattgtgcattgcctgaatggaggcggccggtccgggaccttctgcgcttgtgcaacagtgctggagatgatccggtgccacaacctggtggatgtgttctttgcagctaagaccctgaggaactacaaaccaaatatggtggagactatggaccagtaccacttttgttacgacgtggctttggagtatctagaggggttggagtccagatag

SEQ ID NO: 130993 - DNA, 4329 bp, Artificial Sequence
  Description of Artificial Sequence: Synthetic coding sequence
atggccagggctcaggctctggtgctggccctgaccttccaactatgtgcccctgagactgagacccccgccgctggctgcacattcgaggaagcctccgatccagccgtgccttgtgagtactcacaggcgcagtatgacgactttcaatgggaacaggttcgtattcatcctgggacgcgcgccccagctgatcttccacacggctcttacctgatggtcaatactagccaacacgctccgggacagagagcacacgttatctttcagagcctgtcagagaacgatacccattgcgttcagttctcatactttctttatagcagagacggccacagcccagggaccctgggtgtatacgtgcgagtgaatggggggccccttggtagcgctgtttggaatatgactggctcacacggcagacagtggcaccaagccgagctagctgtatcaaccttttggcccaacgaataccaggtcctgttcgaggccctgatctctcccgaccgtagaggctacatgggtctggacgacattcttctgctgtcttatccctgcgctaaggcacctcacttctccaggttgggagatgtggaggttaacgcaggtcaaaacgcatcttttcagtgcatggcagccggtcgggcagccgaggcagaacgattcctgctacagaggcagtcaggcgctctcgtgcctgccgccggagtaagacacatcagtcacaggaggttcctcgctacttttccacttgctgcagtttcaagggccgagcaggacctgtataggtgtgtatcccaggccccgagaggagctggtgtgtctaacttcgccgagttgattgtcaaggagccacctacccccatcgcaccaccacagctcctcagagcaggacccacatacttgatcattcagctgaataccaatagcatcattggggatggcccaattgtgcggaaggagatcgagtaccgtatggcgcgcggcccgtgggctgaagtccacgctgtatctctgcaaacttacaagctgtggcacctcgacccagacaccgagtacgagatctccgttcttttgactcgccctggggatggagggaccggacggcccggaccgccactgattagcagaacaaaatgcgctgagccaatgcgagcacccaaaggactggcctttgcagagattcaggcacgccagctcaccttacagtgggaaccgcttggatacaacgtgaccaggtgtcatacgtatacagttagcctttgctaccattataccctggggagttcccacaatcagactatccgtgagtgcgtcaagacagaacaaggggtttcgcgctacacgattaagaaccttcttccatacagaaatgtccatgtaagattagtgctaaccaatcctgagggccggaaagaaggtaaggaggtcacttttcagacagatgaagatgttccaagcggcattgccgccgaaagcctgacgttcacaccattggaggatatgattttcctcaagtgggaggagccccaggaaccaaacggactcatcactcagtacgaaatttcataccagagcatcgagagttctgaccctgccgtaaacgtccccggccctcggagaaccatatccaagctgaggaatgaaacgtatcatgtgttttccaatctccatcctggcacaacttatctcttttccgttagagcgcgcacaggcaagggttttggacaggctgctttgaccgagatcacaacaaatatttcggcccccagctttgactacgccgatatgccttcaccattgggtgagtccgaaaacacaatcaccgtcctcctgcgacccgcacagggacggggggcacctatttccgtgtatcaagtaatcgttgaggaggagagagctagacgactccgaagagaaccgggcgggcaggattgttttcctgttcccctgacctttgaggccgcactggcacgcggtttagtccactacttcggggctgaattggcggccagctccctccctgaagctatgccatttaccgtaggagacaaccagacgtataggggcttctggaacccccccttggagcctcgtaaagcatatctgatttattttcaggccgcttcacacttgaaaggggaaacacgtctgaattgtatccgaatcgctagaaaggcggcttgcaaggagtctaaacgacccctggaggtgtcccagcggtctgaggaaatggggttaattctggggatctgcgctggcggccttgctgtgctcatcctactgttaggcgctattatcgtgatcataaggaaaggtaagccagtgaacatgacgaaagctacggtgaattacagacaagagaagactcatatgatgagcgccgtggatcgctcatttacagaccagtccacacttcaggaggacgaacgtctaggactctcgtttatggacacccacgggtatagtactcgaggcgaccagagaagcggcggcgtgaccgaagcctccagcttactgggcgggtctcctcgtcggccatgcgggaggaaagggtctccctatcacacagggcagcttcacccggccgtgagggtggcagatcttttacagcacattaaccagatgaaaacagctgagggctacggcttcaaacaggaatacgagtccttctttgaagggtgggatgccaccaagaagaaagacaaagtgaaaggttcgagacaggaacccatgcctgcctatgatcgacacagagtgaagttacaccccatgctcggcgatcccaatgctgattacatcaacgcgaattacattgatatcagaattaacagggaggggtaccacagatctaatcattttatcgcgactcaaggccccaagcccgagatggtatacgacttttggcggatggtgtggcaagagcactgttcaagcattgtcatgataacaaaactcgtggaggtggggagagttaaatgttcacgctattggcccgaggatagtgacacctatggagatataaaaattatgctggtcaagacagagacactggctgaatacgtagtcaggacatttgcactggagaggcgggggtactctgccagacacgaagtgcgacaatttcatttcacagcttggccagaacatggagtcccatatcatgcgaccggactactggcctttatacggagagtgaaggcgagcacaccgccggatgccggcccaatcgtgattcactgctcagctggtacaggcaggactggatgctatattgtcttggacgttatgcttgacatggccgagtgtgaaggagttgtggacatctacaattgcgtaaaaactctgtgctcgcgtcgagtcaacatgatccagaccgaagagcagtacatcttcattcacgatgcaatcctggaagcttgcttgtgcggcgaaacaaccattcctgtgtccgagttcaaggcgacatacaaagagatgattagaattgatccccaatctaattcatcgcagctgagagaggaatttcagaccctgaactcagtgacccctcctttggatgtcgaggagtgtagcatagccctgctaccccggaacagggataaaaaccgcagtatggacgtattaccaccagatcgctgcctgcccttccttatctccactgacggcgattccaataactatattaatgcagcactcaccgattcttatactcgaagcgctgccttcattgtaacattgcatccactccagtccaccacaccagacttttggcggctggtgtatgattacggctgcacatccatagttatgcttaaccagcttaaccagagcaattccgcatggccctgccttcagtattggcccgagcccggcaggcagcagtacgggctaatggaggttgagttcatgtccggcactgcagatgaggatctagtagctcgagtgttccgcgtacaaaatatctccagactgcaggaaggtcacctcctggtgcggcatttccagttcctacgctggtcagcttatcgcgacacgcctgatagtaaaaaagcctttcttcatctcttggccgaggtagacaagtggcaagcagagtccggtgatggtagaaccatcgtacattgcctgaacggagggggaagatcgggcactttctgtgcatgtgctactgtgcttgagatgatccgctgccacaacctggtagatgttttttttgcagctaagactctcaggaattataaacccaatatggtggagactatggatcagtatcatttttgttacgacgtggcactagaatacctggaaggattggagtcacgatag

SEQ ID NO: 130994 - DNA, 4311 bp, Artificial Sequence
  Description of Artificial Sequence: Synthetic coding sequence
atggctcgggcacaggcactcgtcttagcacttaccttccaactgtgcgccccagagacggagacacccgcagcgggctgtacttttgaagaggcttctgatcctgcagttccctgcgagtacagtcaggcccaatatgatgacttccagtgggagcaggtccgaattcaccccggtactagagctcctgctgatctgccgcacggttcttacctgatggttaatacttctcagcatgcgcctggccagagagcacacgtgatattccagagtctgagtgaaaatgatacacactgcgtacaattttcttatttcctctatagccgagacggacactctcctggcactttaggagtttacgttcgagtcaatggaggtcctttaggttctgcggtgtggaatatgactggctctcacggacgccaatggcatcaagcagagcttgccgtgtccaccttctggcctaacgagtaccaggtcctgtttgaagccctgattagccccgaccgcagaggatacatgggactcgacgacatacttctgctctcgtatccctgcgcaaaggctcctcattttagtcgcctaggagatgtggaagtgaatgccggccaaaatgcatccttccagtgtatggccgccgggcgagctgcggaggccgagagattcttattgcagcggcagagcggtgcacttgtgcctgctgcaggggtgagacatatctcacacaggaggttcctggcgacttttcccctagcagccgtaagtagagccgagcaagatctgtatagatgtgtaagccaagctccacgcggggccggggtgagtaacttcgcggagttgatagttaaggagccgccgacaccgattgcccccccacagctgctgagggctggcccaacctacttgatcatccagctaaacaccaacagcataatcggcgacggcccaatcgtgagaaaagagatcgagtaccggatggcccgcggaccttgggcggaagtgcatgctgtctccctccaaacatacaaactttggcatctcgaccctgacaccgagtatgagatctccgtcctgctgactagacctggagatggcggaactgggaggcctggcccacccttgatcagcagaactaaatgtgctgagccaatgagggccccaaagggattggcttttgccgagatccaggcaagacaattgactcttcagtgggagcctctggggtacaacgtcacacgttgccatacttacactgtctcactgtgctaccattataccctgggctccagccataatcaaacgatccgcgaatgcgtcaagactgagcaaggtgtgagccgatacaccatcaagaacctcctgccctaccggaacgtgcatgtacgactggttctcaccaacccagaagggcgcaaggagggcaaggaggtgacctttcagaccgacgaagacgtgccatctgggatagcagcggagtctcttacatttacacccttggaggacatgatcttcctcaagtgggaggaaccccaagagcccaatggcctaatcacccagtatgagattagttatcagagcattgaaagttccgacccagctgtaaatgtgcctggacctcggcgaacaatctccaaactgcgtaatgagacctaccacgtcttctcaaatcttcaccctggaacgacatatctctttagtgtccgcgctagaacaggaaaagggtttggtcaggccgcactcaccgaaattactacaaacatctcagccccatcgttcgattatgccgacatgccctcccccctgggggaatctgagaacactataaccgtgctcctccgccccgcacagggccggggcgccccaatctcagtgtatcaggtaatcgtggaggaagaaagagccagaaggttacgcagggaaccaggaggacaggattgtttccccgtgcctctcacttttgaagccgcactggctcgggggctggtacactacttcggcgctgagctggccgcttcaagccttccagaggctatgccatttacagtcggagataatcagacgtaccgcggattttggaatcctcctctggaacccaggaaagcctatctgatttactttcaagctgctagccatctgaagggcgagacacggctgaattgtataagaatcgcccgcaaagccgcctgcaaggagtccaagagaccactcgaggtgagtcagcgatctgaagaaatgggcctcattctaggtatatgcgcgggcgggctcgcagtgttgatccttctgctgggtgctattattgttataatcaggaaggggaaacccgtgaatatgacaaaagccaccgtgaactatcgtcaagaaaaaactcatatgatgagcgccgtcgaccggtctttcacagaccaaagcactctgcaagaagacgagagactgggattaagttttatggacactcatggctattcaacccgtggggaccagcggagcgggggtgtaacagaagcttcatctctgcttggggggagcccccgcagaccgtgtgggaggaaaggcagcccgtaccacaccggccagctacatccagctgttagagtagcagacctgctccagcatatcaatcaaatgaaaactgctgaaggttatggcttcaaacaggaatacgaaagctttttcgaaggttgggatgctacgaagaagaaggacaaagtaaaaggtagtaggcaggagcctatgcccgcatatgatagacacagggtgaagttgcacccaatgctgggagaccctaatgccgattatatcaacgccaactacattgacggatatcatcgatctaatcacttcatagctacacagggacccaagcccgaaatggtgtacgatttttggaggatggtctggcaggaacactgctcaagcatcgttatgattacaaagctcgtcgaagtgggaagagttaagtgttctaggtactggcctgaggattcagatacatacggagatatcaagatcatgctggtgaagactgaaaccttagccgaatacgtcgtgagaacttttgccctcgagaggagagggtactccgcgcggcacgaagtgcgccagttccacttcacggcttggcccgagcatggggtgccctatcacgccactggcctcctggcattcatccgccgggtgaaggccagcacgccgcctgacgccggcccaatcgtgatccactgttctgccgggacaggcaggactgggtgttatattgtgctggatgtgatgctggacatggctgagtgcgagggggtggtcgatatctataattgtgtaaaaactctctgcagcagacgcgtcaacatgatccagaccgaagagcagtacattttcatacacgacgctatcttggaggcttgcctgtgcggggagactaccatcccagtttcagagtttaaggctacatataaagagatgattaggattgatcctcagtcaaatagctcccagctacgagaggagtttcagaccttgaacagcgttacaccacctcttgatgttgaggagtgctctattgcccttcttccaaggaatcgggacaagaacagatccatggacgttttgcctccggacaggtgtctcccttttctgatttcaaccgatggagactcgaacaactacattaatgccgcacttacggattcctacaccaggtccgctgccttcatcgttacactgcaccccctccagagcactacacccgatttttggagattagtgtatgattacggatgtacatccatcgttatgctgaaccaactaaaccagagtaacagcgcctggccttgtctccaatactggcctgagcctggaaggcagcagtatggtttgatggaagtcgaattcatgagcgggactgccgacgaggacctggtagcccgcgtatttcgggtacagaacatctcacgtctccaggagggacatctgctcgtgcggcattttcagtttctaagatggtccgcgtatcgcgacactcccgactcaaagaaggccttcctacatctcctggcagaggtggacaaatggcaggctgagtctggcgatgggagaactattgttcactgcctgaatgggggtgggcgcagcggtactttctgtgcctgcgccacagtcctcgaaatgatcaggtgccataatctggtcgatgtcttttttgccgctaagaccctccgtaactacaagcccaacatggtggagaccatggatcaataccacttctgttacgatgttgctctcgaatatctcgaaggtctggagtcacgctag

SEQ ID NO: 130995 - DNA, 4302 bp, Artificial Sequence
  Description of Artificial Sequence: Synthetic coding sequence
atggctcgtgcacaggcactcgtcctggccttaacgttccagctctgtgcaccagaaactgaaacaccagcagcaggctgtacatttgaggaggccagcgatccggccgtgccatgtgaatactcgcaggcccagtacgatgacttccagtgggaacaagtgcggattcatcctggtacacgggcgcccgccgacctcccccacggcagttatctcatggtgaacacaagtcaacacgcacctggtcagcgcgcccatgttattttccagtccctcagtgagaacgacacacactgcgtccagttcagttatttcctgtacagtcgagatgggcacagtcccggaaccctgggagtttacgtcagagtgaacggcggacctctgggttcagcagtgtggaacatgactggctcccatgggcgccaatggcaccaggccgaattggccgtctcgactttctggcctaacgagtaccaagtgctgttcgaggccctcatatctccagacaggcggggctatatgggcctggacgacatcctgcttctcagttatccatgtgctaaagctccacacttctctagattaggagacgtggaagtcaacgccggacagaacgcctctttccaatgtatggctgctggacgggctgccgaagctgaacggttcctgctacagcggcaatccggagccctcgtgcctgccgcaggggtgaggcatatctcacatcgccgctttctggccaccttcccgctggctgctgtttcgcgggccgagcaagacctctacagatgcgtctcacaggccccacggggcgccggagtctctaattttgccgagctcattgtgaaggagcctccaacaccaatcgccccgcctcagctgctccgggcaggtccaacctacttaatcatccagctgaacacaaactccattattggggacggcccaattgtcaggaaggaaatcgagtatcgcatggccagagggccttgggccgaggtgcacgccgtgtctctgcagacatacaaattgtggcacctggaccccgatactgagtacgagatatcagtgctgctgactcgccctggagacggaggtactggacgacccggccctcctcttatctcaagaactaagtgtgcagagcccatgcgggcccccaaggggctggcctttgccgaaatacaagctagacagcttactttacaatgggagcccctgggatacaacgtgacccgctgccatacctacactgtctcactctgttaccactatacccttgggtcctcacataatcagacaatcagagaatgtgttaaaaccgagcagggagtctcccggtacacaatcaaaaatttactcccctacaggaacgtccacgtgcggctggtgttgactaaccctgaaggccgaaaagaaggaaaagaagtgaccttccagactgacgaggatgtcccttcagggatcgcggccgagagcctgaccttcacccccctggaggacatgattttcctgaagtgggaggaaccccaggaacctaacggtctgatcacacagtacgaaatcagctatcagtctattgagagcagtgatcccgctgtaaacgtacccggaccacgccgaactattagcaagctgaggaacgagacttaccatgtgttctccaatctgcatccgggcaccacatacctattttccgttcgtgcaaggaccgggaaaggcttcgggcaggcggcactgacagagatcacgaccaacatctcagcaccgtcctttgactatgctgacatgcctagccccttaggggagtctgaaaatacgataacggtgctactccgccctgcccagggaaggggagcccctatttctgtctaccaggtaatcgtcgaggaagaacgcgcgagacggctgcgtcgggagccaggcggtcaggactgttttccagtgcctctgacctttgaagcagctctcgcaaggggactagtacattacttcggcgctgaacttgccgccagtagcctacctgaggctatgcccttcaccgtgggagacaaccagacttatagggggttttggaaccctccgcttgagcctagaaaagcctacctgatctattttcaagcagcatcacatcttaaaggcgaaacccgcctgaattgcattcgaattgcaagaaaggccgcttgcaaggagtctaagaggccattggaagtttctcagaggagcgaggaaatgggcctcattctcggaatttgcgcggggggcctggccgttctgatcctgctgctgggcgccattatcgtgattattcgaaagggaaagcccgtcaacatgacaaaggccaccgtcaactatcgacaggagaagacacatatgatgtcagccgttgaccgcagcttcactgaccagtctactctgcaggaggacgaacgcctgggactgtcctttatggatactcacggttacagcacaaggggagaccagagaagtggaggcgtgactgaagcctctagccttttgggcggcagcccaaggcgaccgtgtgggaggaagggatccccgtaccacacaggtcagctgcaccctgccgtgcgggttgctgatttgctgcagcatattaaccaaatgaaaactgccgaggggtacggctttaagcaagaatatgagtcctttttcgagggatgggacgcaaccaagaaaaaggataaagtcaagggatctcgacaggagccaatgcccgcctacgatagacatcgtgtgaaattgcatcccatgttgggagaccctaatgctgattatatcaacgctaactacattgacggatatcatcggtccaatcacttcatcgccactcaaggtccaaagcccgagatggtgtatgatttttggcgcatggtctggcaggagcactgcagttcgattgtaatgattaccaaattggtcgaggtgaaatgctccagatactggcccgaggatagcgacacatacggagatattaaaataatgctggtcaagacagagaccttggcagagtacgttgttagaactttcgcactggaaagaagggggtattctgccagacatgaggtgcgccagtttcactttaccgcctggcccgaacatggcgtcccctaccatgccactgggctgttggcgtttatccgcagggttaaggcctccactcctcccgacgccggcccaatcgttatccactgcagcgcgggcaccggtaggacaggctgctacatagttctggatgttatgcttgacatggcggagtgtgagggtgtggtcgatatctacaattgcgtcaaaacgctttgcagtagacgggttaatatgatccagacagaggagcagtacatttttatccatgacgcgattctggaagcctgtctatgcggggagaccaccattccagtgtccgagttcaaagcaacttataaagaaatgatccggatcgacccccagagtaacagctcccaactgcgggaagagttccagaccttgaactctgtaaccccacctttagacgtcgaggaatgcagtatagctctgctgccaaggaaccgtgacaaaaaccgttccatggatgttctaccccccgatcggtgcctgccttttcttatttccacagatggagatagcaacaactacatcaacgcagcccttacagactcatatactcggtcagcagctttcatcgtgacactacacccgttgcagagtaccaccccggacttctggcgtctggtttatgactatggttgcacttcaattgtcatgctcaaccagctgaaccagtccaacagtgcttggccctgtttgcagtactggcccgagccaggacgacagcagtacggcttaatggaagtcgaattcatgtctggaacggccgacgaagatttggtggcaagggtcttccgagtgcagaatatttccagattgcaagaagggcatcttcttgtccgccacttccagtttctgagatggagcgcctaccgggacacgccagattccaagaaggcatttctgcacctgctggccgaagtcgacaagtggcaggccgagtctggcgatggccgtacgatagtgcattgtctgaatggaggagggagatccggcaccttctgcgcctgcgctaccgtgctggagatgattcggtgccacaatctggtggacgtctttttcgcagcgaagaccttgaggaattacaagccaaatatggtggagaccatggatcagtaccatttctgctacgatgttgcactggagtacctggaaggcctcgagtcgcggtag

SEQ ID NO: 130996 - DNA, 6948 bp, Artificial Sequence
  Description of Artificial Sequence: Synthetic coding sequence
atgagaatactgaaacggttcctggcctgtattcagcttttgtgcgtttgcaggttggattgggctaatggatattaccgccaacaaagaaagctcgtcgaggaaattggctggagctacaccggagctctaaatcagaagaactggggaaagaaatatccaacatgtaattcccccaaacagagccctatcaatatagatgaggatctgacacaggtaaatgtgaacctgaaaaaactgaagtttcagggctgggacaagacttccctggaaaacactttcatccacaacactggcaagacagtagaaattaacctgactaatgactaccgcgtgtcaggcggggtgtcagaaatggtgtttaaagctagcaagataacattccactggggtaaatgtaatatgtcatcagatggatccgaacactcacttgagggccaaaagttcccactcgagatgcagatctattgcttcgacgcagataggttctctagttttgaagaggctgtcaagggaaaggggaagcttagagccttgtctatactgttcgaagttggcacagaggaaaaccttgatttcaaagcaattatcgatggagttgagtcggtgtctagatttggaaagcaggccgcgctagaccctttcatcttgctcaaccttctgccaaacagtactgacaaatattatatatataacggaagtctcaccagcccaccctgtactgatactgtggattggatcgtgttcaaggataccgtctcaatcagtgaatcccaacttgcagttttttgcgaggtgttgaccatgcagcaatcgggttatgtgatgctcatggattatttgcagaacaattttagagagcaacagtataaattttcgagacaagtgttctcatcttacacaggaaaagaagaaattcacgaggctgtgtgttcaagcgagccggagaatgtccaggctgatccagagaattacacctcgttgctcgtgacctgggagcgaccccgcgtggtgtacgacaccatgatcgaaaagttcgcagtcctatatcagcagcttgatggcgaggatcaaactaaacatgagttcctgacggatggctaccaggatcttggcgctatactgaacaatctgcttccgaatatgtcatatgtgttacaaatcgttgctatctgtacgaacggtctctacggaaaatactccgaccaattaattgtggatatgcccacagacaatccagagctggatctatttcctgagctcataggcactgaggaaattatcaaggaagaagaggaaggcaaggacattgaggagggagctatcgtcaacccaggcagggattcagcaacaaaccaaattagaaagaaggaaccacagatctccacaacgacccattataatagaatcggaaccaagtacaatgaagcgaaaacaaaccggtcccccaccagggggagcgagttttccgggaagggggatgtgcccaacacctctctcaatagtacttcccagccagtgacgaagctagccaccgaaaaggacatttctctgaccagccagaccgttacagaactgcccccccacaccgtggagggcacaagtgcatccctaaacgatggaagtaaaactgttcttaggtcccctcatatgaatctctccggcaccgcggagtctctcaacacggtctctattaccgaatacgaggaagaatccctgctgaccagtttcaaactggacaccggggccgaggactcaagtggatccagccccgccacatccgctatacccttcataagtgaaaacatttcccaggggtatatcttttcctcagagaatccggagacaatcacttatgatgtgctgattccagaaagcgctaggaatgcatcagaagactcgacctcctcaggtagcgaggagtctctgaaggatccttctatggaaggtaatgtctggttcccgtcctctacggacatcaccgcgcaacctgatgtggggtccggaagagagtccttcctccaaacaaattacactgagatccgcgttgatgagagtgaaaagacgacaaaatccttttctgcaggacctgtcatgtcccaagggccgtctgtgactgacctcgagatgccccactactccacatttgcttattttccaaccgaggttacccctcacgctttcacgccctcctctcgtcagcaagacttggtttcaacagtgaatgtcgtgtattcccagactacacagccggtgtataatggggagacccctttacagcccagctacagctctgaggtgttcccacttgtgacgcctctcctgctggataaccagattctgaataccactccggctgcatcttctagcgacagtgctctgcatgcaaccccagtcttccctagcgtggatgtgagtttcgaaagtatacttagcagctatgatggtgcgcctcttctcccattctccagcgcaagctttagttctgaactgtttaggcacctgcataccgtaagccagatcctgccccaggtaaccagtgcaacagagtctgacaaagtgccattacacgccagcctgcctgtggccggcggcgaccttctcctggaaccttccttagctcagtacagcgatgttctgagtactactcacgctgcctcggagacgctagaatttgggagtgagtccggagtgttgtacaaaaccttaatgttctcacaggtggagcctcctagctcagacgccatgatgcacgcgcgctcttcgggccctgagcccagctatgcgctcagcgacaacgaaggatctcaacacatcttcaccgtcagttacagttccgctattcctgtgcacgacagcgtgggtgtaacttatcagggtagccttttttctggcccctctcatattccaatcccaaagagttctcttataacgccaactgcctccctgctgcagccaacccacgccctcagcggggacggtgagtggagcggcgcatcatccgactccgagttccttctaccagatacagacggcctcaccgcgctcaacatttcttccccagtctccgtagctgaatttacctacactacatccgtgttcggagacgacaacaaggctttgtcaaagtcagagataatttacgggaacgagaccgagctgcaaattccgtcctttaacgaaatggtttacccgtccgaaagtactgtcatgcccaatatgtacgataatgtgaataaactgaacgcttcattacaggagacatcggtgtccattagtagcactaaaggaatgttcccaggatctcttgcgcacacaaccaccaaggtttttgatcatgagatctcgcaagtgcccgaaaataatttcagcgtgcagcctacccacacagtgtcccaggctagcggcgatacatctcttaagcctgtcctgtcggctaactccgagcctgcatcaagcgacccagcgtcatccgagatgctcagcccttcaactcagcttttgttttatgagaccagtgcttcctttagcaccgaggtactgttgcagccctcatttcaggcgagcgacgtggacacactccttaaaaccgtgttgcccgccgtcccgtccgacccaatactagtggagaccccaaaagtcgacaaaattagttccaccatgctacacttgatcgttagtaactcagcctcttcggaaaacatgctacattcaacgtcggtgccggtgtttgacgtgtctccaacatcccacatgcattcagcgagcttgcaaggcctcaccatttcttatgcctccgaaaagtatgaacccgtgctgctgaagagcgagtctagtcatcaggttgttccttctctatactcaaatgatgaacttttccaaacagctaacctcgagattaaccaggcacaccctccaaagggtaggcacgtgttcgctaccccagtcttgtcgatcgacgagcccctgaatactctgatcaacaaattaattcatagcgacgagatcttgaccagcactaaaagttcagtcactggcaaagtgttcgcaggtatcccaaccgttgcctccgatacttttgtgtctaccgaccactccgtccccattgggaatggacacgtcgcaatcacggcagtcagtcctcaccgtgatggcagcgtcacaagcaccaaactcttgttcccctctaaagccacatctgaactgtctcattccgccaagtctgacgcagggctggtgggtggcggcgaggacggcgatacagacgacgatggcgatgacgacgacgacgacagagggagcgacggcctatctatccacaaatgcatgagttgctcttcataccgcgaaagccaggagaaggtgatgaacgacagcgatacccacgagaactccctgatggatcagaacaatcctatttcttattcactctctgagaactcggaggaggacaaccgggttacctccgtctcgagtgacagccagacaggaatggacaggtcccccggcaagtcccctagtgcgaatggtctgtcccagaaacataatgatggcaaggaagagaacgacatacaaaccgggtccgctttattgcccctgtctcctgaaagcaaggcttgggccgtcctgacctccgatgaggagtcaggcagcggccagggaacctccgattctttaaacgaaaatgagactagcactgatttctctttcgccgataccaatgagaaggatgcggacgggatccttgctgccggagacagtgagatcacacctggcttcccacagtcgccgacaagtagtgtgacctcagagaactcggaggtatttcacgtctcagaggctgaggcgtctaacagctcccacgaaagtcggatcggcttggccgaaggtctcgaatcagagaaaaaggctgtgatccccctggtcattgtgagcgcactcacattcatttgccttgtggttctagtgggtatactcatctactggaggaagtgcttccaaacagctcacttctacctggaggattccacgagccccagagtcatcagcacccctccaacacctatctttcctatctcagatgacgttggtgccattccaatcaagcatttccccaaacacgtagctgatttgcacgccagtagcggctttacagaagagtttgaaaccttgaaagaattctatcaggaggttcagtcctgcaccgtagacttgggtatcacagccgactcctctaaccaccccgacaataaacataaaaatagatatatcaacatcgtagcctacgaccactcccgggtgaaacttgcgcaactcgccgagaaggacggcaaacttaccgactacatcaatgccaattacgtggatggttacaacagacccaaagcttatatcgccgctcagggccccttgaagtctacagccgaggatttctggcggatgatctgggaacataacgtcgaggtcattgtgatgatcaccaacctggtcgagaagggacggcgcaaatgtgaccaatactggcctgccgatggctccgaagagtatggcaattttctggttacccagaaatctgtgcaagtgttggcgtattacactgtgcggaatttcacactgaggaatacgaaaatcaagaaaggctcacaaaaaggacgaccctccgggcgcgtggttacccaataccattacacgcagtggccggacatgggggtcccagaatactcactgcccgtgctcacgttcgtgcgaaaagcggcatacgcaaaaaggcatgctgtgggccccgtggtcgtgcattgcagcgctggcgtggggcggacgggaacatatatagttttggactcaatgctccaacaaattcagcatgagggcacggtaaacatcttcgggtttttgaagcacattcggtcacagcggaattacctcgtacagaccgaggaacagtatgtatttattcacgatacactggtcgaagccatactgtccaaggagacagaggtcctggattctcatattcatgcgtacgtgaacgcattactgatcccaggtcccgcaggcaagactaagcttgaaaagcagttccagttgctctctcagtcaaatattcagcagtcagactattcggccgcactgaagcagtgcaacagagagaaaaaccggacctcatctatcatccccgtggagcggtctcgggtcgggatctctagcctaagcggcgaaggaaccgattatattaatgcctcctatatcatgggctattatcagtcaaacgaattcatcatcactcaacaccctctgttacacaccataaaagacttttggcgtatgatctgggatcacaacgctcagctggtggtgatgattcccgacggtcagaacatggcagaggacgagtttgtgtattggccaaataaagacgagccaattaattgcgaaagtttcaaagtgaccctgatggccgaggaacacaagtgcctcagtaacgaggaaaaactgataattcaggactttatattagaggccactcaggacgattatgtgttggaggttcggcacttccagtgccccaagtggcccaatcccgactcacccataagcaaaaccttcgaactcatctcagtgattaaagaggaggctgccaaccgtgacggccccatgatcgtccatgatgagcacggaggggtaacagccggtacgttctgtgccctgaccacactgatgcaccagttagagaaagaaaactctgtcgacgtttaccaggtggccaaaatgatcaatttgatgcggcccggcgtattcgccgacatcgagcagtatcagtttctctacaaagttattttatcattggtgagcacaagacaggaagagaatccctcgaccagcttggatagtaatggcgctgcactgcccgacggaaacatcgcagaatcgctcgagtcccttgtttag

SEQ ID NO: 130997 - DNA, 474 bp, Artificial Sequence
  Description of Artificial Sequence: Synthetic coding sequence
atgggccgcctgactgaggccgccgccgcaggatccgggtcacgagcggctgggtgggcggggagtccaccaacactgctacccctcagtcctacatcaccccgttgcgcggccaccatggcctccagtgacgaggatggaacgaatgggggtgcatcggaagcaggagaggaccgcgaagctccaggcgagcgccgcaggctgggcgtgctggctacagcctggctgactttttatgacatcgctatgacggcaggtcgcctcatcctgagccctcggctggagtgcatcggagccatctccgcccattgccagcctcaaccgcctgagttcaagcgattttcctgccttggtctgagatccagctgggattataagcgcggtccaccacgaccaatcaatttttgtattttcggccgagatcgcgtttccccttgctggccaggctggagccgcacccctgatttgaaatag

SEQ ID NO: 130998 - DNA, 867 bp, Artificial Sequence
  Description of Artificial Sequence: Synthetic coding sequence
atgggcaggctcacagaagccgcggctgccggaagtggcagcagggccgctggctgggcagggagtccccctactctcctgccactcagccctacatctccccggtgcgccgccactatggccagctcagacgaagacggcactaacggtggagcttcagaagctggggaagaccgcgaggcgccaggggagaggagaaggcttggagtactggccactgcttggttaacattttacgatatcgctatgactgctggctggctcgtgctggccattgccatggtgaggttctacatggaaaagggaacccatcgtgggttatataagtccattcagaagactctgaaattcttccaaaccttcgcgctgcttgaaatcgtacactgcctcataggaattgtgccaacatcagtcatcgtgaccggcgttcaggtttcttcacggatttttatggtgtggctgattactcactcaatcaagccgatccagaatgaggagtccgttgtactttttctagtggcctggaccgtcacagaaatcactaggtattcattttatactttctccttactggaccacctcccttatttcataaagtgggctcgctacaattttttcattatcctctaccccgtgggagtggctggagaactgcttaccatatacgcagctctgccccacgtgaagaagaccgggatgttttcaattaggcttcctaacaagtacaatgtgagttttgattattactacttccttttaatcacaatggcatcctacatacctcttttccctcagctctactttcacatgctgagacaacgccgcaaagttctgcacggcgaggtgattgtcgaaaaagatgattag

SEQ ID NO: 130999 - DNA, 1269 bp, Artificial Sequence
  Description of Artificial Sequence: Synthetic coding sequence
atggctggctgcgtgcccctgttacaggggttggtgctggttttagccctgcacagggtggaaccctcagcgacctccctgaaggaacgccatggcctgcactcagactcagcctgcacaggcgtacaggaatccctgttcctaccagcatctaaggcaaacgatgtgctggtaagatggaaacgcgccgggagttatttgctggaagagctgttcgagggcaatctagagaaagagtgctatgaggaaatctgcgtgtacgaggaggctagagaagtctttgagaacgaggtcgttaccgatgaattttggcgcagatacaaggggggatctccttgcatttcccagccttgcctgcacaatggatcctgccaggatagcatctgggggtacacctgtacatgtagcccagggtatgagggctccaattgtgaactagccaagaatgagtgccatccagagcgcacggacggctgtcagcacttctgtttgcctgggcaggagtcttatacatgttcatgcgcacagggatatcggctgggagaagatcataaacagtgcgtgcctcatgaccaatgtgcgtgtggagtcctgacgtcagagaagagagcccctgatctgcaggacctaccttggcaggtgaagttgactaactctgagggcaaagacttctgcggcggtgtcatcatccgcgaaaacttcgtgctgacaacagccaaatgttccttactgcataggaatattactgtgaaaacgtattttaaccgaacgtcccaggatcctctgatgatcaaaatcactcacgttcacgtccacatgaggtatgatgcggacgccggggagaacgacctcagccttctggagctcgaatggccaattcagtgcccgggcgcaggcctgcccgtatgcactcctgaaaaggacttcgccgagcacttgctcatccccagaacacgaggactcctgagcggatgggccagaaacggcaccgacctgggaaacagcttgaccacccggcccgtgacactggtggaaggcgaagaatgtggtcaggtgctgaacgtaacagtcaccacacgaacctattgcgagcgatcctcagtcgcagcaatgcactggatggatggtagtgtggtgacgagggagcatcgcggaagctggttcctaaccggagttctcggatctcaacctgtgggaggtcaagcccacatggtccttgtgacaaaagtgtcccggtattccttgtggtttaaacagatcatgaactag

SEQ ID NO: 131000 - DNA, 1203 bp, Artificial Sequence
  Description of Artificial Sequence: Synthetic coding sequence
atggctggctgcgtcccccttttacaaggcctcgttctcgtccttgctctgcatagggtggagccctccgtcttcctgccggcttccaaagccaatgatgttttggtacggtggaaaagggctggctcttatctcttggaggagctgtttgaagggaatctcgagaaggagtgttacgaggagatctgcgtatatgaggaagccagagaggtgtttgagaatgaggttgtcactgatgagttttggcgccggtacaagggagggtctccctgcatcagccaaccttgcctacacaatggctcatgtcaggacagcatatggggctacacttgcacatgctcacccggctatgaagggtctaactgtgaattagccaaaaatgagtgccacccagaaagaaccgatggatgccagcatttctgcctaccgggacaagagagttacacatgcagttgtgcccaggggtataggctgggggaagatcataagcagtgcgtacctcacgatcagtgcgcttgtggggtcttaacctcagaaaaacgagctcccgaccttcaagatctgccttggcaggtcaaactcactaatagtgagggcaaggacttctgtgggggtgttatcattagggagaacttcgttctcaccaccgcaaagtgttccctgctgcaccgtaacatcacggtaaagacctacttcaatcgcaccagccaggaccccctgatgattaagattacccacgtgcatgtccacatgagatacgacgcagacgctggcgagaatgatctctcactgctcgagctcgaatggcctattcaatgcccaggcgccggactcccggtatgtacgcctgagaaagatttcgccgagcatctgctcatccctcggaccaggggccttctctcggggtgggctaggaatggcacagatctgggtaacagtcttacaacacgtccggtaaccttggtggagggcgaggaatgcggccaggtgcttaatgttaccgtgacaactcggacctactgcgagcgctctagtgtggctgcaatgcactggatggacggaagcgtggtgacccgagagcaccgaggctcgtggtttcttactggggtgctgggatctcagccagtcggcggccaggcccatatggtgctggtaaccaaggtttcccggtattcactgtggtttaaacagatcatgaattag

SEQ ID NO: 131001 - DNA, 1053 bp, Artificial Sequence
  Description of Artificial Sequence: Synthetic coding sequence
atggagcccaaacggatacgtgaagggtatctggtgaaaaaaggcagcgtgtttaatacctggaagcccatgtgggtggtcctgctcgaggacggcattgagttctacaagaagaagtccgacaatagccccaaggggatgatccccttgaaagggtcaactctgacctctccttgccaggatttcgggaaacgtatgttcgtgttcaagattaccaccaccaagcagcaggaccacttctttcaggcggccttcctggaggaacgcgacgcttgggtgcgggacatcaagaaggcgatcaagtgcatcgagggcggccagaaattcgcccgcaagtcgacccggcgaagcatccgcctgccggaaacaattgacctcggcgccctctatctgtcaatgaaggatacggagaaaggtattaaggaactgaacctggagaaggacaagaagattttcaaccactgtttcacaggtaattgtgtcatcgactggctcgtctctaatcagtccgtgagaaatcggcaggagggccttatgatagcctcaagcctgcttaacgagggataccttcaacctgccggagatatgtccaaaagcgcagtggacggtactgcagagaaccctttcttggataatcctgacgccttttattatttcccagattccggatttttctgtgaggagaattcatcagatgatgacgtgatcctgaaggaagagtttagaggagtcattatcaaacaggggtgcctccttaaacagggacatcgaaggaagaactggaaagtgcggaagttcattctgcgggaggaccccgcatatttgcactattatgatccggccggggctgaggaccccttgggggctatacaccttcgtggctgtgtcgtcacatctgtggaatcaaatagtaatggccgcaagagtgaggaagagaatctgttcgagattattactgcagacgaggttcactacttcctccaggcggccacgcctaaagagcgtacagagtggatacgggccatccaaatggcctcccgtactggaaaatag

SEQ ID NO: 131002 - DNA, 648 bp, Artificial Sequence
  Description of Artificial Sequence: Synthetic coding sequence
atggcgtcgctccagatgcggggtaaccctgggagtcatttttgcggcggcacactgatccatcccagctttgttctaacggctgcccattgtctgagggatatcccccagaggcttgtcaatgtagtgctgggcgctcataacgtccgcacccaggagcctactcagcagcatttcagtgttgctcaggtgttcctgaacaactacgatgctgagaacaagttaaacgatgtcttgctgatccaactgagttcccccgccaacctcagcgccagcgtcgcaaccgtgcagctgccacagcaggaccagcccgtgcctcacggcacacagtgccttgctatggggtggggcagagtcggtgctcacgatccccccgcccaggtccttcaggagctgaacgtcacagttgtgaccttcttctgtaggccacataacatctgtacctttgtgccacggcgaaaggctggtatctgtttcggagacagtggaggaccactaatctgcgatgggatcattcaaggcatagactcctttgtgatctggggatgcgccacgagactgtttccagacttttttacccgggtggctctgtatgtcgactggatcagatcaactctgcgacgggtggaggctaaaggcaggccgtag

SEQ ID NO: 131003 - DNA, 858 bp, Artificial Sequence
  Description of Artificial Sequence: Synthetic coding sequence
atgcccggtgccagaagcggaggctctggcggtgatggcagtaattctgggtcttacagtggggatgccagcggagccgtaactgtatgggaggtggtatctttgcttggaaagttgctgggcaccgtcgtggctttaaaggtggtgctttaccttctcagagtgtgtctggccatggcttggaagagcggcggagcaagtcatagcgaactcattcataatcttcggaagaacggaatcatcaaaacagacaaagtgttcgaggtcatgctagccacggatcggagccattacgcaaagtgcaacccatatatggacagtcctcagtcaatcggctttcaggctacgatttccgctccacacatgcacgcctatgccctggagctcttgtttgatcaactccatgaaggcgctaaagccctcgacgtgggcagcgggtctggcattttaaccgcttgcttcgcgaggatggtcgggtgtaccggcaaggtaatcggcatcgatcatatcaaggaactggttgacgactcggtgaacaatgtcaggaaggatgatcccaccttgctcagctcaggtcgcgtgcaattagtcgtaggggacggtagaatgggttatgctgaggaggctccctatgatgcaattcatgtgggagcggctgctcccgtggtgcctcaggctctgatcgaccagctgaaacccggtggcagactcatcctgccagtcggtccggccggcgggaatcagatgctggagcagtacgataaactgcaggacggatcaattaaaatgaaacctctgatgggcgtaatttatgtgccgctgaccgataaggaaaagcagtggtccagatggaagtag

SEQ ID NO: 131004 - DNA, 684 bp, Artificial Sequence
  Description of Artificial Sequence: Synthetic coding sequence
atggcttggaagtcaggtggagctagtcatagtgaattaattcataatctgcgcaagaacggaattatcaaaaccgacaaagtttttgaggttatgctggccactgaccgtagtcactacgccaagtgcaacccatatatggattcaccacagagcatcggcttccaagctacaataagtgcaccgcacatgcacgcatacgcactagaactgctctttgaccagttgcacgagggagctaaggccctggatgtcgggagcggtagcggaattctgacagcgtgcttcgccaggatggtcggatgtacaggaaaagttatcgggatagatcatattaaagagctcgtggatgactctgtaaacaatgtgagaaaagacgacccgaccctgctttcgtctgggcgagtgcaactggtcgtgggtgatgggcgaatgggatatgccgaagaggcgccatatgatgccatacatgttggggccgccgcaccagtcgtccctcaggcgctcattgatcagttaaagccgggcgggaggctgattctccctgttggcccagccggggggaatcagatgctggagcagtacgacaaactgcaggacggaagcatcaaaatgaagccactgatgggtgtaatttacgtccccttaaccgataaggagaaacagtggtcaagatggaaatag

SEQ ID NO: 131005 - DNA, 861 bp, Artificial Sequence
  Description of Artificial Sequence: Synthetic coding sequence
atgcctggagcccgttcaggcggctccggaggggatggctctaattcaggctcttactctggagacgcaagcggggcggtcactgtctgggaggtcgttagcctgctgggcaaactcctgggcaccgtggtcgcactcaaggtcgttctgtatttgctcagggtgtgtcttgctatggcctggaaatccggaggggcaagccacagcgagctgatacacaatctcaggaagaatgggatcatcaaaactgataaagtgtttgaggtgatgctggccactgataggagtcattatgctaagtgtaacccatacatggactctccacaatctattggctttcaggcaactatctcagccccgcacatgcatgcttatgctctggagctgctgttcgaccagctgcacgaaggcgccaaggcgctcgatgttggctctgggagcggcatccttacggcgtgctttgcccgtatggttggctgcacaggaaaggtgattggcatcgaccacatcaaggagctcgtggacgattccgttaataatgttcgcaaagatgaccctacgctcctgagcagtgggcgtgtccagctggtggtgggagatggccgaatgggatacgccgaggaagccccatatgatgccattcacgttggcgcagccgctccagttgtgccccaggctttgatagatcagctgaagcctgggggtcggctgatactgccagttggccccgcaggcggaaatcagatgttagagcagtacgacaaactccaagatggcagtattaaaatgaagccattgatgggtgtgatctacgtgccgctgactgataaagaaaagcaatggagccgggacgaactgtag

SEQ ID NO: 131006 - DNA, 858 bp, Artificial Sequence
  Description of Artificial Sequence: Synthetic coding sequence
atgccgggcgccagatcaggaggatccgggggtgacgggagtaacagcggctcatattctggtgatgcctccggcgcggtgactgtgtgggaagttgtctccctgcttggaaaattgctggggaccgttgtcgctctgaaggtggttttgtatttattgcgggtctgtcttgcaatggcttggaagagtgggggcgcgtcacactccgagcttatccataatctccgtaaaaatggcattattaagactgacaaagtgtttgaggtgatgttggcgaccgatcgctctcactatgccaagtgtaacccctatatggactcacctcagagcattggttttcaggctaccatctcagcaccccatatgcacgcatatgctttggagctcctttttgatcagctgcacgaaggggcgaaggccctggacgtgggatccggatctggaatattaacagcctgtttcgcccggatggtggggtgcacagggaaggtgattgggattgaccacatcaaagagctcgtcgacgatagtgttaataatgtccggaaagacgatcccacactgctgagttcaggcagagtacagctggttgtgggtgacggaagaatgggctacgccgaggaggcaccgtacgacgctatccacgtaggagcagcggcacctgtggtgccccaggccctgatagatcagctgaagcctggtggcaggctgatactccccgtgggcccagcaggcgggaatcagatgcttgagcagtacgacaaattgcaagacggatccatcaagatgaaaccgctgatgggagttatctatgtacctctaacagataaggagaagcagtggtctcgatggaaatag

SEQ ID NO: 131007 - DNA, 579 bp, Artificial Sequence
  Description of Artificial Sequence: Synthetic coding sequence
atggcttggaagtcaggcggcgcctcccactcggagctcattcacaatctccgctcttttcaagccactatctcagctccccatatgcacgcctacgcccttgaactgttgttcgaccagctacatgaaggagccaaagccctggatgttgggtcagggtccggtattctgaccgcttgttttgcccggatggtcggctgcacaggaaaagtcattggcatcgatcatatcaaggagctggttgacgattctgtgaacaatgtgaggaaagacgacccgacgcttttaagttctgggagagtgcagctagtcgtcggcgatgggcggatgggctacgctgaggaagcaccttacgacgccattcacgttggagccgccgcgcctgtggtgccacaggcgctgatcgaccaactcaagccaggcggacggctcattctgccggtcggacccgccggtgggaatcagatgctggaacagtacgacaagctgcaagacgggtccatcaaaatgaagcccttgatgggagtgatctatgttccactcaccgacaaagaaaagcagtggagcaggtggaagtag

SEQ ID NO: 131008 - DNA, 2016 bp, Artificial Sequence
  Description of Artificial Sequence: Synthetic coding sequence
atgaaacaaattttctttctagatgatagcggcccccctttcggacacatggtcctggctctaggcggatatcttggtgggtttgatggtaattttctgtggaaccggatcggcgccgagtacagctcaaacgtgccagtgtggtccctgcggttgctccccgcactcgcaggtgcgctgtcggtccccatggcctatcagattgtgttagagctccacttctcacattgcgcagcgatgggcgcggctttactgatgctgatcgagaatgcactgatcactcaatctaggctgatgctgctcgaaagcgttctgatcttttttaaccttctggccgtgctgtcctacctgaaatttttcaactgtcaaaagcactcccctttctcactgagctggtggttctggctcaccctcactggtgtggcatgtagctgtgccgtcggcattaaatacatgggggtgttcacctatgtcttggtcctcggcgtggctgcagtccatgcctggcatcttttaggcgaccagacgctctccaacgtgtgtgtcttctgccacctgctagcacgcgccgtggcactgttggtgatccctgtggtgttgtacttactgttcttttacgtccacttgattctggtctttcgatcgggacctcacgatcagattatgagctctgcttttcaagcctccttagaaggcgggctggcacgaatcacccaaggccagcccctggaggtcgctttcggctcacaggttacactgcgcaacgtctttggaaaacccgttccatgctggctccattctcaccaggacacatatcctatgatatatgagaatggtcgcggttcttcccaccagcagcaggttacttgctacccatttaaggatgtgaacaattggtggattgtgaaggatccccgccgtcaccagctggtagttagctcccctccaaggccggtccgccacggagatatggtgcagctggtgcatggaatgacaacgagatcattaaacacacatgatgtggctgctcctctgtcaccccactcacaagaggtgtcatgttatatagattataacataagtatgcctgcgcaaaatctttggaggctggaaattgttaataggggaagtgacaccgatgtttggaagacgatcttgtcagaagtcaggttcgttcacgtcaacactagcgctgtgcttaaactctccggcgcccatctccccgattgggggtacagacagttggagattgtcggagaaaaacttagtcgcggctaccacgggtctacagtgtggaacgtggaagaacaccggtatggtgcatcccaggagcagagagaacgcgagagagaattacattctccagcccaggttgacgtcagccgcaatctatccttcatggcaagattctctgaattgcagtggcgtatgttagcattgagatctgatgactctgagcataagtacagcagctctccactggagtgggtaactcttgacaccaacatcgcatattggcttcatcctaggacaagtgctcagatccacttactcggtaacattgtgatttgggtgtccggatctctcgccctggctatctatgccctgctgagtctatggtacctgcttcgccgcaggcgcaatgtccacgacttgccccaggacgcctggcttagatgggttctggctggcgctctttgcgcaggggggtgggcagtcaactatctacccttttttctgatggagaagaccttgttcctctatcactacttacctgctctgacattccaaatcttgctcctgcctgtggttctccaacacatcagcgaccacttgtgtcgttcccagctgcagaggtccattttctccgccctcgtagtggcctggtactcctccgcctgccacgtctccaacaccctgcgacctctcacctatggggataaatccctgtcacctcacgagctgaaggctttgcgatggaaggacagttgggatatcctgatccggaaacattag

SEQ ID NO: 131009 - DNA, 2088 bp, Artificial Sequence
  Description of Artificial Sequence: Synthetic coding sequence
atgtggggtttcctgaaacgaccagtggtggtgactgccgatataaacttgtcgctggtggccctcactggcatggggttgctctccagactgtggagactgacgtacccccgagccgtggtgttgtttcgcaggatacggtggcagtttttcgtcgaacagaattggagttcagttgtcgcttttcctgaatacagttctaatgttccagtgtggtcactgcgccttctaccagccctggcaggagctctgagcgtgcctatggcttatcagatcgtgctcgaacttcattttagccactgcgcagcaatgggagccgccctgctgatgttgatcgagaatgcactgattacacagtctagattaatgttattagaaagcgttctgatttttttcaatttgctcgctgtgttgtcttatcttaagttttttaattgccagaaacactctccattctcccttagctggtggttctggctcacattaacgggcgtggcctgttcttgcgctgttgggattaagtacatgggagtttttacttacgtgctggtcctaggagtcgcagcagttcacgcgtggcacctgctcggcgaccagactctgtctaacgtttgtgtcttctgccacctcctcgcacgggccgtagcactgttggtcatcccagttgtgctctacctgctgttcttctacgtgcatttgattttggtcttccgcagcggaccccacgatcagatcatgtcatcagcttttcaggcctctttagagggcggtctggctcgtatcactcaggggcagcctctggaagtggccttcggatctcaggtgactttgcgaaatgtgtttggaaagccggtgccttgctggctacacagccaccaagacacctatccaatgatttacgaaaatggaaggggcagtagtcatcagcagcaggtgacctgctacccctttaaggacgttaataattggtggatagtgaaggatcccaggcgccaccagctcgtagtgtcgtccccaccccgcccggtgcgacatggagatatggtacaacttgtccacgggatgacaaccagaagcctgaatacccacgatgtagcagctcctctgagcccccactcacaggaagtctcttgctatattgactataatatctcaatgcctgctcagaatctctggcggctggaaatcgtcaatcgcggttccgataccgatgtctggaagaccattctgagtgaggtccgctttgtccacgttaatacctccgctgtcctgaaactgtccggtgcgcacctgcccgactgggggtacaggcagcttgagatcgtaggggagaagctgtcacggggatatcacggatccactgtgtggaacgtggaggagcatagatatggcgcctcccaggagcagcgagagagggagcgggaacttcatagccctgctcaagttgatgtgtctaggaacttatcatttatggccagattcagcgaactgcagtggcggatgttggcactccgcagtgacgatagcgaacacaagtacagcagctcccccctggaatgggtgaccctagataccaacattgcatattggctgcaccccaggacaagcgcccagattcacctgctgggcaacattgtgatttgggtgagcggctctctggctttagctatctacgccctgttgtcactgtggtacttgctccggcggaggcgtaacgtgcatgacctgccccaggatgcgtggttgcgttgggtgcttgcgggcgccctgtgtgcaggaggctgggccgtcaactacctcccgttctttctaatggagaaaacactctttctgtatcactacctgccagcacttactttccagatcctattgttaccggtcgtgctgcaacatatatccgaccatttgtgccggtcacaactgcagcggtcaattttctcagcattggtcgtcgcctggtacagttccgcatgtcacgtgagcaatacacttcgcccacttacttacggcgacaaatcattgtccccacatgagctgaaggcactccgatggaaagattcgtgggatattctcatccggaagcattag

SEQ ID NO: 131010 - DNA, 1041 bp, Artificial Sequence
  Description of Artificial Sequence: Synthetic coding sequence
tggcgaggaggcggttgcactagccccgcaacgctaggggctgccagaggggcagttggaattggcaaggaggggcagtaccagcccctcattgctagcctgacctgggggttggtgccacttagccaggcgcaggagatcgtaaatcggggcagcgacaccgatgtctggaagaccatcctctcagaagtgcgtttcgtgcatgtcaacaccagtgcagtactgaagctcagcggtgctcacctcccagattgggggtacagacagctggaaatcgtgggggagaaactgagcaggggctaccatggcagtacggtgtggaatgttgaagagcatcgatatggcgcaagtcaggaacagcgggaacgggaacgggagctgcatagccccgcgcaggtggacgtgagtaggaatctgagcttcatggcccgattctccgagctgcaatggcggatgctggcccttagatctgacgactctgagcacaagtatagctcgtctcctttggagtgggtcacgctcgatacaaacatcgcctactggttgcacccgaggacttcagcccagatccatctcctgggaaacatagtcatttgggtgtcgggctccctggccctagccatctacgcactgctcagtctgtggtatctactgcgacggcggcggaacgtccacgatctgccccaagacgcatggctgcgatgggttctagctggggcactgtgcgctggggggtgggctgtaaattacctgccctttttcctgatggaaaagaccttgttcttgtaccactacctgcccgctcttacattccaaatcctgctcttgcccgtcgtccttcagcatattagtgaccatttgtgccgcagccagctgcagagatcaatctttagtgccctcgttgtcgcttggtatagctcggcttgtcacgtatcaaacacgctccgacccctcacatacggtgacaaaagtctgtctccacatgaactgaaggctctgaggtggaaggactcttgggatattctgatccgcaagcattag

SEQ ID NO: 131011 - DNA, 471 bp, Artificial Sequence
  Description of Artificial Sequence: Synthetic coding sequence
atggcataccagatagttttagaactccacttctctcattgtgctgccatgggagctgccctgctgatgctgattgagaatgcactcatcacccagtccagattgatgttactggaaagtgttctcatcttcttcaacctgctggcagtgctcagttacctgaagttcttcaactgccagaagcactcactgcctctatgggcccctcggcccaatcacgtccaatgtctgcccggacaactgcgaggtcgcacaagttctgaccactccgggagcgcaactggtggtggactttgggtgccagggcattccgaagagaggctgtgggaaacttgtgctctgctcgcttctttcccccctggccatttgcctcacgatgtgcgctatgaaaatggccggggatcttcacaccaacagcaggtgacatgttatccattcaaggacgtgaacaactggtggattgtgaaatag

SEQ ID NO: 131012 - DNA, 2244 bp, Artificial Sequence
  Description of Artificial Sequence: Synthetic coding sequence
atgtggggatttctaaaacgtccagtcgtggtaacagctgatatcaatttgagcctggttgcactcaccggcatgggattgctgtcccggctgtggcgccttacataccctagagctgtggtcttcgatgaagtatactatgggcaatacatctccttttatatgaagcagatctttttccttgacgacagtggcccaccctttggccacatggtcttggcattggggggctacctgggcggcttcgacggcaattttttatggaatcggattggggctgaatactcttctaacgtgccggtgtggagcttgcggctcctgccagctcttgcgggggccttatccgtccctatggcctatcagatcgtcctcgaactgcacttttcccactgcgccgccatgggcgcagcactcctgatgcttatcgagaatgccctgatcacccagtccagactgatgcttttagaaagcgttctgatcttctttaaccttctcgcagtgttaagttacctgaagtttttcaactgccagaaacactcacctttctcactgagttggtggttctggcttacactcacgggagtcgcctgctcctgcgctgtgggaatcaaatacatgggcgtgtttacttatgtgctggtgttaggtgtcgccgccgtgcacgcctggcacctcctgggagatcagacactatcaaatgttggagcagacgtgcagtgttgcatgcggccagcgtgcatgggacagatgcagatgagccagggagtttgtgtgttctgccacttgctcgccagagccgtggctctgttggtcattcctgtcgtgttgtacctgctgtttttctatgtccatttgatccttgtctttcgcagtggcccccacgaccagataatgtcttctgctttccaggcatccctcgagggaggcttagccaggattactcaaggccagccacttgaggtcgccttcggatcccaagtgaccctccgtaatgtctttgggaaaccagtgccgtgctggctacattcacaccaggatacatacccaatgatctacgaaaatggaaggggcagctctcatcagcagcaggtgacctgctaccccttcaaagacgtgaacaattggtggatagtaaaggatcctaggcgccaccaactcgttgtgtctagcccgccgagacccgtgcggcacggtgatatggttcaactggtgcatggtatgaccacgaggagtctgaatacacatgacgtagccgcaccactgagtccccacagccaggaggtgtcttgttatattgattacaatatttctatgcccgcccagaacttgtggcgcctggagattgtcaaccgagggagcgacacagatgtgtggaaaactatcttgtccgaggtgagatttgttcatgtgaacacaagtgcggtgctgaaattgtctggggcccaccttcccgattgggggtataggcagttggagattgtaggtgagaaactgtcccggggataccatggctccaccgtgtggaacgtcgaagagcacagatatggtgcttcccaggaacagagggaaagggagagagaactccatagtccagctcaggtagacgtgtccagaaatttaagtttcatggctaggttttccgaattacagtggcggatgttggcactgcgctccgacgattccgagcacaaatattcgtcatccccactggagtgggtgacactcgacacaaacatagcatactggttacacccacggacttctgcgcaaatccatctcctcggtaacatcgtgatatgggtatctgggtccctggctttagctatctacgctctattatcactgtggtatttgcttcggcggagacggaatgtacatgatttaccacaggacgcgtggctgaggtgggtgctggcaggtgcattgtgcgctggtggttgggctgttaactatctgccctttttccttatggagaaaactctatttctttatcactacctgcctgctcttacattccagatcctgctgctgccagtcgtactccagcatatatccgatcatctgtgcaggagtcagttgcagcgcagcatcttctccgcactggtggtcgcctggtacagtagcgcttgccacgtgagtaacactctaaggccacttacttacggggataagagtttaagtccccacgagcttaaagctctgcgttggaaagatagttgggatattttgataaggaaacattag

SEQ ID NO: 131013 - DNA, 2178 bp, Artificial Sequence
  Description of Artificial Sequence: Synthetic coding sequence
atgtgggggttcctaaaaagacctgtcgttgtaacggctgacatcaatctgagtctagtcgctctgacaggaatgggactcctctcacgcctatggagacttacctatcctcgggctgttgtcttcgatgaggtttattacggacagtatatctcattctatatgaagcagattttttttttggatgatagtggtcctccatttggtcacatggtactggctctgggcggctatctgggcggattcgatgggaacttcctttggaaccgtatcggcgccgagtacagcagcaatgtgccagtgtggagcttgcgacttctccctgccttggctggagccctctctgtgccgatggcctatcaaatagtgttggagcttcacttttcacactgtgctgccatgggtgccgccttactgatgcttatcgagaatgcactcattacccagtctcggctgatgttgctagagagcgtgctcatctttttcaacctcttggctgtcctgagctacttgaagtttttcaactgtcagaagcactcccctttctctttgagctggtggttttggttgactttgacaggcgtcgcatgttcttgtgccgtgggcattaaatacatgggggttttcacatacgtcctggtgttgggcgtcgcggctgtccacgcatggcaccttctgggtgaccagaccctgtccaacgtttgtgttttctgccacctgctagcacgagccgtggctttgctggtgatcccagtcgtgctgtacctgctgttcttttacgtgcaccttatactcgtctttcgctctggcccgcatgaccaaatcatgagtagcgctttccaagcatctcttgagggggggctggcacggatcacccagggacagccacttgaagtggcctttggcagccaggtgactttgaggaatgtgtttggcaaacctgttccctgttggctgcactcccaccaggacacctacccgatgatttatgagaatgggcggggaagctcccaccaacaacaggtaacgtgttatcctttcaaggacgttaacaactggtggattgtgaaggatccgaggcggcaccaactcgtggtaagctcacctccacgtcccgtccgtcacggagacatggtgcagctggttcacgggatgactactaggagccttaacacccacgatgtggctgcacccctgtctcctcattcccaagaagttagttgctacatagattacaacatctccatgcccgcccaaaacctgtggcgccttgaaatcgtcaacagaggctccgataccgatgtgtggaagaccatattgtcagaagtgcggtttgtgcacgtcaacaccagcgccgtcctgaaactcagcggggcgcacctgcccgactgggggtaccgccaattggaaattgtaggcgagaagttgtctcggggctatcacggctccacagtgtggaacgtagaagagcacaggtatggtgcatctcaggagcagagagaaagagaacgcgaactgcattccccagcacaggttgacgtgtctcgaaatctgtccttcatggctagattctctgaactgcagtggcggatgcttgccttgcgtagtgatgactcagaacacaaatattctagcagtccactggaatgggtaacattggataccaatatagcttactggttgcaccctcgcacaagtgctcagattcacctgttggggaacatcgtcatctgggttagcggttctctggccttggcgatatacgccctcttatctttatggtacttgctgaggagaagacgcaatgttcacgaccttcctcaagacgcatggctgcggtgggtgttggctggcgccctgtgcgcaggaggttgggcagtgaactatcttccattctttttgatggaaaaaacgctctttctgtatcactatctccccgcactgacgttccagattttacttttgccagtggttcttcagcatatatccgaccacttatgcaggagtcaactgcagcgatctatatttagcgccttggtcgtggcctggtatagtagcgcctgtcacgttagcaacaccctccgccctttaacgtacggcgataaatcattaagcccgcatgaactcaaggccctgcggtggaaggatagctgggacatcctgattagaaagcattag

SEQ ID NO: 131014 - DNA, 1827 bp, Artificial Sequence
  Description of Artificial Sequence: Synthetic coding sequence
atggcttatcagatcgtgctggaactccatttcagccactgtgccgctatgggtgcggccctcctgatgctaatagagaatgccctgattacccagtcccggctgatgctgctcgaaagcgttctcatctttttcaatctgctggctgtgctatcttacctcaagtttttcaactgccagaaacactcccccttttctctctcttggtggttttggctcaccctaacaggggttgcatgctcatgcgctgtgggtattaagtacatgggggtgttcacgtacgtgttggtgctgggtgtagcagcagtgcacgcttggcacttgctgggggaccagactctgagtaatgtgtgcgtgttttgtcatctgcttgcccgagctgtggcattgctggtgattccagtggtactgtatcttcttttcttttacgtccatctcattctggtgtttagatcagggccccatgatcagatcatgtctagtgccttccaggccagcttggaaggggggttggcccggatcacccagggacagcctcttgaggtggcatttggcagtcaggtgactctgagaaacgtgttcgggaagcctgtgccctgttggttgcacagtcaccaggatacctaccccatgatttatgaaaacggacggggctccagtcatcagcagcaggtgacatgctatcccttcaaggatgtgaataactggtggattgtgaaggaccccaggagacaccaactagtagtttcatcaccccccaggcctgtgcgtcacggggacatggtgcagctagtacatggcatgactacccggagtttgaacactcatgacgtggccgcaccactgagcccccactcacaggaggtctcctgctatatcgactacaatatctccatgccagcccagaacttgtggagactggagattgtgaatcggggaagtgacaccgatgtgtggaaaaccatcttatctgaagttcgtttcgtgcacgtgaataccagtgctgtgctcaagctctcaggggcacacctcccagattgggggtaccggcagctcgagatcgtcggagaaaagctaagccgagggtaccatggctctactgtctggaacgtggaagaacaccggtacggtgctagtcaggagcaaagagaacgggagagagaactccactcacctgcccaggtggatgtctctcgaaatctgagctttatggcccgatttagcgaactccagtggaggatgctcgccctgcggagcgatgattcggagcacaaatattcgagctcaccactagaatgggtcaccctggacaccaatatagcctactggttacacccgcgtacaagtgcccagattcatctcctcggcaatattgtgatctgggtgtctgggagtctcgctctcgccatctatgcattattatctctgtggtacttactgaggcggcgtaggaatgtacacgacctgccccaggacgcctggttgcgatgggtgctggccggagcgttgtgcgccggtggttgggcagtaaattatctacctttcttcctcatggagaagactctgtttttatatcactatctccctgccttgacattccagatcctccttctgccagtggtgcttcaacatatctccgatcacctgtgcaggtctcagctccagagatctatcttctctgccctggtggttgcttggtactcaagtgcttgccacgtgtcgaataccctccgccccctcacctacggcgacaaatccctatctccccacgagctcaaggccctgaggtggaaggactcttgggacatacttatccgtaagcattag

SEQ ID NO: 131015 - DNA, 471 bp, Artificial Sequence
  Description of Artificial Sequence: Synthetic coding sequence
atggcctatcagatcgtccttgagctgcatttctctcactgtgctgctatgggtgcggcactgttgatgctgatcgagaatgctctgatcacccagtcaaggctgatgcttcttgagagtgtactgatattctttaacctgctcgcagtactctcttatttaaagttcttcaattgccaaaaacacagcttgcctctgtgggcccccaggccaaatcatgtccagtgtcttcctggacagctgcgtgggaggaccagcagcgaccactccgggagtgccaccggcggcggattgtgggtgcctggtcattctgaagaaagactgtgggagacatgcgctctgctggcctctttcccacctgggcatttgccacatgatgttcggtatgagaatggccgcgggtcttcccatcagcaacaggtgacgtgctatccatttaaagatgtgaacaactggtggatcgtgaagtag

SEQ ID NO: 131016 - DNA, 429 bp, Artificial Sequence
  Description of Artificial Sequence: Synthetic coding sequence
atgtggggtttcctcaagagaccagtggtggtgacggctgacatcaatctgagcttggtagctctcaccgggatgggactgctgtcccgcctctggaggctaacatatccacgcgcagtcgtgtttgatgaagtttattatggacagtacatcagcttttatatgaagcaaatcttctttctcgacgactcaggaccccccttcggtcacatggtgcttgctctaggagggtatctgggcggatttgacgggaacttcctttggaatcgtattggagccgagtacagcagcaatgttcctgtctggtcactgaggctacttcccgccttggccggagctctgagtgtgccaatggcctaccagatcgtactcgagctgcacttcagccactgtgcggccatgggagctgcgctgcttatgttaatctag

SEQ ID NO: 131017 - DNA, 1722 bp, Artificial Sequence
  Description of Artificial Sequence: Synthetic coding sequence
atgctcctggagagtgttttaatattctttaatcttttggctgtgctgtcatacttgaagtttttcaattgtcagaagcactccccattctcactaagctggtggttttggttaactctcaccggcgtcgcctgcagctgtgcagtggggatcaaatacatgggcgtcttcacctatgtgctggttctaggtgttgccgcagtgcatgcatggcacctgctgggggatcagacactgtctaacgtctgcgtgttctgtcatctcctggcccgggctgttgctctgctggtcattccagtggtcctatatctcctcttcttctatgtgcacctcatcttggtgtttcgcagtggtcctcatgatcagatcatgtcgtcggctttccaggccagtctcgagggggggcttgctagaatcacccagggtcagccactagaagttgcctttgggtcccaagtgaccctcaggaacgtcttcggaaagcctgtcccttgctggttgcatagccaccaggacacttaccctatgatttatgaaaatgggagagggtcatcgcaccaacaacaggtgacctgctatccctttaaagatgtgaacaactggtggatagtcaaggatcctcggagacatcagcttgttgtctcttcacctcctcggcccgtccgtcatggcgacatggtgcagctcgtacatggtatgactacaaggagcctcaatactcacgacgtcgcagccccacttagtccccatagtcaagaggtgtcctgctacattgattataacatttcaatgcctgcccagaacctgtggcgtctcgagattgttaaccggggatcagacactgatgtgtggaaaacaatcctcagtgaggtgcggttcgtgcacgtgaatactagcgctgtcctgaagctgtccggagcgcatttgcctgattgggggtaccggcagctggaaatcgtcggtgaaaaactgagcagagggtatcatggcagtaccgtgtggaatgttgaggaacaccgatacggagccagtcaggagcaacgtgagcgagagagggaattgcacagccccgcacaagtggatgtcagtaggaacttgagtttcatggctaggtttagtgagctgcagtggagaatgctggcactcagaagcgacgactcagagcataagtactctagcagcccccttgaatgggtgaccctagatacaaacatagcctactggttacatccaagaacctccgcacagattcacttgctcggcaatatcgtaatctgggtcagcgggagtctcgccctggcaatttatgcccttctgagcctgtggtacctcctcagacgtcgccgaaacgtgcacgatcttccacaggacgcttggctgcgatgggtgctggccggggccctctgtgctgggggttgggcggtcaactaccttcctttttttctaatggagaaaaccctatttctctatcattatctgcccgcgcttacctttcagatcctgctgttgcctgtggtgctgcagcacataagtgatcacctctgtaggtcccagttgcagcgctctattttttcagcccttgtagtcgcttggtactcatcagcatgccacgtatccaacactcttagaccactgacctacggtgacaagtctctgtccccacatgagttgaaagctctgcgatggaaggatagttgggatattttgatccgcaaacattag

SEQ ID NO: 131018 - DNA, 2178 bp, Artificial Sequence
  Description of Artificial Sequence: Synthetic coding sequence
atgtggggttttctgaaaaggcccgtggtggtgactgcggatatcaatctttctctggtggctctcaccggaatgggactgctatcaagactttggagactgacatatccccgcgctgttgtgtttgatgaggtgtattatgggcagtatataagtttttacatgaagcagatcttcttcctcgacgactctggccctcctttcggacacatggttcttgcactcggtggctatctcggcggattcgatgggaactttctgtggaaccgaataggggccgaatactccagtaacgttccggtgtggtctttgcgactattgccagctctcgcaggggccttgagcgtccccatggcctatcagatcgtgctcgagctacacttttcccactgcgcagctatgggagcggcccttctgatgttgattgaaaacgctcttatcactcagagcaggctcatgctcttggagagcgtgttaattttcttcaatcttctcgctgtcctgtcctatctgaaattctttaactgccagaagcattccccattctcactgtcttggtggttttggctcaccctaacgggcgtggcttgcagctgtgcagtgggcatcaagtacatgggagtcttcacatatgtccttgtacttggcgtggctgctgtacatgcatggcacctgctaggcgaccagacgctatctaacgtgtgtgtgttctgtcatttactagccagggctgtggcactgctcgtcattccggtggtactgtatctgctgtttttctatgttcacctcattcttgttttccgaagcggtccccatgaccagatcatgagctcggcgtttcaggcttccctggagggaggtctcgctagaataacccaggggcagccgctggaagtggcattcggcagccaagtgaccctaagaaacgtctttgggaaaccggtgccatgttggcttcattcacatcaggacacctacccaatgatttacgaaaatggaagaggtagttcccaccagcagcaggtgacatgttatcccttcaaggatgtgaataactggtggatcgtaaaagaccctcggcggcatcagctggtcgtgtccagtcctccccgacccgtgcgccacggcgacatggtacagctggtacacggaatgaccacaaggtctcttaatacccacgatgtggccgcgcccctctctccgcactcacaggaggtttcatgctatattgactacaacatttctatgcccgcacagaacctttggcggctcgagattgtcaatagaggctcagacactgacgtatggaagactatcctttcggaggtcagatttgtacacgttaatacctccgcagttctcaagctgtccggagcacatttgcccgattggggctaccgacaattggaaatagtgggggagaaattaagccgggggtaccacggatccacagtatggaatgtcgaagaacacaggtatggagcgagtcaagagcaaagagaaagagagagggaactgcactccccagcgcaagtagatgttagcaggaatctgagttttatggcacgcttctccgagctccagtggcgtatgctagctctgcggagcgacgacagcgaacacaagtactccagcagtccacttgagtgggtcacgctggatacgaacatagcatactggctgcacccccggactagcgcccagatacacctgctcggtaatattgtgatctgggtgagtggaagtctcgccctggctatttacgctctactcagcctttggtacctactgcgcagaagaagaaatgtccacgatctaccacaagatgcttggttgcgatgggtcctggcaggtgctctgtgcgcaggcggatgggcagtcaactacctcccgtttttcctgatggagaaaacgctttttctgtatcactacttaccagccttaactttccagatcttgctgctacccgtggtcctccagcatatttctgaccacctgtgtaggagtcagcttcagcgctccatattctccgcgctcgtagtggcttggtattccagtgcatgtcatgtgtccaacaccctccgaccactcacttacggcgacaagtcactgtcaccgcacgagctgaaggctctgcgatggaaggacagctgggatattctaatccgcaaacattag

SEQ ID NO: 131019 - DNA, 507 bp, Artificial Sequence
  Description of Artificial Sequence: Synthetic coding sequence
atggcctatcaaattgttctcgagcttcatttctctcattgcgccgctatgggggctgccctcctgatgcttattgaaaatgctttgataactcagagccggctcatgctgctggagagcgttctgatattttttaatctgttggctgtgctcagctatttgaagttctttaattgccaaaaacattcacccttttcactttcatggtggttttggttgacactgaccggcgtggcgtgctcctgtgccgtgggtataaagtatatgggggtgtttacatatgtcttagtactcggagtggctgccgtgcacgcatggcacctattgggagatcagacacttagtaacgtctgcgtgttttgccaccttctggccagagcagtggccctcttggtgattcctgtagtgctgtatttgctgtttttctatgttcacttaatattggtcttccgctctggtccccacgaccagattatgtcctccgcattccaggcatctttggaatag

SEQ ID NO: 131020 - DNA, 894 bp, Artificial Sequence
  Description of Artificial Sequence: Synthetic coding sequence
atggcatatcagatcgtgctggagctgcacttttcccactgcgccgctatgggcgccgccctcttaatgctcattgaaaacgccctcatcacacagtctaggctgatgttgctggaatctgtgttgatcttctttaacttgttggccgtgctgtcgtacctgaaattctttaactgtcagaaacactccccgtttagtcttagctggtggttctggctcaccttgacgggggtcgcttgctcgtgcgctgttggtatcaagtacatgggagtattcacttatgttctggtactgggagtggccgcagtacatgcgtggcatctactgggtgatcagaccctgagcaacgtgggagcagacgtccagtgctgtatgcggcccgcctgcatgggtcaaatgcaaatgagtcagggcgtatgtgtgttttgccacctgttggcccgcgccgtggcactcctggtaatacccgttgtcctctacctgctcttcttttacgtccatttaatattggtcttccgttccggacctcacgaccagatcatgtcttccgcgtttcaggccagccttgagggcgggttggcccgcatcacgcagggtcaacccctagaggtggcttttggtagtcaggtcacactgaggaacgtgtttggcaaacctgtcccctgctggcttcactcacaccaggacacctacccgatgatttatgagaatggccgggggtcttcccatcagcagcaggttacatgttatccttttaaggacgtcaacaactggtggattgtcaaggatccacggcgccatcagttggtcgtctctagcccaccacgccctgtccgccatggcgatatggtacagctcgtacacggcatgaccacaaggtcgcttaacacatag

SEQ ID NO: 131021 - DNA, 657 bp, Artificial Sequence
  Description of Artificial Sequence: Synthetic coding sequence
atgaagcaaatattctttctggatgactcgggccccccttttggacatatggtgctggccttggggggatacctgggaggtttcgatggcaactttttatggaaccgcattggagcagagtactcatcaaatgtgcctgtatggagtctccgattgcttcccgctctagcgggagcactctctgttcccatggcttatcagattgtgctggagttacacttcagtcactgcgccgcaatgggagcagccctgctgatgctgattgagaatgccctgatcactcagagtcgccttatgctcctcgaatctgtgcttatctttttcaatctgctggcagtgcttagttaccttaagttcttcaactgccagaagcattctcctttttcgctctcttggtggttttggctgacgctgacaggggtagcctgttcgtgtgccgtgggtattaagtatatgggcgtgttcacatacgtgctggtactaggagtggcagctgttcatgcgtggcatctgttaggtgatcagaccctgagtaatgtgggcgcagatgtacagtgctgcatgagacctgcgtgtatgggacaaatgcagatgtctcagggtgtatgtgtgttctgtcacctgcttgctcgggccgttgccctcctagtgatatag

SEQ ID NO: 131022 - DNA, 1398 bp, Artificial Sequence
  Description of Artificial Sequence: Synthetic coding sequence
atggcaatcttttgtggcaccgagctggagcaggtgtgcgtattttgtcacctgttagcaagggccgtggcgctgctggtgattccagtggtcctctacctattgtttttttatgttcatttgatcctagtcttccggagcggcccccacgaccaaatcatgagctccgcctttcaggcaagccttgaaggcggtctggcacgcatcacccaaggtcagcctctggaagtggcttttgggtcacaggtgaccctcaggaacgtgtttggaaaacccgtgccctgttggttgcatagtcaccaggatacctatcctatgatttacgagaacggccgcggatcttcacaccagcaacaggtgacttgctatcccttcaaagatgttaataattggtggatcgtaaaagaccctcgtcggcaccagttggttgtgtcctccccacctaggccagtcagacacggcgacatggtgcagttagtccatgggatgaccacaagatccctgaatacgcacgacgtggcagcgcccctaagcccacactcccaggaggtcagttgttacatagactataacatttccatgccagcccagaatttgtggcgtctagagatagtgaaccgaggctcagataccgacgtctggaaaactatactttcggaggtgagatttgtgcatgtgaatacgtctgctgtgctcaaacttagcggcgcccatctcccggactggggttaccgccagctggaaatcgtgggggaaaaactgtcacgcggctatcacgggtctactgtgtggaatgtggaggaacatagatacggagccagccaggagcagagagagcgcgagagagagctgcattcccccgcccaagtcgatgtcagccgtaatctttcttttatggccaggttcagcgaactgcaggcccagattcacctactgggcaacatcgtcatctgggtgtctggttcactggccctcgctatttatgccttgctgtccctctggtatcttctgcggagaagaagaaacgtgcacgacctgcctcaggacgcctggctcaggtgggttctcgccggcgctctctgtgctgggggatgggcggtaaactatttaccttttttcctgatggaaaagaccctatttctttatcattatctgccagcactcaccttccagatcttgctgctgcccgtggtcctgcagcacataagtgaccatctctgcagatcacagctccaaagaagcatcttctctgcactggtggtggcctggtactcatcggcatgccacgtgtcgaacaccctgaggcctctgacatacggagataagtcgctgtctccccatgaattaaaagctctccgatggaaagactcttgggatatcctcattaggaagcattag

SEQ ID NO: 131023 - DNA, 2253 bp, Artificial Sequence
  Description of Artificial Sequence: Synthetic coding sequence
atgcctcccgcaacaggaggcggtttggctgagagcgagctgcggcctcgaagaggccgctgcggacctcaagccgctagagctgcgggacgtgacgtggccgcggaagcagtcgcacgcagccctaagcgtccagcctggggcagtcgccggtttgaagctgtgggatggtgggctctcttggccttggtgacccttctctctttcgccacaagattccaccgccttgacgaacccccacacatttgctgggacgaaacacatttcgggaagatgggttcctattatatcaaccgtaccttcttttttgacgttcacccccccctgggtaaaatgctgattggtttggccggatacctatctggctacgacggcacctttttgtttcagaaacctggggacaagtacgagcaccactcatacatgggaatgagaggcttctgcgccttcctggggagctggcttgtccccttcgcttacctgaccgtgctcgacctgtctaagagtctctctgccgcgctgttaactgctgctcttcttaccttcgatactggatgcttgaccctgtcacagtatatcctgttagaccctatcctgatgttctttatcatggcagctatgctgagcatggtaaagtacaatagctgcgcggatagacctttttccgcaccctggtggttctggctgtccttgaccggtgtttccttagccggcgcgctgggggttaaattcgtgggcctatttatcatactgcaggtcggcctcaatacgatcgctgatctctggtacctgtttggagacctgtcccttagcctggtcaccgtgggcaaacatctaaccgcccgcgtactctgcttgattgtgctcccactggcattgtacacagccacttttgcggttcatttcatggtactgagcaagtcagggccaggagatggtttttttagctcagcatttcaggcgcgtctctccggtaataacctgcataacgcatccatccctgagcacctcgcttacggcagcgtgatcacagtgaaaaaccttcggatggccatcggatatctgcatagccatagacacctgtatccagagggcataggcgccagacagcagcaagtgaccacttatttgcataaggactataacaatctgtggattataaagaaacacaatacgaatagtgacccgcttgacccctccttccccgtcgaattcgtcagacacggcgatatcatcaggttggaacataaagagaccagccgaaatcttcattcccactatcatgaggcaccaatgactcgcaaacattatcaggtcactgggtacgggattaatggaaccggtgattccaatgacttctggaggatagaagtagttaatcggaagttcggcaaccgaatcaaggtgctacggtccaggatccggttcattcacctggtgacaggatgtgtgttaggctctagcgggaaggttctgcccaaatggggttgggagcagcttgaggtcacttgcactccatacctgaaggaaacgctgaattctatctggaatgtagaagaccacataaaccccaaacttcctaacatctccctggacgtccttcagccttcattccctgaaattctccttgaatcccacatggtgatgattcggggcaactccggtttaaaacccaaagacaacgagtttacaagtaagccgtggcactggcccatcaactaccaggggctcaggtttagtggggtcaacgacactgactttcgagtctacctactgggcaatccagttgtctggtggctgaacctcctctctatcgccctgtacctcttaagcggcagtataatcgccgtcgctatgcagagaggggctcgactgccagccgaagtggcagggctatcgcaggtgctgttaaggggcggcggtcaagtgcttctaggctggaccctgcattatttccctttcttcctgatgggcagagtgctgtactttcaccactattttcccgctatgctgttctcctcaatgctcactggcatcctgtgggatactctacttaggctgtgtgcatgggggctcgcatcctggccgctcgcaagggggatacacgtcgcaggcatcctaagtctgctactcggcacagcctattccttttatctcttccaccccctggcttacggaatggtgggaccgttggcccaagaccctcaatctcccatggccggcctgcgttggctcgactcttgggatttctag

SEQ ID NO: 131024 - DNA, 669 bp, Artificial Sequence
  Description of Artificial Sequence: Synthetic coding sequence
atgaaactgccactcctcctcgccctactgtttggagccgtgagtgcactgcatttacggtctgaaacctccaccttcgaaaccccactgggggccaagacactccccgaggacgaggagacaccagagcaggaaatggaggagactccatgccgggagcttgaggaggaggaggagtggggatcaggctcagaggacgcctccaagaaggacggggccgtggaatctatttcagttcctgacatggtcgacaagaaccttacgtgcccagaggaggaggacaccgtgaaggtagttgggatcccgggatgccagacttgcagatatctccttgtccgctccctacagaccttttcccaggcttggtttacctgtcgaaggtgctatcgcggtaacctcgtaagtatccacaattttaatatcaattatcggatccagtgcagtgtctccgcactgaatcagggacaggtttggatcggggggcggatcactgggtctggacgatgcagacgatttcaatgggtagatggaagccgatggaacttcgcctactgggcggcgcaccagccttggagccgtggagggcactgtgtagcgctgtgtacccgcggcggccactggcgcagagcacattgcctccgccggttgcccttcatctgctcatattag

SEQ ID NO: 131025 - DNA, 669 bp, Artificial Sequence
  Description of Artificial Sequence: Synthetic coding sequence
atgaagttgcccctcttactggcactcctctttggggcagtttccgctctgcatctgagaagtgagacatccactttcgaaaccccactgggagccaaaaccttgccagaggatgaagagacgccagaacaggagatggaggagaccccatgtagagaactcgaagaggaggaagaatggggttccggcagcgaggatgcgtcgaaaaaagacggggccgtggaaagtatttctgtccccgacatggtcgacaagaacttgacgtgccccgaggaggaagataccgtgaaggtggtgggcattccaggttgccaaacctgcagatatttactggtgcgcagccttcagacttttagtcaagcatggtttacctgtagacgttgctaccggggcaacctcgtttccatccataacttcaatattaactataggattcaatgttccgtgtccgcacttaatcaggggcaggtttggatcggtggaagaatcaccggatccggacgttgccgccgatttcagtgggtggacgggtcccggtggaacttcgcctattgggccgcccatcagccctggtcacggggagggcactgcgttgcgctctgcactcgcggtggacactggcggagagctcactgccttaggcggctgcctttcatctgcagctactag

SEQ ID NO: 131026 - DNA, 636 bp, Artificial Sequence
  Description of Artificial Sequence: Synthetic coding sequence
atgaaattgcccctcctgttggccctgctgttcggtgctgtgtcagccttgcacttgcggagcgaaacatccacctttgaaacccccttaggggccaagaccctgcccgaggacgaagaaactcccgaacaggaaatggaggagacaccctgccgtgaactggaagaggaagaggagtggggttctggctctgaggatgcctcaaaaaaagatggtgctgtggaatctatcagtgttccagatatggtggataaaaacctcacatgtcctgaggaggaggatactgtgaaggtggtgggaatcccaggctgtcagacctgtcgttatttgctctttacctgtaggcgatgctacagagggaatcttgtgagcatccataacttcaacatcaactataggatccagtgctcagtcagtgcactgaaccaaggccaggtatggatcggaggaagaatcactggatccggcagatgcaggagattccagtgggtggatggctcccggtggaacttcgcttattgggctgcacaccaaccctggtcgcgagggggccactgtgtcgctctctgcaccaggggcggtcactggcgccgcgcccactgtctgcgaagactcccatttatttgcagctactag

SEQ ID NO: 131027 - DNA, 678 bp, Artificial Sequence
  Description of Artificial Sequence: Synthetic coding sequence
atgcagtgtctgcttctactcccgtttcttctgctcgggaccgttagcgcattgcacctcgagaatgatgccccccacttggagagcctcgaaacccaggcagatcttggacaggacctggatagcagtaaggagcaggagagggacctcgccttaacagaagaagtgatccaggctgaaggagaggaggtcaaagccagtgcgtgtcaggacaactttgaagacgaagaggccatggagtccgaccccgccgccttggacaaagattttcagtgtccaagggaagaggacatcgtcgaggttcaaggctctccacgatgtaagatatgcagatacctgctagttcggacaccgaaaacgttcgctgaagcccaaaacgtctgcagccggtgctacggagggaacctcgtctccattcatgactttaatttcaactaccgaatacagtgctgcacatccacagtaaatcaagcgcaagtctggatcggaggtaatcttagagggtggtttctttggaagcggttctgttggacagacgggtcacattggaactttgcctactggtcgccgggacagcctggtaatgggcagggtagctgcgtggctctctgtactaaagggggatactggcgaagggcccagtgtgataaacagcttcctttcgtctgctccttctag

SEQ ID NO: 131028 - DNA, 4092 bp, Artificial Sequence
  Description of Artificial Sequence: Synthetic coding sequence
atggcctggaaaacactgcctatctacctgttacttctgctctcagtctttgtgatccagcaagtgtctagccaggaattatcgtgcaagggaagatgttttgagagtttcgagcgcggaagagagtgcgactgcgacgcacagtgtaagaagtatgataaatgttgtcccgactacgagtcattctgcgctgaggttcacaatccgaccagcccgccaagttctaagaaagccccgcctccaagtggcgcctctcaaactattaagtcaactactaagagaagtcctaaacccccaaacaaaaagaaaaccaaaaaggttattgaatccgaggagatcaccgaggaacactctgtgtccgagaatcaggaatcatcaagttcctcctcttcctcctcttcatcctccacaatcaggaaaatcaaatcatcaaagaatagtgcagccaatcgtgaattgcagaagaaactgaaagtgaaagataataagaagaacagaactaaaaaaaagccaacccctaaacctcctgtggtggacgaagccggctcgggattggataatggggattttaaggtcacaacccccgatacgagcacaacccagcacaacaaggtaagtacctctccgaaaattacaacggcaaagcccatcaacccgaggccaagtctgccccctaatagtgatacatccaaggaaacctctttgaccgtgaataaggagacaacagtggagaccaaagagacaactacaaccaataagcagacctctactgatggcaaggaaaaaacaacctctgcaaaagagactcagtcaatagaaaagacttccgctaaagacctcgcccccacctctaaggttctggccaagccaacaccaaaagctgaaactaccacaaaggggccagctttaactaccccgaaagagcccacccccaccacgcctaaagaacccgcaagtacgaccccaaaagaacctacacctacaacaatcaagagcgctcctacgactcccaaagagccggcccctacaactaccaaatccgccccaacgacacccaaagaacctgccccaacgactaccaaggagcccgcaccaactaccccaaaggaacctgccccaactactacaaaagaaccagcacccaccacaacaaagagcgcgcccactactccaaaggaacccgcgcccacgacccctaaaaaacccgcccctaccaccccaaaggaaccggcgcccacgactcccaaagagccgacccccactacaccaaaggaaccagctcctacaaccaaggagcccgctcctacaacaccaaaagagccggcccccacagcccccaaaaagccagctcctacgacaccaaaagagcccgcccccacaacccccaaggagcccgcccccaccaccaccaaggaaccatcacctactacacctaaagagccagcaccgactaccacgaaatccgccccaacgactaccaaagagcctgcccccactacgactaagagcgctccaaccacaccaaaagagccttcccccaccactactaaggaaccggcccctaccacaccaaaagaaccagcccccactacacctaaaaaaccagcacctactacgcctaaagagccagcccccacaactccaaaggaacctgctccaacgacaacgaagaagccggcaccaactacccccaaggaacccgccccgaccacgcctaaagaaaccgcaccaacaactcccaaaaagctcacgcctaccacaccagagaaactggctcccaccactcccgagaaaccagctcctaccacgcccgaagaactcgccccaacaacacccgaggaacccacgcctacgacgccagaagaacctgcacccaccactcccaaggccgcagcccccaacacacccaaggagcccgccccaactacacccaaagaacctgctcctactacacctaaagaacctgctccaaccacgcccaaagaaacagctcctacaaccccaaaaggtaccgctccaacgacattgaaggaacccgcccctactacacccaagaagcccgcacccaaagagctggccccaacgacaacaaaggaaccgacttccacgacatgtgataagcccgcaccaactacccctaaaggcactgcacccacaacgccaaaggagcccgcacctacaacaccaaaggaacctgcaccgacaacacccaaggggacagcaccaacaactctaaaggaaccagcccctactactcccaaaaagcccgccccgaaggaacttgctccgacaaccacaaaaggccccacgagcacaacatccgataagcccgcaccaacaaccccaaaagagaccgcgcccaccacccccaaagaacctgcacccacaacccctaagaagccggctccaactacaccggaaactcctcccccgaccacctctgaggtttcaaccccaacaactaccaaagagccgacgactattcacaaatcaccggacgagtctaccccagagttaagcgcagagcctacccctaaagctctggagaatagccccaaagaaccgggagtccccacaacaaagactcccgcagccaccaaaccagagatgacgaccacggccaaggataaaacaacagagcgagaccttagaacgacccctgaaaccacgaccgctgcccccaagatgacaaaggagaccgccacaacgacagagaagaccactgagagtaaaattaccgccaccaccacccaagtgacttcaactacaacacaagataccacccctttcaagatcacaaccctgaaaacgaccactctcgccccgaaggtcactacaacaaaaaaaaccatcaccacaactgaaattatgaacaaaccggaggaaacagccaaacccaaagatcgagcaaccaactccaaagccactacgccgaagcctcaaaagcctacgaaagcccccaagaagcccaccagcacgaaaaaacccaagacaatgccaagagtgagaaaaccgaagaccactccaactccaagaaagatgaccagcaccatgccagagctgaaccctacctcaaggattgctgaggccatgctgcaaaccactaccaggcccaaccagacccctaactccaagctcgtagaggtgaatcccaagagcgaggatgctggcggagccgagggcgagactccccatatgttattgcggccccatgtgttcatgcctgaagtgacacctgatatggattatcttccccgggttcctaatcaagggatcattatcaacccaatgctgtccgacgagaccaacatctgcaatggcaaaccagtagacggcctcaccactctgagaaatggaaccctcgttgccttcaggggacactacttttggatgttaagtccattctcaccaccctccccagctcgcagaatcaccgaggtgtggggaatcccatcccccatagataccgttttcacaagatgcaattgcgagggaaagacgttctttttcaaggactcccaatactggcgattcactaacgatatcaaggatgccggataccccaaaccaatcttcaagggttttggtggcttgacagggcaaatcgtggctgctctgagcactgccaagtataagaattggcctgaatctgtgtacttctttaagagggggggcagcattcagcaatatatttataaacaagaacctgttcagaaatgccccggcagacgcccagcactgaactaccccgtatacggcgagacaactcaggtgcgaaggcgcaggttcgagagggccatagggccgagccaaactcacaccatcaggatacagtacagtccagcaaggctcgcgtaccaggataagggagtgctccataatgaagtgaaagtgtccatcttgtggaggggactacctaatgtggtgacctctgccatctcattgcccaacatcaggaaaccagatggttacgactactacgcctttagcaaggatcagtactacaacatagacgtgccgagcagaaccgccagagcaatcaccacacgatctgggcaaaccctgagtaaggtatggtacaactgcccatag

SEQ ID NO: 131029 - DNA, 2802 bp, Artificial Sequence
  Description of Artificial Sequence: Synthetic coding sequence
atggcctggaagacactccctatttacctgcttttgctgctgagcgtgttcgtgatccagcaagtgagctcgcaggaattaagctgcaagggccgctgtttcgagtcatttgagcggggccgggagtgcgattgcgacgcccagtgtaagaagtatgacaagtgttgccccgactacgagtcattctgcgccgaagtccacaacccaacctcaccccccagctccaagaaggcgccacctccatccggcgcgagccagacaattaagagtaccactaagcgctccccaaaacctccaaacaaaaaaaaaaccaaaaaagtgatcgaaagcgaggagattaccgaggaacattctgtaagcgagaatcaagagtcctctagtagcagctccagcagttccagtagtagtacgatacgaaaaatcaaatcatctaagaactcagcggctaaccgggaactacagaaaaagctcaaggtgaaagacaacaaaaaaaacagaactaagaagaaacccactccgaaacctcctgtggttgacgaggcgggaagtggactcgataacggagacttcaaagtaactacaccagacacatccaccacgcaacataacaaagtttctacatcgcctaaaatcacaacagctaaacccattaacccaagaccatcgcttccgccgaattcagatacatctaaggagaccagcttaaccgtaaataaggagactacagtggaaacgaaagagaccacaaccacaaataaacagaccagcacggacgggaaggaaaagacgacgtcagctaaggagacgcagtccatcgaaaaaacaagcgctaaggacttggcccccactagtaaggttttagccaagccgacaccgaaagctgaaaccactacgaagggccccgctctgaccacacctaaggaacccacacccactactccgaaagagcctgcttccacgactccaaaagagcccacaccaaccacaatcaaaagcgctcccaccacccctaaagaacctgcaccaacaactacaaaaagcgcccccaccacccccaaggagcccgccccaaccacgacaaaagagccagctcccactacaccgaaaaaacccgcccccacaactcctgaaacacctccacctactacttccgaagtgagcaccccgactaccactaaggagcctactacaatccataaaagccctgacgagagtactcccgagttgtctgctgaacccacacccaaggctctagagaattcaccgaaggaaccgggggtgcctactaccaagacccctgctgcaaccaagcctgaaatgaccaccaccgccaaggacaagacaacagagagagacctccggaccactcctgagactacgacagcggcccctaaaatgaccaaagagaccgccacgacaaccgagaaaaccacagaaagtaagatcaccgcgaccactactcaggtaacttcaacaactactcaagacactacgcccttcaaaatcactaccctgaaaacaaccacgctggctccgaaggtgactactactaaaaaaacaataacaaccactgaaattatgaataaacccgaagagactgctaaacccaaagacagagctaccaattccaaagccaccacgcctaagccgcagaagccaactaaagcccctaagaagcctacttcaacaaagaaaccaaagacgatgccccgcgtccgaaagccaaagactacccctaccccacgcaagatgacatcaactatgccagaactcaacccgactagtcgcattgccgaggccatgctgcagactacaacccgtcccaaccagacaccaaatagtaaactggtggaagttaatccaaaatctgaagacgcagggggtgccgaaggcgagacaccacatatgcttctgcgccctcacgtgtttatgccagaagtgacacctgacatggactacctcccacgggtgcctaaccagggtatcattattaacccaatgttatcggacgagaccaatatatgcaacggaaagccagtggacggcctcactaccctcagaaatggcactctcgtggccttccggggacattatttttggatgcttagccctttttctcccccgtcacccgcccgtagaattacagaagtgtggggcatcccatcaccaatcgacacagtgtttaccagatgcaattgcgaaggaaaaactttcttcttcaaggacagccagtactggcggtttacaaacgatataaaggacgccggttatccaaagcctatctttaagggcttcggtggactcaccggccagatagttgccgccctctctacagccaagtataaaaattggcccgaatcagtctatttttttaagcgcgggggcagcatacagcaatatatctacaaacaggaacccgtacagaagtgtcctggccggaggcccgcactcaactacccagtctatggggagactactcaggtgaggaggcggaggttcgagagagccattggcccaagtcaaacacatacaatccggattcagtattccccagcgagactagcgtaccaggacaaaggagtccttcataacgaggtaaaagtaagcatcttgtggcggggactgcctaatgtcgtgacctccgctattagcctgcccaacattcgaaaacccgatgggtacgactactacgcattttccaaggaccagtattacaatatcgacgtgccatcacgtacggcccgcgcaatcaccacgagaagcgggcagacgctgtcaaaggtctggtacaactgtccctag

SEQ ID NO: 131030 - DNA, 3936 bp, Artificial Sequence
  Description of Artificial Sequence: Synthetic coding sequence
atggcttggaaaacattaccgatctaccttctgcttctgctgagcgtcttcgtgattcagcaggtgtcatcccaggacctgtcctcgtgcgcgggtcgttgtggcgaaggctactctcgggacgccacgtgcaattgcgactacaattgccagcattacatggaatgttgccccgactttaagagagtatgtacagcagagctgtcttgcaagggacgctgcttcgagagtttcgagcgagggagagagtgcgactgcgatgctcaatgtaagaagtacgataagtgctgtccagactacgagtccttttgcgccgaggtgaaagacaataaaaagaatcggacgaaaaaaaagccaacccctaaaccccctgtcgttgacgaggccggctcagggctggataatggtgactttaaggttacaacccccgacacctcaaccacccagcataacaaagtgtctacctcccctaagataacgacagcgaagcctatcaacccccgacctagcttgccacccaactccgacacgtcgaaggagacctccttgaccgtgaataaggagacgacagtcgagactaaggagactaccactaccaataaacagactagtaccgatggcaaagaaaaaaccacctctgccaaggagactcaaagcatcgaaaaaacttctgcaaaggatttggctcctacctccaaggtgctagccaagcctacacctaaagctgaaaccaccaccaagggccccgctctaacaacgcccaaggaacccaccccaacaacccctaaggagccagctagcacaacaccaaaagagccaacccccacaactatcaaatcagcgcccaccactcctaaagaacccgcccctaccacgacaaaatcagcgccaacgacaccaaaagaaccggccccaacaaccacgaaagaaccagccccaaccacgccaaaagagccagccccgactacaactaaagagccggcgcccacgacaaccaaatcggcccctacaacaccaaaagaaccagcacctacaaccccgaaaaagcccgcccccacaacccctaaggagcccgcgcccacaacccccaaggagccaacaccaacaacacccaaagagcctgcccctacgaccaaggaacccgctcccacgacacctaaagaaccagctccaacggctcctaaaaaaccagcccctaccacgcccaaggagccagcacctacaaccccaaaggaacccgcacctaccaccactaaggaaccatcaccaaccactcccaaggagcctgctccaacaaccaccaaaagcgcccccaccaccactaaagagccagccccaacaactactaaatctgcgcctactacgcccaaagaacccagccccactactactaaagagccagctcccactacgccaaaggagccggctcccaccacacccaaaaagcccgcaccaaccacgcctaaggagccggcccctactacgccaaaggaacctgctccaacgacaactaaaaagcccgctccaacaactccaaaggagcctgcaccaacaactcccaaggagacagccccaactacgcctaagaagttgactcctacaactcccgagaaactggctccaactactcccgagaaaccggcccctacgactcccgaggagctggcacctacaactcctgaggaacctacccccacaacccctgaggagcccgcaccgacaactccgaaagccgccgctccaaatacacctaaagaacctgccccaaccactcccaaagagcccgcccctaccaccccaaaggagccggctcccaccacccctaaagagacagccccgaccactcccaagggaactgcccccaccaccctcaaggaaccagcccccacaactcctaagaaacccgcccccaaagagctcgcgcccacaacaactaaagagccaacaagcactacatgtgacaagccggcgccgacaacacccaagggcactgccccgaccacccctaaggagcccgcccctactacgccgaaggagcccgcacccaccaccccaaaagggacagcaccaaccactctaaaggaaccagctcctaccacacctaaaaagccggcccctaaggaactcgctccaaccactacaaagggacccactagcacgacatctgacaagcctgcccctaccacaccaaaagagaccgcccctacgacaccaaaagagccagcccccacaactcccaagaagcctgctccaactacccccgaaacccctcctcctactacctctgaggtgtccacaccgactacaactaaagagcctacgacgattcacaagtctccagatgaatccacgcccgagctgtccgccgaacctacaccgaaggcactggaaaatagtccgaaagaacctggggtccccacgaccaagacccctgcggccacaaagccagagatgaccaccactgcaaaggacaagactacagaaagagacctccgtaccacgcctgaaactactaccgctgctccaaagatgaccaaagaaacagccactacaacagagaaaactaccgaatccaaaattaccgctacaacaacacaggttacttctacaaccacccaagatactacccccttcaagattacaactttaaaaacaacaacccttgcccccaaggtgacaaccactaagaaaacaattacaactaccgaaatcatgaataaaccggaagagactgccaagcctaaggatcgtgccaccaactctaaggcaaccacccccaaaccccagaagcccacaaaggccccaaaaaaaccaacatccactaagaaaccaaagactatgccgcgtgtgcggaaaccaaagaccactcctactccacgcaaaatgacctcaactatgcccgaactgaatccaacctcacgcatcgccgaggccatgctccagacaactacgagacctaaccaaacccccaatagtaaactggtggaggtgaatcccaagagtgaagacgccggaggcgctgaaggtgaaacccctcacatgttgctgagacctcatgtgtttatgccagaagtgactcccgatatggattatttaccacgagtacctaaccaaggcatcataattaatcctatgttgagcgacgagactaacatttgcaacggaaagcctgtggatggcctgacaacattgagaaatggaactctggtcgcgtttagaggccactatttctggatgctctcaccgttttccccacccagccccgccaggagaatcacagaggtgtggggtatccccagcccaattgacactgtgtttactcggtgtaactgtgaagggaaaacctttttcttcaaggatagccagtattggaggttcactaacgatatcaaagacgccggttatccaaaaccaatcttcaagggctttggcggcttaactggacagatcgtcgccgccctctccactgccaaatacaaaaattggcctgagtccgtgtactttttcaagagaggtggtagcattcagcagtatatttacaagcaggagcctgtccagaaatgtccaggtaggcggcctgcactgaactatcctgtctacggagagacgacccaggtgcgacgccgaaggtttgaaagagcaatcggcccttcacagacccatactatacgaatccaatacagcccagcccggctagcttaccaagataagggcgtcctccacaatgaggtgaaagtctctatactctggaggggtcttcccaatgttgtaacatccgcgatctccttacccaacatccgaaagcctgatggttatgattactatgccttcagcaaagatcagtactacaacatcgacgtgccgagtagaacagcacgcgctattacaactcgctccggccagacattgtcgaaggtgtggtacaactgcccatag

SEQ ID NO: 131031 - DNA, 4086 bp, Artificial Sequence
  Description of Artificial Sequence: Synthetic coding sequence
atggcttggaaaaccctccccatctacctcctcctgctcctgtccgttttcgttattcaacaggtcagctcccaggacctcagcagctgcgctggccgctgcggagaaggttacagccgcgacgcgacatgtaactgtgactataattgccagcactacatggaatgctgccctgatttcaagagggtgtgcacagccgagttatcctgtaagggccggtgctttgagtccttcgagcgaggccgagagtgcgattgtgatgcccagtgcaaaaaatatgataagtgttgtccagactatgaatccttctgtgctgaggtacacaacccaacctccccccccagttctaaaaaggccccaccacccagcggcgcaagtcagaccatcaagtccactaccaagcgaagtcccaagcccccaaataaaaaaaagaccaagaaggtgatcgagtctgaggagatcactgaggtcaaagacaataaaaaaaacagaactaagaaaaaaccaacaccaaaaccgcctgtggtcgacgaagcagggagcgggttggacaatggcgactttaaagtgaccactcccgacacatccactacccagcacaacaaggtgtccacttcaccaaagatcacaaccgccaagcccattaaccccagaccatcccttccacccaacagcgatacaagcaaagagacctctttaaccgtcaataaagaaaccacggttgaaacaaaggaaaccaccacaaccaacaagcaaacttccaccgacggtaaagaaaagacgacatctgctaaggagactcagtctattgagaagactagtgcaaaagatttagccccaacgtccaaggttctggccaaacccacccccaaggcggaaactacaactaagggacccgcgctgaccacccccaaagagccaactccgactacgcccaaagaacccgcctccacgaccccaaaggagcctacacccacgaccataaaatccgcgcctacaaccccaaaagaacctgcacctactacaaccaagagtgcgccaaccaccccaaaggaacctgcccctaccactaccaaagagcctgctcccaccacgcccaaagagcccgcccccacaaccacaaaggagcctgcacctacaacgactaaaagcgccccaaccacaccaaaggagccagcccccaccaccccaaagaaacccgccccgacaaccccgaaagagcccgcacctactaccccaaaagagccgacccctacgacccccaaagaaccagcacccactacaaaggagcccgctccgaccacaccgaaggaacctgcccccacggcccccaagaaaccagccccaacaactcctaaagagccagcacccacgacacccaaagagccagcgccaaccacaactaaggaaccgtccccgaccactccaaaggaaccagcccccacaacgaccaaaagcgcccccaccaccaccaaggagcccgctccgactactaccaagtctgccccgactacccctaaggaaccttccccaaccactaccaaggagcccgcccccactacccccaaggagcccgcccccacaacacccaagaagcctgcacctaccacccctaaggaaccagctccgactactccaaaagagccagcgccaactaccacaaagaagccagctcccaccacgcccaaagagccggcccccacaaccccgaaagagacggcacccacgacccctaaaaagctgacccccactactcctgaaaaactagctccaactactcctgaaaagccagcaccgacaaccccggaagaattagccccaactacccccgaggaaccaactcctacaaccccggaggagcccgcaccaacgacccctaaagctgctgcccctaatacaccaaaggaacccgcacctacaacaccaaaagaaccagcccccaccacacccaaagagcctgcacccacaacccctaaggagaccgcccccaccacccctaagggaactgctccaacaactttaaaagaacccgccccaacgacacctaaaaagccagctccaaaggagcttgctccaaccaccaccaaagaaccgacatcaaccacctgtgacaaacctgcccccaccaccccaaagggtacagcgcccactactccgaaggagcccgccccaaccacccctaaagaacctgcgccaacaacaccaaaggggacagcacctactactctgaaggagcctgcacccactacacccaaaaagccagcccccaaggagctcgcgcccaccacaactaaagggcctacatctaccacatcagataaacccgctccaactacacccaaggaaaccgcccccacgacccctaaagagcccgccccaacaacccccaagaagcctgccccaacaacccctgaaacccctcctcctaccacgagcgaagtatctacccccacgacaacaaaagagcctacgacgatccataagtctccggatgagtccacaccagagttgagcgccgagccaactccaaaggctctggaaaactcccccaaagagcccggggtgccaacaacaaagactccagccgccaccaagccagagatgactaccacagccaaggataaaacaactgagagagacctccgcacgactcctgagactacaactgcggctcctaagatgacgaaagaaaccgctactaccaccgaaaagacaaccgaaagcaaaattacggcaactaccacacaggtgacatccactacaacacaggatacaacccccttcaagataactactctgaaaacaactaccctcgcccccaaggtcacgacgacaaaaaaaaccatcacgacgacagagattatgaataagccggaggaaaccgctaagccaaaagaccgggccacaaacagtaaggcgaccactcccaagccccagaagccgaccaaagcccctaagaaacccacgtctactaagaagccgaaaaccatgcctcgcgttcggaagccaaagacaacacctacccctcggaaaatgaccagtaccatgcctgaactcaaccccacaagtagaattgccgaggcgatgctgcaaaccacaactcgacccaaccagacccctaatagcaagcttgtcgaagtgaacccaaaatcagaagatgctgggggagcagaaggagaaacgccccatatgctgctccgcccacacgtattcatgccagaagtgacccccgacatggactatttgccaagggtcccaaatcaagggatcataattaatccaatgcttagcgatgagaccaatatttgtaacgggaagcctgtagacgggcttactaccctgaggaatggaactctggtcgccttccgcggccactacttctggatgctgtctccattttcccctccatcacccgcaagaagaattaccgaagtatgggggatccccagcccaatagataccgtgttcacccgttgcaactgtgaagggaagactttcttctttaaagattctcagtactggcgcttcactaatgatatcaaggatgccggctatccaaagccaatctttaagggttttgggggcttaacaggccagatagtggccgcactgtctacagccaagtacaaaaattggcctgagtccgtgtacttctttaagcggggcggttccatccagcagtatatttacaaacaggagccggtgcagaaatgtccaggacggagaccggcactaaattacccagtgtatggcgagacgacacaggtgcggcgtaggaggttcgagagagctattggtccaagtcagacacacacaatccgcatccaatacagtcctgcccggttggcctaccaagacaagggagttcttcacaacgaagtgaaagtgagcattctgtggagaggactgcccaatgtggtaactagcgcaatcagcctgcctaatattcgcaagcccgacggttacgattattatgccttcagtaaggaccagtattacaatatagatgtcccctctagaaccgctcgcgctatcaccacaagatctgggcaaacattgagtaaggtttggtataattgtccgtag

SEQ ID NO: 131032 - DNA, 4215 bp, Artificial Sequence
  Description of Artificial Sequence: Synthetic coding sequence
atggcctggaaaactcttcctatttacctgctgctcctcttatctgtcttcgtgatccagcaagtgtcctctcaagatctgtcctcctgtgccggtaggtgcggagaaggatatagcagggacgcaacttgtaattgcgattacaactgtcagcactatatggagtgttgccccgatttcaaacgggtatgtactgcagagctgagctgcaaaggtcgatgctttgagtcttttgagaggggcagagaatgcgattgcgatgcccagtgtaaaaaatacgacaagtgttgtccagattacgagagtttttgtgccgaagtccataatcccactagcccacctagctctaaaaaagctccccccccaagcggggcttcacagactattaaaagcacaacaaagaggtcccccaaacctccgaacaagaaaaagactaaaaaggttatcgagtcggaggagatcacggaggaacacagcgtgagtgaaaaccaagaatcatcgagctccagttctagcagtagttcttcaagtaccattagaaagattaaaagcagtaagaacagtgccgccaatagggagctccaaaaaaagctcaaggtgaaagacaacaagaaaaaccgaactaaaaagaagccaacccccaagcctcccgtggtagatgaggcggggtcaggcctggacaacggggattttaaggtcacaacccctgatacttctacaacccaacacaataaggttagcactagtccaaaaataaccactgccaagccaataaatcctcgtccgtcacttccaccgaatagtgacacatcaaaggaaacctcgctgaccgttaacaaggaaaccaccgtcgagactaaagagaccaccacgacgaataagcagacgtcaaccgatggcaaggagaaaactacaagtgctaaggaaactcagagtatagagaaaactagcgccaaggacctggcaccaacaagcaaggtgttagctaagcctacacctaaggccgagaccaccacgaagggacccgcccttacaacccctaaggagcctacgcccaccacgccaaaggagccagcttctaccacaccaaaggagccaacgcccacgaccatcaagtccgccccgaccactcctaaggaacccgccccaacaacaaccaagtctgcacctactacacccaaagagccagcgccgaccacaacgaaagagccagcacctacaacacccaaggagcccgcacctacaactaccaaagagccggccccgaccacgaccaagtccgccccaactacaccaaaggagccagctcctaccaccccaaagaaacccgcccccaccactccaaaagagccagcaccaaccacacctaaagagcctacccccactacccccaaggaacctgcccccacaactaaggaacccgcccctactaccccgaaagaaccagcacccacggcccccaagaagccggcaccgactactccgaaagaacccgcacccaccacaccaaaagaaccagccccgactacaactaaggagcccagcccaaccacacctaaggagcctgcccccacgactacaaaatcagctcctacaacaaccaaggagcccgcaccaacaaccaccaagtctgcaccgaccacacctaaggaaccgtctcctaccactactaaggagcccgctcctacgacacctaaggagcccgcgccgaccactcccaagaaacctgctcccacaacacctaaggagccggcccccaccactccaaaagagccagcacccaccacaacaaaaaaacccgcccctaccactcccaaagagcccgccccgacaacaccaaaggaaacagcgccaaccacacccaaaaagctcactccaacaacgcctgaaaagcttgcaccgactacccccgaaaagccagctcccacgacacctgaggaactcgcacctaccaccccggaagagccaacccctaccacacctgaggaaccagcgcctaccacgcctaaggcggccgcccccaacacacctaaggaaccggctccgacaaccccgaaagaacctgctccaacgactcctaaggagccagcaccaacaactccaaaggagacggcaccaaccactcccaagggaactgctcctactacactcaaggaacctgccccaactactccgaaaaaaccagcccccaaagagctcgccccgacaacaactaaggaaccgacttcaaccacctgtgataaaccggccccaacgacacccaagggcactgcgcccacgacgccaaaagaacctgccccgacaacgcccaaagagcccgcaccaacaacacccaagggaacagcacccactacactgaaggaacccgctcccactactcctaaaaagcctgccccgaaggaattagctcccaccaccaccaagggtccaacatcgaccacgtctgacaaacccgcccccacgacccccaaagagacagctcctaccactcctaaagagccagcccctaccacacccaagaaacccgctcccactacaccggagaccccgcccccaacaacaagcgaagtaagtacccccaccaccaccaaggaacctactactatccacaaatccccagacgagtctacccctgaattaagtgcggaaccaacaccgaaagcgctggagaatagcccgaaggagcctggtgtcccaaccactaaaacccccgcagctacaaagcccgagatgactactacagccaaggataagaccaccgaaagggacctcaggactacacccgagacaaccaccgccgcccctaagatgacgaaagagacggccaccaccacagagaaaactacagagtcaaagatcaccgcaacaacgacccaggttacttctacaacaacacaggatactaccccatttaagattaccacactcaaaaccaccaccctcgcacccaaagtgacaactactaagaaaaccattacaactactgaaatcatgaacaagcccgaggaaactgcaaaaccaaaagacagagctaccaatagcaaggcaactaccccaaagcctcagaaacctactaaggctccgaaaaaaccaacatcgaccaagaagcccaagacgatgcctagagtgaggaagcccaagactacacctactcctcggaaaatgacctcaaccatgccagaattgaatcctacttcccgaattgcggaggctatgctccagacgacaaccagacctaaccaaacacccaactcaaaattggttgaggtaaaccccaagtccgaggatgcaggcggtgctgagggggaaacaccccatatgttactccgaccccatgttttcatgcctgaagtaactcccgacatggactacctccctagggtgccaaatcaaggtattataatcaatcccatgctgagcgacgagacaaacatctgcaatggcaagcctgtggatgggcttacaacgttgaggaatggtacactagtagccttcagaggacattacttttggatgctcagcccatttagcccacccagtcctgccagacgaattactgaagtctgggggattccgtcgccaatcgacacagtgttcactcgctgtaattgcgagggaaagaccttcttctttaaagactcccagtactggcgattcaccaatgacataaaggacgccggatatcctaagccaatctttaagggatttggtggcctgaccggacaaattgttgcagctcttagcacagccaagtacaagaactggcccgagagtgtgtatttctttaaaagaggagggagtattcaacagtatatctacaagcaagagccagtacaaaaatgtcctggaaggaggcccgccctcaattaccccgtgtacggcgaaacaacacaggtgcgacgtagaaggttcgaacgcgccatcggccccagtcagacccacaccatccggatacagtactctcctgccaggttggcataccaggataagggagttttgcacaatgaggtcaaggtgtcaatcctgtggagaggccttcccaatgtcgtgacatccgctattagcctaccaaatatccgcaaacctgatggttatgattattacgccttttccaaggatcagtattacaacatcgacgttcccagtagaactgcccgggcaatcactacacgatcaggacagaccctttcaaaggtatggtataactgtccctag

SEQ ID NO: 131033 - DNA, 834 bp, Artificial Sequence
  Description of Artificial Sequence: Synthetic coding sequence
atgggcctcctagaatgttgcgcacggtgtttagtgggagccccatttgcaagcctggtagcaacgggcctgtgtttttttggtgtggcccttttctgcgggtgcggtcacgaggcattgactggaacggaaaaacttatagagacttactttagcaaaaactaccaggattatgaatacctcatcaatgtgatccatgcgtttcagtacgtgatctatggcaccgccagttttttcttcctttatggtgccttgttactcgccgagggattttacaccaccggagccgtgcgacagatttttggcgactacaagacgaccatttgcgggaagggactttcagccactgttaccggcggccaaaaggggagaggctctcgcggtcagcatcaagcgcattcgctggagagggtctgtcactgcttgggcaagtggctcggacaccctgacaagtttgtcggtattacgtacgccctcactgttgtatggctcctggttttcgcctgcagtgcagtgccagtgtacatatacttcaatacttggaccacctgtcagagcattgcctttccctcaaaaacatcggcgtctattggttccttgtgcgccgatgccagaatgtacggagtgctgccctggaacgcattcccaggaaaggtgtgcggcagcaatctgctgtctatctgcaagacagccgagtttcagatgaccttccacctgttcatcgctgcctttgtgggggccgcggccactctggttagcctgctgactttcatgatcgccgcaacctacaactttgctgtgctgaaactaatggggcgaggtacgaaattctag

SEQ ID NO: 131034 - DNA, 729 bp, Artificial Sequence
  Description of Artificial Sequence: Synthetic coding sequence
atgggcctcttagaatgttgcgctaggtgcctcgtgggcgcccccttcgcctcacttgttgcgactgggctttgtttcttcggcgtcgccttattctgcggatgtgggcatgaggcactaaccggtactgaaaaactgatcgaaacctatttcagcaagaattatcaggactatgagtatcttattaatgttatccatgcttttcagtacgtaatctatggcacggcttcattcttcttcctttacggtgccctacttcttgcagagggcttttacacaaccggggccgtgcggcagattttcggcgactataaaacaaccatttgtggtaagggactgtccgccactttcgtgggtattacctatgctctcaccgtagtgtggttactggtgttcgcgtgcagtgcggtgccggtatacatctatttcaacacttggacaacctgtcaaagcattgctttccctagtaaaactagcgccagtatcggaagtctctgcgctgacgctaggatgtacggagtcttgccatggaacgctttccccggaaaggtgtgtggctccaatctgctttccatttgtaagactgccgagttccagatgaccttccacctgttcattgctgcatttgtaggagctgcagctacgttggtgtccttgctgacattcatgatcgccgccacctataattttgctgtgctcaaactcatgggtcgcggaactaaattctag

SEQ ID NO: 131035 - DNA, 834 bp, Artificial Sequence
  Description of Artificial Sequence: Synthetic coding sequence
atgggcctcctggagtgctgcgctcgttgtttagtgggtgccccgttcgcatctctcgtggcgacaggcttatgctttttcggcgtggcgcttttctgcggatgtgggcacgaggcactcactggaactgagaaacttattgagacatatttcagcaagaactatcaagactacgaatatttgatcaatgtgattcacgccttccaatacgtgatatacgggacggcctctttcttcttcctctacggtgcactattactggccgagggtttttacacaactggcgccgtcaggcagatttttggtgattataaaacgaccatctgtgggaagggacttagcgccaccgtgactggcgggcagaaaggacggggatcccgagggcagcatcaggctcactcgctcgagagagtttgtcactgtttagggaagtggctgggccacccagataagtttgtgggcatcacatacgctctcaccgtagtgtggctgttagtgtttgcctgttcggcggtaccggtgtacatttactttaacacctggaccacatgccagtccatcgcatttccaagcaagacgtccgccagcattggaagtctgtgcgctgacgcgaggatgtacggggtgttaccttggaatgcatttcctggaaaagtgtgtggcagcaatctactcagtatctgcaaaaccgcggagtttcaaatgacctttcatctctttatcgcggcgttcgtgggcgctgctgccactctggtttcgttactgaccttcatgatcgcagctacctataattttgccgtcctcaagctgatgggaaggggcactaaattttag

SEQ ID NO: 131036 - DNA, 384 bp, Artificial Sequence
  Description of Artificial Sequence: Synthetic coding sequence
atgggattactggagtgctgtgctaggtgcttagtcggcgcacccttcgcttccctggtagcaaccggactttgctttttcggcgtggccctgttctgcggctgtggtcatgaggccctaacgggaaccgagaaattaattgaaacttatttctcaaagaactaccaggactatgaatatctgatcaatgtgattcacgcttttcagtatgttatctatgggaccgcaagcttcttcttcctgtacggcgccctgctccttgccgaaggattttatacaacaggagccgtgcgacagatctttggcgactataagacgaccatatgcggtaagggcctatcagctactgtcaccggcggccagaaaggccgaggcagccgatag

SEQ ID NO: 131037 - DNA, 768 bp, Artificial Sequence
  Description of Artificial Sequence: Synthetic coding sequence
atgggattgctggagtgttgcgccaggtgcctggtgggagccccattcgcaagtctggtagctacaggactatgcttttttggagtcgctctcttttgtggatgcgggcacgaggctctcactggaactgagaaactgattgaaacctatttttcaaaaaattaccaggattatgagtacctaattaatgtgatccacgctttccaatacgtcatctacggaaccgcctccttcttcttcctctacggggcactccttctcgccgagggcttttacacaactggcgcggtgcgacagaaggggcggggttctaggggacagcaccaagctcactctctggagcgagtttgtcattgcctcggcaaatggcttggccacccggataaattcgtcggtataacttatgccctgacagtggtatggttattggtgtttgcatgcagtgcggtaccggtgtatatttactttaacacgtggacgacgtgccaatccatcgcattcccatccaaaacgtctgcgtcaatcggcagcctctgcgcagatgccaggatgtacggcgtgctgccatggaacgcctttcccggcaaagtgtgtggctctaatctgctttcaatttgcaagacggcagagttccagatgacttttcacctattcatcgccgcctttgtcggagcggctgctaccctggtttctcttctgactttcatgatcgccgccacttacaattttgctgtgcttaagctgatggggagaggcaccaagttctag

SEQ ID NO: 131038 - DNA, 414 bp, Artificial Sequence
  Description of Artificial Sequence: Synthetic coding sequence
atgggattgcttgaatgttgcgcacgttgtttggttggcgcgcctttcgcttctttagtcgctaccggtctgtgcttttttggagtcgctttgttttgtggctgtgggcacgaagccctgacaggtacagaaaagctgattgagacttacttcagcaaaaattatcaagattatgagtacctaattaacgtgatacatgccttccagtacgtcatctacggcaccgccagctttttcttcctgtacggggccctgctgctggcggaagggttttataccacaggagccgtgcgtcagatctttggagattacaaaacaaccatctgtgggaaaggactgagcgccacggttacgggcggccagaaaggcagagggagtagaggtcaacatcaggcccattctctcgagagatag

SEQ ID NO: 131039 - DNA, 303 bp, Artificial Sequence
  Description of Artificial Sequence: Synthetic coding sequence
atgggattactggaatgctgcgcccgttgtctcgtgggggcgccttttgcaagcctggtggcgacaggtttatgtttcttcggcgtggccttgttttgtggctgcggccacgaggccctcactggcacggaaaagctgatagaaacttacttttccaaaaattaccaagactatgaatatctgatcaacgttatacatgcattccagtacgtgatttacggcacagccagcttcttcttcctatacggggccctcttacttgccgaaggattttatactactggggcagtgcggcagatctag

SEQ ID NO: 131040 - DNA, 372 bp, Artificial Sequence
  Description of Artificial Sequence: Synthetic coding sequence
atgggcttactggaatgttgtgcgaggtgtttagtgggcgcccccttcgctagcctggtcgctacaggcctatgcttttttggcgtggctctgttctgcggatgtggccatgaggcactcacaggcacagaaaagctgatagagacatatttttccaaaaactatcaggactacgaatacctcatcaatgtgatccatgctttccagtacgtgatttacggaactgcatcgttcttcttcctgtatggagccctcctgctcgcggagggcttctatacaaccggagccgtgcgacagatttttggcgattataagacaaccatatgcgggaaaggattatctgctacggtcaccgggggccagaaaggctag

SEQ ID NO: 131041 - DNA, 339 bp, Artificial Sequence
  Description of Artificial Sequence: Synthetic coding sequence
atgggcttgctcgaatgctgcgcaaggtgtctggtcggtgccccctttgcttccctggtcgctacgggcctttgtttctttggggtagccctgttctgcggttgtggccacgaagctctcactgggacagagaagctgattgaaacgtatttctccaagaactaccaggactacgaatacctgatcaacgtgattcacgcattccagtacgttatttacgggactgcatccttcttctttctttacggagccctgctgctggcagagggcttctataccactggcgctgtgagacaaatctttggagactacaaaaccacaatttgcggaaaggggtag

SEQ ID NO: 131042 - DNA, 411 bp, Artificial Sequence
  Description of Artificial Sequence: Synthetic coding sequence
atggggctgctcgagtgttgcgcaaggtgtttagtcggcgccccgtttgcatccctggtcgcaactggcctatgtttctttggcgtggcattgttttgtggttgcggccacgaggcgctgactggcaccgaaaagctgatagagacatatttttctaagaactaccaagattacgagtacctcatcaatgttatacacgcctttcaatatgtaatctacggcactgctagcttttttttcctgtatggcgcactgttgctggccgagggattttataccacgggcgcggtgcgccagattttcggggattacaagacaaccatctgtgggaaaggtttgagtgccaccgtaaccgggggtcagaaaggccgggggtccaggggccagcaccaggcccatagtttggagtag

SEQ ID NO: 131043 - DNA, 438 bp, Artificial Sequence
  Description of Artificial Sequence: Synthetic coding sequence
atggctgattctgaacggctgagcgcccccggctgttgggcagcgtgtaccaattttagtcggactcggaaggggatcttgttgttcgctgagattatcctgtgcctagtgatactgatatgtttttccgcctctacgccggggtatagttcactttccgtaatcgaaatgattctcgcggccatcttcttcgtggtgtacatgtgcgacctgcacacaaaaattccattcattaattggccgtggagcgacttctttaggacattgatagccgccatcctgtacctaatcacatcaatcgtcgttctggtggagaggggaaaccacagtaaaatcgtggccggagtgaaggcgatgggagccgcgcttaaacatcgagccaaaggcctacgctctcagggtccgtttcttccgcttctcttagctgaaatcgtatag

SEQ ID NO: 131044 - DNA, 459 bp, Artificial Sequence
  Description of Artificial Sequence: Synthetic coding sequence
atggcagacagtgagcggttgtcagcgcccgggtgttgggctgcttgcaccaacttctctaggactcgtaagggtatcctgctgttcgccgaaattatcctctgtctggttatcctcatctgtttttcagctagtacccctggctactcatcactatcagtgattgagatgattctggctgctatctttttcgtcgtctacatgtgcgacctgcataccaaaatcccattcatcaactggccttggtcagacttttttcgcacccttatcgccgccatcttgtacctcatcacaagcatagtggtgttagtggaaaggggcaatcattctaagatagttgccggcgtactggggcttatcgcaacgtgcctgttcggttacgacgcctatgtcacgttccccgtgcgtcaacccagacatactgccgcgccaacagacccggcagacggtcctgtctag

SEQ ID NO: 131045 - DNA, 336 bp, Artificial Sequence
  Description of Artificial Sequence: Synthetic coding sequence
atgtctgacgccgcagttgacacatcatccgaaatcactaccaaagatttaaaagaaaagaaggaggtggtggaagaggcggaaaacggaagggacgcccctgcaaatggcaacgcggagaacgaggagaatggggagcaggaggcggataacgaggtggatgaagaagaagaagagggcggggaggaggaggaagaagaagaagagggcgacggtgaggaggaagacggcgatgaggacgaggaggccgagtctgcaactggaaaaagagcagcagaagatgatgaggatgatgacgtggacaccaaaaagcagaagaccgacgaggacgattag

SEQ ID NO: 131046 - DNA, 408 bp, Artificial Sequence
  Description of Artificial Sequence: Synthetic coding sequence
atgcagacatttggacccgcaggtgtggcagcagtcggacgtcgggtggagtcgccggctgacaggcgggccactcgcgcctgccactgtaagctctgccttccagccggaagtctacaagggcttaagggagaagagggtagcgttgaggaggcagaaaatgggcgtgatgcacccgctaatgggaacgcaaatgaggagaacggtgagcaggaggccgataacgaggttgatgaggaagaagaagaaggaggagaagaggaagaggaagaagaggaaggcgatggggaggaggaagacggggatgaagatgaggaggctgaatcagctacgggcaagagggctgccgaggatgacgaggacgacgacgtggacactaaaaaacaaaagaccgacgaggacgattag

SEQ ID NO: 131047 - DNA, 333 bp, Artificial Sequence
  Description of Artificial Sequence: Synthetic coding sequence
atgtcggatgcagccgtcgacacctcaagcgaaattacaactaaggatctgaaagagaaaaaagaggttgtagaggaagctgagaatgggagagacgcccctgctaacgggaacgctaacgaggaaaacggcgagcaggaggcagacaatgaagttgatgaggaagaagaagaaggcggtgaggaagaggaggaagaagaggagggggatggggaagaagaggatggcgacgaagacgaggaggctgagagtgcaacaggaaagagggccgccgaggatgacgaggatgatgacgttgacacgaagaagcagaagacagatgaagatgactag

SEQ ID NO: 131048 - DNA, 3714 bp, Artificial Sequence
  Description of Artificial Sequence: Synthetic coding sequence
atggactctggagccgggggacgcagatgtcccgaagcggctctgctgattctgggcccaccgaggatggaacatttgaggcacagtcctggccctggcggccagagattgctgctgccctccatgctgctcgctctcctgctcctgctggccccctctcccggccatgctacaagggtcgtttacaaggtgcccgaagagcagccccccaatactctgataggcagtttagccgctgattacggctttcccgacgtgggacacctgtacaaactggaggtcggcgccccctacctacgcgttgacggcaaaaccggggatatttttacgactgagacttctatcgaccgggaagggctgcgggaatgccaaaaccaactgcccggtgacccatgcatcctggagttcgaggttagcatcactgatcttgttcaaaatggaagcccaagactgctagaaggccaaatagaagtacaggacatcaatgataacacaccaaacttcgctagtcccgtcatcaccctggctataccagaaaatactaacattggaagcctttttcccatccctctcgcatcagaccgagatgccggacccaacggtgttgcctcttacgagctgcaggcaggaccagaggcacaagagttatttggcctgcaggtggcagaagatcaggaagaaaaacagccccagttgatagtcatgggtaatctggaccgagaaaggtgggactcctatgatctgacaatcaaagttcaggacgggggatcaccccctagggcctccagtgcgctgctgcgtgtaacggtgctggatacaaacgataatgccccaaaattcgagagacccagctacgaggcagagctcagtgagaactcgccaattgggcattcggtgatccaggtgaaagccaacgattccgatcaaggcgcaaacgcggagattgagtacaccttccaccaggcccccgaggtcgttcgaagattactccggcttgatcgcaatacgggattgatcacagtccaaggacccgtcgaccgcgaagatctatctactttacgcttctcagttctggccaaagaccgtggcaccaaccccaagagtgcacgtgcacaggtcgtcgttacagtgaaggatatgaatgataacgcacccactatcgaaatccgcgggattggcctcgtgacacaccaagatggaatggccaacattagcgaggacgtggccgaagaaaccgcagtggccctggtccaagtgtccgatagggacgaaggtgaaaatgcagccgtgacatgcgtcgtggcaggtgacgtgccatttcagctgcgccaggcctcggagacaggcagcgatagtaagaagaagtatttcctccagactacaaccccattagattatgagaaagtgaaggactacacaattgagatagtcgccgttgactccggcaaccctccgctctccagtacaaatagtcttaaggtgcaggtcgtggacgtaaatgacaacgcacccgtgttcactcagtctgtgaccgaggtcgcattccccgagaacaacaagccaggggaggtgatcgctgagatcaccgcctccgatgctgactcaggctctaacgccgagcttgtctactcactcgaaccagagcccgcagcaaaggggctattcactatctcgcctgagaccggagagatacaggtgaaaacgagcctggaccgggaacaaagggagtcatacgagctgaaggttgtcgcggcagaccggggtagccctagcctacaaggcaccgccacagtgctagtgaatgtgctggactgtaatgacaacgacccaaaattcatgctgagtgggtataacttttcagttatggaaaatatgcctgccctctcaccagtgggaatggtcaccgtgattgatggggacaagggtgagaatgcacaggtacaactgtcggtagaacaggacaacggcgatttcgttattcagaatggcacgggcaccattctgtctagcttgagttttgacagggaacagcagagcacttatacctttcagctcaaggccgtagacggtggggttcccccgaggtccgcatacgtaggtgtgacaataaacgtgttagacgagaatgataacgccccttacattaccgcacccagcaacacttcccataaattactcacccctcaaacccgccttggagagacagtgtcccaagttgctgctgaggacttcgactcaggcgtcaatgccgagctcatctacagtatcgcgggagggaacccttatgggttgtttcagatcggctctcacagtggcgcaatcactttagagaaggaaatcgagaggagacaccatgggctgcacaggttggtggtcaaggtttcagatcgtggtaagccaccccgatacggcacagcgctggtgcacctatacgtgaatgaaacacttgcgaatcgaaccctgttggagacgttgctgggccactcattagacacccccctggatattgacatcgcaggcgaccctgaatacgaaagaagtaaacagcgggggaatatcctgtttggagtcgtggccggcgttgtggccgtggctctgttgattgccctggccgtgttagtgaggtactgcagacaaagggaggctaaatccggctaccaagcgggcaaaaaggaaactaaggacttatatgcgcccaaacctagcggaaaagccagcaagggcaataaatcaaaggggaagaaaagtaagagcccaaagcccgtgaagccagtggaggacgaggacgaggcaggcctgcagaagagtcttaagttcaaccttatgtcagacgcccctggtgattccccccgaatccacctgccactgaattatcctccaggttccccagacctcggcagacattatcgtagcaattctccgttgccctcaattcagctgcagccccagagtccgtcagcctccaagaaacaccaggtggtgcaggatctccccccagccaataccttcgtggggaccggcgacaccacatccacaggctccgagcagtattctgactacagctacagaacaaaccccccaaaatatccatctaaacaactgccgcaccgacgagttacgttttcagccacatcccaagcccaggaactgcaggatcccagccagcacagttattacgatagcggactggaagaatcagaaactccctccagcaaatcttcgtccgggcccagactgggcccgctggcactgccagaagaccactatgagcgcactaccccagacgggagcataggtgaaatggagcacccagaaaacgatctcagacctttgccggatgttgccatgaccggcacctgtaccagggagtgcagtgagtttgggcactccgacacctgctggatgccagggcagtcatcaccttcccgtcgcaccaagtcctcagccctaaagttgtcaacattcgtgccctaccaagacagaggcggccaggaacccgctggagcgggatctccttcaccaccagaagaccggaatacaaagacggctcccgttcgcttgctgccttcttattcagcattttcccatagcagccatgatagctgcaaagacagtgccactctggaggagataccgcttacgcaaacaagcgactttccccctgctgccactccggcaagcgcacagactgccaaaagagaaatttacttatag

SEQ ID NO: 131049 - DNA, 3183 bp, Artificial Sequence
  Description of Artificial Sequence: Synthetic coding sequence
atggacagcggagctggcggaagaaggtgcccagaggctgctctcttaattcttggccccccaagaatggaacatctgcgccactcacccggccccggtggtcagcgactgctgctgccgagcatgctgcttgcactgttgttactgttggcaccttctccgggacatgctacaagagtcgtctacaaggtgccagaggaacagcccccaaacactctgattggatccttggccgccgactatgggtttcccgatgttggacacctctataagttggaagtgggagccccgtaccttcgagtggacggcaagacgggcgacattttcacaaccgaaacaagcattgaccgggaaggcctcagggagtgccaaaatcagctacccggagacccctgcatcctggagtttgaggtcagtatcacagatttggtgcagaacgggtctccgcgcctgctggagggccagattgaggtccaagacatcaatgacaacaccccaaacttcgctagccctgtcattaccctcgcaattccagaaaacactaacattggttccctctttccaatcccactggctagtgaccgcgatgcaggtcctaacggcgttgcctcttatgagctgcaggcgggccccgaggcacaggagttatttggtttgcaagtggctgaggatcaagaggagaaacagcctcagctaatagtcatggggaatctggatcgggaaaggtgggattcatacgacttaaccattaaggtgcaggatgggggttctcctccacgcgcttcatctgcacttctccgcgtgactgtactggataccaatgacaatgctcctaagtttgagcgacccagttatgaagctgagctttcagagaacagccctatcggacacagcgtgatccaggtgaaggcaaacgattctgaccagggcgccaacgcagagatcgaatacacattccaccaggcaccggaagtggtgagaagactgttacgccttgaccgtaacacaggcctgattactgtgcaaggcccggtcgacagagaagacctatctactctccggttttcagtgctagcaaaggaccgcggcactaaccctaaatctgctcgagcacaggtggtggtcacggtaaaagacatgaacgacaatgcccctacaatcgagatacgtgggatcggccttgtgacgcaccaggatgggatggctaatatcagcgaggacgtagctgaggagacggccgttgcattggtgcaggtcagtgacagggacgagggtgagaacgcagccgtgacctgcgttgttgccggggacgttccgttccagctgaggcaggccagcgaaactggaagcgacagtaaaaagaagtacttcctgcagactacaacgcccctggactatgagaaggtcaaagattataccattgagattgtggcagttgactctggaaaccctccactgtcctccaccaattcgctgaaggtacaggtggtggacgtcaatgataatgccccagttttcactcagtccgtgacagaagtggccttcccagaaaataataaaccaggagaggtaatagccgagatcactgcctctgatgctgattcgggatccaacgccgaactggtctattctctggagcccgaacccgcagctaaagggctgtttaccatttcacccgagacaggagaaattcaggtgaagacttcacttgaccgagagcaacgggaaagctatgagttaaaggtggtcgcggccgatcgcggatctcccagtctacaggggactgccacagtactggtgaatgttctggattgcaacgacaacgatcccaaattcatgctgtctggctacaacttttccgtgatggagaacatgcccgcactgtccccggttgggatggtcacggtcatcgacggcgacaaaggggagaatgcccaggttcaactaagcgtagagcaggataacggagacttcgtcatacagaatgggacagggacaatcctttctagtttaagtttcgatcgcgagcaacagagtacgtacacatttcagttaaaagccgtggacgggggcgtgccacctcgctctgcatacgtgggtgttacaattaacgtccttgacgaaaacgataatgccccttacattactgcaccctccaacaccagtcacaagctgctcaccccccagactcgtctgggagagaccgtgtcccaggtggccgccgaagactttgactctggggtaaacgccgagttaatctactccatcgccggtggcaacccctatggcttgtttcaaatcggttctcactcgggagccattacactagaaaaggagatcgagcgacggcatcacggattgcataggttagtagtgaaggtatcggaccgcggaaagccgccccgttatggcaccgcactggttcatctatacgtcaatgagacactggctaatcggacgctgctggaaactctgttgggccactccctggatacccccctcgacattgacattgcgggagatcccgagtatgaacgctccaagcaaaggggtaacatcctgtttggggtggtcgctggggtcgtggccgtggctctgctcattgctctggcagttctggtgagatattgccgtcaacgcgaagcgaagagcggatatcaggcaggcaagaaagaaaccaaagacctctatgcccctaagcccagtggtaaggcatcgaaaggcaacaaaagtaagggcaagaagagcaagagtccaaagccggtaaaaccagtcgaggatgaagatgaagctggccttcagaaaagtctgaagttcaacctcatgtctgacgccccaggagactcccccaggatccacctgcccctgaactacccccctggcagtcccgacctcggccggcactataggtccaatagcccgctgccttctatccagctacagccccaaagtccaagcgcctcgaagaaacatcaagttgtgcaggacttgccccccgccaacacatttgttggcacgggggacactacttcaacaggtagcgagcaatactcggattatagctataggactaacccgccgaagtatccaagtaaacaggtgggacaacctttccagctgtccacacctcaacctctgcctcacccttaccacggggccatctggacggaggtgtgggagtag

SEQ ID NO: 131050 - DNA, 3147 bp, Artificial Sequence
  Description of Artificial Sequence: Synthetic coding sequence
atggactccggagctggtggacgcagatgccccgaagcggctctgctgatcttgggtcctcccaggatggaacacttgcgacatagtccggggcctggcggccagcggctcctcctcccatccatgctactggccctgctcctcctgcttgccccttctccaggacatgccactagagtggtgtacaaggtgcccgaggaacagcctccaaacacattgatcggctcactggctgcggattatggctttccagacgtgggccacctgtataaacttgaggttggagccccttatctaagagttgatggaaagaccggggatatctttacaaccgagacgtcgatcgatagggaaggactccgcgagtgccagaatcagcttcccggcgatccttgcatcctggagtttgaggtgtctattacggacctggtccaaaacggtagtccgaggctgttagagggccagatcgaggtgcaagacatcaatgataatactcccaattttgcctcaccagtgatcacactcgccatccctgaaaacactaatatcggctctctttttcctatccctctcgctagtgaccgcgatgccggtcccaacggtgtggcatcctatgagctgcaggttgcagaagaccaggaggagaagcagcctcaactgattgtgatgggaaacctcgacagagagagatgggattcttacgacctgaccattaaggtacaggatggggggagtccacccagggcttccagcgcactgctgagagtgactgttctggatactaatgacaatgcacctaagtttgagagaccatcgtacgaggctgagctttctgagaatagtcctattgggcacagtgttatccaggtgaaggccaacgactcggaccagggagccaatgctgagattgaatacacattccatcaggcgcccgaagtcgtgcggaggctgctgcggctcgatcggaacacaggtcttatcacagtgcaggggccagtggatcgagaggatctcagtacactgcggttctccgtactcgcaaaggaccgcgggaccaatcctaaaagcgctcgcgcccaggtcgtggtgaccgtcaaggatatgaatgacaacgcacccacaatcgaaatacgtggcataggcctcgttactcaccaggatggcatggccaatattagtgaagacgttgccgaggagacggccgtggcattggtgcaggtgagtgacagagacgagggcgagaacgcagctgtgacatgcgtggtggcgggtgatgttccttttcagctcagacaagcttctgagaccggttcagacagtaagaaaaaatatttcctacagaccaccacacccctggactatgaaaaggtgaaagattataccatcgagattgtggcggttgactccggaaaccctcctctgtcaagtactaacagtctcaaagtacaggttgtcgatgtgaatgacaacgctccagtgttcactcagagcgttaccgaagtagcattcccagaaaataataaaccaggagaggtgattgccgagattaccgcctctgatgcggactctgggtcgaatgccgaactggtatactcactcgagcctgaacccgctgcaaagggactgttcaccatcagccccgagaccggtgaaatacaggtgaagacctcactcgatcgtgagcagcgggagagctatgaactgaaggttgtggcagctgacagggggtccccatctctgcaggggacagcgacagttctcgtaaatgtgttggattgtaatgataacgatcccaagttcatgctgtccggctataactttagcgttatggaaaacatgcctgctctctctccagtgggcatggtcacggtcattgacggggataagggcgagaatgcccaggtgcagctatctgtggaacaagacaatggtgattttgtcattcagaacggtaccggcactatcctgagctccctttcattcgaccgggagcagcagagtacatatacatttcaactcaaggcagtcgacggtggcgtacccccaagatctgcctatgttggggtaacgattaacgtccttgatgaaaatgacaatgctccatacatcacagcaccaagcaacacctcacataagctactgactccccaaactagactcggagagacagtcagccaagtggccgcagaggattttgacagcggcgtgaacgcggagctaatatactccattgctggtggtaatccatacggcctgttccagatcggaagtcattccggagcgattaccctggagaaggagattgagaggaggcaccacgggctgcaccgcctagtagtcaaagtgtccgatcgagggaagcctcccaggtacggtaccgcactcgtccacctgtacgtgaacgagacactggccaatagaacgttgctggagaccctgctgggacattcactcgacaccccactggatattgatatcgccggcgacccagagtatgagcgatctaagcaacgagggaacatactgttcggtgttgtggcaggagttgtggccgtggcactgctcatcgccctcgccgtgctcgtgaggtattgccgtcaaagggaggccaaatcaggatatcaagcaggtaaaaaggaaacaaaagatctttatgccccgaagcccagcggtaaagcgtcaaaggggaacaagtcaaaaggcaaaaagtctaagtcccctaagcctgtgaagccggtggaagacgaggacgaagccggccttcagaagtctcttaagtttaatctcatgtccgacgcaccaggtgattcgccccgaatccacctgccgctcaattatcctccgggcagcccagatctgggccgccactaccggtcaaacagcccactgcctagtatccagctgcaaccacagtccccttccgcctccaaaaagcaccaggtcgtccaggatctgccaccagccaatacatttgtaggcacaggagacacaacgtctactggttccgagcagtacagcgactacagttacaggaccaatccacctaagtacccatcgaagcaggtcggccagccattccagctgagcacacctcaacccctacctcacccatatcacggcgcgatatggaccgaggtttgggaatag

SEQ ID NO: 131051 - DNA, 3117 bp, Artificial Sequence
  Description of Artificial Sequence: Synthetic coding sequence
atggagcacttacgtcacagcccaggccctgggggacagaggctcttgttgccaagcatgttgttagcactcctgctcctactggctccttcacctggacacgctacacgagtagtgtacaaggtgcccgaggaacagcccccaaataccctgatcggaagtctcgccgcagattacggatttcccgatgttggtcatctctataagttggaggtgggggcgccatatctacgagtagatggaaaaactggagacatatttacaactgaaacttccatagaccgcgaaggactgagggaatgccagaatcagctgccgggtgacccgtgtatcctcgaatttgaggtgtccataactgatcttgtccagaatgggtcccctcggctgctcgagggccagatcgaggtgcaggatattaatgataacacaccgaacttcgcaagtcccgttataacgttggccatccctgagaacaccaatattggctcgctttttccaatcccgttggcctccgaccgcgatgcaggccccaacggcgtagcatcctacgaattgcaggctggccctgaggcgcaagagctgtttgggctgcaggtggccgaggaccaagaggaaaagcagcctcagctgatcgtcatggggaatctggaccgggagcgatgggattcctatgatctgacgataaaagtgcaggatggcggtagtccacctcgcgccagtagcgctttgctacgtgtgaccgttctggatacaaacgacaacgctccaaaattcgaacgcccaagttatgaggcggagttgtcagagaactcccctatcggacattccgtgatacaggtgaaagcgaatgatagcgaccagggtgctaacgccgagattgagtacacattccaccaggccccagaagtcgtccgcaggttactgaggctggacaggaacaccggcctaatcactgtccagggcccggttgacagggaggacctgagcactctgagattttccgtcttggctaaagacagagggacaaaccctaaaagtgccagggcacaggtagtggtgacggtaaaggatatgaacgataatgctcccaccatcgagatacggggcattgggcttgtgacacaccaggatggtatggccaatattagcgaggatgtcgcagaggaaaccgccgttgccttggtgcaagtgtctgacagagacgaaggagagaatgccgcagtgacgtgtgtggtggccggcgacgtgccttttcagcttaggcaggctagcgaaactggctcggattctaagaagaagtactttctgcagactacaacgcccttggattacgaaaaggtcaaggattacaccatcgaaatagtggccgtagacagcggtaatcccccactgagctcaactaactctttaaaggtccaggtcgtcgacgtcaatgataatgcaccagttttcactcaatcagtgacggaagtggcgtttccagaaaataacaaacctggggaagtgatagctgagatcactgcgagcgacgccgacagcggatccaacgcagaactggtgtacagcctggaaccagagcctgcagccaagggtctgtttaccatatcccctgaaaccggagagattcaagtcaaaacttcgctagaccgggaacagagggaatcatatgagctgaaagtggtggctgctgatcgcgggtcaccttcattacagggcactgccacagtgcttgtgaatgtgctggactgcaatgataatgatccgaagtttatgctgagcgggtacaatttttccgtgatggagaacatgcccgctcttagtcctgttggtatggtaaccgttatcgacggtgacaagggggaaaatgcccaggttcagttgtctgtggagcaagataatggagattttgtcattcagaacggcaccggaaccatcctttccagtcttagttttgaccgggaacagcagtccacatatacgtttcagttgaaggccgtcgacggtggtgtgccgcctaggagcgcgtatgtgggcgtgaccatcaacgtcttggacgagaatgataacgccccttatatcacggccccttccaatacttcccacaagttgctgacccctcaaactaggctcggcgagaccgtcagtcaggtggccgctgaggattttgactctggggtgaatgccgagctgatatattccattgccggagggaatccatacggactcttccagatcggatcccacagtggcgctataacactggaaaaagagatagaacgccggcaccacgggctccataggctcgttgtgaaagtctcagaccgtggtaaaccaccaaggtatgggactgcactggtccatctatatgtcaacgaaacgctggctaatagaacattgctggagacactccttggccactcactggatacacctctcgatatcgatatagccggtgatccggaatacgaacggtctaagcagagagggaacatcctttttggcgtggtggctggagtggtggcggtagccctgttaatagctctcgccgtgctcgtccgctattgtaggcaaagagaggcaaaatccggatatcaggcaggaaagaaggagaccaaggacctgtacgcacccaaaccaagtggcaaagcgtccaaaggaaataagtccaaggggaagaaaagtaaatcacccaaacctgtcaaacctgttgaggatgaagacgaagccgggcttcaaaaaagtctgaagttcaacctgatgtcggatgctcctggcgacagtccccgcatccatctccctctcaactaccctcctgggtcaccggatttaggccgccactaccgcagcaactcccccttgccgagcatacagctgcaaccccaatccccttctgcgtcgaagaaacaccaggtcgtccaggacctgccccctgcaaatacttttgtgggtaccggagacactacatcaaccgggtccgaacagtactcggactacagctatcgaacgaatcccccaaaatatccatcaaaacaggtggggcagccctttcagctgagtacgccgcagcccctgccacatccctaccacggcgccatctggactgaggtgtgggaatag

SEQ ID NO: 131052 - DNA, 3123 bp, Artificial Sequence
  Description of Artificial Sequence: Synthetic coding sequence
atgatagtgctgcttttgtttgcattgctttggatggtggaaggcgtcttttcccagctacactacacggtgcaggaggaacaggagcacggtaccttcgtgggcaacatcgcagaggatctgggcctggacataactaaactctcagctcgaggatttcagaccgtgcccaactcacgaacaccctatttggatttgaacctggaaacgggtgtcttatacgtgaacgagaagatcgatcgcgagcaaatctgtaagcaaagtccgtcttgcgttcttcatctggaagtgttcctggaaaatcccctcgaactgtttcaagtcgaaattgaagttttagacattaatgataatcctccgagttttcccgaacctgatctgactgtggaaatatccgagagtgcgacccctggtactagatttcctctcgagagtgccttcgaccccgacgtaggcaccaacagcctgcgggattatgagatcactccaaactcgtatttctccctggatgtgcagacccagggggatggcaaccgctttgccgaattggtgctcgagaaacccctggatagggaacagcaggctgttcatcggtacgtgctcacggccgtggatggggggggcggaggtggcgtgggagagggagggggcggcggcggcggggcaggccttccgccgcagcagcagaggactggcaccgcactgttgaccattagggtcctggactccaatgataacgtacccgccttcgaccagcctgtgtataccgtctccttgcccgagaatagccctcccgggaccctcgttattcagctgaacgccaccgacccagatgaagggcaaaacggggaagtcgtgtattcattttcgtcacatatctctcctagggctcgagaactgtttggcctcagcccacgaaccgggcgcctcgaagtgagcggggagctcgattacgaagagagtcctgtctaccaggtctatgtgcaggctaaagacttgggtcccaacgctgtgcctgctcactgcaaagtgctcgtgagggtgctcgatgccaacgataatgctccagagatcagcttctcaacagtcaaggaggccgtctcagaaggagccgcccccgggaccgtcgtggcactgtttagcgtcaccgaccgcgactctgaagagaacgggcaagtgcagtgtgaactcctgggagatgtgccctttagattgaagtcatcattcaaaaactactatacaatcgtcactgaagccccgcttgatagagaggccggggacagctacaccttgactgtggtggcccgagatcgtggagaacccgcactgtcgacgtcgaaaagcatccaagtccaggtttctgatgtaaacgataacgccccgaggttttcgcagcctgtgtatgatgtttacgtcaccgaaaacaacgtgccaggtgcctacatctacgccgtgagcgccaccgaccgcgacgagggcgccaacgctcagctggcatactctatacttgaatgccagattcagggtatgtcggttttcacatacgtcagcatcaatagcgagaacggctacctgtacgcactgcgtagcttcgattatgagcagctcaaggacttctcatttcaggtcgaggccagggacgccggtagcccacaggcgctggccgggaatgccaccgtgaatatcttgatcgtggaccagaatgacaatgcccccgccattgtggcccctttgccaggacggaatggcaccccagcccgggaggttctacctagatctgcagagccaggctatttgctcacacgggtggccgcagttgatgctgacgatggagaaaacgcaaggctgacatattccattgtacgcgggaacgagatgaacctgttccggatggactggaggaccggggagttgcggaccgctaggcgcgtccctgcgaaacgcgatcctcagagaccttacgaacttgtcattgaagtgcgcgatcatggtcagccccctctctcctctaccgccactttagtggtacagctagtagacggggctgtcgagcctcagggcggggggggctccgggggggggggctctggcgaacaccagaggcctagcaggtcaggcggcggcgagacttcgcttgacttgacattaatcctgataatcgcgcttgggagcgtatccttcatttttctcctggcaatgatcgttctcgctgtgaggtgccaaaaggagaagaagttgaatatttacacgtgcctggcctccgattgttgcctctgctgctgttgctgcggcgggggggggtctacctgttgtgggcgccaggcacgggctaggaagaaaaagctcagcaagtctgatatcatgctcgttcagagttcaaacgtgccttccaatcccgctcaagtaccaattgaagaatcagggggcttcggtagccatcatcacaaccagaactactgctatcaagtctgtctcactcccgagagcgccaaaacggacctcatgtttctgaagccctgcagccccagccgaagcactgatactgaacataatccatgcggagcaattgtgaccggatatacagatcagcagcctgatatcattagtaatggatccatcctgagcaatgagactaagcaccagagggcagaactttcatatctggtagaccggcccagacgggttaactcaagcgccttccaagaggctgatatcgtctcatctaaggacagtggacacggcgactcagaacaaggcgattcggaccacgacgcaacaaatagagcacaaagcgcgggcatggacttatttagcaattgtactgaagaatgcaaggctttaggtcattccgacaggtgctggatgccgtcctttgtgcccagcgatggcaggcaggccgccgactacaggtctaacttgcacgtgcctggcatggacagcgtgcctgatacggaagtgtttgaaacacccgaagcacagcccggggcagaacggtccttctccactttcggcaaagaaaaggcattgcattccaccctcgagcggaaggaactcgacggattgctgactaatacccgcgcaccctacaagccaccctatctgacacggaaaaggatctgctag

SEQ ID NO: 131053 - DNA, 3123 bp, Artificial Sequence
  Description of Artificial Sequence: Synthetic coding sequence
atgatcgtgcttttactcttcgccctgctttggatggtagagggggttttctctcaattacactacaccgtgcaagaggagcaggagcacggaacattcgtcgggaatattgctgaagatctgggtttggatattacaaaattatcggcccgaggatttcagacagtgcctaactccagaaccccatacctggacctcaatctggaaacgggggtcttgtacgtgaatgaaaagattgatcgggaacagatctgtaagcagtctcccagttgcgtactccacttagaagtgttcctcgagaaccctctggagctattccaggtcgagatcgaagtgctggacatcaacgataaccccccttcctttccggagcccgatctgacagtcgaaatctccgaatccgctactcctgggactcggtttcccctggagagcgcttttgaccccgatgtgggtaccaactctcttcgcgactatgagattacacctaactcctatttcagtctagatgtgcagacacagggcgatggcaatagatttgcggaattggtgctagaaaagccactggatcgagagcagcaggcagtgcataggtatgtactgaccgcagtcgacggggggggcggaggaggcgttggcgaaggaggaggcggggggggcggagcaggcttacccccccaacagcagcggaccggaacagctcttctgactattcgcgttcttgacagcaacgataatgtgccggcattcgaccagccagtttacacagtgtcccttcctgagaattccccccccggaactctcgtgatccagttaaatgctacagatcccgacgaagggcagaacggtgaggtggtctactccttctctagtcacataagtcctagggcgcgcgagctgttcggactctctccgagaactggtcgcctcgaggtgtcaggagagctggattacgaagaatcccccgtataccaggtatatgtgcaggccaaagacctagggcccaatgcagtgcctgcccattgtaaggtgctagtccgtgtcctggacgccaatgacaatgcccccgagatttcatttagcaccgtgaaagaggcggtctctgagggcgcagctccgggaactgttgtggccctcttcagcgtgacggacagggacagtgaggagaacggacaggtgcagtgcgagttgttgggcgacgtaccgttccgcctaaagagctcttttaaaaattattacacaattgttacagaagcaccgctagatagggaggccggcgattcctatacactgacagtggtcgccagagatagaggcgagcctgcactgtcaacatctaagagtatacaggtccaggtgagtgacgtgaacgacaacgctccccgcttttcccagccagtatatgatgtgtacgttacagaaaacaacgtgccaggggcatacatctatgccgtgagtgctactgaccgggatgagggagctaacgcacagctagcctactcaatcctggagtgccagatccagggcatgtctgtttttacctacgtttctatcaactcagaaaatggttacctctatgcgctccggagctttgattacgagcagctgaaggacttttcctttcaggtggaggcaagggatgccggatcaccacaggctcttgcagggaatgctacagtgaacatactcatcgttgatcagaacgacaatgctcccgctatcgtcgctccactcccagggagaaacggaaccccagcacgagaagttctgcctcggagcgcagaacctggctatctgctgacacgagtcgcagctgtggatgctgatgatggcgaaaacgccaggctgacatactctatcgtgcgcggtaatgaaatgaacctgtttaggatggattggaggacaggggagctgcgcacggcccgccgcgtgccagccaagcgcgacccccaaagaccttacgagctcgtaatagaggtacgggaccacggccagccacccctgtccagcaccgccacattagtggtgcagctggtcgacggcgccgtggagccgcagggaggagggggctctggtggcggcggtagcggggagcaccagcggccttcccgcagtgggggcggcgagacatcacttgacctgactcttatcttgatcattgcattaggctccgtctcgtttatcttcctcctcgcaatgattgttctcgcagtcagatgtcagaaagaaaaaaagcttaatatttatacttgtttggccagtgactgttgtttgtgttgctgttgctgtggcggcggtggttcaacgtgctgcggtcgacaggcacgtgccagaaaaaaaaagctttctaagtccgacataatgttagtgcagtcgtctaatgtaccgtctaatccagcccaagtacccatcgaagagagcggcggcttcgggtctcaccatcacaaccagaactactgttatcaggtgtgtcttacccccgagagcgcaaagaccgacctaatgtttttgaagccctgttcaccaagtcggagtaccgacacagagcataacccatgcggcgctatcgtgacaggctataccgaccagcagcccgacattataagcaatggatccattctatcaaatgaaacaaagcaccagcgcgcagagttgagctacttggtggatagacccaggcgcgtgaactctagcgcatttcaagaggccgacatcgtgtccagtaaagattcaggacatggggacagcgagcagggcgattccgatcacgatgcaacaaatcgagcccagtccgcagggatggatctctttagcaactgtaccgaggagtgtaaggcattggggcattctgacaggtgttggatgccctcgtttgtcccttcagatggtcggcaagctgccgactaccgtagcaacctgcatgttcctggaatggacagcgtgcctgatacagaggtattcgaaactcctgaggcacagcctggcgccgaacgctcattttccacttttggcaaagaaaaggctctgcactctacattggagcgcaaggaattggacggcctgttaactaatacccgcgctccctataagccaccatatttacgcaaaaagcagaggtgttag

SEQ ID NO: 131054 - DNA, 3933 bp, Artificial Sequence
  Description of Artificial Sequence: Synthetic coding sequence
atggatctgctttctgggacgtatatctttgcagtgctgctggcttgtgtggtgtttcacagcggcgcgcaggagaaaaattatacaatccgcgaagagatgcccgagaacgtcctaattggcgatctgctcaaagacctaaatctgtctttaatccccaacaagtcccttactaccgcgatgcaattcaaattggtgtataagacaggcgatgttccgttgatcagaattgaggaggacacaggcgagattttcacaacaggcgctagaattgatcgcgagaagctctgcgcaggaatacccagagacgaacactgcttctacgaggtggaggttgctatcctccctgatgaaatttttcggttagttaagatccgattcttgattgaggatatcaatgataatgctccactcttccctgccacagtgataaatatctccatccctgaaaatagcgctattaatagcaaatacactctcccagcagccgtggaccctgatgtcggaatcaacggagttcagaactacgagttgatcaagtctcagaacatcttcggactcgacgtaatcgagacaccagagggagataagatgccccagctcattgttcagaaggagctggatcgggaggagaaagacacatatgtcatgaaggtcaaagtagaggatgggggatttcctcagagatcttctactgctattctgcaggtgtctgtcacagatacaaatgataaccacccagtgttcaaggagaccgaaatagaagtgtcaattcccgaaaatgcacctgtgggtacttccgtcacacagctccacgccacagatgcagatattggggagaacgcaaagatacacttctcatttagtaacctggtgtccaatatcgctaggcggctgttccatttgaatgcaaccactggcctcatcacaatcaaggagccgttggaccgcgaagaaacgccgaatcacaaattactggtgctggcatccgacgggggattgatgcctgctagagcgatggtccttgtgaacgtaaccgatgttaacgacaacgtgccaagcatcgacatacgttacatagtgaatcccgtgaatgacacggtggttctgtcggaaaatattcccttgaacactaagattgccttaataaccgtcaccgacaaagacgctgaccacaacgggcgtgtgacttgcttcaccgatcacgaaatcccatttcggctgcgacccgtgttttcaaatcaattcttactcgaaactgccgcttatttggactatgaaagcacaaaggagtatgccataaagctactcgccgctgacgccggaaagccaccactaaaccagtcagccatgctgtttatcaaggtgaaggacgaaaatgataatgccccagtcttcacccagtcatttgtcaccgtgtctatcccagaaaacaactctcccggcattcagctaacgaaggtgagtgccatggacgccgacagtgggcctaacgccaaaattaattatctgctggggcctgacgcaccaccagagttcagtctggactgcagaacaggcatgctgactgttgtgaagaagctggaccgcgagaaggaggacaagtatctgttcaccatccttgctaaggataacggagtgcccccccttactagcaatgtgaccgtgtttgtctccataattgaccagaacgataattcccctgtgtttacacacaatgaatacaatttctacgtgcccgagaatctcccacgacacggcacggtcggcctgatcacagtaaccgatcccgattacggtgataactcagcagtcactctgtctatccttgatgaaaatgacgatttcaccattgactcccaaacgggagtcattcggcccaatatatcctttgatcgtgagaagcaggaatcatataccttctacgtaaaagccgaggatggagggagagtcagtaggtcctcgtcagcgaaagtcaccatcaatgttgttgatgtgaatgacaacaagccggtattcatcgtgccaccctcaaactgtagctatgagctcgtgctgccaagcactaatcccggcaccgtggtgttccaggtcatcgcagtggataacgatacgggcatgaacgccgaagtgcggtattccatagtgggagggaacaccagggacctgttcgcaatcgaccaggaaaccgggaacatcaccctgatggagaaatgtgacgttaccgatctgggcttacatcgggtcctggtaaaagcaaatgacctgggccagccagatagtctgttcagcgtggtcattgtgaatttgttcgtcaacgagtccgttaccaacgccacactgataaatgagctggtgcgaaaaagcaccgaagcgcccgttacacctaatactgaaatcgccgacgtctcctcaccgacctcagattatgtcaagatacttgtggctgcagtggcgggaacaatcacagtagtagtagttatttttataacagccgtagtccgatgtcggcaggccccccatctgaaggcagcccagaagaataagcagaatagtgagtgggcgacacctaatcctgagaatcggcagatgatcatgatgaagaagaaaaaaaagaaaaaaaagcatagcccgaaaaacctcttgctcaacttcgttacaatagaggaaactaaagctgacgatgtggatagcgatggtaatagagttacgcttgacctaccaattgacctggaggaacaaacaatgggcaagtacaactgggtgaccacccctaccacttttaaacccgactctccagatttggccagacattataagtccgccagccctcagcccgcttttcaaatacagcctgagacacccctgaatagtaagcatcacattattcaggagcttcccttggataatacattcgttgcctgcgattctatctccaagtgttcctcatccagttccgatccatatagcgtaagcgattgtggttatcctgtgacaaccttcgaagtccctgtttcagtgcacactaggccatcgcagaggcgcgtcaccttccatttgcccgagggatcacaggagtcatctagcgacggcggactgggggatcatgatgcggggagtttgactagtacttcacacggccttcctttgggctacccccaggaagaatactttgaccgcgccacaccgagcaatagaacagaaggagatggcaacagtgaccctgagtcaacattcatcccccgctcacccacagccgccgaaatcacagtgcagcctacagtggaggaggccagcgacaattgcacccaggagtgcctgatttatggtcactcagacgcctgttggatgccagcctcgctggaccactccagcagtagccaggcccaggcttccgcgctgtgccattcgccccccctatctcaggcttcaacacagcaccactctccaagggtcacccagaccattgccctgtgtcacagccccccagtgacccagaccatagcactctgccactctcctccgccaattcaggtttctgcactacaccattcacctccactggtgcaggccactgcactacatcatagcccgccttccgcccaggcttccgctctgtgttactctcctccgctcgcccaagccgctgccattagccactccagtcctctaccacaggttatcgctctgcatcggtctcaagcacagagttccgtgtcattgcagcaaggttgggttcagggggctgacggtctttgcagtgtggatcagggggtccagggaagtgctacatctcaattttacactatgagtgagaggctgcacccttctgacgactctataaaggtcatcccattgactactttcactccacgtcagcaagcacggcctagtcgtggagatagcccaattatggaggaacatcccctgtag

SEQ ID NO: 131055 - DNA, 4044 bp, Artificial Sequence
  Description of Artificial Sequence: Synthetic coding sequence
atggacctgctctcagggacttatatttttgcagttctcctcgcctgcgtggtttttcactctggagctcaggaaaagaattatacaatccgggaagaaatgcccgaaaatgtgctgatcggcgatctgctgaaggatctgaacctgagcctgataccaaacaagtcactgactactgcaatgcagttcaagctagtatacaagaccggggacgttcctctgattagaattgaggaggacaccggcgaaatattcaccacaggggcacggatcgaccgagagaagctgtgtgctgggattcccagagacgaacattgtttttacgaagtggaagtggcaattcttcccgatgaaatcttccgcctcgtgaaaatccgcttcctcatcgaggacattaatgataacgctcccctgttccccgcaaccgtcataaacattagtatcccggaaaattcagctattaattccaagtataccctgcccgccgctgtcgaccctgatgttggcatcaatggcgtacagaactatgagttgatcaagtcccagaatatcttcggtctggacgtgatcgagacgcccgagggggacaaaatgcctcagctgatagtgcagaaggaactagacagagaggaaaaggacacctatgtgatgaaggtcaaggtggaagatggcgggttccctcaacgctcttccaccgctattctccaggtcagcgtcactgacacaaacgataatcaccccgtattcaaagagaccgaaatcgaggtgagtattccggagaacgcccctgtggggaccagcgtcactcagctccacgcaaccgacgctgatattggggaaaatgcgaaaattcacttctccttttctaatttggtttctaatatcgcacggcggctttttcatctcaatgccaccacgggcctcataactatcaaagagcccttggatcgcgaggagacccccaatcacaaactcctagtcttagccagcgatggcggtctgatgcctgcccgcgctatggtgttagtcaacgtgaccgatgtgaatgataacgtgccatctatcgatattcgctatattgtgaatccagtcaacgatactgtagtgctcagcgagaatattccactaaacaccaaaatcgccctgattacagtgactgataaagacgctgaccataacggcagggtgacatgtttcacagatcatgaaatacctttcagactgcgtccagtcttcagtaaccaatttctcctggagaccgcagcatacctcgattatgaatccaccaaagaatatgccatcaagctgctggccgccgacgcaggaaagcctcccctgaatcaaagtgcgatgctgttcatcaaggtcaaggatgagaatgacaacgctcccgtgttcactcagtccttcgtgacagtcagtattcctgaaaataatagcccaggcattcagctgacaaaagtgagcgctatggacgccgatagcgggccgaacgctaaaattaactatttgctgggacctgacgcccctccagaattttccctggattgcaggacaggtatgttgactgttgtgaaaaaattggatcgcgagaaggaagataagtatttgttcaccattctggcaaaggataacggcgtcccccctctgaccagcaacgtgactgttttcgtctcgataatagatcaaaacgacaatagtcccgtctttactcataatgaatataatttttacgtcccagagaatctcccaagacacggcaccgtggggctgataaccgtcaccgacccagactacggtgacaactccgccgttacactcagtatcttagacgagaatgatgacttcaccatcgatagccagactggtgtcatccggccaaacatatcatttgaccgggagaagcaagaatcatatactttctatgttaaggcagaggacgggggaagagttagtcgctccagcagtgctaaggtgactataaacgtggtcgacgtgaatgataataaaccggtcttcattgtcccaccttccaactgtagttatgagctagttttgccatccaccaatccggggaccgtcgtgttccaggtaatcgcagttgataacgatactgggatgaacgccgaggtgaggtatagcatcgtgggaggcaatacccgcgatctattcgccatagatcaagagactggaaacattacactgatggagaagtgcgacgtgacggatctgggattgcacagggtcttggtgaaagccaacgatttaggacagcctgattccctgtttagtgttgtgatcgtgaatttattcgtgaacgagtccgttaccaacgccacactgatcaatgagctggtccggaagagtactgaagcccccgtgaccccaaatacagagatcgctgacgtgtcctccccgacctcagactacgtcaaaattttggtggctgccgtggccggaacaataacagtagtggttgtaatcttcatcactgctgttgtgagatgccgccaagcgcctcaccttaaggcagcgcagaagaacaaacagaactccgaatgggcaacccctaaccctgagaataggcaaatgattatgatgaaaaagaagaaaaaaaaaaagaagcacagccctaagaatcttcttcttaattttgtgaccattgaagagaccaaggctgacgatgtggacagcgacggcaatagagttaccctggacctgcccattgacctggaagagcagacgatgggcaaatataattgggtcacaacaccgaccacctttaaacccgattcaccagacttggctcgccactacaagtcggcttcaccgcagcctgcctttcagatacagccggaaacgcccttgaactccaagcaccacattattcaagagctgcccttggacaataccttcgtggcctgcgactctatctcgaaatgctcttcctcctcttcagatccatatagcgtgtccgactgtgggtacccagtcacgacctttgaagttccggttagcgtccatacgagacctcccatgaaagaggtagtccgatcgtgtacaccaatgaaggagtcgacgaccatggagatctggatacatccgcagcctcagcggaagtccgaaggaaaagtagcggggaaatcccaaaggagagtgacctttcatttgcccgaaggatcgcaggaatcttcctccgacgggggattaggcgaccatgatgcaggaagccttactagcactagtcatggactgcccctgggttacccccaggaagaatactttgaccgcgccacgccctctaaccgcactgagggagatggcaacagtgatccagagagcaccttcatcccacggtccccgaccgctgctgagattaccgtacagcccaccgtcgaagaagcatccgataactgcacgcaggagtgccttatttatgggcattctgacgcctgctggatgcctgcaagtctcgaccactccagcagtagccaagcccaggcgagtgcactttgtcacagtcctccgctgtctcaggcatccacacagcaccattctccaagggtgacacagacaatcgctttatgtcacagcccgccggttacacaaaccattgcactgtgccattctcctccccccattcaagtttccgcactgcatcattcaccacccctcgttcaggcaacagccctgcatcatagtcccccgtccgctcaggcgagcgccctgtgctactcaccacctttggcgcaggccgcagcaatcagccattccagcccactaccacaggttattgctttgcacagatctcaggcacaatcttccgtgagcctgcagcaaggttgggtgcagggggcggatggcctctgtagcgtggatcagggcgtgcaaggttctgctacttctcagttctacactatgtccgaacggttgcatcctagcgacgattccattaaagttataccgctcacaacgttcacccctcggcaacaagctcggccatcacggggggatagccctattatggaggagcatcctctctag

SEQ ID NO: 131056 - DNA, 3990 bp, Artificial Sequence
  Description of Artificial Sequence: Synthetic coding sequence
atggatctgctgagtgggacctacatctttgccgttctgctggcctgcgtcgtttttcactcgggcgctcaagagaagaattacacaatcagagaagaaatgcccgagaatgtgcttatcggagacttgcttaaagatctgaatctctccctgattccaaataagtcactgaccaccgctatgcagtttaaacttgtctataagaccggcgatgttcctctgattcgaattgaggaggacacaggagaaatttttaccaccggagcacgcatagaccgggagaagctctgtgctgggatcccccgggacgagcattgcttctacgaggttgaggtcgcaattctgcctgacgagatttttcggttggtaaagatcaggttcttaatcgaagacatcaatgacaacgcacctctgttccccgctacagtgatcaacataagcattccggagaacagcgcgattaacagcaagtacacactaccagccgcagtggacccggatgtcggtatcaacggcgtgcaaaattacgagcttataaaatcccagaacatctttgggttggacgtgatcgagacccccgaaggggataagatgccacaactcatcgtgcaaaaggagctggatcgcgaggaaaaagatacatacgtgatgaaggtcaaggtggaggatggtggcttccctcagcgatccagcaccgctattcttcaggtgtcagtgaccgataccaatgataaccacccggtgtttaaggagaccgaaatcgaggtgtcaatccccgaaaatgcacccgtgggtacatccgttacacagctgcatgccaccgacgccgacatcggcgagaatgcgaagattcacttcagtttttccaatctcgtttccaatattgcacggcgattattccacctgaacgccacaaccggcctgattacaattaaggaaccacttgatcgcgaagaaacccccaaccacaaactgctggtgttggccagtgacggcggcctcatgcctgcacgagccatggtgctagtcaacgtcacagacgttaatgacaatgtacccagtatcgatattcggtacattgtgaatccagtgaatgacacagtcgttctgtccgaaaacataccgttgaatacaaagatcgctctgatcaccgtcaccgataaagatgcagatcacaacgggagagttacttgttttactgaccatgagataccatttcggctacgccccgtgttcagtaaccaattcttactggagaccgcagcttatctggactatgagagtacgaaggagtatgcaataaaactcctcgctgcagacgccggtaaacctcctttgaatcagtccgccatgcttttcatcaaggtcaaggatgagaatgacaacgcccctgtgttcacccagagcttcgttaccgtgtcaatcccagagaataactctccaggaatccagcttacaaaagtgtccgccatggatgctgactcgggacccaacgcaaaaatcaattaccttctgggcccggatgccccacctgaatttagtctggattgcaggacaggcatgcttactgtggtcaagaagctagaccgggaaaaagaggacaagtatctgtttaccatcctggctaaagacaatggagtgccacctctgacatctaacgtgaccgtgttcgtctccatcatcgatcagaacgacaactcccccgtctttacacataacgagtataatttctatgttcctgagaacctcccccggcacgggaccgtgggcctgatcaccgtcacggacccagattacggcgataatagcgctgtgactttatcaatactggatgagaatgatgacttcaccatcgattcccagacgggcgtcattcggccgaatatcagcttcgaccgcgagaaacaggagtcttacacattttatgtgaaagctgaggatggaggaagagttagcaggagctcctccgctaaagttacgataaatgtcgtcgatgtgaatgacaataaacctgtgttcatcgtgcccccatccaactgtagttacgaacttgtgctcccatccacgaatccgggaacagttgtctttcaggtcatcgccgtcgataatgacacggggatgaacgctgaagtgcggtacagcattgtcggcggaaatacacgtgatctctttgctatcgaccaagagaccggcaacattacactaatggaaaagtgtgatgtgacagaccttgggcttcacagggtcctcgtgaaagccaatgacctgggtcagccagactcccttttttcagtcgtgatcgtgaacctgttcgtgaacgaaagcgttactaatgcaacacttatcaatgaactggttcgaaaaagcacggaggctcctgtgacaccaaatactgaaatcgcagacgtgtcaagtcctactagtgactacgtaaagattcttgtagcggcagtagccggcactattacagtggtggtagttatttttataactgccgtcgtcaggtgcagacaagcccctcatttgaaggctgctcaaaagaacaaacaaaactcagaatgggcaactccaaatccagaaaaccgccagatgattatgatgaagaagaaaaagaagaagaaaaagcattcaccaaaaaacctgctgttaaatttcgtcactatcgaagaaacaaaggctgacgacgttgactcagacgggaacagggtaacattggatttgccaatcgacctggaagagcagaccatgggaaagtacaactgggtgactaccccaacaaccttcaagccagactctcctgatctagctcgacactacaagtctgcttcacctcaacccgcgtttcagattcagcccgagacacctcttaactcaaaacatcatatcattcaggaacttccactggacaacacctttgtggcctgcgactctatttcaaagtgcagctccagtagtagtgatccttatagcgtctccgactgtggctacccagtaacaacattcgaggtgccggtcagcgtacacacccggccccccatgaaggaggtagtcagatcttgcacacctatgaaagaaagcacaaccatggaaatctggattcacccgcagcctcagtcacagaggcgcgtcaccttccatttacccgagggcagccaggagagcagcagtgatggcggactgggcgaccacgacgccgggagcctgaccagtacttctcacggccttccccttggctatcctcaagaggaatactttgatcgggccaccccttctaaccgcacagagggcgacggtaatagtgatcctgagtccaccgccgaaatcacggtgcagcctaccgtcgaggaggccagtgataactgcacacaggaatgtctaatctacggccactctgatgcctgctggatgcccgcgtccttggaccattcctcaagttcccaagcgcaggcctctgccctgtgtcatagtccaccacttagccaggcaagcacccagcatcactcccccagagtgacccaaaccatcgccctctgtcactctccacccgtcacccaaaccattgccctgtgtcattccccccccccgatacaggtgtcagcactccaccactcacctcccctggttcaggccacagccctgcaccactctccaccatctgcccaggcatccgcattgtgttacagtccccccttagctcaggccgccgctatatctcattcaagccccctgcctcaggtcatagccctgcaccgatcccaggcgcagtcttccgtatctctacaacaaggttgggtgcagggagccgacggcctgtgtagcgtggaccagggcgttcagggaagtgcgaccagtcaattttatactatgagtgaacggctgcatccttccgatgactctataaaggtcatccctctgacaacgtttacaccacggcagcaggcccggccttcaagaggtgattcacccattatggaggagcacccattgtag

SEQ ID NO: 131057 - DNA, 3066 bp, Artificial Sequence
  Description of Artificial Sequence: Synthetic coding sequence
atggacttgttatcaggcacgtatatattcgccgtgttgttagcctgcgttgtgtttcattccggggcacaagagaagaattacaccattcgagaagagatgcccgagaacgtgctaattggcgacctcctgaaagatctgaacctgtctctgatccccaataagagtctgacaaccgctatgcagtttaaacttgtatacaaaacaggagacgtgcccctgatcagaattgaggaggacaccggcgaaatttttacaactggggcacgaatcgaccgggagaagctttgcgccggaattccccgcgacgaacattgtttctacgaggttgaggtagctatcttaccagacgagatctttcgtctcgttaaaattcggttccttatcgaagacatcaacgacaatgccccactgtttcccgccaccgtgataaacatttcaatccccgaaaactctgcaatcaattcgaagtatacacttcccgcggcagtggaccccgacgtgggaatcaatggcgtccagaactacgaactgattaagtctcagaacatcttcggcttggatgtaatagaaacgcccgagggagataagatgccccagctcatcgttcagaaggagcttgatcgtgaggaaaaagatacttacgtgatgaaagttaaagttgaggacggagggttcccccaaagatcaagcaccgccattcttcaggtgtcggttaccgacaccaacgacaatcaccccgtcttcaaggaaactgaaattgaggtgagcatccctgagaatgctcccgttggtacatctgtcacccagttgcatgcaactgatgctgacatcggggaaaacgccaaaatacacttctctttttctaacttggtatccaacattgcaagacgactcttccacctgaacgcaaccactggactgatcacaataaaagaacccctggaccgcgaggagacccccaaccacaaactgttggtccttgcttctgatggtggtcttatgcccgcaagggcaatggtgcttgtgaacgtgaccgatgtcaatgacaacgtgccaagcatcgatatccgctacattgtaaatccggtgaatgacaccgttgttcttagcgagaatatcccattgaacacaaagatcgctctgattacagtgacagataaggacgccgatcacaatggacgagtgacctgtttcacagatcatgaaattcctttcaggctgcggccagtattctccaatcagtttctgctggaaaccgccgcttacctcgactacgagtcaaccaaggagtatgccataaaactcctggcagctgacgcagggaagcctcccctgaatcaaagcgcgatgctattcattaaggtgaaagacgaaaatgataacgccccagtgtttacacagagtttcgtaactgtctccattcccgaaaacaattctccagggattcagctcacaaaggtttccgctatggacgccgactccggacctaatgcaaaaattaactatctgctagggccggatgctccacctgagttttccctggactgtagaactggaatgttaacggttgtgaaaaagctggatagagagaaagaggataagtacctgttcactattctagccaaagacaacggagtgccacccctcacaagcaatgtgacggtctttgtttccattatcgaccagaatgacaattcccctgtgtttactcacaacgagtataatttttacgtgcccgaaaacctcccaagacatgggactgttggactgatcacagtgactgaccctgactacggggataatagcgcagtaaccctgagcatcctggacgaaaacgacgactttaccattgatagccagacaggcgtgatccggccgaatatctccttcgatcgtgaaaagcaagaatcgtatacattctatgtgaaagctgaggatgggggtagggtttctcgaagttccagtgccaaggtgaccattaatgtggtggacgttaatgacaataagcccgtgttcatcgtcccgccatccaattgttcctacgaactagtgctccctagtactaaccctggtactgtggtcttccaagtcatcgccgtggataatgacaccgggatgaacgcagaggtgaggtattctattgtaggagggaacacacgagacttgtttgccatcgaccaggagacaggcaatattaccctgatggaaaaatgtgatgttactgacctcgggttgcatagagttctagtgaaggcaaatgatctggggcaacccgacagcctgttctctgtcgtaattgtcaatctgtttgtcaacgagtccgttactaacgccacgttgatcaacgagttagtgcggaaatccaccgaagcccccgtcacccctaacactgagatcgcagatgtctcttcacctacgagcgattatgtaaagattctggttgccgccgttgcaggaactattacagtagtggtcgtgatctttataacggccgttgtcagatgcaggcaggctccgcacctcaaagctgcacaaaagaacaagcaaaatagtgagtgggccaccccaaaccctgagaatcggcagatgattatgatgaaaaagaaaaagaagaaaaagaagcacagccccaaaaatctgttgctaaatttcgtgacaattgaagagacaaaagctgacgacgttgacagcgatgggaatagagtaacacttgacctacctatcgatcttgaggagcaaactatgggaaaatataactgggtaacaacgcccactacatttaagccagattcccctgatcttgcacggcattataagtctgcatccccacaaccggcattccaaattcagcctgagactcccctgaactcaaagcatcacatcattcaagaactgcctttggacaatacctttgtagcatgtgattctatatctaagtgttcttccagtagcagcgacccttattctgttagcgattgtgggtacccggtgactaccttcgaggtgcccgtatctgtacataccagaccggttgggattcaggtgtcaaacacaactttttag

SEQ ID NO: 131058 - DNA, 3933 bp, Artificial Sequence
  Description of Artificial Sequence: Synthetic coding sequence
atggacctcctgagcggaacttacatctttgcggtcctactggcttgcgtcgtgttccactccggagctcaggaaaaaaactataccattcgcgaagagatgcctgaaaacgtcctgattggtgacctcttgaaggacctgaacctaagcctgataccgaacaaatctctgaccacagctatgcagtttaagctggtgtataagactggggacgtcccgctgattcggatcgaagaagataccggcgagattttcacgacaggtgctcgaatcgatcgggagaaattgtgcgccggcatccccagagatgagcattgcttttatgaagtggaggtggcaattcttccagacgaaatatttcgactggttaagattaggtttctcatcgaagatatcaacgacaacgcacctctgtttccggcaactgtgatcaacatttcaatccctgaaaatagtgccatcaattctaagtacacacttccagccgccgtggaccctgacgtaggcattaatggagtgcaaaattatgagctcattaaaagccaaaacatttttgggctcgacgttattgagacacctgagggagataagatgccccaactgatagtgcagaaggagctagacagggaggagaaggatacatatgtcatgaaggtcaaggtagaggacggggggttcccccagagaagctccacggccatcctgcaggttagcgtgacagacaccaacgacaaccatccagtctttaaggaaacagaaatcgaagtgtctatcccggagaacgcacccgtaggaacctcagtgactcagctccacgccaccgacgcagatattggcgagaatgccaagattcacttttcattctccaatctggtgagcaatattgcccggcgactgtttcatctgaacgcaacaaccggactcatcacaataaaggagcctctggaccgcgaagagactcccaatcacaagcttctcgtgttggcatctgatggagggttaatgccagcccgcgctatggtccttgttaacgtaacagatgtcaatgacaatgtgcctagtattgacatccggtatatcgtgaatcccgtaaatgacactgtcgtgcttagcgaaaacattcctctaaacacgaagattgcactgatcactgtgactgacaaagatgccgaccataatggacgcgtgacgtgcttcaccgaccacgagattccattcaggttgaggcctgtttttagcaaccaatttctgctggaaacagctgcctacctcgactatgagtctacgaaggagtatgcaatcaagctgttggccgctgacgctggcaagccacccttaaaccaaagcgccatgctgttcattaaagtgaaagatgaaaacgataatgccccagtgttcacccaatcattcgtgacagtatcaataccagagaacaatagtccaggaattcagctgacgaaggtgtccgctatggatgcagacagcggcccaaacgctaagatcaactacctgttgggaccagatgcgcctcccgagttttctttggactgcagaaccggcatgttgactgttgttaagaagctggatcgggaaaaggaggacaaatatctgttcaccatacttgccaaagataatggtgtgcctccattgacgtcaaacgtgacagtgttcgtttctatcatagatcaaaatgacaatagtcccgtgtttacacacaacgaatacaatttctatgtgcccgaaaacttgccgagacatggtaccgtcggattgataaccgttacggaccctgattatggcgataacagcgctgtgaccctatccatccttgacgaaaacgatgactttaccatcgattcccagactggagtgattcgcccaaatatatcgttcgatcgggaaaaacaggagtcttacaccttttacgtgaaagcagaggatggtggcagggtaagtaggtcatctagcgcaaaagtgacaataaatgtagtggacgtgaacgacaataagcccgtcttcatcgttccgccatccaactgttcttatgaacttgtacttcctagcaccaacccagggacggtggttttccaagtgattgcagtggacaacgacaccggaatgaatgccgaggttagatattctatagttgggggaaatacacgcgatctgtttgccatagatcaggagaccgggaatattaccctcatggagaagtgtgacgtcactgatctgggactgcaccgggtgcttgttaaagcgaacgatttgggccaacccgatagcctcttttcggttgtgatcgtaaacttgttcgtaaacgaaagcgttacaaacgctacattaattaacgagctggtccggaaaagcaccgaagctcccgtgactcctaacacagagattgctgacgtgagctctcccaccagtgactacgtgaaaattctggtggccgcagtcgccggcacgattaccgtggttgtcgtcatcttcatcacggcagtggttcggtgccgccaggcaccacacctcaaggcagcgcagaagaacaaacagaatagcgagtgggcaacacccaacccggaaaaccgccagatgattatgatgaaaaaaaaaaaaaagaagaagaagcactctcccaagaacctgcttctgaattttgtcactatcgaagaaactaaagctgacgatgtggattcggatggcaatcgtgtgacactggacctgcccatcgacctggaagaacaaactatgggcaaatacaactgggtgaccaccccaaccaccttcaaacctgattcccctgacctagcccgacactacaaatctgcttcaccccaaccggcatttcaaattcagccagaaactccgttaaattctaagcatcatattatacaggagctgccactggataacaccttcgtggcatgcgatagcatctctaagtgttcatcctctagctctgatccatattcggtttcagactgcggctaccccgtgactacctttgaagtccctgtgtctgtgcacactaggccttcacagaggcgtgtaacattccacctccctgaagggtcccaagagagctcttcggacggtggtctgggagatcatgacgcaggtagcttgacgtctacatctcacggcttgccactgggatacccccaagaggaatacttcgatcgggcgaccccaagcaaccggactgaaggcgatgggaacagcgacccagagtcaacttttatacctggattgaagaaggcagcagagataacagttcaacctaccgtggaggaggcatcagacaactgcacacaagaatgcttaatctacggtcacagcgatgcatgttggatgccggccagccttgaccatagctcttctagtcaggctcaagcttccgcgctgtgtcactccccaccactctcccaagcttcaactcagcaccactctccccgggttacccagacaattgcgctgtgccattccccaccagtcacacagactattgcactctgccacagtccacctccaatccaggtttcagcgttacaccattcacctcccctcgtgcaagctacagctctgcaccattcaccacccagtgcacaggcgtcagccctgtgctattcacctcctctcgcccaagcagctgccatcagccatagtagccctctgcctcaagtaattgccctacatcggtcacaagctcagagctctgtttccctgcaacaaggttgggtgcagggtgctgacgggctctgcagcgtcgaccagggagtccaaggctccgctacgagccagttttacacaatgagcgagcgactgcatccctccgatgactctattaaagttattccattgacgacttttacaccaagacagcaggcccgcccttcacggggagactctcccataatggaagagcaccccttgtag

SEQ ID NO: 131059 - DNA, 4044 bp, Artificial Sequence
  Description of Artificial Sequence: Synthetic coding sequence
atggacttgttgagtgggacttatatattcgcagtgctccttgcttgtgtggtattccactccggagcccaggaaaagaactacacaatcagggaggagatgccggaaaacgtgctgatcggcgacctccttaaagatctcaacctcagccttatcccgaacaagtccctgaccacagctatgcagttcaagctggtgtacaaaaccggcgacgttccccttataaggatcgaggaggatacgggtgagatatttaccactggtgccaggatcgacagggagaagctctgtgcaggaatcccacgtgatgagcattgtttttacgaggtcgaggtggcaattctgcctgatgagattttcaggcttgttaaaattcgcttcctgatcgaggatataaacgacaacgcacctcttttccccgccacagtgataaatatctctatccccgagaattccgcaatcaactcgaagtacacactccccgctgcagtagaccccgacgtcggtatcaacggtgtccagaactacgaactgatcaagagccagaatatttttggtctcgatgtgatagagacacctgaaggcgacaaaatgccccaactcatcgtgcaaaaagagcttgatagagaggagaaggatacatacgtgatgaaggtgaaggtggaggatggggggtttccccaacgatctagcactgcaattctccaggtatctgttacagataccaatgacaaccatcccgtcttcaaggagaccgaaattgaagtgagcattcccgagaatgcgccggtgggtacgagcgttacacagttgcacgccacggacgcggatattggcgaaaatgccaaaatacactttagcttctctaatttagtgtctaacattgccaggagactgtttcacctgaacgctaccactgggctgatcaccatcaaggagccgctggaccgcgaggagaccccgaatcacaaactcctggtgctggcgagtgatggtggtttgatgcctgcccgtgcaatggtgctcgtgaacgtgacagatgttaacgacaatgtgccctctatcgatatacggtatatcgtgaatcctgtgaacgatactgtcgttctttcagagaatattccattgaatacaaagattgctctgatcactgtgaccgataaggacgcagatcacaacggccgagtcacgtgttttacagaccatgagatcccattcaggttgcggccggtcttttcaaaccaattcctactagaaactgccgcgtatctggattacgagtcaactaaagagtacgcgattaagctcctggctgcggacgccgggaaaccccctctaaatcaatcagccatgctgtttatcaaagtgaaagatgaaaatgataatgcccctgttttcacccaaagctttgtgaccgtttctatcccagagaacaatagtcctgggattcaacttacgaaagtaagcgcgatggacgcggacagcggcccaaacgctaagatcaactacctcctcggtcctgacgcaccccctgaattctctctcgactgccggaccggcatgctaactgtggtcaagaagctagaccgagagaaagaagataaatatctctttaccatcctcgcaaaggataacggcgtccctccactgactagcaacgtgacagtgttcgtgtcaatcatcgaccagaacgataacagccccgtttttacacacaatgaatataatttctacgtgcctgaaaacctgccacgccacggcacggtggggttgattaccgtgaccgacccagactatggggacaatagtgctgttacgttgtccattcttgacgaaaacgacgatttcacaatcgatagtcaaacgggagtaatccggcccaatatcagctttgatagggagaagcaagagtcatatactttttatgttaaagcagaggacggaggaagagtgagcagatcgtcatcagctaaggtgaccatcaatgtcgtggatgtgaacgacaataagccagtgttcattgttccccctagcaattgttcctacgaattagtgttgccatcgacaaaccctggaaccgttgtgttccaagtgattgccgtcgacaacgacaccgggatgaacgcagaggtacgctattccatcgtcggaggaaacacaagggacctttttgcaattgaccaggagacaggaaacattactctgatggaaaagtgtgacgtcactgatcttggtctgcaccgggtgctcgtgaaggctaacgatctgggccagccagactctctgttctcagtagtgatagtgaacctgtttgtgaacgaatcagtcaccaacgctacactgattaacgaactggtgaggaaaagcacagaggcgcccgtaacaccgaacacagagattgccgatgtctcatcgcccacctcagactacgttaagatactagtggcagcggtcgctggtacgatcacagttgtcgtcgtgatatttattactgccgtggtgcgttgccgacaagctccacacctcaaagcagcacagaagaacaaacaaaactcagaatgggctactcctaatcctgaaaatcgacagatgattatgatgaagaagaagaagaagaaaaaaaagcatagccccaaaaacttgctgctgaactttgtaaccatcgaggagacaaaggcggacgatgtcgatagtgatggaaatagggtcactctcgatctcccaattgatctggaagaacagactatgggaaaatataattgggtcactacaccaaccacttttaaaccagatagcccagacctagccagacactacaaaagtgcgtctccacagcctgcctttcagattcaacctgaaacgcctctgaactccaaacatcacataatccaggagctgccccttgacaatactttcgtggcctgcgacagcatcagcaaatgcagcagttctagcagcgacccctactccgtaagtgattgtggctaccctgtgaccacctttgaggtgcccgtgtccgtgcacactaggccccccatgaaggaggttgtgagatcctgtactccaatgaaagagtcgactaccatggagatttggatacatccacagccacagagaaaaagtgaaggcaaagtcgccggaaaaagccagaggcgagtcactttccacttgccagaaggtagccaggagtcatcctctgacggagggttgggtgaccatgacgctggaagcctgaccagcacatctcacggcctccccttaggatacccccaagaggagtatttcgatcgtgctacaccctctaaccggaccgagggcgacggcaattcagaccctgagtccacctttatccctggtctgaagaaagcagcagagattacagtgcagcccactgttgaggaagcttctgacaactgcacccaggagtgcctgatctacggacattcggatgcatgttggatgcccgctagcttggatcactcatcaagcagtcaagctcaggccagtgccctctgtcattcccccccattgtctcaggctagcacccagcaccactctcctcgggtgactcagaccattgcgctgtgtcattccccccccgtgacccagaccatagctctatgtcactcccctcctccaattcaagtgtccgcactgcaccatagccccccactggtgcaggctacagcactgcatcatagtccccccagcgcacaggcatccgctctatgctactcccctcctctcgcccaagcagctgccataagccactccagccccctgccgcaggtgatcgcattgcacaggtcgcaagctcagtcttctgtgagcctccagcaggggtgggtccagggcgcagacggactttgttccgtagatcagggtgtacaagggtcagccaccagtcagttctataccatgagcgagcggctgcatccaagcgacgacagtattaaggtcatccctctgactaccttcactcctcggcagcaggctcgcccctcccgtggtgactctcccattatggaggagcaccctctttag

SEQ ID NO: 131060 - DNA, 4014 bp, Artificial Sequence
  Description of Artificial Sequence: Synthetic coding sequence
atggacttgctctccggcacttacatcttcgctgtgctgctagcctgcgtcgttttccactctggagcccaggaaaaaaactacaccatcagggaggagatgccagaaaatgtgttaattggagacctcctgaaagatctaaatttgtcgctcatcccaaacaagtccctaaccaccgctatgcagttcaagctagtgtataagaccggggatgtccctctcatcaggattgaagaagatacaggagaaatatttactactggggcccggattgacagggagaagctgtgtgccggtattccaagggatgaacactgcttttacgaagtggaagtggcaattcttcccgatgaaatctttaggttggtgaagattagatttctgattgaagatatcaatgacaatgcacccctgttcccggccactgtgattaatattagcattcctgaaaatagcgccatcaactcaaaatatacactgcctgccgccgtggatccagacgtggggattaatggggtgcagaactatgaactaattaaatctcagaatatttttggccttgatgtgattgagaccccagagggcgacaaaatgccccagctgatcgtgcagaaagaactcgaccgggaggagaaggatacctacgtgatgaaagtaaaggttgaagatggggggtttccacagcgttcaagcactgcgatccttcaggtcagcgtcacagacacaaacgataatcatcccgtcttcaaagagaccgagatcgaggtctctattccagaaaatgcccccgtgggcacttctgtgactcagctccacgccactgacgcagacataggtgagaatgccaaaatccacttcagttttagcaatctagtctcaaacattgctcggagactgtttcatctcaacgcaacgactggtctaatcacaatcaaggaaccgctggatagagaagaaacacctaaccataagctgctggtgttggcctccgacggcggccttatgcccgcgagagccatggttcttgttaatgtcacagacgtgaacgataatgtgccaagtatcgatatcagatatatcgtgaacccggttaatgataccgtcgtattgagcgagaacatccccctaaatactaaaattgcactgataaccgttactgataaggacgccgatcataacggacgcgtcacatgcttcaccgaccatgaaattcccttccgcctgaggcccgtgttcagcaatcagtttttgctcgaaactgccgcatacctagactacgagagcaccaaagaatacgcaattaaactgctagctgccgacgccggcaaacctccgcttaatcagagcgcaatgttatttatcaaagtgaaagacgagaatgataacgctccagtgtttacacagtcctttgtgacggtttctatcccagagaataactccccaggaatccagctaactaaggtgtcagccatggatgctgactccgggccgaatgctaagatcaattacctgctcggccccgatgcaccgcccgagttcagtctggattgccggaccgggatgctgacggtggtgaagaagttggatcgggaaaaggaggataaatacctgttcaccattttggcaaaagataacggtgtgccgcccttaacttcaaacgttacagtgtttgtgtcgattatagatcagaatgacaactccccagtgtttacccacaacgagtataacttctacgttcctgagaacctgccccggcacgggaccgtgggcttaattacagtgacggatccagactacggggacaattcagctgtcaccttgagcatattagacgagaatgatgattttacaattgactcccagacgggtgttattaggcctaacatttccttcgacagggagaagcaagagtcctacacattttacgtgaaagcagaagatggaggacgggttagtcggagtagctccgccaaagtcactattaatgtcgtagacgtaaatgataataaacccgtgttcatagtcccaccttctaactgtagctatgaacttgtgttaccctcaaccaatcccggtacggttgtattccaggtcatcgctgtagacaacgacacaggtatgaacgctgaggtgcgctatagcattgtgggtggtaatactagggatctcttcgcgattgaccaggaaacagggaatattacattgatggaaaagtgcgacgtgaccgacctgggcctgcacagagtcctggtaaaagcaaatgatcttgggcagcctgattccttgttcagcgtggtcatcgtgaatctgttcgtcaatgagtccgtaaccaatgccaccctgattaatgagctcgtacggaaaagcactgaggcccctgtgaccccgaatacagagatcgcagacgtttcgtcgccgaccagtgattacgtaaagatccttgttgcggcagtagcgggaaccattacagtcgtggttgttatctttataacggccgtcgtgagatgccgtcaggctccgcacttaaaagccgcacagaaaaataagcaaaattcagaatgggctacacctaaccccgagaatcggcagatgattatgatgaagaaaaaaaaaaagaagaaaaagcactcccctaaaaacctcctcttgaattttgtcactattgaggagacaaaggccgatgatgtcgatagcgatgggaacagggtgaccctagatctacccatcgacctggaagagcagacgatggggaagtacaattgggtcacgacccctaccactttcaagcccgattccccagatctggccagacattacaaaagcgcttccccccagcctgctttccaaatccagcccgaaacccccttaaatagcaaacaccatattatccaagagttaccattagacaacacattcgtcgcttgtgacagtataagcaagtgctcctcgagctcctcagacccatacagcgttagcgactgcggctacccagtgacaacgtttgaagtaccggtgtctgtgcacacaagacctcccatgaaggaagtagtgaggtcttgcactccgatgaaagagagcactacaatggagatctggatccacccacagccgcagagtcaacggagagtcacctttcacctccccgagggatcgcaggagtcgagcagcgacggaggcctcggcgaccacgatgccggttctttgactagtacctcccacggcctcccgctggggtaccctcaggaagagtattttgacagggccactccgagcaaccgaaccgagggagacggaaattcagatccggaaagtacattcatacctggattgaagaaggccgctgagattactgtccagccaacggttgaggaagcaagcgacaactgcacccaagagtgtctgatctatggtcactctgacgcttgctggatgcccgcctccctcgatcatagtagctcatctcaggctcaagcctcagctctgtgccactccccacctctgtcacaagcctcgacccaacatcacagcccgcgagtgacgcagactatcgccctatgccactccccgcccgtcacacagactatcgctctctgtcattccccccctccaatccaggtatcagctctccaccacagtcccccactggtgcaggcaaccgcactccaccactcccctcctagtgcccaggcttctgcattgtgttattcacctccactggctcaggcagccgcaatctcacacagctctcctctgccacaggtgatcgcactccataggtcccaagcacagtcttccgtatccctccaacagggctgggtgcaaggcgctgatgggctatgttccgtagatcagggggtccaggggagcgcaacttctcagttctatacgatgtccgaaaggctgcacccatccgacgactcgatcaaagtcatcccgctaaccacatttacgcctcgccagcaggcacgtccaagcagaggggactccccaattatggaagaacaccctttgtag

SEQ ID NO: 131061 - DNA, 3078 bp, Artificial Sequence
  Description of Artificial Sequence: Synthetic coding sequence
atggacttactatctgggacatacattttcgcagtgctgttggcatgtgtcgtctttcatagcggggctcaggaaaagaactacaccattcgggaagaaatgcctgagaacgtcctaataggtgacttgctgaaagatttgaacctttcccttattccaaataagagcctgaccaccgcaatgcaattcaaactcgtctacaagaccggcgatgttccacttatcagaatcgaagaggacacaggggagatcttcacgaccggcgcccggattgatagagaaaagttgtgtgccgggatcccaagggacgaacactgcttctacgaggtggaagtggctatcctgccagacgagatttttcgattagtgaaaattcggtttctgatagaagatatcaacgataacgctccattatttcctgcaactgtcatcaacataagcattccggagaattccgccatcaacagtaaatatactttgcccgcagcagttgatcctgacgtcggtatcaatggggtccagaattacgagctgatcaagtctcagaatatctttgggctcgacgtaattgaaactcccgagggcgataagatgccccagcttatcgtgcagaaagaattggatagggaagagaaggatacttacgtgatgaaggtgaaagtcgaggacggaggatttccccagcgttcaagcacggccattctgcaggtctctgtgacagataccaacgacaaccacccagtattcaaggagacagaaatcgaggtgagcatcccagaaaacgcccctgtggggacctccgtgactcaactgcacgctacagacgccgacattggagagaatgcgaagattcacttcagtttttccaatctcgtaagcaacatcgccaggaggttgtttcacctcaacgctactacaggactgataactataaaagaacctctcgatagggaagaaactcccaaccacaagttattagtgttagcaagcgacggtggcctgatgccagcgcgggctatggtgctggttaacgtcactgatgtcaacgataacgtgccttctatcgatatacggtacattgtgaaccctgttaatgataccgtggtcttaagcgagaacattcctctcaacacaaagattgccttaatcaccgtcaccgataaagatgccgaccacaacggaagggtcacatgtttcacagatcatgagatcccgttccggctgcgtccagttttctccaatcagtttttattggagactgctgcctacctcgattatgaaagcaccaaggagtatgccattaaattattggctgcagacgcgggaaagcctcctctcaaccagagcgcgatgctgttcataaaagtaaaggacgagaatgacaatgcgccagtttttactcagagttttgtgacggtttccattccggagaataatagccctggcatccaactcaccaaggtgtccgctatggacgccgatagtggccccaacgcgaaaattaactacctcctcggccctgatgccccccctgagttttccctggactgtcgtacgggcatgttgaccgtggtcaaaaaactcgaccgtgagaaagaagacaagtatctttttacaattctcgctaaagacaatggagtacctccgttaacatcaaacgtgaccgtgtttgtctctataatcgaccaaaatgacaactccccagtattcacccataatgaatataatttctacgtacccgaaaacctcccccgccacggcactgtgggcttgatcaccgtgacggatccagattatggggataactccgctgtgacactgtctatactggacgagaatgacgatttcaccatagattctcagactggcgtcatccggcctaacataagtttcgatagggagaagcaggagtcttataccttctatgtcaaggccgaggacggcgggcgcgtcagcaggtcttcatcagccaaggtaaccattaatgtggtggacgtcaatgacaacaagcccgttttcatagtgccacccagtaactgcagttacgagctcgtactgccatccactaatcctggcaccgtggtgtttcaggtcattgctgtggataacgatacaggcatgaacgcagaagtgaggtattccatcgtgggcggtaatacccgtgatctgtttgcaatcgatcaggagactggcaatatcactctgatggagaaatgcgatgtcactgatctgggacttcaccgggtgctggtgaaggccaacgacctggggcaacccgattctctgttttcggttgtgatcgtgaacctcttcgtcaacgagtccgtgaccaacgctacactgatcaatgaactcgtgcggaagtccacagaggcccccgtgactcccaatactgaaattgccgatgtgtcatcccccacatctgactacgtgaagatcctggtagcagcagttgcaggaacgattactgtggtggttgttattttcatcactgctgtggtgaggtgtcggcaggcaccacacctgaaggcggcccagaagaacaaacagaacagtgagtgggccactcctaaccccgaaaaccgccagatgatcatgatgaagaaaaagaaaaagaagaagaagcactccccgaagaatctgctgttgaactttgtgacgatcgaggaaactaaagccgacgacgtcgactctgatggaaacagagtgactttggacctccctattgatcttgaagagcaaaccatggggaagtacaattgggtaacaacacccactacgtttaaacctgatagcccagacttagctagacactacaaatcagccagcccccagcccgccttccagatccagcctgaaactcctctgaacagtaaacaccatattatacaggagctcccgctggacaacacgttcgtcgcgtgcgattctatttcaaagtgtagctcttcatcatctgatccatattccgttagcgactgcggttaccccgttaccaccttcgaagttcctgtgtcagtccataccaggcccactgattcaagaaccagtactatcgagatttgttctgaaatatag

SEQ ID NO: 131062 - DNA, 4020 bp, Artificial Sequence
  Description of Artificial Sequence: Synthetic coding sequence
atggacttactgtctggaacgtatatcttcgcagtgctgcttgcgtgcgtcgtttttcacagcggggcccaggagaagaattatacaatccgagaagagatgcccgagaacgtcttgatcggcgacctcctgaaagacctcaatctctccctcatccccaataaatcactaaccacagctatgcaatttaaactagtgtataagacaggcgacgtacctcttatccgaattgaagaggataccggcgaaatcttcactactggcgcgagaattgaccgggagaagctgtgtgcaggcattccaagggacgaacattgtttctatgaggtagaggtggcgattcttcctgacgaaatcttccgcctagttaaaattcgttttctaatcgaagatatcaacgataacgctcccctgttccctgccactgtgatcaatatttcgataccggagaattctgcaatcaactccaaatatacacttcccgccgccgtagaccccgacgtgggcatcaatggtgtgcagaattatgagctgatcaaatcccagaacatctttggcctggatgtgatcgagacaccggagggggacaagatgccgcagctgatagtccaaaaggagcttgacagggaggaaaaggacacatacgtgatgaaggtgaaagtggaggatggtggatttccccagcggagctccacagccatcctacaggttagtgtgaccgataccaatgataaccaccctgttttcaaggaaaccgagatcgaagtgagtatccctgagaacgctcccgtcgggacctccgtgacccagctgcacgctacagatgccgacattggagaaaacgccaagatccatttttcgttttcgaaccttgtcagtaatattgctcgacgactgttccacctgaatgccacaaccggcctgattaccatcaaagagccactcgatcgcgaggagacccccaatcataaattgcttgtgcttgcttccgacgggggactgatgcctgcaagggccatggtgttagtgaatgtcaccgacgttaatgataacgtcccttcaatagatataaggtatatcgtgaaccctgttaacgacaccgtcgtactgagcgagaacattccactcaatactaaaattgccctgattaccgttaccgataaagatgcagatcataacggacgcgttacctgctttactgatcatgagattcctttccgacttcgtcctgtcttttctaatcagttcctgctcgagacagctgcctatctggattatgagtcaaccaaggagtacgcgatcaagctgctcgctgccgatgcaggcaagccgccattgaaccagtccgcgatgctcttcatcaaggtgaaagatgagaacgataatgctcccgtcttcacacaaagtttcgtcacagttagcataccagagaacaattcccctgggatccagctgactaaggtatctgcaatggatgcagacagcggaccaaacgcgaaaattaattacctcctgggcccagatgcgccccccgagttcagcttagattgccggaccggcatgctgaccgtcgtcaagaaattagatagggagaaggaagataagtatctgttcaccatcctggctaaagacaatggtgtacccccccttacgtccaacgtgacagtattcgtctctatcatagatcagaacgataacagccccgtgtttactcataacgagtacaacttttacgtccctgaaaacctgcccagacatgggactgttggcctgattaccgtcaccgatccagactatggggataatagcgcggtgactctttccatcttggatgagaacgacgatttcaccatcgattcccagactggagtgatacggccgaatatatcctttgaccgcgagaaacaagagagctatacattttacgtgaaggcggaagacggcggccgggtttccagatcgtcctccgccaaagtcacaataaacgttgtggacgtaaacgataataaacccgtgttcattgtgccaccctccaactgctcttacgaactggtgctgccatccacaaacccagggaccgttgtttttcaggttattgctgtggataacgacaccgggatgaacgccgaggttcgttactcgattgtgggtggaaacacaagagacctgtttgccattgaccaggaaacagggaatattactttgatggagaagtgcgacgtgacggacctcggcttgcaccgcgtccttgtgaaggccaacgatttgggacagcccgattctctgttcagtgttgtaatcgtcaacctatttgtcaatgagtcggtcacgaatgccacgctgatcaacgaactggtgaggaagtcaaccgaggcccctgtgactccgaacactgaaatcgctgatgtgagcagtccaacctcagattacgtgaagattcttgttgcggccgtggccggaactattactgtcgtggtggtcatctttattaccgccgtggttcggtgtagacaagcccctcacctgaaagccgctcagaagaacaagcaaaactccgagtgggctacaccaaatcccgagaatagacagatgattatgatgaagaaaaaaaagaaaaagaaaaaacactccccgaagaacctgcttctgaacttcgtcaccatcgaagagaccaaggctgacgatgtggattctgacggaaaccgggtgacgctggatttgccgatagatctggaagagcagacgatgggtaaatacaactgggttacaactcccactacctttaagcctgatagtccggatctggcgcggcactacaagtccgcctccccccaacctgctttccagatacagcctgagaccccactgaacagcaagcaccacataattcaggaattaccactcgacaacacattcgtggcgtgtgacagtatcagtaaatgtagtagttctagctctgatccctactctgtgtctgactgcggctaccccgtcactaccttcgaggtgcccgtgtccgtgcacacacgtccaccaatgaaagaggtagtcagaagttgtactcccatgaaggaatccactactatggaaatctggatccatccacagccacagcgcaaatctgagggaaaagtggcggggaagtcgcagcgccgagtgacattccaccttcccgagggatctcaagaatcctcttccgacggtggcctcggcgaccacgacgcaggaagcctcacgtcgacctcccacgggctgcccctcggctacccgcaagaggagtattttgaccgcgcgacacccagtaaccgcacggagggcgacggcaacagtgaccctgaaagtactgctgagatcacagtacagccaacagttgaggaggccagcgataattgcactcaggagtgtcttatctatggacacagtgatgcctgctggatgccagcaagcctagaccacagtagttcctcccaggcgcaagctagcgcattatgccatagcccccctctgtctcaagcgtccacccaacaccatagcccgagagttactcagaccatcgctctgtgtcactcccccccggtaacacagactatcgcactgtgtcattcaccacccccaattcaagtgtccgctctccatcactcccctccccttgtgcaggctaccgcactgcatcactcccctccctcagcacaagccagtgccttatgttattcaccccctcttgctcaggcagcagcaatatctcattcatcccctctccctcaggtgatcgctctccacagatcgcaagcacagagtagcgttagtctgcagcaaggttgggttcagggcgcagatggattgtgtagtgtggatcagggcgtccaagggtcagctacatctcagttctacacaatgagcgagagattgcatccgtccgatgactccatcaaggtaattcccttaactacatttactccccgtcagcaggcccggccctctagaggggactctccaataatggaagaacatccactgtag

SEQ ID NO: 131063 - DNA, 3198 bp, Artificial Sequence
  Description of Artificial Sequence: Synthetic coding sequence
atggatctgctctcaggcacttatatcttcgccgttttgctcgcctgtgtggtgtttcatagcggagctcaggaaaaaaactacaccatcagggaggagatgcccgagaatgtgctcatcggcgatctcctgaaagacctgaatctgtccttaattcccaacaaatcgctgaccactgcgatgcagtttaagcttgtgtataagacaggtgacgtgcctcttatccgcatagaggaggataccggagagatttttaccacaggcgcgagaatcgatagagaaaaactgtgcgcaggcattccgagagatgaacactgtttttatgaggttgaggtcgctattttgccggacgagatctttcgccttgttaagattcgctttttgattgaggatatcaatgataacgcacccctttttcctgccacggtaattaacatttcaatacccgagaattccgcaattaacagtaagtataccctccccgccgctgtagatccagatgttggtattaatggcgttcagaattacgagctcattaaaagtcaaaatatcttcggactcgacgtgattgagacaccggaaggcgataaaatgccccagctcatcgtccagaaagagctggaccgggaggaaaaagatacatatgtgatgaaggtcaaggtcgaagatggcggctttccgcagaggtccagtactgccatactgcaggtgagcgtgacagatacgaatgacaatcacccagtgttcaaagagaccgagatagaggtcagtattcccgagaacgcgcccgtgggtacatctgtcacccagttacatgcaacagatgcggatatcggcgaaaacgccaagatccacttttcattctctaacctggtgtcgaacatcgctagaaggctgtttcacctgaacgccaccacagggttaatcactataaaggaaccactggacagggaagagacgccaaaccacaagctgctggtgctggctagtgatggagggctgatgcccgcaagggcaatggtcctggtgaatgtgacagacgtgaatgataatgttccgtcaatcgacattcgctacattgtgaatcctgtcaatgacacggtggtactttcagaaaacattcctcttaacacaaaaattgcgctcatcactgtaactgataaggatgctgatcataacggccgcgtcacctgctttactgaccacgagatacccttcaggttgagaccggtgttctccaaccaattcctgctggagaccgcagcataccttgattatgagtctacaaaagagtacgccattaagctgctggctgctgacgcagggaagccgcctctcaaccagagtgccatgctattcatcaaagtgaaggatgagaacgataatgccccagtatttactcaaagctttgttactgtctctatcccagaaaataacagccctggtattcaattgaccaaggtgtcagcaatggacgcagactccgggcccaatgccaaaatcaattacctattgggccccgatgccccaccggagttctccctggattgtcgcacaggcatgctgaccgtggttaaaaagctggaccgggagaaggaagataaatacctctttaccatactagccaaagataacggtgttcccccactcacatctaacgtgactgtcttcgtgagcataatcgaccagaatgacaacagtcctgtgttcacacataatgaatacaacttctacgtgcctgaaaatctgcctcggcatggcactgttggactgatcacggtgacagatcctgattacggcgataactctgccgtcaccctgtccatactggacgagaacgacgatttcaccatagattcccaaactggcgtgatacgccctaacatatccttcgaccgagagaaacaagagagttacactttttacgtgaaggctgaagacggcggtcgtgtgagccgtagcagcagcgctaaggttactattaatgtggttgatgtcaatgacaacaaacccgtctttatcgtgcccccttccaattgctcctacgaactcgtgctccccagcactaacccaggtacagtcgtttttcaggtgatcgcagttgacaacgacaccgggatgaacgcagaggtgcgttacagtattgtgggtggcaatacacgggacctctttgccatagaccaggagacaggcaacattaccctgatggagaagtgtgacgtgacagatttaggactacatagagtgctggtcaaggccaacgatctggggcagcccgactccctcttctccgtagtcatcgtgaatcttttcgtaaatgagtcagtgaccaatgcaactctgatcaacgagctcgttcgcaagagcacggaagccccagtcacgccaaatactgagatcgccgatgtgagttcacctaccagtgattatgtgaagattctggtggctgcagtggcaggcacaatcaccgtcgtggtcgtcatcttcatcacagccgttgtgaggtgccggcaggcccctcatcttaaggccgcacagaaaaataagcagaatagtgagtgggccacacctaatcctgagaatcgccagatgatcatgatgaaaaaaaagaagaaaaagaagaagcattcccctaaaaatctgctccttaatttcgtcaccattgaggagaccaaggctgatgacgtagactcagatggcaacagggttacacttgatctgcctattgatctagaggagcagacgatgggaaaatacaattgggtgactaccccgactacatttaaacccgactctccagatctcgctcggcattataaatccgcaagcccccagccggcgtttcaaatccaacccgaaactccgctaaactcgaaacaccatataatacaggagctgccgctggacaacacctttgtggcgtgcgattcaatttcaaagtgttctagctcatccagcgatccttacagcgtctctgactgcggatacccagtgactacatttgaggtgcctgtgtccgtgcacacacgccccccgatgaaggaggtggtccgctcctgtacccctatgaaagagtccaccacaatggagatttggattcatccccagccacaacggaagagcgagggtaaagttgcaggtaaaacggtgctgacgagctcgagcccatctgctatgaccctatcctacctggattag

SEQ ID NO: 131064 - DNA, 1344 bp, Artificial Sequence
  Description of Artificial Sequence: Synthetic coding sequence
atggcgaccgccgccacaactactaccaccacaacagctaccgtggcgctaactacctcctgggataacgcaaccggcaggccaaccgccgagccagatccaattctcgacaattatgtgctcctggtcgttgttatgtccctcttcgtggggggaacccttgtcgtgctgagcggagtactgctcctgtgcaagagatgttgggacgtgcaccagcgcctgaacagagctatggaggaagctgagaagactaccaccacatatctcgacaacgggactcaccccgcccaggacccagattttagaggcgaagaccctgaatgtcaagacgccgagactgaaaggttcctctctaccagctctaccggtagacgcgtctccttcaatgaggccgccctctttgaacaaagccgcaagacccaggacaaagggaggagatatacactcaccgagggagacttccaccacctcaaaaacgcgcgactaacacatctgcacttaccccctctgaaaatcgtgacgatacacgagtgcgatagcggcgaggcttcttcagctacaactcctcacccggctacttcccccaaagctactttagctatttttcagccaccaggtaaggcacttactgggagaagtgtagggcccagctctgccctgccaggtgatccttacaattccgctgcgggggccaccgacttcgccgaaatcagtccaagcgcaagttctgacagcggggagggtacgagcctggacgcaggtacaaggtctaccaaagccggcggccctggggccgcggcaggacccggtgaggctggtcctgggtccggtgcaggaacggtcttacaattcttgaccaggttaagacggcatgcatcacttgacggagcatccccatattttaaagttaaaaaatggaagctggagcctagccagcgtgctgctagtcttgacacccggggatcccccaaacggcaccatttccaacgccagcgcgccgcctcggagagcacagagcaggaggagggggacgcccctcaggaagacttcatccagtatatcgcccgtgccggagacgccgtggcctttccacacccacgcccgttcctggcgagccctccacctgcccttggcaggtatttctccgtcgacggcggcgctagagggggccccgtgggaccatgtcccccatctccaccccctcgacggcccagagagcgctctccgggccccgtggatacccggtcaccagcttctagcggtaaagccccacctagagggggactcactggtgccacgtctccggcttggacaagaggagggaaacaaggggagacaggatag

SEQ ID NO: 131065 - DNA, 3114 bp, Artificial Sequence
  Description of Artificial Sequence: Synthetic coding sequence
atgactgtgggatttaactccgatatctcctcagtcgtgcgggtaaacacaactaactgccacaagtgcctactgtccggcacatatattttcgcagtgctgcttgtttgtgttgtcttccattccggtgctcaggagaaaaattatacaatccgtgaagaaatccctgaaaatgtcctgattggcaatttgttaaaggatctcaacctgtcactaattcccaacaagagtctgaccacaaccatgcagttcaagcttgtctacaaaacaggagatgtcccattaattcggattgaggaagacacgggagaaatatttacgaccggagctaggatcgatcgggagaagctgtgcgccggcatcccgcgagatgaacactgcttttatgaagtggaggtggccatcctgccagacgagatcttccggcttgtgaagatcagattccttatcgaagacattaatgataatgccccactgttcccagccactgtgattaacatcagtatacccgagaactcagcaatcaatagcaagtacacgctcccagccgctgtcgacccagacgttggaatcaacggagtgcagaattatgaactcatcaagtcccagaatattttcgggctggatgtgattgagacacccgaaggggacaagatgcctcagctcattgtgcagaaagaactggaccgcgaggaaaaagacacctacgtgatgaaagtgaaagtagaggatggcggattccctcaacgcagtagcaccgccatcctgcaggtctcggttactgacacaaacgataatcatcccgtgtttaaggagaccgagatcgaggtgagcatcccagagaatgctccagtgggtacatccgtgacacagcttcatgcaaccgacgcagacatcggcgagaacgcaaaaattcactttagcttttcaaacctggtgagcaatatcgctagaaggctgtttcacctcaacgccaccacaggcctgataacgatcaaggaaccccttgaccgggaggaaaccccaaatcataagctcttagtgctcgcctcagacggcggactgatgccagcaagagccatggtcctggttaacgtcaccgacgtcaatgacaacgttcctagcatcgatatccggtatatcgttaatcccgtaaacgacacggtggtcctgtccgagaatatcccccttaacacgaaaatcgcactgataacagtcacggataaagatgccgaccataacggccgagtgacttgctttaccgatcatgagattccattccgactgaggccagtgttctctaatcagtttttgctggagaacgccgcatacctggactacgagagcaccaaagaatatgcaattaagctgcttgctgccgacgcggggaagcctcccctcaatcaatccgctatgctctttattaaggtgaaagacgaaaatgacaacgcacctgtgttcactcagagtttcgtgactgtgtccattccggagaataacagtcccggcattcaacttatgaaggtctctgccaccgatgccgatagcggccctaacgctgagattaattatctactgggccctgacgctccacccgaattttccttagacagacggaccgggatgctcaccgtagtcaaaaagctggatcgggagaaagaagacaaatacctgttcaccatcctggccaaggacaatggagtgccgccactcacatccaatgtgactgtatttgtgtccatcatcgatcagaatgataacagtcccgtgtttacgcacaacgagtacaaattctacgttccggagaacctcccacgccacggcactgtcggccttatcacagtaacagatcctgattatggggacaactcagcagtcactctgtctattctggacgagaatgacgacttcaccatagatagtcaaaccggcgtgatccgtcctaacatcagttttgatcgagaaaagcaagagtcatatacattctacgtgaaggcagaggatggaggtcgggtgagtcgcagttcatcagccaaagtcacaattaacgtcgtcgacgtgaacgataacaaaccagtatttatcgtgccgccctacaattactcttatgaacttgttttacctagcacaaatcctggtacagtggtgtttcaggtcattgctgtcgacaacgataccggtatgaacgcagaagtacggtatagcatagtaggggggaacaccagagacctatttgctatcgaccaggaaacagggaacattaccctcatggaaaagtgcgatgtcacagatcttggactccaccgagtactcgtcaaggcaaacgacctgggccaacctgattctctgttttcagtcgttattgtgaacctgttcgtaaatgagtcagtgacaaacgccacattaattaacgagctcgtgagaaagtccattgaggccccagtaacacccaacacagaaatcgcagatgtttcctcacccacgtccgattatgtgaagatcttggtcgccgccgtggccgggacaatcacagtggtggtggtgatctttattacggccgtggtaagatgtcgccaggctcctcatcttaaggcagcccagaagaacatgcagaacagtgaatgggccacccctaaccccgaaaaccgtcagatgattatgatgaagaagaagaaaaaaaaaaagaagcattctcctaaaaacctcctcttgaatgtggtcactatagaagagacaaaggcggatgacgttgattctgatggcaatagggttacccttgatctgccaatcgatctggaagagcagactatgggcaaatataactgggtaaccacccctacgacctttaaacctgattcccccgatctggccagacactataagagcgctagtccacagccggctttccaaattcaacccgagaccccactgaacttaaagcaccacattatacaggaactacctttggacaatacatttgtcgcctgcgactcaatctctaattgctcctcgagcagtagcgacccctactctgtgagtgattgtggctaccctgtcacaaccttcgaagtgccagtgtctgtccacactcgtcccactgattctaggacgtag

SEQ ID NO: 131066 - DNA, 3147 bp, Artificial Sequence
  Description of Artificial Sequence: Synthetic coding sequence
atgtttcgcgtaggtttccttattatctcctcatcctcttctcttagccccctccttctagtgagcgtggtacgcgtgaatacaaccaattgtcataaatgtcttctctcaggcacatacattttcgctgtgctgctcgtgtgcgtcgtgttccattcgggtgctcaggagaaaaactacaccatccgcgaggagatacccgagaatgtgctcataggaaacctccttaaagacctcaacctaagccttatccccaataaatcactgaccaccacaatgcagttcaaactggtgtataagactggggatgtgcctttgattaggatcgaggaggacacaggagaaatttttaccacaggagccaggattgatcgcgagaaactctgcgcgggaattccacgcgatgagcactgcttttacgaggttgaggtagctatcttacccgatgaaattttccggctggtcaaaattagatttttgattgaggatataaatgataacgcccctctcttcccggccacagtgatcaacatcagcattccagaaaattccgctattaattctaagtataccttgcccgccgccgtggacccagacgtggggattaacggagtgcagaattacgagctgatcaaatcccaaaacattttcggcctggatgtgatagagacccccgaaggcgacaagatgcctcagctaattgtgcagaaggaactggatagggaggaaaaagatacatacgtgatgaaagtgaaagtagaagacggcggcttcccacaacggagctctactgcgattctccaggtcagcgtgacagatacgaacgacaaccatcccgtctttaaagaaaccgagatcgaggtctctatccctgagaacgctcctgtcgggacgagcgtgacacagctccatgctacggatgctgacatcggggaaaatgctaagatccatttctccttctctaacttggtgtccaatatcgcacgccgactgttccatctgaatgctaccacaggcttgataacaataaaggaacctctggacagggaggagactcccaatcacaaactgctggtgctggcctccgatggaggactgatgcctgcccgcgctatggtgctggtcaacgttactgacgtgaacgacaatgttccatccatcgatattaggtacatcgtgaatcccgtgaatgatactgtagttcttagcgagaatatcccacttaataccaaaatcgccctaattaccgtcacggataaagatgcagaccacaacgggagagtgacatgtttcactgatcacgagattcctttccgcctcaggccagttttttccaaccagtttttgctggaaaatgcagcgtatcttgactacgaaagcactaaggaatatgccattaaacttctcgccgcagatgccggcaagcctccactgaatcagagtgctatgctgttcattaaagtaaaagacgaaaacgacaatgctcccgtgttcactcagagtttcgtcaccgtatctatacccgagaacaatagccccggcatccagcttatgaaagtctcagctaccgacgcagattcgggccctaatgccgagataaactacctgctaggccccgacgccccccctgagttcagcctggatcgccggactggtatgctgacagtggtcaaaaagctagatagggagaaggaagataagtacttgttcaccatcctggccaaagataacggggtgccacccctcacaagcaatgtcactgtgttcgtgagtatcattgaccagaacgacaattccccagtattcacccacaacgagtacaagttctatgtgcctgaaaacctgcctaggcatggcactgtgggtctgataactgtgacggaccctgattatggcgacaattcggccgtcactctatccattctcgatgagaacgatgattttactatcgactcacagactggcgtaataaggcccaacatcagcttcgatagagaaaagcaagagagctatacattctatgtgaaggcggaagacggtgggcgggttagtcggagtagcagtgccaaagtaactataaatgtggtggatgtcaatgacaacaagccagtctttatcgtgcctccttataattactcctatgagctggtgctaccatcaactaacccaggaacagtcgtttttcaggtcatcgccgtggacaatgatactgggatgaacgccgaggtccgctactctattgtcggaggcaatacacgagatctgtttgctattgaccaggaaaccggaaacattaccctgatggaaaaatgcgacgtgacagatctgggcctgcaccgagtgctcgtgaaggccaacgatctcgggcagccggacagcctgttctccgtggtcattgtgaacctatttgtgaacgaatcagtgactaacgccacactcattaacgagctcgtcaggaagtctatcgaggctccagtgacaccaaacacggagatcgctgacgtctcaagtccgacctccgattacgtcaaaattcttgtggccgctgtggcagggaccatcacggtcgttgtagtgatatttatcactgctgtcgtgcgttgccggcaggcaccccacttgaaagccgcgcagaaaaatatgcagaactcggaatgggctactcccaatccggaaaacaggcaaatgattatgatgaagaaaaaaaaaaagaagaagaagcactcccccaagaatttactgttaaacgtggtgacaattgaggagaccaaagctgatgacgtagactcagacggcaacagggtgaccctggatctaccgatcgatctggaagagcaaactatgggaaaatataattgggtgactacgcctactacttttaagcccgatagtcctgacttggccaggcactacaagagcgcatctccccaaccagcttttcagatccagccagaaacaccactgaacctgaagcatcatattatacaagaactgcctcttgacaacacattcgtggcttgcgattctatttctaattgctcttcttcatcctcagacccatactccgtatccgactgtggttacccagttacaactttcgaagtgcccgtaagcgttcatacacggcctactgatagtcggacctag

SEQ ID NO: 131067 - DNA, 3960 bp, Artificial Sequence
  Description of Artificial Sequence: Synthetic coding sequence
tgagtggtccgagttaatacaaccaactgccacaaatgtctgctgagcggtacgtacattttcgcggtgctgctcgtgtgtgtggttttccacagtggcgcccaggagaagaactatactataagggaagaaatacctgagaacgtattgattggaaatttattaaaagatctcaacctctctcttattccgaataagtcccttaccaccactatgcaattcaagttggtctataagactggagatgttccactaattcgaatcgaagaggacactggcgaaattttcacaaccggtgcccgcatcgatagggagaagttgtgtgctgggatccctcgcgatgagcactgtttttacgaggtggaggtggccattctgcctgatgaaatattccggttggtaaaaattcggtttctgattgaggatattaatgataatgcaccactcttcccagccactgtgattaatatctcaatcccagagaactcggctatcaacagcaagtatacacttcctgcggccgtcgatcccgacgtcggtatcaatggtgtgcaaaattatgagctgataaaatcccaaaatatctttgggttagatgtgatcgagacccctgaaggtgacaagatgccgcagctgattgtccaaaaagaactggatagggaagagaaggacacctatgtgatgaaagtcaaggtcgaagatggcggtttccctcaacggagttctacggccattttgcaggtatccgtgactgataccaatgataatcatcccgtgttcaaagagactgaaattgaagtgtcaatccctgagaatgcacccgttggtacttctgtgacccagctgcacgcaactgacgctgacatcggcgaaaatgccaagatccatttctcgttctctaatctggtctctaacatcgcacggcgcctctttcacttgaacgcaaccaccggacttatcaccataaaggagcccctggatcgcgaagaaacacctaaccataagctacttgtgctagccagcgacggcggcctcatgccggctcgcgccatggttctggtcaacgttacagatgtgaatgataacgtgccttcaatcgatatccgttacatcgtgaatcctgtcaatgatacagtggtcctgtctgaaaatattcccctgaataccaagattgcgctcatcaccgtgaccgataaggacgcagatcacaatggcagggttacatgctttactgaccacgagatccccttcaggctaaggcccgttttctccaatcagttcctccttgaaaatgccgcgtatttggattatgagtctaccaaagaatacgccataaaactgctcgctgcagacgccgggaagccaccgctaaatcagtctgcaatgttgtttattaaggtaaaggatgagaacgacaatgcccccgttttcacacagagttttgtgacggtgagcatacccgagaacaatagcccaggaatacaattgatgaaggtcagcgcgactgatgctgattctggacccaatgcagaaattaattatctcctgggcccagatgctccaccagaattttcattagaccggagaaccggcatgttgaccgtggttaaaaagctggaccgcgaaaaagaggataaatatctgtttacaatcttagctaaggacaacggcgttccacctcttacaagtaacgtgaccgtgttcgtcagtataatcgaccaaaacgacaactcgcccgtgttcacacacaatgaatataaattttatgttcccgaaaatctgcctcggcatgggacagtaggcctgatcactgttactgatcctgactatggcgacaactccgctgtgacactttcaattctagacgagaacgatgacttcacgattgactcccagactggggtaatccgcccaaacatctcctttgatagggagaagcaggaatcctataccttctacgtcaaggcagaggatggaggcagggttagccgcagctcatctgccaaggtcacaatcaacgtcgtcgatgtgaatgataataaacctgtcttcattgtgcctccctataattactcttatgagctggtgctgcccagtactaaccctgggactgtggtgttccaggtgatcgccgtggacaacgatacgggaatgaacgcagaagttcgatatagcatcgtgggagggaacaccagggacttgttcgccatcgatcaagaaactgggaatattactctgatggaaaaatgcgacgtgacggatctggggctccatcgggtattggtaaaggctaacgacctagggcaacccgactctctgttttccgttgttatagttaacctatttgttaacgaatccgttaccaacgcaaccctcattaacgaacttgtaaggaagagcatcgaagcccctgtaacacccaataccgaaattgccgacgtttcttcacccacatcagattatgtcaaaatcctggtcgctgccgttgcggggacgataaccgtagtagttgtgatcttcataactgccgtcgtccgatgtcgacaggccccacaccttaaagctgcacaaaagaacatgcagaactctgagtgggcaaccccaaatcccgagaacagacagatgattatgatgaagaaaaaaaagaagaagaaaaagcactcacccaagaatctactgcttaatgtcgttactattgaggagaccaaggcagacgacgttgacagcgatggaaaccgggttactctcgacctccccatcgatctggaggagcagactatgggcaagtacaattgggtcaccactccaaccacatttaaacccgactctcctgacctagccaggcattataaatcagcctctccacagcccgcatttcagatacagcccgagacccccttgaatctgaagcaccatataatccaggaattgcccttggacaacaccttcgtggcctgtgatagcatctcaaattgctcctcttccagttccgatccgtacagcgtgagtgattgcggctacccagtgaccacttttgaggtgccggtgagtgtacacacgcgacccagtcagcgccgggtgacattccaccttcccgaggggagtcaggaatcaagctcagacggcggactgggcgaccatgacgcgggcagtctcacttctaccagtcatggacttcccttgggatacccccaagaggagtattttgatcgggcaacaccctctaaccggactgagggagatgggaactctgacccagagtccacatttataccaggcctgaaaaaagaaatcaccgttcagccaacagtggaggaagccagtgataactgtactcaagagtgcttgatctatgggcatagcgacgcatgttggatgcctgcctctctggatcactctagctcttcacaggcccaggctagtgccttgtgtcactcgccccccctgtcacaggcatccacacagcatcattctcctccagtgacacagaccatagtactgtgccattcacctccagtaactcagactatcgctctttgtcactctccacctcccatccaggtgtccgcactccatcactcccctcctttggtgcaggggaccgcactgcaccacagccccccgagcgcacaagcgagcgcgctatgctattcaccccccctggcccaagcagccgcaatctctcattccagctccctcccacaggtcattgctctgcaccgctctcaggcacaatcctcagtgagcctccagcagggatgggtgcagggtgctaatggcctgtgctctgtagaccagggggtgcagggctctgcaacgtcacagttctacacaatgtccgaaaggctccaccctagtgatgattccataaaagtgattccccttactacattcgctccgagacagcaggctcgcccttctcgcggtgacagcccaataatggaaacacaccccttgtag

SEQ ID NO: 131068 - DNA, 1080 bp, Artificial Sequence
  Description of Artificial Sequence: Synthetic coding sequence
atgcgaagtattaggaaaaggtggacaatctgtacaatctctctgctactgattttctataagacgaaagagatcgccaggaccgaagagcaccaggagactcagttgataggtgacggcgagctgagcctctctcgctcacttgtcaacagctctgataagatcatcagaaaagcagggtcttccattttccagcacaatgtggagggctggaagattaatagcagcttggtcctcgaaattaggaagaacatcctcagattcctggatgccgaaagagatgtgtctgtcgtgaaatcctcctttaagcccggcgacgtgatccactacgttctggatcgcagaagaactctgaatatttcacacgatctccactcccttctgccggaagtgtccccaatgaagaatcggcggttcaagacgtgtgccgtcgtggggaatagtgggatccttctcgacagtgagtgcggaaaagagattgattctcacaactttgtgatcaggtgtaacttggctccggtagtggaatttgccgcggacgtgggaacaaaatcagatttcatcaccatgaacccaagtgtggtacagagagcctttggggggttccggaatgagtcagatagggagaagtttgtacaccggctgtcaatgctaaatgactcagtcctctggattcccgcttttatggtcaaggggggggagaagcatgtggagtgggtgaacgctctcatcctcaaaaacaagcttaaggtcaggactgcatatccgagtctgaggttaatacatgctgtgcgtggctattggctcacaaataaggttcccatcaagcggccttcaaccggcctccttatgtacactctggccaccaggttttgtgatgaaattcatctgtacggattttggccgttccccaaggacctgaacggcaaggcagtcaaataccattattatgacgatctgaagtaccgatacttctcaaacgcgagtcctcatcgtatgcctctagagtttaaaaccttaaatgttctccacaaccgaggggcattaaagcttactaccggtaaatgcgtgaagcaatag

SEQ ID NO: 131069 - DNA, 72 bp, Artificial Sequence
  Description of Artificial Sequence: Synthetic coding sequence
atgatgcagctcttacagctactgctcggcctccttgggcccggcggctatctctttcttctcggcgattag

SEQ ID NO: 131070 - DNA, 3480 bp, Artificial Sequence
  Description of Artificial Sequence: Synthetic coding sequence
atgtacttgtcaatctgttgttgctttctcttgtgggcccctgcgctgacgcttaagaatcttaactatagcgttcccgaggagcagggcgctggtaccgtgataggtaatattgggcgcgatgccaggctgcagcctggactccctcctgccgagcgcgggggaggcggcagatccaaatccgggtcataccgcgtcctcgagaacagcgcccctcacctacttgacgtggatgcggacagcggtctactctatacaaaacaaagaatagatagggagtccctttgtagacacaacgccaagtgtcaactatccctggaggtattcgcaaacgacaaagaaatctgcatgatcaaggtcgagattcaggacataaacgataatgcgccgtcgttttcatccgatcagattgagatggacatttcagaaaatgccgcaccaggaaccaggtttcccctgacatcggcgcacgatcccgacgccggggagaacgggctaagaacatacctgttgactcgggacgaccacgggctcttcgggttagacgtgaaatcacgcggtgatgggacaaagtttcctgaactggtcatccagaaggccttggaccgtgagcagcagaatcatcataccctcgtgttaacagccctggatggcggagagcctccacgcagcgccacagtccagatcaacgtgaaagtaatcgattcaaacgataactctcctgtctttgaagccccttcttacctggtggaactcccagaaaacgctcctctgggtaccgttgtgatagaccttaacgccaccgatgccgacgagggcccaaacggcgaggtactgtatagcttttcttcctacgtcccagatcgcgtgagagagctctttagcatcgaccccaagacaggcctaatccgggtgaaggggaacctggattatgaagagaacggaatgctggaaatcgatgttcaggcacgggatttggggcctaacccaattccagcccactgcaaggtcacagtcaaattgatcgacagaaacgacaatgcaccttcaattggcttcgtgtcggttagacagggggcactctctgaagccgcccctcctgggactgtcatcgccctggtcagagttacagatagggattctggcaaaaatggacaacttcagtgtcgggttctgggcggtgggggcacggggggcggcggaggattgggcggtccaggcggttcggtgccgtttaaattggaagaaaattatgacaacttctatactgtggtcaccgatcgtcccttggaccgcgagacacaggacgaatacaatgtgaccatcgtggctcgggatggaggttctcccccgctgaatagcaccaagtcattcgctattaagattttggacgagaatgacaatcccccgcgttttacaaagggtctgtacgtattgcaggttcatgaaaacaatattcccggagaatatctaggtagtgtcctggcccaggaccccgacctgggccaaaatggaacggtcagttactccatcctcccaagccacatcggggatgtttctatatatacatatgtcagcgtcaacccaaccaacggcgccatttatgcgcttcgaagctttaatttcgaacagactaaggccttcgaattcaaagtgcttgcgaaagactcgggagctcctgcccacttagagtccaatgccaccgtgcgggttactgtcctagacgtgaatgataacgccccagtcatcgtcctgccaacgctgcagaatgataccgcagagctgcaggtccccagaaatgctggcctgggatacctagtgtccaccgtgcgggcactggacagtgacttcggggaatctgggcggctgacctatgaaattgtggacggaaatgacgaccacctattcgaaatagaccccagctctggcgagatacgcacattgcacccattttgggaagatgtcaccccagtggtcgaactggttgtgaaggtgacggaccacggaaagcccacactgagtgctgtggcaaaactgatcattcggagcgtgtccggaagtctccctgagggcgtgccgcgggtgaacggcgagcagcaccactgggatatgtcactgccccttatagtgacattgtcgacaatttctattatcctgcttgcagcgatgatcacaattgccgtgaaatgcaaacgggagaacaaagaaattcgcacatacaattgtcgcatcgccgaatactcacacccacagctcgggggcggcaaaggcaaaaaaaagaagatcaacaaaaatgatatcatgctggtgcaaagtgaggtcgaagagaggaatgccatgaacgtgatgaacgtggtgtcatctcctagtttggctacttcccctatgtatttcgactaccagacgcgcctgccccttagctcacccaggagcgaggtgatgtatctaaaacccgcatctaataatctgacagtcccacaggggcatgccggatgccacacctcctttaccggccagggaaccaatgcatctgaaactccagcgacgaggatgagtattatccagaccgataattttcctgctgagccaaactatatgggctcgcggcagcagttcgtacagtcctcctcaacatttaaagatcccgaacgcgctagtctgcgagattcaggccacggagattctgaccaggccgactctgatcaggacacgaacaagggttcatgttgcgacatgtccgtgagagaggcactgaagatgaagacaacaagcactaaatcgcagccgcttgagcaagaacctgaagagtgcgtgaactgcactgacgagtgccgggtgttggggcacagtgaccggtgctggatgccccaattccctgcagccaaccaagctgaaaacgccgattacagaaccaatttatttgtgcctaccgtggaggccaatgtagagactgagacatacgagactgtgaatccaacaggcaagaagacattctgcacctttggtaaagacaagagagaacacaccattctcatagcaaacgtcaaaccatacctgaaggccaaaagagccctctcacctctgctgcaggaagtgccctcagcttcttcttcccccaccaaagcttgtatcgagccttgtacttctactaaaggaagtctcgacggctgtgaagctaaacccggcgccctggcagaagcttcctcacaatacctgcccaccgacagccagtacctgtccccctccaaacaaccccgcgaccccccttttatggccagcgaccagatggcgcgggtgttcgctgacgttcacagccgggcttcaagggattcaagcgaaatgggagcggtgcttgagcagttagatcatccgaaccgcgatctcggcagggagtccgtcgacgcggaggaagtggtgagggaaatcgacaagcttctgcaggattgccgcggaaatgatccggtggctgtgaggaagtag

SEQ ID NO: 131071 - DNA, 3408 bp, Artificial Sequence
  Description of Artificial Sequence: Synthetic coding sequence
atgcatcagatgaatgcaaaaatgcacttccgattcgtgttcgctcttttgatcgtgtcctttaatcatgacgtcctggggaaaaacctcaagtatagaatatacgaggaacagcgggtggggagcgtgatcgccagacttagtgaggacgttgccgatgtactgctgaaactccccaatccgagcactgtacgcttccgggcaatgcagaggggcaattctcctctactcgtggtgaatgaagataacggggagatcagcattggtgctacaatcgaccgcgaacagttgtgccagaagaacctgaattgcagcattgaatttgacgttatcactctgcctactgagcacctgcagctgtttcatatagaggtcgaagtcctcgacatcaatgacaactccccccagttcagccgttcccttatccccattgagatatccgagagcgctgccgtcggtaccaggatcccacttgactctgcctttgatccggatgtgggcgaaaactcgctgcacacttactctttgagcgccaatgatttctttaatattgaggtgcggaccaggaccgacggcgcaaaatatgccgagttgattgtagtgagggaactggatcgtgaattgaagtcttcttacgaactccagcttaccgccagcgatatgggcgtgcctcagcgatctggaagcagcatcctgaagatcagcatttccgatagtaatgataattcacccgcctttgaacagcaaagttacataatacaattgctggagaatagccccgtgggtactctacttctagacctgaacgctactgatcctgatgaaggcgcgaatggcaaaatcgtgtactcattttcctctcatgtgagcccaaaaatcatggaaacctttaagattgatagtgaaagaggccacttaaccttgttcaagcaggtggattatgaaatcacgaagtcttatgaaatagacgtgcaggcgcaggatctgggccccaactccatcccagcccactgtaagattatcatcaaggtcgtagacgtgaatgacaataagccggagataaatattaacttaatgagcccaggcaaagaggagatatcctatattttcgagggggaccccatcgacacatttgtggccctcgtgcgggttcaggataaggacagtggcctgaatggcgagatcgtgtgcaagcttcacggtcacggacattttaaattgcaaaagacatatgaaaacaactatttgatacttacaaacgccacactggaccgggagaaaagatcagagtattccctaacagtcatcgccgaagaccggggcactccttccctaagcactgtgaaacactttacagtgcaaattaatgacatcaatgacaatcctccccactttcagcgaagccgctatgagttcgtgattagcgagaataactcccccggagcctacatcacgactgtgaccgccactgatcccgacttaggagagaacggccaggtcacttacacaattctcgaaagcttcatcctgggcagctcaatcactacctatgtgaccatagacccctccaatggggctatttatgccctaaggatattcgaccacgaagaagttagccagattacgttcgtcgtcgaggcccgtgatggaggctcacctaagcagctcgtgtctaatactacagttgtgctcacaatcatcgacgaaaacgacaatgtgcctgtggtcattggccccgcactccgcaataacacagccgagattacaattcccaagggagcggagtctgggtttcacgtgacaagaattcgcgcaatcgatagggatagcggggtgaacgctgagttgtcctgtgcgatagtggctgggaatgaggagaatatttttatcattgacccaaggagctgcgacatccacactaatgtttccatggactcagtcccatacacagagtgggaattgtcagtgatcattcaggacaaggggaaccctcagctgcatactaaagtgttgctgaagtgcatgattttcgaatacgccgagtcagtgacaagcacagccatgacctccgtttctcaggccagcctggatgtttcaatgattataatcataagcttaggagccatctgtgccgtccttttggtcatcatggtgctattcgccaccagatgcaatcgtgagaaaaaggacacgcgatcctacaattgccgggttgcggagagtacctatcagcaccacccaaaacggccctcacggcaaatacataagggggatataacactagttcctacaataaacgggacactgcccatccggtctcatcacagatcgtcaccaagcagctctcctactctggaaaggggccagatgggaagccgacaaagtcataactcgcaccaaagcctcaacagtctcgtcaccataagttccaatcacgtccccgaaaatttttcgctcgagcttacccacgccacaccagccgtggaacaggtaagtcagctgctgtcaatgctgcatcagggccagtaccagcctaggccttcctttagagggaataagtactctaggagctacaggtatgccctccaagatatggacaagttctcactgaaggactccggtcggggcgacagcgaagctggcgattctgactacgacctaggacgggactctcccattgaccgcctcttaggggagggtttttctgacttgtttttgactgatggaaggatccctgcggccatgaggctctgtacggaggagtgtcgggtgctcggtcactcagaccaatgctggatgccccccctcccttcgccgtcatctgattaccgcagcaacatgttcattcccggcgaggagtttcccacccagccccagcagcagcacccgcatcagagcctggaagatgatgcacagcctgccgacagcggagagaagaagaagtcattctcgacctttggcaaggatagccctaacgacgaggacaccggggatacttctacgtctagcctcctgtcagaaatgtcctctgtctttcagcgacttctccccccaagtctcgatacatacagcgagtgtagcgaggtggaccggagcaattccctggagcggagaaaagggcccctgcctgctaaaactgtgggctatccccagggagtggctgcctgggccgcctccacccatttccagaaccctacaacgaactgcggtccaccgctgggcacccactcttctgtgcagcccagctcaaagtggctccctgctatggaagaaattcctgagaattacgaggaggacgatttcgataatgttctgaatcatcttaacgatggcaagcacgagttgatggacgccagcgaattggttgccgagatcaataaactccttcaggacgtgaggcagagttag

SEQ ID NO: 131072 - DNA, 3405 bp, Artificial Sequence
  Description of Artificial Sequence: Synthetic coding sequence
atgcatcagatgaacgcaaagatgcatttcaggtttgtgttcgctctgttgattgtgagcttcaaccatgatgtgcttgggaagaatcttaaatatcgcatctacgaggagcaaagggtgggctctgttattgccagactgtcagaggacgtggcagacgtcttgctgaagttacccaacccatcaactgtgaggtttagggccatgcagagaggtaactctcctctgctggtcgtgaacgaggacaatggcgagatctctatcggcgccacaatagatcgggaacaactgtgccagaaaaatcttaactgcagtatagaatttgacgtgataacactccccacagaacatctccagctcttccacattgaggtggaagtattggacatcaacgacaattctcctcagttcagcagatccttgattcccatcgaaatctctgagagtgctgccgtgggcacgagaattcctctggattcggctttcgatcctgacgtgggagagaatagtctccatacatactctcttagtgctaatgatttctttaatattgaagtgagaactcgcactgacggggcaaagtatgccgagctgatcgtggtccgcgagctagatcgggagttgaagtcttcctatgagctccagctgacagcctcagacatgggagtgcctcagcgatccggctcatcgattctcaaaattagcattagcgattcaaatgacaattcaccggcatttgagcagcagtcttacattatacagctgctagagaattcccctgtcgggaccctgctgctcgatcttaatgctaccgacccagacgaaggcgcaaatggcaaaattgtctatagcttcagctcccacgtctcgcccaagattatggagacctttaaaatcgatagcgagcgcggacacttgaccctgtttaagcaggtggattacgaaatcacaaagtcatatgaaattgacgtgcaggcccaggatctgggacctaattcaataccggcacattgcaagatcattataaaggtcgtagatgtgaatgacaacaagccagagattaatatcaatcttatgagtcctgggaaagaggaaatctcctatattttcgaaggagatcctatcgacacattcgtagcactggtacgcgtgcaggataaagacagtggactgaacggagaaatagtctgtaagctgcatggccacggtcattttaagctgcagaaaacatacgagaacaattaccttatactcaccaacgctaccttggacagggaaaaaagatccgaatactctctgactgtgatagccgaggaccgaggaacgccttcactatccactgtgaaacatttcactgtgcagataaatgatattaatgacaacccccctcatttccaacggtcacggtatgagtttgtgataagcgagaacaactccccaggggcttacatcacgactgtgactgcaaccgaccccgatcttggcgagaacggtcaggtaacttacactattcttgaatccttcattctcgggtcctccataacaacctatgtcaccatcgacccgagtaacggagcaatctatgcattacggatctttgatcacgaggaggtgtcacagatcacgtttgttgttgaagctcgtgacggagggagtccaaagcagcttgtctcaaacacgaccgtagtgctaaccatcattgatgagaatgataacgtgccagtcgtgattggcccagcactgaggaacaatacagccgaaattactattcctaaaggagccgagtccggtttccacgtgacaagaatcagggctatagatcgggattctggggtcaatgcagaactttcatgcgccatcgtcgccggcaacgaggagaacatcttcatcattgaccccagatcctgcgacattcacaccaacgtctccatggatagtgttccatataccgagtgggagctgtcagtgattattcaggataaggggaatccccagttgcatactaaagttctgttgaaatgtatgatctttgaatatgccgagtctgtcacatctacagcaatgactagcgtgagccaagcttcattggacgtgagtatgatcatcattatatcgcttggagctatatgtgccgttctgctcgtcattatggttttgttcgccaccaggtgtaacagagagaagaaagatacaaggtcatataactgccgcgttgctgaatccacataccagcatcaccccaaaagaccaagtaggcagatccataagggcgatatcaccctcgtccctactataaatggtacattacccatccgatctcatcaccggtcgtccccaagcagcagccctactctggaacggggtcagatggggtccagacagtctcataactcacatcagtctctcaatagccttgtgactatttcttctaatcacgtgccagaaaacttcagcctagaacttacacacgccaccccggcagtagaggtgtcccagctactctcaatgctccaccagggacagtatcagcctcgccccagcttcagagggaacaagtacagtaggagttatcgttacgcattacaagacatggacaaattcagtttaaaagactcaggcaggggtgattctgaggcaggtgactcagactatgatttaggccgcgattcaccgattgaccggctgctgggagaaggattcagcgatctattccttaccgacgggcgcatccccgcagctatgagattgtgcaccgaagagtgtcgggtcttgggccactctgatcagtgttggatgccgcccctccccagtccaagtagtgattaccgctcaaatatgtttattcccggagaggagttccctacacagccccagcaacagcaccctcaccagagtttggaggatgacgcgcagccggctgattccggtgagaagaagaagtctttttccacctttgggaaggatagtccgaatgatgaagacacaggagacacctcgactagtagtctgttgagtgaaatgtcaagcgtgttccagaggttgctccccccaagtctggacacgtactccgagtgctccgaagtggatagatccaatagcctggagcggcgcaaaggccctctgccagctaaaacagtgggctacccgcagggtgtggcagcttgggcggcttctacacattttcagaaccctactacaaattgcgggccaccactcggaacccactcatctgtacagccttcttcaaaatggctaccagcgatggaggagatcccagaaaactacgaggaagatgatttcgataacgtactgaaccatttaaatgatggcaagcacgaactgatggatgctagcgagctagtggcggaaatcaacaaactcctccaggatgtcagacaatcttag

SEQ ID NO: 131073 - DNA, 3306 bp, Artificial Sequence
  Description of Artificial Sequence: Synthetic coding sequence
atggagagtctgctgttgccagttttgctcttgctcgcaatactgtggacacaggcagctgctctgattaacttgaagtacagcgttgaggaggaacaacgggctgggacagtgattgcaaacgtcgctaaagacgctcgagaggcaggctttgcgcttgatccaagacaagcttctgcctttagagtcgtgagcaattcagctccccatcttgtggacattaaccctagttctggcctgctggtgacgaaacagaaaatcgacagagatctcctttgtcgccagagtcctaagtgcatcatttctttggaagtaatgtcatccagcatggaaatctgcgttattaaggttgaaatcaaggatctcaatgacaacgcgccaagcttccctgccgcgcagatcgagctcgagattagtgaggccgcttcgcccggaacgcgtattccccttgattcagcctacgaccccgacagtgggtctttcggggttcagacttatgagctgacccccaacgagttattcggcctagagataaagactcgcggagatggtagccgattcgctgagctcgtcgtcgaaaaaagcttggaccgagagacacaatctcactacagcttcaggattacggccctggatggcggcgacccacccagacttggaaccgtcgggttgtccatcaaggtgacagactcaaatgacaacaaccctgtgttctctgaaagcacctacgctgtgtctgtgcctgaaaattcacctcccaatactcctgtgatccgccttaacgcctcggatcccgatgaaggtacaaatggacaagtggtctacagcttttacgggtatgtcaatgatcgcacccgggagctctttcaaatcgacccccactccggcctggttaccgtcacgggtgccctggactacgaggagggccatgtttacgaattggacgtccaggccaaagacttaggtcctaattcaattcctgcacattgtaaggtgacagtaagtgtcctggacaccaatgacaatcccccggtgatcaacttactttccgttaactcagaactcgtagaagtgtctgaaagtgctccaccgggatatgtgattgcgctcgtcagagtgtcagatcgggatagcggcttaaatggcagagttcagtgcaggttgttaggaaacgtccctttcagattgcaagagtacgaatcattttccactattctggtcgacgggcgtctagacagagaacagcacgatcagtataacctcacaatccaggctcgtgatggtggggtgcccatgttgcagtcagctaagtccttcacagtactgatcacggacgaaaatgacaaccaccctcacttttcaaaaccttattatcaggtgattgtccaggagaacaatacacccggcgcttatctgctttcagtgtctgcaagagacccagatctggggctgaacgggagcgtatcctatcaaattgtaccctcccaggtgagagacatgcctgtgtttacttacgtgagcatcaaccctaactccggcgatatatatgctttgcgcagctttaaccacgagcaaactaaggcttttgaatttaaggtgctcgctaaggacggcgggcttccttccctgcagagcaacgccacggtcagagttattatcctggatgttaacgataacacaccagtcattacagcgccaccccttatcaatggtacagctgaagtctacattcctcgtaactccggcatcggctatttggtaaccgtggtcaaggcagaggattatgatgaaggagagaacggaagggtgacgtacgatatgacagaaggagacaggggcttcttcgaaattgaccaggtgaatggtgaagttagaactacgcgtacatttggagaaagttcaaagagttcgtatgagctgattgtggtagcccatgatcacggcaagacttcactctctgcctctgcactagtgttgatctacttgtccccagctctcgacgctcaagagtcaatgggaagcgtgaatctgtccttaattttcattatcgccctcggatctattgccggtatcttatttgttacaatgattttcgttgctataaagtgtaagcgagacaacaaagagatcaggacttataactgccgcatcgccgagtactcctatggccatcaaaaaaaatcatctaagaagaagaaaatcagtaaaaacgatattcgacttgttcccagggatgtcgaagagactgataaaatgaatgtggttagctgctctagcctcacatcttccctaaactatttcgattaccaccagcagaccctcccgcttggctgccggagatccgagagcacttttctaaacgttgagaatcagaatacacggaatacatccgctaaccacatctatcatcactctttcaacagccaaggcccacagcagccagacctcatcatcaatggtgtaccactgcctgaaactgagaactattcattcgattccaattatgtaaactcacgggcacatttaattaagtcgtcctcgacctttaaagacctggaggggaactctctcaaagattccggacatgaggagtctgatcaaaccgacagcgagcacgatgtgcagcgttccctctattgcgacaccgcagtgaatgacgtgctgaatacatctgtgacaagtatgggttcccagatgccggatcacgaccaaaacgaagggttccactgtcgcgaagaatgccgcatcttgggacatagtgaccgatgctggatgccaaggaatccaatgcccattcggtctaaaagtccagaacacgtgcggaatattatcgctcttagcattgaggccaccgcagccgacgttgaagcttacgatgactgtggccctacaaaacggacctttgccacgttcggcaaggacgtgagcgaccaccctgctgaggagcgcccaaccctgaaaggcaagcggaccgtcgacgttaccatatgttccccgaaggtgaacagcgtaatccgggaggctggcaatgggtgcgaggcgatctcacctgtaacatccccactccaccttaagtctagcttacctacaaaaccctccgtgtcttacaccatcgcgctggcccctcctgctcgtgacctggaacagtacgtgaacaatgtgaataatggccccacacggccctcagaggcggaaccaagaggtgccgactcagaaaaagttatgcacgaagtgtcaccaatcttaaaggaaggtagaaataaggagtcccccggcgtgaaaagactgaaggacattgtgttgtag

SEQ ID NO: 131074 - DNA, 3447 bp, Artificial Sequence
  Description of Artificial Sequence: Synthetic coding sequence
atggaatccctgttgctacctgtgttattgcttctagctatcctgtggacacaggctgctgccctgatcaatctgaagtatagtgtggaggaggagcaacgcgccgggaccgtgatcgccaatgttgccaaggatgcacgcgaggccggctttgccttggatccaaggcaggcctcagcatttagggtagtgtcaaattccgctcctcacttggttgacataaacccttcttcagggcttctggtaaccaaacagaaaattgacagggacctgctgtgtcgtcagagcccaaaatgcatcattagcttagaggtgatgtcatcatccatggaaatctgcgtgattaaagtggagattaaggacctgaacgataacgccccctcttttcccgcagcccagatagagcttgagatcagtgaagcggcctctcctggtactaggataccgttggactccgcctatgaccccgatagcggaagtttcggagtacagacgtacgaattgacacccaacgaattgtttggactcgagataaagaccagaggcgatggaagtcgctttgcagagttggtggtcgaaaagagcctcgatcgcgagacccagagccattactcatttcgtattacagccttagatggaggcgatcctcccagactgggcacagttggtctcagcataaaagttacagattctaacgacaataatccagtgtttagcgagtccacatacgcagtgtcggtaccagaaaattctccgcctaacacgccagtgatccgtctgaacgcttccgatccagatgaggggactaacgggcaggtggtttactccttctatggatacgtaaacgaccggacacgcgagctgtttcagattgaccctcactccgggctcgtgacagtcaccggggccttggattacgaggaggggcatgtctacgaactcgatgtccaagctaaagacctggggcctaattcaattcccgctcattgcaaggtcactgtatccgtgctggacaccaatgataatcctcccgtgattaacctcctctcagtcaactccgagctcgtggaagtgtctgaaagtgccccacccgggtacgtcatagctctggtcagagtcagtgaccgagactcaggtttaaatggaagagtgcagtgcagactcctcggaaacgtcccttttaggttgcaagagtatgaatcattctctaccatcctagtggacggccgcctagatagagagcagcatgaccaatacaacctcacaatccaagccagggacggcggggtgccaatgctccagtctgccaagtcattcaccgtgttgattacagacgaaaatgataaccacccccacttttcaaagccctattaccaagttatcgtgcaggagaataatacgccgggcgcctatcttttgtcagtgtcagcaagggaccccgacctcggcctgaacggttcagtcagttatcagatcgtccccagccaagtccgagatatgcccgttttcacttacgtatctattaaccccaacagcggcgacatttacgctctacgctcctttaaccatgagcagactaaagccttcgagtttaaagttttggctaaagatggggggcttccatcgttgcaatcaaacgccactgttcgggtcatcattctggacgtgaacgataacacacctgtgattacggcccccccccttatcaatggcacggctgaggtatatatcccacgcaactcaggcataggatacctggtcacggtggtgaaagctgaggattacgatgaaggagagaatggacgtgtgacctacgacatgacagagggcgaccgtgggttcttcgagattgaccaagtcaatggggaggtcagaacgaccaggaccttcggggagtccagcaaaagctcttatgaactgatcgtagtggctcatgaccacgggaagacctctctcagcgccagtgccctggttctgatctacttatcgcctgctctggacgcacaagaaagcatgggctccgttaatctcagcttgattttcatcattgcactaggcagtatagccggtatcctgtttgtcactatgatcttcgtggccataaaatgtaaacgagacaacaaagagataagaacctacaactgttctaactgcttaacaattacctgtctgctcggttgtttcataaaagggcagaactccaagtgtctacactgcatttctgtatccccaattagcgaagaacaagacaagaaaacagaggaaaaagtgtcactccggggtaaaagaatcgcagagtattcctatggccaccaaaagaagtcatcgaaaaagaagaagatatcaaaaaacgacattcgactggtgccccgggacgtggaggagacagacaaaatgaatgttgtgtcttgttccagcttaacatcctcattaaactacttcgattaccatcaacagaccctgcccctcggctgccggcgtagcgagagcacgtttcttaacgtggaaaaccagaacacacgcaatactagtgccaaccatatttaccatcattcattcaactcccagggaccacagcagcccgatctgataattaacggtgtccctctccccgagactgagaactattcctttgatagcaattacgtgaatagccgggcccatctcattaaatcttctagtacattcaaggatcttgagggaaatagcctgaaggattctggacatgaggaatccgaccagactgatagtgagcatgacgtccagcgctccctgtactgcgatactgctgtcaatgatgtcctcaatacctctgtgactagcatgggatcacaaatgcctgatcacgaccagaacgaaggatttcactgcagggaagagtgccggattctgggacatagcgacaggtgttggatgccccggaacccaatgccaatccggtccaagagccctgagcatgttaggaatatcattgcactgtccatcgaagcgaccgccgcagatgttgaagcgtacgatgactgcgggcccaccaagcggacgtttgcaacattcggaaaggacgtctccgaccaccccgcagaggaaaggcctacgctgaaggggaagaggacagtcgacgtgactatctgcagccccaaagtgaattccgtgatccgggaggccggcaatggatgtgaagcaatatctcccgttacctccccacttcatctgaagagcagtcttcctacgaagccaagtgtctcgtacactatcgccttggccccccccgctcgagaccttgaacaatatgtgaataatgtaaacaacgggccaacccgcccttccgaagctgaaccgaggggcgcagatagcgaaaaggttatgcatgaagtcagtcctattttgaaggagggaaggaacaaagagagtccaggcgtgaaaagactgaaggatatcgtcctttag

SEQ ID NO: 131075 - DNA, 3303 bp, Artificial Sequence
  Description of Artificial Sequence: Synthetic coding sequence
atggaaagcctgttactccctgtcctattactgttagccattttgtggactcaggcggccgcactaattaacctgaagtattccgtggaggaggaacaaagggcaggcaccgtgatcgctaatgttgcgaaagatgcaagggaggcaggatttgccttagacccgcggcaggcatccgcttttcgcgtggtgagcaatagtgcaccacatctagtggacattaatcccagttcgggactgctcgttactaaacaaaaaatcgatcgcgatttactgtgcagacagtccccaaagtgtataatctcgctcgaggtgatgagtagttcaatggagatctgcgtgatcaaagtggagattaaggatctgaacgataatgccccttcttttccagctgctcaaattgagttggagatatccgaagccgccagccccggcacccgcatccctctggattctgcttacgaccctgattccggatcatttggggtgcagacatacgagctgactcccaatgagttattcggtttggagattaaaactagaggagatggatcaaggttcgctgaactcgtagtcgaaaagagcttggacagagaaacccaatcacactatagcttcagaattactgccttggacggcggcgacccccctaggctgggcactgtgggcctgtcaataaaagtcaccgacagtaatgacaacaaccccgtcttttccgagtctacatacgccgtttctgtgccagagaactctccccccaacactcctgtgattcgccttaacgctagtgaccccgacgagggtactaatggccaggtggtttatagcttctacggatacgttaacgaccgcacacgcgagttgttccagatcgatccacactccggtctggtgacagtcaccggagcactcgattacgaagaagggcatgtgtacgagctggatgttcaggcaaaggatttgggacctaactccattcccgcccactgcaaggtgacggtttcagttcttgacaccaatgacaatcctcccgtgatcaacctgcttagtgtgaacagtgagctggtcgaggtcagcgagagcgctcctcccggctacgtaattgctttggtccgagtgtccgatagggatagtggcctgaacggccgcgtgcaatgccgattgctgggaaatgtaccatttaggttgcaggagtacgaatctttcagcactatcctcgtagacgggcgcttggacagggagcagcatgatcagtataatctgacaatccaggcacgcgacggaggggtgccaatgcttcagagcgccaaaagttttacagtgctgattaccgatgagaatgacaatcatccacacttctcaaaaccttattaccaggtcattgttcaggaaaataacaccccgggggcttacctcctgtctgtgtccgcgcgggatccggacctcggcctgaatggaagcgtttcttatcagatcgtcccaagccaggtgagggacatgcctgtctttacctatgtcagcattaacccaaatagtggcgacatttatgccttgcggtcttttaatcacgaacagactaaagcatttgaattcaaagtactggccaaggacggaggcctgcctagtctgcagtccaatgctacagttagggtgataattctggacgtgaacgataatacgccagtcatcacggcacccccattaatcaatggcacagccgaagtctacatacccagaaattctggcatcggttatctcgtgaccgtggtgaaggccgaagactatgatgaaggggagaatgggcgggtgacctacgatatgaccgagggcgatagaggctttttcgaaatcgaccaggtgaacggagaggtccggacaactcgaacttttggcgagtcttccaaatccagctatgagctgatcgtggtggcacatgatcacgggaaaacttctctcagcgcttccgcattggtgcttatctacctgtcccctgcccttgatgcccaagaatcaatggggagcgtgaatctgagtctgattttcataattgccctgggttctatagcgggtattctgtttgtgactatgatctttgttgccatcaaatgtaagcgggacaataaggagatccggacatataattgcaggatcgcggagtacagttatggacatcagaaaaaatcaagtaagaaaaaaaaaattagcaagaacgacattcgattagtgccccgagacgtcgaggagacggacaagatgaatgtggtgtcttgctcttctttaacttccagtctaaattattttgattatcatcagcagacgctgccactgggttgcaggcgatccgagtcgacattcttgaatgtggaaaaccagaacacaagaaatacttctgcgaaccacatctatcaccactccttcaactcacagggcccccagcagcctgacttaataattaacggtgtgcctctacctgaaaccgagaactacagctttgactctaattatgtaaattctagagcacatttaattaagagcagtaccttcaaggatctggaaggtaattctctgaaggattcaggtcatgaggaaagcgatcagactgattcagagcacgacgtccagcggtccctctattgcgacactgccgttaacgacgtgctgaataccagcgttacctctatgggcagccaaatgcctgaccacgatcaaaatgagggctttcactgtagggaagagtgcaggatactggggcattccgacaggtgctggatgccacggaatccaatgcccatacgctccaagagccccgagcacgtcaggaatataatcgccctctctatcgaggccactgccgccgacgtggaggcctacgatgactgtggcccaaccaagcgaacattcgctacattcggtaaggatgtaagtgatcaccctgccgaagaaagaccaacactaaagggaaagcgcactgtcgatgtaaccatctgctcaccaaaggtaaacagtgtgataagagaagcgggcaatggctgcgaagcaatttctcccgtgacaagccctctccacctgaaaagctctcttcccaccaaaccttctgttagctacacgatcgcgctggcccccccggctagggatctggaacaatatgtcaataacgttaataacggtccaacccgtcccagcgaggctgaaccaaggggtgctgactcagagaaggtgatgcatgaagtcagccccatactaaaggaggggagaaacaaagagtcacctggagtgaaacggctgaaagacatcgttctatag

SEQ ID NO: 131076 - DNA, 2094 bp, Artificial Sequence
  Description of Artificial Sequence: Synthetic coding sequence
atgttcacgttagacgtggaggaaaacgagaacggggagcgtaccccttacttgattgtgatgggagctctggatcgagagacacaggaccagtatgtctctataattatcgcagaggatgggggctcccctccactgctagggtccgccacactgacgataggcatatctgatattaatgataattgtccgttgttcaccgacagccagataaacgtgaccgtgtacgggaatgcaaccgttgggactcctatcgctgccgttcaggccgtggataaagatctgggcaccaatgcccagatcacctacagctattcccagaaagtccctcaggcttccaaagacttgttccatttagacgaaaatacaggagtaatcaaactgttttctaaaattggaggcagtgtgctggaatcccacaagcttaccatcctcgcgaatggccccgggtgtattccagcagttatcacagcgttggtgtcaattatcaaggtgatctttcggccacctgagattgtaccccgctacattgccaacgaaatcgatggtgtggtatatctaaaggagttggagccggtgaatacccccattgcattttttaccatacgagatccagagggcaagtataaggttaactgttatctggatggagaggggccctttcgcctgtccccctacaaaccttacaacaatgagtatttgttggagaccaccaagccaatggattacgagttgcaacaattttacgaagttgctgtcgtcgcctggaacagtgaaggtttccatgtcaaaagagtgataaaagtgcagcttttggacgataacgataacgctccgattttccttcagcccctcatcgaattaacaatagaggagaataactctccaaatgcctttctgaccaagctctatgcaacagacgccgactccgaggagaggggccaggtttcatatttcctcggccctgacgcgccaagttacttctcccttgattcagtcactgggatactcacagtgtccactcagctcgacagagaagaaaaagagaagtatcggtatactgtgcgagcagtggattgcggcaaaccgccaagagaatccgtggcaaccgtggctttgactgttcttgataaaaacgacaactcaccgagatttatcaataaggatttctcatttttcgtgccggagaacttccccggttatggggaaatcggcgtgattagcgtgacagacgccgacgcaggtcgaaacggttgggtggccctctcagtcgtgaatcagagcgacattttcgtaatagacacaggtaaagggatgttgcgagccaaagttagtctcgaccgggagcagcaaagctcatacacgctctgggtggaagcagtagatggtggtgaacccgctttgtccagcaccgctaagatcacgatcctgctactggacattaacgataacccaccactagttcttttcccgcagtcaaatatgagttacctgctggtgttaccaagcactttacccggctcacctgtgaccgaggtatacgcagtcgataaggatactggtatgaatgcagttatcgcctatagcataatagggagaagaggaccgcgcccagaatcattccggattgatccaaaaacaggtaatatcaccctagaggaagcccttctgcagaccgattacggactgcataggctgctggtgaaagtttccgatcacggctatcccgagccactgcattcaactgttatggtgaaccttttcgtgaacgacactgtttctaatgaatcctatatcgagagtcttctgaggaaggagcccgagattaatatcgaggagaaggaaccacagatatccatcgaaccgacgcataggaaggtggagtcggtgtcatgtatgccaactctcgtggcactgagtgtgatctcccttggatcgattaccctggtgacaggcatgggtatttatatttgcttgagaaaaggcgagaaacaccctcgagaagatgaaaatctggaggttcagattcccctgaagggcaaaatcgatttgcacatgcgcgaaagaaaaccaatggatatttccaacatttag

SEQ ID NO: 131077 - DNA, 2856 bp, Artificial Sequence
  Description of Artificial Sequence: Synthetic coding sequence
atgaggggtcgaggcaatgcacgctcctcccaggccctcggcgtctcttggtgccccgcaacatggcacccacggttagatatgggtcgcctgcatcggccccgatcttccacaagctataggaacctgcctcatttattcctgtttttcctcttcgttggcccattctcctgccttggttcttattctcgcgctactgagctgctgtactccctgaacgaaggcctgccagctggagtactaatcgggtctctggcggaggatttaaggcttctccctcgttccgcaggcagaccagacccgcagtctcaacttcctgagcgcaccggtgctgaatggaaccctcctctgtccttctctttggcctcccgtggactgagcggacagtatgtgacacttgacaacaggtccggtgagctccataccagcgcgcaggagatcgatcgcgaggccctctgtgttgaagggggcggggggacagcatggtcagggtctgtgtccatatccagcagtccatcagattcctgcctccttctcctggacgtattggtgttgccccaggagtacttcagattcgtaaaggttaaaatcgccattcgagacataaacgacaatgctccgcaattccctgtcagccagatatcggtttgggtgcctgaaaacgcaccagttaatactcgcctagcgatcgaacaccctgctgtggatccagacgtaggaatcaacggagtgcaaacctatagactgctcgactatcatggaatgtttacattagatgtagaagagaatgaaaacggggaaagaacaccatatctcattgtaatgggcgccctggacagagagacacaagatcagtacgtgtccataatcatcgccgaggatggtgggtcgccacccctcctgggctctgccacactaactattgggatttcggacatcaatgataactgccccctgtttacagattcacagattaatgtgaccgtgtacggaaatgccacagtaggcacccctattgcggctgtccaggcagtggataaggacctcggaacgaatgcacagataacatactcctattctcagaaggtcccacaggcatcaaaggacttattccacctggacgaaaacacaggtgtgataaagctcttttctaaaattggaggatccgttctggagtcacataagctgacaatcctcgccaacggtcctggttgcattcccgctgtgattacggcactggtcagtataatcaaggtgattttccgacccccagaaatcgttccccgatatattgcaaatgagatcgatggcgtcgtctaccttaaagagctggagccggtcaatacacctattgctttcttcacaattcgcgacccagaggggaagtacaaggtgaactgctaccttgatggggaggggcccttccgcctgtccccctacaagccttataacaacgagtacctgcttgagacaaccaaacccatggattacgagcttcagcaattttacgaggtggcggtggtggcatggaatagtgaaggctttcatgtgaagcgagtcatcaaagtgcaactcctggacgacaatgacaacgcacctatattcttgcaaccactgatcgaactgactattgaagaaaataactcacccaacgcttttttgactaaactctacgccacagacgctgattccgaagaaagaggacaggttagctacttcctgggcccagatgcccctagttatttcagccttgattcagttactgggatccttaccgtatctacacaattggaccgggaagaaaaggaaaagtacagatacactgtacgcgccgtggattgcggcaagcctccacgggaaagtgtcgctaccgtggcactgactgttctcgacaaaaatgacaacagccctcgttttatcaacaaagatttttcattcttcgttccagaaaacttcccgggttatggagagatcggcgtgatctccgttaccgacgcagatgctggacggaatggctgggtcgccctaagcgtcgttaatcagagcgacatctttgtgatagacactggcaagggaatgcttagggccaaagtatcactcgacagggaacagcagtctagctacacactgtgggtcgaggctgtggacggtggcgagcccgctctctcgtccacggccaaaatcacaatcctgttgctggacatcaacgataacccccctctcgtcttgttcccacagtctaacatgagttatctgttagtgctcccctccacgttgcctgggagtcctgtcacggaagtatacgctgtggacaaggataccggaatgaatgcagtcatcgcttactccataatcggtcggcggggccctcgccctgagtcatttcgaatcgatcccaagacagggaatataaccttggaggaagccctgttgcagacagattatgggcttcatagactgctggttaaagtcagtgatcatggctacccagaaccgctccattccacagtgatggtgaacctcttcgtgaacgatactgtgagtaacgaatcttacatcgagtctttactaaggaaagaaccggagatcaacattgaggagaaggaacctcagatttctatcgaacccactcaccgaaaggtggagtctgtctcatgtatgccaactcttgtcgcgctgtctgtaattagcctcggatcgatcaccttagtgaccggtatggggatctacatttgcctgcggaaaggggagaaacacccgagggaggacgagaacttggaggtgcagatcccacttaaggggaagatagacctccacatgagggaaaggaagcctatggatatctctaacatttag

SEQ ID NO: 131078 - DNA, 2856 bp, Artificial Sequence
  Description of Artificial Sequence: Synthetic coding sequence
atgcgtggaaggggtaacgcccggagctcccaggccttgggggtcagctggtgtccagcaacttggcatcctaggctggatatggggaggcttcaccgccccaggagctcaacctcatacaggaacctgccccacctcttcctgttcttcctgttcgtggggccatttagttgcctcgggtcgtactccagggccacagagctgttgtactccctcaatgaggggctcccagccggtgttttgatcggcagccttgccgaggacctgcggttactgcccaggagtgctgggaggcccgaccctcagagccagctacctgagcgcactggcgcggagtggaatccacctctgtcattttcgcttgccagccgtggactttctggacagtacgtgacacttgacaacaggagcggcgagctgcatacaagtgctcaggagatagaccgcgaagctctgtgtgtggaaggtggaggcggtacagcttggtctggttccgtctcaatttcctctagtccttccgattcatgtctgctgctgcttgacgtccttgtcctgcctcaggagtattttagatttgtaaaggttaagatcgccatcagggatatcaatgataatgctccccaatttccagtgagtcagatctcagtctgggttcctgaaaacgccccagtaaataccagactggccattgagcatcccgccgtggaccccgatgtggggattaatggcgtgcagacgtaccgtctgctggactatcacggcatgttcacgcttgatgttgaggaaaatgagaatggagagcgtaccccatatctgattgttatgggcgcactggaccgagaaacacaagaccagtatgtgagtattattattgctgaagacggagggtcccctcccttgctgggtagcgcaaccttgacaatcggaattagtgatattaatgataattgtccactgttcacagacagtcagatcaacgtgaccgtctacggaaacgccactgtgggtaccccgatagccgcggtacaggcagtggacaaggatctggggaccaatgctcaaattacctacagctatagtcaaaaggttcctcaagcgtccaaagatcttttccatttagatgagaacacaggggtgattaaattattctcaaaaatcggtggcagtgtgctggagagccacaagcttacaattctggccaatggccctggatgcatacccgcggtgatcacagctctggtgtccatcataaaggttattttcagaccccctgagatcgtcccgagatacattgccaatgagatcgatggggtcgtgtacctcaaggagctggagccagtgaatacgcctatagctttctttacaatccgcgatccagagggaaagtacaaggtgaattgttatctcgacggcgagggccctttcaggctgagcccctacaaaccatacaacaacgaatacctgctcgaaaccaccaagcctatggactatgagctgcagcagttctacgaggtagcagtggtggcttggaatagtgaaggttttcacgttaagcgggtgatcaaggtacagcttctagatgacaacgataacgcgcccatctttctccagccacttatagagctgaccatcgaagaaaacaatagtcctaacgccttcctcacaaagctgtacgctacagatgcagactccgaggagagggggcaagtgtcctactttttaggacctgatgctccttcttacttctccttagatagtgtgactggtatcctgactgtgtccacgcagttggaccgtgaagaaaaagaaaagtatagatataccgttcgcgccgtcgactgcggcaaacctccgcgcgagagcgtagccacagtagccctcacagtgctcgataagaacgataacagcccacgtttcattaataaagacttctctttcttcgttccggagaacttccctggctacggagagatcggggtcatctcagtcactgatgctgacgccggcaggaatgggtgggtagctctgtctgttgtaaaccagtccgatatcttcgtaatagacactggcaaggggatgctccgcgcaaaggtttccctcgatagagaacaacagtcaagctacactctatgggtggaggctgtagacggaggcgagcccgccttaagcagtacggccaagattactatcctcctactggacataaatgacaaccctccactggtcctgttcccgcaatcaaacatgtcttatttactcgtactgccctctacgctgcctgggtcccccgtgactgaagtgtatgcagtcgacaaggacacgggaatgaacgccgtgattgcctactcaattatcggaagacgggggcccaggccagagtctttccggattgatcccaagactggcaacataacgctagaggaagcgctgttgcaaacggactatggtctgcaccgcctcctcgtgaaggtgtctgaccatgggtatcccgagccactgcattcgaccgtaatggttaacctatttgttaacgatactgtatctaacgaaagttacatagagtccctactacgcaaggagccagaaattaatatcgaagaaaaagaaccgcagatttctatcgagcccacacaccggaaggttgagtctgtatcctgcatgccaacattggtggcacttagcgtcatctccctgggctccatcactctagtgacagggatggggatttacatttgtctgcgtaaaggggagaaacaccctcgagaggatgaaaatttggaggtgcaaatccccttaaaaggtaaaatcgatctgcacatgagagagagaaagccaatggacatcagcaacatctag

SEQ ID NO: 131079 - DNA, 3603 bp, Artificial Sequence
  Description of Artificial Sequence: Synthetic coding sequence
atgttaagaatgcgaactgcaggatgggccaggggctggtgtctggggtgttgcctgctgctgcctctcagccttagtctagctgcagcgaagcagctcctacggtatagactggctgaagaggggcccgcagacgtacggatcggaaatgtggcgtctgacctggggatcgtgaccggcagcggtgaagtcacattctctcttgagtctggctccgagtatctgaaaatagataacttgaccggagaactcagcactagcgaacgcagaattgatcgcgaaaagttacctcagtgtcaaatgatcttcgatgagaacgagtgttttctcgatttcgaagtttctgtcatcgggccttcccagtcatgggtagacttatttgaaggccaagtaattgtgctggacattaacgacaatactcccacgttcccgtcccccgtgctcactctcacagtggaagagaatcggcccgtggggactctgtatctactgccaaccgccaccgatagagactttggaaggaatggcatcgagcggtatgagctacttcaagagcccggtggaggtgggagtgggggagaaagtaggagagccggggccgccgattccgcaccgtacccgggtgggggggggaacggcgccagtggtggagggtcaggcggtagcaaacgtcggctcgatgcatccgagggaggtggagggacaaatccgggcggacggtcgtctgtcttcgagttacaggtagccgatacacctgatggagagaaacagccgcaactgatcgttaagggggtttatgaagcggacctagcagagaatagtgcacccgggacacctatactccagttgagagcagcagatctggatgtgggcgtgaatgggcagatagaatatgtgtttggcgctgctactgagtccgtccgccgccttctccggctggacgagacgtcaggctggctgagtgttctacatagaattgatcgagaagaggtgaatcagctgaggttcactgttatggcccgcgaccggggccagccccccaaaacagacaaagcaacagtggtcctaaacatcaaggacgagaacgacaatgtgccctccattgaaataaggaaaataggacggatccctctaaaggatggcgtggcaaacgtggccgaggacgtgctggtggacacgcctatcgccttagttcaggttagtgaccgggatcagggcgaaaatggtgtggttacctgcacagtggttggcgatgtccccttccaattaaaacccgcaagtgacacagagggcgatcagaacaaaaagaaatacttcctgcacacatctacccctttggactatgaagccaccagggagttcaatgttgtcatcgtggctgtggatagtggatctccgtccttgtcgagcaataattctctgatcgtcaaggttggggacaccaacgacaatccccccatgtttggccagagcgtggtggaggtctactttcccgagaacaacatcccaggcgagcgagtagccaccgtcttagccacagatgctgatagcgggaagaatgcggaaattgcgtactctcttgactcctcagtgatgggtatttttgccattgaccccgacagtggcgacattctcgtaaatactgtgcttgaccgcgagcaaaccgaccggtatgaattcaaggttaacgccaaagacaagggtatacccgtcttgcaagggtctacaaccgtgatagtgcaggtcgccgataaaaatgacaatgaccccaagtttatgcaagacgtttttacgttctatgtgaaagaaaacctgcagcctaactctcctgtcggaatggtcactgtaatggacgctgacaagggcaggaacgctgaaatgtctctatacattgaagagaataacaacatattcagcatcgagaacgacaccggcacaatctacagcactatgtcttttgatagggagcaccagactacttatacattcagggtgaaagccgtggatggaggggatcctccacgcagcgctacagccaccgtttccctctttgtgatggatgaaaacgacaacgcgcccactgtcacactgccaaagaatattagctacacccttctgcccccctctagcaatgtccgtaccgtggttgccaccgtgctggccacagactctgacgacggcatcaacgccgatctgaactattccatcgttgggggtaatccctttaagctcttcgaaatagacccaacatccggcgtcgtatcactcgtcggaaaactgacccagaaacactacggattgcataggcttgtcgtacaagtgaatgatagcggccagccgagccagagtacaacgactcttgtgcacgtatttgtcaatgagagcgtgagcaacgcgaccgctattgactcacagatcgcacggagcttacacatacctcttacccaggatatcgcaggggatccatcctatgagatttccaagcagagattgtctatcgtgatcggcgtcgtcgcgggcattatgaccgtgattctgataatattaatagtggtcatggctcgctattgtagatctaaaaacaagaacggttatgaagctggcaagaaagatcacgaagatttcttcaccccacagcaacatgacaagtccaagaaacctaagaaagataaaaagaacaagaaatccaagcaacccctgtactcctcaatagttaccgttgaagcgtccaaacccaatgggcaaaggtacgactccgtgaatgaaaagcttagcgattccccatctatgggacggtacaggtccgtaaatggcggaccaggtagcccggacttggcaagacactataaaagttcatctcctctccccacagttcagttacaccctcaatcccctacagctgggaaaaaacatcaggccgtccaggatttgcccccagccaatacgtttgtgggcgcaggcgacaatatctccattggctccgaccactgtagtgaatactcctgccagaccaacaataagtattcgaagcagcccttccggagggtcacgttctctgtggtttctcagccacaagacccccaccagggttcactgcaatcttgctatgattcgggtctggaagagtccgagaccccatccagcaaatctagctccggtccaaggctcggggccctgccccttcccgaagacaattacgaacggacaacgcccgatggcagcgtagactctaggccactcccagacgtggctctgactggcaaatgtactagggaatgtgatgagtacggacattcagattcctgttggatgcccgtccgaacgtccccggaaaggaaaaagagccagcccaagctgagtacattcatgccggtggatgagcgcggctcacaggaaaaattggcaaacggggaggcagcaatcatgggggatagaaatcgcaatttattgaacaagaagctgacatcaagttacgagaccttctcggccgcaagtttcagtaaaaacgaagaagccaaccccgaggatatcccactgaccaaaaccggcgagtacaaacccagcccagtgaacacacttacgcgaagggaggtgtacctgtag

SEQ ID NO: 131080 - DNA, 3210 bp, Artificial Sequence
  Description of Artificial Sequence: Synthetic coding sequence
atgctgcgtatgcggacggccggctgggctcgaggctggtgcctcggatgctgcttactgctgccactctccctgtctctggctgccgccaaacaactgttgcgatatcgactggctgaagaaggaccggccgatgtccgcattggcaatgtggcatccgatctgggaattgttacaggatccggggaggttactttctctctagagagcggttctgagtatttgaaaatcgataatctgactggtgaactgagtacttccgagcgtcgcatcgatagagagaagcttccgcagtgccagatgattttcgatgagaacgagtgtttcctggacttcgaagtatcagtcatcggtcccagtcagtcgtgggtagaccttttcgaaggccaggttattgttctggacattaacgataacaccccaacattcccgtctcctgtgctgactctgacagtggaagaaaatcggcccgttgggacgctgtacctcctcccaaccgctaccgatagggacttcggccgcaacggaattgaacgttacgaattactgcaagagcccggcggggggggttccggcggcgagtcacgaagagcgggggccgccgattccgcaccctatcccggcggtggcggtaacggggcatctggcggcggctctgggggcagcaagcgaagattggacgctagcgagggtggcggcgggacaaaccctgggggccgatcaagtgtgttcgaactgcaggtcgccgatactcccgatggcgagaagcagccccagctgatcgttaaaggtgccttggatcgagaacaacgtgactcctatgagctgaccctccgtgtaagagacgggggcgaccctccgaggtcgtcccaggctatcctccgcgtgctgatcactgacgtgaacgacaactctccgagattcgagaagtccgtttatgaggccgacctcgccgagaactcagcaccagggacacccatcctacaactgcgcgcagccgacttagatgtgggcgtgaacggccaaatcgagtacgtcttcggcgcagcaacggagtctgtaaggcggttgcttcgccttgatgaaactagtggatggctgtccgtattgcacagaatcgaccgagaggaggttaatcagcttcgttttaccgtgatggcccgggacagaggacaaccaccaaagactgacaaggctacagtggtgctgaacatcaaagatgagaacgataacgtaccttccattgaaattcgcaagataggaaggatccctctcaaggacggggtggcaaatgtggccgaggacgttctcgtagacaccccaattgcacttgttcaggtctccgaccgcgaccagggcgaaaatggggttgtcacatgtacagtggtgggcgacgtacccttccaactcaagccagcatccgatacagaaggcgaccagaataaaaaaaaatattttcttcataccagcacccctctggattacgaggccacccgggaattcaacgttgtgatcgtggcagtcgactccggaagtccctcactctcaagtaataatagcctgatagtaaaggtgggagacactaacgataatccgcctatgttcgggcagagcgtggtggaagtgtacttccccgaaaacaacatccctggcgagcgagtggccacagttctcgccacggacgcagactcaggtaagaacgctgaaatcgcttactctctggactccagcgtgatgggtatcttcgccattgatcctgattccggagacattctggttaacaccgtattggacagagagcagacagacagatacgagttcaaagtcaatgctaaggataagggcattccagtcctgcagggcagtactacggtaattgtgcaggtcgccgataaaaacgataacgatccgaaattcatgcaggacgttttcaccttttatgtgaaagaaaatctgcaaccaaattctcccgtcggcatggttaccgtgatggatgcggataaaggtcgcaatgccgaaatgtccctttatatcgaggagaacaacaacattttttccattgagaatgataccggaacaatctactctaccatgtcattcgatagggaacaccagacgacatacacgtttagagtcaaggctgtggacggcggcgatccaccccggagtgccacagctacagtcagcctcttcgtcatggatgagaacgataatgcaccaactgtcactctaccaaagaacatttcctataccctattgcctccatccagcaacgtccgcacagtggtcgctactgtgctcgccacagattctgacgacggaataaacgcagatctgaattactctattgtggggggtaatcccttcaaactgttcgagatcgaccccacctcgggcgtggtgtccctggttggaaagctcacacagaagcactacggccttcaccgtctggtcgtccaggtgaatgactctgggcagcctagccaatccaccaccaccctggtccatgtttttgtaaatgagagcgtttccaacgcgactgcgatcgatagccagattgcccgaagcttgcacatacctctgacacaggacatcgcaggagacccaagctatgagatctccaagcagagactgagtattgtgattggggtcgtagcaggcataatgactgtgatccttatcatcctcatcgtagtgatggctcgatactgcagatcgaagaataagaacggatatgaggcgggcaagaaggatcatgaagacttcttcacaccacagcagcacgacaaatccaaaaagcctaaaaaggataagaagaacaagaaatcaaagcagccactctattcttctatcgtcacagtcgaagcaagtaagcctaacggtcagcgttacgattcggttaatgagaagctctcggactccccctccatgggtcgataccggtcggtgaatgggggacccgggtccccagatttagcgcgccactataagagcagcagtcccttgccgactgtacagttacatccccagtctcccacggcgggaaaaaagcaccaagccgtccaggatctcccacccgctaatacctttgtgggcgccggggataacatctctattggaagcgaccattgctctgaatatagctgtcagacgaacaacaaatattccaaacagatgcggctacacccttacataacggtctttggctag

SEQ ID NO: 131081 - DNA, 3768 bp, Artificial Sequence
  Description of Artificial Sequence: Synthetic coding sequence
atgcttcgaatgcggacagctggttgggcccgtggctggtgcctcggatgctgccttttactgcctctgtctctgagccttgcggcggctaaacagttgttacgctaccgtctggccgaagaagggcccgccgacgtcagaatcggcaacgtggcaagtgacctcgggatcgtgacaggttcaggtgaggtgactttttcactggaaagcggatccgaatacctgaagattgacaatctgaccggcgagttgtccacgagcgaaaggcgcatagatagagaaaaattgccacagtgtcagatgatatttgacgaaaacgagtgcttcttggactttgaggtgagtgtaataggcccttcacagagctgggtcgatctctttgaaggccaggtcatcgttctggacatcaacgataatacacctactttcccatcccccgtgctaactcttaccgtggaggagaaccggcccgtgggcacactgtacctgctgcccactgcaactgatagggactttggtcggaatggcatcgagcggtacgagctgctgcaagaacctggtgggggtgggtctggcggagagagcagacgtgctggagccgcggacagcgccccttacccaggcggtggcggcaacggggcttccggcggggggtctggggggtcgaaacgacgattagatgctagtgaaggcgggggagggactaatcctggggggcggagctcagttttcgagctgcaggtggccgatacccctgacggggagaaacagcctcaactgatcgtcaagggagcgctggacagggagcaaagggattcttacgagttgacactgcgggtgcgagacggaggcgatcctcctcgcagcagccaggccatccttcgagtgctcatcaccgatgtgaacgacaactcgcctcgattcgagaagtctgtgtacgaagcagatttggcagaaaacagtgctccaggtactccaatcctgcagttgagggcagctgacctggatgtgggtgtgaacggacagattgaatacgtctttggtgccgccactgagagtgtgcgacggctgctgcgtctagatgagacttctggttggttgtccgttctacatcgaattgatagggaggaggtaaaccagttacgatttaccgtgatggctcgcgatcggggccagcctccaaaaactgacaaagcgacagtcgttttgaacattaaggacgaaaatgacaacgtgccttctattgagatccgcaaaatcggaaggatcccactgaaggacggtgtggctaacgtggccgaggatgtcttggtggacacccctatagcactggtgcaggtgtcagacagggatcaaggggaaaacggtgtggtcacttgtactgtggttggtgacgttcccttccagctgaaacctgcaagcgacacagaaggcgaccaaaataaaaaaaagtactttctgcacaccagcacaccactggattacgaagctactagagagttcaacgtggtgattgtcgccgtggattctggttccccaagtctaagctcaaataatagtctgatcgtgaaagtgggcgacacgaatgataaccctcctatgttcgggcaatcagttgtcgaagtgtactttccagaaaacaacatccctggtgagcgcgtggccacggttctcgctacagacgccgattctggcaagaatgcagaaatcgcctattcacttgattcttctgtgatgggcatctttgcaatcgatcccgactccggtgacatactggtgaataccgtactggaccgggagcagacggatcgctatgagttcaaagtgaatgcaaaagataaaggcatccccgtgttgcagggctctacgaccgtgattgtgcaagttgccgataagaatgacaacgatcccaaattcatgcaggacgtttttacgttttatgtgaaagagaaccttcagcctaactccccagtgggaatggttaccgtgatggacgctgacaagggacggaacgccgagatgagcctctacatagaggaaaataataacattttcagtatagaaaacgacacaggtaccatctactcaacaatgtccttcgaccgggagcaccaaacaacatatacgttcagggtgaaggcagtggacgggggggacccccctcgatccgccaccgctaccgtcagcttattcgtgatggatgaaaatgataacgcccccacagtgacgctgccaaaaaatatttcctacaccttgttgcccccatctagcaacgtacgcactgtcgtggccacggtgctggcaacagattccgacgatgggattaacgctgacctgaattactcaattgtggggggcaatccgttcaagttgttcgagattgatcctacatcaggggtcgtctcgttagtgggcaagctgactcaaaagcactacggactgcatcgcttagtggtgcaggtaaacgattccggccagccctctcagagtactactactctggtacacgtgttcgtgaacgagagtgtctccaacgccacagctatcgactcacagatcgcaagaagcttacacatacccctcacccaggacattgctggcgacccatcctatgagattagcaaacagaggttgtccatagttatcggcgtcgtggctgggattatgaccgtgatccttataatactaattgttgtgatggccaggtattgcaggagcaagaacaaaaatggttatgaggccgggaagaaggatcatgaagatttttttactccccagcagcacgacaagtccaagaaaccgaaaaaagataagaaaaataagaaatctaagcagccactgtatagctctatcgtcacagttgaggcatcaaagcccaacggccagagatacgacagcgtgaacgaaaaacttagtgactctccaagcatggggcgctatcgttcagttaacggtggacctggtagtccagacctcgcccggcactacaagtccagctcccccctgcccaccgtgcagctgcacccacagagcccaaccgccgggaaaaagcaccaggcagtgcaggatctcccaccggctaacacgtttgtgggggcgggcgacaatatctccatcgggtctgaccactgctccgaatactcatgtcaaacaaataataaatattcgaagcagcctttcagaagagtgaccttttctgtggtgtcacagccacaagatcctcatcaggggagtctgcagtcctgttacgatagcggcctggaagagtctgagacaccctccagcaaatcttcctccggcccccgacttggagccctacccttgccagaggataattacgagcgaactacccccgatggcagtgtgggggaagcagagcacatggagaatgacagccgtcctctgccagacgtagcactcaccgggaaatgcacccgagaatgtgacgaatacgggcattcggactcttgctggatgccagtacggacaagccccgagagaaagaagtctcaacccaaattatcaacgttcatgccagttgatgagaggggcagccaggagaaattggccaatggcgaagccgccatcatgggagatcggaacagaaatttgctgaacaagaagctcactagcagttacgaaaccttttcggcggcatcttttagcaaaaacgaagaagctaatcccgaggatattccactcacgaaaactggcgaatataagccaagcccggtcaacacgctcactaggcgagaggtgtatctttag

SEQ ID NO: 131082 - DNA, 2922 bp, Artificial Sequence
  Description of Artificial Sequence: Synthetic coding sequence
atgagccccgtgaggcggtggggctcgccttgcctgtttccattacagcttttctccctgtgttgggtgttatccgtggcccagtctaagacagtgcgttactctacttttgaggaagacgcacccggtacagtgatagggactcttgctgaagacctccatatgaaggtttcgggagatacgtcttttcgcctgatgaaacagttcaacagctcgttgttgcgtgtgagggaaggtgacgggcaacttacagtgggggacgcggggctggatagagaaaggttatgtggtcaggcacctcagtgtgtgctggccttcgatgttgtctcgttcagccaggagcagttcagactggtacatgtggaagtcgaggtccgggacgtgaatgaccacgcacccaggtttccgcgtgcacaaatccctgtggaggtgagcgaaggcgctgccgtgggaacacgcatcccgctggaagtacccgtggacgaggatgtgggagccaacggattacagaccgttcgcttagcagagccacattctccctttagagtggagctgcagacaagggctgatggagcccaatgcgccgatctggttctgcttcaagagctcgacagagagtctcaggccgcgtactctctcgaactggtggcccaggacggaggaaggcctccaagaagtgccacagccgccctaagtgtgcgcgtccttgacgccaatgaccacagccctgcatttccacagggcgccgtggcggaagtggaactagccgaggacgcaccggttggctctctgttgctcgacttggacgcagcagatccagacgaaggacccaacggggacgtcgtgttcgcgtttggagcacggacgcctcctgaggcccggagattgtttagactcgaccccaggagcggacgacttactttggcgggcccggtggattatgagcgccaagacacgtacgagctggacgtcagagcgcaggacagaggcccaggaccaagagccgcgacatgtaaggtaattgtgagaatcagagatgtgaatgacaacgctcctgatatcgccatcactcccttagccgctccaggagccccagcaacttctccctttgccgccgctgccgcggctgccgccctgggcggggcagacgcctcttctcctgcaggcgccggaaccccagaagctggagcgacctcgttagttcccgaaggggctgcccgcgagtcactggtggctctggtgagcacgtcagatagggactccggcgctaacgggcaggttaggtgcgcactatatgggcacgagcacttccgtctacagcccgcctacgcggggtcttatttagtggtgactgcagccagcctggaccgcgaacggatcgctgaatataaccttactttggtcgccgaggacagaggagccccgcctctgagaacggtgcgaccctacaccgtccgggttggggatgagaatgataacgcccctctcttcacccgccctgtctacgaggtctctgtgagggaaaataaccctcctggcgcttacttagctacggtagccgccagggaccgggacctgggccgcaatggacaggtgacctacaggctccttgaagccgaagttggccgggcagggggggcggtgagcacttatgtctccgtcgatcccgctacaggggccatatacgcactgaggagtttcgattacgaaacgttgcgtcagctggacgtcaggattcaggcttcagatggaggatcacctcagctgagctccagtgcactggtacaggtcagggtccttgatcaaaatgaccacgcccctgtgttagtgcatcccgctcccgcaaacggctccttggaggtggcggtacctggccgaaccgctaaagacacggtggttgcaagggtccaagcccgcgatgccgacgagggcgccaacggggaactggcctttgaactgcagcagcaagagccaagggaagctttcgcgattggacgccgtacgggtgagatattgctgactggtgatttaagccaggagccacccggtagggtgttccgtgccctgctggtcatctccgacggaggccggcctccattgaccactactgctacagtgtcgttcgtcgttaccgccggtgggggtagggggccagctgccccagcttctgccggatcccctgagcggagtcgccccccaggttcgcgccttggtgtgtctggaagcgtcttacaatgggatacacctttgattgttatcattgtgctggctggctcctgcaccctgttgttggcagcaataatcgctattgctacaacctgcaacaggcggaagaaggagccctatggcgcaagcccgggattcggcaaggagcccgctccacctgtcgctgtgtggaagggtcatagctttaatactatctcgggacgcgaggctgagaagttttccggcaaggacagcggtaaaggggattcagacttcaatgattctgacagtgacatttccggcgacgctcttaaaaaggacttgattaaccatatgcagtcaggactgtgggcttgtacagccgagtgcaagatccttgggcacagtgatcggtgttggagtccttcttgcagcggacccaatgcacacccttctccccaccctccggcccagatgagtactttctgcaaatcaactagcctaccgagagacccattgcggcgcgataattattatcaagctcagctccccaaaacggtgggcttacaatccgtctacgagaaagtacttcaccgggactacgataggactgtcactctgctcagccccccaagaccgggacggctgcctgatctccaagagattggcgtgcctttataccagtccccccctggcaggtaccttagtcccaaaaagggagcaaacgagaatgtatag

SEQ ID NO: 131083 - DNA, 3213 bp, Artificial Sequence
  Description of Artificial Sequence: Synthetic coding sequence
atgagccccgtgcgccgttggggctccccctgtttgttcccactgcagcttttctctctgtgctgggtgctgtccgtggcacagagcaagaccgtccgctattctacgtttgaggaagatgctccaggcaccgtgattggcaccctggccgaggatctgcatatgaaggttagcggagacacgtcttttaggctgatgaagcagttcaattctagcttgttgcgcgtgcgcgagggtgatgggcagctgactgtgggcgacgctggcttggatcgggaacgtctgtgtggacaggcccctcagtgtgtgctcgcctttgatgttgtgtctttctcacaggagcaatttcgcctggtccatgtggaggtcgaggtgagggatgttaatgaccatgcgccacgttttccgcgcgcacaaatcccggtagaagtgagcgagggggctgctgtgggtacacggatcccgctggaagtgcctgtggatgaagatgtgggagctaacggccttcagaccgtcaggcttgccgagcctcactccccatttcgggtggaacttcagacaagggccgatggggctcagtgcgcagacctggtgttgttacaagaacttgatcgtgagtcccaagcagcgtacagcctcgaactggtcgctcaggatggcggcaggcctcccagaagcgccacggccgctctttccgtgcgggtcttggacgctaacgatcacagtcctgccttcccacaaggcgcagtggctgaggttgaacttgccgaagacgcgccagtgggtagcctgttgcttgatctggacgctgctgatcctgacgagggtcccaacggagacgtagtgtttgccttcggtgcccgaacaccacctgaggcaaggcggctttttcgtctggatcctagaagtggacggctaactctggccggtcctgtcgattatgagaggcaggacacgtatgaattagatgtgcgagctcaagaccgtggtcccggccctcgtgcagctacctgtaaggtaatcgtccgaattagggatgtgaacgataatgcccctgacatcgccattacacctctagccgctcctggtgcaccggctacctccccatttgcagccgcggccgccgccgccgccctcggcggtgcagatgccagcagccctgccggagcaggcactcctgaggcgggtgcaaccagcctcgtgcccgagggagccgcgcgcgagagtctggtggccctggtgtcaaccagcgatcgcgacagcggagccaacggtcaggtgaggtgcgccctttacggacatgaacacttcagactacagccagcctacgccgggtcttacctggtcgtgactgctgcctctctggacagggagagaattgctgaatacaatctgaccctcgttgcggaagatagaggcgcccccccactgaggacagtgcgaccctacaccgttcgcgtgggcgatgagaacgataatgcccctctgtttacacggccggtatacgaggtatcagtgagggagaacaatcctccgggcgcataccttgccactgtagccgccagagatagagacctaggacggaacggacaggtaacgtaccgacttctcgaggccgaagtgggtagggccgggggagccgtgtctacttacgtttcagtcgatccagcaactggggcaatttacgctctcagaagtttcgactacgagaccctccgccaactggatgtcagaatccaggcatcagacggcggatcacctcagctgagctcatctgcacttgtgcaggtacgggttctcgatcaaaacgatcacgcccccgtcctggtccaccctgctccagccaatggtagcctggaggtagccgtgcccggcaggacagcaaaagacaccgtcgtggcacgggtacaagcacgcgatgctgatgagggggctaatggggagttagcgttcgaactgcagcaacaggagccaagggaagctttcgccattggcaggaggacaggagagatactgctcacaggcgatcttagccaggagcctccggggcgggtgttccgcgcccttcttgtgattagcgacggtgggcggccccctctcaccacaacagcaacggtgagttttgtggtgaccgctggtggcgggagggggcccgctgcccccgcctctgccgggtcccccgagaggtcacgaccacctggctcacgactcggagtaagtggcagcgtgttgcagtgggatacgcccctgatcgttatcatcgtgctcgcagggagctgtactctcctgcttgccgcaatcatcgctattgcgactacatgcaacagaagaaagaaagaggtcaggaaggggggtgctttacgtgaggagagaccgggggccgccggaggcggtgcctccgcacctgggtctcctgaagaagccgcccgaggggccggcccgcgacctaacatgtttgatgtgctgactttcccgggtacaggcaaggctccatttggaagccccgccgccgacgcacctcccccagccgtggccgcagctgaggtgccgggctcagaaggtggaagtgccactggtgaaagcgcatgccattttgagggacaacagcgtctgcggggtgctcatgccgaaccttatggtgcctctccaggcttcggtaaggagcctgcaccacccgttgcggtttggaaaggacacagctttaatactatctccgggagagaggctgaaaagtttagcgggaaggactctgggaagggggatagcgattttaatgattctgactccgacatttctggcgacgccctgaagaaggatctgattaatcatatgcagtctggcttatgggcgtgtacggccgaatgcaagatcctgggccactctgaccggtgttggtcgcctagctgcagcggacctaatgcacacccttcaccacaccctccagcccaaatgtctaccttttgcaagagcaccagtctgcccagagatcctctaagacgcgacaactactatcaagcacaactgcctaagaccgttggtttgcagagtgtgtacgaaaaggtcttgcacagggattatgataggactgtcaccctgctgagccctcctcgtccggggcgcttacctgatctgcaggaaataggggtgcccctataccagagtccacccggacgctatctttctcctaaaaagggcgccaatgagaacgtgtag

SEQ ID NO: 131084 - DNA, 1791 bp, Artificial Sequence
  Description of Artificial Sequence: Synthetic coding sequence
atgtcacccgtccggcgttggggctctccctgcttgtttcccttgcagctcttttctctgtgctgggtgctgtccgtagcccagagtaagaccgttagatattccacatttgaagaagacgcacccggcaccgttatcgggacacttgccgaggacctgcatatgaaagttagcggggatactagcttccgtcttatgaagcagttcaattcatcccttctgagggtgcgcgaaggagatgggcagctgacggtgggagatgccggactggaccgagagcggttgtgcggacaggcccctcagtgtgtcttggctttcgacgtggtgtctttttcacaggaacagtttaggttagtccatgtggaggtcgaagtccgtgacgtgaatgaccacgctccggttctcgtccacccggccccggctaacggttcactggaggtcgccgtgcccggtaggaccgccaaggacacggtggtcgcccgcgtacaggcccgcgacgccgatgaaggagccaatggagaattagcctttgagctgcagcagcaagaacccagggaggcctttgcaatcggccgacgcacaggcgagattcttttgacaggtgacctgtcccaggaacccccagggagagtgtttagagccttgttggtaatttcagacggtgggcgtccacctctgactaccacagccacagtctcttttgtggtgaccgccggcggcggcaggggaccagcagctcctgcttccgcagggagtcccgaaaggtccaggcctcctggttcccggctgggcgtcagcggaagcgtactgcagtgggataccccgttaatagtcataattgtgctggccggttcatgcaccctgctgctagctgctattatcgccatagctacaacctgtaatcgccggaagaaggaggtgcggaaaggcggagctctgagggaagagcgccctggggccgccgggggcggtgcaagcgcaccgggttctccggaagaggctgctagaggcgccggaccaagacccaacatgttcgatgttctgacattcccgggcacgggcaaagccccctttggaagcccagctgccgacgcacccccacccgctgtcgcagccgccgaggtacccggatctgaaggcggaagtgccaccggggagtctgcctgtcacttcgagggacagcaacgtctgcgtggggcccacgccgaaccctatggcgcctccccaggctttggtaaggaacctgccccccccgtagccgtgtggaaggggcactcattcaatacaatatctggccgggaagccgaaaagttttccggaaaagactctggcaagggagactctgacttcaacgattccgatagcgacatttctggggacgccctaaagaaggacctgattaaccatatgcagtcaggcctgtgggcttgtactgcggaatgcaagattctcggccactcagaccgatgctggtccccgtcatgctccggcccaaacgcgcaccccagcccacatcctcccgcccagatgagcaccttctgcaaaagtactagtttgcccagggaccctctgagaagggacaactattatcaggctcagctccccaagaccgtaggactccaatctgtgtatgagaaggttcttcaccgggactacgacagaacagtcaccctcttgtcccccccccggccgggaaggttgccggacttacaggaaataggggtgcctttgtaccagagcccacccggccggtatctgtccccaaaaaagggtgctaacgaaaacgtgtag

SEQ ID NO: 131085 - DNA, 2742 bp, Artificial Sequence
  Description of Artificial Sequence: Synthetic coding sequence
atgagcccagtgaggagatggggatccccgtgcctgttcccacttcagttattttcactctgctgggttctttcagttgcccagtccaagacagtgaggtacagcacttttgaggaagatgcccccgggacagtcatcgggaccctcgcagaagacttacatatgaaagttagtggagatacttcattccggttaatgaaacagttcaattccagcctgttgcgcgtgcgggaaggagacgggcagctgactgtcggagatgcggggctggatagggaacgcctgtgtggtcaggcccctcagtgcgtgctggcattcgatgtcgtcagctttagccaggaacaatttcgcttggtccacgtggaggtggaagtacgggacgtcaatgatcacgctcctagattcccaagggcacagatccccgtggaggtctcagagggagccgccgtcggcacccgcataccactcgaggtgccagtcgacgaggacgtcggggccaatggcctccagaccgtccgccttgccgaaccccattccccttttcgcgtggaattacaaacccgggccgatggtgctcagtgcgccgatctggtgctcctgcaagaactggatcgcgaaagccaggccgcatacagtctagagctggtagcacaggatgggggcaggccacctagaagtgccacagctgcgctgagcgtgagagtcctggacgccaatgaccactcccccgccttccctcagggagctgttgctgaggttgagctcgcagaagatgcccctgtcggaagcttgctactggatcttgacgcggctgaccccgacgagggacccaacggtgacgttgtttttgcgtttggggcccgcactcctcctgaggcccggaggctgtttagactggatccgcggagtggaagactaaccctggcagggcccgtagactatgagcgccaagatacctatgagctggatgttcgggcccaggaccgcggaccaggaccccgggccgccacatgtaaggtgattgttcgaatacgcgacgtgaacgacaatgcacccgacatcgcaattaccccactcgcagcgcctggcgctggcaacctcaccttgcgacggaacggtcaggttacttaccgtctgctggaagcagaagtcgggagggctgggggagccgtaagcacttacgtaagcgtggacccagcgactggggcaatttacgctttaaggagcttcgattatgagaccctgcggcaacttgacgtccggatccaggcgagcgatggggggtccccccagttgtcctccagcgcactggtccaggtgcgagtcctggatcagaacgaccatgctcccgtacttgtgcatccagccccggccaatgggagcctggaagtcgcggtcccagggagaacggcgaaggacacggtcgtcgcaagggtacaggctagggacgccgatgagggagctaacggtgagctggccttcgaactgcaacagcaagagcctcgcgaggcgttcgccataggacggaggactggagaaatcctcctcactggtgacctgtctcaggaacctccaggacgcgtgtttcgagccctgctggttatcagtgatggaggccggccacctctcaccaccacggctactgtctcattcgtggtgaccgcggggggtggaagaggccctgccgcacccgctagcgccggcagtccggaaaggtcacgtcccccaggatcaagactcggtgtatccgggagcgtgcttcagtgggatacccccctgatcgtgataattgtgctggccggcagttgcaccttgctgctggccgctattattgctatagccacgacctgtaatcgaagaaagaaggaagttaggaaaggtggggcgctgcgcgaagagcggccaggagccgcgggcggcggggctagcgcccctggcagccccgaggaagctgccagaggcgccggccctagacctaacatgttcgatgtcctgacatttcccggcactggcaaagccccttttgggagtcccgccgccgacgccccaccaccagctgtggcagctgcagaagtacctgggagcgaagggggtagcgctacaggtgaatcagcctgtcattttgagggacaacagcgacttcgaggcgcccacgccgagccatatggagctagccccggatttggaaaggagccagctcctcccgtggccgtgtggaagggtcattcattcaacactattagtggccgggaggctgagaagttttcagggaaggattccggcaaaggggacagtgatttcaatgactcagacagcgacatctcgggggatgcattgaaaaaggacctgataaaccacatgcagtctggcctgtgggcgtgcactgccgagtgcaaaattctcggccactctgacagatgctggtcaccgtcctgttcaggacctaacgctcacccctcccctcaccctcccgcccagatgtcaaccttctgtaagtctacatctctccctagggatcctctgcgaagagacaactattaccaggcccagctgcctaaaaccgtgggcctccagtccgtgtacgaaaaagtccttcaccgcgactacgaccgaacagtgaccttgctaagtcccccccggccaggtcggctccctgatctgcaggagataggagtccccctctatcagtcaccacccggccgttatctgagcccaaagaagggggcaaacgaaaacgtctag

SEQ ID NO: 131086 - DNA, 3612 bp, Artificial Sequence
  Description of Artificial Sequence: Synthetic coding sequence
atggaccttcgagatttctatcttttggctgcgttaatcgcctgccttaggctcgattcagccatcgcgcaggaacttatttacaccatccgtgaagaactccctgagaatgtgccaatcggcaacatccccaaagacttgaatatcagccacatcaatgccgcaacaggcacctctgccagcttggtgtaccggttagtttctaaggcaggcgatgcacctctagtcaaggtatcatcctccactggcgagatcttcacgacaagtaaccgtattgatcgggagaagctctgtgccggcgcctcatacgctgaagaaaacgagtgttttttcgaattagaagtggtgatacttccaaacgattttttcagactcattaagatcaaaattattgtgaaggacaccaacgacaatgcacctatgtttcccagtccagtgattaatattagcattcccgaaaacactctgatcaacagtcggttccccatccctagcgcaactgatcctgataccggatttaacggcgtgcagcactatgagctgctaaacggccagtctgtgtttggcctagatatcgtggaaacccccgagggcgagaaatggccacagctgattgtgcagcagaacttagaccgggagcagaaagacacttatgtaatgaagatcaaagtggaagatggaggcacgcctcagaagtcgtccacagccattctgcaggtcacggtcagtgatgtaaacgataatcgccctgtgtttaaagaaggacaggtggaggtgcacattcctgaaaacgcaccagtcggcacatccgttatacaactgcacgccacagatgcagacatcggaagtaatgcggaaatcagatatatcttcggggcccaggtcgctcctgcaaccaagaggctgtttgcactgaataacaccaccggactcattaccgtacagcgttctctcgatagggaagagactgccatccataaagtcaccgtgctggccagcgacggctctagcacacctgcacgggctacagtaacaattaacgtcaccgacgtaaacgataacccccctaacatcgaccttagatatatcatatctcctattaacggcacagtctacctctcagagaaggaccccgttaataccaaaatcgcccttatcaccgttagcgacaaggacaccgacgtcaatggaaaggtcatttgtttcatcgaaagggaggtgccgttccacctgaaagccgtgtatgacaaccagtatctgctggagacctcctccctcttggattatgagggaaccaaagaatttagtttcaagattgtcgcctccgatagcggaaagccaagtctgaaccaaaccgcgctcgtgcgggtgaagcttgaagatgagaacgataacccccctattttcaaccagccagtgatcgagttgagtgtatcggagaacaaccggcggggactgtatctgaccaccatctcagctaccgatgaggacagtggaaaaaatgccgatatagtatatcagctgggtcccaatgccagtttcttcgacctcgatcgaaaaactggggttctgaccgcctctagggtattcgaccgtgaagaacaagagagatttattttcacagtgaccgcacgagataacgggacaccccctctgcagagccaggctgctgtcatcgtgacagttcttgacgagaacgataacagtcctaagtttacacataaccacttccagttctttgtcagcgaaaacttgcccaagtactctactgtgggggttattaccgtaaccgatgccgatgctggcgaaaacaaagccgtgacgctttctatacttaacgataacgacaactttgtgctcgacccgtacagcggcgtaataaagagcaatgtgagctttgatagggagcagcagagtagttacacattcgatgtgaaggcaaccgatggcggacagccacctcgttctagtacggccaaggtaactattaacgtgatggacgtgaatgacaactctcctgtggtgatctcccctccttccaatacaagctttaagctggtgcccctgtcggcaataccaggttccgtcgtggctgaagtatttgcggttgacgtggacacggggatgaacgcggagttaaaatacactattgtgtctggtaacaataagggactgttccgaatagacccagtcactgggaacatcacgctcgaagagaaaccagcacccactgacgtgggacttcatcggctcgtagtgaacatcagcgacctcgggtatccaaaaagtctccacactctcgttttggtgtttctgtatgtgaatgatacagccgggaacgccagttatatatacgacctgataagaaggaccatggaaacgccactggaccgcaatattggcgactcatcccagccctaccagaatgaggactacttaactatcatgattgccattattgctggagccatggtggtgattgtcgtgatctttgtgacagtgttggtacgatgcaggcatgccagcagattcaaggccgcccagagatctaagcagggggccgagtggatgagcccaaaccaggaaaataagcagaataagaaaaagaaacgcaagaagcggaagtcacctaaatcctcgctgcttaatttcgtcacaattgaagaaagcaagccagatgacgcggtgcatgaacccattaacgggacgatttctttgcccgccgagttggaggagcaatcaattggtcggtttgactgggggcctgcaccccctaccacttttaagccaaacagtccagacctggctaaacattacaagagcgccagtcctcagcccgccttccaccttaagccagatactcctgtgagcgtcaagaagcatcacgtgatccaagagctgcccctcgacaacacctttgttggcggctgtgacaccctctccaaacgatcctcaactagcagcgatcacttctccgctagtgagtgtagctcccagggggggtttaagaccaagggaccgctacacacacggcagtcccaaagacgggttacctttcatctgcctgacggtagtcaagaatcttgctcagactccggcttaggggatcatgagcccgtaggcagcggtacattaattagccatccgctacccctagtgcagcctcaggatgagttttatgatcaggcatcgcctgataaacggaccgaggctgacggaaacagcgatcccaacagcgatggaccactaggcccccgaggactggcagaggctaccgaaatgtgcacacaagagtgcctggtcctgggacattccgataactgctggatgcccccagggctggggccatatcagcatcctaagagtccactcagcacattcgcccctcagaaagagtgggtgaagaaggacaagctcgtgaacggtcatactctgacacgcgcctggaaagaagatagcaaccgaaaccagttcaatgaccgcaagcaatacgggagtaatgagggccacttcaataacggcagtcacatgacagatatccccctggccaacttgaaatcgtataaacaagctggcggagctaccgagagccctaaagaacatcagctgtag

SEQ ID NO: 131087 - DNA, 3099 bp, Artificial Sequence
  Description of Artificial Sequence: Synthetic coding sequence
atggacttgcgcgatttctatctgcttgccgctctaatcgcatgtttacgcctagatagcgccattgcccaggaactgatttacacaatccgggaagaactgccagagaacgtccctatcggtaacatccccaaggatctgaacataagtcatatcaacgccgctaccgggacatcagcctccttagtctacagactagttagcaaggcgggcgacgcaccattagtgaaagtttcaagtagcacaggagaaatctttaccacttcaaaccgtattgatcgagaaaagctgtgcgcaggggcatcctatgccgaagagaacgagtgcttttttgagctggaggtggtaattctgcctaatgattttttccggctgattaagatcaaaatcattgtgaaggacacgaatgataacgcccctatgttcccctcacccgtgatcaatattagcattccagagaacacgcttattaacagccggtttcctattccaagtgcaacggatcccgataccggcttcaatggcgtccagcactatgaactgctaaacggacagtctgtgtttggcttggacatcgtggagacaccagagggtgaaaagtggcctcagctaattgttcagcagaatctcgacagggaacagaaagatacttacgtgatgaagatcaaagtggaagatggcggcacccctcagaagtcatccacggcgatattgcaagtgacagtgtcagacgtaaatgataatcggccggtgttcaaagagggccaggtggaagtgcacattcccgaaaacgctccggtgggaacctcagttatccagttacacgcaaccgacgccgatatagggtctaacgcggaaatccggtacatttttggggcacaggtggccccagcaacaaagcgccttttcgctctgaacaatacgaccggactgattacagtacagcgaagccttgaccgcgaggaaaccgctatccacaaggttacggtgttggcaagcgacgggagctcgactcccgcccgcgccacggtaactatcaatgtaactgatgtgaacgataacccacctaatattgacctccgctacattatctctcccatcaacggcaccgtttacctatcagagaaggatcctgttaataccaagatcgctctgattaccgtatctgataaagatacggacgttaacgggaaggtgatttgttttatcgaaagagaggtgccctttcaccttaaagccgtctatgataaccaatatctgctggagacaagctccctcctggattacgagggaactaaagagttttccttcaagatcgtagcctctgattccggaaaaccgagccttaatcagacagcactggtgagagtcaaactcgaagatgaaaatgacaatccccctattttcaaccagcccgtgatcgagctgtccgtgtccgagaacaatcggcggggactgtacctgacaaccatctcagcaacggacgaagattcgggcaaaaacgcagacatcgtatatcagctgggccccaatgcaagttttttcgatctcgatcgtaaaactggggttctcactgcttcgcgcgtttttgatcgagaggagcaggaacgcttcattttcaccgttacagcccgagataacggaaccccacccctgcagagtcaggctgccgtcatcgtgactgttctggacgagaacgataattcacccaagtttacgcacaaccactttcagttcttcgtctctgagaatctgcccaagtacagcaccgtcggcgtgatcaccgtcaccgacgccgatgctggcgaaaacaaagctgtcaccttatccattctcaacgacaacgataacttcgtgttggacccatattctggggtaattaagagcaatgttagcttcgaccgtgaacagcaatcgtcttacacctttgacgttaaggctactgatggcgggcagccccctagaagctcaactgctaaagtcaccatcaacgtaatggacgtaaatgacaactcccccgtggtaatctcgcctccctcaaatacctcattcaagttagtccctctcagtgctatccccggctctgtcgtagcggaggtctttgccgtagacgtcgacacgggaatgaatgccgaattaaagtacaccatcgtgtctggaaataataaggggttgttccgcatcgaccctgttacgggaaatataacgcttgaggagaagccggctccaacagacgtggggttgcatcgactggtggtcaatatcagcgatctcgggtatccgaagtctctgcacaccttggtcctggtctttctctatgtgaacgacactgccggcaacgcaagttacatctatgacttaattcgaaggaccatggagacccccctggatcgcaacataggtgattcttcgcagccttaccaaaacgaggattatctcacaatcatgatcgcaatcattgccggtgctatggtggtgattgtggttatattcgtgacggttctggtcaggtgccggcacgcaagcagatttaaggcggcccagagaagtaaacaaggagcagaatggatgtctcccaaccaggagaataagcagaataagaaaaaaaagcgcaagaaaaggaaaagtcctaagagctcgttgctgaacttcgttaccattgaggagagtaagccagacgacgctgtgcacgagccaataaatggtaccatttccctgcctgctgagctcgaagaacagagcatcggccgtttcgattgggggcccgcgccgcccaccactttcaaaccgaactcccccgatctcgccaagcattataaatctgccagtccccagccagcctttcatctgaaaccagacacaccggtttcagtgaagaagcaccatgtgatccaggagttgccccttgataacaccttcgtgggtggatgtgacacactttctaaacggtcttcaacctcgagcgatcacttcagcgccagcgagtgttcttcgcaggggggatttaagaccaagggccccctgcacacaaggcaagtcaatgaacacttctattggtcgatttccaccgcttacaagtgtccagtgaatcagtactag

SEQ ID NO: 131088 - DNA, 3714 bp, Artificial Sequence
  Description of Artificial Sequence: Synthetic coding sequence
atggacctcagagatttttacttattagctgccctgattgcttgcctgcgacttgactctgctatcgcccaggagctgatctatacaatccgagaagagctgccagagaacgtccccatcggaaacatacctaaggatctcaatatttcccacatcaatgccgctaccggcacctctgctagtctggtttatagattagtgtcaaaggcaggcgacgcaccactggttaaggtgtcaagtagtacaggtgaaatttttactactagcaaccggatcgaccgcgaaaagctttgcgctggcgcatcttacgccgaagaaaacgaatgtttctttgagcttgaagtcgttattctgcctaacgattttttcaggctaattaagattaagatcattgtcaaagatactaatgacaacgccccaatgttcccctcgcctgtgataaatatcagcattccagagaacacacttatcaatagccgattccctatcccttctgccaccgaccccgatactgggtttaatggggtccagcactatgagctcctcaatgggcagtcagtctttggcctggatatcgtggagacccccgaaggtgagaagtggccccaactcatcgtccagcagaacctggacagggaacagaaagacacctatgtcatgaagattaaggtcgaggacggaggtacgccgcagaagtcttccactgcgatcctccaggtgacagtttctgatgttaatgataatcgcccagtgtttaaagaaggccaggttgaggtccacatccctgagaatgctcccgttggcacatcagtcatacagttacacgctaccgacgctgacataggatctaacgccgagattaggtacatttttggggcccaggttgctcccgcaaccaagcggctcttcgcacttaataacaccaccggtctcatcacagtgcaacgatctcttgacagggaggaaacagcaattcacaaggtcactgttctggcaagcgatggtagctctactccagcacgcgccaccgttactattaatgtgaccgatgttaacgacaaccccccaaacatcgatctacgctatatcatttctcctatcaacggaactgtatatctgtctgaaaaagatcctgtcaataccaagatcgccttgatcaccgtctcggataaggatacggacgtcaacgggaaggtgatctgtttcatcgagagggaggtccccttccacctcaaggctgtgtatgacaaccagtacctcctggaaacttcaagcctgctggattacgaaggaacaaaagaattttcatttaaaattgtggcctcagatagtggtaaaccgtcattaaaccaaaccgcccttgtcagagtcaagctggaagacgagaacgataatcctcccatctttaaccaaccagtcattgagctaagtgtttcagagaataaccgtcgaggactgtacctgactaccatctccgctactgatgaggattctggcaagaacgctgacatagtgtatcagctgggcccaaacgcatcctttttcgatcttgatcgtaagaccggtgtgcttaccgcctccagggttttcgatagagaggagcaggagcgtttcatcttcacagttactgctagggacaatggcactccccccctgcagagccaggctgctgttattgtgaccgtcctggatgaaaatgacaacagcccaaagtttacacataatcacttccaattctttgtgagtgaaaatttaccaaagtatagtactgtgggtgtaataacagtgacagatgcagatgccggtgagaataaggccgtgaccctgagtattctcaatgacaatgacaacttcgtgctcgatccttactctggtgtcatcaagagcaatgtgagcttcgatagggaacagcagtccagctatacgttcgacgtgaaagccacagatgggggtcagcctccaagatcctcaactgcaaaggtaacaattaatgtcatggacgtgaacgacaactcccctgtggtaatttcaccacctagtaatactagctttaaactggtgcccttgagtgctatcccgggctccgtagttgcggaagtgttcgccgttgacgtagacacaggaatgaatgccgagttaaagtacacaatcgtgagcggtaacaacaagggcctgttcaggatcgatccggtgaccggcaacataactctggaagagaagccggcccctaccgatgttggcctgcataggcttgtggtgaacatctctgacttgggttatccgaaatcactgcatacactggttctggttttcctgtacgtgaacgatacagcaggcaatgcctcttatatctacgatttgattaggcggacgatggagacgccattagatcgtaatattggtgattcaagccagccttatcagaatgaggactatctcacaattatgatcgcaattatagccggcgccatggtggtgatcgtagtgatctttgtaaccgtcctggtcaggtgtagacacgcatcgaggttcaaggccgcgcagcgatctaagcagggtgctgagtggatgtctccaaatcaggagaacaagcaaaacaaaaaaaagaagcggaaaaaaagaaaaagtcccaaatcttccctgctgaatttcgtaaccatcgaggagagcaaacccgatgacgccgttcatgagcctatcaacggaaccatttcactgcccgccgagctggaagagcagagcatcgggaggtttgactggggcccagctccccctactacctttaaacctaactcacccgatctggccaaacattataaatctgcctcgccgcagcctgcgtttcatctaaagcccgacacaccagtgtcagtgaagaagcatcacgtcatacaagagcttcccctcgacaatacattcgtgggagggtgtgacacactgtccaaacgaagctccacctcttcagatcacttctccgcatctgagtgctcgtcacaaggagggtttaagacgaagggtcctctgcacacacgccagtgtaattctcacagcaaatccgataacatccctgtcaccccccagaagtgccctagcagtaccggtttccatattcaggagaacgaggagtcccactatgagtcccaaagaagagtgacgttccacctcccggatgggtctcaggagtcgtgctccgattcagggttgggcgaccacgaacctgtgggaagtggaactctcatcagccaccctctgccactggtccagccccaagacgaattttatgaccaggcaagccccgataagcggactgaggcggatggcaatagcgatcctaattctgacggcccattaggcccgcgcggtctcgccgaggctaccgagatgtgtactcaggagtgtttggttcttgggcatagtgataactgttggatgccacccggactgggcccataccagcaccccaagtctcccctttcgacttttgccccccagaaggagtgggttaaaaaggataaactcgtcaacgggcatactcttactagggcctggaaggaagactcgaaccgaaaccagttcaatgaccggaagcagtatgggtcgaatgaagggcacttcaacaatggcagccatatgacagacattcctctagctaatcttaaatcatataagcaagctggcggcgctacagaatccccaaaggagcatcagctctag

SEQ ID NO: 131089 - DNA, 3612 bp, Artificial Sequence
  Description of Artificial Sequence: Synthetic coding sequence
atggacctgagggatttctacctgttggccgcgctgattgcatgtttgaggctggacagcgcaatcgcgcaggagctgatctacaccataagggaagaactgcctgaaaatgtgccaataggcaatattccgaaagacttgaatatttctcacattaacgctgccacaggcacttccgcttcccttgtgtataggttggtcagtaaagcgggcgatgcccctctagtgaaggtgtcttctagcacgggcgaaatcttcacgactagtaacagaatcgaccgagagaaactgtgcgcaggtgcatcatatgccgaagagaacgagtgtttctttgagctagaagtcgtgattctgccgaacgactttttcagattaattaagatcaagatcatcgttaaagatacaaatgacaacgcgccgatgttcccctcccccgttattaatatcagcatccctgaaaacaccctgattaactctaggttccctatcccctcggccaccgatcctgacactggatttaacggggtgcagcactatgagctgttgaacgggcagagtgtcttcggtctggatattgtcgagacccccgaaggagaaaaatggccccaacttatcgttcaacagaatctggacagggagcaaaaggacacatatgtgatgaaaatcaaggtggaggatggcgggaccccacagaaaagtagcactgccatcttgcaggtgaccgtttctgatgtcaacgacaacaggcctgtctttaaggaaggccaggtagaggtacacatcccggaaaacgcccctgtgggcacatccgtgatccagttgcacgcaacagatgccgatatcgggtcaaatgcagagattcgctatatcttcggagctcaggtggcccccgccactaagcgcctgtttgctttaaacaatacgactggccttataacggtccaacgtagtttggatagggaagagactgccatacataaggtcactgtgctcgcttccgacggaagttccacaccggcccgcgccacagttacaataaatgttacagatgtgaatgacaatccaccgaatatcgacctccggtacattatatccccaatcaatggaactgtatacctgtctgagaaggaccctgttaataccaagattgccctcatcacagtgtctgacaaagataccgacgttaatggaaaagtgatttgtttcatagaaagagaagtgccttttcacctaaaagctgtgtacgacaatcagtacttgcttgaaaccagtagccttctggattatgaaggaacgaaggagttctcttttaaaatcgtggccagcgacagcggcaagccttccctgaaccaaacagcacttgttcgggtgaaactcgaggacgagaacgataatcccccgatctttaatcaacccgttattgagctctccgtctctgagaataatcgccgtggcctgtatttgaccacaatctcagcaaccgatgaggacagcggaaaaaacgccgacattgtgtaccaactaggaccaaatgccagcttcttcgacctcgacaggaagactggcgttcttaccgcctcccgcgtttttgatcgagaggagcaagaacggttcatttttacagtcaccgctagggacaatgggactcctccactccagtcgcaggcggccgtgattgttacagtcctggacgagaacgacaactcacctaagttcacacataaccactttcagttctttgtgagcgaaaaccttccgaaatatagtaccgtcggggtgatcacagtcaccgacgccgacgcgggtgaaaataaggcagtgaccctgagcattttaaacgacaatgataacttcgttcttgacccgtatagtggtgtgatcaaatctaacgtgtccttcgatcgtgaacagcagtctagctacacatttgatgttaaggctactgatggcgggcagcccccacgtagttcaaccgctaaggtgaccataaacgtgatggatgtcaatgacaactccccagtggtcatcagtcccccatccaataccagtttcaagctggttcccttaagcgccatcccaggaagcgtggtggccgaggttttcgctgtagacgttgatacagggatgaacgcggagctgaagtacacgattgtatccgggaataataagggtctgtttcggatcgatccagtgaccgggaacataactctggaggaaaagccagccccaacggacgtgggactacaccgtcttgttgtgaacatctctgatcttgggtatcccaagtcactgcatacactcgtcctcgtgttcctgtatgtaaatgatacagctggtaacgcatcatacatatatgacctgatccgccgcaccatggagacaccacttgatcgaaacatcggggattcttcacagccataccaaaacgaggattacctaacaattatgattgccatcatcgcaggcgctatggtagtgattgtggttatcttcgtgacagtgttggtgcgctgtcgccacgccagtcggttcaaggcggcccagaggagtaaacagggggccgagtggatgagtccaaatcaggaaaataaacagaacaaaaaaaagaagcggaagaagcggaagagcccgaagtcttcacttctcaactttgttaccatcgaggagagcaagccggacgacgcggtgcacgaacctattaacggtacaatcagtcttccagcagagttggaggagcaatccatcggccgttttgactgggggccagctcctcccactacattcaagccaaacagtccagacctggccaagcattacaaaagcgcctcccctcagccagcattccatctgaagcctgacaccccagtctctgtaaaaaagcatcatgtgatacaagaactccctctggacaatacattcgtcggagggtgcgatactctctctaagcgctccagcacctcatctgaccatttttccgcttccgagtgttcttctcaaggaggatttaaaacaaaaggacctctgcacacaagacaatctcaaaggcgggtaacatttcacctgcctgacggttctcaggaatcatgcagtgacagtgggctgggcgaccacgagccagtaggttctggtactcttatttctcatcctttacccctggtccagccacaggatgagttttacgaccaggcatctccagacaaaaggaccgaagctgacggtaactcagatcccaattccgatgggccacttggaccgcgcggactagccgaggcaaccgagatgtgtactcaagaatgcctcgtgctggggcattcggataattgctggatgcccccagggcttggcccatatcaacaccctaaatctccattgtccacctttgcaccccagaaggagtgggtgaaaaaagataagcttgtcaacggacatactttaaccagagcctggaaggaggactcgaacaggaaccagttcaacgataggaaacaatacggatccaacgagggccactttaacaacgggtcacacatgacagacatacctctggctaacttgaagtcctacaaacaggcaggaggcgcaaccgagtcacccaaggagcatcaattgtag

SEQ ID NO: 131090 - DNA, 3714 bp, Artificial Sequence
  Description of Artificial Sequence: Synthetic coding sequence
atggacctccgggatttttacctgctggccgctctcatcgcgtgtctgaggctagattccgctatcgcccaagagctgatctatacaatccgtgaagaactgcctgagaatgtccctattggaaatatccctaaggacctgaacatatcacatatcaacgcggctaccggtacgagtgccagtcttgtgtatagactggtgtccaaagctggggacgctcccctggtaaaggtttcctctagcaccggtgagatctttacaaccagcaaccggattgacagagagaaattatgtgcaggagccagctacgctgaggagaacgagtgcttcttcgagctcgaagtagtcatcctgccaaacgacttctttcggctaattaaaataaaaatcatcgtgaaggatacaaatgataacgctcccatgtttccaagccctgttataaacatcagcattccagagaataccctaatcaattctagattccctatcccttctgctaccgacccagataccgggtttaacggagtacaacactacgaactcctgaacggacagagcgtgttcggcctagatatcgtagagacccccgagggggagaaatggccacagctgattgtccaacaaaatttagatagagagcaaaaagacacttatgtaatgaagattaaagttgaagatggtgggaccccacagaaatcatccacagccattttgcaggtcactgtgtctgacgtgaacgataacagacccgtctttaaagaaggacaagtcgaggtgcatatcccagagaatgcccccgttggaaccagcgttatccagttgcacgcaacagatgcagacatcgggtccaatgctgaaattcgctatatcttcggggcacaggtggccccagcaactaaaaggctgttcgccctcaataacactactggactcattacagtgcagagaagcctagaccgcgaggagacagccattcataaggtaacagtgctcgcctctgatggtagcagcactccagcccgtgctacggtcaccatcaatgtgaccgacgtcaacgataatccccctaacattgacttacgttatataatctctcctattaacggcaccgtgtatctttctgaaaaagatcccgtgaatactaagatcgctcttatcactgtgtccgataaagacacagatgtcaatggcaaagtaatttgcttcatcgagcgcgaagtgccattccatctaaaagccgtatacgataatcaatacctgcttgagacatcatcactgctggattatgagggaaccaaagagttcagcttcaaaattgtcgcttcagatagtgggaaaccatcactgaaccagaccgccctggtgcgcgtaaagttagaagacgagaatgataaccctcccatatttaaccagcccgtgatcgagctgagtgtgagtgaaaacaatcgacgggggctgtatttgaccactatcagcgccaccgacgaggatagtggaaaaaatgcggatatcgtataccagcttggcccaaatgcaagctttttcgatcttgaccgaaaaacaggtgtgttgacagctagcagggtgttcgatcgggaagagcaagaacgcttcatattcaccgtaacagccagggataatggcacaccccccctccagtctcaggccgccgtgatagtgactgttttggatgaaaatgataatagccccaaatttacccacaaccacttccagttttttgtatccgagaatttacccaagtattctacagtgggtgtcataaccgtcaccgatgccgacgccggagagaacaaggccgtcaccctgtcaattctgaacgataacgataactttgtgctggacccttacagcggcgtcatcaagtccaacgtttctttcgacagagagcaacagtccagttatacattcgacgtgaaggcaaccgacggaggccagcccccccggagttctactgccaaagtaacaattaacgtaatggacgtcaacgataattcaccagtagtcatcagccctccgagtaatacatccttcaaactggtccccttatccgctattcctggaagtgtcgtggccgaagtgttcgcggttgacgttgacacaggcatgaatgctgaactgaagtacaccattgtgtctggtaataacaagggcctcttcaggatcgaccccgttaccggaaacatcacattagaggaaaagcctgcaccaacggatgttggcctgcatcgacttgtggtcaatatcagtgacctcggttaccccaagtctctgcacaccctggttttagtcttcctttatgtaaacgacacggccggaaatgcctcatacatctatgatttgatccgccggacaatggagacccccctggatcgaaatatcggcgatagctcgcaaccttatcagaacgaagactatttgaccataatgatcgccatcatcgcaggagccatggttgtcatcgtggtcatttttgtgaccgtattggtgcggtgccgccacgcatccagattcaaagctgcacagagatctaaacagggggcggagtggatgtctcctaatcaggagaataaacagaacaagaaaaagaagaggaagaagagaaaaagccctaaatcttcccttttgaacttcgtgacaatagaagaatccaaacccgacgatgccgtccacgagcccattaatgggacaatttctttgccagccgagttggaagaacaatctattggtcggtttgactgggggcctgcaccaccaaccaccttcaaaccaaactccccagacctggccaagcattacaaaagcgcctccccacaacccgccttccatttgaagcctgacacacctgtgtcagttaaaaaacatcatgtcatccaggagctccccctggataatacctttgtgggcggctgcgacacactgtctaaaagaagttcgaccagctctgatcacttcagcgctagcgaatgctctagtcaggggggttttaaaactaaggggcctcttcatacacgacagtgtaacagccactccaaaagcgacaacatacctgttacgcctcagaagtgcccgagcagtacggggtttcatatccaagagaatgaagaatcccactacgaaagtcagcggagggtgacattccatctcccagatggtagccaggaaagctgcagtgactctggactgggcgaccacgaacctgtgggctcaggcactcttataagccacccattgcccctcgtccagcctcaggatgagttttatgatcaagcttcccccgataagcggaccgaagccgacggaaattccgatcccaattcagatggccctctaggacctcgtggactggcagaggccaccgagatgtgtactcaggaatgcttagtcctgggacatagcgacaactgctggatgcctccaggcctgggaccataccagcatcccaagagtccgctgtccaccttcgctcctcaaaaggaatgggtcaagaaagataaactcgttaacggtcataccctgactagggcctggaaagaagactcaaatagaaaccagttcaacgaccgaaagcagtacggctcgaacgagggccatttcaacaacggaagccacatgaccgatatccccctggccaatcttaaatcgtataagcaagccggaggggccaccgagtcccccaaggagcatcagttatag

SEQ ID NO: 131091 - DNA, 2424 bp, Artificial Sequence
  Description of Artificial Sequence: Synthetic coding sequence
atggtattttccaggcggggtgggctgggcgcacgagatctcttactgtggctgcttcttcttgctgcatgggaggttggatccggccaactacactactccatcccagaggaagcgaagcacgggacattcgtgggtcgcgttgcccaagatcttggcctggaattggctgaattggtcccacgactattccgggtggcctcgaagacccaccgcgatctactcgaggttaatctccagaacggcatcctgtttgttaacagtcgaatcgaccgggaggagctgtgccagtggtctgccgaatgcagtatccaccttgagctgatcgctgatagacctttgcaggtgtttcacgtcgaggtaaaagttaaagacataaacgataacccccctgtttttcgaggccgcgagcaaatcatcttcattcccgaaagcagactcctcaattcacgatttcccattgagggcgcggctgacgcagacatcggcgccaacgctctattaacatacaccctctcccccagcgattattttagcctagatgtcgaggcctctgatgaactgagcaagagcctgtggctggaactgagaaaatacttagatcgggaagaaaccccggagcttcacctcctgctgacagccactgatgggggaaaacccgaattacaggggaccgtggagctcttgataactgtgctggatgtgaacgataatgcacctttgtttgatcaagcagtctaccgggtgcacttgctcgagaccaccgcaaatggcaccttggtaacaactctgaatgcttctgatgcggacgagggcgttaacggagaggtcgtcttctctttcgattcaggcatctctagagatatacaggaaaaatttaaagtcgattcgtccagcggcgagatcagactcattgacaaactcgattatgaggagacaaagtcctatgaaattcaagtgaaggccgtcgacaaaggttccccacctatgagcaatcactgcaaagtgctagtcaaggttctcgatgtgaatgacaacgctcctgagctggccgtaacttccctttacctccccatcagggaggatgctcccctctcaaccgtcatcgccctgatcaccgtgtccgatcgagactccggcgccaacggacaggtgacatgtagtctgatgcctcatgtgccgtttaagctggtgagtacatttaagaattattactctctagtgctcgacagcgccctcgatcgcgagtcattaagtgtctacgaacttgtggttacggctagagacggcgggagtccatcgctttgggccactgcacgggtctcggtggaagttgctgacgtcaacgataacgctccagccttcgcacagcctgagtacacagtttttgtaaaggagaacaaccctccgggatgccacatattcaccgtcagcgctcgcgacgctgacgctcaggagaatgccctggtttcttacagcctggtggaaagacgagttggggagcgcgccctgtcgaactacgtgtccgttcacgcagaaagtgggaaggtgtatgctctgcaacctctagaccatgaggagctggaactgctccagtttcaggtatcagcgagagatgctggggttccccccctgggcagtaacgttacactgcaggttttcgttctggatgagaacgataatgctcctgctctgcttgcacccagggtcggaggaacaattggagctgtgtccgagcttgtgcctcgcctcgtgggcgcgggccacgtcgtagctaaggtccgagccgtggatgccgatagcggatataatgcctggctctcatacgagctacagcccgcggcaggtggggctaggatccccttccgcgtgggtctatatactggggagatttccaccacacgcgttctagacgaggcggatctgtctcgctatcgactcttggtactggtgaaggaccacggcgagcctgccttgaccgccacagcaactgtgttggtgagtctggtggaatctggccaagcccccaaagcctcttccagggcttctgtgggggtagccggccccgaagcggcactggttgatgttaacgtgtacctgatcatagccatctgcgcggtctcgtcactcctggtcctcacactcttgctctacactgcactgagatgcagtgtgccccctactgagggtgcgtacgttccaggtaaacccaccctggtttgttcgtctgcacttggctcatggagcaatagccagcagcggcgacaacgcgtgtgcagttctgaaggaccacctaagacagatctgatggccttctcccccggtctaagtcccagcctgaatacttccgaacgtaacgaacaaccggaggctaaccttgatctcagcgggaatgtctctcctactttcgagttttggctatag

SEQ ID NO: 131092 - DNA, 2061 bp, Artificial Sequence
  Description of Artificial Sequence: Synthetic coding sequence
atggtgtttagccggaggggagggttaggcgctcgagatctgctgctatggcttctgctgttggccgcatgggaggtgggcagcggccagctccactactccataccagaagaagcaaaacatggaaccttcgtaggacgagtggctcaggatttagggttagagctggctgaactggtaccgcgactattccgagtagcaagcaagacgcacagagacctcctcgaggttaacttgcagaacgggatcttattcgtaaactcgcgtattgaccgcgaggagctgtgccagtggtccgccgagtgtagcattcacctggagctcatcgcagataggccgcttcaagtatttcacgtggaggttaaagtaaaagacataaatgataatccccctgtgtttcggggcagagagcaaattatttttataccggaatcgcgactgttaaattcacgcttccccatcgaaggcgctgccgacgctgacattggtgccaatgcactgcttacatacacactctccccatccgattattttagtctagatgttgaagcgtcggacgagttatccaagagcctgtggctggaactccggaaatacctggatcgagaggaaacacctgaactccacctgctactcaccgccacagacggcggcaagcccgaactgcagggaactgtcgagctgttgatcactgtactggacgtgaatgacaacgctcctttattcgaccaggccgtataccgcgtgcacctgcttgaaaccacagcgaacggtactcttgtgacgactctcaacgcgtcagatgccgatgagggggtgaatggagaggtagtgttctcctttgattccggcattagtcgggacattcaggagaagtttaaagtcgatagtagcagcggtgagatccggcttatcgacaaactggactacgaggaaaccaagagctacgagatccaagtcaaagccgtcgataagggcagcccacctatgtccaaccactgcaaggtgcttgtcaaggtcctcgatgttaacgacaatgcccccgaattggcagtgacctccttatatttgccaatccgagaggatgcccccctgtcgaccgtcatagcacttatcacggtaagcgatagggacagcggcgctaatggccaggtcacctgcagtctgatgccacacgtgccattcaaactcgtaagcacctttaagaattactactctttggtgctggactccgccctggaccgagaatcactctccgtgtacgaattggtggtgacagcccgagacgggggatctccgagcttgtgggcaacggcaagggtatccgttgaagtggccgatgtgaacgacaatgctcccgcattcgcccaacccgaatataccgtttttgtgaaggaaaacaacccacctggatgccacatcttcactgttagtgcgagagacgccgacgcgcaggaaaatgccttagtatcctactccttggtggagcgccgggtgggcgaacgggcactgtccaactatgtgagcgttcacgccgaaagcgggaaggtttatgccttacagcctcttgaccacgaggaactcgaacttctgcaatttcaaccgagacaaccaaacccagactggcggtattccgccagcttgagggctggaatgcactcctcggtgcatctcgaagaagcggggattcttcgagcaggaccaggtggacccgaccagcagtggcccactgtctctagtgctactcccgaaccagaggcgggagaggtgagccctcccgttggagccggtgtgaatagcaattcttggacctttaagtacggacccggcaacccaaagcagtccggccccggagagctccccgataagtttattattccggggtcgccggcgatcattagtattcgccaggaaccaaccaacagccagatagacaaatccgacttcatcactttcgggaagaaggaggaaacaaaaaagaagaagaagaagaaaaaggggaataaaacccaggaaaaaaaagaaaaaggcaatagcactacagacaactccgaccagtag

SEQ ID NO: 131093 - DNA, 2853 bp, Artificial Sequence
  Description of Artificial Sequence: Synthetic coding sequence
atggttttttcaaggagaggcggtctgggcgcgagagacctgctcctttggttgctgctgctggcagcgtgggaggtcggatccgggcagctccattatagcattcctgaggaggccaaacatggtaccttcgtgggtagggtcgcccaggacttaggtctagaactcgccgaacttgtgccccgcctctttcgcgttgcgagcaagacccaccgagaccttttggaggttaacctacagaacggaattctcttcgtgaactctcggattgatcgtgaagagctatgtcaatggtctgcagaatgcagtattcatttggagctaatcgctgacaggcccctccaagtcttccatgtggaagttaaggtcaaagacatcaatgacaatccgcctgtgtttcggggaagagaacagatcattttcataccggagagcagactgcttaactcccgctttcccattgaaggcgcagccgatgcagacatcggggcaaatgcactgctaacgtacacactgagcccatctgactatttttctttggacgtagaagcatcagacgagctgtccaagagtttatggctggaactgcggaaatatctggacagggaggaaacaccagagctacatcttctgctcacggccactgatggaggaaaaccagagctgcaggggacagtggaactcctgataactgttctagacgttaatgacaatgctcccctgtttgaccaggcagtctatagggttcatcttttggagaccacagccaacggaacgctcgtgacaacactcaatgcaagtgacgcagacgagggagtaaatggtgaggtggtcttctcatttgactcagggattagccgggacatccaagaaaagtttaaggtcgattcttcatccggagagatccggctcatcgacaagctggattatgaagagaccaaatcctatgaaatacaagtcaaggccgtggataagggctcgccaccaatgtctaaccactgtaaggttctggtgaaggtcctggatgtgaacgacaatgctcctgagctggcagtaacctcattatatttgcctataagagaagatgcacccttaagcaccgtaattgcacttattactgtgagcgatcgcgacagcggcgctaatggacaggtcacctgcagtctcatgcctcacgtcccctttaagctcgtgagtacatttaaaaattactacagcttggtcctggattcagcgcttgaccgcgagtctctgagcgtctacgagctcgtggtgaccgcccgggacggcgggagccctagcctgtgggccaccgccagagtgagtgtcgaagtggctgatgtcaatgacaacgctccagccttcgcgcaacctgaatataccgtatttgtgaaagaaaacaacccacctggatgccacatctttacagtatcggcgagagatgctgacgctcaggagaacgcactagtctcctactcccttgtggagaggagggttggtgagagggctctatctaactacgtatccgttcacgctgaatctggcaaggtttatgcattacagcccctagatcacgaagagcttgagctgctgcaattccaggtgtctgcaagggacgcaggtgtgcccccgctgggatccaacgtcaccctgcaagtgttcgtcctggatgagaatgacaatgcccccgctctgttggcccctagggtgggtggtaccatcggtgcagtctcagagctcgtgccccgattggttggtgctggtcacgtagtcgctaaagtccgtgccgtcgacgccgacagtgggtacaatgcgtggctcagttatgagctacagccggctgcaggtggggcgcggatcccattccgggtcggtctctatactggggagatctccaccactcgggtgctcgacgaagcagacctgtcaagataccgacttctcgtcctggtgaaagatcatggtgaacccgccctgacagcgactgctactgtcttagtcagccttgttgaaagtggccaagctccgaaagcatccagtcgggccagcgtcggagtcgcaggccctgaggcagctttggtggatgtgaacgtttacttgatcatagcgatctgcgctgtctcctcgctgctggtcctcacccttttactctataccgctctgaggtgctccgtccctcctacagagggcgcctacgtgcccggcaaaccaaccctggtctgttcctccgcactcggaagttggtcgaacagccaacagaggcggcagcgcgtgtgctccagcgagggtccccctaagaccgatcttatggccttctctcctggcctgtctccttcattaaacactagcgaaagaaacgagcaacccgaggctaacctggatctctcagggaacccccggcaacctaatccagactggcgctatagcgcgtctttgcgcgctggaatgcacagctccgtacacctggaagaagccggtatactaagagctggccctggaggccctgatcagcaatggccgacggtttcaagcgcgactccagaaccagaggccggcgaagtgtcaccacctgtcggagctggggtgaacagcaattcatggaccttcaaatatggcccgggaaatcccaagcagagcggacccggggagttacctgataaatttattatcccaggatccccagcaatcatctctatccgccaggaaccgacaaatagtcagatcgacaaaagcgattttattaccttcggcaagaaggaggagacaaaaaagaagaaaaaaaagaagaaaggcaataagacccaggaaaaaaaggagaagggtaattccactaccgataatagcgaccaatag

SEQ ID NO: 131094 - DNA, 2847 bp, Artificial Sequence
  Description of Artificial Sequence: Synthetic coding sequence
atggtttctcgctgtagttgcttgggagtacagtgtttgctcctctccctgctcctgctggctgcttgggaggtgggaagcggccagctgcactatagcgtatatgaggaagcccggcacggcaccttcgtaggtcggatcgctcaggatctgggtctagagttggcagagctggtgcagcgattatttagggtggcctctaaaagacatggagacctgctcgaagtgaacctgcaaaacggaatcctgttcgtgaatagcaggattgatagggaagaattgtgcggacggtccgtggagtgcagtatacatctggaggtgatcgttgacagacccctgcaggttttccatgtggacgttgaagtgaaagatataaatgacaaccccccccggttttctgtgaccgaacagaagttatcaataccagaatctcgacttctggactcgcgctttcccctggagggagcttctgacgcagacgtcggagagaatgcgcttctcacctataaactgtcaccgaatgagtactttgtgctcgatataatcaacaagaaggacaaggataagttccctgtgcttgtcctcagaaagctgctggatcgagaagaaaaccctcaactaaaattgctgttaaccgccacagatggcggaaaacccgaatttacaggttcagtttcccttctgatattagtgctggatgcaaatgacaacgctccaatttttgaccgacccgtgtacgaggtgaagatgtacgagaaccaggtgaatcagacattagtgatcaggctaaatgcttccgattctgacgaagggatcaacaaggagatgatgtactccttcagcagcctagtgccaccgactatcagacgaaaattttggattaacgagaggaccggggagatcaaagttaacgacgctattgattttgaagacagcaatacatatgaaattcatgttgatgtgacagacaagggaaatcctcctatggtcggccactgcacggtgctagtggagcttctggatgaaaacgataattccccggaagtcatcgtcacaagcttgtccctgcccgtgaaggaagacgcacaggttggaacagtgattgcattgatttctgtgtccgatcacgatagcggggccaacgggcaggtcacttgctccttgacacctcatgtgccctttaagcttgtgtccacttacaaaaactactatagcctggtcttggacagcgccctggatagagagagggtttccgcctatgagcttgttgtgaccgctagagatggaggctctccccctctatgggctacagcctcagtatcagtcgaagtggctgacgtgaacgataacgccccagctttcgcacagtctgagtacacagtatttgtaaaagaaaacaaccccccaggatgtcacatctttaccgtttccgcctgggatgcagacgcacaggaaaacgctctggtgagttattctctagtggaacggcgactaggcgaacgttctttatctagctacgtgtcggtccacgccgaatctggcaaggtgtacgctctccagcctttagatcacgaagaactggagctcctgcagttccaggtttccgctagagacggtggcgtcccaccactaggaagcaacctgacactgcaggtgttcgtgctggatgagaatgataatgcccccgccttactcgctagtccagcaggatcagcaggaggggccgtatcagaactggtccttcgatccgtggtcgccgggcacgtggttgccaaggtccgtgccgttgatgcggactcaggctacaatgcttggctctcgtatgaactccaatccgcagctgtcggagcgagaattcctttccgcgtgggtctatatacaggcgaaattagtacgacgcgggctctggacgagacggacagtccaaggcagcgcttgttggtattggtcaaagatcatggagagccctcacttacggcaacagccactgtgctcgtcagtctggttgagggctcacaggcacccaaggcttcctctagagcgagtgtgggcgtagcccccgaagttgctttagtggacgtgaatgtctatctcatcatcgcaatctgcgccgtttcttccttactggtcctcactcttttattgtacaccgctctgcgatgctccgccgccccaaccgagggggcctgtggcccagtcaagcccaccctggtgtgtagcagcgcagtcgggagctggtcgtattcccagcagcggcgacagcgtgtttgcagcggagaagggctgcctaaggccgacctaatggctttctccccgtctttgcctccttgtccaatggtagacgtggacggggaggaccagagcatcggaggagatcattctcggaagcctcggcagcctaaccctgattggcgctactcagcttccttaagagccggcatgcactcttcagtgcacctcgaggaggccggcatcctgagggcaggccccggcgggccagatcagcagtggcccaccgtgagcagtgccacacccgagcccgaagccggcgaggtgtccccccccgtgggagccggtgtgaattctaatagctggaccttcaaatatggtccgggaaatcccaagcagagcggaccgggagagcttcccgacaagttcataattccgggaagtcctgccataatctcaattcgccaggagccaacgaactcgcagatcgacaagagtgatttcatcacattcggaaaaaaagaggagactaagaagaaaaagaagaaaaaaaaggggaacaagacacaggaaaagaaggagaaaggtaacagcacgacagacaatagcgatcaatag

SEQ ID NO: 131095 - DNA, 2058 bp, Artificial Sequence
  Description of Artificial Sequence: Synthetic coding sequence
atggttagccgttgtagttgtctgggtgtccagtgtctgctgctctctctcttgctgctggccgcatgggaagtgggaagcggccagctccactacagtgtgtacgaggaagcgaggcatgggacattcgtgggaaggattgcacaggatctcggcctcgaactagctgaactggtgcaacgcctgttcagagtggcaagcaagcggcatggggaccttctcgaggttaatctgcagaatggtattctgttcgtgaattctagaatcgatcgagaggaactgtgtggccgttctgtggagtgcagcattcatctcgaggtgatcgtggatcggcctttgcaggtgttccacgtcgatgtggaagtcaaagacatcaacgacaaccctcccaggttttcagtaactgagcaaaagttatctatccccgagtcaaggctgctagatagtagattcccacttgagggtgcttccgatgccgatgttggagaaaacgccctgctaacatataagctctctcctaatgagtatttcgtgctcgatattatcaataaaaaggacaaagacaagttccctgtgctggtgcttcgaaaacttttggacagagaagagaacccacaactgaaacttctcttgaccgcaaccgatggcgggaagccagagttcacaggatctgtgtcactgctgatcttggtgctcgatgccaacgacaacgcacctatctttgacagacccgtctatgaggtgaagatgtacgagaaccaagttaaccagacactggtgatacggctgaatgccagcgatagcgacgagggcatcaacaaggaaatgatgtattctttttcttctctcgtacccccgaccataaggcggaaattttggattaacgagagaacaggcgagatcaaggtcaatgacgccatcgatttcgaggactccaatacctatgagattcatgtcgatgtaactgacaagggaaacccgcccatggtgggccattgtacagtcctagtcgagctgctcgacgagaatgacaactctccagaagtaattgtcaccagtctgtctttgccagttaaggaagatgcccaggtaggtaccgttatagccctgatctctgtctctgaccacgactcgggagctaacggtcaggtgacttgtagtctgacacctcacgtgccgtttaaactggtttcaacgtacaagaattactactctctagtgttagatagcgccctcgatcgcgagagggtgtctgcgtatgagcttgtcgtgactgcacgggacggaggctccccaccgctgtgggccacagcctcagtaagcgtggaggtggccgacgtgaatgacaacgccccggccttcgctcaatcggagtacacagttttcgtgaaagaaaacaatcctcctggctgtcacatttttaccgtgagtgcttgggacgccgatgcacaggagaatgccctggtgtcctattctctcgtggaaaggcggctcggggagagatcacttagtagttacgtgtctgtgcacgcggaaagcggaaaagtctacgctttgcagcccctggatcacgaggagcttgagctgctccaattccagccgaggcagccaaacccagattggcggtactcggcttcattacgcgcaggcatgcatagcagcgtgcatctcgaggaggctgggattctgcgcgccggccccgggggaccagatcagcaatggcccaccgtgagctcagccactcctgagccagaggcaggggaggtcagtcctcctgtgggcgcaggagtaaacagcaatagctggacatttaagtatggacctggaaacccgaaacagagtggcccgggagaactgcctgacaaatttataatccctgggtctccagccataatctcaatacggcaggagccgactaattcacagatagacaaatcagacttcattacgtttggaaagaaagaagagacaaagaaaaagaagaaaaagaaaaaggggaacaaaacccaggaaaagaaagagaagggcaactctactaccgataactccgaccagtag

SEQ ID NO: 131096 - DNA, 2850 bp, Artificial Sequence
  Description of Artificial Sequence: Synthetic coding sequence
atgttcggattccagcggagaggactgggaacacctcgtctgcagttatggctgctccttctcgaattttgggaggttggaagcggccagctgcattattcagtgagcgaggaagccaagcatggcaccttcgtaggaagaatcgcccaagacctcggactggaattagcagagctggttcagcgtttattccgagtggcatctaagacacatggtgatctgttggaggtgaacctgcagaatgggattttgtttgtcaacagtcggatcgatcgcgaggagctttgcggacagtccgcagagtgtagtattcatttggaagtgatcgtcgataggcccttgcaagtttttcacgttaatgtcgaggtcaaagatatcaacgacaaccctcccgtgttttctctacgggaacagaaactgttaattgctgaatccaagcagtccgactcaagatttccactggagggagcttctgacgccgatatcgaggagaatgccctgctcacttataggctatcaaagaacgaatacttttcattagacagcccgaccaatggaaagcaaattaagcgattatcactgatcctgaaaaaatcacttgaccgggaaaaaacccccgagcttaacctactactgaccgcaacggatgggggaaagccagaactgactgggactgtgagactgctcgttcaggtcctagacgtcaacgacaatgatccggagttcgacaaaagcgagtacaaggtctcactcatggagaacgccgctaaggagacccttgtgctgaaattgaatgccacagatagagacgagggggttaacggagaggtcacatactctctgatgtctattaaaccgaacggaaggcacctgttcacattagatcaaaataacggggaggtgcgggtgaatggtactctagactacgaggagaataagttttataagattgaggtacaagctaccgataagggaaccccccccatggcgggacattgtactgtgtgggtggaaatactcgacactaacgataactcccctgaggtcgccgtgaccagccttagcttgcccgtcagagaggatgcgcagccatctactgttatagccctcatatcggtgagtgatagggactcaggcgtgaatggccaggtcacctgctccttgactccgcatgtgcccttcaagctcgtctctaccttcaagaattactattcgctagtattagatagcgccctggatagagaaaatgtctgggcctacgagttggtagttacagccagagatggcgggagtccgagcctgtgggcaactgcccgggtgagtgtcgaggtggccgacgtaaatgacaatgctccagcatttgctcagccagaatacactgtctttgtcaaagagaacaatccacctggttgccatatattcacagtgtcggctcgagacgctgacgctcaggaaaatgccctggtttcttattccctggtggaaagacggctaggcgatcgggctctcagttcatatgttagcgtgcacgccgagtccggaaaggtctatgccctgcagcccctcgaccatgaggaattagagcttctgcagtttcaagtgtctgcgcgagatgccggagtgcccccattatcctccaacgtgactctgcaggtttttgtactcgatgaaaatgataatgctcctgccttattggccacacaggctgggtctgctgggggagccgtcaacaagctggtgccccgcagcgtgggggctggccatgtcgtggccaaagttcgagccgtggatgcagacagcgggtataacgcctggctgagctacgagctacagccagcagcaggcggatcaagaattccgtttcgggtgggattgtatacaggcgagatatccacgacccgcgctctagatgaggcggatagcccccgtcacagactgctggtgctggttaaagaccacggtgagcccgccctcacagcgactgcaaccgtgttggtcagcctagtggaaagcggacaagcgccgaaggcatcctcccggaccctagccggcgccgcaagccctgaagctgcattggttgacgtgaacgtgtatttgatcattgccatctgcgtcgtcagctcgctgctggtgctcaccctgttgctgtatactgcactgtggtggtcagcaactccaacagagggagcttgcgctccagggaaaccaactctcgtctgtagtcgagctgtgggctcttggtcttactctcagcagcgccgccagcgggtgtgcagcgaggaggggccgcctaaaacagacctcatggccttttctcctagcttgcccttggggctgaataaggaagaggagggcgaacggcaagaacctggctctaatcacccaggccaacctcgccagccgaacccagactggcgatattcggctagcttgagagctggaatgcactctagcgtgcatctcgaggaagcaggcatccttagggcagggccagggggccctgaccaacagtggccaaccgtgtctagcgccactccagagcctgaagcaggagaggtgtccccacccgtgggcgcaggggtgaactcgaactcatggacttttaaatatggccctggaaaccccaagcagagtggacccggcgaactgcctgataagttcattattcccggatcccctgctatcatatcaattcggcaggagccaacaaactcccagatagacaaatccgattttattacattcggaaagaaagaggagaccaaaaagaaaaagaagaaaaagaagggcaataagactcaagagaaaaaagagaagggtaactccacgacggacaactccgaccagtag

SEQ ID NO: 131097 - DNA, 2826 bp, Artificial Sequence
  Description of Artificial Sequence: Synthetic coding sequence
atggtaatcatcggcccccggggacccggcagtcaacgccttttgctgtctttgcttctgctggccgcatgggaggtgggttcaggccagctgcattactctgtgtatgaggaggcgaagcatggaacctttgtgggaagaattgcacaggaccttggattggagctggccgaactggtcccacgtctgttccgcgtcgcctctaaacggcacggtgatctgttggaagtgaacctacaaaatggcatcctgtttgtgaactctagaattgatagagaaaaattgtgtggccgaagcgctgagtgttctatccacttggaggtgatcgtggatcgccctttacaggtttttcacgtcgatgtggaagtcaaggatattaacgacaaccctcccgtttttagggagagagaacaaaaggtgcccgtaagtgagtcagcacctctggacagccatttcccactggaaggcgccagtgacgcagatatcggtgtaaacagtctgctcacttatgccctatccctaaatgagaacttcgagctaaaaataaagacgaagaaggataaatctatcctccctgaattagtgctccggaaattgctggatcgagaacagacacctaaactgaatctgcttctgatggtcattgacggaggcaaaccagagctgactggatccgtgcagatacagatcacggtgcttgatgttaacgacaacgggccagcattcgacaaaccctcctataaagtggttctcagtgagaatgtgcagaacgataccagagtcattcagctgaatgcttcagacccagacgagggtctgaacggagagatttcttacggaatcaaaatgattctgcctgtgtcagaaaagtgtatgttttctattaaccctgacactggcgaaatacgcatctacggtgagttggatttcgaagagaacaacgcatacgaaatccaggtgaatgcaatagataaaggcattccctcaatggccgggcattccatggttcttgtggaggttcttgacgtgaacgacaacgtgcccgaggtcatggtcacatccttgtcactcccagtacaagaagacgcccaggtggggaccgtgatagcactcataagtgtctcggatcgcgactccggtgcaaacggacaggtgatatgcagccttacaccccatgtcccgtttaagttggtgtcgacatataagaactactattcactggtgttagattccgccctggatcgagagtcggtgtccgcttatgaactggtggtcaccgcccgtgatggtggcagcccttcactatgggccaccgctcgggtctctgtggaggttgccgacgtgaatgataacgctcccgcatttgcacagccggagtacaccgtatttgttaaggagaataatcccccaggctgccacatcttcacagttagcgcttgggatgcagatgcccagaaaaatgccttagtatcttacagtcttgtggaaaggagggtgggggaacatgccctcagttcttacgtttctgttcacgccgagagcggcaaagtttatgcgctccaaccattggaccacgaggagctcgagctgctgcagtttcaggtttccgcccgcgacgctggggttccccctctcggcagcaacgttaccctgcaggtctttgtgttggacgagaacgacaacgctcccgccctcttagctactcccgcaggaagcgccgggggcgccgtgtcagaacttgtcccacggagtgtgggcgcaggccacgtcgtggctaaggttagagcggtggacgccgacagcgggtacaatgcctggttgagctatgaacttcagccagccgctgttggcgcacatattccctttcatgtcggcctgtacaccggcgagatcagcaccacgaggatcttagacgaagccgatgctcctagacatcggctgctagtcctagtgaaagaccacggcgagcccgcactgacatccaccgctactgtactcgtatctctggtggaaaatggccaggcacccaaaacttcctctagggcatcggtcggcgccgttgacccggaggctgctttggtagacatcaatgtttatctgatcatcgcaatttgtgctgtgtcttctctgctggtacttacactgctgctctataccgccctccgctgcagtgcaccacccacagtttctcgttgtgctccaggcaaacccacactggtgtgcagctccgctgtgggttcctggtcctactcgcagcagagacggcagagagtttgttctgcagaaagtccaccaaaaacagaccttatggctttttctccctccctgcaactttctagagaagactgtctgaatcccccttcagaaccacggcagcccaatcccgactggagatatagcgcaagtctcagggcgggcatgcacagctcagtgcacttggaagaagccggcattctgagggccggcccaggcggacccgaccagcagtggccgaccgtaagcagtgcaacccccgagcccgaagccggcgaggtgtcgcctcccgttggtgcgggagtgaacagtaacagttggaccttcaagtacggtcccgggaaccccaagcagagcggccccggggagctcccagacaagttcattattcctggtagtccggccatcatctcaattagacaggagcccacaaactcgcagatcgacaagtcagatttcataacattcgggaaaaaagaggagacaaagaaaaaaaaaaaaaagaagaagggaaataaaacccaggagaaaaaggagaaaggcaactcaactacagataactccgaccaatag

SEQ ID NO: 131098 - DNA, 2853 bp, Artificial Sequence
  Description of Artificial Sequence: Synthetic coding sequence
atgctgtcctcatggcaggggggcccaagaccccgtcaattactattgtggctcctgatcctggcagcctgggagactggttcaggacagctgcattacagcgtgcctgaagaagcaaagcacggcacttttgtggggaggatagcccaggacctgggtctcgagctggctgaacttgttccaaggctgtttagggtggctagcaaaaggcatggggaccttcttgaggtgaatctgcagaacggaatcctgtttgtaaactcgcgtatcgatcgggaggaactgtgcggtcggtcagctgaatgttctatccacctggaggtaatagtggacagaccccttcaggtttttcatgtagaggtcaaagtgcgtgacatcaatgataacccccctatattcccagagagtaagaagagaatcattatcgcagagagtagaccacccgaaacgcggtttcccctggatggggcatccgacgctgacatcggggtgaatagtgctttgacttacagactggatcctaatgactacttcacgttggatgctcagaacagtctggagcaaatgagcagcctcagcctagtactacgaaagaccttagaccgagaggaaatccaagagcattctctgcttctgacagcttcagacggcggaaaacctgagctcactggcactgtccaactgcttatcaccattttggatgtaaatgacaatgctcctgagttttatcagtctgtctataaagtgacagtgcttgaaaacgccttcaatggcacgctcgttataaaactgaatgccaccgacccagacgacggcacaaacggtgacatagtctactcattcagaagaccggtatggcccgccgttgtctacgccttcactataaaccccaacaatggagagattagaactaaaggcaaactggactttgaggagaaaaagctgtacgagataagtgtggaggccgtcgacaaggggaatattcctatggcaggccattgcacgctgcttgtggaggtgctagatgtcaacgataatgcgcctgaagtgaccatcacttctctctccctgccgatcagagaggatacccagccctcagcaatcattgcactaatttccgtctcggacagagattctggttctaatgggcaggtgacctgcacgctaacgcctcacgttccctttaagctggtgtcgacctataaaaactactatagcttggtcctggacagtgcgctagatagggaaagcgtgtccgcctacgaactagtggtcactgctagagacggaggctccccttcgctatgggccaccgcctcggtgtcagtgggcgtcgctgatgtcaacgataacgctcccgccttcgcccaacccgaatacactgtatttgtgaaggaaaataatccaccgggctgccatattttcacagtgagtgcgcaagatgccgatgcccaagaaaatgccctggtcagctactcgttagtggaacgacgggttggagagagagccttgagttcctatgtcagcgttcatgctgagagtggaaaagtgtacgccctccagccgctggatcacgaggagctggaattgctgcagtttcaggtgtctgcacgcgacagcggtgtgcccccattgggatccaacgtaacactccaggtgttcgtgttggatgagaacgacaatgccccagcattactcacacctggcgccggaagcgccgggggaacagtttccgagctgatgccccgatcagtaggtgctggccacgtcgttgctaaggtgagggctgtggacgcagacagcggctacaacgcatggttaagttacgagttacagctcgccgcggtgggggctcggatccccttccgagtgggcctttataccggcgagatttccactacacgacctctcgatgaggtggacgccccgcaccatcggctgctagtcctcgttaaggaccatggagagcccgccctgacagctactgcgactgtcttgctaagtctggttgagtcaggccaagctccacaggcttcttccagagccagtgctggtgccgtgggtcctgaggccgctttagtggacgtaaatgtatacctgattatagcaatctgcgccgtatctagtctgctcgttcttacgctgctgttatacactgcgctccggtgttctgcaccgcccaccgagggcgcttgtgctcctgggaaaccaactctggtttgctcctcagccgcgggttcatggtcttattcacaacagcgacgaccaagggtgtgttcaggtgagggaccccacaagacagacctcatggccttcagcccaagcctcccaccgtgtctgggaagcgctgaggggactggacaaagagaggaggactccgagtgtctgaaagagcccagacaaccaaacccagactggcgctattccgccagtctccgggctgggatgcattcatctgtgcatcttgaggaggcgggaattcttcgcgctgggcccggggggcctgaccagcaatggccgaccgtgagcagcgctacacccgagcccgaagctggggaagtgagtccccccgtgggagccggtgtgaactcaaattcatggaccttcaagtatggacccgggaatcccaagcagtcaggccctggagagttgcctgataagttcattattccaggcagccccgctatcatatccatccggcaagagcctactaattctcagattgataaatctgactttattacattcggaaaaaaagaggagacaaaaaagaagaaaaagaaaaagaaaggcaataaaacccaagaaaaaaaagagaagggaaatagcactacagacaacagcgaccagtag

SEQ ID NO: 131099 - DNA, 2715 bp, Artificial Sequence
  Description of Artificial Sequence: Synthetic coding sequence
atgcttagtagttggcagggaggacctcgtcctcgtcagctgttgctgtggctgctcattttagctgcctgggagacaggcagcggccagctacactattccgttcccgaggaggctaaacacggaacgttcgtcggcaggatagcacaagatcttggcctagagctcgccgagcttgtcccgaggttgtttagggtggcctccaagaggcacggggacctcctcgaggtgaatctacaaaatggcatcctgtttgttaatagtcgcatcgatcgcgaagaactgtgtggacgctcagcagagtgtagtatccatctggaagtgatcgttgaccggccactgcaggtcttccacgtggaagtgaaagtccgagatatcaatgataatcctcccatctttccagagtcaaagaaaaggattatcattgccgagagcaggcccccggaaactcgcttccctctcgatggcgcaagcgatgccgacatcggggtgaacagcgcccttacctacaggttggaccccaacgactactttacgctcgacgctcagaacagcctggaacagatgagcagcctgtctctcgtattgagaaaaacactggacagagaggagatccaagaacatagcttgctgctgaccgcttcagatgggggcaagccagaactcacaggaactgtacagctgctgattaccatcctggatgtgaacgataacgcaccagagttctaccagtccgtctataaagtcacagttctcgaaaacgccttcaacgggactttagtaattaagctcaacgcaactgaccctgatgacggcaccaatggcgacatcgtgtacagtttccgaaggccagtctggccggccgttgtctatgctttcactattaaccccaacaatggggaaatcagaaccaagggaaagttggattttgaggaaaagaaactatacgaaatttctgtcgaagctgtcgacaagggcaacattcctatggcaggtcattgtaccctgttggtcgaagtgctggatgtgaatgacaatgcccccgaagtgactatcacaagtcttagcttgccgatccgcgaggatacccagccttcggcaattatcgctcttatctctgttagcgaccgggacagcggcagcaatgggcaggttacatgtacactcacaccacatgtcccttttaaactggtatcaacatataaaaactactattcgttggtgctggattccgccctggatagagagtcagtgtccgcatatgagctagttgtcacggctcgggacggcgggagccccagtctatgggcaaccgccagtgtcagcgtcggggtggctgacgtcaacgacaacgccccggccttcgcccaacctgagtatactgtcttcgtgaaggagaataatccccctggctgccacattttcaccgtgagcgcccaggatgccgacgcccaggaaaacgctcttgtgagctacagtttagtggagcgaagagtgggtgagcgggccctgtctagttacgtcagcgtgcacgcagaaagtggcaaagtatacgccctgcagccgctggaccatgaagagctggaactcctgcagtttcaagtaagcgccagagatagcggcgtaccgcctctgggtagcaacgtcacactccaagttttcgtcctagatgagaatgacaatgctccagcgttgctcactccaggtgcgggcagtgcaggcggtacagtgtcggagctgatgccaagaagtgtcggtgcggggcatgtggttgctaaggtccgcgcagtcgacgcggacagtggttacaacgcatggcttagctatgaactccagcttgccgcagttggggctaggattcccttccgggtgggtctttacacaggtgagatttccactacacgacccctcgacgaagtcgatgcccctcaccaccggctcttggtcctcgtgaaagaccatggggagcctgccctcacagcgaccgctaccgttctcctgtctttagtggagtctggccaagcaccgcaggcttccagccgtgcatccgccggcgctgtcggtcccgaagccgcattggtggacgtgaacgtgtacttgataatagctatttgcgccgtgtcaagcctgcttgtgctgaccctgctcctgtacactgccctccgatgcagcgccccaccaactgagggtgcatgtgcaccaggcaagcctaccttggtctgttcgagcgcggccggctcttggtcgtacagtcagcagcgccgacctagagtatgctctggggaggggcctcacaaaactgacctcatggcattcagcccttccctcccaccctgcctgggatctgccgaaggaacaggacaacgcgaagaagactctgagtgtttgaaggagcctcgtcagcctaaccccgactggaggtacagtgcaagcctgagggcagggatgcactccagtgtgcacttagaggaggctggcatcctgagagcgggaccgggtggacctgatcagcagtggcccactgtcagctcggccactcccgagccagaggcaggagaggtcagccctcccgtgggcgcaggtgttaactccaacagctggacttttaaatacggtcctgggaacccgaaacagtcaggacccgagcccaagaaacagacccaagtgtctttcctgcttaggcggaagggcgaagcgtctcaacctagacaatag

SEQ ID NO: 131100 - DNA, 2475 bp, Artificial Sequence
  Description of Artificial Sequence: Synthetic coding sequence
atggctagtagcattcggagggggcggggggcctggacacggctgctctctttgctccttttagcggcctgggaggtgggaagtggccagcttcggtactcagtgcccgaagaagccaagcacggtacgttcgtgggcagaattgcacaggacctcggattggagttggaagagctcgtgcctcgcttgtttagagtggctagcaagaggcacggagatttgttggaggtgaatctccaaaacggcattctgttcgtgaacagccgcatcgatcgtgaagaattatgcggcaggagcgccgaatgctctatccatgtagaggtaatagtcgacaggccactgcaggtcttccacgtggaggtcgaagttaaagatatcaatgataaccctcctatatttcccatgacagtcaaaaccattagatttcccgaaagtcggctgttggacagccgattccctctggagggagcctcggatgccgacatcggagtaaatgctctgcttagctacaagcttagcagttccgaatttttcttccttgatatccaagccaacgatgagttgagcgagagcttgagtctagtgctgggaaagtctctcgatcgggaggaaactgcagaagtgaatctactgctggtggcaactgacggcggtaagcctgaattgactggtacggtgcaaattctgattaaggtgttggacgtcaatgacaatgaaccaacgtttgcacagagtgtttacaaggtgaagcttttggagaatactgcaaacggaaccctggtcgtaaaactgaatgcttccgatgcggacgaaggccccaacagcgagatagtttattccctgggtagcgacgtgtcaagtaccattcagaccaagttcactatcgaccccatctcaggggagattaggaccaaagggaagctcgattacgaggaggccaagtcttacgaaatccaggttaccgctactgacaaaggaactccttccatgagcggtcattgcaagatttccctcaagctggtggatattaacgataatactcctgaagtgtcaataacgtcactgagtctgcccatcagtgagaacgcttccttaggtaccgttatagctcttattactgtgagcgacagagatagcggcacaaatggacacgtcacttgtagccttacccctcacgttccattcaaactggtctccactttcaaaaattattactctctggtgctggactccgccctcgaccgtgaatcggtgagcgcatacgagttggtggtgaccgctcgagacggaggcagcccttcgctctgggcaaccacatccgtctcaattgaggtggcagatgtgaatgataacgcacctgcattcgcccagcccgagtatacagtattcgtcaaggagaataaccctcctggatgccacattttcactgtatccgcgtgggatgcagacgctcaggagaatgctctcgtgtcatattctctggttgaacgccgagtgggagagagagccttgtctagctacgtgtcagttcacgccgaatcaggcaaagtatacgccctccagccactggatcatgaggaagttgagctgttgcagtttcaggtctccgcaagagacgcaggagtgccacccctagggtcaaacgtgactctgcaggtttttgtcctggacgagaatgataacgctcccgcccttctggcacccagagcaggaactgctgcaggcgccgtatcagagctggtcccctggtcagtcggtgccggacatgttgtggcgaaggtccgggccgtggacgcagactcaggctacaatgcttggctgtcatacgagttgcaattgggaacagggagtgcaaggattccttttagagtgggcctgtatacgggggagatctccacgactagggccttagacgaggcagactccccacgccaccgtttgttagtgttggtcaaagatcacggagaaccagcgctcacagctacagcaaccgttctggtcagtctggtagagagcgggcaggcccctaaggcgagctcaagggcatgggttggggccgcagggtccgaggctacactggtggacgtgaatgtgtatctgataattgcaatctgcgccgtgtcgtccctactagttctgaccgtgctgctttacaccgcgctgaggtgttctgtgccgcctacagagggcgccagagcgcccggtaagccgacactggtgtgttcctcagccgtgggcagctggtcctacagtcagcagaggcgacagcgcgtctgttcgggggaagatccgcctaagacagatctgatggcattctccccttctctgagtcaggggcctgatagtgctgaggagaagcagctgtccgagagcgaatacgttggcaaagtctcactactcctgtttctcgccaatagtaaaatcgtgttatttaagaagttctacatgatatcgacctcatacctggattcctag

SEQ ID NO: 131101 - DNA, 2847 bp, Artificial Sequence
  Description of Artificial Sequence: Synthetic coding sequence
atggctagcagtatccgccgaggaagaggcgcttggacaagactccttagcctgcttttgctggccgcctgggaagtgggctctggccagctgagatacagtgtgcccgaagaagccaaacacggaacctttgtaggacgcatagcacaagacctcggcctggagctggaggaactggtgcctagactgttccgcgtggcatctaaacgccatggtgatctcctggaggtcaacctgcaaaatggcatcctcttcgtcaacagcagaatcgaccgcgaggagctgtgtggacgatctgccgagtgcagtattcatgtagaggtgatcgtggaccgccccctgcaagtatttcacgtggaagtcgaagtgaaggatattaacgataatccacccatttttccgatgacagtaaaaacaattagattcccagagtcgcgcctcctggatagccgcttccctctggaaggcgcttccgatgccgatattggggtaaacgcactgctgtcttataaattgtctagcagcgagttttttttcttggatatacaggcgaacgatgaacttagtgagagtctgtcactggtgcttggcaagtctctggatcgagaggaaactgccgaagtgaacctcctactggtggctactgatggcggaaagcctgaattaacaggcactgttcagatcctgatcaaggtcctggacgtaaacgacaatgagcctacctttgcacagtccgtgtacaaggtaaagttgctcgagaacaccgccaatggcacacttgtggtaaaactaaacgcctccgacgcggatgaggggccaaattctgagattgtgtactctctggggagcgacgtatccagcaccatacagaccaagttcaccatcgaccccatctctggcgaaatcaggactaagggaaagctcgactatgaggaagccaagtcctacgaaattcaagtgactgccactgataagggcaccccctctatgtctggacattgcaaaataagcctaaagcttgttgatattaacgataacacaccagaagtatctattacttccctgagtctcccaattagcgagaatgcttctcttgggacagtgattgcgcttatcactgtttcggaccgggacagcggtaccaacggccacgttacatgttctctgactccacatgttcccttcaagcttgtgagcaccttcaaaaactattatagcttggtgcttgactccgccctggacagggagtccgtctccgcatatgaattggtcgtcaccgctagagacggcgggtcaccctctctctgggcaaccacatctgtatcaatcgaagtggctgacgtgaatgacaacgcacccgcctttgcacagcccgagtacacggtcttcgtgaaggagaataaccctcccggttgtcatatcttcactgtcagtgcatgggacgcggatgcccaggaaaacgctttggtttcttactccctggtcgagagaagagtcggcgagagggccctgagttcatatgtttcagtacacgccgaatccggaaaggtctacgcccttcagccgctggaccacgaagaggtagagcttttacagtttcaagttagcgcgcgggatgccggggttccgcccttgggcagtaatgtcaccttgcaagtcttcgtccttgatgagaatgacaatgcccccgcgctacttgctcctcgggctgggacggccgctggagcggtttctgaactggtgccatggtcagttggggcaggccacgtggttgctaaagtgagggccgtcgacgccgactcgggatacaatgcctggttgagttacgagttacaactggggactggctctgcccgcataccctttagagttggtctgtataccggcgagatttccacaactcgggcgcttgatgaagccgatagcccccggcacaggctgctcgtactcgtgaaggaccacggagaaccggcacttaccgccacggcaacagtactggttagtttggtggaaagcggccaggcgcctaaagctagcagccgggcctgggtcggggctgctgggagcgaggccactctcgtggatgtgaacgtgtacctcatcatcgccatttgtgctgtgtcctcactgctggtgttaacagtcctactttacacagccctaagatgtagtgtgcctccaaccgagggggcccgagctccagggaagcctaccctcgtgtgtagcagtgccgtggggtcatggtcttatagccagcaacgccggcagagggtttgttctggagaggacccccctaagacagacctgatggcgttcagtccatccctgtcccaggggcccgactctgccgaggaaaagcagctgtcagagtccgagtatgtggggaaaccaagacagcccaatcctgactggcgatactccgcatctcttcgcgctggaatgcactcctcagtgcatttagaggaagccggaatcctgagagccggccccggggggcctgaccagcagtggcctaccgtttcctccgcgacaccggaaccagaagcaggtgaagtgagccccccggtgggtgctggagttaacagcaactcctggacatttaagtacgggcccggcaaccccaagcagtctggacctggagagttgcccgacaaatttattataccaggatcacctgctatcatctcaatcaggcaagagcccacaaattcacagatcgataagtccgatttcattaccttcgggaaaaaagaagagactaagaagaaaaagaaaaaaaagaagggcaataagacgcaagaaaagaaagagaagggaaactccaccactgacaactcagatcagtag

SEQ ID NO: 131102 - DNA, 2853 bp, Artificial Sequence
  Description of Artificial Sequence: Synthetic coding sequence
atgctgttctcatggcgcgaagaccccggggctcaatgtctgttactgtccctgctcctcctggccgcctccgaggtcgggagtggccagttacactactcggtaagtgaggaagctaaacacggtacctttgttgggcggatcgcacaagaccttgggcttgagctggctgaactcgtgcctcgattatttagagtggcatcgaaacgtcacggcgacctcctggaggtgaacttacagaacggcatcttgtttgtgaattcacgcattgacagggaagaactctgcggccggagcgcagagtgctccatacacttggaggtgattgttgaccgacccttgcaggtgttccacgttgaagtcgaagtaaaagatattaatgacaatgcacctgtgtttcctatggctgtgaagaatctgttcatttccgaatcacgccagcccggaagccgattttccctggaaggcgcttccgacgccgacatcgggacaaatagcttactgacttactccttagatagtactgagtactttactttggatgtaaaacgcaatgacgaggagatcaagtcactggggctggtcctgaagaagaacctcaacagggaggatactccaaagcactacctgctaattacagcgatcgacggagggaaacccgagttaaccggaaccacccaactgaaaatcaccgtgctcgatgtaaatgataatgcccctgctttcgagcgcacaatttataaagtcaggctgttagagaacgctccaaacggtactcttgtggttacagttaacgccactgacctagacgagggggtgaataaggacatcgcctacagttttaacacagatatgagcgccgatatcctcagtaagtttcacctcgatcctgtcaacggccagatatcggtgaagggaaatatcgacttcgaggaatcgaagtcctatgagatacaggtggaagccacagataaaggcaacccccccatgtctgaccactgcacagtcctactcgagatcgttgacattaatgacaacgtacccgagctggtgattcagtcgttgtcgttgcctgtcctggaggattctccgctttccaccgtaatcgcactgatctccgtgtcagacagagattcaggagtgaacgggcaggtgacatgctctctcaccccacacgtgccattcaagctagtctcaacatttaaaaattactattcacttgtgctggatagccccctggatcgggagagcgtttctgcatatgagctggtggtgaccgctcgggacggcggttcccccagcctgtgggctaccgccagtgtgagtgtggaggtagctgacgtgaatgacaacgcccccgccttctcacagtcagaatatactgtctttgttaaagaaaacaatccccccggatgtcatatctttaccgtgagcgcccgggatgcagatgcccaggagaatgcactggtctcctacagccttgtggagaggcgggtgggagagagggcactcagttcctatgtctcggtgcacgcagagagtgggaaagtgtatgccctgcagccgctcgaccacgaggaactggaactcttgcaattccaggtgtctgcccgcgatgcaggcgtgccaccgctcgggagtaacgttactttacaagtgtttgtcctggacgagaatgataacgctcctgccctgctgatgccaagagtgggcggaattggaggcgccgtttcagagcttgttcctcgcagtgttggggcgggccacgtcgtcgccaaagttagagcagtagatgcggactctggttacaatgcctggttgtcctacgagctccagcctggaacagggggcgcccggattccctttcgcgtagggttgtataccggggaaataagcacaacaagggccctggatgaggttgacgctcctcgacatagattgctggtgctggttaaagaccacggggagccaagtctcacagccacagctactgtgctggtgagcctggttgaatccggccaggctccaaaggcatcaagtcaagcatcagcgggtgccaccggtccagaagctgcacttgtggacgtgaatgtctatttaattgtggccatctgtgctgtgtcttctttgctcgtgctgaccctgctgctctatacggctctgcgctgctcagctccccccacagagggtgattgtggccccggcaagccaaccctggtgtgttcaagcgccgtgggctcctggtcctattcccagcaacgccagcagcgggtctgcagcggcgaaggcctgccaaaaaccgacctcatggccttctcgccttcgctgccaccctgccccatatcacgggaccgcgaggagaagcaggacgttgacgttgacttgtcggccaagccacggcaaccaaatcctgattggcgctacagcgcctccctgagagcaggaatgcattcctctgtacatttggaggaggccggaattctacgtgccggccccggggggccggaccagcagtggcctaccgtgtcatctgccacacctgaacccgaggcaggtgaagtctctccccctgtgggcgcaggcgtgaattctaactcatggaccttcaagtacggacccgggaaccctaagcagagcggccctggcgagctgcccgacaagttcattattccaggcagtccagccatcatttctattcggcaagagcccaccaattcccagatcgataagagcgattttatcacttttggtaagaaggaggaaactaaaaaaaagaagaaaaaaaagaaaggaaataaaacccaggagaaaaaagagaaggggaatagtactaccgataacagcgaccagtag

SEQ ID NO: 131103 - DNA, 2475 bp, Artificial Sequence
  Description of Artificial Sequence: Synthetic coding sequence
atgctgttttcctggcgggaagaccccggggctcagtgtctgttgttgagccttttgctgctggctgctagtgaagtgggaagcggccaactgcactacagcgtcagcgaagaggctaaacatggtacgttcgtggggcggatcgctcaggatctgggcctggagctggcagaactggtgcctcgtctgttccgcgtggcctcaaagcgccacggtgatctcctggaagtgaatctgcagaacgggatcctatttgtgaattcaagaatcgatcgcgaagagctttgtggtaggagcgccgaatgcagcatccatctggaggtgattgtggaccgcccactgcaagtgtttcatgtggaagttgaggtgaaagacattaacgacaatgcaccagtttttcctatggctgtgaagaatctgttcatctctgagagccgccagccagggtcgagattctccctggagggggccagtgacgccgacatcggaacgaatagccttctgacatattctctggactcaactgaatatttcaccctggacgtaaaacgaaatgacgaggagatcaaatccctggggctggtcctgaaaaagaacctgaatcgggaggatactccaaagcattacttgctgatcacggccatcgatggggggaagcccgaacttactggtaccacccagcttaagattacggtgttggacgtcaatgataacgcccctgcattcgaacgcacgatctataaggtacgcctcttggagaacgcgccaaacggaaccctggtcgttacggtcaacgccacggatctcgatgaaggggtgaacaaagacatcgcttacagtttcaacacagatatgtctgccgacatactgtccaagtttcaccttgaccctgtgaacggacagatctccgtgaaaggcaacatcgattttgaagagagtaaaagttacgaaattcaggtggaggctacagataagggcaacccccctatgtcggaccactgtactgtgctgctcgaaattgtcgatatcaacgacaatgtacccgagctggtcattcagtctctatccctcccagtcctggaagacagcccactgagcactgtcattgccctgattagtgtcagtgatcgggacagcggggtaaatgggcaggttacctgctctttaaccccacatgttccattcaaactggtgtcaactttcaagaactattatagtctcgttctggactcgccactggatcgggagtccgtatcagcttacgagctagtcgtgaccgcccgcgatgggggctctcccagcctgtgggccacggcctcggtgtccgtggaagtggcagacgtgaatgacaacgcaccggccttttcccagagtgaatataccgtattcgtgaaagagaacaaccccccggggtgtcacatattcaccgtctctgctagagatgcagatgctcaagaaaacgcgctggtgagctatagccttgttgagcgtcgagtgggcgaaagggccctgtctagctatgttagcgtacatgccgaaagcgggaaggtgtacgcactccagccgcttgaccacgaggaactggaactcctgcagtttcaagtcagtgcccgcgacgccggggtgcccccactgggctccaacgtgaccctccaggtgttcgtactggatgaaaacgacaacgcccctgcactgttgatgccccgggtgggtggaattgggggagccgtctcagaattagtgccacggtccgtcggggcgggacacgtggtggctaaagtccgggccgtggatgccgactcgggctacaatgcatggctgtcctatgaactgcaacccggaactgggggggctcgaataccttttagggtggggctgtacaccggcgagatttctacaactcgagccctcgatgaggtggatgctccaagacaccgtctcctggtcttagtaaaggaccacggagaacccagcctgacagcgactgcaaccgtgctggtgtctctggtcgaatccggccaggcacccaaggcatcaagccaggcctctgctggggcgaccggacccgaagccgccctggtagatgtcaatgtttatctgattgtagctatttgcgccgtgagcagccttcttgttttgacattactgctgtacaccgctctgcgttgtagcgcccccccaacagagggcgactgtggccctggaaagcccacgctggtctgcagtagcgcagtcggttcttggtcctattctcagcagagacagcagagagtgtgctccggcgaaggtcttcccaaaactgacctgatggcttttagcccctcccttccaccttgtcctattagtcgtgacagagaggagaaacaagatgtggatgtggacttatcagccaaggtgtcaaatttttatctgtttttcccaaagtgcctgtgttttagttttctcaacgtctcaacccctctggaaatacactag

SEQ ID NO: 131104 - DNA, 2451 bp, Artificial Sequence
  Description of Artificial Sequence: Synthetic coding sequence
atggtgtattcgagaagaggaagcctcggcagcaggctcctcttactctggttgcttttggcctactggaaagccggcagcggtcaactccactacagcatacccgaagaggctaagcacggaactttcgtcggccggatagcccaggacctgggactggaactggccgagttagttccaaggctgttcagggtcgcatccaaaggaagaggtgatctgcttgaggtcaacctccagaatgggatcctgttcgtgaacagccgtatcgacagagaggagctgtgtagaagacgcgctgagtgctctatccacctcgaagtaattgtggatcgaccactgcaggtcttccacgtcgaggtggccgtgaaggacatcaacgacaacccccccagattctctcggcaggagcagcggttattcatcctggaaagccgcatgcccgattccaggttcccgctggagggcgctagcgaccttgatatcggagcaaacgctcagctaagataccgcctcaatcccaatgagtatttcgacctggatgtgaaaaccaacgaagaggagacaaattttctggagctggtccttcgaaaatcgttagaccgcgaagagacacaggagcatcgattgttggtgattgcgactgacggcgggaagccagagctcaccggaactgttcagcttttgataaacgtgctcgacgcaaatgacaacgcaccagagtttgataagtccatttacaatgtgcgtctcctcgagaacgcgccctctgggaccctggttataaaactgaacgcttccgacgctgatgagggtatcaacaaagagattgtgtatttctttagtaatctggtcctagacgacgttaagtccaagttcattattaatagcaacactggagagatcaaagtgaacggggaactggattatgaggactacaactcatacgaaattaacatcgatgccatggataagtcgaccttcccgctgtccggccactgcaaagtggttgtcaaacttctggacgtaaatgataatacccccgaaatggccattaccaccttattcctcccagtgaaggaagacgcccccctttcaaccgtcatcgccctgatctctgtttctgaccgcgactcaggagccaatggtcaggtgacctgcagcctaatgccacacgtgccgtttaagctcgtctccacatttaagaactactactccctggtgctagactccgccctggatcgggaaagtgttagcgtgtatgagctcgtggtgactgcccgcgacggaggctcgccgagcctctgggccactgccagcgtttccgttgaggtagccgatgtgaatgacaatgccccagctttcgcacaaccccagtacaccgtgttcgtgaaggagaataacccacctggctgccacattttcactgtgtcggccagggatgctgatgcccaagagaatgccctcgtatcatatagcctcgtcgagcgccgcgtgggcgaacgcccattgagctcatatgtgtcagtccacgcagagagcggcaaagtttatgccctccaacccctggaccacgaagaggtagaactgctacagttccaggtatccgcaagggatgcaggcgtaccaccccttgggtccaacgtaacactccaggtatttgtcctcgatgagaacgataacgctcctgcactactggttcctcgcgtaggtggaaccgggggagcagttagcgaactcgtgcctagaagcgttggcgctggacatgttgtcgctaaagtccgtgcagtcgatccagactctggctataatgcttggctgtcatatgagctgcagccagcaccaggttcggcgaggatcccgttccgcgtagggctctacaccggagaaatatccacaacccgatcgttagacgaaaccgaggccccacgccataggctcctggtcctggtcaaagaccatggcgaacctcctctcacagcgaccgccacggtgcttgtcagcctggtggagagtggtcaagctcccaaggcttcaagtcgggcatccgccggcgccgtcggccccgaggcagccctcgtggacgttaatgtgtatttaattattgccatctgcgcagtttctagtctgctcgtgcttacgctgctcctctatacggctctgcgatgtagcgctcagcccaccgaagctgtctgcaccaggggcaagcccactctcctgtgtagctccgcagtgggcagctggtcttattcacaacaacggagacagagagtatgtagcggcgaggcgccacccaagactgatcttatggcctttagcccttccctgccgcaaggaccaacttcgacagataatgtgagctttctgattctgacgagcatttttccgtcacagtttagcaacatcaagtgtcacattcaccccttgttcctgtatcttaagatcatgagctag

SEQ ID NO: 131105 - DNA, 2673 bp, Artificial Sequence
  Description of Artificial Sequence: Synthetic coding sequence
atggtgtattcacggcggggatctctgggttcccggctcctcctcttgtggctgctgttggcttattggaaggcaggctccggccagctacactactcaatcccagaggaagccaagcatggcacattcgtcgggcgcatcgcccaagacctggggctggagctcgcagagcttgtgcctcgactgtttagagtcgccagcaagggcaggggggatctgcttgaagtaaatctccagaatggcatcctgtttgtgaacagccgaatcgaccgcgaagagttgtgccgtcggcgtgccgagtgttccattcatttggaggtcatagtggaccggccccttcaagtctttcacgtggaggtcgcagtaaaggatattaatgataaccccccccggttcagtcggcaggagcagaggctgtttatactggaaagtcgaatgcctgactcgagattcccactggagggtgcttccgacctggatattggagcaaacgctcaattgcggtacaggctaaatccgaatgaatattttgacctcgacgttaaaaccaatgaggaggagaccaatttcctcgaattggtccttcgcaaatctctggacagggaggaaacccaggagcaccgcttactggtgatcgccacagatggcggcaagccggagttgaccggaaccgttcagctgcttattaacgtgttagacgcaaacgacaacgcccctgagtttgataaaagcatctataacgttaggttactggaaaacgccccctcggggacactggtgattaagctgaacgcctctgacgcagacgaaggaatcaacaaggagatcgtttattttttctctaatctggtcttggatgacgtcaagtccaaattcatcattaatagcaatacgggcgagatcaaggttaatggtgagctcgattacgaagactataacagctatgaaattaacattgatgccatggacaagagcacattccccttgtccggccattgcaaggtggtcgtgaaattgctggacgtgaatgacaatacgcctgaaatggccatcacaaccctgttcctgcctgtgaaggaggacgccccactctcaaccgtgattgcacttatttcggtgagcgaccgcgatagcggcgccaatgggcaggtgacttgttcgctgatgccacacgtgccattcaaactggtgtctacattcaagaactactattctctggtgctggatagtgcacttgacagagaaagcgtgagcgtgtacgagctagtagttaccgcccgggacggcggcagcccaagcctttgggcaacagcatctgtgtctgtcgaggtggctgacgtgaacgataatgctccagcattcgcgcagccgcagtatacggtgttcgttaaggagaacaaccctcccggctgtcacattttcacagtgtctgcgcgggacgccgatgcgcaggaaaacgcccttgtctcctattcactggtggaaagacgcgttggtgagcgccccctgtccagttacgtgagtgttcacgcagagagcggaaaggtatacgctctgcagccacttgatcatgaggaggtagagcttcttcaatttcaggtttcagctcgggacgcaggtgttccccctctgggctccaacgtgacactccaggtatttgtactggacgaaaatgataacgccccagctctgcttgtaccccgcgttggggggactggcggcgccgtcagtgaacttgttccacgcagcgtgggcgccgggcacgtagtggcgaaagtgagggctgtggatccagattcaggatacaatgcctggttaagctacgagcttcagcctgcacctgggagcgcacgaattccattccgggttggcctgtacaccggcgagatctccacgacaagaagcttggatgagactgaggccccccggcatagactgctggttttggttaaagaccatggagagccgcccctcaccgccactgccactgttctggtatccctggtggagtccggccaggcgcccaaggcgtctagcagggccagtgccggcgcggtgggacccgaggccgcgctggtggacgtgaacgtctatctcatcattgctatttgtgccgtcagctcactgctcgtgctgactctcctactgtatactgccctgagatgctcggcacagccgacggaagcagtgtgcacacgaggaaaacccaccctgctgtgcagctccgccgtgggatcttggagttacagccagcagcgacgacagcgggtgtgttccggcgaagccccgcccaaaaccgacctcatggctttctctccctcactcccccagggaccaacttctacagacaacccacgccagcctaaccctgactggagatattccgcgtctctaagagccggcatgcactcaagtgttcacctcgaggaagcagggatcctgcgggcaggaccaggaggacctgatcaacagtggccaaccgtgtctagcgctaccccagagccagaggccggcgaagtaagcccaccagttggagccggtgtaaactctaactcatggacattcaaatacggaccaggtaaccctaagcagagtggacccgaacctaaaaagcagacgcaggtgtcattcttgttgcgacgcaaaggagaagcgtctcaacctaggcagtag

SEQ ID NO: 131106 - DNA, 2811 bp, Artificial Sequence
  Description of Artificial Sequence: Synthetic coding sequence
atggtctactctagaaggggatctctgggatcgcgattattactactttggctgctgctggcctactggaaggctggctccggccagcttcactattcaattcctgaagaggctaagcatgggactttcgtcggacgtatcgcccaggaccttggtctggagttggccgagctggtgccccggctattccgcgtggcttcgaaagggagaggagacctcctcgaagtcaaccttcagaacggtatcctgttcgtgaactctagaatagaccgggaagagttatgcaggcgcagggcagagtgcagtatacatctggaggtgatcgtggacaggccacttcaagtgtttcacgtcgaggttgcagtcaaggacatcaatgataatccccccagattcagccgccaggagcagcgcctgtttattctggagtcccggatgcctgatagtcggttcccattggagggtgcttccgatctggacatcggtgccaacgcccagcttcgctatcggctgaaccccaatgaatactttgacctcgatgtgaagactaacgaggaggagacaaatttcttggagctggttctccgtaagagtctagatagagaagagactcaagaacacaggctattggtcattgccactgatggaggtaagcctgaactaactggtaccgtgcaactcttgatcaacgtgctagacgcaaatgataacgccccggagtttgataagagtatttataacgttagactcctggaaaatgcgccctccggcactctggtgataaagctcaatgcctcggatgccgatgagggaattaacaaggaaattgtatacttcttctctaatcttgtgctcgacgacgttaaaagtaagttcatcataaactcgaatacgggggaaattaaggttaacggtgaactcgactacgaagattacaactcctacgagatcaacatagatgcaatggacaagtccacattcccattatctggtcattgcaaagtcgtggtaaaacttctcgacgtaaacgacaacacgcccgagatggccatcaccactctgttcctgcctgtaaaagaggacgccccactctcaacagttatcgctctcatctctgtgagtgacagagattctggtgcaaacgggcaggtcacctgcagccttatgccacatgtgcctttcaagctggtgagtactttcaagaactattacagcctggtccttgattcggctctagaccgagagtcagtgtcggtgtacgagttagtcgtgacggctagagacggaggtagcccaagcctgtgggccactgcctctgtttcagttgaggtggcggacgtaaatgacaatgcccctgcctttgcccagccccagtataccgtttttgtgaaagagaataacccccctggatgccacattttcaccgtgtccgcccgcgacgccgatgctcaggaaaatgccctggtaagttattctctggtggagagaagggtgggggagcgcccccttagctcgtacgtctctgtccacgcggagagcggaaaggtgtatgccctccaacctctggaccacgaagaggttgaattgctgcagtttcaagtttcggcacgggatgcaggagtgcctcccctgggcagcaacgtgaccctgcaggtttttgtgctggatgagaatgacaatgcgcctgccttactagttcccagagtgggaggcaccggaggggctgttagcgaattggtgccacgatctgtcggcgccgggcacgttgtagccaaggtccgtgccgtggaccccgactccggctacaacgcttggttgagctatgaattgcagccagcacccgggagcgcccggattccattccgggtcgggctctataccggggaaattagcactacccggtcgctcgatgagacagaagcacccagacatcgcctcctggtgctggtgaaggaccacggggagccaccactgacagccactgcgaccgttttagtatccctggtggagagtggacaagcccccaaggcctccagcagggcctcagccggagccgttggcccggaggccgcccttgtcgatgtgaatgtttatttaataattgctatctgtgccgtcagtagcttgctggtgctgaccctcctgttatataccgccctgcggtgctctgcccagccgaccgaggcagtgtgtacgaggggcaagcctacactcctatgcagctctgccgtgggatcatggagctatagccagcagcgacggcagcgggtttgtagcggtgaagctcctccaaagactgatctgatggcgtttagcccctcactgccacagggtcccacgagtacagacaatccacggcaacctaaccctgattggagatactctgccagcctccgtgcaggaatgcacagttcagtgcatctcgaagaggcgggcatcctgcgtgccggccccggaggacctgatcagcagtggcccactgtgagctcggccacacccgagcccgaagctggcgaggtgagccctcctgttggcgccggcgtgaacagcaacagctggaccttcaaatacggccctgggaaccccaagcaaagcgggcccggcgagttacctgataagtttatcattcccggcagcccagccattatttctatcaggcaagaaccgactaacagtcaaatcgacaagagcgattttatcaccttcgggaaaaaagaggagacaaaaaaaaagaaaaagaagaagaaggggaacaagacccaggaaaagaaggaaaaaggaaacagcaccaccgacaactctgaccagtag

SEQ ID NO: 131107 - DNA, 2061 bp, Artificial Sequence
  Description of Artificial Sequence: Synthetic coding sequence
atggttttcacccccgaagataggttgggaaagcaatgtctgttgctaccacttctactgctggcagcttggaaagtggggagcggacagcttcactactcagtgcccgaggaggcaaaacatggcacattcgtcggcaggatcgcgcaggatttgggattggaactcgctgaactggtgccccgcttgttccggatggcttctaaagaccgcgaagatcttctggaggtgaatctacagaacggaattctcttcgtgaattctagaatcgatcgggaggagctctgcggtcgttcggccgagtgtagcatccaccttgaggtgatcgtggatagacctctccaggtctttcatgtcgatgtcgaagtgcgggacataaacgataatcccccgttattcccggtagaggaacagcgcgtactcatctacgagtcccgcctccccgatagcgtgtttcctctggaaggtgcatccgatgcagatgtgggatctaattctattctgacctataaattgagctcaagcgagtactttgggcttgacgtgaaaatcaactcggatgataacaaacagattggtctgttgctcaaaaagagcctagaccgggaagaggcccctgcccacaacctctttctgactgccaccgatgggggtaagccggaactgacagggacagtacagctattggtgaccgtgcttgatgtgaacgacaatgcaccaacatttgaacaatccgagtatgaggtgaggatttttgagaatgctgacaacggcactactgtgatcagactaaacgcttctgaccgggacgagggagcaaacggagccatctcttactcattcaattctctggttgcagctatggtcattgatcatttctctatcgacaggaatactggcgagatcgtgattaggggtaaccttgatttcgaacaggagaacctgtacaaaatccttatagacgcaacagacaaagggcatcctcctatggcaggacattgcactgtgctggtaagaatcctggacaagaatgataacgttccagagatagctctcacctcactctcactgccagtgcgcgaagatgctcagttcggcacagtgattgctctcatcagtgttaatgatctggatagcggtgctaacggccaggtgaactgctccttaacgccgcacgtgccattcaaactcgtgtccaccttcaagaattattacagcttggtccttgattctgcactggaccgggaatccgtgagtgcttatgaattggttgttacggcaagggacggtggaagtccctccctgtgggccactgcctcattatctgtggaggtggcagacatgaacgataacgctccagcattcgcccagcccgaatataccgtgttcgtgaaggagaacaatccacccggctgtcatatatttactgtgagtgctcgtgacgccgatgcccaagagaatgcgctggtgtcctatagtttagtggaaagacgcgtgggtgagagagctctgtcatcctatattagtgtgcatgctgaatccggtaaggtatacgcactccagccgctagatcacgaggagctggagctgctgcagttccagccccgtcagccaaaccctgactggcgctattcagcaagcctcagagctggaatgcactcaagcgtccatctggaagaggcgggtatacttagggcaggccctggcggtccagaccaacagtggcctacagtttcaagcgccaccccagaacccgaggctggcgaggtctcccctcctgtgggtgcaggcgtcaatagcaacagttggacattcaaatacggacccgggaatcctaagcaatctggtccaggagaattacctgacaagttcattatccctggcagtcccgccataatctctatcaggcaggagcccacaaatagccagattgataagtcagattttattacatttgggaaaaaggaggagactaagaaaaagaaaaagaaaaagaaaggcaacaaaacccaggaaaagaaggagaaagggaactcaaccacggataactccgaccagtag

SEQ ID NO: 131108 - DNA, 2853 bp, Artificial Sequence
  Description of Artificial Sequence: Synthetic coding sequence
atggtcttcaccccggaggaccgcctgggtaaacagtgtcttttactcccacttcttctcttagcggcgtggaaggtggggagtggccagctgcattacagcgtacctgaagaggcaaagcatgggactttcgtgggccggatcgctcaagatttaggtctggaactcgcagagctggttccacggctctttcgcatggcgagtaaggacagagaagacctgcttgaagtcaatctgcagaacggaatcttgtttgtcaactctcggatagaccgagaggagctgtgtgggaggtcagctgagtgctctatccatctggaggttatcgtcgatcgccctctccaggtttttcatgtagatgtggaggtgagagacatcaacgacaatcccccactctttccagtggaggaacagagggtgctgatctacgagagccgactcccagattccgtctttccacttgagggcgctagcgacgcagatgttggctctaattccatcttaacatataagctgtcttcgtctgaatacttcggcctggacgtcaagataaacagtgatgacaacaagcaaatcggactgctcctcaagaagtcattggaccgcgaggaggccccggcccacaatctattcctcaccgccaccgatggtgggaagccggaattaactggcacagtgcaactgctggtcaccgtcctcgatgtgaacgacaacgctcctacatttgagcaaagcgagtatgaggtcagaatctttgagaacgccgataacggcaccacagtgattcgcctcaatgcctctgatcgcgacgagggggccaatggagccatctcctattcttttaattcactagtcgccgccatggtgattgatcatttctctattgatagaaacacaggtgaaattgtgatcagaggcaaccttgattttgagcaggaaaatttgtataaaatcctcattgacgccacagataaaggccaccctcctatggccggtcactgcaccgtccttgtgcgtatattagataagaatgataacgtacccgaaatcgcgctgacatccttgtctctccccgtccgcgaagacgcccaatttggtaccgttatcgccctgatcagtgtgaacgacttggactcaggagcaaatggacaggttaactgttcgctgactcctcacgtgccattcaaactggtcagcacttttaaaaactattatagtttggtgctggacagtgctctggaccgcgagtctgttagtgcatacgagctcgtggtgacagccagagacggcgggtctccaagcctttgggccacagcttcattgtccgttgaagtggcagacatgaacgataacgcacctgcatttgcacagccagagtacactgtttttgttaaagaaaataacccccccgggtgtcatatcttcaccgtgtcggctcgcgacgccgacgcccaagaaaacgccctggtatcttattctctggtggagcgcagagttggggaacgggctctgagctcctacatttccgtgcacgctgaaagcggaaaagtgtacgcacttcagccccttgaccacgaggaactagagcttctccagttccaggtcagcgccagggatgccggcgtccctccgttaggaagtaacgttactctccaggttttcgtcttggatgagaatgacaatgcccccgccctgcttgccccacgggtcggtggtactggcggggccgtgtctgaactggtaccgaggtcactgggagcaggacaggtcgtggccaaagtgagggcagtcgatgctgactctgggtataatgcatggttaagttatgaactccaacctccagcgagcagcgccaggttcccctttcgggtgggactttacaccggcgaaatcagtactaccagggtgctggatgaagccgactcacctcgtcatcgactccttgtgctggtgaaggatcacggcgaacccgccctgacggccaccgcaactgttttggtgagcctcgtcgaatctggacaagcaccaaaagcatcgtcacgggctagcgttggagcagccgggccagaggcagctctggtggatgttaacgtgtacttgattatagcgatctgtgccgtgtcatctctcctcgtcctgaccctgcttctttacacagctctgcggtgcagcgcgccaccaacggagggggcttgtacagccgacaaacctacgttagtgtgtagttccgccgtgggcagttggtcctactcccagcagcgccggcagcgggtttgcagcggggaagggccccccaagatggaccttatggctttcagtccctctttaagcccatgtccaatcatgatgggcaaggcggagaaccaggatctcaacgaagaccatgatgccaagcccagacaacctaatcccgactggagatactcagcttcactgcgggctggtatgcacagttccgtgcatttggaggaagcaggcattctgagagccggaccaggcgggccagaccaacaatggcctaccgtgagctcagctacaccagagccagaagctggcgaagtgtcccctccagtgggcgcgggggtgaacagcaatagctggaccttcaagtatggacccggtaatccaaaacagtctggccccggggagcttccagacaaattcattattcctggcagccctgcaatcatatctatccgacaggaaccaacgaattctcagatagacaaatctgacttcatcacctttgggaaaaaggaagaaacaaagaagaagaagaagaaaaagaaggggaacaaaacacaggaaaagaaagagaagggcaactccactaccgataattctgatcaatag

SEQ ID NO: 131109 - DNA, 2370 bp, Artificial Sequence
  Description of Artificial Sequence: Synthetic coding sequence
atggtgtgccctaatggctacgatcccggtggcagacacctgctcttatttatcatcattctggccgcttgggaggcagggaggggtcaactgcattatagtgtcccagaggaggcgaaacatggaaactttgtcggaagaatagcccaggacctggggctggaactcgccgagctagtgccgcgcctcttcagagccgtttgcaagttcagaggcgacttgctggaggtcaaccttcagaatggtatcctgttcgttaacagccgcattgatcgggaggaactctgcggcagatcggccgaatgttctatccacctcgaagtaattgtcgaacggcccctacaggtgttccatgttgacgtagaggtaaaggacatcaatgacaacccaccagttttccctgccacccagcgtaacctgtttatcgccgagtcgcggccgctcgacagcagattcccactggaaggagcttccgatgctgacatcggtgaaaatgcactcctgacttacaggttgtccccaaacgagtatttctttctcgacgtgccaacatccaatcagcaggtgaagcccttggggcttgtgctgcgcaagctgctggacagagaggagacacctgaactccacttactcctcacagcgactgacggaggcaagcctgagttgacgggcaccgtccaactgctaattaccgtactggataataacgacaatgccccggtttttgatcggactctgtatactgtaaagttgcccgagaatgtcagtattggcacgcttgtgatccaccccaatgcatctgacttggacgagggtctgaacggcgacattatatacagcttctcttcagacgtgagtcctgacattaagtctaagttccacatggacccactgagcggcgcgattacagtgatcggccatatggactttgaggaatcaagagcccacaagattcccgtcgaagcggttgacaaggggttcccgcccctagcaggccactgtaccgttctggtcgaggtggtggatgttaacgataacgccccacaattaaccttaacatccctcagccttccgatccctgaagacgcccagcccggcacagtgattactctgatcagtgtctttgaccgcgatttcggcgtgaatggtcaagtgacctgcagcctgactccaagggtccccttcaaactggtatcaaccttcaagaattactacagcctggttctggacagcgccctcgacagggagtcggtcagcgcctatgaactggtggttacagcacgggacggtggttctccatccctgtgggccacagccagcgtcagcgtagaagtggccgatgttaacgataacgctcccgccttcgcccaacccgagtataccgttttcgttaaggaaaacaatccccctgggtgtcacatctttaccgtgtccgcaggcgatgccgacgcccagaaaaatgcattagtctcatattctctggtcgaactacgtgtaggagaaagggcactcagttcatacgttagtgtgcatgcggagagcggaaaggtatatgctttacagcccctggaccatgaagaattagagttgttgcagttccaggtctctgcaagggacgccggggtccccccactgggctcgaatgtcaccttgcaggttttcgtgctggacgagaatgacaacgccccggcactgttggcaccccgggttggcggtaccggtggcgccgtgcgcgagctggtcccaagaagcgtcggagctgggcatgtggtggcgaaggtccgcgccgtcgacgccgacagtggatataatgcttggctgtcttacgagctgcaacctgtggctgccggggcttccattccttttagggttggcttgtataccggagaaatcagcacaacaagagccctggacgagacagacgctcccaggcatcgtctgttggtgctcgtcaaagatcacggagaaccctccctgactgccacggccaccgtgctggtgtccttggtcgaatccggacaggcccctaaagcctcatcccgcgctagtttgggcatcgctgggcccgaaaccgaattggtggacgttaacgtatatcttataatcgcaatctgcgctgtgtccagcctgctcgtgctcactttgctcctgtatactgcattacgttgttcagctccctcatccgagggagcttgctccttagtgaaaccaactctggtctgttcaagcgcagtgggcagctggagcttctcgcagcaacgcagacagcgtgtgtgtagcggagagggtccacctaaaacagacctcatggcattcagcccctccctgccgcagggccccagcagcaccgacaatgtgagccataagtag

SEQ ID NO: 131110 - DNA, 2814 bp, Artificial Sequence
  Description of Artificial Sequence: Synthetic coding sequence
atggtttgtccgaatggatatgatcccggcgggcggcacctcctgctctttataattattttagccgcgtgggaggcgggacggggtcagttgcactacagtgttccagaggaggcgaagcacggaaactttgtgggacgtatcgcccaggacttggggttagagcttgctgagctggtgcctcggctctttagggcggtgtgcaagtttagaggcgatctgctggaggttaacctgcagaacgggattctgttcgtcaacagcaggatagacagggaggagctctgtggacggagtgctgagtgcagcatccatctcgaggtgattgtggaacgccctctacaggtgttccacgttgatgtcgaagtaaaagacattaatgacaaccctccggtttttcccgcaactcagcggaacctgttcattgctgagtcgaggccccttgattcacgttttcctctcgagggagcaagcgatgctgacatcggggagaacgccctactcacttaccggctatctcctaacgaatacttcttcctggatgtacctacctctaatcagcaggtcaaacctttggggcttgtattaagaaaactcctcgaccgcgaagagacacccgagctgcacctgcttctcacggcaacagatggaggtaaaccagagctgaccggcacagtgcagctgctgattacagtgttagacaacaatgacaatgctcccgtgttcgaccggaccctttatacagtcaagctgccggagaatgttagcatcgggaccctagtcattcatcccaacgcctcagatctggatgaaggcttaaatggcgacattatttattcattcagctcagatgtgtccccagacattaaatcaaaattccacatggacccactttccggggccatcacagtaatcgggcatatggatttcgaagaatcccgcgcccacaaaattcccgtggaggcagtggataagggcttcccgcccctggctggacattgtaccgtgctggtggaggtcgtggatgtaaacgataacgccccccagctgaccctcacgtccctgagcctaccaatccctgaggatgcacagcccggaaccgtcattaccctcatatccgtgttcgaccgtgatttcggggtcaacggacaggttacgtgctcgctgactccacgtgtgccatttaaactagtgtcgacgtttaagaattactattcattagttctagactcggcactcgacagagagtctgtgtctgcatatgagctcgtggtcactgccagagatggggggtccccaagtttatgggccaccgctagcgtgtctgtggaggtggctgatgttaacgacaacgcacctgcgttcgcacagccggaatacacagtttttgtaaaggagaataatccccccggctgtcacatttttacggtgtccgcgggggacgccgatgcccagaaaaacgctttagtttcctattctctcgtagagctcagggttggtgagcgggcactgagttcatatgtgagcgtgcacgccgaaagcggcaaagtttacgccctccagcccctggaccatgaggaacttgaattattacagttccaggtcagtgcgcgagatgctggggtgcctcctctgggcagtaatgtaacacttcaggtatttgttttggatgaaaacgacaatgcccccgcactcctcgcaccacgcgtcggtgggaccggtggggccgtaagagaacttgtgccacggtcggtgggggccgggcacgtggtggctaaagttcgtgccgtagacgcagacagtgggtataacgcttggctgtcgtatgaactgcaacctgtggctgctggcgccagcattccatttcgcgtcgggctctatactggtgagatctccactacgcgcgcactggacgagacagacgcaccaagacacaggctgctcgtcctggttaaggatcacggagaaccctccttaaccgctacggccaccgtgctagtcagcctagttgaaagcgggcaagcccctaaagcgtcaagcagggcctccctggggatcgctggcccggagaccgaactcgtggacgtgaatgtctacttgataatagccatctgtgctgtgtcttcgctgctggttcttacactgctattatacacagctctgagatgctcagcccccagctctgagggtgcctgtagcctagtcaaacccacactggtatgctccagcgccgttggcagttggagctttagtcaacagcgtcgtcaacgggtgtgtagcggggaaggtccacccaaaaccgatctgatggctttttccccttcgctaccgcaggggccctcctccacagacaacccccggcagccaaatccagattggaggtattctgcttctctacgagccgggatgcattcttctgtgcacctggaggaggcaggaatactgcgggccggtccaggtggtccagaccaacaatggcctactgtctcatcagccactcccgagccagaagcaggtgaagtgagcccacccgtgggcgctggcgtaaatagcaattcctggacttttaagtatggacccggaaacccaaagcagtcgggtcccggggagttgcccgacaagttcataatccctggctccccagcaataatctccatcaggcaagaaccaaccaatagccaaatcgacaaatccgatttcattactttcgggaaaaaagaggaaaccaagaagaagaagaagaagaagaagggcaataaaacccaggagaagaaggagaaaggaaattccaccacagacaacagcgaccagtag

SEQ ID NO: 131111 - DNA, 2445 bp, Artificial Sequence
  Description of Artificial Sequence: Synthetic coding sequence
atggactaccattggcgcggcgaactgggctcctggagactgctcttgctgcttctgctgctggctgcttggaaggttgggtctggtcagttgcactattctgtccctgaggaggcgaagcacggaactttcgtcggacgcattgctcaggatctcgggctggagttggccgagctggtgccgaggctgttcagagtggcatccaagagacatagagatttgctggaggtctctttgcagaatggaattttattcgtcaattcaaggatagatcgcgaggagctgtgtggccgtagcgccgagtgcagcattcaccttgaggttatagtagaccgaccattacaggtttttcatgttgatgtggaggtaaaggatgtcaatgataacccacctgtgtttcgcgttaaagaccaaaagctcttcgtttctgagtctagaatgcccgactctcggtttccgctggagggtgccagcgatgcggacgtgggcgctaactccgtattgacttacagactcagttcccacgattattttatgctggatgtcaattctaaaaacgacgaaaacaagctggtggaactcgtgctgaggaaatccctcgatcgtgaggatgctcccgctcatcacctgttcctgaccgcaactgacggagggaaacctgaacttaccggcaccgtgcagctgctggtcactgtcctggatgttaacgataacgcacccactttcgagcagtccgagtacgaggtcaggatttttgagaacgcggacaacggaacgacagtaattaaattgaatgccagcgatcccgacgagggcgcgaacggagctattagctacagcttcaactcactggtagagaccatggtcattgaccacttttctatagataggaatacaggcgagattgttattaggggcaacctcgattttgagcaggaaaatctttacaagatactgatcgacgctacggacaaaggtcacccacctatggctggtcactgcacagtgctagtaaggattctcgataagaacgacaacgtgcccgagattgcccttacttctctcagtctgcccgtgagagaggacgcacagtttgggaccgtgatcgcactaatttctgtgaatgacttggattcaggcgctaatggacaagtgacatgctcactcatgcctcatgttcccttcaagctggtgtctacatttaaaaattactactctctggtcttggactccgccctggatcgcgagcgggtcagtgcctacgaactcgtagtaaccgctagagacggcggtagtccgtctctctgggcaacggccagtttatccgttgaggtggccgatgtgaacgacaacgcacctgcttttgcccaacctgagtacactgtctttgtgaaggagaacaaccctcccggctgccacatctttacggtgtctgcccgtgatgccgacgcccaagagaacgcattggtcagttactctttggtggaacgccgcgtcggtgaaaggagcctgagctcttacatttctgtacacaccgagtctggcaaagtgtatgctcttcaacccctagaccacgaggagctggagctcctccagttccaagtgtcagcaagggacgccggtgtgcccccccttgggagcaacgtgacgctgcaggtgtttgtgctcgacgagaatgacaatgctcctgcactcctcgaaccccgggtcggcggaacaggcggcgccgcatcaaaacttgtgcctcggagcgtcggtgccggacatgtcgtcgccaaagtacgggctgtggacgcagatagcggatacaatgcttggttaagctacgagcttcagcccgctgcctcttccccgaggataccgtttcgcgtcggcctttacactggcgagatcagcactacacgtgtcctggatgaggccgacagccccaggcatagactgctcgtacttgtaaaagatcacggtgaaccagctctgaccgcaaccgctacagtcctcgtctcactcgtggagtccggccaggcacctaaggcctcaagccgtcagagcgccggtgtgctcggacccgaggcggctctcgttgacgtgaacgtatacctgatcattgccatatgcgctgtctcttccctactggtgctgaccctattactttacacggcccttagatgctcagctctgcccactgagggcggctgtcgggctgggaaaccaactctggtctgcagctctgcagtcggatcctggagttacagtcaacagcagccacagcgtgtttgcagcggtgagggacctcccaagacagacttgatggccttcagcccatgtctgccacctgatttaggatccgtagacgtcggagaagagcaggatttaaacgtggaccatgggctcaaagtcagcccttttaagttcaggacacataaattctatctatggaaactatag

SEQ ID NO: 131112 - DNA, 2853 bp, Artificial Sequence
  Description of Artificial Sequence: Synthetic coding sequence
atggattaccattggaggggggaacttggaagttggcgactgctcttgctgctgctgttactggctgcctggaaggtgggctcagggcagcttcactactctgtgcctgaggaggccaaacatggaactttcgtggggaggatcgcccaggacctcgggctggaacttgcggaattggtcccacggctgtttagggtggctagcaagcgacatcgcgaccttctggaagtaagcctgcagaacgggatcctctttgtgaactcccgtattgatcgcgaagagctctgtggtagatctgccgaatgcagcatccacttggaagtgatcgtcgatcgcccactccaggtctttcacgtcgatgtggaggtgaaggatgtgaacgataatccacccgtgttcagagtgaaagaccagaagctctttgttagcgaatcccgtatgcctgattctcggtttcccttggagggagcgagtgacgccgatgtcggcgccaatagcgtgttgacatacagactgtcatctcacgattacttcatgctggacgttaacagcaagaatgacgagaataagctcgtggaactcgtcctccgcaagtctctcgatcgagaggacgcacccgcccaccatctatttctgaccgctaccgatggtggaaaacctgagctcaccggcaccgtccagttgctggtgacggttttggacgtaaacgacaacgctccaacattcgagcaaagcgaatatgaggtacgaatattcgagaatgctgataatggcaccaccgtgataaaactgaatgcgtccgatcccgacgagggtgcaaatggcgcaatttcttatagcttcaatagcctggttgaaactatggtgatcgaccatttttctattgacagaaataccggtgaaattgtaattcgcggtaatctcgacttcgagcaagagaacctctacaaaatcctcattgacgcaaccgacaagggccaccctccaatggctgggcattgtacggtgttagtgagaattcttgacaaaaatgataacgtcccagaaattgcgctcacctctctttcccttcctgtgagggaggatgcgcagtttggcacagttattgccttgattagcgtgaacgaccttgatagcggtgctaacggccaggtgacctgctcactgatgccacacgttcctttcaaactggtttcaacgttcaaaaactactattcccttgtgctcgacagtgcactggaccgcgaacgagtaagcgcctacgagctagtcgtcaccgctcgagacggaggcagtccatccctgtgggcaaccgccagcctatcagtagaagtagcagacgtgaatgacaacgctcctgcctttgcccaaccagagtacacagtctttgtgaaggagaataatccccctggctgccacatttttacggtcagcgccagggatgccgatgcacaggaaaatgccttagttagttactccttagtggagcgcagagtgggagaacgatccctgtcaagctatattagtgtccatacagagagcggaaaggtgtatgccctgcagcctttagaccacgaagaactcgagctgctccaatttcaggtgagcgcccgggatgccggggtcccaccattgggctcaaacgtgacattacaggtgtttgtgctagatgagaatgataacgctccggcacttctggagcctagggtcggcggtacgggcggagctgcgtctaaactggtgcccagatcagtgggcgccggacacgtggtcgccaaagtgcgcgccgtggatgctgattccggttacaacgcgtggcttagctacgaactgcagcccgctgcgtctagcccacgtatcccctttcgcgtcggcttgtatacaggtgaaatctcaacgactcgagtattggatgaagcagattcccctcgccaccggttgctggtcctcgtgaaagatcatggcgagcctgccctcaccgcaactgcgacagtccttgtgtctctggtggaatcgggccaggcgcccaaagccagtagtaggcagtcagcgggagtgttgggcccagaggcagctctagtcgatgtgaacgtctacttaatcattgccatttgtgctgtatcctcactgttagtcctgactcttcttctttatacagcccttcggtgtagtgcgctgccaaccgaaggcggatgcagggcaggcaagcccactttggtgtgctccagcgccgtggggagctggtcctattcccagcagcagccgcagcgcgtgtgttccggcgaaggtccaccaaagaccgatctgatggccttctccccctgcctaccacccgacttaggatcagtagacgtcggagaagagcaggatttgaacgtagatcatggcctcaagccaagacagcctaaccccgattggcgatactcagcatcgctccgggctggcatgcacagctctgtccaccttgaagaggccggcattttaagagcaggcccaggagggcccgatcaacagtggcccacagtgagttccgcgacccccgagccggaggcaggggaggtgtctccaccggtcggcgccggtgttaattctaacagctggacctttaaatacggccctggtaacccaaaacagagcggtcctggcgagctgcccgataagtttataatccctggctcccccgccatcatcagtatccgacaggagcccacgaactcccagattgataaatcagatttcatcacattcggaaagaaagaggagacaaagaagaagaaaaagaaaaagaaggggaacaaaacacaggaaaaaaaggagaagggcaattccactaccgacaactccgaccaatag

SEQ ID NO: 131113 - DNA, 2529 bp, Artificial Sequence
  Description of Artificial Sequence: Synthetic coding sequence
atgctgtattcatcacgtggcgacccagagggacagcccctcctgttgtcgctcctgattctcgctatgtgggttgtggggtctggacaactgcactattcagttcccgaggaggcagaacatgggacattcgtcggcaggattgcccaggacttggggctcgagctcgctgagttggtgccaagactttttcagctggactctaagggcaggggtgacttattagaggttaacctccagaacggtattctatttgtcaatagcaggattgaccgggaggagctgtgtgggcggtccgctgaatgctccattcatcttgaagtgatcgtagaccgaccactgcaggtgtttcacgtggatgttgaggtgaaagatatcaatgataaccctcctgttttcccagctacacagaagaatttgtttatcgccgaatcccggccccttgactcacgctttcccctcgaaggagcgtcagacgccgacattggagaaaacgccctgctgacataccgactcagtccgaacgagtattttttcttggatgttccaacttcaaatcagcaagttaaaccgctcggactggtcctcaggaagctgcttgatagagaggaaacccctgaacttcaccttctccttaccgcaaccgatggcggcaagccggagctgaccggtacggttcagctcctgattaccgtactggacaacaatgacaacgcacctgtttttgaccgcaccctgtatactgtaaagctccccgaaaatgtgagcatagggaccctcgtcatacaccccaacgcatcagatctagacgaagggctgaatggcgacattatatactccttttctagcgatgtgtcgcccgatataaaatcaaagttccatatggacccccttagcggcgcgattactgtaattggacacatggattttgaggagagccgtgctcataaaatccccgtggaggcagtggataagggctttcctcccctggctggacattgtactctgttagtggaggtggtggatgtgaatgacaatgcccctcagctgaccattaagacattgagcgtccccgtcaaggaagacgctcaattaggaacagtgattgctcttatcagtgtcattgatctagatgctgacgctaacggccaggtgacgtgttcgcttacccctcatgtcccattcaagctcgtatccacgtataagaattattattccctggtgctggaccgggcactggatcgggaatctgtttcagcatacgaactggtcgttacggctagagacgggggatcaccgtccctgtgggctactgctcgagtctcagtggaggtggctgacgtgaacgataacgcacccgccttcgctcagtccgagtataccgtgtttgtaaaggagaataacccaccaggctgtcacatcttcacagtgtcagcaagggatgctgatgcgcaggaaaacgccctagtctcctattcactggtagaaagaagactgggggaaaggtccctgagtagttacgtgtccgtacacgccgagagcggcaaggtctatgcacttcagccgttggatcatgaggagctcgaactcttgcagtttcaggtgagtgccagagatgccggagtgcctcctctgggatccaacgttactctgcaggtgtttgtgctcgacgaaaatgacaatgcgcccgccctcctgaccccgagaatgcgaggcaccgacggggctgtttcggaaatggtcctgaggtcagtgggcgccggggtcgtggtgggcaaggtcagagctgtcgacgcagattccgggtacaatgcctggctgagttacgaactacagccagaaaccgcctcagcaagtataccatttagagtaggcctctatactggcgaaattagtactactcgggctctcgatgaaactgacgccccccgacagcgcttactggtcctcgttaaagatcatggggagccagctttgacagccacagccacagtgctcgtgagcctggttgagtccgggcaggctcctaaatcctcctctcgagctagtgtgggtgcaactggaccagaggtgactttggtggatgtgaatgtctatctcatcatcgctatttgtgctgtgagcagcctgttggtgctgactttactgctgtacacggtactgcggtgctccgccatgccaaccgagggggagtgtgcacccgggaaacccacactcgtctgctcaagtgccgtgggttcttggtcctactcacagcagcggagacagcgcgtatgtagtggagaagggaaacagaagactgacctgatggccttctctccgggcttatcaccttgcgccggaagcacggaaagaaccggtgaacccagcgcatctagcgactccacagggaaggtggggttctcatcgatattattcatctacatcattttctttttggaacggtattacagactgttgccaggggccgtccagatagttctgttcatttttctggagatccagcagatttttttcctgataaaatag

SEQ ID NO: 131114 - DNA, 2853 bp, Artificial Sequence
  Description of Artificial Sequence: Synthetic coding sequence
atgctgtattccagtaggggagatccggaaggacaacccctcctgttgagcttgctaattctggctatgtgggtggtgggatcaggacaactgcattatagcgtccctgaggaagcagagcacggaaccttcgtgggtcgcattgctcaggatctgggtctcgaactggcggagttggttcccaggcttttccagctggatagcaagggtcgtggggacctgctcgaggtgaacctgcagaatgggattttattcgtgaattcacggatcgatcgcgaagaactctgtggaaggtccgcagagtgttctatccacctggaggtgatcgtcgaccgtccgctgcaagtgttccatgtggacgtggaggtaaaagacattaatgacaacccacccgtgttccccgcgacccagaagaatttgtttatcgccgaaagccgacccctggactcccggttccctctagagggggccagtgacgcggatatcggcgagaatgcactgctgacgtatcggttaagccccaacgaatatttttttctcgatgtccctacttccaaccagcaggtgaagccccttggtctagtattgaggaagctcctggatagagaggaaacaccagagcttcatctgctcctcaccgcaaccgacggtggaaaacccgaattaaccggaacagtgcagcttctgatcactgtgctggataataacgacaacgccccagtctttgacaggaccctgtacactgtgaaactgccagagaatgtgtccatcggaaccctcgtaatacaccccaatgcctcagacttagacgagggtctgaacggtgacatcatatatagtttttctagcgatgtgtctccagatattaaatcaaagttccacatggatcctttgtctggcgctatcacagtcatcggccatatggacttcgaggagtctcgtgcccataaaatcccagtcgaggctgttgataaagggtttcccccactggccggtcactgtacactgcttgtggaggtggtggatgtgaacgataacgctccgcaactgacaatcaagactctaagtgtcccagtaaaagaggatgcacagctgggaacggtgatagctttgatttctgtgatcgacttggacgctgatgcaaacggtcaggtcacctgctcactcaccccacacgtccctttcaaattggtgtccacttacaaaaactactattcactggtgctcgatcgggccctggatcgcgagtctgtcagcgcatatgagctcgtagtcactgcacgggatgggggttcccctagcttgtgggccacagcacgcgtgtcggttgaggtggcggacgtcaacgacaatgcccctgcatttgcgcaatcggagtacacagtctttgttaaagaaaataacccgcctggctgccacatctttaccgtgtcagcccgcgacgccgatgcccaggagaacgccctggtgagctattctctggtcgaacgcagactgggggagcggagcctgagctcgtatgtgtccgttcacgctgagtctggcaaagtttacgcactccagcctctagaccacgaggagttagaactgctgcagttccaagttagcgcacgagacgccggagttccccccctgggatcaaatgtgaccttgcaggtgtttgtactagacgaaaacgacaatgccccagccctactgaccccccgaatgcgaggtactgacggggctgtgtctgaaatggtgttgcgatccgtgggggcaggcgtggtcgttgggaaggtgcgcgctgtcgacgccgattctggatataacgcatggctgtcatatgaattacaaccagagacggcctctgcctcaattccattccgggtcggattatataccggtgagatcagcacgactcgcgccctggatgaaaccgacgcccctagacaaagacttttggtgctcgtcaaggatcacggcgaacccgccctgaccgctactgcgactgtgctggtgagtctagtcgagagcggccaggctcctaaaagctcgagcagggccagcgtgggagctacagggcctgaagttaccctggttgacgtgaacgtgtacctgataatcgccatttgtgctgtttcctctcttctagtcctgacactattactgtacaccgttctccgttgctctgctatgccaactgagggcgagtgcgcccccggaaagcctaccctagtgtgttcttccgctgttggctcatggtcatactcacagcagcggaggcagcgggtctgtagcggagaaggcaaacagaaaactgatctgatggccttcagccccggactctcgccctgcgctggttctaccgagagaacaggtgagccctcagcatcctctgacagcactggcaagccgcggcagcccaaccccgactggcgctatagtgcatccctccgggctggaatgcactcttctgtgcatctggaagaagcggggattctgcgggccggccccggcggccccgaccagcagtggcccacagtcagcagcgcgaccccggagccagaagcaggcgaagtttcccctccagtgggcgcgggcgtgaatagcaattcatggacatttaaatatggccccggcaatcccaaacagtcaggtccaggggaactgccagacaagttcattatacctggtagccccgcaatcataagcattcgccaggagcctacgaacagccaaatagataaaagcgactttattacctttggcaagaaagaagagaccaagaagaaaaaaaagaagaagaagggcaataagacccaggaaaaaaaagaaaaagggaactctacaacagataattctgatcagtag

SEQ ID NO: 131115 - DNA, 2892 bp, Artificial Sequence
  Description of Artificial Sequence: Synthetic coding sequence
atggtgggttgcggcgtcgctgttttatgtctgtgggtctcgtgtggcgccgcggctgggcagttggagtactctgttcctgaggagacggaaaggggagtggcagtcggaaatttaagtgcggatctgagactgcccgccgctgccatgtccagcaggaacttccgatttttgagctctcaccgcgagctatacttcggcgtcgacctccccagcgggaacctggtagtgcgcgaacccgctgaccgcgaacagttgtgtcgggccaaggccgcatgcgtgttgacatatgaccttgtgttagaggacccactggagcttcacaaaattagaatccacgtgctggacaccaacgataacagtcctctctttccggcgggcgacgtgcaactgcacataccagaatttttaacacctggcgcacggttcacattacctaacgcacaggacgacgacgaagggagcaacggtatcttgagctattctctttccccttcccagcatttcagattagacatgggcagcagagtcgatggatccgaatatccagaactggtcctggagaaagctcttgatcgcgaacagagagcaacccatctcctggtcctgacagccagggatgggggactgccggcacggtctggcgatgcacaagtgaccatcatcgtggtcgataccaacgataatgctcccgtcttcgagagatcagtgtatcgaactaaggtgcctgagacggcaccgaatggcacagtcttattccgagttcaggctctagatccagacgagggctctaatggagaggtgcaatattccctgtctaattccacacaggccgaactgcggcacaggtttcatgtgcaccccaagtctggggaggttcaagttgccgcatctttggggccccctgaaacactcctggaggcctacatcgaagcacgggatgagggcgtcttcggtctagctagtacagcaaagctgctggtcgaagtcactgacgtaaatgatcacgcacccgaactggacttcctaactctgagcaatccagtgcccgaggacgccgcacccgggactgtcattgcattgttttcggtgaaggacgaggatctcgactcaaacgggcgcgtcatttgtgggatgtccagtgctggacctttccagttgactgcaagttttgataactactattcgctgctgattgatggaccactcgatcgggagcaaatttcggagtatcaggtcctgatcacagcgtcggactcagggtccccccccctttccaccagacggactattactgtcagcgtcgcagacgtaaacgataacactcccaactttcctcagccacagcaggaactctttgtagccgaaaataacggccccggggctagcttgggcagagtgtttgctcaggatcccgacctgggcaagaacggactggtcagttatgagctacttgatgtgatttccgagggacccagtgcttcatcactcttggcggtggaaagttcttccggagctataacagctaaaacaagctttgatttcgaacagctgagagggttccacttccaggtggagggtagagatggagggatccctccacgatcagctaccgtgacaataaacctttttgtggtcgaccgcaacgataactatccagttattctgttccctttgccaaggaacggctcagtgcccgtagaaatcgtgccacgtagtgcccgaactggacatttggtcactaaagtagtcgccgaagatgccgacagcggcagcaatgcctggctgtcttatcatatatcccgcgcttccgactcttctctatttcgcatttccgccaatatcggagagctgcggactgcccggctcgtgctccccacagatgccgtaaagcagcgcgtggtggtggttgttagagaccacggagaccctccactttccagctccgtaacattgggtgtgctcttgagtaattcagttccacaactactgccagattttgaagatgtctgggaaccaggcggtcagctatccgcacagaatttgtacttagtgattgccctggcgtgtatttcgtttctcttcctgggctgcttactgtttttcgtatgtaccaagctccaccaaagcccaggttgctgcgcgcagagttgctgtcggtcgactgaggaccttagatacggtagcaagatggtatctaacccatgtatgacatctgccacaatagatgtgactactgtagagcggctatcccagacatacctgtaccgagcttcactgggccttgggtctgacaacaactcactcttgcttcggggagagtataatgccgcagatctgcgcaatctcgcaaccggagtaggcctaaatctgcctatctcctgcatccaaatcagaaacaggaagggcgaccacgcaaatgtaaacgccatgccaaggcaacctaaccccgactggcggtactccgcctctctccgcgcaggcatgcacagctcagtgcatctggaggaagcggggatcttacgcgcgggaccaggcggccctgatcagcagtggcctacagtgagtagcgctacccctgaacctgaggctggcgaagtgagccccccagttggagcaggcgttaactcaaattcctggacttttaaatacggaccggggaacccaaagcagagtggaccaggcgagctgccagacaaattcattattccaggcagcccagcgatcattagtatccggcaagaacctacaaactcacaaatagataaatcagatttcatcacattcggcaaaaaggaggaaactaagaagaagaagaaaaaaaagaagggaaacaagacccaggaaaaaaaagaaaaagggaactctacaaccgataacagcgatcaatag

SEQ ID NO: 131116 - DNA, 2457 bp, Artificial Sequence
  Description of Artificial Sequence: Synthetic coding sequence
atggttgggtgtggcgtggctgtcttgtgtttgtgggtttcctgcggagccgccgccggccaactggagtactccgtgcccgaagaaacagagcgaggggtggccgttggtaatttgagtgctgacctgaggctacctgcagcagcaatgtcttcgaggaatttccgtttcctgtcttcacaccgagaactgtattttggggtagatcttccctcgggaaatcttgtggtgagagaacccgctgatagggagcaactgtgtagagcaaaagcggcgtgcgtactgacatatgatcttgtgcttgaagacccgctcgaattacacaaaatccgcatccatgtcctcgatactaacgataattcgcccctgttcccagcaggggacgtgcagctgcacatacctgagttccttacccctggggcccgattcactctccccaacgcacaagacgacgatgaaggctctaacggcatactttcctacagcctaagcccctcccagcattttcgccttgatatgggctcgcgtgttgacggaagcgagtaccccgagctcgtgcttgagaaagcccttgaccgcgagcagagggccactcatctgctcgtgttaaccgctcgggatggtgggctgccagccaggtccggtgacgcgcaagtgactattattgtggttgataccaacgataatgcaccggtcttcgagcgctcagtatatcgcaccaaagtgcctgagactgcccccaacggcaccgttttattccgcgttcaggcactcgaccccgacgaggggtctaacggagaggttcagtattcactatcaaactctacccaagccgaactccgccaccgattccacgtgcaccctaaatccggagaagtccaggtcgccgcatcactgggcccccccgagactcttctcgaagcctacatcgaggcaagagacgagggcgtattcggtctggcctcaacagccaagctgcttgttgaagtcacagatgtcaatgaccacgcaccagagcttgactttctgaccctttcaaaccccgtgcccgaagatgccgccccaggaacagtgattgccctgtttagcgttaaagatgaggacttggatagcaatgggagagtcatctgtggaatgtccagcgccggccctttccagctcacagcctcattcgacaattactattccttgctcatcgatggccctcttgatagagagcaaattagtgaatatcaggtactgattaccgcgtccgatagcggttccccacccctgtccacacgcagaacaatcacagtctccgtggctgacgtcaacgacaatactcccaactttccccagccccagcaggagctgtttgtggcagaaaacaatggaccaggcgcatctctgggacgggtgttcgcccaagatccggatctcggtaaaaatggcctcgtgtcatacgagctgctcgatgttatcagcgaggggccatccgcgagcagcctgctggccgtggaatccagctctggtgccattaccgccaaaacctccttcgatttcgagcagcttagagggttccactttcaggtcgagggcagagatggggggatacccccacgctctgccacagtgactatcaacctattcgtggtcgacagaaacgataactatccagtaatcctcttccccttgccaaggaacggaagtgtgccagttgagatcgtccctcggtcagcgcgaacggggcacctggtcactaaagtcgttgccgaggacgccgactccggcagcaacgcctggctaagctatcacatctctcgggcaagtgactcttctctattccgcattagcgctaacattggagaactccgtacagcccgcctggtactcccgacggatgccgtgaaacagcgcgttgtcgtggttgtccgggaccacggggatcctcccctgagcagttccgtcaccctgggtgttctgctcagcaattccgttccgcagctgctccctgatttcgaggatgtttgggagcccgggggccaactctcagcacagaatctctatctggtgatcgcgctggcctgtatatctttcctttttctggggtgtttactcttttttgtgtgcacaaaactccaccagtcaccggggtgctgcgcgcagtcctgctgccgcagtacagaagatctcaggtatgggtccaaaatggtatctaacccgtgtatgacaagtgctacgatagacgttactaccgtcgaacgattgtctcagacttacctgtatagagcctcattaggtcttggcagcgacaacaactccctgttactgcggggcgagtataacgcagccgatctccggaacttggccactggcgttggactgaatcttccaatctcatgtatccaaatccgcaaccgcaaaggcgatcacgctaatgttaacgctatggttagcaaattctacggcatttag

SEQ ID NO: 131117 - DNA, 3024 bp, Artificial Sequence
  Description of Artificial Sequence: Synthetic coding sequence
atggaacaggcggggaccagacccgccgctacggaacatccccggctgcgccggcctatgccgtggcttctcctgctgccgctgttactcctcctgctgcttctgttgcccggacccgccgcctcccagctgcgttacagtgttcctgaggaacaggccccgggcgcactggtgggaaatgtggccagggctctcggtcttgagttaagaaggttgggacccggatgcctgcggatcaatcacctgggggcacccagccctagataccttgagctcgatctcacatctggagccctcttcgttaacgaacgcatcgaccgggaggccctttgtgaacaacgcccccgctgcctccttagcctcgaagtgctcgcccacaaccctgtggcagtgtccgcggtggaggttgagattctcgacatcaacgacaatagcccaagattcccacgccccaactaccagctgcaggtgagtgaaagcgtggccccgggagcacgctttcacattgagtcagcccaggatcctgatgtgggagctaatagcgtgcagacctatgagctgtcaccttccgagcacttcgaactggacctgaagccactccaagagaacagtaaggtcctcgaactggttctgcggaagggcttagaccgggagcaggctgccctgcaccatctggtgctgacagctgtggacgggggtattcccgcacggagcggcaccgctcagatttccgtgcgagtcctcgataccaacgataactcccccgcctttgatcaaagtacatacagggtccagcttcgggaagacagcccgcccggtacactcgtggtgaagcttaacgcaagcgatcccgatgaggggtcaaacggcgagctgcggtacagcctcagttcttataccagcgatagggaaagacaactcttttcgatcgacgctagcaccggggaggtgcgcgtcattggcggactagactacgaggaagccagctcatatcaaatctacgtgcaagctactgaccggggccccgtccccatggccggccactgcaaagtcctggtggacatcgtagacgttaacgataacgcccctgaagtggtcctcactgacctctattctcccgtcccagaaaacgctacccccaatactatcgtggccgtgctctccgtcaacgatcaggattcaggacctaaccgtaaggtttccctgggactggaagctacattgcccttccggctgaatggcttcggtaactcctataccctggtggtttcaggcccattggaccgggaaagagtggctgtttacaacatcacggtcaccgctacggacggaggtatcccacagttaaccagtttgcggacactgaaggtcgaaatttctgacattaatgacaatcccccctctttcctggaagatagctacagtatttatatccaagaaaataatctccccggcgtcctcctctgcactgttcaggcaaccgacccagacgaaaaagaaaacgctgaggtgacctattctttgctcgagagagaaatccagggactacctgtcacctcttacgtaagtatcaatagtgctagtgggagtctgtatgcggtgaactccttcgactacgagaaatttagagagttctttgtgactgtggaggctcaggataaggggtcaccacccctgagctctaccgtgactgctaacgtttacgtggtggacatgaatgatcacgctcctcatatcttgtatcctacttccaccaattctagtgcggcgtttgaaatggtgccacggacagcccccgcgggctacttggtaactaaagtgatcgctatggatagcgacagcggacagaacgcctggctgttctatcatttggcacagactagcgacttagatctgtttaaggtggaactgcatactggggaaataagaactacaaggaagatgggggatgaatcagggagtacgtttaatttaactgtcgtcgttagagacaatggtgaaccgagtctgagtgcaagcgttgccattactgtggctgtggtggatcgcgtgagcaagatacttcccgatacgcagcgacacgtcaagtcaccacggacctattctgagattaccctgtacctcataattgctctgtctaccgtatcattcatctttttgttaactattatcattctctcgatcataaagtgttacaggtacaccgcatatggcacagcttgctgcgggggtttttgcggagtgagagaacgctcccctgccgagctgtataagcaagctaacaacaatatcgacgcccggattcctcacgggttaaaagtgcagccccactttatcgaggtccggggtaatgggagcctgactaagacttattgctataaagcctgtctgaccgccgggagcggaagcgatacgtttatgttttacaacactggcgctcagactggcccaggtccatctggggcccaggcagctgtgaccgatagccgcaatcttactgggcaatccggacagaatgccggtaatctcattattctcaagaacgaagctgtgagtcagaatgaaccaaggcagccaaatcccgattggaggtatagcgctagcctgagggccggcatgcactcgagtgttcatttggaggaagcaggcattctgagagccgggcctggcggacccgaccagcagtggccaaccgtctcctcagccactcctgagcccgaggcgggcgaagtctcacctccagttggcgctggggtcaacagcaacagctggacatttaagtacggcccggggaatcctaagcagtccgggcctggcgagctcccagataaattcatcatccctggcagcccagcaatcatctccattagacaggagccaaccaattcacagattgataagagcgatttcatcaccttcggcaaaaaagaagagaccaagaaaaagaaaaaaaaaaaaaaaggaaacaagacacaagagaagaaagagaaaggaaacagtacgacagataacagtgaccaatag

SEQ ID NO: 131118 - DNA, 2457 bp, Artificial Sequence
  Description of Artificial Sequence: Synthetic coding sequence
atggcaggtacacggcggaagtccctccagaatcgacaggtgggctctctgctcatctttctgtgcatctcagtgggagatgccaccaccatccgctactccgtcgcagaggaaatggagtcaggttcattcgttgcaaatgttgctaaagacctcgggctggaggttgggaaactggccgcacgcggcgcgagactcgtctccgaaggtaataaaatgcatttccgtctgcatcggaagaccggagacctattcgttaaggagaaattagaccgcgagagcctttgcggaaaggccgacccatgcgtcttgcacttcgaagtggtgctggtggagccactgcagtcgtttagagcagaggtgcgcgtgttcgatatcaacgacaacgcacccgtgttcctgaacaaggagcccctgctgaaaattcctgaaagtaccccactggggtcacggtttccactgcagtccgcccaagatcttgatgtgggcctgaatggcctgcagaattataccctgagtgccaacgggtattttcacctccatacgcgattctgctcacacgggccaaagtatgccgagctggtgttgaacaaaccactggatcgcgaggagcaaccagaggtcaatttgacgatcaccgccgtcgacggaggctctccacctaaaagtggaacggctcatattcacgtggtagtgctggatgtgaatgaccacgttcctcagtttagtaggctagtgtaccgggcgcaagtatctgagaactcacccaacggttctctggtggctactgttactgctgtagacctcgacgaaggcactaataaggctatcacctacagtctggcccagaacccagaagctattctgaagacctttcagattgaccctcagaatggggaggtgcggctcaggggtcctttggatttcgaagctatcgagacatacgatatcgacattcaagcgacagacggcggaggtcttagcgcacactctaaagttctggtagaggtcgtggatgtgaacgataacccacccgaagtcatggtatcctcagtgagcagtcccttacccgaggatagccccccacagacggttgtcgcattatttactattagagacagagacatccgggtcggtgggaaggtaacgtgcttcctgagggaggatttgccgttcgtcatcaaaccgacctttggtaattcctattccttagtaactgaccgcagcctggatcgcgaagaggttagcggttataacatcaccatcgtcgctatggacaccgggccaccttctttatcggccgaaaccatgatcgaggtgctgatttccgatgttaatgacaatcccccgattttccgtgaggactcctatattttgacagtccgggaaaacaactctccggccgtcttcataggaaaagtccatgcagaggacttggatctcggtgagaatgcccagattacctacagcctgctacctcctaagaacggcgacctcagtgtatttgcctacatctccataaacagcgggaacgggaagctgtacgcactccggaccatggattatgaggccatccaagattttcagttcgtggtcaaagcgaccgacggagggttcttatctctgagttcccaggtcacagtaagggtggtggttctcgatgacaatgacaacaggcctatgattctgtatcccctacagaacggcacacttccatgcaacgatctggtaccacgttctgcagaagcaggatacctcgtcactaaggtggtggctgtcgacggcgattccggtcagaattcctggctatcatatcatctacttaaggctacggacctgggtttgttttccgttcagcggcagaatggggaaatccacactctgcgccaaatcagtgagcgggatcctatgatgcaaaaactgatcattctcgtgcaggatcatgggcagccggctctctccacaactgtatcacttaatattcttctcgtggacggattttctgagccctacctgcagttccaggatcctacaaagcactcacgcaaggttaaccctagtaccaagtacctggtgattagcttggtgatcctatcttttttgtttctgctgagcgtgattgtcattttcatcatccacgtgtatcagaaaatcaaataccgcgagaagtttaccatccaggagcacttttacgatgactgcaacttttcaaataatctcgtgcaggggcaggggaacggctctctttccagaccttgtccttacgaaatgtgctccgctacgggaacagggaacagtgagtttaggtttctgaagagatttatgcctaatttcccgttcccccatgctacgggtgaaatcaaaatggaagcaggaagctcactcccgccaaactctgatagaaacaaatctcagcggttggaaggccacgaccaggtgtcagacgactacatgtag

SEQ ID NO: 131119 - DNA, 2394 bp, Artificial Sequence
  Description of Artificial Sequence: Synthetic coding sequence
atggaaaatcagggcactagaacacaacagatacggcaggtcctacttttgttcgttttgcttggtatgtctcaggccggaagcgaaacctggtcattctctgtggccgaggaaatgcagagtggaagcttcgtgggtaatctagctaaggacctgggtctgaaagtgagggaactttcgtctcggggggccagagtagtttctaacgacaagaaacagcgcctgcaacttgacattaacaccggagatctgctcctctctgaaaccctcgaccgggaggagttgtgcggtagcatcgagccctgcgtattgcacctgcaggtgctaatgcaaaatcccactcagttcctgcaaattgagctgcaggtgagggacatcaacgatcattctcccatcttctccgaaaaacaaatgctgttagagataccggagaactcccctgtcggcgctgtgtttctcctggaatctgcaaaggacttagacgttgggattaatgccgtgaagtcttatactatctcccctaactcccatttccatatcaaaatgagggtgatccctgacaatcgaaagtatcccgaattggtgctggataaagctctcgactacgaggaactccccgagctgagtttcatcctgagcgcgttggatggcggaagccctcctagaagtggaacagctttggtacgggtcgtcgtcgtcgatataaatgataactccccggaatttgaacaggctttctacgaggtcaagattagggaaaactctatcctcggctcactgatcctgatcgtaagcgcatgggaccttgacagcggtactaatggggagatctgctacacattcagccacgcttctgaagatatccgcaaaacatttgaaattaaccagaagtccggtgagattaccctgagagctcccctcgatttcgagactatcgagtcttattctattataattcaggcgaccgacggcggcggcctgtttggaaagagtaccgttatcattcacgttatcgacgttaatgataatgcccctgaaatcactgtgtcctccatcacatccccaattccggaaaacactcccgagactgtcgttatggtcttctcaattcaagacatagactctggggataatggcaggattgtttgctctattcccgaggatcttccttttgttctaaaatcctcagtcgagaactactacacactggaaactgagcgtcctctagatcgcgaatccaccgccgaatacaacatcactattaccgttacagaccttgggataccacggctcaagaccgaacacaatactacagtgctggtctccgacgtgaatgataatgcgcccacttttactcagacatcctacacattgtttgtgcgagagaacaattcacctgcgctgcacataggctcagtgtccgctacagacagagactccgggactaatgcccaggtaaactattccctgttacctccccaggacttgcatctgccactggcttctctggtgtctatcaacaccgacaatggacatctgttcgctctgagatccctggactacgaggccttgcaggcttttgacttccgcgttggagcaaccgatcgcgggtctccagccctgagttccgaagcactcgtgcgcgtgctggtgcttgacgcaaacgataacagtcccttcgttctgtaccccctgcagaatggaagtgcgccttgtaccgagctcgtgccgcgggcagccgagcccggttatctggtgaccaaagtcgtggctgtagacggagacagcgggcagaatgcatggttgtcttatcagttactcaaagccactgaaccagggctgtttggggtctgggcacataatggcgaggtgcggactgcccggttgcttagtgaaagagatgctgccaaacaccgcctagtagtgctggtgaaggataatggcgagccgcctagatcagccaccgctaccctacaggttctcctggttgatggcttcagccagccctacctccccttgcctgaagctgcaccagctcaggcccaggctgattctctgacagtctatctcgtcgttgctctggcaagcgtcagctccttgttcctcttttccgtgctgttattcgttgctgtaagactatgtagacggagtcgagccgcctccgtcgggtcatgcagtgtgcccaaaggacctttcccggggcacctcgtggatgtatccggaacaggtactctttcacagtcttatcagtatgaggtttgcctcaccgggggcagcgaaactaacgagttcaagttccttaaaccagtcattcccaatatacaggccaaaggtcttggcaagaattcagaagagaattcgacattccgcaatagtttcgggttcaacttctag

SEQ ID NO: 131120 - DNA, 1299 bp, Artificial Sequence
  Description of Artificial Sequence: Synthetic coding sequence
atggtgttctccatacaggacattgactcaggcgacaatggccggatagtgtgctccatacctgaggacctacctttcgtcctcaaaagtagtgttgagaactattacactttggaaaccgagagaccgctggatcgtgagagcacggccgagtacaacatcacgattaccgtaaccgacctgggcatccccaggctaaaaactgaacacaatacaacagtcttagttagtgatgtcaacgacaacgccccaaccttcactcagacttcctacaccctgtttgtgcgggagaacaacagccccgctctccacataggcagtgtctccgcaaccgacagggacagtggcactaacgctcaagttaattatagtcttctgcctccacaggatttgcacctcccgctcgcgtccctagtaagtatcaataccgataacggccatctgtttgccctcaggtccctggactacgaagccctgcaggcattcgattttagggtcggcgctaccgaccgagggtctcccgccctgtcctctgaagctctggtcagagttctggtactggacgccaacgataactctccgtttgtactgtaccccctgcaaaatggctcagcaccatgcactgagcttgtgcctcgagcagccgagccaggctacctagtcacaaaggtcgtggccgttgatggagactccgggcagaatgcctggctctcctatcaactgttaaaggccacggagcccggcctcttcggcgtttgggcacataatggcgaagtacgcacagcccgcttactttcggagcgtgatgccgcaaaacatcgtctggtggtactggtcaaagataacggagagccacctcgtagcgcgacggcgactttacaggtactacttgtggatggcttctcacagccatacttgccgctccccgaggcagccccagctcaagctcaggcagattctctgactgtgtatttagtggttgccctagcaagtgtgagctcgctgttcctgttttcggtgcttctgtttgtggctgttcggttgtgtagacgatctcgggctgcaagcgttgggtcttgtagtgtccctaaaggtccgtttcctgggcacctcgtggacgtctccggcactggtacactgtcccagagttaccagtatgaagtgtgtcttactggtgggagcgaaaccaatgaatttaagtttctcaagccagtcatccccaacatccaggcgaagggcctggggaaaaatagtgaggagaattctactttccggaactcgtttgggtttaatttttag

SEQ ID NO: 131121 - DNA, 399 bp, Artificial Sequence
  Description of Artificial Sequence: Synthetic coding sequence
actatcgaaagctattccataatcatccaggccactgatggcggaggtctattcggcaagtctaccgtaatcattcacgtgatcgacgtcaatgataatgctcctgaaattactgtctccagtatcacctcccccatccctgagaacacacctgaaaccgtcgtgatggtgttctcgatccaggatattgacggtaccacagaagagctgttcgtccctttccgcaagacttcacacgtgctgaagtcctcggtggagaactactataccctggagactgagcggccactcgatagggaaagcacagccgagtacaacattaccatcacagtgaccgatcttgggattcctcgccttaagactgaacataataccaccgtgctcgttagcgacgtgtag

SEQ ID NO: 131122 - DNA, 2388 bp, Artificial Sequence
  Description of Artificial Sequence: Synthetic coding sequence
atggaaaacggcggcgccggaaccctccagattaggcaagtcctgctcttctttgtgctgctggggatgtcacaggccggaagcgaaaccggcaattttcttgtcatggaagagctgcagtctggttccttcgttgggaatctagctaaaacgctgggactcgaggttagtgagctgtcatcccggggtgccagagtagtatcgaatgacaacaaagaatgtttacagcttgatacaaataccggcgacctcctcttacgggaaatgctagatagggaagaactgtgtgggagcaatgagccttgtgttctttatttccaggtgctcatgaaaaacccgacacagttcctgcagattgagttacaggtcagggatattaatgatcactccccagtcttcctggaaaaagaaatgcttttagagatccctgaaaatagtccagttggtgccgtgttcctgctcgaatccgctaaggatctggatgttggcatcaacgcagtgaaatcctacacaattaacccaaattcacatttccacgtgaagatccgggtcaaccccgacaatcgtaaatatcccgagttggtgctcgacaaggcactggattacgaggagcgccccgaactttccttcatactcacagctttggatggtggctcacccccgcggtcaggcaccgctctggtgcgcgtcgttgttgtcgatattaatgacaactcgccggaattcgaacaagcattctatgaagttaaaattcttgaaaactccattctcggttcactcgtggtaaccgtgtctgcatgggatctggacagcggaaccaactccgaacttagctatacattttcacacgcttctgaagacatccgaaagacatttgaaatcaatcagaagagcggggatattactctgacagcacctcttgattttgaagccatcgagagttactctattatcatccaggccaccgacgggggcggactgtttggcaagagtactgtacggatccaggtcatggatgtaaacgacaacgctcccgagataaccgtcagtagcatcactagcccaattcccgagaatactcctgagaccgttgtaatggtattccggatcagggatagagactccggcgacaatggtaagatggtatgtagcattccagaggatattccctttgtactcaagtcttcggtaaacaattattacaccctagagacggagcgccctctcgatagagagagcagggcggagtataatatcactataactgttacagacctcgggacacctcgactgaagacagagcacaatattacagtgctggtcagcgacgtgaatgataatgctcccgcctttactcaaacaagctacgccctgtttgtccgggagaataactcacctgcattgcacatcggctccatctctgctaccgaccgcgatagcggtacaaacgcccaggttaattactccctactgccttctcaggacccacatctgccactggcaagcctcgtttcaattaacgccgataatggacacctgtttgctcttcgctcgttggactacgaagctctacaagggttccagttcagggtgggggctactgatcacggatctcctgccttaagctccgaggcattagtccgtgtcctcgtccttgatgctaacgacaactcacctttcgtactatatccgctgcagaacggttcagcaccatgcacagaactggtgccatgggccgcggagccaggttacttggtgacgaaagtcgtggcagtagatggggacagcggccagaatgcctggctgtcataccagctactgaaagcaactgagccaggtctgtttggagtgtgggcccataatggagaagtccggacggctaggttgctgtccgagcgagatgcagccaagcaccgcttagttgtgctcgtcaaggacaatggggagccacctcgctccgctacagcaacattacacgtgttactggtggacgggttcagtcagccttacttgccactgccggaggcagcacccgcacaggcccaggctgatagcttgacagtctatctggtggtcgctctggcctctgtatcctctctctttctgttcagcgtcttgttgttcgttgcggtgagactttgtagaagaagtagagccgcacctgtcggccggtgttctgtcccggagggacctttccctggtcatctggtcgatgtctcaggcactggtacgttgagccagtcttaccattatgaggtgtgtgtgacggggggctcccggtccaacaagtttaagtttctgaagcccattatcccaaacttcctgccacaatccactggctcagaagtagaggagaacccacctttccaaaacaacctgggattctag

SEQ ID NO: 131123 - DNA, 1257 bp, Artificial Sequence
  Description of Artificial Sequence: Synthetic coding sequence
atggtgtgtagcattccagaggacattcccttcgtgctcaaaagcagcgtcaataactattacactctagagacagagcgaccactcgatagggaatcccgagccgaatataacataacgatcaccgtgacagacctcggcactcccaggttgaagaccgaacacaacatcacagtactagtctcagatgtgaatgacaacgctcctgcattcactcaaactagctacgcactatttgttagggaaaataattcaccagccctccatataggctccatctctgccactgatcgggatagtggaacaaatgctcaagttaactactcactcctcccctcccaagacccccacctgcctctagcgtcactcgtgtctatcaacgccgataatggtcacctgtttgcactacggtcactggactacgaagctttacaaggatttcagttcagagtaggtgccactgaccacggctcaccagcgttgtctagtgaagcccttgttcgggttctggttctcgacgctaatgataactcgcccttcgtgctgtaccccctgcagaacggctctgcaccctgtaccgagctggtgccatgggccgccgaacccggttacttagtgacaaaggtagtggcggtcgacggggattcaggccagaacgcatggctctcttaccaacttcttaaggccacggaacccgggctctttggcgtctgggcccataacggtgaggtccggacagctcgcctgctgtcagagcgagacgcagccaagcaccgtttggtcgtgctagtcaaagataacggcgaacctcctcggtccgccaccgcaaccttgcacgtcctgttagttgacggattctctcagccttatctgccgttgcccgaggcagcccccgctcaggcccaggccgatagccttaccgtctacctggtcgtggccctggctagcgtctcatcactcttcctattttcagtgttgctatttgtggccgtacgactctgcagacgctcaagagcagcgccagtggggcgctgttcagtccccgaaggaccttttcccgggcatcttgtcgacgtgagtggcaccggaaccctgtcccagtcttatcattatgaagtgtgtgtaaccggcggctcaaggtctaataagttcaaatttctgaagcccatcatccccaacttcctgcctcagtccaccggttctgaagtggaagagaatccccctttccagaataatctggggttttggatacaatag

SEQ ID NO: 131124 - DNA, 1377 bp, Artificial Sequence
  Description of Artificial Sequence: Synthetic coding sequence
atggatgtgaacgacaacgcccccgagatcaccgtgtctagtatcactagccctatcccagaaaacactcccgaaaccgtcgttatggttttcaggattagagatagggatagtggtgacaatggcaaaatggtgtgcagtatcccagaggatataccctttgtgttgaagtcttccgttaacaattactatactctggagaccgagcgacctctagatcgcgagtctagagcagaatacaatatcactattaccgttaccgacttaggcacaccccggttgaaaacggagcataacattacggtcctggtgtcggatgtgaacgacaatgcgcccgctttcacacagaccagctacgcattgttcgtgcgggagaacaatagccccgccttacatatcggcagtatctcagctaccgatcgggactccggcactaatgcacaagtcaattacagcctgctgccttcacaggacccccatttacccctcgcatcactggtgtctatcaacgctgacaatgggcatctgtttgcccttcgcagccttgactacgaagctcttcagggatttcagtttagagttggcgccaccgaccatgggagccccgccctcagtagcgaggcactggtacgcgtactggtacttgatgcgaatgataacagcccgttcgtcctctaccccctgcaaaatgggagcgccccatgtactgagcttgtcccgtgggccgccgagcccggctacctggttactaaagtcgtagcggtcgacggggatagcgggcagaatgcttggctaagctatcaactactcaaggccacggagccaggattgttcggagtgtgggcccacaacggtgaggtgaggacagcccggctgctgagcgagcgcgatgccgcaaagcacagactggtggtgttggtaaaagacaacggagaaccacctcggtctgccactgccaccctccatgttctcctggtagacggcttttcacagccatatttgccgctgccggaagccgcccctgcccaggcccaagctgactccctcacagtgtacctcgtggttgccttagcaagtgtatcatctctgttcctgttctctgtactgctgttcgtcgccgtgcgcctgtgtcgcagatctcgggccgcgcccgtgggtcggtgcagcgtcccggagggacccttcccagggcatcttgtggatgtttcaggcaccgggacactaagccagagctatcactatgaagtatgcgtcactggtggtagtaggtctaacaagttcaagtttttgaagccaatcatccccaatttccttccccagagcaccggttcagaggtcgaggagaaccctccctttcaaaataacttagggttctag

SEQ ID NO: 131125 - DNA, 2397 bp, Artificial Sequence
  Description of Artificial Sequence: Synthetic coding sequence
atggaagcatccggcaaattgatttgtcggcagaggcaggttctcttttcttttcttctactggggctcagcctcgcgggagctgctgagccccggagctattctgttgtcgaagaaacagaaggatcctcattcgtaaccaatctggcgaaggatttaggactggaacaacgagagttttcacggcggggcgtgagggtggttagccggggtaacaagttgcacttacaactgaaccaagagacagctgatttactgctgaacgaaaaactggaccgagaagacttgtgcgggcataccgaaccttgtgtgctacgattccaggtgctgcttgagagtcctttcgaattctttcaagcagaattacaagtgatagatattaacgatcactcacctgtattcctggacaagcagatgctggtaaaggtgtctgaatcttcaccgcctggtactaccttccccttaaaaaacgccgaggacctggatgtgggccagaataatatagagaactacattatcagtcccaattcctatttccgagtcctgactaggaaacggagtgacggtcgaaagtacccagaattggtcctggacaaagcactggatcgcgaggaggaagccgaactgcggcttacacttaccgccctggacggaggatctcccccccggtccgggacggctcaggtgtacatcgaggttcttgacgtcaacgacaacgccccagagtttgagcagcctttttacagggtgcagatctccgaggactccccggtgggctttcttgttgtgaaagtgtcagctacagacgtggacaccggagtaaacggtgagatctcatactcgctttttcaagcctccgaggaaatcgggaagacttttaagattaaccctttaacaggtgagattgagctcaaaaaacagttagatttcgagaaactccagtcatatgaagtgaacatcgaagctagagacgcagggactttctcaggaaaatgcaccgtgctgattcaagtgattgacgtaaacgaccatgctcctgaggtcacaatgtccgccttcacctctccgatacctgaaaatgcgccggaaacagtggtggccctgtttagcgtgtcagatctggattcaggcgaaaacggcaagatttcttgcagcatacaggaggatcttccgttccttctgaagtctgccgaaaatttttacactcttctgaccgagcggcccctcgacagagagagtcgcgcagagtacaacattacgatcactgtgaccgatctcggaactccaatgttgattacccaattaaacatgacggtactgattgccgacgtgaatgacaacgcaccggcatttactcagacgtcatataccctgtttgtcagggaaaataacagccccgctctccatatcagaagtgtgtccgctactgatcgcgactctggaacaaatgcacaggttacatacagcctgctgcccccgcaagatccgcatctgccattgacctcattggtctctattaacgctgataacgggcatctcttcgcactgagatccctggattatgaggctctccaggggttccagtttcgggtgggagcatccgaccacggtagcccagcactgtcgtccgaggcactagtgagggtcgtcgtccttgacgctaacgacaactctcctttcgtgttgtaccctcttcagaacgggtccgctccatgcaccgagttggtgccccgagcagccgaacccggctacttagtgactaaggtggtagccgtggacggagactcgggtcaaaatgcttggctctcctatcagctcttgaaagccacagagctgggtcttttcggcgtctgggcccacaacggagaggttcgaaccgccagactcctctcggagcgagatgccgccaagcataggctagtggtacttgtgaaggacaacggggagccccctaggtctgctacagcgacccttcatgttctgttggtggacggattttctcagccctacctgccacttcctgaggccgccccaacacaggctcaggccgatctgctgaccgtatatctcgtcgtggccctggcgagcgtgtcttctctgttcctcttcagcgtattgctgttcgtcgctgtacgcctctgtagacggtctagggcagcatccgtaggccggtgcctggtaccggagggccctctgcctggccacctcgtcgacatgtccgggacacgtacactttctcagtcctaccagtacgaagtgtgcctggcaggaggctccgggaccaacgaattcaagtttctgaaaccgattattcctaacttcccaccccaatgccctggaaaggaaatccaggggaactctacatttccgaacaactttgggtttaatattcagtag

SEQ ID NO: 131126 - DNA, 2235 bp, Artificial Sequence
  Description of Artificial Sequence: Synthetic coding sequence
atggaggcatccggcaaactaatctgccgccagcggcaggtcctattctccttcctgctcctgggacttagtttggccggcgcagctgaaccaaggagttatagcgtggtggaggaaaccgaaggctcatcttttgtcacaaacttggcaaaggacctcggcttggaacaaagagagttctcccggagaggggttcgcgtcgtctcacgcggcaataagcttcacttgcagttgaatcaggaaactgcggacttgctcctgaatgagaagctggacagggaagacctttgtgggcatactgagccatgtgtgctgagattccaggtcttactggaaagccccttcgaatttttccaagccgaattacaggtgattgatatcaatgatcattccccagttttcctggacaagcagatgctggtcaaagtgtccgagtcctctccgcccggtacaactttcccactcaaaaatgccgaggatttggatgtgggccagaataatattgagaactatatcattagtcccaactcatatttccgtgtactgacgaggaagagatctgatggacgcaagtacccagaacttgtgctagataaagccctcgatcgcgaagaggaagcagagctgcgactcacactaacagctcttgatggggggtcgccaccacgctcaggtaccgcccaggtctatatcgaggtgcttgacgtcaatgacaatgccccagaattcgagcagcctttctacagggttcagatctcagaggactctccagttggttttttggtggtgaaggtgagcgccacagatgtagacaccggagtgaacggtgagatctcctattccttgtttcaggccagcgaggagatcggaaagacctttaagattaacccactcaccggcgaaattgagcttaaaaaacagctggatttcgagaagctccagtcctacgaggtcaacatagaagccagagatgctggcacattctctggcaagtgtactgtcttgattcaggtgatcgacgttaacgaccatgcccccgaagtaactatgagcgccttcactagccccattcccgagaatgcccctgagacagttgtggctctgttctctgttagtgacctagattcaggggaaaatggcaaaatctcttgttcaatccaagaggacctccctttcctcttaaaaagtgcagagaatttttataccctgctgacagagcgacctttggatcgtgaatcccgggcggagtacaatattactatcacagtcacagatctgggcacacccatgctgatcacccagctgaatatgactgtgctgattgctgacgtgaatgataatgctcccgcttttacacagacctcctacactctgtttgtacgggaaaataactcaccagcccttcatataaggagtgtctccgccaccgaccgggacagcggtactaacgcccaggtcacatattccctgttgccgcctagggtggttgtcctggatgcaaatgataacagcccttttgtcctgtaccccttgcagaatggttcagcgccttgcacagagctagtcccaagagccgctgaaccgggctacctggtgacaaaagtggtggccgtcgatggcgacagcggacagaacgcctggttaagctatcagttgttaaaggctactgagctgggcctttttggcgtgtgggcacacaatggagaagtcaggaccgctagactgctgtcagaacgagatgctgctaagcaccgcctagtggtactcgttaaggataacggagaaccccctcggtccgcaacagcaaccctgcatgtattgctggtcgatggtttctcccagccatacctccctctaccagaagctgcaccgacacaggctcaggcggacctgctcacagtgtaccttgtggtagcactcgcatctgtatcctcactttttctcttttccgtgcttctctttgtcgctgtcagactgtgtaggcgttccagagccgctagtgtggggcggtgcttggtacccgaagggccccttcccggccatctggtggacatgagtgggacaagaaccctgtctcagtcttaccagtacgaggtctgtctcgccggggggagcggtactaacgaattcaaatttctgaaacccatcatccccaattttccgccccagtgtcccggaaaggagatccaaggcaactcgacgttcccaaacaattttggattcaatattcagtag

SEQ ID NO: 131127 - DNA, 2409 bp, Artificial Sequence
  Description of Artificial Sequence: Synthetic coding sequence
atggaggcatccggcaagttaatttgccgccagagacaggtgcttttctcctttctcctgctcggcctgagcctcgcgggagctgcagaaccgcggtcatactctgttgtcgaggaaactgagggaagctcctttgttacaaacctggctaaagacctgggtctcgaacagcgagaattttcacggcggggagttcgggtcgtgagcagaggaaataaactgcatctgcaactgaaccaggagactgctgatctcctccttaacgagaaacttgatcgcgaagacctctgcggacataccgagccttgcgtattgcgatttcaggttcttctcgagtccccattcgaattctttcaggcagagctccaagtaattgacatcaatgaccactcccccgtgttcctggacaaacagatgctggttaaggtttctgagtcatcgccccctggtacaacattcccattaaagaatgctgaggatctggacgtcgggcagaacaacattgagaactacattataagtcccaacagttatttccgtgttctgacaagaaagcgaagcgatggacggaaatacccggagctcgtactcgacaaagccctcgatcgggaggaggaggccgaactgcgactgactctgaccgctctggacggcgggtctccacctcgctcagggactgctcaggtttacatcgaggttcttgatgtgaacgacaacgcgcccgaattcgagcagcccttttatagggtccagatatccgaggattcacccgtgggcttcctggtggtgaaagtatctgctaccgatgtggatacaggggtcaacggtgagatttcctattccctgttccaggcttctgaggaaataggcaagactttcaaaataaaccctctaacaggcgaaatagaactgaaaaagcagttggatttcgagaaactgcagtcttatgaggtgaacattgaagcgcgtgatgcaggcacattttctgggaaatgtactgtgctgatccaagtgatcgacgtaaatgatcacgctcctgaggtcactatgtcggcttttacctctcctatcccggaaaacgccccggaaactgtagttgctctgttctcagtgagcgatctggactctggcgagaacgggaagatatcttgctctatccaagaagacctcccatttcttttgaagtcggctgaaaatttctatactctccttacggagagaccgttggatagggagtcccgggctgagtataatatcacgatcacagtcacggacctaggcactcccatgttaataacccagctgaatatgactgtgctgattgcagacgtgaacgacaacgcccccgccttcacacaaacgagctatactctgttcgtgagggagaacaactccccagctctgcatattcgctctgtgtctgctacagaccgtgactccgggacaaacgctcaggtgacctattcgctgctgccaccccaggacccccatctgcctctaacttctcttgtgtctatcaatgcagacaacgggcacttattcgccctgaggtccctggactacgaggcactacaaggattccagttccgcgtcggcgcctcggatcacggcagccccgccctctcatctgaagctcttgtcagggtggttgtgctggatgccaacgataacagcccttttgtactctacccacttcagaacggctccgccccttgtactgagctggtgccacgtgccgctgagccaggctacctggtgactaaggttgtagcagtcgacggagacagtgggcagaacgcatggttgtcctatcagctcctgaaggcaaccgagctcggtctgttcggcgtgtgggctcataatggagaggttagaacagcaagattgctgtctgaacgcgacgctgccaagcacaggctggtcgttctggtgaaggacaatggcgaacccccccggtccgccacggcgactttgcatgtcctgctagtcgatgggttttctcagccatatctaccactacctgaagccgcccctactcaagctcaggccgacctcttgactgtgtatctggttgttgccctggctagcgtctccagtctcttcctgtttagtgtcctgctgttcgtcgctgtgaggctgtgccggcgctctcgcgctgccagcgtcggaagatgtttggtgccagaaggacctttacccggacatctcgtagacatgtccggtactcgaactctgtcccagagctatcagtatgaggtgtgtctggccggtggatcaggaaccaatgagttcaagtttctgaaaccaatcatacccaattttcccccacagtgtcctgggaaggaaatacagggtaactcaaccttccccaacctttgtgtctgcaacatagtgcggatttatagctag

SEQ ID NO: 131128 - DNA, 2397 bp, Artificial Sequence
  Description of Artificial Sequence: Synthetic coding sequence
atggagatacgtggcgccctcgatcttcggaagagacaggtcttaatctttctggtattactgggactcagccgcgctggtaccgagagtgcccactactctgttgcagaagaaacggaaatcggctcctttgtcgccaacttggctcgcgatctaggactgggcgtggaggagctttctagccgcgaagcacgtgtcgtttccgatgataacaaaaagtatctgcatctggatctcctcacaggaaatctactactgaatgagaagcttgatagggatgagctctgcgggtctaccgaaccatgtgtactgcactttcaggtagtactggaaaaccctctgcaattttttcgtttcgaactgtgcgtcaaagacatcaacgatcattcacctacattcctggataaggaaatcctgattaagataagtgagggaaccacagtcggcgctaccttcctgatggagtctgcccaggatctggatgtaggctccaacagtttacagaactatacgatctcgcccaactcacatttctacataaaaatcccggatagttctgaccggaagatctaccctgaactggttctggatagagccctggactacgaacaggaggcagagctgagactcacgctaaccgctgttgacgggggctcaccgcccaagtcgggaacgacacttgtattgatcaaggtcttagacatcaatgacaacgcgcctgaattcccccaatcactgtacgaggtgcaagtgcccgaggacagacctctgggatcttggattgcaacaatctcagccaaggatttagatgcaggcaattatgggaaaatttcttacacgttttttcatgcttccgaggatattcgcaaaactttcgagattaacccgattagcggcgaggtgaatctgagatcacccctagatttcgaagttatacaatcatacacaatcaacatccaggccacagacggagggggtttgtccggcaaatgcacactgttggtgaaagtaatggacattaacgacaacccgcctgaggttactatttcttccattacaaaaaggatccccgagaatgcttcggaaacactggtggccctgttttctatcctcgaccaggacagcggcgataatggcaggatgatctgtagcatccaggataatctcccattcttcctgaagcctacattcaagaacttcttcaccctggtgtccgaaaaggccctcgatagagaatctcaggccgaatataatattacgataactgttacagatcttgggacaccacgactcaaaaccgaatacaacataactgttctcctgagcgatgtgaacgacaacgccccaaccttcacacagacctcctataccttgttcgtcagagagaacaattcacccgctctgcatattggttcagtgtctgccacagacagagattcggggaccaacgcacaggttaattatagcttgcttcccccacaggatcggcatttgccacttgcttctctagtgtctattaacgcggataacggtcatttgtttgctctacgttccctagattatgaagctctacaggagtttgaattcagagtgggggcgactgataggggctcccccgctctctcaagtgaggctctcgttagggttcttgtgctggatgccaacgacaatagcccgtttgttttgtatcctctgcagaatggatccgctccatgtactgagctggttcctagggccgcagagcccggttatctcgtgaccaaagtagtcgccgtggatggagactccggtcagaatgcctggctcagttaccagctgcttaaagcaactgaacctggccttttcggcgtatgggcccataacggggaagttaggaccgcaagactgttgtcagagcgcgacgctgctaaacacaggctcgtcgtcctggttaaagacaatggagaacccccccggtctgctaccgctactctgcatgtcttacttgtggatggtttcagccagccctacctgccacttcctgaggccgcccctgcacaggcacaggcagactctctcacagtctatttggtagttgctcttgcgagcgtgtcatccctttttctcttttctgtgctgttgtttgtggcggtccggctctgcagacggtccagagcagccagcgtcggacggtgctctgtcccggagggacccttcccaggccacctggtagatgtatctggcacagggaccctaagtcagtcttatcagtacgaggtgtgtttgactgggggatcagggactaatgaattcaagttcctaaagcccattatcccaaattttcaggtgcatgatacaggccggaatatgggcgagatcgagaatttcaggaattcatttgggctgaacattcagtag

SEQ ID NO: 131129 - DNA, 1938 bp, Artificial Sequence
  Description of Artificial Sequence: Synthetic coding sequence
atggagtcagcacaggacttggacgttggctctaactcacttcagaactacacaatttccccaaatagtcatttctatattaaaattcctgactcaagtgatagaaagatttatccagagctcgtccttgaccgcgccctggactacgaacaggaagcagagttgcgcctgaccctgacagccgtggacggcgggagccctcccaaatcaggaacaacactcgtcttgataaaagttttggacattaatgacaacgcgccagagttcccgcagtctctgtacgaggtgcaggtgcctgaagacagacccctcgggtcttggatcgctactatcagtgccaaggacctggatgctggtaattacgggaagataagctatacattcttccacgcgtcagaggacataagaaagacctttgagatcaaccctatttccggtgaagtgaatctgcgtagcccactggatttcgaagtcatacagagttacacaatcaatatccaggcgacagatgggggcgggctcagcggcaaatgtaccctgctggtgaaagtgatggacattaatgataatccccccgaagtgacaatctcatcgatcaccaaaaggattcccgaaaatgccagcgagaccctcgtggctctgtttagtatacttgaccaggattccggcgataatggcagaatgatctgttccatacaagacaatctgcctttcttcctcaagcccacttttaagaatttctttactttagttagtgaaaaagcattggatcgagagtcacaagctgagtacaatatcaccattacagttaccgatttgggaacaccccggcttaaaacagagtataatatcaccgtacttctgtctgatgtgaacgacaatgcccctaccttcacacagacaagctatacgttgttcgtccgcgaaaacaactcccctgctctgcacattggatcggtgtcagccaccgatcgcgactcaggtactaacgcacaggtcaattactctcttttgccaccccaggacagacacctgccgcttgctagcctggtcagcattaatgctgataatggtcatctgttcgccctcaggtcgcttgattatgaggcactacaggagttcgagttccgcgttggggcaacagataggggttctccagcgctgtcctccgaggccttggttcgggtgctcgtacttgacgcaaatgacaattcaccctttgtactttatccattgcaaaatggctcagccccttgtaccgaactggtccccagggcagcagaaccagggtatctcgttacaaaagtggtcgcagttgacggggacagcggtcagaacgcatggttgtcctatcagctgctgaaagccactgagcccggcctgtttggcgtctgggcacacaatggggaggttagaaccgctcgtctgctgagtgagagagacgcagctaagcatcgattggtcgtactcgtgaaggacaacggggaacccccaagatcggccacagccacactgcatgtactgctcgtcgacggattctcacagccttatctgcctctgccagaagctgccccagcacaggcacaggccgattccttaactgtgtaccttgtggtcgctttagcctcagtaagcagcctatttctcttctccgtcttgttgtttgttgccgtgaggctttgtcggcggtctagagccgcatccgtgggcagatgctctgtacccgagggccccttccccggtcaccttgttgacgtgtctggcaccggaaccttgtcccagtcgtatcagtacgaagtgtgtttgaccggtgggtccgggaccaatgagttcaaatttttgaagccgatcatcccgaattttcaggttcacgataccggaaggaatatgggggagattgagaacttccgcaacagttttggactgaacattcagtag

SEQ ID NO: 131130 - DNA, 2382 bp, Artificial Sequence
  Description of Artificial Sequence: Synthetic coding sequence
atggaggcccgtgttgagcgggccgtccagaagcgtcaagtgttgttcttatgtgtgttccttggcatgtcctgggccggcgctgaaccactgcgctattttgttgctgaggagacagagcggggcacatttctgaccaatctcgccaaggacctggggctgggcgtcggcgagctgcgggccagggggacgcgcatcgtcagcgaccagaacatgcagattctgttactgtcttcgcttaccggggacctcttgctaaacgaaaaactcgatcgtgaagagctttgtggcccccgcgagccctgcgtgttgccctttcagcttctccttgagaaacctttccagattttccgcgccgagctctgggttcgagatatcaacgaccacgctccagtattcctggacagggagatatcacttaaaatactggagtcaaccactcccggggctgcctttcttcttgagtctgcacaagatagcgatgtgggcactaatagtctttccaattacacaatctctcccaacgcctatttccatatcaacgtacatgattcaggggaagggaacatctacccagagctggtactgaaccaggtcctagaccgagaggaaatcccggaattctcactgaccttaacagctctagacggagggtctccgccccggtcaggaacagctctggtgcggatcctggtgctggacgtaaacgataacgcaccggatttcgtacgctccttgtacaaggtgcaggttcctgagaactctccagttggaagcatggtggtgtctgtttccgcgagagatctggacacggggagcaacggtgagatcgcctatgccttcagctacgcaactgagagaatcttgaagacctttcagattaatcctacatctggcagcttgcatttaaaagctcaacttgattatgaagccatccagacctataccctgaccatccaggctaaagacggaggcggccttagcgggaagtgcactgtggtggtagatgtgacagacattaatgacaatcggcctgaactgctactaagtagcttgactagtccgattgcggagaactctccagaaactgtcgtggctgtatttcggattagagatagagacagtggtaataacggtaagaccgtctgttcaatccaggacgatgtgccctttatcctcaagccctccgtggagaacttttatactctggtcaccgagaagcctttagaccgtgaaaggaacaccgagtataatataactattaccgttacggaccttgggacgccacggcttaaaaccgagcacaacatcacagttctcgtgtctgatgtaaatgataatgcgcctgcttttacccagacttcctacactctcttcgtgcgggaaaataactcgcctgcattgcccattggcagtgtatcggccactgatcgggattctggaacgaatgcccaggtcatctactccctgctaccatcacaggatccacacctgccacttgcctccttagtcagtatcaacgccgataatggacacctgttcgccctccgctccttagattacgaagcactgcaagccttcgagttcagggtgggcgccaccgatcgcggctctcccgccttaagtagcgaagcacttgtaagggtgctagtgctggatgctaacgacaatagtccatttgtgctctacccactccagaatagctctgctccctgcacagagcctttacctcgggctgctgagcctggatatttggtgaccaaggttgttgctgttgacggggactccgggcaaaatgcatggttatcataccagctcttgaaggccacggagcccggcctgttcggtgtatgggctcataatggtgaagtgcgcacagcacgtctcctttccgagcgagacgccgcgaagcagcggcttgttgtgttggtgaaggacaatggcgagccccccagaagtgcaactgctacactccacgtcctactggtcgatgggttttctcagccatacctgaggcttccggaggccgcccccgatcaggcgaactctctcaccgtatatctcgtggttgctctcgccagcgtttccagcttgttcctgctctcagtgctactgttcgtcgcagtcagactgtgtcgcaggagcagagctgcaccagtggggaggtgctctgtgcccgagggccctttcccccggcaccttgtggatctgagcggaacgggcaccctgagccagagttaccagtatgaggtgtgtttaacaggcggctcaggaaccaacgagtttaagttcctaaaaccaattatccccaatctgctgccgcagtcaaccggaagggaggtcgaagaaaataggccgtttcagaataatttaggattctag

SEQ ID NO: 131131 - DNA, 2331 bp, Artificial Sequence
  Description of Artificial Sequence: Synthetic coding sequence
atggagattggttggatgcataacaggagacagcgccaggttctagttttctttgtcctactctccttaagcggagccggagcggaattggggtcatacagcgtcgttgaagagaccgaacgaggctcgtttgtcgccaatctcggcaaggacctgggcctgggcctaactgaaatgagtacccgaaaagcccggattattagccaggggaataagcaacacctacaacttaaagctcagactggcgatcttctgataaacgagaaactggaccgcgaggaactctgtggaccaaccgagccctgtattctgcacttccaagtcctcatggaaaaccctctggaaatcttccaggctgaactgagggtcattgatatcaatgaccattcaccaatgtttaccgagaaggagatgatactcaagattcctgaaaatagtccactggggacggagttccccctgaatcacgcgctggacctggacgttggtagcaataacgtgcagaattataagatcagcccatccagccatttccgtgtgctcatccacgagtttcgggacgggaggaagtatccggagctggttctggataaagagttagatagggaagaagagccccaactccggctgaccctcacagcgttggatggtggctcacccccacgctcaggtactgcccaagtcaggattgaggtggttgatatcaacgataacgcccccgagttcgaacaacctatatacaaagtgcagatcccagagaactctccgctcggcagcctggtggccacagtgagcgctcgcgatttggacgggggcgctaacggcaagatcagttacaccctcttccagccatctgaagacatcagcaagaccctcgaggttaatcctatgacaggagaggttagactccggaagcaagttgattttgaaatggtgaccagctatgaggttcgcattaaggcaacagacggcggtgggctgagtggcaagtgcacgctcctgctgcaggtcgtggatgtcaatgataacccaccgcaggtgacgatgtccgccctgaccagccccattccagagaactcccccgaaatagtggtggctgtgttctcggtgtccgatcccgacagcggaaataatggaaaaacaatcagcagcatccaggaagatctgccctttcttcttaagccatccgtcaaaaatttctacaccctggttaccgaaagggcactcgatagggaggctcgtgctgagtacaatatcacactgaccgtgaccgatatgggcaccccacggctgaagactgaacataacatcaccgtgcagattagcgacgtgaacgataatgcccccacatttacccagaccagctatacgctgtttgtacgtgaaaacaattcccccgcccttcatattggctctgtgagtgccactgaccgtgattctggtaccaacgcccaggtaacttattccctcctcccacctcaggacccacacctgcctcttgcatctctcgtcagcataaacgctgacaatggccacctctttgctctgagatctctcgactatgaagcacttcgagaattcgagtttagagtgtctgcaacagatcgcggaagtccagctctctcctccgaagccttggttcgggtgttggtcttggacgccaatgataacagcccgttcgtgttgtacccacttcagaacggaagtgccccgtgtaccgagctggtgccaagagctgctgagccaggctacctagttaccaaggtcgtcgccgtcgatggagattctggtcagaacgcgtggctgtcttatcagctcctgaaagctacggagcctggattgtttggggtttgggcccacaatggggaggtacgaaccgcccgcttgctgtcagagagggacgccgcgaagcagaggcttgtggttctggtgaaagataacggtgaaccccccagatcagcaactgccaccctgcatgtgttgctcgtagacgggttttcccagccattcctgcccctgccggaagcagcccctgggcagacacaggcaaactcgctgacagtgtatctcgtggtagcccttgcatctgtctcctcactcttcctgttttctgttcttctgtttgtggccgtgcgtttatgccggagaagcagggctgcctcggtcggcaggtgtagcatgccagaaggacctttcccaggaagacttgtggatgtcagcggtaccggcactctcagccagagctatcagtacgaagtgtgcctgaccggggggtccgagacgtcagagtttaaattcctgaagccaatcatacctaacttctccccctag

SEQ ID NO: 131132 - DNA, 2397 bp, Artificial Sequence
  Description of Artificial Sequence: Synthetic coding sequence
atggaagccggtgaggggaaggaaagggtgcccaagcaacgccaggtgttaatattttttgttcttctgggaatcgctcaggcttcatgtcagcctcgccactacagcgtagccgaagaaactgaaagcggctcttttgtcgccaacttattaaaggacctgggcctggaaatcggtgaactcgcagtgcgtggcgcgagggtggtaagcaaagggaaaaagatgcacctccagttcgaccgtcagacaggtgacttgcttcttaacgagaagctggatagagaggagttgtgcggcccaaccgaaccatgtgtgctgcccttccaagtgcttctcgaaaaccccctgcaatttttccaggctgagctacggatcagagatgttaacgatcattcgccggttttcttggacaaagagatcctgctcaaaattcccgaaagtattacacctggtactacgttcttaatcgaacgcgcccaggatctcgatgttggaaccaatagtttacagaactacacaatcagtcccaattttcatttccaccttaaccttcaggacagccttgatggcattattttgccacagctggtgctgaaccgggccctggacagggaagagcagcctgagattcgcctcaccctgaccgctctggacggtggatcgcccccacggagtggtacagctctagtaagaatagaagtagttgatattaacgacaacgtgcccgagttcgcaaaattgctgtacgaggttcagattccagaggacagtccggtaggctcccaagtagctatcgtcagcgcccgagacctggatatcggcacaaacggggaaatttcatacgcgtttagtcaggcatcagaagacatccgcaaaacgttcagactgtctgctaagtccggcgagttgttgcttagacagaaattggatttcgagtccatccagacatacaccgttaacattcaggcgaccgacggagggggcctatctggtacatgcgtggttttcgtacaggtgatggaccttaatgataatccccctgagctgaccatgtcaacacttatcaaccagatacctgaaaatctgcaggacaccctaatcgcggttttttctgtatccgaccccgatagcggcgacaacgggcggatggtgtgtagcatccaagacgatctccctttttttctaaaaccaagcgtcgaaaacttttatacacttgtgatctctaccgccctggacagggagacaaggtcagagtacaatattacaattacagttacagactttggtacacctcgactcaagactgagcacaacattacagttctagtctctgatgtcaatgataatgccccagcattcacccagacaagctacacattgtttgtgagggagaacaatagtcccgccctccacattgggtctgtttctgccaccgaccgtgatagtggtacaaatgctcaggtaacatatagcctgttgcccccccaagatccacacctgccactcgcaagtttagtaagcattaacgccgataatggtcatctgtttgctctccagtcactggactatgaagccttacaggcctttgagttcagagtgggcgccgccgacagagggtcccctgccctgagtagcgaggcactggtgagggtcctcgttctggacgccaacgacaactcaccgttcgtgctgtatcctctgcagaatggatcagccccatgtaccgagcttgtgccgcgggcagccgagccaggctacctcgtgaccaaagtggttgccgtcgacggcgactctggtcagaacgcgtggttgtcctaccagctgctgaaggccacagagccagggctcttcggagtgtgggcacacaacggagaagtgaggaccgctcggctcttacgcgagcgagacgctgccaaacagcgcctggtggtcctggtgaaggacaacggagaaccaccgaggagtgctacagctacgctccatgtgttactagtggatggattcagccagccttatcttctcctgcccgaggctgctcccgcccaggctcaagcagatttgctgacagtctaccttgttgtggccctcgcatcagtcagtagtctgttcctgttttctgtcctgttattcgtggcggtcagactttgcagacggagtcgggcggccagcgtgggacgttgcagcgtgccggaggggccgttccctggccagatggtggatgtgtccgggaccggcacattgagccagtcctatcaatacgaggtatgtctcacagggggatctggcaccaacgagtttaagttcctgaaacctatcataccaaacttcgtggcccagggggctgagagagtgtctgaggcaaacccctcatttagaaagagtttcgagtttacttag

SEQ ID NO: 131133 - DNA, 648 bp, Artificial Sequence
  Description of Artificial Sequence: Synthetic coding sequence
atgaacctggtgggtagttatgcgcaccaccaccatcaccaccacccacaccctgcgcacccaatgctgcacgaaccctttctgtttggccccgcttctagatgtcaccaggaacggccgtactttcagtcatggctgctgtctccagccgacgcagctcccgacttccccgcaggcggccccccgccggcagcagcagccgcagccacggcgtatggcccagacgctcgacctggccaatcacccggtaggctggaagcattggggggacgtcttgggcggcgcaagggttcaggccctaaaaaagagaggcgccgcactgagtcgatcaattctgcctttgccgagctacgagagtgcatcccgaacgtcccagccgacacgaaattgtcaaagatcaaaacccttcgcctcgccacctcatacatcgcgtatctaatggacgtactcgctaaggacgcacaaagcggcgaccccgaggcattcaaggctgaattaaaaaaggctgatggagggagggagtccaaacggaaaagggaactgcagcaacacgaaggctttccacctgctctcggcccagtggagaagcggataaaaggcagaactgggtggccacagcaagtgtgggcgttggaactgaaccagtag

SEQ ID NO: 131134 - DNA, 2388 bp, Artificial Sequence
  Description of Artificial Sequence: Synthetic coding sequence
atgaaaaaattgggccggatacaccccaaccggcaggtgctggcattcatcttaatggtctttctttctcaggttcggcttgagcctatcaggtactctgtgctcgaagagacagaatccggatctttcgtcgctcacctggcaaaggacctcggtctcgggatcggggagctggcgagtcggtccgcccgggtgctctccgacgacgacaagcagaggctgcagctagaccggcagaccggagatttgctcctgcgtgagaaacttgaccgcgaggagctgtgcggtcctattgagccctgtgttcttcactttcaagtttttctcgagatgcccgtgcagtttttccagggggagctgctcattcaagatatcaacgatcattcccctatcttcccagagagagaagtgctcctcaagatccttgagaattctcagccaggaacgcttttcccactgctaattgcagaggatctggatgtcggctctaacggactgcagaaatatacgattagtccaaatagtcactttcatatcctaacacgaaatcactctgaaggcaagaagtatccagaccttgtccaggataaaccactggatcgggaggagcagcctgagttcagtctgacactcgtcgcactcgacggcggttcaccccctaggtctgggactgtgatggtgaggatcctaataatggacataaacgataacgctcccgaattcgtgcacacgccatacggtgtacaggtgttggagaattctcccttagacagccctatcgtgagggtgttggcccgcgatattgacgcaggaaactttggctcagtcagttacgggctcttccaggcatctgacgagatcaagcagactttttccattaacgaggttaccggggagatacttcttaagaagaaattagacttcgagaaaatcaagagttatcacgtggaaattgaggccaccgatggtggcggcctgtccgggaaagggactgttgttatcgaagtagtggacgtcaacgataacccgccggagctgatcatcagctcgctgaccagttccatacctgagaacgcccccgaaaccgtggtgtccatttttaggatccgtgacagggactctggagagaacggaaagatgatttgctccatccccgataaccttcccttcatacttaagcctactctgaagaatttctatactctagtcacggaacgacctctggaccgggagaccagtgccgaatataatattaccatagctgtaacagatctggggacgccacggttgaagacacagcagaatataacagtgcaggtgtctgacgtgaacgacaatgcgcctgcattcacacagacctcttacactctctttgtgcgcgaaaataatagccctgccctgcacatcggctccgtgagcgccaccgaccgcgactctggaaccaatgcccaggttacatatagccttctgcctccccaggatccgcacttgcctctcgcctcacttgtgagcatcaacgccgataacggccatttgtttgccctgcgaagcctcgactacgaggctctacaggcctttgagttcagagtgggtgcctcagatagaggatcaccggcactgagctcagaggcacttgtcagggttctagtcctggatactaacgataacagtcccttcgttctttacccactgcagaacggcagcgcgccctgtactgagcttgtgccgagagccgcagagccaggctatttggttacaaaggtggtcgcagtggacggggatagtgggcagaacgcttggttgtcctaccagcttctgaaggccaccgagccgggactgtttggagtgtgggcgcacaacggcgaggtgcgtacggcgcgtctgctgtcggagcgggatgctgctaagcaccgacttgttgtgctggtgaaagataacggagaaccccccagatctgccaccgctaccctccatgtgctgctggtggatggcttttcccagccctacttgcccctccccgaagctgcacccgctcaggctcaggccgactctcttactgtgtatctggtggtggcgctggccagcgtgtcctcgctttttctgttctctgtgctgctgttcgtggctgtgcgcttatgccgaaggtctcgggcagcttccgttggcaggtgctcagtgccagaaggaccctttcctggtcatctggtagacgtgtcagggacaggcaccctctctcaatcatatcagtatgaggtttgtttgacaggcgacagcggcacaggtgaatttaaattcctcaagccgattttcccaaacctgcttgttcaggataccggacgcgaagtcaaagaaaaccctaaattccggaatagcctggtgttttcatag

SEQ ID NO: 131135 - DNA, 2391 bp, Artificial Sequence
  Description of Artificial Sequence: Synthetic coding sequence
atggaagctggtggggaacgcttcttgaggcagcgacaagtcctcctcctattcgtgttcctcggagggtccctcgctggatctgagagcagaaggtattcagtcgccgaggagaaagagaaaggtttcctgatcgccaatctggcgaaagacttgggactgagggtcgaagagttagctgcccgcggtgcccaagtcgtgagtaaaggtaacaaacaacatttccagctgtctcaccagaccggtgatctgctgctgaacgaaaaactggaccgggaggaactgtgtggccctaccgagccatgcatcctgcatttccagatactgttgcagaacccacttcaatttgttaccaatgagctccggattattgacgttaacgatcatagccccgtgtttttcgaaaatgagatgcatctcaaaatattggaatcaaccctgcccggaacagtcattcccctcggtaatgccgaggaccttgacgtcggcaggaattctcttcaaaactataccattactccaaactctcacttccacgtccttacaaggagccggcgggatgggagaaagtacccagaattagtactggacaaagccctggacagagaggaacagccagagttgagcctaactttgaccgccctcgacggaggtagccctcctaggtctgggactgcccagatcaacattcaggtgctggatatcaatgacaatgcccccgaattcgcgcaaccactgtatgaagtagccgtcctggagaacaccccagtgaacagcgtgatagtgacagtgtccgcctccgatctggatactggcagtttcggaacaatctcttatgcctttttccatgcttccgaagagattcgcaaaacatttcagttaaatcctattaccggtgacatgcaacttgtgaagtacctgaatttcgaggccatcaacagctacgaagtggacatcgaggccaaggatgggggaggccttagtggtaagtccaccgtcattgtccaggtggtggacgtcaatgataatccccctgagctgaccctgtccagtgtcaattcccccatcccagaaaactccggcgaaacagtgctcgccgtcttctcagtctccgacctagatagcggggataacggaagggttatgtgcagtatcgaaaacaatcttccattctttctgaagccctcagtggagaacttttacactttggtgtccgagggtgccttagatagagagaccagaagcgagtataatatcacaatcaccattaccgatctcggtaccccgcgtctgaaaactaagtataatataacagtgctggttagcgacgtgaatgataatgcacccgcttttacgcaaatctcttacacactatttgtacgggaaaataatagccctgccctccacatcggctctgtgagcgcaactgaccgggatagtggcaccaacgctcaagttacttatagcttgcttcccccacaggaccctcacctgccattgtcgagcttagtcagcattaacgcggataatgggcacctgtttgcactgagatctctggattacgaagcgctccaagcctttgagttccgagtgggggctacagaccgaggtagccccgcactttcatccgaagctctcgtacgcgtgctcgttcttgatgctaacgacaattctccattcgttctgtaccccctgcagaacgggagcgcgccctgcacagaattggtaccgcgggctgcggagccaggatatctcgtaacaaaagttgtggcagtggacggggattctggtcagaacgcgtggttatcataccaactgttaaaggctactgagccaggtcttttcggggtgtgggcgcacaacggagaagtcagaacggcccgcttactgagcgaacgtgacgcagccaagcatcgattggtagtgctggtcaaggacaacggagagcctccgcgctcagcgaccgcgacattacatgtgctcctcgtggacgggtttagtcagccctatctgccactcccggaggccgcccctgcccaggcccaggctgacctgcttacagtatatttagttgtggccctggcaagtgtgagctccttgtttctcttctccgtcctgctgttcgtggcagtgcggctgtgccgccggtctagggctgctagtgtgggccggtgcagcgtgcccgagggcccttttcccggccagatggtcgatgtgagtggaacaggaactctgagccagagttatcagtacgaagtctgcctaaccggaggaagcggaactaacgagtttaagttcctgaaaccaattatccccaatttcgtcgctcagggggcagaaagggtgagcgaggctaacccgtccttcaggaagtccttcgagtttagctag

SEQ ID NO: 131136 - DNA, 1107 bp, Artificial Sequence
  Description of Artificial Sequence: Synthetic coding sequence
gggggagctccccctcggtccggcacaactactataaggatagtggtgctggataacaatgataatgcaccagaatttctgcaaagcttctacgaagtgcaagtgccagagaacagtccgctcaactccttggtcgtggtggtatcagctcgagatctagacgccggagcttatggctcagttgcatacgccctctttcagggggatgaagtgactcagcctttcgtgatcgacgaaaagactgccgaaattcgcttgaaaagagcactagactttgaggccaccccctattacaacgtagagatagtggcaaccgatggaggtgggttatcaggcaaatgtaccgtggccatagaggtggtcgatgtgaatgacaacgctcccgagctgacgatgagcaccctgtcgtctcccacgcccgagaatgcaccagaaactgttgtagccgtcttcagcgtgagcgaccccgattccggcgataatggacggatgatttgctctatccagaatgatcttccctttctgctcaagcccactctgaaaaacttctacacactggtgactcagcggacactggatagagaaagccaggccgaatataatatcaccattacagttaccgatatggggacacctaggctcaaaacagagcataatatcacagtgttggtgtccgacgtgaacgacaacgccccggccttcacacagacctcgtacactctcttcgtgagggaaaacaacagcccggctcttcatattgggagcgtgtcggccactgatagagatagcggcacgaacgctcaagtgacttactcactgctgcctccgcagaatccgcatctgcgcctagcgagcctcgtctcaattaatgcggataacggtcacctgttcgctctccggagtctggactacgaggctctccaggccttcgaattccgcgtcggcgcaacggaccggggctcccccgcactgagttctgaagccctcgttagggttttgtgctggactcccacgacgacgcgtccatcttgctgcatccgttgccgcactgcccgaaggttagcccctagctggtgccctgggagaccatcccgggcgacgtggtag

SEQ ID NO: 131137 - DNA, 2388 bp, Artificial Sequence
  Description of Artificial Sequence: Synthetic coding sequence
atggaaaccgctcttgctaaaactccccagaaacgccaggtgatgtttttggctatcttgcttctcttatgggaggccggcagcgaggctgttcggtactctattcctgaggaaacggaaagcggatactcagtagcgaatctggcgaaagacctggggttgggagtaggcgagttagcaacaaggggggcaaggatgcactacaagggtaataaggaacttctccaattggatattaagactgggaacttactactgtatgagaagttggatcgcgaggtaatgtgcggcgctacggagccatgtatattgcatttccagctgttattggagaatccagtccaattcttccagaccgatctgcaactcacagacatcaacgaccacgcacccgagttccctgagaaggagatgctcttgaagatccctgaaagcacccaaccagggaccgtctttccactcaaaatcgcccaggactttgatattggcagcaataccgttcaaaattacaccataagcccgaacagccacttccatgtggcgacccacaaccgcggagacggccgtaaataccctgagcttgtcctagataaggccttggatcgcgaggaacgccctgaattaagcctgacactgacagctctggacggcggagcgcctccccgtagcgggactaccactatccgtatcgtcgtgctggacaacaacgataacgcacctgagttcctgcaaagcttctacgaagtgcaggtccctgagaactccccgctgaactccctggtggtagtggtcagcgcaagagaccttgatgctggcgcatacggtagcgttgcatacgcactatttcaaggcgacgaagtgacgcagccttttgtgattgatgagaagacagcggagattcggcttaagagagcgctcgactttgaggctaccccttactataacgtcgaaatcgtggcaacggacggcggcggtctgagcggcaaatgcaccgtggcgattgaggtggtggacgtgaacgacaacgcaccagaactcactatgtctacactgagctctcccaccccagagaatgccccagaaacggtcgtggcagtgttttctgtctccgatccagactctggggacaatggaaggatgatctgcagtattcagaacgacctaccctttctgcttaagccaacactcaagaacttttatacacttgtcactcagcgtactttagaccgagagagccaggccgagtacaacattaccatcacagtcaccgacatggggactccaagactgaaaaccgaacataatattaccgtcttggttagcgacgtcaatgacaatgcccccgcgttcacgcaaacatcttatactttgtttgttagagaaaacaacagtccagccctgcacattggtagtgtcagtgctactgacagggactcaggcactaatgctcaggttacgtattccctgttacctccacagaatccccacctgcggctcgctagcctggtgtctatcaacgcagataacggtcacttgttcgcccttagatctcttgattacgaggctctccaggcattcgaatttcgcgttggtgctactgatcggggaagcccagccctttcctccgaggccctggtgagagtgttggtgctcgacgcaaatgacaatagcccatttgttctctatcctttacagaatggaagcgccccttgcacggaattagtcccgagagcggccgaacccggctatttggtcaccaaggtagtggcagtggacggggatagcgggcagaatgcttggctgtcataccagcttttgaaagccacggaacctggcctgtttagtatgtgggctcacaacggcgaagtccgcaccgctaggctcctgagcgaacgggacgccgctaagcaccggctggtcgttttggtcaaggacaatggcgaacctcccaggagcgccaccgccaccttacacgttctcctagttgacgggttctcccagccttacctgccactgcccgaggccgccccggcccaggctcaggctgattcactgaccgtgtatttggtcgtggctttggcaagtgtgtcgagcctgtttctgttctctgtcctgcttttcgtagccgtgcgactgtgccgaagatctcgagcagcctccgttggccgttgcagcgtaccagagggtcccttccccggtcatttagtagatgtttccggcacaggcacactgtctcagtcttaccattacgaggtgtgcctcacaggcgacagtggcgctggggagttcaagttcttgaaaccaatcattcccaatctcctcccccagggggccggtgaagaaatcgggaagacggcagcgtttaggaattcatttggattgaattag

SEQ ID NO: 131138 - DNA, 1107 bp, Artificial Sequence
  Description of Artificial Sequence: Synthetic coding sequence
ggtggcagtccgccgcgctccggtacgtctgaaatccagatccaagtgctggatatcaacgacaacgtgccagaattcgcgcaagagctctacgaagcacaggttccagagaataaccccctgggatccctggtaatcactgtttcagccagagacttagatgcaggctcatttggtaaagtgagttacgctttgttccaggtcgacgatgtcaatcagcccttcgaaatcaacgctatcaccggcgaaattcgcttgcggaaggcactcgatttcgaggagattcaatcttatgacgtggatgtggaagccacggacggggggggcctgagtggcaaatgcagtcttgtcgtgagggtgctagacgtcaacgacaacgctcccgaacttacaatgagctttttcatatcacttattcctgaaaacctgccggagattaccgttgccgttttctcagtcagcgatgccgacagcgggcacaaccagcaggtgatctgctcaattgaaaacaaccttccatttcttttacgccccagcgtggaaaatttctatacgctggtcaccgagggcgccctggatcgggagtctagagctgagtacaacattactatcacggtgacggatctggggacacccaggctcaaaacccagcagtctatcaccgttcaggtgagtgatgttaatgacaacgtgccagcgtttacccagacctcttacacactgtttgtccgcgaaaacaactcccccgctctccacattggatccgttagcgctaccgacagggattcaggtatcaatgcccaagtcacatacagcttacttcctccccaagatccccaccttcccctaagcagcctagtgagtatcaacgcggataacgggcacttattcgccttgagatctctagattacgaggcgctgcaatcattcgaatttcgggttggagccacagacaggggcagcccagctctttcctctgaggcacttgtcagactcctgtgctggactccaaccaccactcggcccagctgttgtactaggtgcaggactgctcccagaccagccccaagctggtgcccagggaggccttctcgagctacctggtag

SEQ ID NO: 131139 - DNA, 1977 bp, Artificial Sequence
  Description of Artificial Sequence: Synthetic coding sequence
atgctactgaaaatttccgagatcacaatgccgggtaaaatatttccgctcaaaatggcccacgatctggacacgggcagcaatggcctgcagagatataccataagctcaaacccccatttccatgtcctcacccggaatcgcagtgaaggaaggaaattccccgaacttgtcctggacaaacctttagatcgggaagaacagccccagctgcgcctcacgttgatagctctggacggcggctcaccaccgagatcaggcacctccgagattcagatacaggtactggacatcaacgacaatgtgcccgaattcgctcaggagctgtatgaggcccaagtgcccgagaacaaccctttgggtagcctggtcattacagtaagtgcaagggacctggatgcagggagctttggcaaagtgtcgtacgctctgttccaagtcgatgacgtgaatcagccattcgagatcaacgccatcacaggggaaattagattgcgcaaggccttggattttgaggagatccagtcttacgatgttgatgtcgaggccactgacggcggtggcctgagcgggaaatgctcccttgtggtgcgggtcctggatgtgaacgacaacgctcctgagctgaccatgagctttttcatcagcctcattcccgaaaaccttcccgagattaccgttgcggtcttctcagtgagcgacgctgattccggccataatcaacaggtcatctgttcaatcgagaataatctcccattcctgctgaggccctcggtagaaaatttctacaccttagtcacggagggggccctcgacagggagtctagagctgaatacaatatcactattaccgtgacggatctgggcaccccccgcttaaagacccagcaatccatcacggtgcaggtttctgacgtgaacgacaacgtcccagccttcactcagactagctacaccctgtttgtcagggagaataactctccggccttgcatatcggatctgtgagcgcgaccgatagagattctggcataaacgcacaggtgacctatagccttttaccaccacaggacccacatctccctctgtcttccttggtttcaataaacgcagacaacggccatctttttgcgctccgaagcctggattacgaggctctgcagtcttttgaattcagagtgggggcaacagacaggggatccccggctctttcctccgaagcgctggtgcgcctgttggtgttggatgccaatgacaactctccctttgtgctgtaccccctacaaaacggcagcgccccttgcaccgagttggtgcccagggcagccgagcccggatatctcgtgactaaggttgtggctgtagacggggatagtggacagaacgcctggctaagttaccagctccttaaagcaacagagctgggcctgttcggagtctgggctcacaacggcgaggtcagaaccgcgaggttgctgagtgaaagagacgcagcaaaacatcggttggtcgtcctggtcaaagataacggggaacctcctagatccgccacagccacactgcatgtactgctagtggacggattcagccagccttacttacctcttcctgaggcggctcccgcacaggcacaagccgattccctcacggtctatctagtggtggctctggcctcggtctcctcactgtttctgttcagcgtgctattatttgtggcagtgcggctatgcagaaggtcaagggctgccagtgtgggaagatatagcgttccagagggaccatttcctgggcaccttgtggatgtatccggaaccggaacactgtcccagtcctatcagtacaaggtgtgcttgaccggaggttcagagaccaacgagtttaaatttctcaaacctataatgccaaattttcctccccagggtacagagcgcgagatggaggagaccccaaccagtaggaattcgttcccgttctcttag

SEQ ID NO: 131140 - DNA, 2385 bp, Artificial Sequence
  Description of Artificial Sequence: Synthetic coding sequence
atgatgcaaacaaaggtccagaataagaagagacaggtcgcgttttttatcttgctcatgctttggggggaggtcggaagtgagtcaattcagtactcggttctcgaggaaacagagtcagggaccttcgtggcaaatctcaccaaagatttgggcctgagagtgggagaactggccagcagaggtgcacgggtggtgtttaagggaaatcggcagcatttacaatttgatcctcaaacccacgacctgctgctcaacgaaaaactggatcgggaagagttgtgcgggagtaccgagccttgtgttcttccttttcaagtcctgcttgagaaccctttacagttttttcaggcaagtctgcgtgtgcgggatatcaatgaccatgcccccgaattccctgccagggagatgcttctaaagatttcagaaatcacaatgccaggtaaaattttccccctgaaaatggcccacgacttagatacaggatccaatgggcttcaacggtacacaatttcaagcaatcctcacttccacgtcttaacgaggaatcgcagcgagggcagaaaattcccagaactcgttctggacaagccactcgaccgagaggaacagccacagttgaggctaacccttatcgcccttgatggcggatctcctccgcgatctggtacttccgagattcaaattcaggtcctggatataaacgataatgtcccggaatttgcccaggagttgtatgaagcccaggttcccgaaaacaaccccttgggcagcctcgttatcacggtgtctgcgcgagatctggatgccggatcattcggcaaggtttcttatgccctgttccaggtggacgacgtgaatcagccattcgagatcaacgccatcactggtgagatccgccttagaaaggccttggacttcgaggagattcagtcctatgacgtggacgttgaagccacagatggcggagggctgtccgggaagtgctcacttgttgtgagagtgctggacgtgaacgataatgcccccgaactgactatgtccttttttatctctctcatccctgaaaacctgcctgaaattactgtcgcagtctttagtgtctccgacgccgactccgggcacaatcaacaggtgatatgttccattgaaaataacctcccttttctcctccgtccatcggtcgagaacttctatactctggtaaccgagggcgcgctggaccgagaatctcgcgcggagtacaacatcacgatcacagtgacggacctgggcacgcccaggctgaagacacagcagtctattacagtgcaggtttctgatgtcaatgataacgtgccggcctttacacaaacttcgtatacattgttcgtaagagagaataactctcccgcccttcacatcgggtcagtgtctgccaccgaccgggactcaggcatcaacgctcaagtcacatacagcttactgccaccgcaagatccacatctgccgctaagtagcctagtgtctatcaacgctgataacgggcatctgtttgcattgagatccctggattatgaggccctccaatcttttgaattcagggtgggagctaccgacagagggagtccggcactgtcatcggaggccttagtgagattattggtgcttgatgccaatgacaattcccccttcgtcctgtaccccctccaaaacggaagcgctccctgcacggaactagtgccacgcgcagctgaacctgggtaccttgttacaaaggtggtggctgtggatggggatagcggccagaatgcctggctgtcttaccagttacttaaggccacagagctcggcctgtttggagtgtgggcccacaatggagaggtacggacagctcggctcctctccgaacgcgacgccgctaaacaccggcttgttgtgttagtgaaagacaacggagaacctccgaggtccgccactgctaccctccacgtgctgctggtggacgggttcagtcagccataccttccgcttccagaggctgcacctgcccaggcccaggcagattccttgactgtgtaccttgtagtggcattggcaagcgtctcgtccctgttcctattctccgtgttactgttcgtggcagtgcgcctgtgccggcgctctcgcgccgcctctgtggggcgttattcggtgcctgagggcccatttcctggtcacctcgtggatgtgtcagggactggaaccttgtctcagtcctatcagtacaaagtgtgtctgaccggtggcagcgaaaccaacgaattcaaatttctaaagccaataatgcctaactttccccctcaggggaccgagagggaaatggaagagacaccaacttccaggaactcatttccattctcttag

SEQ ID NO: 131141 - DNA, 1107 bp, Artificial Sequence
  Description of Artificial Sequence: Synthetic coding sequence
gggtctccccccagaagcggtaccgcactcgtacgaatattggtgctggatgtgaatgataacgctccggactttgtgaggtcactctataaggtgcaggtccccgaaaattctccggtcggttcgatggttgttagtgtgtcggcacgcgatctagataccggatccaatggggaaattgcatatgctttttcttatgccacagagcggatactcaaaaccttccagattaaccctacctctggatctctgcacctgaaagcccagctcgattatgaggctatccagacctatacacttacaattcaggcgaaagacggaggcggtttgtccggcaaatgtacagtggtagtggacgtgacggatatcaacgataatagacctgagctgctcctcagttcgctgacaagcccaatagcagagaactcaccagagacggtagtggccgtgttcagaatcagggacagggattcgggaaataacggaaagacagtttgtagcattcaggatgatgtgccattcatcctgaagccttcagtcgaaaatttttacacactagtcacggaaaaacctctggatcgcgaaagaaatactgaatataacataactatcaccgtgaccgacctaggaacccctaggctgaagacggagcataacattacagtgctggtctccgatgttaacgataatgccccagcctttacccaaacatcttacaccctcttcgtcagagagaataacagtcctgccctacccataggatccgtctctgcgaccgatagagatagcggcaccaatgcacaagtaatctatagtctcttaccgtctcaagatccacatttacctctcgcttcccttgtgagtattaacgctgataatgggcatctttttgcactgagaagcctggactatgaggctctgcaagctttcgagtttcgcgtcggcgcgaccgataggggtagtccagcattaagctcagaggctctggtgcgcgtgttgtgttggacacctactacaactcgcccctcatgctgcacacggtgccgtacagccccaagaccagccccatcccgctgccctggccgtccctcccgggccacctggtag

SEQ ID NO: 131142 - DNA, 2406 bp, Artificial Sequence
  Description of Artificial Sequence: Synthetic coding sequence
atggaggcttcagggaaactgatatgtcggcagagacaggtgcttttctcatttctcctcctcggcctgtcattggccggggcagccgaacctcgctcttacagcgtagtcgaggagacggaaggaagttcttttgtaacaaacctggccaaggatctgggtctggaacagagagagtttagccgacggggtgtccgggtggtatctagagggaacaagctccacctgcaactcaaccaggaaacggccgatctcctgcttaacgagaagttggacagagaagatctgtgcggccatacagaaccatgtgtgttgaggttccaggtgctgctcgagtctccttttgagttttttcaggctgaacttcaagtgatcgacatcaacgatcatagtcctgtgtttttagataagcagatgctggtgaaggtgtccgagagcagcccacccgggactgctttccctctcaagaatgccgaagatctggatatcggccagaataatattgaaaattatattatctcgcctaatagctatttccgagtcctgaccagaaagcgcagtgacggccgaaagtacccagaattagtcttggataaagcattggatcgggaggaggaggcggagcttcggcttaccctaactgccctggacggaggaagcccgccacgatctggcaccgcacaggtgtacatcgaggtggtggatgtcaatgacaacgcacccgaattcgagcaacctttctaccgtgttcagatcagcgaggactcccctatatctttcttggtggtgaaagtgtccgctactgatgtcgacacaggtgtgaacggagaaatttcctattcactttttcaagcttccgacgagatcagtaagacattcaaagttgattttctgaccggcgaaatccgcctaaagaagcaattggattttgaaaaatttcaatcttacgaggttaacatcgaggcccgggatgcaggtgggttcagcgggaaatgcaccgtgttaattcaggtgatcgacgtcaacgaccatgctccagaggtaactatgagcgcttttaccagtcccatccctgagaacgcacccgagactgtggtggctctctttagcgtcagtgatctggattccggagaaaacggcaagatatcctgctccatccaggaggaccttccttttctcctcaagtcctccgtaggaaacttttacacactgctgactgaaacacccctcgatcgtgagtcccgggcagaatacaacgtcaccattaccgttacggacctgggcactcccagactgactactcacctgaatatgactgtattagtgagtgatgttaatgacaacgctcctgcattcacccagactagttacacactttttgtacgggagaacaatagtcccgccctgcatattgggagtgtgagtgctactgaccgcgatagcggtaccaatgcccaagtcacgtacagtctcctccctccccaggaccctcatctgcctctcgcctctcttgtatcaattaataccgataatgggcatctgtttgcattgcggtcccttgactacgaggcactgcaggcatttgagttcagggttggggcttccgatcgaggctcaccagcattgagcagcgaggcgttagttagggtgttggtgctcgacgctaacgacaattccccctttgtactgtaccctctccagaacggtagcgccccctgcactgaacttgttcctcgagcagccgaacctgggtacctcgtcaccaaggttgtggccgtcgacggcgactcgggccaaaatgcttggctgagctatcaactgttaaaggcaacagaaccgggactattcggcgtgtgggcgcataatggggaagttagaacggcacggctcttaagcgaacgcgatgccgccaaacagcggctggtggtactggtgaaggataatggagagcctccttgttccgccactgccacacttcacctgttgttagtggacggcttcagccagccgtaccttcctttgcctgaggcagccccagcccaaggacaggccgactcactcacagtttatctcgtcgtcgctttggcatcagtatcctccttgttcttgttcagtgtgttgctattcgttgccgtgctcctctgtcgcagatctcgtgcagccagcgtgggtagatgcagtgttccagagggtcctttccctggccatctcgtcgacgtgcgaggtacgggatccctgtcacagaactaccagtacgaagtatgcttagcagggggctcggggaccaatgagttccaattccttaagcctgtactgcccaacattcaggggcactccttcggccccgagatggagcagaactctaactttcggaatgggtttgggttctccctccaactgaagtag

SEQ ID NO: 131143 - DNA, 2472 bp, Artificial Sequence
  Description of Artificial Sequence: Synthetic coding sequence
atgaaaattcagaaaaagctgacaggatgctctagactgatgctcctgtgcctctctctcgaactccttctcgaggccggagctggcaacattcattactccgtgccagaggaaaccgacaaaggctcctttgtcgggaatatcgcgaaggatcttggcctgcagccccaggaactcgcagatggcggggtacgaatcgtctccaggggacgtatgccattgtttgccctgaatccaaggtcgggctccctgatcaccgctagacgcatcgatagggaggagctttgcgctcagtctatgccctgtctcgtgtctttcaacattttagtggaggataaaatgaagctcttccccgtcgaagtggaaattatcgatataaacgacaacacccctcagtttcagctggaagagctggagtttaaaatgaatgagatcacaacgcccgggacgcgcgtatccctcccttttggccaagacctggatgtgggcatgaacagtctgcagtcatatcagttaagttctaatccccatttcagtctcgacgtacagcagggggcggacggcccacaacatcctgagatggtgcttcagtcccccctagacagagaggaggaggccgtgcatcatctcatactcacagccagtgacgggggagagcctgtcaggagtgggaccctgcggatctatattcaagttgtagacgccaatgataaccccccagctttcacgcaggcacagtatcatatcaatgtgcccgaaaacgtccctttgggtacccaactcctcatggtcaacgccacagatccagacgaaggcgcaaatggcgaagtgacgtatagcttccacaacgtggatcatagagtggcccagatatttaggcttgacagttacacaggagaaatcagtaacaaagagccgctggattttgaggaatacaaaatgtatagtatggaggttcaagctcaggacggagctgggctgatggctaaggtgaaggtgttaattaaagtgttggacgtcaacgataatgcgcccgaagttaccattacatcagtcacaacagccgttccagagaacttcccaccagggactatcattgctctaatcagtgtgcatgatcaagacagtggggacaatgggtatactacatgttttattcccggcaacctgcctttcaaactggagaagcttgtcgacaattactatcgcctggtgactgagcgaaccctggaccgcgagttgatcagcggatacaatataaccatcaccgcgatcgatcaagggactcccgccctgagtacagagacacatattagcctgctggtgacggatattaatgataacagtccggtctttcaccaggattcctatagcgcttatatcccagagaacaacccgcggggtgctagtattttctctgtgagagcccatgatctggattcaaatgagaacgcccagatcacatacagccttattgaggacactattcagggcgctcccttgtccgcctacttgtccattaacagcgataccggcgtgctctacgctctgcgatcgttcgactacgagcagtttcgcgatatgcagttaaaggttatggcccgggatagcggcgatcctcccttgagctccaacgtgtctctcagtttgttcctcctggaccaaaatgataatgcccccgaaatcctctaccccgcgctgccgactgacggctctacaggagtcgagttggccccactttccgctgagccagggtacctggtcacgaaagttgtggccgtagacagggacagtggccagaatgcttggctctcttaccggctcctgaaggcttccgagcctggattgtttagcgtcggcctccatactggggaagtccggaccgcaagggctctgctcgacagagacgcactgaaacagagtctggtggttgctgtacaggaccacggacagccacccctgagcgcaaccgtgactctgactgtcgcggtcgcagatcggatctcagatattttggcagatctgggctcccttgagccgtccgctaaacctaatgactctgacctgacactgtaccttgttgttgctgccgcagccgtgtcttgtgttttcctggccttcgttatagtgttgttggctcacagactaagaaggtggcacaagagccggctcttacaggcatccggcgggggactcgcctccatgccgggatcacacttcgtgggagtggacggtgtgcgagctttcttgcagacatacagccacgaagtatcactgacagcagattccagaaagtcccatcttatctttccacagcccaactatgctgacaccctgatcagtcaggaatcatgtgagaaaaagggattcttaagtgccccgcagagcctcctggaggataaaaaagagccgttttcacaggttaacttctgtgatgagtgtatttcttacctcgagaagaataattcctag

SEQ ID NO: 131144 - DNA, 2796 bp, Artificial Sequence
  Description of Artificial Sequence: Synthetic coding sequence
atgaaaattcagaagaagctgaccggatgtagtagactcatgctcctgtgcctttcactggagctcctcttagaagccggcgcggggaacattcactacagcgtgccggaggagactgataaggggtcatttgttggaaatattgcgaaagacctcggactgcaaccccaggaactggcagacggcggcgtgcggattgtttctcggggaagaatgccactgttcgctctgaatccgagaagcggctccctgatcacagcccgcaggatcgatcgagaagaattgtgtgctcagagcatgccgtgtctggtttcctttaatattctagtagaggacaagatgaagttgttcccagtcgaagtggagattatcgacattaatgacaataccccacagtttcagctggaggaactggaattcaagatgaatgaaatcactacgcccggaacccgcgtgtccctgccatttggccaggatctcgacgtaggaatgaattcactgcaatcttatcagctcagctctaacccgcattttagtctcgatgtccagcaaggtgctgatggcccgcagcaccctgaaatggtgcttcagagtccgctggaccgggaagaggaagctgtacaccacttgattctcaccgccagcgatggaggggagcccgtgcgttccggcaccctccggatctacatccaggtggtggacgctaatgacaatcctcctgcctttacacaggcccagtatcacatcaacgtccccgaaaacgtgccgctggggacacagttactgatggtcaacgccaccgacccagacgagggcgccaatggcgaggttacctatagcttccataacgtcgaccatagagtggctcaaatctttcgactggattcctacacgggcgagatctcaaataaagagcccctagatttcgaagagtacaaaatgtatagtatggaggtgcaggctcaggacggtgccggtctgatggcaaaagtcaaggttctcataaaggtgctggacgtgaatgataatgctccagaagtcaccatcacttcagttactacagccgtccccgagaacttccctccgggcaccattatcgccctcatctctgtgcatgatcaggatagtggagataacggctataccacatgttttatccctggcaacctcccattcaaactagagaaattggtcgacaactactacaggcttgtcacagagcgcacccttgaccgcgagttgatctcgggttacaatatcacgatcaccgcgatcgaccaaggaacgccagcgcttagcacagaaacccacatttctttgctggttacagatattaacgacaatagccccgtattccaccaggatagttactccgcatacattcccgagaataatccaagaggggcctctattttctcggtgagggctcatgatctggactctaacgaaaacgcacagatcacgtatagcctgatcgaagacactatccagggggcacctctgtccgcttacctgtctattaactcggataccggggttttgtacgctctgcgctcattcgattacgagcaatttcgtgacatgcagctgaaggtcatggcgagagacagcggcgatcctccactcagttccaatgtaagtctcagcctgttcctgctggaccagaacgataacgcccccgagattctgtatccagccctaccgaccgatggctccacaggcgtggaactcgcccctctaagcgctgagcctggctacttggttacaaaggttgtggctgtggatagagactccggtcagaacgcctggctgtcttaccgcctgttgaaggcctccgagccaggtttgttctctgtaggtttacatactggcgaagtaagaactgcaagggccctacttgatcgggacgcactcaagcagagcctcgtggtggcagttcaggaccacggacagccaccgctctctgccaccgttacactgactgtggccgtggctgatcgcatcagcgatatcctcgcagatcttggcagcttagagccctcagcaaaacctaatgacagcgacctaacgctctatctcgtcgtagcggccgcggccgttagttgcgtatttttggcattcgtcatagtgctgctggcacaccgcttgagaagatggcacaaaagcaggcttttacaagccagcggtgggggcctcgcttcaatgcctggatcacacttcgtcggagtggatggcgtgagggcattcttacagacttattctcacgaggtgtccttaaccgccgacagtcgcaagagccatctgatttttcctcagcccaactatgccgacaccttgatttctcaggaatcatgcgagaaaaaagggtttttatccgccccccaaagtctactggaagacaaaaaggagccgttctcacagcaggccccccccaacaccgattggagattttcccaagcccagcgcccgggcacttcaggtagtcaaaatggcgacgatacgggaacatggccaaacaaccagtttgacaccgaaatgttgcaggctatgattctggcctccgccagcgaggccgccgatggctcttcgaccctcggcggcggggcggggacgatgggtctgtccgctcgctatggaccgcagtttacccttcaacatgttccggattatcgacagaacgtttacatccctggcagtaatgctacactaacaaatgccgcagggaaaagagatggaaaggcgccggctggagggaatggtaataaaaagaaatctggcaaaaaagagaaaaagtag

SEQ ID NO: 131145 - DNA, 2811 bp, Artificial Sequence
  Description of Artificial Sequence: Synthetic coding sequence
atggccgcccagcgaaaccgcagcaaggaaagcaaggattgttcgggcctggtgttactgtgcttgttcttcggaataccatgggaagccggagcccgacagatttcttattcaattcccgaggaactggaaaagggaagttttgtgggaaacataagcaaagatctgggcttggcaccccgggagttggccgagcgcggcgtgagaattgtatctcgcggacgaacccagctgttctccctgaacccaaggtctggctccctgataaccgcagggcgtatcgatcgggaagaactgtgcgcacagtcggcccgctgcgtggtgtcgtttaatatcctggtggaggatcgcgttaaactcttcggcatcgagatcgaggtgactgacatcaatgataacgcccccaagtttcaggctgagaaccttgacgtgaaaatcaatgagaacgtagctgccggaatgcgcttccctctcccagaggccattgacccggatgtaggggtcaattcattgcaaagttatcagttatctccgaacaagcacttcagtcttcgcgtgcagagccgggcgaacggggtaaagtaccctgagctcgttctggagcattccctcgatcgggaagaggaggccattcaccatctggtgcttaccgcctctgatggcggagatccgctgcgcagtggtactgtgcttgtgagcgtcactgtgttcgatgcgaatgataatgccccggtgttcaccctccctgaatatcgggtaagcgttccagagaacttaccagtgggcactcagctgctgactgttactgcaacagatagggacgagggcgccaatggggaggtaacatactcatttagaaagctgcccgacacacaactgctgaagttccagctgaataagtacacaggggaaattaaaatttctgaaaacttagactacgaagaaactggcttctacgagatagagatccaagctgaggacggcggagcttacctggctactgcgaaagttctaattacggtggaggatgtcaacgataattccccagagctgacgattaccagtctcttctctcctgtcacggaagactctcctttgggaaccgtggtcgccctgttaaatgtccatgacttggattctgagcagaacgggcaggtaacttgctctatcctggcctatctcccattcaaacttgagaaatccattgatagctactacaggctggttatccaccgcgctctggatagggaacaggtctcctcatacaatattacagtcaccgcaacagatgggggcagcccgcccctctctactgaagcccactttatgttgcaggtggcagacattaatgacaacccccctaccttttctcaggtctcctattttacatacatccccgaaaataatgccaggggagcgtctattttttctgtgaccgctctggatccagactctaaggagaatgcacagattatctattcgctagcagaggacacaattcagggggttccgctatcaagttacatcagcatcaacagcgatacaggcgtgttatatgccctacgctctttcgattacgagcagttccacgaactgcagatgcaagtaactgcctcagattccggcgacccccccctctcctctaatgtgtccctctctcttttcgtcctcgatcaaaacgacaacgctcctgagatcttgtaccctgcacttccgactgatggcagcacaggtgttgaactggccccgagaagcgcagagccagggtacctggtcacaaaagtggtggccgtggacagggatagtggacaaaatgcttggcttagttatagattactcaaggcatccgagcccgggctctttgccgtgggcgagcacaccggcgaggtcagaacagctagagccttacttgaccgagacgccctgaagcaatctctcgttgtggccgttcaagaccatggccagcctcccttgtctgctaccgtgacactgaccgtcgcagttgcagattcaattccccaagtcctggccgatctcggaagctttgagtcaccagccaactcagagacatctgatctaaccctatacctggtggtggcggttgctgcagtgtcgtgtgtgttcctggctttcgtcatcgttctcttggctcacaggctgagaaggtggcataagagccggcttttgcaagcctccggaggcggacttacaggtgtgtcagggagccactttgtgggcgttgacggcgtaagagcgtttctgcagacctattcccatgaggtgagcttaaccgccgattccagaaagagtcacctgatttttccccagcctaactatgccgataccttgatcagccaggagtcttgcgagaaaaatgatcctctgtcgttactggatgactctaaattcccaatcgaggatacaccactcgtaccccaggcgcccccaaacaccgattggaggttctcccaagcccagcggcccggtacctccggaagtcagaatggtgacgacacagggacttggcccaacaaccagtttgatacggaaatgctgcaggccatgattctggctagtgcctctgaggccgcggatggttcttccactctcggcggtggcgcagggaccatggggctctccgccagatacggcccccagtttactctgcagcatgttcctgactacagacagaatgtttatatacctgggagcaacgccactttgacaaacgcggcaggaaagagggacggaaaggctcccgccggtggcaacggtaataagaagaaaagcgggaaaaaggagaaaaaatag

SEQ ID NO: 131146 - DNA, 2808 bp, Artificial Sequence
  Description of Artificial Sequence: Synthetic coding sequence
atggcaaatcgtctgcagcggggcgatcggagtaggcttctcctcctgttatgcatcttcctgggaaccctacgggggtttcgtgctcggcagatacggtactctgtgcccgaagagaccgagaagggcagcttcgttggtaatatcagcaaggacctcggactggaaccccgcgaactggccaaaaggggggttaggatagttagccggggcaagacgcaactgtttgctgtgaacccaagaagcggaagcctgatcactgctggcaggattgatcgcgaagaactctgtgagacagtttcatcatgttttcttaacatggagttgcttgtcgaagataccctgaaaatatatggtgtggaagtggaaataatagacatcaatgataacgcccccagcttccaggaagacgaagttgaaattaaggtgagcgaacatgccataccgggtgcccggttcgccctacccaacgcgagagatcctgacgtcggtgtgaacagtctgcaatcctaccagctgagccccaacaactatttcagtctgcagctgcgcggaagaacagatggcgccaagaatccagagttggtccttgaagggagtctggatcgagaaaaggaagcggctcacctcctgctgctgactgccctggacggaggagatccgatccggaagggcgccgttcccatccgggtagttgtacttgatgtcaacgaccatattcctatgttcacccagtcagtgtaccgcgtttccgtacctgagaacatcagctccggcacccgcgtgctcatggtgaacgcaactgacccggacgaagggatcaatggtgaggtgatgtactcctttaggaatatggagagcaaagctagcgaaatcttccagctcgactcacagaccggtgaggttcaggtgcgaggatcacttgacttcgagaaatacaggttttacgagatggagatccagggacaggacggtgggggcctgttcacaacaacgacaatgctaatcactgttgtggatgtcaacgacaacgcgcccgagatcactatcaccagttctatcaattctattttagagaatagccccccgggaaccgtgatagccctgctcaacgtgcaggaccaagactccggcgagaacgggcaagtctcatgttttattccaaatcacctgccgttcaagttggagaagacttacggcaactactacaaattgatcacttctcgggttcttgatcgggagttggtgcagtcgtacaatattacgctcacagccacagatcaggggagcccccctctgtcagctgagacccacgtgtggttgaatgtggcggatgacaacgacaatccgccggtgtttccccattcctcctattcagcatatatccctgagaataacccaaggggggctagcattttttcagtgacggctctagacccagactctaagcaaaatgcattggtaacatattctctcaccgatgacacagttcagggggttcctctttcatcctacgtgtcaataaactccaacactggtgtgttgtacgcactacaatccttcgactatgaacaatttagagacctggagttgcgcgtgatcgcccgggatagtggcgaccctcctctgagcagcaatgtgagtctgtcactcttcgtgcttgatcagaatgataacgcccctgagattctctatcctgccctccccaccgatggtagtaccggcgtcgagcttgccccccggtctgcggagccaggctatttagtgactaaggtggtcgcggtggacaaagacagcggacagaacgcatggttgtcctacaggctactcaaggcctccgagccgggcctatttgccgtgggagagcacacaggagaggtaagaactgcaagggccctattggaccgagatgctctgaaacagtccctggtggtggccgtgcaagaccacggtcaacccccgttgtcggcaacggtgactctcaccgtggcagttgcagattctattcccgaggtgctcgcagacttgggatccctcgagtctcttgctaactcggagacatccgacctgtcactgtacctagtggtcgccgtcgctgctgtctcttgtatctttctcgtctttgtaatcgtgcttcttgctctcagactgtggcgctggcacaagtcgcgtctgctacaggccagcgaagggggcctcgcggggatgcctaccagtcattttgtgggcgtggacggcgtgcaggcattcctgcagacttattcacacgaggtaagtctgattgcagattcgcagaagtctcatcttatttttccgcagcccaactacggagatacgctcattagccaggaaagttgcgagaagtcggaaccactcctgatagccgaggactcagccattatccttggaaaatgcgaccccacaagcaatcagcaggcacccccaaacacagactggcggttctcccaggcccagagaccggggacctctggaagccagaacggagatgatactggcacttggcccaacaaccaatttgatacggaaatgctgcaggccatgatccttgcctccgcctccgaggcggctgacgggagtagcaccctaggtggcggcgccgggacaatgggcctgagcgcaagatatgggcctcagttcaccctgcagcacgttcccgactacaggcagaatgtctatatccccgggagcaatgctacactaaccaacgcagccggaaagcgggacggcaaggcgccggccggggggaacggcaacaaaaagaagtctggcaagaaggaaaaaaagtag

SEQ ID NO: 131147 - DNA, 2253 bp, Artificial Sequence
  Description of Artificial Sequence: Synthetic coding sequence
atggccaataggttgcagcgaggagatagatcaaggctgctcctgctcctgtgcatatttctggggaccctgcgggggttcagagctcgacaaataagatactccgtgcctgaagaaaccgagaagggctcttttgtggggaatatctctaaggatcttggcctggagccccgagaacttgctaagagaggcgtgcgcattgtgtctcgtggaaagacacagttgtttgcggttaacccccggtcagggtcacttattaccgctggacgcatcgaccgcgaagagttatgtgaaacagtgtccagctgttttctaaacatggagctcctagttgaagatacactgaagatttatggggtggaagtggagattattgatattaatgacaatgccccatctttccaggaggatgaggtcgaaattaaagtgtccgaacacgccattcccggagcccggttcgcactgcccaatgcccgtgatcctgacgtgggggtcaatagcttacagagctaccagctgtctcctaacaactatttctccctgcagctcaggggacgtacagacggggccaagaaccctgaacttgtgcttgaagggagcctggacagggagaaggaagccgcgcacctgctgttgcttactgccttggatggcggtgatcctattcgcaaaggagcggtacctatcagggtcgtggtgctggatgtgaacgaccacatacctatgttcacccagagcgtgtatagggtgagcgtgccagagaacataagctctggaacaagggtcctcatggtgaacgcaactgatcccgacgaaggcataaacggcgaggttatgtactccttccgcaatatggaaagtaaagcctctgaaattttccagctggattcccagacaggggaagtccaagtcaggggtagcctcgacttcgagaagtatagattctacgaaatggaaatccaggggcaggacgggggcggtctctttacaaccaccaccatgcttatcacagttgtggacgtgaacgacaatgcgccagaaatcactattacgtcctcaatcaactcaattttggagaacagccccccgggaactgttatcgcactcctgaatgtgcaggatcaggacagtggagaaaacgggcaggtgagctgtttcatccccaatcacctcccttttaagctcgagaaaacgtacgggaattactataagcttattacttcccgggttctcgatcgcgaattggttcagagttataacattactctgacggctactgaccagggatcccccccattgagtgctgaaacccacgtatggcttaatgtggcagacgataatgataacccgcccgtattcccgcacagcagttacagtgcctatattcccgagaataaccctcgtggtgccagcatcttttcagtgaccgctctcgatcccgactccaagcagaatgccctagttacctactctctgacagatgataccgtacaaggagttcctctttcttcctatgtgagtatcaacagtaacactggagtcctgtatgcattgcagtcctttgactatgagcagtttcgcgatctggaattgcgcgttatcgccagggattcaggggaccctccccttagcagcaatgtgagtctgagtctgtttgtgctggatcagaacgataatgctcctgagatactctaccccgctctgcccacggatggttcaacgggagtcgagcttgcaccccggtcagccgagccagggtacttagtgactaaggttgttgccgtggataaggatagcggacaaaatgcgtggttatcataccggctacttaaagcatcagagcccgggctgttcgccgtgggggaacacaccggggaacaggcacctcccaatactgattggcggttttcccaagcccagagacctggaacctcagggtcccagaacggggacgataccgggacttggcctaacaaccagttcgataccgagatgcttcaggcaatgatacttgccagcgcctctgaagcagctgacgggagctctactttgggaggaggcgcgggtacgatggggctgtctgcccgatacggccctcaattcaccttgcagcatgtgccagactatcggcagaatgtctacattcctggtagcaacgcgactctgacaaacgcggctggcaaacgggacggtaaagcccccgccggcgggaatggtaacaaaaagaagtctggcaaaaaggagaagaagtag

SEQ ID NO: 131148 - DNA, 2799 bp, Artificial Sequence
  Description of Artificial Sequence: Synthetic coding sequence
atgatccccgcccgcctgcatcgggattataagggcctggtccttcttggtatcctgctgggcaccctatgggagacaggatgcactcagattcgctacagtgttccagaggagcttgagaaaggcagtagagtcggagacatctcacgcgatctcgggctagagcctcgagaactcgcagaacgaggggtgcgaattatcccccgtggccgtactcagctctttgctctcaaccctagatccggctccttggtgaccgctggcagaatcgacagggaagaactatgcatgggagccatcaaatgtcagctgaacctagacatcctgatggaagataaagtgaagatttatggggtggaggtggaggtaagggatatcaatgataacgccccttacttcagagagtctgagcttgagataaaaatctctgagaacgccgcgactgagatgagatttcccctccctcatgcctgggacccagatataggcaaaaactcactgcagtcttacgaactctcaccaaacacccatttctctctcatcgttcagaacggcgccgacggttcaaagtaccctgaactcgtgcttaagagagccctggaccgagaggaaaaagccgcccaccacctggtgctgaccgcaagtgatggtggcgatccagtgagaaccggaaccgcccgaattagggtgatggttctcgatgcaaatgataatgccccagctttcgcgcagccagagtatcgtgctagcgtgccggagaacttggccctggggacccagctcctggttgttaatgctacagatcctgacgagggcgtaaacgcagaggtaagatatagctttcgatatgtggacgacaaagccgcacaggtgttcaagcttgactgtaacagcggaacaatcagcaccatcggggaactggatcatgaggagtcagggttctatcaaatggaggtgcaagccatggacaacgcaggatattcagcccgggctaaagtgcttattactgtgttagacgttaacgacaacgcaccagaggtcgtgctgacaagtctggcttcctctgtgcctgagaattctccacgaggaactttgatcgctcttctcaacgtcaatgaccaggatagcgaagaaaatggtcaggttatttgcttcatacagggcaatctcccctttaaactcgagaaatcttacggcaactattactcgcttgttacagacatcgtgctggatcgcgaacaggtaccatcttataacattaccgtgacagctactgacaggggtaccccacccttgtccactgaaacccacattagcctgaacgtcgccgataccaacgataatcctccggtgttcccacaggcatcctacagtgcatacattccggaaaataatccaaggggagtcagcctggttagcgtaacggcccacgaccccgattgcgaagaaaatgctcagattacgtattctctagcagaaaacactattcagggcgcgagcctaagcagttacgtctccatcaattctgacaccggagtactgtacgctctgagctcctttgattatgagcagtttagggacctacaggtgaaagtgatggcacgcgacaatggtcaccctcccttatcttcaaatgtgagcctgtccctctttgtcctagaccagaacgacaacgccccagagatattatatcctgcactcccaaccgatggttcaaccggcgtggaactggcgcccaggtccgcggagccaggctaccttgtcaccaaggtggtggccgttgacagagattcaggccagaatgcttggctgtcgtaccggctgctaaaagcctccgaaccaggcctgttttctgttggcctccacacaggagaagtgagaacagctcgcgccctgcttgatcgggatgccctgaagcaatcgttagtggtggcagtgcaggaccacggccagcccccacttagcgctacagtcacgctgacagtggccgttgccgacagtatcccgcaggtcctagcagatctgggctccttggagtcacctgctaatagtgagacaagcgatttaaccctctacctcgtggtcgctgtcgctgccgtgagctgtgtgttcctagccttcgtgatcctgctgctggcactgcgacttaggaggtggcataagtctagacttctgcaggcctcgggcggcggactgacgggcgcccctgctagtcacttcgttggcgttgacggcgtgcaggccttcctgcaaacctactcccacgaagtgtcacttaccactgatagccgcaaatcgcatcttattttcccacagccaaactatgcagacatgctcgtgtcacaggagagtttcgaaaagagcgaacctctgctgctgtctggtgacagtgtcttcagcaaggattcacatggactgatcgaacaggcccctccgaacaccgactggaggttctcacaggctcaacgaccaggaacctcaggcagtcagaacggagatgacactggtacgtggccaaataaccagtttgacaccgaaatgctgcaggctatgattcttgcatctgccagtgaagcagccgacggctcttccaccctgggtggaggcgcagggacaatgggactaagcgccagatatggaccacaattcactctccaacatgtgcctgattaccgccaaaacgtatacattcccggttccaacgccaccttgaccaacgctgctggaaagcgcgatggaaaggcccctgccggcggtaacggtaataagaagaaaagcggcaagaaagagaagaaatag

SEQ ID NO: 131149 - DNA, 2799 bp, Artificial Sequence
  Description of Artificial Sequence: Synthetic coding sequence
atggctgccctgcagaagctgccacactgccggaagctggttctactgtgttttctgctggctacactttgggaggcacgcgccggccaaatccgctattccgtgcgcgaagaaatcgataggggcagctttgtaggcaatatcgcgaaggacttgggacttgaaccgctcgctctggcggaacaaggggtgcgaatagtgagtagaggtaggagtcaactcttcgcactgaacccaaggagtggctcactggtcacggcaaacagaattgatagggaggagttgtgtgcccaaagtgcgccttgcttactgaacttcaatattctcctggaagacaaactgaccatctatagcgtggaggtcgaaattactgacataaacgacaatgccccaagatttggcgtcgaggagctggagctgaagatctcagaaaccacgacacccggattccggattccactgaaaaacgcccatgacgcagatgtcggggagaacgcgctgcagaagtatgcgctaaacccaaacgaccacttcagcctggacgtacgcaggggagcggatggcaataaatatccagagctggtccttgaacgcagtttggaccgagaagaggaggctgtgcatcaccttgtcttggtggcttctgatggcggcgaccccgtcctatcgggaacgtcaaggatctgcgtaaaggttttggatgccaacgataatgccccggtattcacgcagcccgagtaccgaataagtatacccgaaaatacactggtgggcactaggatcctcactgtcacggctaccgacgctgacgagggatactacgcccaagttgtgtacttcctagaaaagagtcccggcgagacaagcgaggtctttgaattaaagtctacctccggcgagttgacgatcattaaggatctggattacgaggatgccaccttccacgagattgatattgaggctcaggatggccccgggctcctgaccagagccaaggtgatcgtgacagtattggatgtaaacgataatgccccagagttttatatgacaagcgcaacttcctccgtctctgaagatagcctgccagggaccattatcggattgtttaatgtgcatgatcgagatagtggccaaaacgcttttactacctgtagtctgcccgaggacttaccattcaaactggagaagtccgtagataactattaccgtctcgtgaccacgcgcgccctagacagagaacagttcagtttttacaatatcaccttgacagccaaggatggcggcaatccttccctttctacggatgctcatatactgcttcaagtcgccgatattaacgataatgccccagccttttcaagaacctcatactcaacctatatcccagagaataaccctagaggagcctccgtgttctccgtgacagcccacgaccctgattcaaatgacaatgcgcacgtgacttactcatttgcagaagacacggtccagggagccccattgagcagttatatttcaattaattcagatactggcgtgctctatgccctgcgatcattcgactacgagcagctgcgtgaccttcaggtctgggtgatagcccgggacagcggcaatccccctttgagcagcaacgtgagtctgtcacttttcgtcctggatcaaaatgacaacgcacctgaaatcctataccccgccttccccaccgacgggagtactggcgtcgaactagcccctagaagtgcggagccgggctatctggttacaaaagtggtcgccgtagatcgcgattctggtcagaacgcctggctcagctatcatttgttaaaggcctctgagcctggacttttcagtgttggactgcacaccggcgaggtgcgcactgcacgtgcccttttggatcgagacgcccttaaacagagcctggtggtggcaatccaggaccatggacagccgcccctcagcgccaccgtaacgctgacggtcgctgtagctgaccgaatccccgatattctggccgatctgggctccctggaaccgtctgctataccaaatgattccgatctgacactctacctcgtcgttgccgtcgcagccgtttcctgtgtgttcctggcattcgtgattgtactcctggcccatcggctccggagatggcacaagtccaggctgctgcaagctagcggagggagcctaacaggcatgcaatccagtcacttcgttggcgtggatggcgtcagggcttttctgcagacttatagtcacgaggtttctctcacggcggattcacggaagtctcatctgattttcccacagcccaattatgccgatacattaatctcacaggagtcttgtgagaaaaaagatttcctctctgccccccagtcgcttctggaggaagagagagaggaaacctttagccagcaggctccaccgaatacggactggcggtttagccaggcccaacgaccgggtacatccggatctcagaatggagatgacaccggcacatggcccaataatcaattcgacacggagatgctgcaggcgatgatcctcgcaagtgcttctgaggcagcggacgggtcaagtaccctcgggggcggtgctggcacgatgggtctatcagctcgttacggcccacaattcacactgcagcacgtgcccgattaccgacaaaatgtgtatatacccggctccaatgcaacactgaccaacgctgctggcaaacgcgacggaaaggcaccggccggtggaaatggaaataaaaaaaagtctggcaaaaaagagaagaagtag

SEQ ID NO: 131150 - DNA, 2799 bp, Artificial Sequence
  Description of Artificial Sequence: Synthetic coding sequence
atgaccaactgtctgtcattccgcaatggaagaggactggcattgctttgcgctctgttagggactttgtgcgagactggttctgggcagattagatattccgtatctgaggaactggacaaaggttcatttgtcggtaatatagcaaatgacctcggtctggaacctagggaactagccgaacgtggcgtcagaatagtgagccgcggtagaactcagttgttctcactgaatcctcaatctggatccctcgtgacagctgaaaggattgaccgagaagaactgtgcgcacaaatacccctctgtcttgtcaagattaacatccttgttgaggataaactgaagatttttgaggttgagatagagatcaaggacattaatgataacgcgccgaactttcctacggaggagctggagatcaaaatcggagagctaacagttcccggaacacggtttcctataaaaactgcattcgaccccgatgtcggcatcaactccctacagaattataaactgagccctaatgattattttagtctcgccgtgaatagtgtgagcgagggtgcaaaatacccagagcttgtcctcgagcgggctcttgatagagaaaaaaaagagatccaccagctcgttctagtggcgagcgacgggggagatcccgtccacagtgggaacctccatattcaggtgatcgtattggatgccaacgataatccaccgatgttcacccagccagaatacagggtgagcgtgtgggagaatgtgcccgtgggtacacggttattaactgtcaatgcgacagatcccgacgaagggttcaatgcgcaggtgtcgtacatactagacaagatgcccgggaaaattgctgaaatctttcacttgaacagcgtatcaggggaggtgagtattctaaagtcgctggattacgaggacgctatgttctacgagattaaaatcgaagcccaagatgggcccgggctactcagtcgggccaaaatcctggtgacggtccttgacgttaacgacaacgcacccgagatcacaattaccagcctgacatcttccgtgccggaagagggcaccgtcggaagggaaatcgctctgattgacgtccatgacagggacagcggacaaaatgggcaagtggaggtttttgtcctaggcaatctgccttttaagctcgaaaaaagtatcgatcagtactaccggctggtcacagctacatcgttggatcgcgagcagataagtgagtacaacatctccctgcgagcttccgacggtggcagccctccactttcaaccgaaacacacattactctgcacgtgatagatattaatgataatccaccaacttttccgcacctgtcctatagcgcgtacattcccgagaacaacccccgcggggcctctatctttagcgtgaccgcacaagatccagatagcaataacaacgctagaatcacgtacgccttgactgaggataccctccagggagctcccttgtccagttttgtctcaattaacagcaatactggagttttatatgcactgcgatctttcgactacgaacagtttcgcgaccttaaattgctggtgactgcgtcagattctgggaatcctcccttgtcgtctaacgtatcactgaatctctttgttttagatcaaaacgacaatgcacccgagattctatatcctgcccttcctacggacgggagcaccggggtcgagctcgctcctagaagcgccgagcccggatacctggtgaccaaggtggtagcagtcgaccgcgactccgggcagaatgcatggttgtcgtatcgtctgttaaaggccagcgagcccggactgttcagcgtgggcctccacacaggcgaagttcgaaccgcccgggcactgctcgacagggacgcactgaagcagagccttgttgttgctgtgcaagatcacggacagcctcctctcagcgccacagtgactttgaccgtcgccgtagcagatcgcataccggatattctagctgacctgggatcccttgaacctagtgccaagcctaacgattcagatcttacgctataccttgttgttgcggtggccgctgtatcttgcgtgttcttggcttttgtcatcgttctcctggcactgaggttacggcggtggcataaaagtcggctcctgcaagcaagcgggggcggattggcttctacaccaggaagtcattttgttggtgccgatggggtgcgggcgtttctgcagacttatagtcatgaggttagcctgactgcggatagtaggaaatcgcacttgatattcccgcagcctaattatgccgatactctaatttcccaggagtcctgtgagaagagcgagcctctcttgataacccaggatctcctggagatgaaaggcgattcgaaccttttacagcaagcacctcctaatacagattggcggttttcccaagctcaacggccagggacttcaggctcccagaatggagacgatactggaacttggccaaacaatcagttcgatacagagatgctgcaggccatgatcttggccagcgccagtgaggccgccgatggcagctcaacattgggcgggggggctggtacgatggggctgtcagctaggtatggcccacaattcaccctgcagcacgttcctgattaccggcagaacgtctacatccccggcagcaacgcaacattgactaacgcagctggcaagcgggacgggaaggccccggctggcggtaacggaaacaaaaagaaatctggtaagaaggaaaagaagtag

SEQ ID NO: 131151 - DNA, 2796 bp, Artificial Sequence
  Description of Artificial Sequence: Synthetic coding sequence
atggcttccccccccagggggtggggctgtggggaactgttgctcccttttatgctgctgggcaccctgtgcgagccaggctctggacagatccggtattccatgccagaggagctggacaaaggtagcttcgttgggaacattgccaaagacttgggcctggagccccaagagctcgcggaacgcggggttaggatcgtatcccgcggacgtacacagctcttcgctcttaacccccgatccggatccctggtaaccgcaggtcggatcgatcgtgaagagctttgcgctcaatcacccctttgcgtcgtgaattttaacattctcgtggaaaataagatgaagatctacggagtagaagtagaaattatagacattaacgataacttcccccggtttagagacgaggagttgaaggttaaggtgaacgagaacgctgctgccggcactcgcctggtactccctttcgctagggatgcagacgtcggtgtgaattctctgcgatcctatcagctcagctccaatctacacttctcgttggacgtggtctctggcactgacggccagaagtatcccgagctcgttcttgagcagccccttgacagggaaaaagagactgtccatgacctgctcctgacagccctggatgggggcgatccagtgttaagcggcacgactcacatcagggttacagtgctcgacgcaaacgataacgcacctctgtttaccccctcggagtactctgtgtccgtccccgaaaacatacccgtcgggacccgcctgctgatgttgaccgctaccgaccccgacgaagggatcaacggaaaacttacttattcctttcgtaatgaagaggaaaaaatcagcgagaccttccagctcgactctaatctgggggagatctccaccttacagagcttggattacgaggagtcacggttctatctgatggaggttgtggcccaggatggtggggcactcgtcgctagcgccaaagttgtagttactgttcaagacgttaacgacaacgccccagaagtcattttaacttctctgacctccagcatctccgaggattgtttacctggaactgtgatcgccctgttttccgttcatgacggcgactccggcgagaatggcgagattgcttgctccattccccggaatcttcccttcaagctggagaaatcagttgataactattatcacctgttgaccacacgcgacctggaccgggaggagaccagcgattataatatcactttgaccgttatggatcacggtaccccacccctgtctaccgagtcacatatcccactaaaggtagccgacgtgaacgataacccgcccaacttccctcaggcttcttacagcacctcagtaaccgagaacaacccacgcggggtatcgatttttagcgtgacagcccacgaccccgactccggcgataacgctcgggtcacgtactcactcgctgaggacactttccagggggccccattgagctcgtatgtgagtatcaattcggataccggtgtgttatacgccctgagaagcttcgactatgagcaacttagagatctgcagttatgggttacagccagtgattcaggaaatcctcctttgtcctctaatgtgtctttaagtttgtttgtattggatcagaatgacaatactcccgagatcttgtaccccgctctgcctaccgacggcagcaccggcgttgaacttgctcccagatctgctgagccaggctatctagtgaccaaagtcgtggctgtcgataaggatagtggacagaacgcctggttaagctacaggctcctgaaggcttctgagccaggcctgttcgcagtcgggctacacacaggagaagtgaggaccgctagggcgctcctggatcgagatgccctaaaacagagcctggtggtcgctgtggaggatcacggccaaccacccctgagcgccaccttcactgtgactgttgctgtggctgataggatcccagatatactggccgatcttggatccattaagaccccgattgaccctgaagacttggatctcactctgtatctggtcgtggccgtggcagccgtgtcttgcgtatttttagcctttgtgattgttttactcgtgctgcggcttcgccgttggcacaagagcaggctcctgcaggctgaagggtcccggctagccggcgtcccggcctctcatttcgtgggcgtcgacggagtgcgggccttcctccaaacatatagtcacgaagtgagccttaccgccgacagccgcaagtcccacctcatttttccgcaacccaattacgcagatacattactctccgaagagtcttgcgagaagagcgaaccactcttgatgtcagacaaagtagatgcgaataaggaggagcgccgggttcagcaggcccctcctaataccgattggcgcttctcccaagcacagcgcccagggactagcggttcccaaaatggcgacgataccggcacatggccgaataatcagtttgacactgaaatgctgcaagcgatgatcctggcctccgcttccgaggcagcagacggcagtagcacactgggtggcggggccggtacgatgggactgtcagctaggtacggccctcagtttaccctgcagcatgtgccagactacaggcagaatgtttacattccggggtctaatgctaccctcaccaatgccgccggcaagagggatggaaaagcacccgctggcgggaatggcaacaagaagaagtctggaaagaaagagaaaaagtag

SEQ ID NO: 131152 - DNA, 2799 bp, Artificial Sequence
  Description of Artificial Sequence: Synthetic coding sequence
atggcacctcctcagaggcaccctcagcgttctgaacaagtcctgctactcacactgttaggaactctctggggggccgctgcagctcagatacgctacagcatccccgaagaattggagaaaggatccttcgtaggcaatatcgtgaaagacctgggcttagagccccaggaactggcagaacatggtgtgcgcatagtgagcagaggtcggatgcaactttttagtctgaatccacgcaatggaagtctggtgaccgcaggtcggatagaccgggaggagctgtgtgcacaatcaccgcggtgcctcgtcagctttaacattctggtcgaggataaacttaatctctaccctgtagaggttgaaatcgtggatataaatgataatacacctagattcctcaaagaggagctggaagtcaaaatcctcgaaaacgccgcaccctcaagccgctttcccctaatggaggtgtatgatcctgacgtagggatgaactcactgcaggggttcaaactgtccggaaactcccactttagtgtggacgtgcagtccgaagcacacggacccaaataccctgagctcgtactggaggggactctcgatagggaaggagaggcagtgtacagattagtactcaccgccatggatggtggggatcccgtccgctcaagcgtggcccagatacttgtgactgtgctggacgtaaacgacaacacccccatgtttacccagcctgtgtacagggtatcagtaccagagaatctgccagttggcacgccggtactagccgtgactgcaaccgaccaagatgaaggggttcacggggaagttacatactctttcgtgaagattacggaaaagattagccaaatcttttgcctgaatgtcctgaccggtgagatctcaacatccgccaatctggactatgaagattccagcttttacgagcttggggttgaggctagggacggaccggggctgagagatagagccaaggtgctgattacaattctggacgtcaacgacaacgtgccagaggtggtagtcacgtccggctcaagaaccatagcggagtcggccccccctggcacagtgattgctctatttcaggtatttgaccgtgattcaggattgaacggactggtcacatgctccatcccacgatccctgccgttcgaacttgagaagagcgtcggcaactactaccggctggttactaacgccgctttggatcgggaggaggtgttcctatataacatcactgtcacagccaccgataagggcacaccgccactgagcacagagactatcatctctctgaatgtggcagacactaacgacaatccacctacgttcccccactcatcatattccgtttacgtgttagaaaacaacccgagaggggcctccattttctcagtgaatgctctagacccagacgttgatcagaacgctcaggtgtcgtactcccttgcagaggataccctccaaggtgctccactgtcttcctacgtttcaattaactctgacacgggaatcctgtacgccttgcgatcatttgattatgaacagttgcgggatttgcaactgtgggtcaccgcaagcgacagtggcgacccgcccctttccagcaatgtgtcgctctctctttttgtgttggatcagaacgacaatgcccctgaaatcctgtacccagccctgccaaccgatggatccaccggtgtggagttggcccccagatcagctgaacccggttaccttgtcacaaaagttgttgctgtggaccgggacagcggccagaatgcctggctttcttaccggcttctgaaagcttcggaaccaggtttgttctctgtggggttgcacacaggcgaggtcaggactgcaagagccctcctcgaccgggatgctctcaagcagtctcttgtggtggccgtccaagaccatggtcaaccccccctgagtgccaccgtaacactcaccgttgccgtcgctgatcgaattcccgatatcctggcagacctcgggagtctggaaccaagtgccaagcccaacgacagtgaccttacactgtatctggttgtcgctgtcgccgcagtgtcctgtgtttttcttgcctttgtcatagtcctgttagcacttcgactccagcgttggcataagtctagattgctgcaggccagcggaggcgggctcgcgtctatgcctgggtcccacttcgtcggtgtcgaaggggttcgcgcctttctgcagacttactcccacgaagtctcactcacagcggactctcggaaatcccacctcatctttccccagcccaattacgcggacacattgattaatcaggagtcctatgaaaagagcgagccattgcttatcacccaggacctcctggagaccaagggagagcctcgccagttgcagcaggcacctccaaacaccgattggcggttcagccaagctcagcggcctggcacctccggatcacagaacggcgacgacacaggcacctggcctaataaccaatttgacacagagatgctccaggctatgattttggcttccgccagcgaggcggccgacggaagctccacactgggtggcggcgcaggaacaatgggacttagcgctaggtacgggccacaatttacgctgcagcatgtgccggattacagacaaaatgtgtacattccgggctctaatgctaccctgaccaacgctgcaggaaagcgcgacggcaaggcgccggccggtggcaatggtaataagaaaaagagtggcaaaaaagaaaaaaagtag

SEQ ID NO: 131153 - DNA, 2799 bp, Artificial Sequence
  Description of Artificial Sequence: Synthetic coding sequence
atggcagcccagccccgaggcggagactatcgcggttttttcctcctgtctatcttgctcggaactccgtgggaggcctgggccgggagaatactgtatagcgtcagtgaggaaacagacaagggctcttttgtcggagacatcgccaaggacctggggctggagccaagggagctggccgagaggggggtccggatcatctctcgcgggagaacacagttattcgcattaaatcaacggagcggctctctggtgaccgctggtcgaatagaccgagaagagatttgcgctcagagtgctaggtgtctcgtgaattttaatatactgatggaagacaagatgaatttgtatccaattgatgtcgagattatcgacattaacgacaatgtgccccggttcctcactgaagagatcaacgtaaagataatggaaaatactgcccccggagtacggtttcccttgagtgaggccggggacccagacgttgggaccaatagcctgcaaagttaccagctctccccaaaccgacacttttcactggctgtacagtccggagacgacgagacgaagtaccccgagctggtgctcgaaagagtactcgatcgcgaggaagagcgcgttcatcacttggtgctgaccgctagcgatggaggggacccaccacgttcatcaaccgcccacattcaggttacagtggtggatgtaaatgaccacacaccggtgttttcactgcctcagtatcaggtcaccgtcccagaaaacgtgccagtgggcacccgtctgttgaccgttcacgcaatcgacctggatgagggcgttaacggggaggtaacatactcattcagaaagatcacccctaaattgccaaaaatgttccatctgaactcgctgaccggcgagatcagcaccctggagggcctggactatgaagagacagccttttacgagatggaggtgcaggctcaagacggcccaggcagtctgaccaaagctaaagtcctgattacggtgttggatgttaacgataacgcccctgaggtgaccatgacgtcactatcctcctccattcccgaggacacaccactcggcacagtgatagctctgttctatttgcaggaccgtgactcggggaagaatggcgaggtgacctgcacgatcccggagaatctgccatttaaactcgaaaagtcaatcgataattattataggcttgtgactacaaagaacctcgaccgcgagaccctcagcctgtataatatcacactcaaggccaccgacggcggaacccctcccttgagccgggagactcacatcttcatgcaggtcgccgatacgaacgataacccaccaacatttcctcattcatcctacagtgtgtacatcgccgagaacaatcctaggggagcaagcatcttccttgttaccgctcaggaccacgattcagaagacaatgctcaaattacctattccctagctgaggataccatccagggagcaccagttagtagctacgttagtatcaactcagacaccggggtgctgtacgctctacagtcttttgactatgagcagcttagggagctgcagctcagggtgactgcccatgactctggtgatccccccctaagctccaacatgtccttatcactgttcgttctggaccagaacgacaacccccccgaaattctgtatccggccctgcctactgacgggtccaccggaatggaactcgctcctcgtagcgccgagcccggctatttggtaaccaaagtggtggccgtggacaaagattccggccaaaatgcatggcttagctacttgctgctaaaggccagtgaaccaggactattcgcagtgggcttgtacacgggggaagttcggaccgctagagcgcttctggacagagacgccctgaagcagagccttgttgtggccgttcaggaccacgggcagcctcccctgtctgccaccgtcactctgactgtggccgtagccgattcgattcccgaagtgctcgcggatctcggctccctcgagcctagtgatggaccttacaactatgacctgaccctctacctggtcgttgctgttgctacagtttcctgtgttttcctggctttcgtcttagtgctcctcgcactgcgtctcagacgatggcacaagtctcgtctgctgcaggcctccgagggaggcttggccaacgtccccaccagccactttgtgggtatggacggagttcaggcgttccttcagacatacagccacgaggtgagcctaactgctgattctagaaaatcacaccttatctttcctcagcctaattacgtggacatgctcatttcacaagagtcatgcgagaaaaacgacagcttgttgacgagtgtggacttccaggagtgcaaggagaatctgccgtccattcagcaagccccgcccaatacggattggagattctcccaggcacagaggcccggcacgagcggatcacaaaacggcgatgacactggcacctggcccaacaaccaattcgacaccgaaatgctccaggctatgatcctagcatccgccagtgaagccgctgacggcagctctaccctgggaggaggagcaggtacgatgggcttatctgcaaggtacggaccccaatttaccctgcaacacgtccctgattacagacagaatgtctacattcccggatccaacgcaactctaacaaatgcggccggaaagagagacgggaaggcaccagctggaggtaatggcaacaagaaaaagagcgggaagaaagagaagaaatag

SEQ ID NO: 131154 - DNA, 2799 bp, Artificial Sequence
  Description of Artificial Sequence: Synthetic coding sequence
atggctgccccccagagcaggccccggaggggcgagcttattctcctgtgcgcgctgctgggtacactctgggagatcgggcgcggccagatcaggtatagcgtcccagaagaaacagacaagggatcattcgtgggtaatatcagcaaagacctcggcctagatccaagaaaattagccaaacacggggtcaggatcgtgagtcggggaagaacccagctcttcgcgctcaaccccagatctgggtccttaatcaccgccggccggattgacagagaggaactgtgcgcacagtcccctaggtgtctgattaacatcaatactctcgtcgaggataagggtaagttgtttggggtcgagattgaaattatcgacattaacgataacaacccaaaattccaagttgaggacctcgaagtgaagattaacgaaatagccgttcccggagcccgctatccactgcccgaagctgtagaccccgatgttggagttaactcattgcagagttatcaactgagtccaaaccaccacttctcactcgacgtacagacgggagacaacggggctatcaatcccgagttagtgctagagagagccctggaccgagaagaagaagcagcccaccatctggtgttaacagctagcgatggggggaagccacccagaagtagcactgtgcgaattcatgtgactgtgttggatacaaacgataatgctcctgtgtttccccacccaatctatcgggtgaaagttctcgaaaatatgcccccagggactcgactgctgacagtaaccgcctctgacccggatgaagggattaatggcaaggtggcatacaaatttaggaaaatcaacgagaaacagacccctctgttccaacttaatgagaacaccggcgagatttctatcgcgaaaagcctggactatgaagaatgtagtttctatgaaatggagatccaggcagaggatgttggagccctgctcgggcggaccaagctgctgataagtgtcgaggatgtaaatgacaatcgcccggaggtcattataactagcttgttctctcctgtgcttgaaaactctctgccagggacggtgatcgcgttcctgtctgttcatgatcaggattctggtaaaaacggccaggttgtgtgttacactagagataacctgccctttaagctggaaaagtctatcgggaactattatagacttgttacccgtaagtacctggatcgcgagaatgtgtccatctataacataaccgtaatggccagcgacctaggaaccccaccgctttccaccgaaacacagatcgccctgcacgtcgcagacattaacgacaatccccctaccttcccacacgcctcctattccgcctacatcctggagaataacctcagaggtgctagcatattttcactcacagcacatgaccccgattcacaggaaaacgcgcaggtaacatacagcgttacggaggacacactgcaaggtgccccgttatcctcatacatcagtatcaattctgacaccggggttttgtacgcactgcagagcttcgattatgaacagatccgggacttgcagctcctggtgactgcttctgattctggggatccgccccttagttctaatatgagtttgagcctctttgtgctggaccagaatgataacgctccagagatcctctatccagccctacccacggatggtagtaccggcgtggaactggcaccaaggagcgccgaaagaggctaccttgtgaccaaagttgttgctgttgatcgagattctggacagaatgcttggctctcctaccgtctgctaaaagcgagcgaaccgggtctcttttcagtcgggctgcatactggagaagtacgcactgccagggccctgcttgatagggacgctttaaaacagagcttggttgtagcggtgcaagaccatgggcaaccgccactttcagctacagtaacacttactgtggcagtggcagattctatccccgaggtacttaccgaactagggtccctgaaaccctccgtagaccccaatgactcatctttgaccctgtatctggtggttgccgtggcagccattagctgcgtatttttggccttcgtcgctgtcctgttgggcctgaggctgcgcaggtggcacaagagtagacttttacaggattccggtggccgactagtcggggtacccgccagccacttcgttggcgtggaagaggtgcaggcctttctgcagacgtattcccaagaagtgtccctcacagcagatagccgaaagtcccatctcatttttcctcagcctaattacgcagatatgttgatatcccaggaagggtgtgaaaagaacgacagtctgctcacttcagtggatttccacgagtacaaaaacgaggctgaccatggacaacaggctcctcccaatacagattggagattcagtcaggcacagcggcctgggacctccggatcccagaacggagacgacactggcacctggcccaataaccaatttgacacagagatgttgcaggcaatgatcctggcctcagcatccgaggcggcggatggcagttcaacattgggagggggtgcaggtaccatgggcctgtctgcacgctatggccctcagtttacactccaacatgtccccgattatcgacagaacgtgtatatcccaggctcaaatgccacactgacaaacgcagcgggcaagagggatgggaaggctccagctggaggtaatgggaataaaaagaagtctggtaaaaaggaaaaaaagtag

SEQ ID NO: 131155 - DNA, 2784 bp, Artificial Sequence
  Description of Artificial Sequence: Synthetic coding sequence
atgcaaagagcacgcgaggccgagatgatgaagtcccaggttttattcccatttctgttgtctcttttctgtggcgccatctcccaacagattcgctataccatccccgaagagcttgctaatggttctcgggtgggcaagctagccaaagaccttggattgtccgttagggaactcccaacacgtaagttacgcgtgtccgctgaggactattttaacgtcagcctggaaagcggggacctactggtcaatggccgaatagatcgtgaaaagatttgcggtcgaaagctggagtgtgctcttgagttcgagacagtcgctgagaacccgatgaatgtcttccatgttgttgtggtcattcaagacatcaacgacaacgcccctcggtttgtggccaagggaattgacctggaaatttgcgaaagtgccctgcccggtgttaagtttagcttggattctgcccaggacgcggacgttgaggggaacagtcttaaactgtatacaattaatcctaatcagtacttctcgctgagtaccaaagaaagccctgacggttccaaatatcccgtgctgctgctggagaaacccctcgatcgagagcaccaatctagtcatcgacttattctgactgctatggacggcggagatcctcccctgtcaggaacaacccacatatggattcgagtcaccgacgctaacgataacgctcctgtgttcagccaggaggtgtatagggtgagtctccaggagaacgtcccatgggggacctctgtgcttagagtaatggcaactgatcaggacgaaggaattaatgctgaaattacatacgcctttttgaactccccgatatctacatctctattcaatttaaatccgaacactggcgatataactaccaatggcacgctggattttgaagaaacaagccggtatgtcctgtcagtggaggctaaagacggcggggtgcacaccgcacattgtaacgttcagatagagatagtggacgagaacgataacgctccggaggtgacatttatgtcattttctaatcagattccagaggattctgatcttggcactgttatcgcattaatcaaagtgagagataaagacagcggccagaatggaatggtgacatgttacacacaggaagaggtgccctttaaactcgaatctaccagcaaaaactactataagctcgtgatagccggcgccttaaaccgggagcagaccgccgactacaacgtaacaattattgcgactgataaggggaaacccgccttgtcgtctaggacctcaattacactgcacatctctgatattaacgacaatgccccggtttttcaccaagcgtcctacgtggtgcacgtaagcgagaacaatcctcccggcgcctctattgcccaagtctcagcttcggaccccgatctgggccctaacggtagagtgtcctacagcattcttgcctcagacttagagccacgggagctgctgtcctacgtgagcgtgtcgccacaatctggcgtcgtcttcgctcagagggctttcgaccacgagcaactccgggcctttgagttaactctgcaggcgcgcgaccagggtagccctgctctctcagctaatgtctctctacgcgtactggtgggcgatctgaatgataatgctcctagggtactctatcccgcgctcggcccggatggatccgccctgtttgacatggttccgcgtgcggcagaaccgggctaccttgttaccaaggtagtggccgttgacgcggactccggacacaatgcctggctgagttatcacgttttgcaggcttccgagcccgggttgttttcactaggtttgaggacaggcgaagtcagaacggcaagggcccttggagacagagatgccgctcgtcagcggcttctggtggccgtacgtgacgggggccagcctccacttagcgccactgctaccttgcatctaatcttcgcggacagccttcaggaggtcctccctgacctgtccgaccggccggagccgtccgacccccagacagagttgcaattttatctggtcgttgccctcgctcttatttctgtgctgttcttgctggcagttattctcgcgatagctctgaggctgaggcgaagttcctcactggatacggaggggtgtttccagacaggcctctgttctaaatcaggtccgggcgttccaccaaatcactccgaggggaccctgccttattcctacaacctgtgtattgcaagccattccgccaagactgagtttaatagcctgaacctgacacccgaaatggctcctccccaagacctgctgtgtgacgacccctctatggtcgtttgcgcctccaacgaagaccacaagatcgcatatgacccttctctcagcagccaccaggctccacctaacactgattggaggttctcacaagcccagcggcctgggacctcgggcagccagaatggcgacgataccggcacttggcctaacaatcaatttgacaccgagatgctgcaagctatgattcttgcctctgcgagcgaggctgcagacggcagcagtaccttaggcggaggagccggcacaatgggcctcagcgctagatatggaccccagtttaccttgcagcacgttcctgactaccggcagaacgtatacatacccggtagcaacgccacactgacaaatgctgccggcaagagggacggcaaggcacctgccggagggaacggcaataagaagaagagcgggaagaaagagaaaaaatag

SEQ ID NO: 131156 - DNA, 2796 bp, Artificial Sequence
  Description of Artificial Sequence: Synthetic coding sequence
atgaaagcttcctccgggcggtgtgggctggtgaggtggctgcaggttctgttaccctttttgctctcactgttcccaggagcactcccagtgcagataaggtactcaatccccgaggagttggcgaaaaacagcgtggtcggcaacctcgccaaggatctgggactgtctgtgcgcgacctcccagcgcgcaagctgcgcgtctcagccgaaaaggagtatttcaccgttaaccctgagtctggagacttgctggtgtcagatagaatcgacagggaacagatctgcgggaagcagccattgtgcgttttggatttcgataccgttgccgagaatcctctgaatattttctatattgcagtgattgttcaggatattaacgacaatacccccctgttcaagcagaccaagatcaatctaaagataggcgaaagtaccaagccaggaacaacttttccactcgaccccgcacttgacagtgacgtcggccccaattctttgcaacgataccacctgaatgataatgagtactttgaccttgccgagaaacagacaccagacggaagaaagtacccggagctgattctcaaacatagccttgatagagaagagcactctctccatcagctggtcctaaccgccgtagacggtggggacccaccgcagagcggaactacacagatacgcatcaaggtgactgacgctaatgataaccccccagtgttttcacaagatgtgtatagggtcacgctgcgtgaagatgtgccgccaggcttcttcgtgctacaggttacggctactgatagagacgaaggcataaatgctgaaattacgtactctttccacaatgttgacgaacaggtcaaacactttttcaatctgaacgagaaaacaggcgagattacaaccaaggacgacctggacttcgagatagccagcagctataccctcagcattgaggcgaaggatcccggggatctcgccgctcactgttcaatccaggtggaaatccttgacgataacgattgcgcccccgaagtgatcgtgacatctgtgtccacacctctgcccgaagatagtccccccggaaccgttatagctctgatcaagaccagggatcgtgattcaggtgagaacggcgaagtgtactgccaggtgctggggaacgcaaagttcattctgaaatcctccagtaagaactattacaaactggttacagacggagccctggaccgcgaggagattcccgaatataacctcacgatcaccgcgaccgacggagggaaacccccgctgagtagctctattatcgtgacgctgcatatctctgacgtcaacgataacgcccccgtatttcagcagacatcctacatggtgcatgtagccgaaaacaacccaccgggcgcttccatagcccagatttccgcatcagatcctgacctcgggccctccggacaggtatcttactctattgtcgccagtgacttgaaaccgcgagagattctgtcatacgtgtccgtttcagcccagtcaggcgtggtattcgctcagcgagcgttcgaccacgaacaactccgggcctttgaattaactctgcaagcccgcgatcaggggagtccagctcttagtgcaaacgtgtccttgcgcgtgctcgtgggggacctcaatgataatgcgcccagagttttataccctgcattagggcctgacggcagcgctctctttgacatggtcccccgcgccgccgaaccggggtacctggtgaccaaggtggttgccgtggacgccgactcgggccacaatgcatggctttcctaccacgtcctgcaggccagtgagccgggtttgttctcacttggcttgcgtaccggcgaagtcaggacggcgagggccctgggagaccgggatgccgcccgtcaaaggttgctcgtggcagtgcgagatggtggccaaccccctcttagcgccaccgccactttacatcttatttttgccgactctctccaagaggtcctgcctgatttatctgatagaagagagccgagtgatccccaggccaagcttcaattttatctggtcgttgctctcgccttgatttcggtgctgttcttcctcgctgttatcctggcaatatctttaaggctcagactttctagcagatccgacgcctgggattgcttccaacctggccttagttccaagccaggtcctggagtcttgccaaactatagcgaaggaactcttccctacagctataatctgtgcgtggctagccaaagtgctaagactgaatttaacttcctgaacattaccccggagctggtgccggctcaggacctggtgtgtgacaacgcctcttgggagcagaacacaaaccacggtgcggcaggagtgccattcgcaagtgatactattctcaagcaggccccgcctaatacagattggaggttttcccaagctcagcgacctgggacctcaggctcacagaatggcgatgacaccggaacatggcctaacaatcaatttgatactgagatgctccaggccatgatcctggcaagcgcctcagaagcggctgacggcagttcaacactgggaggtggtgcgggaaccatggggttgtcagcacggtacgggccccagttcacactacagcacgtgccagattacagacagaatgtgtacattccaggttccaatgcgactctgacgaacgctgctggtaagagggacggtaaggctcctgcaggcggcaacggtaataagaagaagtctggaaaaaaagagaaaaaatag

SEQ ID NO: 131157 - DNA, 2772 bp, Artificial Sequence
  Description of Artificial Sequence: Synthetic coding sequence
atggggagtggagcgggggagctcggcagggccgagcgcctacctgttctgttcctgtttctgttgagcctcttttgcccagccctgtgcgagcagataaggtataggattcccgaggaaatgcccaagggcagcgtagttggcaatttggccacagatctgggcttctccgtgcaggaacttcccaccaggaagcttagggttagctccgagaagccatatttcacagtctccgccgaatctggtgagctgctcgtctcgagtaggcttgatagggaggagatctgtggcaaaaagccagcatgcgccttggagttcgaagcggtcgcagaaaacccactgaatttctaccacgtgaacgtagaaatcgaagacataaatgaccacacaccaaaattcactcagaactccttcgaactccagattagtgaaagcgctcaaccagggacccgctttatcctggggtccgctcacgacgctgatatcgggtcaaatacactgcagaactatcagctatccccatcagatcatttctccttaatcaataaggaaaagtcagatggaagtaaatatccggaaatggttctgaaaacccccctagacagggagaagcaaaagtcctatcatctcacccttactgctcttgatttcggtgccccccctttgagcagcacagcccaaatccacgtccttgtaaccgatgcaaacgataatgcccctgtgttttcccaggatgtgtatagagtttcactcagcgaaaacgtttatccaggtactaccgttctgcaagttactgcaacggaccaggacgagggagtgaatgcagagatcacattcagcttcagcgaggcttctcagatcactcagtttgacctgaactcaaataccggggagatcaccgtgctcaacactctggatttcgaggaagtgaaggagtattccatcgtcctggaggccagagacggcgggggaatgatcgcacagtgtacggtggaggtggaggtcattgatgagaatgataatgctcccgaagtcatcttccagtcattgcccaatctgatcatggaagacgccgagttaggtacgcacattgcgctcctgaaagtgcgggataaagacagccgacataacggcgaagtcacctgtaagctggagggcgatgtccccttcaagattcttactagttcgcgcaacacgtacaagctcgtcacagacgctgtgcttgacagagagcagaaccccgaatataacatcaccgtaaccgccaccgatcgaggcaagccaccactgtcctcctctagcagcataacattacatatcggagatgtaaatgacaatgcgcccgtgttctcacagtcctcctatattgtccacgtcgcagagaataaccctccaggcgcttccatctcacaagtcagggccagcgaccccgatctcggcccaaatgggcaggtgagttattgcataatggcatcggatctcgagcagcgagaactgtcaagttacgtgagcattagtgctgaatctggcgtagtcttcgcacagcgcgcttttgatcacgagcaactgcgcgcttttgagttgacactccaggcccgcgaccagggatcacccgccctgagtgctaatgtctcacttcgggtccttgttgacgaccgaaacgataacgcgcctcgagtcctctatcccgcgctaggccctgatggatccgcactgttcgacatggttccccacgccgcggagccagggtacctggtgacaaaggttgtcgctgttgacgcagatagtggccataacgcatggcttagctaccatgtgttacaggcgtctgagcccggcctcttctccctgggactgaggactggagaggttagaacagcccgcgcgctgggagatcgggatgccgtgcgccagcgcttactggtggccgtgagagacggtggccagccacctctttccgctacagccaccctgcatctggttttcgcagattccttgcaggaagtcttaccagacattacagaccgtcctgacccctccgatttgcaggcggaactgcagttttatctagtggtggccctggccctcatcagtgtcctgtttctcgttgccatgatacttgctattgcgcttaggctacggaggtccagctcccctgcctcatggtcttgtttccagcctggcctgtgtgtaaagagtgagagtgtggtgccccccaattactccgaaggcacccttccttactcctacaatctgtgcgtcgcccatacaggcaagaccgagtttaacttcttgaaatgtagcgaacagctgtcctctggtcaggacattctttgtggtgacagctcaggagcgctgtttcctctttgtaattcatctgagttgaccagtcaccagcaggccccgcctaatactgactggcggttctcacaagcccagaggccgggaacgagcggctcacagaatggtgacgatacaggaacatggcctaataatcagttcgacactgagatgctccaggccatgatcctggccagcgcttcagaggctgcagacgggtccagtacactgggcgggggagctggtaccatgggtttgagcgcccgatatggtcctcagtttaccctgcagcacgtgcctgattacaggcaaaatgtatacattccaggatctaacgccacactaacaaacgccgcgggtaagcgggatgggaaagcccctgcggggggaaacggaaataagaagaagtctggcaagaaggagaaaaagtag

SEQ ID NO: 131158 - DNA, 2793 bp, Artificial Sequence
  Description of Artificial Sequence: Synthetic coding sequence
atgggaggcagttgtgcccaacgccgccgggcggggccacgccaagttctgttcccccttctcctgcctctgttctatccgaccctctctgaacccattcggtacagcatacccgaagagctggcaaaaggaagcgtagttggtaacttggctaaggatctagggctctccgtgctcgacgtgagcgctagaaaattgagagtgagtgctgagaagctccacttctctgtcgacgccgaaagtggtgacctcttggttaaaaatcgaattgatcgtgagcaaatctgcaaagaacgccgtcggtgtgagctgcaactggaagcagtagtcgaaaatccattgaatattttccatgtgattgtggttatcgaggacgttaatgaccacgctccacagtttgacaagaaggagatacacttggagatctttgaatccgcatccgccggaacaagactcagtctagatcccgctaccgacccagacatcaatattaattccatcaaagattataaaatcaactcaaatccctatttttcgctgatggtccgggtgaactccgatggaggaaaatatcctgaactgtctctggagaagctcctagatagagaggagcagaggtcccactctctgatactgaccgctttggacggcggcgatccaccacggtcagcaacagcccacatagagatcagcgtgaaggacactaacgataatcctccagtgttctctcgagatgagtaccggatctctctaagtgaaaacttgccaccaggaagcccggtcctccaggtgactgctacagaccaggatgagggtgtgaacgctgagattaactactacttccgttctaccgcccagtctactaagcacatgttttcactggatgaaaaaaccggaatgatcaaaaacaatcagtcctttgacttcgaagacgtagagcgatatacgatggaagtggaggccaaggacggtgggggtctcagcactcagtgcaaagtgataatagagattctcgacgaaaacgataactcacctgagataataattacctcactgtctgaccaaattttggagaatagcccaccaggcatggtagtcgctctgttcaagacccgggacctcgacttcggcggaaacggggaagtcaggtgtaatatcgagaccgacattccgttcaaaatctattcatcttccaacaattattacaagctggttactgatggcgccctggaccgggagcagactcctgagtacaatgtgaccatcgttgccaccgaccggggcaagccccccctgtcatccagccggtcaattactctgtatgttgctgacataaacgataatgcccctgtgttcgatcagaccagctatgtggttcacgtggccgaaaacaatccgcctggcgcatctatcgcacaggtgagtgcgtccgatcctgatttgggcctgaacggccacattagctactccatcgtggccagcgatctggagcccctggccgtgagtagctacgtatccgtgagcgctcagtcaggggtagtcttcgctcagcgggcattcgaccacgagcagttacgcgcctttgccctaacactgcaagcacgggaccacgggtcacccaccttgagcgcgaatgtgagtctccgcgtcctggtgggagatagaaatgataacgccccaagagtgctgtacccagctttaggacctgacggatcagccttttttgatatggtgccccggtccgccgaacctgggtatctggtaacgaaggtggtggccgtcgatgcagattccggtcataacgcgtggctgtcttaccacgtcctccaggcctcggagcccggtttatttagcctgggacttcgaacaggagaggtgcgtaccgctcgggcactgggcgatagggatgctgcccgccagagactgctagttgcagtgcgggacggtggccagcccccgctgtctgccacagccacactccatcttgtatttgccgacaacctacaggagatattacccgacctaagcgatcgtccagttctgtcagatccacaagcggaactgcagttttatttggtggtcgcactggcactgatcagcgtgctgttcctgttagccgtcattctcgccatcgcgctcagattgcggcgctcgctgagccccgccacttgggattgcttccaccccggattgtgcgtgaaaagcggcccagtggtcccaccaaactacagcgaaggcaccctgccttatagctacaacctgtgcattgcccacactggcacaaaagagttcaacttccttaaatgctctgtgcctctgcacagtaacgaggatatggtgtgctcagtcagtccaggggccctgataccgcctcacggtggtgaggatcttacctcacacccagaaaccctgacatcccaggcacctccaaataccgactggcgattcagccaagcccagagaccaggcacctctggaagccaaaatggcgatgatactggaacctggcccaataaccagtttgacacggagatgctacaggccatgatacttgcaagcgcatcggaagcggccgatggctccagtacattagggggcggggccggtacaatggggttgagcgcaaggtatggccctcagtttactctccagcacgtgccggattataggcagaatgtgtatattcctggcagtaacgccaccctgaccaacgccgccgggaagcgagacggaaaagctcccgccggcggcaatggaaataagaaaaagagtggcaagaaggaaaaaaagtag

SEQ ID NO: 131159 - DNA, 2790 bp, Artificial Sequence
  Description of Artificial Sequence: Synthetic coding sequence
atgggaggcagttgtgcccagaggagacgggctggtcctaggcaggtcttatttccgctgctgctgccgctgttctaccctacgctttgcgaacccataaggtacagcatacctgaggaattggctaaaggtagcgtggtggggaacctcgccaaagatctgggcttgagcgtactggacgtgtctgcaagggagttgcgagtgagcgccgaaaagcttcatttcagcgtggacgcacagtctggggatctgctcgtcaaagataggattgaccgtgagcaaatttgtaaggaacggagaagatgtgagctccaacttgaggccgtggtggaaaacccattaaacatctttcacgttatcgtcgttatcgaggatgttaatgatcacgctcctcagtttcggaaggacgaaataaatttagaaatttctgaatcagtgtccctgggaatgggaaccattctggagagtgcggaagatcccgatatcagcatgaactcactctcaaaataccagctttcgcccaatgagtactttagtctggtggaaaaggacaatcctgacggaggaaaatacccggaactggttctgcagaagacgctggatagagagacccaatcggcccatcatctcgtactgacagcattagacgggggggaccccccgcgcagtggaaccgcccaaatccgtatactggttatcgacgccaatgacaacccccccgtattcagccaggacgtgtatagagtgtccctgcgggaagatgttcctccaggcacctcaattcttcgggtgaaggccaccgaccaggatgaggggattaattcagagattacttacagttttttcggcgtggccgataaggctcagcacgtattctcgctggactatacaaccggcaatatccttacccagcagcccctggattttgaagaagtggaaagatacacgatcaatatcgaagcaaaggatagagggagtctgagtacccgctgcaaggtcatagtcgaagtcgtggatgaaaatgacaattcgcccgagattattattacttccctgtcagatcaaatcatggaagactccccccctggtgttgtcgtcgccctcttcaagacccgggatcaggattctggggagaatggcgaagtaaggtgttcgttgtcccgtggagtgccattcaaaatccatagcagttcaaataactattacaagctggttaccgacgaagccctcgaccgggagcaaactcctgagtataatgtaacaatcgcagctaccgaccgaggcaaacctccattatcttccagcaaaactatcaccctgcacatcacagatgtaaatgataatgcaccagtattcggccagtctgcttacctggttcacgtcccagagaataaccagccaggtgcctctatcgctcaggtgtcagcaagcgacccagactttggcctcaatggtagggtgtcgtacagcctaattgccagtgatttggaatcacgcaccctgagctcttacgtgtcggtctcagcccagtcaggggttgtgttcgctcaacgtgcgtttgaccatgagcaactcaggacgttcgagttgaccctgcaagcacgggaccagggaagtcccgctctgtcagccaatgtcagtctgcgggtcctcgtgggagatcggaatgataatgctccccgagtgctgtatccagccttaggaccagatggcagcgctctcttcgacaccgtcccacgcgctgcgcagcctgggtacctcgttactaaggtcgttgccgtcgatgccgatagcgggcacaacgcctggttgtcctaccatgtggtccaggctagtgaacccggtctgttcagtctcggcttgagaacgggagaggtgcgtatggtccgtgccctcggcgacaaagatagcgtgcgtcagcgcctcctggtggccgtacgagacggtggccaaccacccttaagcgcaaccgcgaccttgcatctggtgttcgctgactcattacaagaagtgctgcctgacttcagcgatcaccctactccgtcagactcccaggctgaaatgcaattttatcttgttgtggctctcgccttgatctccgttctctttctgctggctgtgatcctcgccatcgcgctcagactgcgccaatcattcagccctacagcaggtgattgcttcgaatccgtgctgtgctccaaatctggcccagttggacctcccaattacagtgaaggcacactcccgtacgcatacaacttttgcgtccctggcgaccagatgaacccagaatttaattttttcacaagcgtggaccactgccccgcaacgcaggataatctgaacaaagatagtatgctgctcgcctccattcttacgccctcggtggaggctgataaaaaaatacttaagcaacaggcacccccaaatactgattggaggtttagccaggcacagcgccccggcacatccggctcccagaatggcgatgacacaggaacctggcccaacaaccagttcgacacagagatgctgcaggcaatgatattggcaagcgcctctgaggcagcagatggtagttctacccttgggggcggggccgggaccatgggcctctctgcccgatatggtccacaatttaccctgcagcatgttcccgattaccgccagaatgtgtacatcccaggtagcaatgcaacccttactaacgccgcaggcaagcgtgatgggaaggccccagcaggaggtaacggaaataaaaagaagtccggtaagaaggagaagaaatag

SEQ ID NO: 131160 - DNA, 2805 bp, Artificial Sequence
  Description of Artificial Sequence: Synthetic coding sequence
atggtccccgaggcctggaggagcggccttgtatccactggccgggttgtcggggttctccttctgctcggtgcattgaacaaggcctccaccgtaatacactacgaaatccctgaggagcgtgaaaaaggcttcgctgttggcaacgtcgttgcgaatctgggactggatctcggatctctgagcgcccgacgctttagggtagtctcgggagcaagccgtcgcttcttcgaggtgaacagagagacgggggagatgttcgttaatgaccgtctggacagggaagaattgtgtggtaccctgccgagttgcacggttactctcgagctggtcgtggaaaatcctttggaactgttttccgtggaggtggttattcaagatataaatgacaataatcccgcctttccgactcaggagatgaagctggaaatctccgaagcagtcgctccaggtaccagatttccccttgagtcagctcacgacccagacgtgggcagcaattcactgcagacatacgaactgagtcgaaatgaatattttgcactcagagtccagacgagggaggactcgactaaatacgctgaactagtcctggaacgggccctcgatcgggaacgtgaacccagcttacagctggtgctgaccgctctagacgggggaactcccgccctgtcagcctctctgcctatccatataaaggtgctagatgccaatgacaatgctcccgtgttcaatcagagtctgtatcgcgctcgggtccttgaggatgccccgagcggaacccgagtcgtccaggtcttggcaacagacttagatgagggccccaacggggaaatcatctatagcttcgggagtcataatagggcaggggtcaggcagctgtttgctctcgacctcgtaacaggtatgctgacaattaaggggcggttggacttcgaggatactaagctccatgaaatatacattcaagccaaagacaaaggcgccaacccggaaggggctcattgcaaggtgttggtggaggtagtggatgtcaatgataatgcccccgagataaccgtcacatccgtgtactcccctgtgcccgaggacgccccgcttggaaccgtaattgcactactgtccgtcactgacctggacgctggtgagaatgggctggttacttgtgaagtccctcccggactgcccttcagcttgactagcagtctgaagaactactttactctgaagacctctgccgacctggatagggaaacagtgcctgagtacaacctttccataactgcccgcgatgccggtaccccttcactctccgccctgaccattgtacgcgtgcaggtctcagacattaacgataatcctccccagagttcccagtcatcctatgacgtttatattgaagaaaataacttgcccggggcacccatactgaaccttagcgtgtgggatccagacgctcctcagaatgcccgcctgagctttttccttttagagcaaggcgcggagacaggcctggtgggccgttatttcacaattaatcgcgacaatggtatcgtttcttctctggtgcccctggactacgaggacaggcgggagtttgagcttactgcacacatcagtgatggcggcactcccgtactcgcgaccaatatcagcgtgaacatcttcgttacagataggaatgataatgccccgcaagtgctatatcctagacctggtggcagttctgtcgagatgctccccagaggcacatccgcagggcacctggttagtcgtgtagttggttgggatgcggacgcgggtcataatgcttggctgtcatattccctgctcggatcccctaaccagagtttatttgccattggattgcacaccggacagatctccacagcccgccctgtgcaggacactgacagcccaaggcagaccctgaccgttctgataaaggataatggggagccatcacttagtactaccgccaccttgaccgtttcggtgaccgaggactctcccgaggctagagccgagttcccaagcggaagcgcgcccagagagcagaaaaagaatctgacgttctatctactcctgtcgctgattctggtctctgtgggattcgtggttaccgtgtttggggtcattatcttcaaggtgtataagtggaagcaaagcagggatctgtatcgggccccggtgtccagtctctaccggacccccgggccttcccttcacgctgatgccgttcggggtggacttatgagcccccatctatatcaccaggtttacttgacaacagactcaagacgctcagaccccctccttaagaaaccaggcgcagcatcacccctcgcgagtaggcagaatacactgcgtagttgcgaccccgtcttctaccggcaggttctgggcgctgagagcgcccctcctggacagcaggccccacctaacactgattggagattctcccaggctcagcgtccagggacgtccggcagccagaacggcgacgatactgggacctggccaaataaccagttcgacaccgagatgctgcaagccatgatcctggcctcggccagcgaagcagccgatggatctagtaccctcggtgggggcgcgggcaccatgggcctcagtgctcgctatggcccacagttcacattgcaacatgtgcctgattatcggcagaatgtatacattccaggatctaatgcaacacttacaaacgccgctgggaagcgcgatggtaaggcgcccgctggtggtaacggtaacaaaaagaaatctgggaagaaagagaagaagtag

SEQ ID NO: 131161 - DNA, 2817 bp, Artificial Sequence
  Description of Artificial Sequence: Synthetic coding sequence
atgctgcgaaaggtccgctcatggacagagatttggaggtgggcaaccctgttgttcttgttttatcatctcggttacgtgtgtggtcagattcggtacccagtcccagaggagtctcaagagggcactttcgtcggaaacgtggctcaggactttctgctggataccgatagccttagtgcgcgccgcctgcaggtggctggcgaagtgaatcagcgacacttcagggtggacctggatagtggtgcgctgcttattaagaaccccattgaccgagaggctctatgcggcctgagcgcgtcttgcatcgtgcctctggaatttgttactgaggggcccctggagatgtatcgcgccgaagtggaaatagtcgacgtgaatgaccacgcgcctagattcccaagacagcagcttgatcttgagatcggagaggcggcgccccccggacaacgcttcccgcttgagaaggcccaggatgcagacgtgggctccaattctatttcctcatatcgtctgtcgtctaacgagcatttcgccttggatgtgaagaaacgctcagatggatcactggtgccagaactgctcctcgagaagccattggatagagaaaagcaatctgattatcggctggtactgacagctgtggatgggggcaaccctccacggagcggcactgccgaattgcgtgtgtctgtcctagatgtcaatgataacgcaccagccttccagcagtctagttatagaatcagtgtcctggagtctgcccccgcagggatggtgttgatccagctgaatgcaagtgacccagacttaggcccctcagggaacgtgactttctatttctcaggacacacacccgatcgggtaagaaaccttttcagccttcaccccactacaggcaaactgacattactgggaccattggactttgaaagtgaaaattattatgagtttgatgtcagagcaagagatggaggcagcccggctatggagcaacactgctctcttagagtcgatcttctcgatgttaatgacaacgcaccgtatattaccgtcacctccgagttgggtacattgcccgagtccgcagagccggggacagttgtggcacttatttctgtgcaggatccggatagtgggtctaatggcgacgtcagtttgagaattcccgaccatctaccttttgccctcaagtctgcatttcggaaccaatttagtctggtgactgctggccccctggacagggaagcgaaatcaagctatgatatcatggtgaccgctagtgatgcaggaaacccacctctgtctactcaccgaaccatcttcctcaacatctctgacgtaaatgacaatcccccctctttctttcagcgcagtcatgaggtcttcgtgccagagaataataggccgggtgatttactctgttctctagctgcgagtgaccctgactccggcttaaacgccctgatctcatatagcctcctggaacctcgtaaccgggacgtttcggccagctctttcataagtctcaacccccagacgggtgcggtgcatgcaacccgatccttcgactacgagcagacccagaccctacagtttgaggtgcaggctagggatcggggtaacccccctttgtctagcacagttacagtcaggctgttcgtactagatctcaacgacaatgccccagcagttttgcggcccagagcccggcccggaagtctgtgccctcaggccctgccaccttccgtaggtgccggtcatcttattacgaaagtaactgccgtggatctggatagcgggtataacgcctgggtgtcctatcagctactcgaggcacccgacccatcactgtttgctgtgagcagatacgctggcgaggtgcgaaccgcagttcctatccctgctgatctccctccccagaagctcgtgatagtggttaaggatagtggttcccctccactgtccacttctgtaactctgttggtgagtctcgaagaagatacacaccccgttgtgcccgacttaagagagagcagcgcgccccgcgaaggggaatcccgcctgacgctatacttggccgtttccttggtcgctatttgtttcgtgtccttcggatcttttgttgccctgctcagcaagtgcctgcgcggagcggcctgcggagtgacgtgctttccagcagggacctgcgcctgtcttacccggtcccgtagaagagaaggcctccctccaagcaatggaattctgagaatccagctaggctccgatgacccaattaagtttgtggacgttggggggcatagtcacggctgcacccccttagctagtgcacctaccagatcggattcctttatgatggtgaagtccccttccgcccctatggctggagagcccgtgcgtccaagctgccccccgtctgacctgctgtacggtctcgagcaagccccccctaacacagactggaggttcagccaagcccagagaccggggaccagcgggagtcagaatggtgatgatacaggaacatggccgaataatcaatttgacacagagatgcttcaggcgatgatactggcctccgcaagcgaagctgccgatggctcctcaacactcggtgggggcgctggtactatgggactctctgctcgctacggaccacaattcaccctacagcacgttcccgactatcgtcagaacgtctatatcccaggctcgaatgcaactttaacgaatgcagctggtaagagagacgggaaggcccctgcagggggaaatgggaataaaaagaagtcagggaaaaaggaaaagaaatag

SEQ ID NO: 131162 - DNA, 2835 bp, Artificial Sequence
  Description of Artificial Sequence: Synthetic coding sequence
atggggccgaaaaccttaccccaactggccggaaaatggcaggtgctgtgtatgctttccctatgttgctggggctgggttagtggccagttgcggtactctgtagtggaggaatcagaacctggtactcttgtgggcaacgtggctcaggatctaggcctgaagatgacagacctgctgagtagaaggctgcagctgggctctgaagaaaacggaagatatttctcactctccttaatgtctggagcactggctgtgaatcagaagatagaccgggagtcactgtgtggcgcttccacctcatgtctcctacccgtgcaggttgtcaccgaacacccactcgagctcattcgggtcgaagttgagattcttgatcttaatgataatagcccttctttcgccaccccggagagagaaatgcgaatttccgagtcagcagcgagtggcgctcgcttccccttggattccgcccaggaccccgatgtgggaaccaacacagtctcattctacactttgtctcccaactcccatttctcgctgaacgtcaagactctaaaggacgggaaaccgtttccagaactcgtcctggagcagcagttggacagggaggcacaagccagacaccagttagttctcactgccgtcgatggaggaacgcctgcaagatcagggacgacacttatttctgtaattgttctggacatcaatgataatgctccaacatttcagtcatcggtcctgagagtcggaatacctgagaacgcaccaatcggcacccttttgttgcggctaaacgccaccgatcctgacgaagggaccaatggccagctggactattcttttggagatcataccagcgaagctgttaggaatctttttggcctggacccctccagcggagccatacatgtcctgggcccaatcgacttcgaggagagtcgcttttatgaaatccatgccagggcacgggaccagggccagcctgctatggaggggcattgtgttatacaagtggacgtgggggatgtgaatgacaacgcacccgaggtgctgctagcttccctggctaacccagtgttggaatcgactccggtaggcaccgtggttggcttatttaacgtgagagatagagactctggacgcaatggtgaggtctccttagatatatcacccgatctccccttccagattaagccctctgagaatcactattcgctgctgaccagccagcctctcgatcgggaggccacatcccattatatcatcgagctattagcctctgacgccggatccccttcccttcacaagcacctgaccatcaggctgaatatctccgacgtaaatgataatgcgcctcggtttaaccagcagttgtatacagcgtacattctggagaaccggccacctggctctttgttgtgtactgttgctgccagcgaccccgatactggcgataacgcccgactgacatacagcattgtgggaaatcaagtgcagggtgccccagctagttcttttgtttacgtaaatccagaggatggtcgaatcttcgctcagcgcacattcgactacgagttgctgcagatgttgcagatcgtggtgggtgtgagggattctggctcccctccacttcacgcaaacacatcactacatgtgttcgtgttagacgagaatgataacgctcccgccgtgctgcaccctagacctgactgggagcattcagctccccaaagattgccccgcagcgcaccccccggatccctggtcaccaaagttaccgccgtggacgccgatgcagggcacaatgcgtggttatcgtatagtctgcttccccaatccactgcacctggtcttttcctggtgtccactcacaccggcgaagtcagaacagcaagagccttattggaagacgattctgacacacagcaggtggtagtcttggttcgggacaatggagacccctctctatcaagcaccgctactgtgctcctggttctggaggatgaggatccggaggaaatgccaaaatcctcagactttctcatccatcccccagagagatcggaccttacactgtaccttatagttgccctggctaccgtgtccctcctgagcctggtgactttcacattcttgagtgctaagtgtcttcaggggaacgctgatggtgacggcggcggcggtcaatgttgccgacggcaggactccccatcccccgacttctacaagcagagctcacccaatttgcaagttagctccgacgggaccctcaaatacatggaggtgacactgaggccgacagattctcagtcacattgctaccgtacatgcttttctccagcctcagacgggagtgacttcacatttctccggcctctgagtgtgcagcagccaacagcgttggcactggagccagatgcgattcgatctaggagtaacacccttagagagagaagccagcaggccccccccaatactgattggcgattctctcaggctcagagaccggggacaagcgggtcacagaacggagatgatacaggaacttggcccaacaatcagtttgacaccgagatgctgcaggctatgatactcgccagcgccagtgaggctgccgacggttcgtctacactgggcggtggggccgggacgatgggcctttccgcgcggtacgggcctcagttcacattgcagcatgtgccagattaccgtcaaaacgtgtatattcctggatctaacgccaccctgacgaacgctgccggtaagagggatgggaaggctcccgccggcggaaatggcaacaaaaaaaaatcaggaaagaaggagaagaaatag

SEQ ID NO: 131163 - DNA, 5868 bp, Artificial Sequence
  Description of Artificial Sequence: Synthetic coding sequence
atgtttagacagttttatctgtggacatgcctcgcttccggcataattcttggaagtctgttcgagatttgcctgggacagtacgatgacgactgcaaactcgcccgcggcggacctcctgctacgattgtagcaattgatgaggagagtagaaacggaactatcctcgtggataatatgctgattaagggaacagcgggagggcctgaccccacaattgagctcagcttgaaagacaacgttgattattgggtcctcatggaccccgtcaagcaaatgttgtttctgaattccaccggtagggtgcttgaccgagatccaccaatgaacatccactccatcgtggtgcaggtccagtgcatcaacaaaaaggtggggactatcatataccatgaagtcagaattgtggtcagagacaggaatgacaacagccctaccttcaagcatgaaagctattacgctacggtgaacgagttgacgcctgtcggcaccaccatcttcaccggtttctccggggacaacggtgctacggacatcgatgacgggccgaacggacagattgagtacgtcatacagtataacccagatgatcccacatcaaacgatacatttgaaatccctctgatgctgactggcaatattgtgttgcgtaagagactgaattacgaggacaaaactagatacttcgtgataattcaagccaatgacagagcacagaacctaaatgaacggcgaaccacgacaactacactcactgttgatgtgctggacggcgacgacttagggcccatgttcctgccctgcgtgttagtacctaatacgcgggattgtaggccgctcacataccaagcagctattccagaactcaggacccccgaggagctgaacccaatcattgtgactccaccaatccaggcaattgaccaggatagaaacatccaaccaccctccgaccgcccagggatcctttactctattctggttgggactcccgaagactatcctcggtttttccatatgcatcctaggactgcagagcttagcctactggagccagtaaaccgcgacttccatcagaagtttgatctcgtgatcaaagccgagcaggacaacggccaccctttgcccgccttcgctgggctgcacatcgagattctggatgagaataaccagtctccatactttaccatgccaagctaccagggctatattcttgaatctgcccccgtgggagcaactatttctgattccctgaaccttacatcacctctgcggatcgtggccctggataaagatatcgaggacacaaaagacccagagctccacctttttctgaatgattacacgagtgtgttcacagtcactcagacaggcattacacgatatttaacactgctgcagcctgtagacagggaggagcagcaaacttatacattttcaattactgcatttgacggcgtgcaggaaagcgagccagtaattgttaatattcaggtcatggacgctaatgacaacacccccacgtttccagaaatcagttacgatgtttacgtgtacactgatatgcgtcctggcgacagcgtaatacaacttactgccgtcgatgctgacgaaggttccaacggcgagataacatacgagattctcgtgggcgcccaaggcgacttcatcattaacaaaaccacgggcctcatcacaattgcccccggtgtagagatgatagtagggcggacgtacgcgttgactgtgcaggctgccgacaacgcgccacctgccgagagaagaaactccatctgtacagtttacattgaagtcctacctccgaataaccagagcccgccccgattcccacagctgatgtattctctggagatcagtgaagcaatgcgcgtaggcgctgtgctgctgaatctgcaggccacggacagggagggggactctatcacttacgcgattgagaatggggacccccagagagtgtttaacctgtctgagaccactgggattttaacgcttggaaaggccctagaccgagagtcaactgaccggtatatcttgatcattacggcctccgatggtaggcctgatggcacgtccaccgccacggtcaacatcgttgttactgacgtgaatgacaatgctccagtttttgatccatacctgccacgtaacctgtcagtcgttgaggaagaagcaaatgcattcgtgggccaggtgaaagccacggatcccgatgctggaataaatggccaggtccactattctctgggcaactttaacaacctgttcaggatcacctcaaacggatctatttatacagccgtaaaacttaatcgggaggtccgcgattactacgagttggtagttgttgccacggacggagccgtccatccgcggcattcaacccttactctggccattaaggtgctcgatatcgacgacaactcacctgtcttcaccaattctacctacactgtactggtggaggaaaacctccccgcgggcacaaccatcctgcagattgaggctaaagacgtggatctcggcgcgaatgttagttatagaatacggtcgccagaagtcaagcacttttttgcgctgcacccgtttacgggagagctgagtcttttacggtccctggactatgaagcctttccggaccaggaggcctctattactttcctggttgaggcattcgatatctacggcacgatgcctccgggaatcgcaaccgtgacagtaatcgtaaaggatatgaacgactatccgcctgtctttagcaagcgcatttataagggtatggtcgcccccgacgctgttaagggcacaccaattacaactgtttatgccgaggatgcagacccccccggcctgccggcttccagagtaaggtaccgagtggacgacgtgcagttcccttaccctgcctccatttttgaagtcgaagaagattccggacgagtcatcaccagagttaatttgaacgaggagcccacaaccatttttaaactggtggttgttgcctttgatgatggcgagcccgtgatgagttcctctgctactgtgaagatcctggtcttgcaccctggggaaatcccaaggttcactcaggaagagtatcgacctccgcctgtatccgagctggccaccaagggaactatggtaggggtcatcagtgctgcagccataaatcagagcatcgtctatagtatcgtgtctggtaacgaggaagatacattcggcatcaataacatcaccggcgtgatctatgtgaacgggcctctagattacgagacacggacctcatatgtcctcagagtccaagctgatagcctcgaagtggtgctcgccaaccttcgggtaccctcaaaatccaatacggccaaggtgtatatcgagattcaggacgaaaacaatcacccacctgttttccagaagaaattttatatcgggggggttagcgaagacgctagaatgttcacttcagtcctcagggtcaaagcaactgataaagatacagggaattatagcgtgatggcctaccgtcttatcatacccccgattaaggagggcaaagagggttttgtggtggaaacctatacggggttgatcaaaacagcaatgctttttcataacatgaggaggtcgtacttcaagttccaagtcattgccactgatgattatggcaagggactgagtggaaaggcagatgtcctggtttcagtggtgaatcagctggacatgcaggtaatcgtgagcaatgttccccccactctggtggagaaaaaaatagaagatcttacagagatcctggataggtacgtccaggagcagattcctggtgctaaggttgttgtcgagagcattggcgccaggcgccatggggacgccttcagtttggaggattataccaaatgtgacctgaccgtctatgctattgatccccaaaccaatagagccatcgatcggaatgagctgttcaagttcctggatgggaagttgcttgacattaataaggatttccaaccatactacggggagggagggcggattttggagattagaacaccggaggctgtgacctccattaaaaaaagaggcgagtcccttggctacacggagggagccctgctggctctggccttcattattattctatgttgcattcctgctatccttgtagtgcttgttagttaccgccagttcaaagttaggcaagccgagtgtaccaaaacggctagaatccaagccgccctgcctgctgctaagccagctgttccagcaccggccccagtggctgctcccccacccccgccccctcctcctcctggcgcacacctctacgaagaactcggcgattcaagtatcctgttcctcttgtaccatttccaacagtcccgcggcaacaactcagtgtccgaagaccgaaagcaccagcaagtggtaatgccattttctagtaataccatcgaggcccataagtctgctcatgtggacgggtctctgaagtcaaataagttgaagagcgcaagaaagttcacctttctgagcgatgaagacgatctgtccgctcataaccctctatataaagagaacatttcccaagtcagcacaaacagcgatattagtcagcgaacagacttcgtcgaccccttctcacccaagatacaggctaaaagtaagtctcttagaggcccaagagagaagatccagaggctttggtcccagagcgtaagtctaccgagacggttgatgaggaaagtgccaaatagacctgagattatcgacctgcaacagtggcaggggaccaggcaaaaagccgagaacgagaacaccggcatttgcactaacaaacgaggatcgtctaacccactcttgacgacagaggaagccaacctcacagaaaaggaagagattcgccagggagagactctcatgatagagggcactgagcagttgaagtccttgagtagtgactcgtctttttgtttcccccggccccatttctctttctctacactccctacggtatccaggacagtggaattgaaatccgaacccaatgtgatctccagccctgccgagtgttctctcgagctcagccctagtaggccgtgcgttctccattcgtcactgtctcggcgcgagacaccaatctgtatgctgcctattgagaccgagcgcaacatctttgagaattttgcccaccccccaaatatcagtccttcagcttgtcccctccctcctccaccccccatctcacctccaagcccccctccagcccccgctcccctggccccccccccagatattagccccttcagccttttttgtccccctccctctccaccctctataccactccccctgccgcctccgactttttttcctttgtccgtgagcacgtccggcccccccaccccgcccctcctgccaccgtttccaacccccctgccacctcccccaccgagtatcccctgcccacccccgcctagcgcaagcttcctgtctacggaatgtgtgtgtatcaccggagtgaagtgcactacaaatctcatgccggccgagaagatcaagagttcgatgacacagttgtccacaaccacagtgtgtaagaccgatccccagcgcgaaccaaagggcatactgcgccatgtgaagaatttggccgagctggagaaaagcgttgccaatatgtatagtcaaattgagaaaaactatcttcggactaacgttagcgagctgcaaaccatgtgtccttcagaagtgaccaatatggaaatcactagcgagcagaataagggttccctaaataatattgtcgaggggaccgagaaacaatcccactctcagtctacttctctgtag

SEQ ID NO: 131164 - DNA, 5874 bp, Artificial Sequence
  Description of Artificial Sequence: Synthetic coding sequence
atgtttcgacagttctatctgtggacctgcctagcgtccgggatcatactgggctctctgtttgaaatatgcttgggacagtatgatgacgactgtaaactggccagggggggcccccccgccaccatagttgcgatcgacgaggagtctcgaaacggcactatcctggtggataatatgctgattaaagggacagccggaggaccagaccctacaatcgaactatcactgaaggataatgtcgactactgggtcctgatggatccggtgaaacagatgttatttctcaactcgacagggcgggtccttgaccgtgatccaccaatgaatattcactcgatcgtggtccaggtacaatgtattaacaagaaggttggaacaatcatatatcacgaagttaggatagtggtaagagaccgaaatgacaacagccccacctttaaacatgagtcttattatgcgaccgtgaacgagctgacccccgtgggcaccaccatttttacaggtttctctggcgacaatggagctactgatatagacgatgggcccaacggccaaatagaatacgtgattcagtacaacccagacgatcccacgtccaacgacacctttgagataccccttatgctgacgggtaacatcgtgctcaggaagagactgaattacgaggacaaaactaggtactttgtcattattcaggccaatgatcgagcacagaatctgaacgaaaggcggactaccacaacgacattgaccgtggacgtccttgacggtgacgatctgggaccaatgttcctcccctgcgtactggtgccaaataccagggattgccgaccacttacgtatcaagccgccattccagagctcagaacgccagaagaactcaatccaatcatcgttactcctccgatacaagctattgaccaggacaggaatatacagccaccaagcgataggccaggcatactgtattcaatcctagtgggcacgccggaggactacccaagattcttccacatgcacccacggaccgcggaattatctctcctggaaccagtgaaccgggatttccatcaaaaattcgacctggtcattaaggctgagcaggataacggccatccactgccagcatttgcaggacttcatattgaaatccttgacgagaataatcaaagtccgtacttcacgatgccatcataccaagggtacatactcgaatcagcccctgtgggggccaccatctccgactcactgaacctcacttcccccctccgaattgtggcactggacaaagacatagaggacacaaaagatcccgaactgcaccttttcttgaatgactacacctccgtgttcaccgtgactcagaccggaattaccaggtatctcactcttttgcaacctgtggatcgcgaggagcagcaaacttacacgttctctataacagcctttgacggggtgcaagaaagcgaacctgtgatcgttaacatacaggtgatggatgcgaatgacaatacccctacttttcccgaaatctcatatgacgtctacgtttacacagatatgcgcccaggagattctgtgatccagctgaccgctgtagatgcagatgagggtagcaacggggagatcacttacgagatattagtgggtgcccagggcgacttcatcattaacaaaaccacaggactaatcaccattgccccgggagttgaaatgatcgtaggccgcacttatgccctgaccgtccaagcagcggataacgctccgccagctgagcgcagaaattctatttgtacggtctacatcgaggtcttgcccccaaacaaccaatcgccacccaggtttccacaacttatgtactccctcgagatttccgaggctatgagagtgggcgccgtgctcctgaacttgcaggctaccgatcgggagggtgattccattacttatgcaatcgagaatggtgacccccagcgggtctttaatctatccgaaaccactggcatcttaaccctcggcaaggcactggacagggagtctaccgaccgctatatattgattattacagcgtcggacgggcgccctgacggcacaagcactgcaacagttaatattgtcgtgactgatgtgaatgataatgccccagtgttcgatccctacctgccacgcaacctgagtgttgtggaggaagaagctaatgcattcgtgggacaggtgaaagcgaccgaccccgacgccgggattaacgggcaagttcattactccctgggaaacttcaacaacctctttcggattacttcaaacggctcaatatatacagctgtaaagctgaaccgagaggtgagggactattatgagctagtagtagtggcgacagacggtgccgtccatcctcggcattctaccctgacgctggccatcaaagtgttggacatagatgataatagtccagtctttactaactcaacatatactgtgctggtagaggagaacctccctgctggcacgaccatactgcagattgaagccaaagatgtagacctgggggctaacgtgagctatcgcatcagaagtccagaggtgaagcacttcttcgccctccaccccttcacgggggaactcagtctgctaagatccctggactacgaagcttttcccgaccaggaggcatctattacctttctggtcgaggctttcgatatatatgggacaatgcctccaggtattgccacagttacggtgattgtcaaggacatgaacgattacccccctgtcttctccaagcggatttacaagggcatggtcgccccagacgccgtgaagggcaccccgataacaaccgtgtacgcggaagacgctgatcctcccggtctgcctgccagccgcgtgcggtaccgtgtcgacgatgttcagttcccctacccagccagtatcttcgaggtggaggaggatagtggcagggttatcacccgcgtcaatctgaacgaggaaccaactaccatatttaaactggtcgttgtcgctttcgatgacggtgagcctgtcatgtcctcaagtgccaccgtgaagatcttagtgctgcatcctggtgaaattccaaggttcactcaggaagaataccgtcctccaccagtgagcgagctagcaaccaagggcacaatggtcggggtgatctctgcagccgcaattaatcaatcgatagtgtactctatagtcagcggtaacgaggaggataccttcgggataaataacattactggagttatttacgtaaatgggcctttagattacgagactagaacatcttacgttctccgtgtgcaggctgacagcctagaggtggttctcgccaatctccgcgtcccctcaaagagtaacactgccaaagtgtacatcgagattcaggatgagaataatcatccacctgtgtttcagaagaagttctatattggcggagtgtcagaagatgctcggatgttcacatccgtgctccgggtcaaagccactgacaaagatactgggaattacagcgtaatggcgtatcgccttataatcccacctatcaaggagggaaaggaggggtttgtggttgagacatacactgggctgatcaaaactgctatgctgttccataacatgcgccggagctatttcaaatttcaggttatcgccactgatgattacgggaaaggcctgagtggtaaagcagacgttctcgtgtccgttgtcaaccagctggacatgcaagtgattgtgtccaatgtcccaccaacattggttgagaaaaagattgaggacctcaccgaaattctggatagatacgtacaggagcagatccctggggccaaagtggtggtcgagagtattggggctcggcgccacggagatgcctttagcttggaggattacaccaagtgcgatctaacagtgtatgccatcgatccgcagaccaaccgcgcgattgatcgcaacgagctgtttaagttcctggacggaaagctcctggatatcaataaggactttcagccgtattacggcgagggaggccggatcctcgaaatccgaactccagaggcagtgacaagcatcaagaagcgcggggaaagtttgggctatactgagggcgccttgctggctttggccttcatcatcattttgtgttgtatccccgcaatccttgtggtgctggtctcctaccggcagttcaaggtgcgccaggcagagtgcacaaagactgcccgaatccaagccgcgttgcctgccgccaaaccggctgtaccagcaccagcacccgtggccgcccccccacctccacccccaccccccccaggcgctcacctgtatgaggaactgggcgatagctcaatgcacaatctctttttgctctatcactttcagcagtcgagaggtaacaactccgtctccgaggatcgcaaacaccagcaagtggtgatgcccttctccagtaataccatcgaagcccacaaaagtgcccatgtagacgggtcacttaaaagcaacaaactgaagagcgccaggaagttcacattcttgtccgacgaagatgatctgtccgcacataaccctctgtataaggaaaacatttcacaggtgtcgaccaacagcgatatatcccagagaaccgattttgtggaccctttttctcccaaaatccaggcaaaaagcaagtccctaaggggcccccgcgagaagatccagcggctgtggtctcagtccgtgtcgctcccgagacggcttatgcggaaggtcccaaacagacctgaaatcattgacctgcagcagtggcagggtacccgtcaaaaggctgaaaatgaaaatacaggaatatgtacaaataaacggggatcctcgaatccattactcactaccgaggaggccaacctgacagagaaggaggaaatccggcagggcgagacactcatgatcgaagggaccgaacagttgaagagcttaagctcggacagctccttttgcttcccccggccccacttttctttcagcaccctgccaactgtgtcgaggaccgttgaactgaaatccgagccgaacgtaatatctagcccagcggaatgtagtctcgagctgtctccgtcaagaccgtgtgttttgcacagtagcctctccagacgggaaactcccatctgtatgcttccaatagagactgaacgaaacatcttcgagaacttcgcacaccctccaaatatatcaccctcagcctgccctctccctccaccccctccgattagcccaccctctcctcctcccgctccagccccccttgccccgcccccagacatctcgccctttagcctgttttgcccacccccatccccacctagcatccctctgcccctcccacccccgacattcttcccactctctgtatccacctccggacccccaaccccaccactcttaccgccctttccaacacccttgcccccccctccgcccagtattccctgtccccctccaccttctgcatcattcctatctacagaatgcgtctgtattactggagttaaatgcaccactaacctgatgcccgcagagaagataaaatcatctatgacccagctgtctacaactactgtctgtaagacagatccccagcgggagccaaaaggtatacttcgccatgtgaagaacttggcagagctcgagaaatctgtggctaatatgtacagccagatcgagaagaactacctccggaccaacgtctccgagctccagactatgtgtccatcagaggttacaaacatggaaattacttctgagcagaacaaaggttctctcaataacatcgtggaaggcaccgagaagcagagtcactcccagagcacttccctgtag

SEQ ID NO: 131165 - DNA, 2886 bp, Artificial Sequence
  Description of Artificial Sequence: Synthetic coding sequence
atgtttcgacagttttacctatggacatgcctggcttccggaatcatcctggggtcattgttcgaaatttgtctgggacagtatgatgacgactgcaagttggcacgcggtggtccgcccgccacaatcgttgccatcgacgaagaatcacgcaacggtaccatcctcgtagataacatgctgataaaaggcacggcaggtggccctgaccccactattgaactttcactgaaggacaacgtagattactgggtgctcatggaccccgtaaaacagatgctgttcttaaatagtacaggccgcgtcctggatcgcgatccccctatgaacattcacagcatagtagtacaggtacagtgcattaataagaaggtgggtaccatcatatatcacgaggtccgcatcgtggtgcgagacagaaacgacaactctccaacgtttaaacatgagtcatattatgctacagtgaatgaactcacgcctgtcggtaccacgattttcacggggtttagtggagacaacggagcaaccgatatcgatgatggaccaaacgggcaaatcgagtatgtgatacaatacaatccagacgatcccacaagcaatgataccttcgaaattcctctgatgcttacaggcaatattgtcctgagaaagcgactcaactacgaggacaagactcgctatttcgtgataatccaggcaaacgaccgggcacagaacctgaatgagcgccggaccacgacgactactctcacagttgacgtactagacggcgacgacttgggccccatgttcctgccgtgcgtgcttgtacctaatacccgcgattgtcggcctttgacctaccaggcggcaataccagagttacgaacccccgaggagttaaaccccataatagtgacaccccccatccaagcaatcgatcaggatcgaaatatccagcccccctctgataggcctggcattttatattcaatcttggtagggactcctgaggactaccccaggttctttcacatgcacccccggactgccgaactcagcctccttgaaccggtcaaccgcgattttcaccaaaagtttgacctggtcattaaggccgagcaggataacggtcacccgctgcccgcctttgcaggacttcacatcgaaatcctggacgaaaacaatcagagtccatactttaccatgccgtcctatcaagggtacatcctggagtccgctccggtgggtgctactatatctgactcacttaacctcactagccccttgcgaatcgtcgcactggacaaagacatcgaggacactaaggatcccgaactgcatctgtttttgaacgattacacttccgttttcaccgttacacagacaggaatcacccggtatctgactcttctgcagccggtggacagagaggaacagcagacctacaccttcagcattaccgcctttgacggagttcaagagagcgagcctgtgattgtgaatattcaggtaatggacgctaacgacaacaccccaaccttccctgagatcagttatgacgtttatgtctacactgacatgagacccggcgacagcgtgatacagctcaccgccgtagatgcagacgagggatcaaacggagagataacttatgaaattttagtgggggcccagggcgattttatcattaataagaccactggtctcattaccatcgctccaggggtggaaatgatcgtgggccgcacctacgctctgactgtgcaagctgcagacaacgcaccaccggccgaacggagaaactccatatgtactgtctacatcgaagttcttcctcctaacaatcagagcccgccaaggttccctcagttgatgtatagcctagagatatccgaggccatgcgggtgggggctgtacttttgaacttgcaggccacggacagagaaggcgatagtattacctacgccatcgagaatggggacccacaacgtgtgttcaacttgtcagaaaccaccggcattctcacactgggaaaggccttggatagagagagtaccgatagatatatcctgattattacggcctcagacggccggcctgatggaacttctacagctacagtgaatatcgtagtcactgatgtgaacgataacgcaccagtgttcgatccatatttgcctcgaaacttatctgtggtcgaagaagaagctaatgcattcgtgggccaagtaaaggccaccgacccagacgctgggattaacggccaggtccactatagtctgggcaactttaacaacctgttcagaatcacaagcaacggttctatttatacagcggtcaagttgaatcgggaggtgagagattattacgagctggtcgtcgtcgcgacggacggggccgtgcaccctaggcacagcactctaactctcgccattaaagttctggatatcgacgacaattcccccgtattcactaatagcacttatactgtgctagtagaggaaaatctgccggctgggacaaccattttgcaaattgaggccaaagatgtcgatctaggggcaaacgtctcttaccggattagaagccccgaagtaaagcacttttttgcgcttcaccccttcaccggggaactttcccttctccgcagtctggattatgaagcatttcccgatcaagaggccagcatcacttttctggttgaagcttttgacatatacggcacgatgccccccggcattgctacggtgacagtgattgtcaaggacatgaatgactatcccccagtcttcagtaagcgtatctataaaggtatggtggctcctgacgccgtgaaaggaacccccatcacaaccgtgtatgccgaagacgccgacccacccgtctcacgccgccattag

SEQ ID NO: 131166 - DNA, 2430 bp, Artificial Sequence
  Description of Artificial Sequence: Synthetic coding sequence
atgttccgacaattttacctgtggacttgtctagcaagtggcataatcttgggatctctgttcgagatctgcctgggtcagtatgatgatggcaccatcctggttgacaacatgcttattaaaggaaccgcaggtggcccggacccaaccatcgagctgtctctgaaagataacgtcgattattgggtcctgatggatcccgttaagcaaatgctgtttcttaactccaccggaagagttttagatcgggatcccccaatgaatattcatagcatagtcgttcaggtgcagtgtatcaacaaaaaggtcgggaccatcatctaccatgaagtgcgaatcgtcgtccgcgacagaaacgacaattcacccacatttaaacacgagagctactacgcaacagtaaatgagctgacgccggtggggacaacaatttttacaggattcagcggcgacaacggggcaaccgatatcgacgacggccctaatggccagatcgagtatgtcatacaatacaatccagatgaccccacttccaacgatacatttgagatccccctcatgcttacaggcaacattgttttgaggaagcgtctgaactatgaagacaagacccgttatttcgtgattatccaagctaacgatagagctcaaaacctcaacgagaggaggaccactaccacaactctcactgtcgacgtgctggacggggacgacctcggtccaatgttcctcccctgtgtcctcgtgcctaataccagggactgccgcccactgacataccaggcagctatccccgagctgagaactccggaagagctcaatcctatcatagtcacacccccaattcaggcaatcgaccaggatcgcaatattcagccccccagcgacagacctggcatactatacagtattctagtcgggacccctgaggattatccaagattttttcacatgcatcctcgcactgctgaactgtccctgttggagcctgtcaacagggatttccaccagaagttcgatttggtcataaaggcagagcaggacaatgggcacccactccccgccttcgccggcctgcacatcgaaattctggacgagaataaccagtccccgtactttactatgcccagctaccagggctatatcctggaatccgcaccggttggcgccaccattagcgattccttgaacctgaccagcccacttagaattgtagctctggacaaagatatcgaagacacgaaggatcctgaactgcatctcttcctgaatgattatactagtgtgtttactgtgacccagaccgggatcactagatatctgactctgctccagcctgtcgaccgagaagagcagcaaacatatactttttccatcacagcgtttgacggggtgcaggaatctgaacccgtgatcgttaacatccaagttatggatgctaacgataacacacctacatttcctgagattagctatgatgtgtatgtgtacacagacatgcgaccaggtgatagcgttatacagttgacagcggtggacgccgatgagggctcaaatggggaaattacttacgagattctggttggtgcgcagggggatttcattatcaacaagacaactggactgattaccatcgcccctggggtcgaaatgattgtgggccgtacatatgcacttacagtgcaggccgctgacaatgccccacccgctgagcggaggaatagtatttgcacagtttacatcgaggtgttaccaccaaacaaccaaagtccaccaagatttccgcaactgatgtatagtctggaaatctctgaggcaatgcgggtgggcgctgttctattaaacttacaggcaacagatcgagagggtgattctataacatatgcaatcgagaacggagacccgcagagggtgttcaacctaagcgagactacgggaatcctaaccctcggcaaagctctcgaccgggagtctactgataggtacatccttatcatcacagctagcgacgggagaccggacgggacctcaaccgctacagtgaatatcgttgtcaccgatgtcaatgacaacgcccccgtttttgacccttatcttcccaggaatctttcagttgtggaggaagaggcaaacgccttcgtcgggcaggtcaaactgagcaccaccaccgtctgtaagaccgaccctcagagggagcccaagggcattctgagacatgtaaagaatttagctgagctggagaagtctgtagcaaacatgtatagccagattgaaaaaaattacttaaggactaatgtgagcgaattacagacaatgtgcccctctgaggtgacgaatatggagataacaagcgagcagaataaaggctctctgaataatatcgtggaaggtaccgagaagcaatcccactcacagtccacatcactctag

SEQ ID NO: 131167 - DNA, 5055 bp, Artificial Sequence
  Description of Artificial Sequence: Synthetic coding sequence
atgtttcggcagttttatctgtggacttgtttggcctctggtatcatcctcggctccctcttcgaaatatgcctgggacagtatgatgatgattgcaagttagcacgaggaggacctccggcaaccatcgtagctattgatgaggagagtaggaatggcaccatccttgtagacaacatgctaatcaagggcacagccggaggtcccgatcccacaatcgagctgtccctgaaggataacgttgactactgggtgctgatggaccccgtaaaacagatgctgttcctcaattctacggggagagttctcgatagggacccaccgatgaacattcattctatcgtcgtccaggttcagtgcattaacaagaaggtggggactattatctatcatgaggttagaatcgtagtccgcgatagaaacgacaattctcccacattcaaacacgagtcatattacgcgaccgtgaatgaactgacgcccgtcggcactacaatctttaccggtttcagcggggataacggagcaacagatattgatgacggccccaatggccagattgagtatgtgattcagtacaaccccgacgatccgacatccaacgataccttcgaaatccccctgatgttgaccggaaacatcgtgctgcgcaagaggctcaattacgaggacaagactagatatttcgtgatcatccaagcaaatgaccgcgcccaaaaccttaacgaacggaggaccactactacgactctgacagtagatgtgctggacggcgatgatctagggcctatgttcttgccctgtgtgctcgtacctaacacacgcgactgccgaccactgacttaccaggctgctatacccgaacttcggacgcccgaggagcttaatcctataattgtgacgcctccaatccaggccatagatcaagacagaaacattcaacccccctcagaccgtccaggcatattgtactctattctggttgggactcctgaggattaccctcgcttttttcacatgcacccccgaactgctgagctgtctttgctggagccagtgaacagagactttcaccagaagtttgatctagttataaaagccgaacaggataatggtcatccgctgccggcctttgctggtctccacatcgaaatcttagatgagaataatcagtccccctatttcacaatgccgtcttaccaaggctatattctagagagcgcccctgtgggggctacaatctctgactcgctgaatttgaccagccccctgagaattgtggccctcgacaaagacattgaggatgtgccgccgagcggtgtgccaacaaaggatccggagctccacctctttttaaatgactacacctcagttttcacagtgacccagaccggcatcacaagatatttgaccttacttcagcctgttgatagggaggagcagcaaacctacacattctcaatcactgccttcgacggagtccaggagagtgaacccgtaatcgttaacattcaggttatggatgccaacgacaatacacctacattccccgagatctcctacgatgtttacgtgtatacagatatgcgcccaggcgacagtgtgattcaattgaccgcagtggacgccgatgagggcagcaacggcgagatcacctacgaaatcctggttggggctcagggagattttataatcaacaaaaccacagggttgatcaccatcgcccccggtgtcgaaatgattgtcggcaggacttacgcactcaccgtccaagccgcggataacgctcctcccgccgagcgccgaaactcaatctgtacagtctacattgaggtgctgccacccaacaatcaatccccccctcgatttccccagcttatgtattctcttgagatttcagaggcaatgcgtgtaggcgctgtgctcctcaatctccaggccaccgaccgagagggcgatagcatcacgtacgcaatcgagaacggggacccacagagggtctttaatctctccgagacaacagggatcttgaccctcggcaaagctctggatcgtgagtccacagacagatacatactgattataacagcttctgacgggagacccgacggaacctcgacagctactgttaacatcgtggtaactgatgtgaacgataatgcccctgtgttcgatccatatctgccccgcaacttatccgttgtcgaggaagaagctaacgcctttgtgggccaggtcaaagcaacagatccggatgccgggatcaatggacaagtacactatagcctgggcaactttaataacctgtttcgaattacgagtaatggctctatatataccgctgtgaagttgaatcgagaagtgcgggactattacgagttggtagtcgttgctaccgacggtgcggtgcacccccggcattcgacccttactctggcgataaaagtcctcgacattgatgacaattcacctgtcttcaccaactctacctacaccgtgctggtggaggaaaatcttcccgcgggcaccacgatcctgcaaatagaggcaaaggacgtagaccttggagccaacgtttcctatcgtatcagatcccccgaagttaaacacttcttcgccctgcaccccttcacgggggaactgagtctgctgagatccctggattacgaagctttcccagaccaggaagcatccatcaccttcctggttgaagcgttcgatatatacggcactatgccccctggcattgccaccgtgacagtgatcgtaaaggacatgaacgattaccccccggtattctctaaacggatctacaaaggaatggtagctcccgacgctgttaaaggcacacctatcacaacggtctatgctgaggacgcagatccccccggcctgccggccagccgggtgcggtatagggtggatgatgtgcaatttccgtacccggcctccatttttgaggtggaagaagatagtggccgggtgattactagagtgaatctcaacgaggaaccaactaccatattcaaactggtagtcgtggccttcgacgacggagaaccagttatgagtagtagcgccaccgtgaagatcttggtgctgcaccctggcgaaattccacgcttcacccaagaagagtataggcctcccccagtaagcgagttggccaccaagggtaccatggtcggggtgatctcagctgcagccatcaatcagagtattgtctacagcattgtcagcggtaacgaagaagacacattcggcatcaacaacatcaccggcgtaatttatgtgaatggccctctcgattacgaaacacggacctcctatgttttgagggtgcaagcggactcgctggaagtcgttctcgcaaacttgagggtgccgtccaagtcgaacaccgcaaaggtctatatcgaaatccaggacgaaaataatcatccccctgtgtttcagaaaaagttctacatcggaggggtgtctgaagatgcaaggatgtttaccagcgttcttagggttaaagcgaccgataaagatactggaaattacagtgtgatggcgtatcggttgattattccacccattaaggaggggaaggaagggtttgtcgttgagacatataccggtctgatcaaaaccgccatgctgtttcataatatgcgacgctcttactttaagttccaagtgatcgccaccgacgattacgggaagggactcagcggcaaggctgacgtgctagtttcggtggtgaaccagctggacatgcaggtcatcgtgagtaatgttccacctactctggtagagaaaaaaattgaggacttgacggagattctggacaggtacgtgcaggagcagatacccggcgctaaagtggtggtggagtcaattggagcccgccgccacggagatgctttctctctggaagattacactaaatgtgacctcactgtctatgccatcgaccctcaaactaaccgcgctatagaccgaaacgagttgtttaaatttttggatggcaagctactggacataaataaggactttcagccctactacggggagggaggaaggatccttgaaattcgcactcccgaagctgtgaccagcataaagaagcggggagagtcattgggttacactgaaggagccttgcttgcccttgcattcataattatactctgctgtatacctgcaatcctcgtagtgttggtttcctacaggcagttcaaggtaagacaagccgagtgtacgaagacagcccggatacaggctgctctgcctgccgcgaaacccgcagtccctgctcctgcgcctgtggccgcaccccccccccctccacccccaccccctggcgctcacctgtatgaagagttaggagattccagcatgcacaagtatgagatgccgcagtatggaagccgtaggagacttctgccacccgcggggcaggaagaatacggtgaggttgtcggagaggctgaagaggaatacgaggaggaagagtgggcacggaagcgaatgattaagctggtcgttgacagggagtatgagacaagcagcactggagaggacagcgctcctgaatgccagcgcaacaggcttcaccatccgagcatccacagtaatattaacggcaacatctatattgcccagaacgggagcgttgtcagaaccagaagagcttgccttaccgacaacctaaaggtggctagtccagtccggctgggtggccctttcaaaaaattggacaagctcgccgtcacacatgaagaaaacgtccctctgaataccctcagcaaagggcctttcagtaccgaaaagatgaatgctagacctacattggtgacattcgccccttgccccgtcggcaccgacaatactgccgtgaagcctctgaggaatcgtctgaagagtactgtggagcaggagtctatgatcgattctaagaatatcaaagaggcccttgagttccacagcgatcacacacaaagtgatgacgaggagctgtggatggggccatggaataacctccatatccctatgacaaagctctag

SEQ ID NO: 131168 - DNA, 5859 bp, Artificial Sequence
  Description of Artificial Sequence: Synthetic coding sequence
atgtttcgccaattctacctgtggacatgtctggcttctgggatcattctggggagcctgtttgagatctgcctcggacaatatgatgatgactgcaaactggctcgcggggggccacctgcaactattgttgccatcgatgaggagagccggaacggaaccatcctggttgataatatgttaattaaggggactgccggaggaccagatcctactatcgaactctctctgaaagacaacgtcgactattgggtcctgatggatccagttaaacagatgctcttcctgaacagcactggcagggttttggacagggacccaccaatgaacattcacagtattgtggtgcaggtgcagtgtattaataagaaagtgggaactattatctatcacgaggtgcggattgtggtccgcgaccgcaacgacaatagtcccacctttaagcatgagtcttactacgcgacagtcaatgagctgacgcccgttgggactaccatattcacaggattctctggagacaacggcgccactgacatagacgatggaccaaatggacagatagagtatgttatccagtacaatcctgacgacccaacttcaaacgacactttcgaaattcctctgatgcttaccggtaacattgttctgcggaagagactgaactatgaggacaagacacgatacttcgttataatacaagcgaacgatcgggcccaaaacttgaatgagagacggacaaccacgacaaccttaaccgtggatgtcctggacggtgacgacctgggaccgatgtttctgccttgcgttctggtgcctaatacccgtgactgtcgtcccctcacgtaccaggcggctatccccgagctccgaaccccggaagaactgaaccctatcattgttacaccaccaatccaagctattgaccaagatcgcaacatccagccccccagcgataggcccgggattctttattcgattctggtagggacccctgaagactatccacgctttttccacatgcacccccgcacagcagagctgtcacttctcgaaccggtcaatcgcgattttcaccaaaaattcgatctcgttatcaaagctgaacaagacaatggccacccccttcccgctttcgcaggcctacatattgagatcctggacgagaacaaccaaagcccttacttcaccatgcctagctaccagggctacatcctggaatctgcacctgtgggcgcaacaatctccgactccctgaatctcacaagcccactgagaattgtggccctggacaaggacatcgaggatactaaagatcctgagctccaccttttcctgaatgattacaccagtgtgttcactgttacccagaccggcatcacgagatatctgaccctgttgcaaccggtggaccgagaggagcagcaaacctatacttttagcataactgcatttgacggagtccaggaatcagaaccagtgattgtgaacatccaggtcatggacgctaatgataatactcctacctttcctgagattagttacgacgtttacgtgtacactgatatgaggcccggggatagcgttatccagttgactgctgtagatgctgatgagggctccaatggtgaaataacctacgaaatcctggtgggggcacaaggggacttcatcattaacaaaactactggcctgattacgatcgcaccaggagtggaaatgatcgtcggtaggacttatgccttgacagtgcaggccgccgataacgctccccccgccgagcggcggaactccatttgcacggtctatatcgaggttctgcctcccaacaatcaatcaccaccccggtttccacaactgatgtactcccttgaaataagcgaggccatgagagtgggagcagtgctgctcaacctccaggcgactgatcgggagggggacagcatcacctacgccattgaaaacggggaccctcaacgggtgttcaacctgtccgaaaccaccggcatcctgaccttggggaaagcactggatagggagagtacagaccgctatatcctgatcataacagcttccgacggccggcctgacggcacgtctaccgccacagtaaatatcgtggtaaccgatgtgaatgataatgctcctgtgttcgatccatatctcccccgaaatctgtcagtcgttgaggaggaggcgaatgctttcgtcggccaagttaaggctaccgaccctgacgccggaataaatgggcaggtgcactattccctcgggaactttaacaatttgtttcgaatcacgtccaacggatctatttatactgccgtgaagctgaacagggaagtcagagattattatgagctggtggtcgtggctactgacggggcggtgcacccacgccattcaactttaacattggctataaaggtcttagacatcgatgataacagtcccgtttttactaactctacttacaccgtgctggttgaagagaacttaccagctggaaccactattctgcagattgaggccaaagacgtcgacctgggggctaatgtctcctatagaatccgctcacctgaagtgaaacacttttttgcacttcatccctttaccggagagttaagtcttctgcggagcctcgattacgaagcattcccagatcaggaggcctcaatcactttcctggtagaggcatttgacatctacgggacaatgcccccaggcatcgccacagttacagtcattgtgaaagatatgaacgactatccccctgtgttcagcaaacgcatctacaagggaatggtcgcaccagatgccgtaaagggtactcccattaccactgtgtacgccgaagacgcggaccccccagggttgcctgccagccgcgtaaggtatcgagtcgatgacgtccaattcccatacccagcttctattttcgaggttgaggaggacagtggacgcgtcattacacgcgtcaatcttaacgaggagcctaccaccatcttcaagctcgttgttgtggcctttgatgacggagagccagtcatgtcatcttccgcaactgtgaagattcttgtgttacatcccggcgagatcccacgctttacacaagaagagtacaggcccccccccgtgtctgagctcgcaactaagggcactatggtaggtgtgatcagcgctgccgctatcaatcaaagcatcgtttattcgatcgtgtcaggtaacgaggaagatacattcggaattaataacatcaccggagtgatttacgtgaacggtcccctggactacgagaccagaacaagctacgttttgcgcgtgcaggcagattcgctcgaggttgtgcttgcgaatctacgggtgccatctaaatctaacacggccaaagtgtatatcgaaattcaggacgaaaataaccatcctcccgtgttccagaaaaagttttacattggaggggtcagtgaggacgcccgaatgttcacttccgtgctgcgagttaaggccaccgacaaggacaccggaaactactctgtcatggcatatcgactgatcatccctcccattaaagaggggaaggagggctttgtggtcgagacctataccggattgatcaagacagccatgctgtttcacaatatgcggaggtcatatttcaagttccaggtcatagctaccgacgactacggcaagggactaagtgggaaagccgacgtgcttgtgtctgtagtgaatcaactggacatgcaagtgatcgtctcaaatgtcccacccactcttgttgagaaaaagattgaagaccttaccgagatacttgatcgctatgtgcaggaacagatacctggcgccaaggtggtcgttgagtctattggggctagacgacacggagatgccttctctcttgaggactatacaaagtgtgaccttactgtctatgccatagacccgcagaccaaccgcgctatagacagaaatgaacttttcaagttccttgatgggaagttgctcgatataaataaagatttccagccttattacggtgaggggggcagaatactcgagatacgcacacctgaggcagtgacttctatcaaaaagaggggcgaatctcttggatataccgagggcgctcttctggcattagctttcatcatcatactgtgttgtatccccgccatcctggtggtactggtatcctacaggcagcgccaagcagagtgtacaaaaaccgcaagaatccaggcggcattgcccgctgccaaacccgctgttcccgcaccagcacccgtagccgcaccgccgccccccccccctccgcctccgggagcacatctctacgaggaactgggcgactcctccatcctgtttttactgtatcacttccagcagtcccggggcaataactccgttagtgaagatcggaaacatcagcaggtggtgatgcccttctcctccaacactattgaggcacacaaatccgcacacgtcgacggatctctgaaatctaataaactgaagagcgctcgcaagtttacgttcctgtcagatgaggacgacctgtccgcgcataaccccctttacaaggagaacatctcccaggtttccactaattccgatatcagtcagcggacagacttcgtggaccccttctccccaaagatccaggctaaatctaagtccctgagaggtccgcgagaaaagatccaacgactttggtcacagtctgtgagtttacccaggaggctcatgaggaaagtgccgaaccgccctgaaataatcgacctgcaacaatggcaaggaacccggcagaaagccgaaaacgaaaacaccggcatatgcactaataagaggggttccagcaaccccctgctgaccacagaagaagcaaacctgacggagaaagaggagatcaggcaaggagagaccctgatgattgaaggtaccgaacaactgaagtcactctcctccgactctagcttttgtttccccaggccacacttcagtttcagtacactgcccaccgtgtcaagaaccgtcgagctgaagtccgagccaaatgtcatctcatcacccgccgaatgcagtctggaattatcaccaagtcgtccttgtgttctccattctagtctgtccaggagggaaacccccatctgtatgcttcctattgagactgaacgcaacatctttgagaacttcgcccaccctccaaatatctcgccatccgcctgtcccctgcctccaccacctccaatttcaccacccagccctccaccggctcccgctcctcttgcacctccaccagacatttctcctttctcccttttttgccctcctccctcccctccttcaatacctctcccccttcccccccccacattctttccattatcggtgagcacaagcgggccacctaccccaccccttctcccgccctttcctacccctctgccacctccccccccttccattccttgtcctcctccccctagtgcctccttcctctccaccgaatgtgtatgtatcaccggtgtcaaatgcactaccaacctgatgcctgctgagaaaattaagtcttcaatgacacagctgtccactacgactgtctgcaaaaccgatccacaaagggaacccaagggaattctgcgacacgtgaagaatctggccgagcttgaaaaatcggtggccaacatgtatagccagattgaaaaaaattacttgaggaccaacgtgtccgagcttcaaaccatgtgccctagcgaagtgacgaatatggaaattacatccgagcagaataagggctctctgaacaatattgtcgagggaacagagaagcagtctcattctcaaagcaccagcttgtag

SEQ ID NO: 131169 - DNA, 5748 bp, Artificial Sequence
  Description of Artificial Sequence: Synthetic coding sequence
atgttcagacagttttatctgtggacttgcctggccagcgggatcattcttggttccctgtttgagatatgtctagggcagtacgatgatgactgcaaactagctcgcggtggccctcccgccacgattgtcgctatcgatgaagagtcaagaaatggtaccatattggtggataatatgttaatcaaaggcactgcaggcggacctgatcctactatcgagctctcgttgaaagataatgtggattattgggtgctcatggaccccgtcaaacaaatgctgtttctaaacagcacaggaagggttctggatagagaccctcccatgaacatccatagtatcgttgttcaagtacagtgcatcaacaagaaggtgggaacaattatataccacgaagttagaatcgtagttcgcgaccgcaacgacaattccccgaccttcaagcacgagagttactatgccactgtgaatgaactaacacctgtggggacaacaatcttcacaggcttttccggcgacaacggagccactgacatcgatgatgggcccaatggacagattgagtatgttattcagtataatcccgacgatccagacagggcacaaaacctcaatgagcgacgcactaccaccacaactctgacggtggatgtgctcgacggggatgacttaggcccaatgttcctgccttgtgtgctggtccccaacactagggactgtcggccgttaacctaccaggcagcgatcccggagctgagaactcccgaagaacttaaccccatcattgtcacgcccccaatacaagcaattgaccaggatagaaacattcaacctcctagcgaccgcccagggattctgtactctattctggtgggtaccccagaggattacccgcggttttttcacatgcatccacggaccgctgagctgagcctcctagagccagtaaaccgcgatttccaccaaaagttcgatctcgtcatcaaagcagagcaggataacggccaccccttaccagctttcgcaggactgcacatcgaaattctagatgagaacaaccagtcaccatacttcaccatgccctcgtatcagggatacatcctcgagagcgcgcctgtgggcgcaacaatctctgattctctgaatcttacatccccactgagaattgttgccctggacaaagatattgaggatactaaagaccctgagctgcacctgttcttaaatgactatacatcagtcttcaccgtgacccagactgggattacaaggtatctgactttgttgcagcccgtcgatcgcgaggaacagcagacctataccttctccatcacagcattcgacggcgtccaggaaagcgagcctgtgattgtcaacattcaggtcatggacgctaatgataacacccccactttccctgagataagctacgacgtttatgtctacacagatatgcggcctggcgactcagtgattcagttgaccgccgtggacgcagatgaggggagcaacggggagatcacgtatgaaatactggtgggagcccagggagacttcataatcaacaaaacgacaggccttattactatcgctcctggcgttgaaatgatcgtcggaaggacctatgcactcacggtgcaagctgcagataatgcccccccagctgagagaagaaactcaatatgcaccgtgtacatcgaggtattgcctccaaataatcagtctcccccacgattccctcagctgatgtattccttagaaatttccgaggcaatgagggtcggggcagtcctcctgaacctgcaggcaacagatagagaaggagacagcattacctatgcgatagagaatggcgaccctcaaagagtcttcaatctaagcgaaactactggcatccttaccttgggcaaagccctggacagagagagcacagataggtatatactgatcatcacagcatccgatggtcgccccgatgggactagcacagccacggttaatatcgttgttacagatgtgaatgataacgcccctgtgtttgacccctacctgccgcggaatctcagcgttgtggaagaggaggcaaacgctttcgtcggtcaggtgaaagcgacagacccagatgccggaatcaacggacaggtgcattacagtctcggcaattttaataatctgtttcggatcacctccaatggcagcatctacactgccgttaaactgaatagagaagttagagactactatgaacttgtagtggtcgccactgacggcgccgtgcatcctaggcactcaaccctgacattagcgattaaagtacttgatatcgatgataattctccagtcttcactaacagcacctacactgtgctggtggaggaaaatcttcctgccggaactaccattctgcagattgaagccaaagacgttgacctgggcgctaatgtttcgtaccgcatccggtcaccagaggttaagcacttcttcgctctgcatccgttcacaggtgagttaagcctcctgagaagcctggattacgaggcttttcccgaccaggaggctagcatcactttccttgttgaagcttttgacatatacggaacaatgccaccaggcatagctaccgtgacagtaattgtcaaagatatgaacgactacccgcccgtatttagcaaaaggatttacaagggtatggtggctccagatgctgtgaagggaactcccatcaccaccgtttatgcagaggacgccgacccgccaggacttcctgccagcagagtaaggtacagagtggatgacgtccagtttccttaccccgcgtccatcttcgaggtggaagaggattccgggcgtgtgattactcgcgtgaatctaaatgaagaacctaccaccattttcaagctcgtggtggtagcatttgacgatggcgagcccgttatgtccagctccgctacagtcaaaatcctcgtgctgcatccaggggaaattcctcgtttcacacaggaggagtacaggccccctccagtgtccgagctggccacgaaaggcaccatggtcggcgttatctctgctgctgccatcaatcaatccattgtgtacagtatcgtgagcggaaatgaggaagacacctttggcataaataatattactggggtgatttatgtgaatggacccctggattatgagaccaggacttcctacgtgctccgcgtacaagccgattcgctcgaggtagtgctcgccaatctgagagtaccctctaagtctaatactgctaaagtctacattgaaatccaagacgagaataatcatcctccagtgtttcagaaaaagttttacattgggggcgtgtctgaggacgcaaggatgtttacttctgtgctgcgggtgaaagccactgacaaggatacaggcaattacagtgtcatggcataccgtctgattatacctcctatcaaggagggcaaagagggctttgtagtggaaacctacaccggcttaatcaagacagccatgcttttccacaatatgcgaaggtcgtattttaaatttcaggtcatcgctaccgacgattatggaaaggggttgagcgggaaagccgatgtgctcgtgtctgttgtgaaccaactcgatatgcaagttatagtgtcaaatgtcccccccacccttgttgagaaaaagatcgaagatctgacagagatcctggaccgatatgtgcaagaacagatccccggagccaaagtcgtggttgagtccatcggtgctagaagacacggcgacgccttctctctggaagattatacaaaatgcgatcttaccgtgtatgctatcgatcctcagaccaatcgggctatcgaccggaatgaactttttaaattcttggacggtaaattgctcgatatcaacaaagactttcaaccctactacggtgaaggtggacgcatattggagatccggaccccggaagccgtgacaagtatcaaaaaacggggggaaagcctcggatacactgagggagccctgctcgcactggctttcatcatcatcctttgttgcattcccgctatcctcgtggtgctggtgtcttatcgacagcggcaggctgagtgcactaagactgcaagaattcaggcagccctgcctgctgcgaagccagccgttcctgcccccgcacctgtggctgccccgccccctccacctccgcctcccccaggtgcacatttgtacgaagagctgggcgactctagcatcctcttcctcctataccactttcaacagagtaggggtaacaattctgtttcagaggaccgcaagcaccagcaggttgttatgcctttttcatccaatactatagaggctcacaaatccgcacatgtggatggatccctgaagtctaacaagctcaagagtgctcggaaatttacattcctgtccgatgaagacgacctcagcgcccacaaccccctgtataaggagaatatcagccaggtttcgaccaacagcgatatcagtcagcggacagatttcgtcgaccctttttcccccaagatccaagcgaaaagcaagtctcttcggggcccaagagaaaagatccagcggctgtggtctcagtcggtcagtctgcccagacgcctgatgcgaaaagttccaaaccggcccgagattattgacctccagcagtggcaaggtacacgacagaaggcggagaacgagaacacagggatttgtactaataagcggggctctagcaacccactgttaactactgaggaagccaacttgaccgaaaaggaagagattcggcaaggtgagacactgatgattgaaggaaccgaacagttaaagtcactgagcagcgattcgtccttctgtttcccccggccacacttttctttcagcacacttccaactgtgtcccggacagtggagctcaagtcagagcccaatgtgatctcatcaccggccgagtgctcactcgaactgtctcctagtcggccctgcgtgctgcactcctcactcagccgcagggagacacccatctgcatgctgcccatcgaaaccgaacgaaatatctttgaaaatttcgctcacccccctaacatttctccatcagcatgcccgctgccgccaccaccccctatctccccaccaagtccgcccccagcacctgcaccgttggctcctccaccagacatctcaccatttagcttgttttgcccaccacccagtcctccctccattcctctcccgctgcctcctcccacattctttcccctctcagtgagcacaagcggaccacccaccccacccctactcccaccttttcctacaccactcccccccccacccccaagcattccctgcccaccgccgccaagcgcttctttcctgagcaccgagtgtgtttgcattaccggggttaagtgcaccacgaatctgatgcccgccgagaaaataaagagtagcatgacccagctttccacgacaaccgtgtgcaagactgaccctcagagggagcccaaggggattttacgccatgtaaaaaacctggcagagttggagaagtccgttgctaatatgtacagccaaatcgagaagaattacctacgcaccaatgtcagcgagcttcagacaatgtgtccatccgaggtaacaaatatggagatcactagcgaacagaataaagggtctctgaacaacattgtagaaggaaccgagaaacagagtcatagccagagtactagcctgtag

SEQ ID NO: 131170 - DNA, 5799 bp, Artificial Sequence
  Description of Artificial Sequence: Synthetic coding sequence
atgtttcggcagttctacttatggacatgccttgcctcaggaatcatcctcgggtcattgttcgagatctgtttggggcaatatgacgatggtacaatactggtagacaatatgcttatcaagggtactgccggtggtccagaccccaccattgaactgtctttgaaagacaatgtggattattgggtacttatggaccccgtaaagcaaatgttgttccttaattccaccgggcgtgtgttggatagagatccccccatgaatatccacagtattgtggtccaggttcagtgcataaacaagaaagtgggcacgattatctaccatgaagtgcgcatcgttgtgagagaccgcaatgacaactctccgacgttcaaacatgagtcatactacgccacagttaatgagctaaccccagtggggaccaccattttcactggcttctccggggataacggggctaccgacattgatgatggccctaatgggcagatcgaatacgtcatccagtataatcccgatgatccgacaagtaatgacacgttcgagatacctctgatgcttacaggcaatattgtccttcgtaaaagattgaattacgaagataaaacacgttacttcgtaattatccaggcaaatgaccgcgcacagaatctcaacgagcgcagaacaaccaccaccaccttaactgtggatgtcctggatggtgacgacctcgggcccatgtttttgccctgcgtgctggtaccaaatacaagagattgccgtccgctgacctatcaagctgctatccccgagctgcgaacccccgaggagctgaatcccatcatcgtcactccccctatacaggcaattgaccaggatcgaaacatccagcctccctctgatcggccaggcatcttgtactccattttggtgggcacccccgaagactaccctcggttcttccatatgcaccccaggaccgctgaattgagcctgttggaacctgttaaccgcgacttccatcagaagttcgatctcgtgatcaaagccgagcaggacaatggccaccccctcccggcctttgctgggctccatattgaaattctggacgaaaataaccagagcccatacttcactatgccaagctaccagggctatatccttgagtccgccccagtaggcgcgactatttccgactccctgaaccttacgtcccctttgagaattgtggctctggacaaggatattgaggacaccaaagacccggaactccacttgtttctgaacgactacactagtgttttcactgtgacacaaacaggaattaccaggtatctgacattgttacagcccgtggatcgcgaggagcagcagacctataccttttctatcactgctttcgacggtgttcaggaatctgagcccgtgatcgtgaatatccaggtaatggatgcgaacgacaatacccctacattccccgagatctcatatgacgtgtatgtgtatacagatatgcggcccggcgatagtgtgattcaacttacggccgtggatgctgacgaaggaagcaatggggaaataacttacgagattctcgtgggggcccagggtgacttcattataaataaaaccactggtctcattacgatcgctccgggggtagaaatgattgtggggcgcacctacgcgttaaccgtccaggccgctgacaatgcaccccccgcagaacgccggaatagtatctgtaccgtctatatcgaagtgctccctccgaacaatcagagccctcccagatttccacaactgatgtatagccttgagataagcgaagcaatgcgggtcggtgcagtgcttttgaaccttcaggccacagatcgggagggggattcgataacttatgctattgagaacggtgatccccagcgtgtgtttaacctgtcggaaactaccggcatacttacgctgggcaaagccttagatcgggagtctaccgacagatatatactcatcatcacggcctccgacgggcggcccgatgggacatcaaccgctacagtgaatatcgtggtgactgacgttaacgacaacgccccagtgtttgatccttatctcccacgcaatctgagcgtagtggaggaggaagctaatgcgtttgtgggtcaggtgaaagccacagaccctgacgccggtatcaacgggcaggttcactactctctcggcaacttcaacaatctcttccgtattacatctaacgggtcaatttataccgccgtcaaactgaaccgcgaagtgagagattactacgagctcgtcgtcgtggctacggatggagccgttcatccccgccactcgaccctgacactggctatcaaggtactcgatatagacgataacagccctgtgtttactaatagtacctacacggtgttggtagaagagaacttgcctgcagggacaaccatcctgcaaattgaggctaaagacgtcgatctcggcgccaatgtatcctatcgaatacgctctccagaagtaaaacatttcttcgctttacacccctttaccggggaattgtctctactacggtccctggactacgaggcatttcctgatcaggaagcgtccatcaccttcctggtggaggctttcgatatctacggaacaatgcccccagggattgccacagtgaccgtgatcgtgaaagacatgaatgactatcctcctgtattctctaagagaatatacaaaggcatggttgcccctgacgccgtgaaaggcacaccaataactactgtttacgccgaggatgcagacccccctggattgcctgcatctagagtccgctatcgggttgacgatgtgcaatttccttatccggcatcgatctttgaggtggaagaagattccggccgagtgattacacgggtcaatctaaatgaagaacccacaacgatctttaaactggtggttgtggcttttgatgatggtgagccagtcatgagcagctctgctacagtgaagattctggtcttgcacccaggtgaaatacctagattcactcaggaagagtataggccccctccagtgagtgaacttgctaccaaagggacgatggtgggggtgatttccgccgcggctattaaccagtcaattgtctattcgatagtgtcaggcaacgaggaggatacttttggaattaacaacatcaccggggtgatctatgtcaacggaccgctcgactacgagacccgcacttcttatgtcctgcgcgtgcaggccgactctctcgaagtggtgcttgccaatttacgtgtcccatcaaagtccaataccgccaaggtgtatattgaaatccaggacgagaataatcacccaccagtgttccagaaaaaattctatattgggggcgtatccgaagatgcacggatgtttacctcagtgctgcgtgttaaggctacagacaaggatacaggcaactactctgtgatggcgtaccgtctgatcatccccccaatcaaggagggcaaggagggattcgtcgtcgaaacttatacgggcctcattaaaacggccatgctctttcataatatgaggaggagctacttcaaattccaggtgatagcaacagacgattacggaaaagggctgtctggcaaagccgatgtgctggttagcgtggttaaccagctggacatgcaggtgattgttagcaatgtccctccgacccttgttgaaaaaaaaatcgaggaccttacagagatcttagaccgctatgttcaggaacagattcccggggcaaaggtcgtcgtggagtccataggcgccagaaggcacggggacgccttctcgctggaagattataccaaatgcgacttgactgtttacgccatcgatccccagacaaaccgtgcgattgaccgcaacgagctctttaaattcctggacggcaaactgctcgacataaacaaggactttcagccctactatggcgaaggcggacgcattctggagatacgcacacccgaagcggtcacttcaattaagaagagaggcgagtcgctggggtacactgagggcgcattgctggcactggccttcatcattatcttgtgttgcattcctgccattctagtggtgctggtgtcatacaggcagaggcaagctgagtgtactaagacagcccggattcaggcggccttaccggcggcgaaacctgccgtgccagccccagccccggtggcagctcctccccccccacccccaccccctccgggcgcacacctgtacgaggagctgggggattctagcatgcacaacttgtttctgctgtaccactttcagcagagtagaggcaataacagcgtcagtgaggatcgcaaacatcagcaagtagtgatgccatttagttctaacacgatcgaggcccacaagtctgcccacgtcgacggcagtctgaagtcgaataagctcaaatctgccaggaaatttacttttctcagtgatgaggatgacctctctgctcacaaccccctgtataaggagaacatttcccaagtctccacgaacagtgacatctctcagcgcaccgatttcgtagacccatttagtcctaagatccaggccaagagcaaaagcttacgcggcccccgggaaaagatacagcgtttgtggtcccagtcagtgtcgcttcctagacgtttgatgcgcaaagtgcctaacagacctgaaattattgaccttcagcagtggcaaggtactaggcagaaggcggagaatgaaaacacggggatttgcaccaataagagaggcagtagtaacccactgcttacaaccgaggaggccaatctgactgaaaaagaagagataaggcagggagagacccttatgattgagggcacagaacaattgaaaagtctgtcttcagattccagcttctgtttccctcgtcctcactttagcttttctactttgcctaccgtctccagaacagtcgagcttaagtccgaaccaaatgtaatctccagccctgcagagtgcagccttgagctgtccccttcccgaccatgtgttctgcactcaagcttatcccgccgggagactccaatatgtatgctaccaattgaaaccgagcgaaacatctttgaaaactttgcccaccctccaaacatatctccctcggcgtgccctcttcctccaccgccccctatttcgccaccctccccgccacccgcacccgcacctcttgcaccaccacctgatataagtccattctcccttttttgtccaccccccagcccaccctcgattcccctgccactccctccacctactttcttccccctctctgtgagcacgtccgggccaccaactccgcccctgcttcccccctttcccactccgcttccaccaccccccccgtccatcccatgtccaccccccccaagtgcgtcgttcctgagcaccgaatgtgtttgcataaccggagtgaaatgtactacaaatctgatgcctgcagagaagattaagtccagcatgacccagctgtctacaaccacggtctgcaaaaccgatcctcagcgtgagcctaaaggaattcttcgacacgtaaagaatctggcagaactggagaaatccgttgctaatatgtattcccagatcgaaaagaactaccttagaacaaacgtatctgaacttcagacaatgtgtcctagtgaggtgactaatatggagattacctcggagcagaataagggaagcctgaacaatatagtggaagggaccgagaagcagtcccactcccagagcacttccctttag

SEQ ID NO: 131171 - DNA, 4620 bp, Artificial Sequence
  Description of Artificial Sequence: Synthetic coding sequence
atgtttcggcagttctacctgtggacttgtttggctagcggaataatcctgggatccctgtttgaaatttgtctcgggcagtatgatgacgactgcaagctggcccgtggcggccctccagcaacaatcgtcgccattgacgaagaatcacgaaatggcacgattcttgtagacaatatgctcatcaaaggtacggctggaggaccagaccccacgatagaactctcactcaaggataatgtggactattgggtgcttatggatcctgtaaagcagatgctttttctcaatagtaccgggagggttctcgacagggaccctccgatgaatattcactccattgttgttcaggtgcaatgcataaacaagaaagtggggacgatcatctaccacgaggtccgcatcgtggtgagagataggaatgataatagtcccacctttaagcatgagagttactatgctaccgtgaacgagctgacacccgtcggtaccaccatcttcacaggtttcagcggtgacaacggggctacagacatagatgacgggcctaatggccaaattgaatacgttatccagtacaacccggatgatccaacttccaacgacacttttgagatccccctaatgctcacggggaatatcgtactgcgaaagcgcctcaattatgaagataaaacaagatactttgtgataatccaggcaaacgacagggcacagaacctcaatgaaagacggacaaccacgactacattaaccgtggatgtactggatggcgatgacctcggccccatgttcctgccatgcgtgttggtgcccaatacccgcgattgccgccccctcacttaccaggccgccattcccgaactgaggacaccagaagagctgaatcctatcattgtgacacctcctattcaggccatcgatcaggatcgcaacattcagcctccatctgacagacctggaattctgtatagtatattagtgggaacacctgaagactatccccggttctttcacatgcaccctcggactgccgagctctcattgctggagccagtcaaccgcgattttcaccagaagttcgacctcgtcattaaggcggagcaggataacgggcacccattacctgcttttgccggcctccacattgaaattctggatgagaataaccagtcaccctattttaccatgccaagctaccaggggtatatcctagaatctgcacccgttggcgccaccatctctgattctctcaacttgactagtcccttacggatcgtggctctcgataaggacatcgaagacacaaaggatccagagctgcacctgttcctcaatgactacacatctgtctttaccgttacccagaccgggatcactcggtacctcaccctcctccagccagtggacagagaggagcagcaaacctacacattcagtattacagcctttgatggcgtgcaggagtctgagcctgtcattgtgaacatccaggtaatggatgccaatgataataccccgacatttcccgaaataagttacgatgtgtacgtctacacagacatgaggcccggcgatagcgtaatccaattgaccgctgttgatgccgatgagggaagtaatggggagattacgtacgaaatcttggtgggagcccagggggactttattatcaataagacaactggcctgatcactattgcccccggagtagagatgattgtggggcgaacctacgctcttactgtgcaggccgcggataacgcacccccggcagaacggcgcaattcaatttgcaccgtgtatattgaggtactccctccaaataaccagtccccgcctcgatttccccagctgatgtattccctggaaatttccgaagccatgagggtgggggcggttcttttgaatcttcaggcaacagaccgcgagggcgactcaatcacttacgccatcgagaatggcgacccgcaaagagttttcaacctcagcgagactaccgggatactgacgctgggaaaggctctagatcgcgaaagcactgaccgttatattctcataattacagcttcagacggccggcccgacggcacttccacagctacagtgaatatagttgtcaccgacgtgaacgataacgcccccgtgttcgacccctaccttccaagaaacctctcagtcgtggaggaggaggccaacgcattcgtcggacaagtgaaggcaaccgatccagatgccggaattaatggacaggtgcactacagcctcggtaacttcaacaatttgtttcgcattacttctaacggaagcatctacacagctgttaagctcaatcgcgaggtcagagactattacgaactggtcgttgtggcaactgatggtgcagttcacccccgacacagcactcttaccctggcgattaaggttctggacatagatgacaattcaccggtcttcacaaactccacctatacagtgttagtggaggagaatctgccagctggaaccacaatcctgcagattgaagcaaaggatgtcgatctgggggccaacgtatcttaccggattagaagccctgaggttaagcacttcttcgccttgcatccgttcaccggggagctgtctctgctgcgtagtctggactatgaggcctttccagatcaggaggcctccataacattccttgtggaagcattcgacatatacggcacgatgccacccggaatagcaactgtaactgtaatagtgaaggacatgaatgactatccacccgtattctccaagagaatatataagggcatggttgccccagatgccgtcaaagggacgcctatcaccactgtctacgccgaggatgcagatcctcccgggttacctgcgtctcgggtccgatacagggtggacgatgtgcagttcccttatcctgcctccattttcgaagtcgaagaagactctggtagggtgataacccgggtgaatctgaatgaagagcccactaccattttcaaactggtggtggtggcctttgatgacggagagccagtgatgtctagcagtgccaccgtgaagatccttgtgctccatcccggggaaatccctaggtttacccaggaggagtataggcccccaccggtttccgagcttgctactaaaggtacgatggtgggcgttatctccgctgcagccatcaaccaatccattgtatactctatcgtgagtgggaacgaagaagacacattcggaattaacaacataaccggcgtgatctatgtgaacggccctttagactatgagactcggacctcctacgtgctcagggttcaggccgattcactggaagtggttctggctaacttgagagtgccgagcaagagcaacacagccaaagtatacattgagatccaagatgagaacaaccaccccccagtttttcagaaaaaattttatataggaggcgtttcagaggatgcccgcatgttcacttctgtgttacgggtgaaggcgactgacaaggataccgggaactactccgtaatggcttacagacttattatccctcccattaaagagggcaaggaggggtttgtggtcgaaacttacactgggctcatcaaaactgccatgctcttccataatatgagacgaagttactttaagtttcaggttattgccacagacgactatggcaagggcttatctggaaaggcagacgtgttggtctccgtggtgaatcaattggacatgcaggttatagtttctaatgtgccacctaccctggtggaaaaaaaaatcgaagatctaaccgagatactcgaccgatacgtgcaggagcagatacctggtgctaaagtggtggttgagtcaattggagcaagacgccatggagatgctttcagcctcgaagattacaccaagtgcgacctcactgtgtatgcaatcgacccgcagaccaacagggcaattgaccgtaatgaactgttcaagtttcttgatggtaaactgctagatattaataaagattttcagccttactatggggagggcggacgcattctcgaaattaggaccccagaggcagtcaccagcatcaaaaaaagaggcgagagtctgggctataccgaaggagctttgcttgctttggcctttatcatcatcctgtgctgtatccccgccatacttgtggtactggtcagctataggcagtttaaggtgcgccaggccgagtgcaccaagacagctcgcattcaggccgcccttccagctgcgaaaccagcggttcctgctccagctccagttgccgcacctcctccaccccctccccccccacccggagctcatttgtatgaagaactgggggacagttccatgcataagaattatccctggtccctcgaactcatcctggcacgcaatatggataagattattaccgtaatgagcatggggatgaagtgcctgaatatgggggtggcggtcgattgctaccaccaactggaccgccggaatatggtccggtggctggtgaagctcaggaagaatatgagacgtaagagaaaaagtcagaggaagctgaagaaccagaggctgaaacttgagtctctggtccgcaggaaaaaatag

SEQ ID NO: 131172 - DNA, 2160 bp, Artificial Sequence
  Description of Artificial Sequence: Synthetic coding sequence
atgtttagacaattctatctttggacttgtctcgcgtccggcatcattctcggatctttgtttgagatttgccttggccagtatgatgatgactgtaaactcgccaggggcgggcccccagctactattgtggcaatcgacgaggaatcccgtaatgggactatcttagtcgataacatgttgataaaggggacagcaggaggaccagatccgactatcgagcttagcctgaaagataatgtcgattattgggtgcttatggaccctgtgaaacaaatgctgtttttgaactcaactggcagggttctggacagagatcctcctatgaatatccacagcatcgtagtccaggtgcagtgtatcaacaagaaggtgggtaccatcatctatcatgaagtgaggatcgtcgtcagagatagaaatgacaacagtcctacttttaaacatgagtcttactatgccacagttaacgagttgaccccagtcggaaccacgatcttcacaggcttctctggcgataatggcgccacggacattgacgatggtcccaatggacagatcgaatacgtgatccagtataacccggacgatccaactagcaacgacaccttcgaaatacctctgatgctcacgggcaatatagttctccgtaagagattgaattatgaagacaaaactcgctacttcgttattattcaagccaatgatcgcgcccagaatttgaacgagagaaggactacaacaactactctgactgtcgacgtgttggacggcgacgaccttgggcccatgttccttccctgcgttctcgtgcccaacacgcgggattgtagacccctgacttatcaggcggcaatcccagaactgcgcactccagaggagctcaaccccataatcgtcactcccccaatccaggctatcgatcaagatcggaacattcagcctccatcggatcgccccgggatcctctactcaatactcgttggaacccctgaggattacccaaggttcttccatatgcaccctcggacagctgagctaagcctcctagagcctgtcaaccgcgacttccaccaaaagtttgatctggttattaaagcagaacaggacaatggtcaccccttgcccgcctttgcgggactgcacatcgagatcctcgacgagaataatcagtctccatacttcacgatgccctcctatcaaggatacatactggagtctgcgcccgtcggagcaaccatctccgattcactgaacctgactagcccactaagaattgtggcgctcgataaggacatcgaagatgaagaacccaagaagattaagaagcctaaagtagaaatccgcgaaccatccgaggaggaagaagtcgttgtcaccatagaaaagccacccgccgctgaacccacatacacgacctggaagcgagcgcgaatcttccccatgatcttcaaaaaagtgagggggctggctgacaagaggggaattgtggacctggagggcgaggagtggcaacgacgcctggaggaagaggataaggactatcttaaattgactctggatcaagaggaagcaaccgagtccaccgtagagagcgaggaggagagtagctccgactacaccgaatattctgaggaggaaagtgagttctctgaaagcgagacgaccgaggaggagtctgaaagcgagacaccatccgaagaggaggaatctagcacccccgagtcagaggagagtgaaagtactgagtcagaaggcgaaaaggcaaggaaaaacattgttctagcccggcgtagaccaatggtggaagaggtaaaggaggtaaagggccgcaaagaggaacctcaggaagagcagaaggaacccaaaatggaggaagaagaacattcagaggaagaagaaagcggtcctgccccagtcgaggagtcaactgaccctgaggcccaggatatacctgaagaagggtcggccgagtcagctagcgttgagggaggcgtagaatccgaagaggaaagcgaatctggcagctcgtcaagttccagtgaatcccagtcaggcggcccctggggttatcaggtgccggcgtacgatagaagcaaaaatgcaaaccagaagaagagccctggtgctaactctgagggctataacactgcattgtag

SEQ ID NO: 131173 - DNA, 1953 bp, Artificial Sequence
  Description of Artificial Sequence: Synthetic coding sequence
atgtttaggcagttctacttgtggacttgtcttgcctctggaataattctgggtagtctgtttgaaatttgccttgggcagtacgatgatgattgcaagcttgctcgcggtggtccccctgccactatcgtagccatcgatgaggagagcagaaacggtaccattttagtggataatatgcttatcaagggcactgcgggaggccccgaccccactatcgagctgtcactcaaagacaacgtcgattattgggtactgatggacccagtgaaacaaatgctgttcttgaacagcactggcagggttttagacagggaccctcccatgaacattcatagtattgtggtgcaagtgcaatgtattaacaaaaaggtggggactattatctatcatgaagtgcgaatagttgtgcgcgatcgtaatgataactctcctaccttcaagcatgagtcgtactatgctaccgtgaacgagcttacccctgtcggtacaaccatattcactggcttcagcggggacaacggggctactgatatcgatgatgggcccaatgggcaaatcgagtacgtgattcaatacaatcctgatgatcctacaagtaacgacacctttgaaatccctctcatgctcactggaaacatcgttctccgaaaacggctgaattacgaggataaaacgagatattttgttattattcaggcaaatgatcgcgcccagaacctcaatgagcgccggaccaccaccactacactcaccgtggacgtcctcgacggcgatgatttgggaccaatgtttctgccctgtgtgttagttccgaatacccgcgactgtcgtcctctcacctaccaggctgccatacctgagctgagaacgccggaggagctgaaccctataattgtaacccccccgattcaggccatagatcaggatcgaaacattcagcccccaagcgacaggcctggcatactttactctatcctcgtcggtacacccgaggattatccaaggttctttcatatgcaccctcgtactgccgagctatcattacttgaacccgtaaaccgggattttcaccagaagtttgacctcgtcattaaggaggagccgaaaaaaattaagaagcctaaggtagaaattagggaacccagtgaggaggaggaagtggtggtgacaatagagaagccgcccgccgcagagcctacctacactacctggaagagggctcgcatcttcccaatgatcttcaagaaagtcagaggactggccgataagcgcggcatcgttgacctcgaaggtgaagaatggcagcggagactagaggaagaggacaaggactatctgaagttaaccttggaccaggaagaggcgactgagtccaccgtggaaagtgaagaggagagcagttctgattacaccgaatactctgaggaggaaagcgaattctccgagtcagagacaaccgaggaggaatccgagtccgagacaccttcagaagaggaggagtcgagcactccggaaagcgaagaatccgaaagtaccgagtccgagggtgaaaaagcacgaaagaatatagtgctcgcccggaggaggccaatggtcgaagaggtgaaggaggtgaaggggcgcaaagaggagccccaagaggagcagaaggagccaaaaatggaggaggaggagcattccgaagaggaggagagcggaccagctccagtcgaagagagtaccgatcccgaagcacaggacatcccagaggaggggtctgcggagtcagcgagtgtcgagggcggggttgaatcggaggaagagtccgagtctggtagctcctccagctcaagcgagtcccagtctgggggaccttgggggtaccaggtgcccgcctacgacagatcaaaaaatgcgaatcagaagaaatctcctggtgctaactccgaaggttataataccgcgctgtag

SEQ ID NO: 131174 - DNA, 5358 bp, Artificial Sequence
  Description of Artificial Sequence: Synthetic coding sequence
atgtttcgccaattttatctatggacctgtcttgcttccgggatcatactcgggtccctgttcgagatttgtctaggccaatacgacgatgattgtaagttagcgaggggcggaccccctgcaacaatcgttgccattgatgaagaaagccgcaacgggaccattcttgtggacaatatgctgataaaaggtacggcagggggccctgaccccactatagagctgtccctcaaggacaacgtggattattgggtgctcatggatccggtaaaacagatgctctttttgaactcaaccggacgcgtgcttgaccgggatccccccatgaatatccatagtatagtggtgcaggtgcagtgtattaacaagaaagtaggcaccatcatctatcacgaggtgagaatcgtcgttcgagataggaacgataactccccgacctttaaacatgaatcctattacgctacagtcaacgagcttacaccagtcggcacaacaattttcaccgggttttctggggataacggcgccacagatatcgacgatggacccaacggacagattgagtacgtaattcagtacaaccctgatgacccaacatctaacgacactttcgaaattcctttgatgctgacaggcaacattgtgctacgtaaacggttaaactatgaagataagacaagatactttgtgatcatccaggcgaatgatagggcgcagaacctcaacgaacggaggacaaccacaactactctgactgtagatgtcctagacggggatgacctgggacccatgttcctaccctgcgtcttagtgccaaatacaagagattgcaggccgttgacgtaccaggccgctatcccagaactgaggaccccggaagagcttaaccctatcattgttaccccccctattcaggctattgatcaggacaggaatattcagccgccaagcgaccgtcctggcatactctactccatcctggtggggaccccggaagactacccaagatttttccacatgcatcctcgcactgcagagctgtctttactggagcctgtgaatcgggatttccatcagaaattcgaccttgttattaaagcggaacaagataacggtcaccccttaccagctttcgctggcctccacattgagatcctcgatgaaaacaaccagagtccgtattttaccatgccctcctatcaaggctacatcttagagtcagcaccggttggcgctactatcagtgattcattaaatttgacatccccactgagaattgtggccctggataaagacatagaggatgtcccacccagtggcgtgccgactaaagaccctgagctgcatctctttcttaatgactacacatcggtgttcacagtcacacagaccggaatcaccaggtacttgaccctactgcaacctgtggacagagaggagcagcagacttacaccttcagcatcaccgcttttgatggggtgcaggagtctgaacctgttatcgtaaacattcaggtgatggatgccaacgataataccccgacttttccagagatctcgtatgatgtgtacgtgtatacggacatgcggcccggcgacagcgttattcaactgactgctgtagatgcagacgagggctccaatggggaaattacatacgagatcttggttggggcccagggggactttatcatcaacaagacaacaggccttattacaatcgctcctggtgtcgagatgattgtaggtcggacttatgcactgactgtgcaagccgctgacaacgcgcccccagccgaaagacgaaattcaatctgtactgtgtacatagaggtgctgccccccaacaatcagtctccccctcggtttccacagttgatgtattccctggaaatctccgaggccatgagggtgggggccgtactgctgaatctgcaagcaactgatcgtgagggggactccatcacttacgccattgagaacggcgatccacagcgtgtattcaacctatccgagacaactgggatactcacactcggtaaagctttggaccgcgagtcgacagatcggtacatcctgatcattaccgcgagcgacggcagaccagatggcacctccaccgccaccgtaaacatcgtcgtcaccgatgtgaacgataacgccccagtcttcgacccttacctgcccaggaatttatccgtggtggaagaggaggccaacgcatttgtgggccaggtgaaggcaacagacccagacgcaggcatcaacggccaggtccactattctttgggaaacttcaacaacttgtttagaatcacttccaacgggtctatttatactgctgtaaaactgaacagagaggttcgggattactacgagctcgtcgtagtggccactgatggtgctgtccatcctcgccattctaccctgacgctggcgattaaggtgctggacattgatgataactcccccgtgttcacaaattctacctataccgtactagtggaagagaatctgccagcggggaccactattctccagatcgaagctaaagacgtggatctgggcgccaacgtgagttataggattcggagtcctgaagtaaagcatttcttcgccctgcacccttttacaggagaactctccctcctgcggagtctcgattacgaagcgtttccagatcaggaggcgtctatcactttccttgtggaagcctttgatatctacggaactatgccccctgggatagctacagttacagttatagtgaaggatatgaatgattatccgcctgttttctcaaaacgcatctataaaggcatggtggctcccgacgccgtgaaaggaaccccaattactaccgtgtacgcagaagatgcagatcccccgggcctacctgcctcacgcgttagatatcgggtagatgacgtccagtttccttatccagcgagtattttcgaggtcgaagaggatagcgggcgagtcattactcgagtgaacctcaatgaagaaccaactaccattttcaaactagtggtggtggcctttgacgacggggagccagttatgagcagctccgctactgtgaaaatcctagtgctgcaccccggcgagatcccccggtttacacaggaagaatacagacctcctccagtgtcagagctggctactaaagggactatggtgggagttatttctgctgcagccatcaatcaatccatagtttactcaatagtgagcggcaatgaggaggacacgtttgggatcaataatattaccggcgttatttacgtcaatggcccattagactatgaaacccgtactagctatgtgctgagagtccaggccgactccctggaggtggtcctcgccaatcttcgggtgccaagtaagagcaatacagctaaagtgtatatcgaaattcaggatgagaataatcatccccctgtcttccagaagaaattctatatcggaggtgtaagcgaagatgcaaggatgtttaccagcgtgcttcgcgttaaagccaccgacaaggacaccggcaactactcggtgatggcttatagactgatcattccgcccataaaagaggggaaagagggctttgtcgttgagacttacaccggtctcatcaagacggccatgttattccacaatatgcgacgatcctacttcaagttccaggtaatcgctacagacgattacgggaaggggctcagcggcaaggctgacgtacttgtctctgtggtgaatcagcttgatatgcaggtgatagtgtccaacgtgcccccaactttggtcgagaaaaagatagaggatttgactgaaatcttggatagatacgtacaagagcaaatccctggtgccaaggttgtagtcgagtctataggggctcggagacatggggacgccttctctctcgaggattacaccaagtgtgatttgactgtgtatgccatcgacccacagactaacagagctattgaccggaacgaattgttcaaattcctggatggtaagctactcgacatcaataaagacttccagccttattacggggaggggggacgcattcttgagatacgcacccctgaagctgtcacctcaatcaagaaacggggggaaagcttgggatatacagaaggggcattgctcgcgttggcattcatcatcatcctgtgttgtatacctgcaatcctcgtggtccttgtttcatatcgccagttcaaggtacggcaagctgaatgtaccaagaccgcccgtatacaagctgcgcttcctgctgctaaaccagcagtgcctgcacccgcccccgtcgcagcacctccccctcccccacctcctcccccaggggctcacctttatgaggagctgggcgatagcagtatgcacaagtacgaaatgcctcagtatggttccaggaggaggctcctcccacccgcaggtcaagaagaatatggggaggtcgtgggggaagccgaggaggagtacgaggaggaagaagaagagcccaagaaaataaaaaagcctaaggtcgaaatcagagagccctccgaagaagaggaggttgtcgtaaccattgagaaacctcccgccgctgagcccacttacacaacttggaaacgagctcggatttttcccatgattttcaaaaaggtgagaggcctcgccgataagcgggggatcgtggacctggaaggtgaagagtggcagagacgcttggaagaagaagacaaagattatctcaagctcacactggaccaagaggaagctacagagagtacagtcgagtctgaagaggaatcctctagtgattacacagaatactctgaggaggagagtgaatttagcgaatcagagactactgaggaggagtctgagagcgaaacaccctccgaagaagaagagtctagcactcccgaaagtgaagaatccgagtcaacagagagtgagggcgaaaaggcccgaaaaaacattgttctggcaaggcgaagaccaatggtggaagaggttaaggaggtaaaagggaggaaagaggaacctcaggaagagcagaaagagcccaagatggaagaggaagagcacagtgaggaagaggagagtggacctgccccggtcgaggaatccacggatcccgaggcacaagatattcctgaagagggtagcgccgagagcgccagcgtggaagggggggtggaaagcgaggaggagagcgagtctggtagctcctcctctagttctgagtctcagtcgggtggcccgtggggctaccaggtgcccgcttacgaccgcagcaaaaatgcaaaccaaaagaagagcccaggagccaactccgaagggtacaataccgccttgtag

SEQ ID NO: 131175 - DNA, 2946 bp, Artificial Sequence
  Description of Artificial Sequence: Synthetic coding sequence
atgttccggcagttttatctgtggacttgcctggcctcgggcattatcctaggctccctctttgaaatttgccttggacagtacgatgatgattgtaaactggcaagggggggacctcccgccactatcgtagccatcgacgaagagtccaggaatggaacaatacttgttgataatatgctgatcaagggcacggccggcggcccggatcccacaatcgagctgtccttgaaggataacgtggactattgggtgttaatggacccggtgaaacagatgctgtttctaaactcgactgggagggtgttagatcgagacccgccaatgaacatacattcaatcgtcgttcaagtgcaatgcatcaacaagaaagtgggcactatcatctaccacgaggtgcgcatcgttgtaagggacaggaacgataacagccccacatttaagcacgagtcttactacgccaccgtaaacgagctaactcccgtgggcactactatttttactggtttcagcggcgataatggcgctacagacatcgacgacgggcccaacggacagatagaatacgtgattcagtataatcctgatgacccaacatcgaacgataccttcgaaatcccgctcatgcttactggaaacattgttcttaggaaacgactgaattacgaggataagactcggtacttcgtgattattcaggccaacgaccgggctcagaacctcaatgagcgccggaccactaccaccaccctgacagtggacgtcctggatggcgacgacctggggcccatgtttttgccttgtgtgctggtacctaacacacgggactgccggccacttacataccaggccgctattcccgagttaagaacccccgaggagctaaacccaatcatcgtcacgcctccaattcaggctattgaccaggaccggaatatccaacccccaagcgaccgacctggcatcctgtactcaatcctggtggggacacctgaggactaccctcggtttttccatatgcaccccagaacagccgagttgtcactgctggagcctgtcaacagggatttccatcagaaatttgatcttgtcatcaaggccgagcaggacaacggccatccgctccccgccttcgcagggctgcacatcgaaattctcgatgagaataaccagtcaccgtacttcacaatgccatcctaccaagggtacatcttagagtcagctcctgtcggtgctaccatttcggattctctcaacctgacctcgccgctgcgcattgtggccctggacaaggacatcgaggatacgaaagacccggaacttcatctattcctgaatgattacacctcggtctttaccgtaacccagactggtataacccgttatctgaccttactccagccggtcgacagggaggaacagcagacttatactttctctatcacagcattcgacggggtgcaggagagcgagccagtcatcgtgaatatccaagttatggatgctaacgacaacactccgacgttccccgaaattagctacgatgtttacgtgtatacagatatgaggccaggcgactccgtgatccaactgacagcagttgacgctgacgaaggatctaatggggagataacctatgagattctcgttggcgcccaaggtgatttcattattaacaagaccacaggattaattactattgctccgggcgtggagatgatcgtgggtcgaacatacgccttgacagttcaggccgcagacaacgctcctccagctgagagacggaacagtatttgtactgtctatatcgaggtcctgcctcccaataatcagtcacccccaagatttccacagctcatgtatagtctagagattagcgaagctatgagagtaggcgccgttttgctgaatctgcaagctaccgatagggaaggcgattcgatcacttatgccatagagaacggcgaccctcaacgtgtcttcaatctgagcgagacaacaggaattttgacccttggtaaagcgttagaccgggagtcgaccgaccggtatattttgatcattacggctagcgatggacggccagatggagaagaacccaaaaagattaagaaaccaaaagtggaaatcagagagccttccgaagaggaggaggtcgtggtcacgatcgagaagcccccggctgccgagcccacttacacaacatggaagcgagccaggatcttcccgatgatatttaaaaaggtgagagggctggccgataaacgcggtatcgtggacctcgaaggcgaagaatggcagcgaagactggaggaagaggacaaggattatctgaaactcactctggaccaggaggaggcaacagagtctacagtggagtccgaagaagaaagcagttccgattacacagagtattccgaggaggaaagcgagtttagcgaatccgagaccacagaggaggagagcgagtcagaaacaccgtccgaagaagaggagagcagcactccagagagcgaggagtctgaaagcactgaatccgagggcgagaaagccaggaagaatattgtcctggcacgccggcgtccaatggtggaggaggtgaaagaggtcaaaggcagaaaggaagagccccaggaagagcagaaggaaccaaagatggaagaggaggagcattcggaagaagaggagtccggaccagcccccgtagaagaaagcaccgatccagaggctcaggatattccagaggaagggagtgcagagagcgcctcagtagagggcggagttgagtctgaagaagagtctgaatccggttcatccagctctagctcagaatcccagtctggagggccatgggggtaccaggttccggcctatgataggagcaagaacgctaaccaaaagaagagccctggggcaaatagcgaaggttacaatacagctctctag

SEQ ID NO: 131176 - DNA, 3453 bp, Artificial Sequence
  Description of Artificial Sequence: Synthetic coding sequence
atgcccagctatcaagggtatatactggagagcgccccggtgggagcaactatctcggattcactgaatctgactagccccctgcggatagtagccctggacaaggatattgaggatgtgccgccttcaggggtacccactaaggatccagagcttcatctgtttctgaacgactacacctccgtgttcaccgtgacacagactggcatcaccaggtacctaaccctactgcagcctgtagacagggaggaacaacaaacttacacattctccatcaccgctttcgacggagtgcaggagagtgaaccagtgattgtgaatatccaagtgatggatgctaacgacaacacgcccacctttccggagatatcttatgatgtgtacgtgtatacggatatgcggcccggcgacagcgtaatccagctgacagcagttgacgcagacgaaggttctaacggcgaaatcacctatgagatacttgtaggtgcccaaggagactttataatcaacaaaacgacaggactgataactatcgctcctggggtggaaatgatagtgggtaggacctacgcactgactgtacaggcggccgataacgccccacccgcagaaaggcgcaacagtatatgtacggtatacatcgaggtgctccctccgaacaaccaaagtccgccacgcttcccgcagctaatgtactctcttgagatcagcgaggcgatgcgggtgggcgccgtgttactgaatctacaagccacagacagagagggggattctatcacatacgcaattgagaacggcgaccctcagagagtgtttaatctgtccgagaccactggcatcttaactctgggcaaagcgttagaccgagagtccacggataggtatatactcattattactgccagcgatggccgtccagatggcacgtctaccgccactgttaatatcgtggttacagacgttaatgataacgccccagtgtttgatccttacctaccccggaacctgagtgtcgtggaggaagaggcaaatgccttcgtggggcaagtgaaggctaccgatccagatgccggcatcaatgggcaggtgcactactcccttggtaacttcaacaacctgttccgtattacctctaacggatcgatatacaccgcggtgaaattaaacagggaagtgcgtgactactatgagcttgtcgtggtcgccacagacggtgctgtacatccccggcatagtaccttgactcttgctattaaggtcctcgacatcgacgacaattcacccgtcttcacaaatagcacatacactgtgttagtcgaggaaaatctgcctgctgggactacaattctgcagattgaagccaaagacgtcgacttaggtgcaaacgtgtcatatcggatccggagtcccgaagtcaagcacttttttgccctgcaccctttcactggagagctatctctgttgcggagtctagactatgaggcattccctgaccaggaagcgagtattaccttcctcgtggaggccttcgatatttacggtacaatgccaccgggaatagcgactgtcacagtgatcgttaaggacatgaacgattaccctccagtgttctcgaaaaggatttataaaggaatggtagcgcccgatgccgtcaaagggactccaattactaccgtctacgccgaggacgccgaccctcctggcctgcccgcttctagagtgaggtatagggtagacgacgtccagtttccttatccagcaagtatcttcgaggttgaagaggatagcggaagggtgattactcgcgttaacctgaatgaggagcctactactatatttaaactcgtggtggtggcgttcgatgacggcgaacccgttatgtcctccagtgctacggtgaagatccttgttctgcaccctggggagattccaagatttacccaggaagaataccgaccgccccccgtgtccgagttggccacaaaagggaccatggttggtgttatctcagcagctgcgataaatcagagcatagtgtacagcattgtgtccggcaacgaggaggatacattcggcataaacaacatcaccggggttatatacgtgaatggacccctagattacgagacgcgcaccagttatgtcttgcgcgtccaggccgactcactggaggttgtactcgctaatttgagagtgcctagtaagagcaacaccgccaaggtctatatcgaaatacaggatgagaacaaccaccccccggtgtttcaaaaaaagttttatattggtggtgtttctgaggacgcccggatgttcacgtctgttttgcgggtgaaggcaacggataaagataccgggaactactcagtgatggcttaccggcttatcatcccccccattaaagaaggcaaggagggcttcgtggtggaaacttatactgggctgattaaaaccgctatgctgtttcataacatgagaagatcatatttcaaatttcaggttatagcaaccgacgactatggtaaagggctcagtggcaaagcagatgtgctagtgtcagtcgtcaaccaactggatatgcaggttatagtttctaacgtaccacccactctggtcgaaaagaagatcgaagacttgaccgagattctggatcggtatgttcaggagcagatccctggcgcgaaagttgtggtagaaagcattggcgcccgaagacatggagatgcattttccttggaggactacaccaagtgtgatttgacggtatacgctatagacccacagacaaacagagccatcgacagaaacgaactttttaaatttctggatggcaagctgttggacatcaataaggattttcagccttattacggggaaggcggcagaattttggagattagaacaccagaagccgttactagtatcaaaaagcgcggagagtccctgggatacaccgaaggcgctctcctcgccctcgcttttattattattctttgttgcatacctgcgatcctggttgttctggtcagctataggcagttcaaggtgcgccaggccgaatgtacgaaaacggcgaggatccaggcggctctccccgccgctaagccagccgtgcctgcgccagcgcctgtggctgctccacccccgcccccacctccaccaccaggagcccacctttatgaggagctgggtgacagctccatgcataaaaactacccctggtccctggaattgattctggcgcgcaatatggataaaataatcactgtgatgtccatgggtatgaagtgtcttaatatgggtgttgcggtcgactgctaccaccagctggatagaaggaacatggtgcggtggctggtcaagttgcgaaaaaacatgagacgtaagcgcaaaagtcagcgcaaactgaagaaccagcgcctgaaactggagagtttagtacgtcgcaagaaatag

SEQ ID NO: 131177 - DNA, 990 bp, Artificial Sequence
  Description of Artificial Sequence: Synthetic coding sequence
atgtttcgccagttctatctctggacatgcttggccagcggtataatccttggctccctgtttgagatctgtctcggccagtacgatgacgactgcaagttagcgcgtggggggcctccagccacaatcgtagccattgatgaagagagcagaaatggcactatcttggtggataacatgctcattaagggaaccgccgggggacccgatcccacgatcgagcttagcttgaaagacaatgtcgattactgggtgctcatggatccagtgaagcagatgctgtttcttaacagcacgggacgcgtattggatcgcgatccacccatgaatatacatagcattgtcgtgcaggtacagtgtattaacaagaaggttggcacaatcatctaccacgaggtgcggatcgtggtgagagatcggaacgataacagccctacatttaagcacgagtcatactacgcaactgttaacgaactgacacccgtgggcacaactatctttaccggattcagcggcgataacggcgccacagatatcgacgacggccctaacgggcagatcgaatatgttatacagtacaaccctgatgatcccacatccaatgacaccttcgagatccccctgatgttaaccgggaacattgttctgcgcaaacgcctcaactacgaagacaaaacgaggtatttcgttattattcaagcgaacgatagagcccagaacttaaatgaacgaaggactacgacgactacactcacagtagatgttttggatggcgacgacctggggcctatgttcttgccatgtgtgttggtgccaaacacccgcgattgcaggcctcttacataccaagcagccattcctgagttaagaacgccggacctggggtcactgtgcagcggtactaactcctggtgccagggcagatcgggtgtacactggtcttcgccggcttggaggtgcctgttcccccggaggctccaccagatgtag

SEQ ID NO: 131178 - DNA, 5046 bp, Artificial Sequence
  Description of Artificial Sequence: Synthetic coding sequence
atgtttcgacaattttatttatggacgtgcttggcgtccggtatcatcctgggatccctgttcgagatttgtctgggccagtacgatgacgggtggagatatatgtactgcaagctggccagaggcggccccccagcaacaatcgtggcgatagacgaggagtcacgcaatggtactatcctggtggataacatgctgattaaaggcacagctggcggccccgacccaaccatcgaactgtcgctgaaggataacgtcgactactgggtgttaatggacccagtgaagcagatgctctttctgaatagcaccggcagggtcctcgacagggatccacccatgaacatccattcaatcgttgtacaggtccagtgcatcaacaaaaaggtggggacaatcatctaccacgaggtgcggatagtggtccgcgataggaatgacaattccccaaccttcaaacacgagagttactatgccaccgttaacgaacttactcccgtggggacgacaatctttaccggcttcagtggcgacaacggggcaacagacattgacgatggtcctaacgggcagatagaatacgtgatccaatacaatccagacgatcccacaagcaacgacaccttcgagattcctctcatgctgacaggcaacattgttcttcgcaagcgcctgaattatgaggataagacacgatatttcgtaatcatccaagcgaatgacagagcccagaatctcaacgaacgtcgtacaactaccacaaccttaacagtagacgtcctggacggcgacgacttgggtccgatgttcctgccctgcgtgttggtccccaacacgcgcgattgtcgcccgctcacgtaccaggccgccatccctgaactgaggacacctgaggagttgaatccaattattgtgactccaccaattcaggcaatcgatcaggacaggaatatccagcctccttccgacagacctggaatcctatactctattctcgtcgggacaccagaggattatccccggtttttccacatgcaccctaggaccgccgaattgagtcttttggagccggtcaaccgggatttccaccagaagttcgacctcgtgatcaaggccgagcaggacaacgggcatcctttacccgcatttgccgggcttcatatcgagatccttgatgagaataaccagtcaccatatttcactatgccatcttatcaggggtatatccttgaaagcgcgcccgttggagcaaccattagcgacagtctcaacctgacctccccattgcgaattgtggcactggacaaggatatcgaagacactaaggacccggaactccacctcttcttgaacgattacaccagcgtgtttactgtgactcagaccggcatcaccaggtacctgactctgttacaacctgtcgatcgtgaagagcagcagacctatacattttctataacagcatttgacggcgtccaggagagcgaaccggtgattgtgaatatccaggttatggatgcaaatgacaacacaccgaccttcccagaaatatcttatgacgtctacgtatataccgacatgcgacctggtgatagcgtaatccagttgaccgctgtcgacgccgacgagggctccaacggagagattacgtatgaaatcctcgtgggcgcccagggagatttcattatcaacaagactaccggcctgatcacaatcgccccgggagtcgagatgatagttggcagaacttacgcgctaacagtgcaagccgccgacaacgcaccccctgctgagcgtcgaaactccatttgtaccgtgtacattgaggtgttgccaccaaacaaccagagccctcccagattcccgcagctcatgtactccctcgaaattagcgaggccatgcgagtaggagcggtgctgcttaaccttcaggctactgacagagagggagatagtataacctacgctattgaaaacggtgacccacagagggtatttaatctaagtgaaacgacaggaatcctcacattgggaaaagccctcgatcgggaaagtactgaccgctatattctgataattaccgccagtgatggccgcccagacggtacctctaccgccacggtgaatatcgtcgtgacagacgtgaatgacaatgcccccgtcttcgatccgtacctcccgagaaacctgtccgtcgtggaggaggaggccaatgcattcgtgggtcaggttaaagccactgacccagacgctggaatcaatggacaggtgcactatagcctgggaaacttcaataaccttttcagaataacatcaaacggttcaatttatacagcagtgaaactgaaccgcgaggtgagagattactacgaactcgttgtcgtggcaacagatggcgctgtccaccctcggcattctacactaacgttggctatcaaggtgctagatattgacgacaacagtcccgtgtttaccaactcaacgtatactgtgctggtggaggaaaaccttccagccgggactacaatcttgcagatagaagccaaagacgtagatctgggtgctaacgtctcttaccggatacggtcccctgaagtgaagcactttttcgctctgcaccccttcacaggcgagctgtcactgctgcggtcactcgactatgaggcattcccagaccaggaggccagtataacatttctggtggaggcttttgatatctatggaaccatgccgcccggtatcgccaccgtcacagttattgtcaaggatatgaatgactacccccccgtgttcagcaagcggatatataagggtatggtggcccctgacgccgtgaagggtactcccatcaccacagtttacgccgaagatgcagaccctccaggtcttcccgcttccagagttaggtacagggtggatgacgtgcaattcccctaccccgcatccatttttgaggtagaggaagattcaggcagagtgataacgagagtgaacctgaacgaagaaccgactactatttttaaactcgtcgtggtggcgttcgatgatggggagcccgtgatgtcctcatccgcgactgtgaagatcctggtgttgcatccaggtgagatccccagattcacacaagaggaatatcgccctccgcccgtgtccgaactggcgaccaaaggaacaatggtaggggtcatctctgctgccgcaattaaccagagcattgtgtactctattgtctccggcaacgaggaagacacttttggcatcaacaatattactggggtgatctatgttaacggtcctttggactatgaaacgcggacctcttacgttttgcgggtgcaggctgactctctggaagtggtgctcgctaatcttcgtgtgcctagcaagagcaacacagccaaggtctacatcgagattcaggacgaaaacaatcacccgcctgtcttccagaaaaagttttatataggtggggttagcgaggacgctagaatgtttacgagcgttctgcgagtgaaagcgacagacaaggacaccggaaactattcagttatggcataccgccttattatccctccaatcaaggaaggcaaggagggtttcgtcgtcgaaacctacacaggtctcatcaagactgctatgttgtttcacaacatgcgacgctcatattttaagttccaggtgattgccacagacgactacgggaaagggctgtccggaaaagccgacgtgctggtgtcagtcgtcaaccagctggacatgcaggtaattgtgtcaaacgtgccaccaactctggttgaaaaaaagatcgaggatctgacagaaattctggacaggtatgtccaagagcaaattcctggggcaaaggtagtggttgaatctattggggcccgcagacacggtgatgcctttagcctggaagactacaccaaatgtgatctgaccgtttacgccatcgatccacagacaaaccgggcaatcgatcggaacgaactgttcaagttcctggatggcaaactgctagacatcaataaggactttcaaccctattatggagagggggggcgaattctggaaatacggacccccgaagcagtgacatcgatcaagaaaaggggcgaaagtctgggctacaccgagggtgcccttttggcccttgctttcataattatcctgtgttgcattccggctattctggtggtgctggtgagctataggcagaggcaggcagagtgcaccaagaccgcgcggatccaggcggccttacccgcagctaagcccgcggtcccagccccagcccctgtggccgctccacctccacccccaccaccgccccccggagcccacctctatgaagagcttggcgactccagcatcctgtattaccgctatgaaatgccacaatacgggtcaagacggcgattgttaccaccggctggtcaggaagaatatggcgaggtggtgggcgaggccgaggaagagtatgaggaggaagaatgggcccggaagagaatgattaaactggtggtggaccgagaatacgaaactagctctacgggcgaagactcagcacctgagtgccaacgtaatcgactgcaccatccatcgattcacagcaacataaatgggaatatctatatcgcccagaatggatcggtcgtgaggaccagacgggcatgtctcactgataatttaaaggtcgcctcaccggtcagacttgggggccctttcaagaagctcgacaagctagctgtcactcacgaagagaacgtccctctgaatactttgagcaagggtccattttcaactgagaagatgaatgcgcgacccactctcgtgaccttcgcaccgtgtcccgtaggcacagataacacagctgtgaagccgcttaggaatcgcctcaaatccacagtggagcaagaatctatgatagacagtaagaatattaaggaggccctcgaattccactctgaccacactcagtcagatgacgaagagctgtggatggggccttggaataatttgcacatccctatgacgaagctctag

SEQ ID NO: 131179 - DNA, 5889 bp, Artificial Sequence
  Description of Artificial Sequence: Synthetic coding sequence
atgttcaggcagttctacctgtggacttgccttgccagcggaattattctggggtctctgttcgagatatgcctcggccagtatgatgacgcatactcttatgaagactgtaaactggctagaggagggcctcctgctacaatcgtcgccatcgacgaagagagtcgcaacggcaccatactagttgacaatatgttgattaaaggtacagccggtgggcccgatcccactatcgagctgtctctcaaagacaatgtggattactgggttctgatggatcctgtgaaacagatgctctttctgaatagtactggacgtgtgttagacagggatccgcctatgaatattcattccatcgttgtgcaggtgcaatgcatcaacaaaaaagttggcactattatttaccacgaagtgcgaattgtcgttcgggacaggaatgataatagccctacctttaagcacgaatcttattacgccacagtgaacgaattaacgccagttggcacgaccatttttactggcttttcaggggacaacggtgccacagatatagacgatggccctaacggacaaattgaatacgtgatccagtacaaccctgacgatccaacatcaaatgatacttttgagatccctttaatgctgactggaaatatcgttctccgcaaacgcctgaattatgaggacaagactaggtacttcgttattattcaagctaatgatagagcccagaacctcaacgaacggcggactaccactaccacactaactgtggatgttctggatggcgacgatctgggccccatgtttctgccctgcgtgctggtcccaaataccagagattgccgcccgctgacatatcaggctgcaatccccgagctgcggacccccgaagagctgaacccgattatcgttactccccctattcaagcaattgatcaggaccgcaacatccagcctcccagcgaccgaccaggaatactgtactctatacttgtcggcacccccgaagattacccccgctttttccatatgcatcccaggacagctgaactgagcctgctggaaccggtcaatcgagacttccaccaaaaattcgatttggtgattaaagccgagcaggacaacggacatccactccctgcgttcgctgggttgcatatagaaattcttgatgaaaataaccaaagtccatatttcacaatgcccagttaccagggctatatccttgagagtgctcccgtcggcgccacaatctctgactccctaaaccttacctcaccactcaggatagtggctctggataaggacatagaggacacgaaggacccagagctgcacctttttcttaatgattacacctctgtgtttaccgtcacccagaccggcatcacaagatacctgacgttgctgcaacccgtcgaccgtgaggaacagcagacatacacttttagcattactgcatttgatggcgtgcaggagtctgagcccgttatagtgaatatccaagtgatggatgccaacgataacacgcccacattccccgagatatcctacgatgtgtatgtgtataccgatatgaggccaggagattccgttattcaactgacagcagtggacgctgatgaggggagcaatggtgagatcacttacgagattctagtcggcgcccaaggagactttattataaacaagaccaccggtctgattacgattgctcccggggtcgagatgattgtggggcgcacttacgcccttaccgttcaagcggcggataacgccccaccagccgaaagacggaacagtatttgtaccgtgtacattgaagtgttacctccaaacaaccagtctcccccccgcttcccccagttgatgtacagtctggaaatcagtgaggccatgagagtcggcgcagtacttctgaatctgcaggcaactgacagagaaggcgactccattacctacgctatcgagaatggcgatcctcagagggtattcaacttatcagaaacaacgggcatccttaccctgggtaaggcgctcgaccgggagtcgacagatagatatatcctgataataactgcctctgacgggcgccctgacggaacgagcacagcaaccgttaacattgtggtcacggacgtcaacgacaacgcccctgtgttcgatccgtatctgccccggaatctgtcagtagtggaagaagaagctaacgcctttgttggccaggtgaaggcgactgaccccgatgccggaattaacggacaggtccactactcactgggtaatttcaacaatctcttccgcatcacgagcaacggctccatttacacagcagtgaaactgaaccgagaagtgagagattactacgaattggttgtggtcgccaccgatggagcggtgcatcccaggcactctaccctcacacttgccatcaaagtgctggatattgacgataattctcccgtttttacgaacagcacctatacagtgctggtggaagagaatctgcccgctggaacaactatcctgcagattgaagcaaaggacgtggacctgggcgctaacgtcagttaccgtatcagatctcccgaagttaaacacttcttcgcattacaccccttcacaggggagctgagtctgctgcgtagtctggattatgaggccttcccagatcaagaagccagcatcacctttctggtggaggccttcgatatttatggaacgatgccaccaggcatcgcgacagtaactgttattgtgaaagatatgaatgactatcctccagtgttttcaaagaggatatacaaaggaatggtcgctcctgatgctgtgaagggtaccccaataaccaccgtttacgccgaggacgccgaccctccgggccttccagcatcaagagtgcgatacagggtcgacgacgtgcaattcccttaccctgcctctatttttgaagtggaggaggacagcggtagagtgatcacaagagtgaatcttaacgaggagcctacaaccattttcaagctagttgtggtagctttcgacgatggtgaacctgtgatgtcctcttccgccaccgttaaaatcctggtgctgcaccctggcgaaattcccagatttacccaagaggagtacagacctccacccgtgtccgagttagccactaagggtaccatggttggtgttatctcagccgccgccatcaatcagtctatcgtgtattctattgtgtcagggaatgaagaggacactttcggcataaataatattaccggcgtgatctacgtaaatggacccctggactacgaaacccgcacaagctacgtcctgagggttcaagccgactcactcgaggtggtcctggcgaatctccgcgtaccaagtaaatccaacacagccaaggtatatattgaaattcaagacgaaaataaccatccacccgtctttcagaagaagttctatattggaggcgtgtctgaagacgctcgtatgtttacgagcgttttacgggtaaaagcaactgacaaagacaccgggaattattccgtgatggcatataggctgattatcccacccataaaggagggaaaagaggggttcgtggtggagacctacactggactgattaagaccgctatgctctttcataatatgcgacggtcatacttcaagttccaggtcatcgccacggatgattacggaaagggtctgtccggcaaggccgacgttctagtttccgtggtgaaccagctggacatgcaggtcattgttagcaatgtgcccccaactctggtggaaaagaagattgaggacctgacggagatcctggatcgctatgtgcaggagcaaattccaggcgctaaggtggtggtggaatctatcggggcacgtcgccacggagacgcgttctccctcgaggattacactaaatgcgaccttaccgtgtatgcaattgatccccagacgaatcgggccatagacagaaacgagttgttcaaatttcttgacggaaaattattagatatcaacaaggactttcagccatattatggcgaagggggtaggatcctggaaatacgcactcctgaagctgtgacatcaattaaaaagagaggagagtccctcggctataccgagggggcattgcttgctcttgcatttatcattatcttatgttgcatccccgccattctggtggtgctggttagttatagacacttcaaacgcaggcaagcggagtgcacaaaaaccgcgaggatccaggcggctctgcccgctgctaagccagcggtccctgctccggcacccgtggccgctcctccaccaccgcctccgccgcccccaggtgctcatctatacgaagaactgggagactcctctatgaaaggcctttttctgctgtaccactttcaacaatcgcgaggcaacaactcggtctcagaagacagaaaacaccaacaggttgtcatgcctttttcaagcaatacaatcgaagcccacaagtcagcccatgtggatggctccctcaagtctaacaagctcaagtctgctaggaaattcaccttcctgtctgacgaggacgacttgagtgctcacaatcccctatacaaagagaatatctcccaagtgtccacaaattccgatatctctcagcgaaccgactttgttgacccgttcagccccaagattcaggcaaaaagtaaatctcttcgcggcccaagagaaaagatccaaaggctctggtctcaatctgtgtcactgccacggcgcctgatgaggaaggtccctaacagacctgaaattatcgatttacaacagtggcagggcaccaggcagaaggcagaaaacgagaacaccggaatatgcaccaataagcgaggttctagcaaccccctgctcaccaccgaagaagccaacttgactgagaaagaagaaatacgacaaggcgaaacgctaatgattgaaggaacagaacagctaaagagtctctcaagcgattcgtccttctgttttcctcggccgcacttttcttttagcaccctccccacagtgtcaagaactgtggaattgaaaagtgagcccaatgtcataagcagtccggcagaatgcagccttgagctctcacctagtaggccttgcgtgctacactctagcctgtcccgaagagagaccccgatctgcatgttgcccatcgaaactgagcggaacattttcgaaaactttgcccatcctccaaacatctccccctcagcttgcccactgcctccccctcctccaatcagcccacccagcccccctcctgcgccagctcccctggctccgccccccgacatcagccccttcagtctgttttgtccccctccttctcctccctccatcccattgccactgccccctcctacctttttccctttgagtgtgtccacctcaggacctccaactccccccctgctaccaccatttccaacccccctgcctccccctcccccctctattccatgccccccccctccctctgcctccttcttaagcacggagtgtgtttgcatcaccggggtgaaatgtaccactaatctgatgcctgctgagaagataaagtccagtatgacacagctgtctacaacaacagtgtgcaagaccgatccgcagcgggagcccaaggggatcctgagacacgtaaaaaatcttgcggagttggagaaaagcgtcgctaacatgtacagtcaaatcgaaaagaattatctccggactaatgtttcggaattgcaaactatgtgcccgagtgaggtcacaaacatggagatcacttcagagcagaacaaaggaagcctaaacaatatcgtggaaggcaccgagaaacagtctcattcacagtccacctctctgtag

SEQ ID NO: 131180 - DNA, 5661 bp, Artificial Sequence
  Description of Artificial Sequence: Synthetic coding sequence
atgtttcgccaattctatctgtggacctgcctggcaagcggcattattctgggctccctctttgagatctgcctgggccagtatgatgatgattgcaagctcgcgcgcggaggccccccagccacaattgtggctatcgatgaggagagcagaaatgggactatattagtggacaatatgctcattaaagggacagctgggggacccgacccaacaatcgagctctccttgaaggacaacgtcgattactgggtgttgatggaccccgtgaaacagatgcttttcttgaactcaacgggtcgagtcctggacagagacccaccaatgaacattcactccattgttgtgcaggttcaatgcatcaacaagaaagtgggtactattatatatcatgaggtccgcatcgttgtgcgggataggaacgacaatagtcccactttcaagcacgagtcttattacgctaccgtgaacgagctgacgccagtcggtacaacgatatttaccggcttctcaggggacaacggtgccactgacatcgacgacggcccaaatggtcagattgaatatgtcatacagtataaccccgacgatcctacctccaacgacaccttcgaaatccctctgatgctgaccggaaacattgtcctgaggaaaaggctgaattatgaggataagaccagatacttcgtcattatccaggccaacgaccgtgcccagaatctgaacgaacgcagaactacaaccactacgctgacagtagacgtcctggacggcgatgacctcggcccgatgttcctgccttgcgtgctggtgcctaacactcgggattgccggcctctcacatatcaggccgcaatcccggagctgcgtacaccagaggaacttaatccaatcattgtcaccccacccattcaggcaatcgaccaggatcggaatattcagcccccaagcgacaggccaggaattctgtacagcattctggttgggacgcccgaggattacccacgcttcttccacatgcacccccggactgccgaactctctctgctggaaccggtcaatcgcgatttccaccaaaaattcgacctagtgataaaagctgagcaggacaacggccaccccctacctgccttcgctggactgcacatcgagattttggacgagaataaccagtccccctattttactatgccatcttatcagggatacatcctcgagtccgcccctgtgggagctactatttctgactcactgaaccttacatctcccctgcgtattgtggccctagataaagatattgaagatactaaagatcccgagctgcatctgttcttgaatgactatacctcagtattcaccgttacccagactggcattacacggtacttgacgctgttgcaacccgttgaccgagaggagcagcagacctacaccttctccattactgcctttgacggcgtccaggagtcagagcccgtcatcgtgaatatacaggttatggacgccaacgacaacacacctacatttcctgaaatcagttatgatgtctacgtttatactgacatgagaccaggagactctgtgattcagctgaccgcagttgacgcagacgaggggtccaacggcgaaatcacttacgagattttggtcggcgctcaaggcgacttcattatcaacaaaactacaggtctgatcactatcgcccctggtgtggaaatgattgtgggaaggacatacgccctgaccgtacaggcagcagacaatgcgccacccgcagaaaggtcaacaggtatcctgacactaggaaaggcactggaccgtgagtcgacagatagatacatcttaatcatcactgcttcggacggaagaccagacggtacctcaactgccaccgtgaacattgtggtcaccgacgtgaacgacaacgccccagtgtttgatccctacctgcccagaaatctgtcagtggtcgaagaggaagctaacgctttcgtcggacaggtcaaggctaccgatcccgacgcaggtattaacgggcaggtccactatagcctcgggaactttaataatttatttcgcataacgagcaacggtagtatctatacagctgtgaagctgaaccgcgaagtgcgggattactacgagctggtggttgtggctacagacggggcagttcacccaagacactcaactttgactttggccattaaggtcctggacattgatgacaatagcccagtatttactaactcaacttatacagtgcttgtggaggaaaatcttccagccgggacaacaattcttcagatcgaggcaaaggacgtggacctcggagctaatgtgagttaccggattcggtccccagaagtcaagcactttttcgctttgcatccttttaccggcgagctgtccctgttgagatccctggactacgaagcattccccgaccaggaggcttctataacattccttgtagaggctttcgacatctacggcacgatgccacctggtatcgccaccgttacagtgattgtcaaggatatgaatgattacccgcccgtgttttccaagagaatctataaaggtatggttgccccagacgcagtgaagggcactccaattaccacagtgtatgccgaagatgccgatccgccaggattacctgcctcccgcgttcgttatcgtgtggacgatgtgcagtttccctacccggcctccatctttgaggtcgaagaagactcaggccgcgtaattacacgggtgaacctgaatgaggaacccaccacgatatttaagctggtggtggtggcctttgatgacggggagccagtgatgagctcatccgccactgtgaagattttggtcctccaccccggcgaaatccctagatttacacaggaagaatatcggccaccccccgtctccgagctggctacgaaaggaacaatggtaggtgtcatctccgcagcagccataaaccagtcgattgtttatagcatcgtgtcagggaacgaagaagatacatttgggatcaacaacattacaggagttatttatgtaaacggcccactggattacgaaactcgcacaagttatgtgctccgtgtgcaggctgattcactcgaagttgtgctagcaaacctgcgcgtgccaagtaagtctaataccgcgaaggtgtacatagagatccaagacgagaacaatcatccaccggtgttccagaagaagttctatattggaggggtcagcgaggacgcacgaatgttcacctccgtcctgcgagtgaaagccacagacaaggatactggaaattacagtgtaatggcatataggctgattataccccccattaaggagggaaaagaaggattcgttgtcgagacctataccggcctgattaagaccgccatgctctttcacaatatgcgccgcagctattttaagttccaggtgattgccacagatgactacggtaaaggcctgtcagggaaagcagacgtgttggtgagcgtagtgaatcaattggatatgcaggtcatcgtgagcaatgtgccacccaccctcgtggagaaaaaaatcgaagacctgaccgaaatcctagatcgctatgtgcaggagcagattcccggcgccaaggtagtcgtcgagagtatcggtgctagaaggcacggcgacgcgttttctctggaagactataccaagtgcgacctgactgtctacgccatcgatccccaaacgaatagggcgatcgaccgtaatgaactcttcaagtttctcgacggaaaactgttggacatcaataaagacttccaaccctattatggagagggagggaggatcctggaaattcggacgcctgaggccgttacgtccatcaaaaaaagaggcgagagcctcggctacacagagggggcactcctggccttagccttcattatcattctctgctgcattcccgcaatcctagtcgttttggtgtcttatagacactttaagagacgccaggcggagtgcacaaaaaccgcacggatacaggcagccttaccagctgccaagccggccgtacccgctcccgctcccgtggctgccccgcctcctccaccccccccaccccccggtgctcacctttatgaggagctgggggatagcagcatgaaaggcctgtttcttttgtatcactttcagcagtccagaggtaataattcggtgtccgaggatcgcaaacatcagcaggtggtcatgcccttttcatctaatacaatagaagctcacaagagcgctcacgtggacggttccctcaagagcaacaagctaaagagtgcgcgcaaatttaccttcctgagtgatgaagacgacctttctgctcacaaccccctttataaggagaatatcagccaggtgagcactaatagtgatatcagccagaggacagatttcgtcgatccgttttcacctaagatacaggccaagtcaaagagtctgcggggtccacgggaaaaaatccaacgactttggtctcagtcagtatcgttaccccggagattgatgagaaaagtgccaaaccgccccgaaatcattgatctacagcaatggcagggcacaaggcagaaggccgaaaatgagaacaccggtatctgtacaaacaagcggggcagtagcaaccctctgctaactaccgaagaggccaatctgaccgagaaggaggagattcgccagggcgaaaccctgatgatcgaaggtacggaacaactaaagagcttgagcagcgattcgtctttctgcttcccacgccctcacttcagctttagcaccctgcccactgttagccgtactgtggagctgaagtccgagcccaacgtaatcagcagcccagccgagtgctctttagagctcagccccagcaggccttgtgttctgcacagtagcctgtcccgccgggagacccctatatgcatgctgccaatcgaaaccgagagaaatatttttgagaacttcgcccatccccccaacatctccccctccgcttgccccttacctccccctccccccatctctcctccttctcctccgcccgcccccgctcctctggccccacccccagatatctccccgtttagtttgttctgccccccgccgtccccacccagcatccccttaccgcttcctccacctactttcttcccactcagcgtcagtacatccggtccccccaccccccccctgttacctcctttccctactccactgccccccccacccccatcaataccatgtcccccaccaccatctgcaagtttcctgtctactgaatgcgtgtgcattaccggtgtgaagtgcaccacaaatcttatgcctgccgagaaaattaaaagtagtatgacacagctgtcaaccacgaccgtttgtaaaaccgatcctcagcgtgaaccgaaggggattctgcgccatgtgaagaatctggccgaactggaaaaatcggtggccaacatgtactcccagattgagaagaactacctcagaacgaatgtctccgagctgcaaaccatgtgccccagcgaagtaacaaatatggaaatcacaagcgaacagaacaaaggatcccttaataacatagttgaagggaccgagaaacagtcccattctcaaagcacaagtctctag

SEQ ID NO: 131181 - DNA, 1965 bp, Artificial Sequence
  Description of Artificial Sequence: Synthetic coding sequence
atgtttcgccagttttatctttggacctgcttggccagcggcatcatccttggaagtttatttgagatctgcctcgggcagtacgatgacgactgtaaactcgccagaggcggtccacccgcaacaatcgtcgctattgacgaagaatcgaggaacgggactatccttgtggacaatatgcttattaagggcactgccggtggtcctgaccccactatcgagttgtcactaaaagataatgtggactactgggtactgatggacccggtcaagcagatgctttttctcaactccaccggcagagtgctggatcgagaccctcccatgaacattcacagcatcgtggttcaggtgcagtgtatcaataagaaagtcgggacgatcatctatcacgaagtgcggattgtggttagggaccggaatgataattcccctacgttcaagcacgaaagctattacgctacagtcaacgaactgacccccgttggaactaccatctttacggggttctcaggggacaatggtgcaacagacattgacgatggacctaatggtcagattgaatatgtgatccaatataatcccgatgacccgacctctaacgatacctttgagattccccttatgctgactggcaatattgtcctgaggaagaggctgaattatgaagacaagactaggtacttcgtgatcattcaggcgaatgaccgcgctcagaatctgaacgagaggagaacgacaacgaccaccctgaccgtggacgtgttagacggtgacgatctcggcccaatgttcctgccgtgcgtcttagtccccaacactagggattgccgtccactcacataccaagcagcgattccggaattgagaacccctgaggagttaaatccaattattgtgacacctccaatccaagccattgaccaggatcggaacatccagccaccctccgatcggccagggatcctgtacagcattctggtgggtacccccgaagactaccccaggttcttccacatgcaccctagaaccgcagagctgtccctgttagaacccgtcaatcgggatttccatcagaaattcgacctcgtgatcaaagccgaacaggacaatggacacccactgcccgccttcgcaggccttcacattgaaatcttggacgagaacaatcagtctccatacttcaccatgcccagttaccaaggatacatacttgagagcgcccctgttggcgccaccattagtgactcactgaatctgacaagtcccctccgcatcgtagccctggataaagacattgaagacacaaaggaccctgagttgcatctcttcctgaatgactacacgtccgtgttcacagtaactcagacaggaatcaccagataccttacactgcttcagccagtggaccgagaagaacagcagacatacacgtttagcattacagctttcgacggcgtgcaggagtctgagcccgtgatagtcaacatacaagttatggacgcaaatgataatacacccacatttcccgaaatttcctatgatgtgtatgtgtacacagatatgagacctggtgactcggtcattcagcttacagccgtcgacgcggacgaggggagcaacggcgaaattacttatgaaatactcgtgggagcacaaggagacttcattattaataaaactactgggttgataactatcgcccccggcgtggagatgatagtggggcggacctacgcccttaccgtgcaggctgctgacaacgccccaccggccgagagaaggaactctatatgtaccgtgtacatcgaggtcctacccccaaataaccaaagcccccccaggttcccacaactgatgtatagtctggaaatttcagaggcaatgagagtcggagctgtgttattgaacctgcaacatggtgacagcaacctcagggaatccactggccagggtaagcactag

SEQ ID NO: 131182 - DNA, 5034 bp, Artificial Sequence
  Description of Artificial Sequence: Synthetic coding sequence
atgttcagacagttctacctgtggacctgtctcgcatccggaattatccttggatccctgtttgaaatatgcttagggcaatacgacgacgactgcaagctggcccgtgggggccccccagcaacaattgtggctatcgacgaggaatcaagaaatggcacaattctggtggacaacatgttgatcaagggaacggctggcggtcccgatcccactattgagctctcattgaaagataacgttgactactgggtgctgatggaccctgtcaaacagatgctatttttgaactcaacaggaagggtgttagacagggaccctccaatgaacatccactcgatagtagtgcaggtccagtgtatcaacaagaaagtcggcacaattatctaccatgaggttcgaattgtggtgcgggatcgaaacgataactctccaacgtttaagcacgagagttactacgctacagtcaacgagcttaccccagtcggaacgacgatcttcacaggatttagcggagacaatggtgctactgacatagacgatggaccaaacggtcaaatcgaatatgttattcaatacaatcctgatgatcccacctcaaatgacacattcgagatccccctaatgctaaccgggaacattgtgttgcgaaagcgcttaaattatgaggataagactcgatacttcgtgatcatccaggccaacgacagggcacagaacctgaacgaacgaaggaccaccactactaccctgaccgtggatgtgttagatggtgatgacctggggcccatgttcttaccttgcgttctggttcccaatacaagagattgtcgccccctgacttaccaggccgccatcccggagcttcgaactccggaagagttgaatccaatcatcgttactccccctatccaggctatcgatcaggatcggaacatacagcccccatctgatcggcctggtatcctgtatagtattctagtcggtactcccgaggactaccccagatttttccacatgcacccccgcacggctgagctgtccctgttggaacccgtgaatcgcgattttcatcagaaattcgatctcgttataaaagcagaacaagataatgggcaccccctgccggcctttgcaggtctacacattgaaatcctggatgagaacaatcaatcaccttatttcacaatgccatcttatcagggatacatcctggagtctgcacctgtaggcgccaccatctccgattctctgaatctcacctccccactccggatcgtggcgctggacaaagatattgaggacactaaggatccggaactgcatttgttcctgaatgattatacaagcgtatttacagtgactcagactggcatcacaaggtacctaacactgctgcagccagtggacagagaagagcagcagacatacacctttagcataaccgcatttgacggggttcaggagagtgagcccgtcattgttaatattcaggtgatggatgccaacgataacacccccacctttccagagatcagctatgacgtctacgtgtacactgatatgagacccggtgacagcgtaatacagttgactgctgttgatgctgacgagggatcgaacggcgagattacctatgagatccttgtcggagcccaaggcgactttatcataaacaaaactaccgggctgatcacgattgcccctggcgtcgagatgatcgtggggcgtacatatgccttgactgtgcaggctgctgataacgcgccacctgcagagaggaggaatagtatctgcacagtctacattgaggtcttgccgccaaataaccagtcacctcctcgcttcccgcagctgatgtattcgctggagatctcagaggccatgcgtgtcggcgcggttctcctgaacttgcaagctactgatagggagggcgacagcatcacatacgccatcgagaacggagatccccagcgtgtcttcaacttgtctgagacgaccggaatactcactttgggcaaggcattagaccgggaaagcacagataggtatatactgatcatcacagcttcagacggtagacctgacggtacatcgaccgccactgttaacattgtggtgacagacgtaaacgacaatgcgcccgtgttcgatccataccttccgcgaaatctgtcagtggtagaagaggaggctaacgcattcgtcgggcaggtgaaagctactgatcctgatgccggtatcaatggccaggtgcactatagcttgggaaatttcaacaacttatttagaattaccagtaacggttccatctatacagccgtgaagctgaaccgggaagtgagagactattatgaactggtcgtggtggcgacggacggtgccgtccaccctaggcactccaccttaacactagccattaaggtgttggacatagacgataacagtccagtttttacaaacagcacatacacagttctggtggaggagaatttgccagccggcactacgattctacagatagaggccaaggatgtggacctcggagcaaatgtctcctatcggatccgaagtcctgaagtaaagcatttttttgcactgcaccccttcaccggtgagttgtcgctgctgcgtagtctcgattatgaggcctttccagaccaagaagctagcattacattcctggtggaagcgttcgatatctacggaactatgccaccagggattgctaccgtgaccgttatcgtgaaggacatgaacgactaccctcctgttttttccaagcgcatttataaaggaatggtcgcccctgatgccgtcaagggcacgcccatcaccaccgtctatgcagaggacgctgatccacccggcttaccggcctctagagtcaggtaccgcgttgacgatgtgcagtttccttaccctgccagcatcttcgaagtagaagaagatagcggccgggtgatcacgcgggtaaacctgaacgaggaaccaacaaccatatttaaattggttgtggtcgcattcgatgatggcgaacccgtgatgtcaagcagcgcaaccgtcaaaattttagttctccatcccggagaaatccctcggtttactcaggaggaatataggcctccgcccgtctcagagttggctacgaaggggactatggtgggggtcatctccgctgccgcaattaaccagtctattgtgtactccatcgtctcaggtaatgaggaagacactttcgggatcaataatattaccggggttatatacgtaaacgggcccctcgactatgaaactcggacttcttatgtcctcagagtgcaagcagactccttggaggtcgtgctggcgaacctgcgcgtgccctccaagagtaatactgccaaggtgtacatcgagatccaggacgagaacaaccatcctcccgtcttccagaaaaagttttatataggcggcgtgagcgaagacgctcgcatgttcacctctgtgttgcgagtgaaggccacagacaaggatacgggaaattacagcgtgatggcatatagattgatcattcctcctattaaagaaggcaaggaaggatttgtggtggagacttatactggcctgatcaaaaccgctatgctttttcataacatgcggaggagctacttcaagtttcaggtaattgccacggacgactacggtaagggcttgagcgggaaggccgatgtgctggttagtgttgtcaaccagctggacatgcaggtcattgtcagtaatgttccccccaccctggtggaaaaaaagattgaagatctgaccgagatactcgaccgctacgttcaggaacaaattccgggcgctaaagtggtcgtagaaagcatcggcgcccgtcgacatggtgacgccttttccttagaggattatactaagtgtgacctcaccgtctatgctattgatccacagacaaacagagccattgaccgcaacgagttgttcaagttcctagatgggaagcttctggacattaacaaggacttccagccctactacggcgaaggtggccgaattctggagatccgaacacctgaagccgtcacctctattaagaagcggggagagtctctggggtacactgagggagcactgctagctctcgcattcatcatcatcctttgttgtatccctgcgatccttgtcgttttggttagctacagacacttcaaacgtcgacaggccgaatgtactaagacagcacgaatacaggccgctctaccagcggcgaagcctgcagtgcccgcaccagcgccagttgctgctccacctccccccccgcccccacctcccggcgcccacctctacgaagagttaggagacagttctatttaccgctacgagatgccacagtatggctcacgaagaagactgttgccaccagccggacaggaggagtatggggaggtggtgggggaagccgaagaagagtatgaggaggaggagtgggctagaaagagaatgataaagctggttgtggaccgggagtatgagacatcttcgaccggagaagactctgcacctgagtgtcagaggaaccggttacatcacccttccatccattcgaacatcaacggcaacatttacattgcacagaacggaagtgttgtgcgcactcggagagcatgtctgaccgacaacttgaaagtagcaagtcccgtcagactcggggggccctttaaaaagctggataagctggcagttacacatgaggagaatgtccccttaaacaccctgagcaagggacccttctcaacagaaaaaatgaacgcgcggcccaccctggtgacattcgctccctgcccggtcggaaccgacaacacggcagtgaagccgcttaggaaccgcctcaaatcaactgtggaacaagaatcgatgatagattcaaagaacataaaggaggccttagaatttcattcagaccatacccagtcagatgacgaggagctgtggatgggcccctggaacaacctgcatattcctatgaccaagctgtag

SEQ ID NO: 131183 - DNA, 279 bp, Artificial Sequence
  Description of Artificial Sequence: Synthetic coding sequence
atgtttcgacagttttacctgtggacatgtctcgcgagtgggatcatactgggcagtctgttcgagatttgtctcgggcagtacgacgacgactgtaaactagccagaggcggccccccagctaccattgtcgcaatcgacgaggaatctaggaacggaactatactagtcgataatatgctgatcaaaggcaccgccgggggtcccgaccccactatagagctctcgttaaaagacaacgttgattattgggtgttgatggacccagtcaagcagtag

SEQ ID NO: 131184 - DNA, 3453 bp, Artificial Sequence
  Description of Artificial Sequence: Synthetic coding sequence
atggctccacctcttaggccacttgctcggctcaggcctcccggaatgttactccgggccctgctgcttttactcctgctgtcccctctgcccggtgtgtggtgcttttctgaacttagcttcgttaaggagcctcaggatgtgaccgtaacgaggaaggaccctgttgtgcttgactgccaggcacatggcgaggtaccaatcaaggtgacatggctcaagaatggcgccaagatgagtgagaacaaaagaatcgaggtcctctcaaatggttccctgtacatttcagaggtggagggaagacgcggcgaacagagcgacgagggcttctaccagtgtcttgcaatgaacaagtacggcgctattttgtcccagaaggctcacctggccctttctactatttcggcattcgaggtgcagccaatcagcaccgaagtgcatgaggggggagtcgccaggtttgcatgtaaaatttcatcccacccaccagctgttatcacatgggagtttaatcggacgactcttcccatgacaatggatcggattaccgcgctgcctactggcgtgctgcagatttacgacgtctcacagagagacagtggcaattatcggtgcattgccgcaacggtggcacaccggcgtaaatccatggaggcttcactcactgtcatccctgcaaaggaaagcaagtctttccatacgcctacaattattgccggtccgcagaacatcaccacctcactccaccaaacagttgtcctggagtgcatggctacaggtaatcccaagcctatcatcagctggagtcggctggatcacaagagtatcgatgtgttcaacacccgagtacttgggaacggaaaccttatgatttctgatgtgaggctgcagcacgctggtgtttacgtgtgcagggccacaacccctggaacccgaaatttcacagtggctatggcgacactgaccgttctagcccccccatcctttgtcgaatggccagagagcctcactagaccaagagccggtacagcgcgtttcgtttgccaggccgagggcatcccttctcctaagatgtcctggcttaagaacgggaggaagatccattccaatggccgaatcaagatgtacaatagcaaacttgttataaaccagatcatccctgaagacgatgcaatataccaatgcatggctgaaaattcacagggaagtattttaagtagggcacggctgacagtagtcatgagtgaggaccggccaagcgccccatacaacgtgcatgctgagaccatgtcgagttccgctattttactggcctgggagcgtccactgtacaactccgacaaggtaattgcctactctgtgcactatatgaaggcggagggcctcaacaatgaggaataccaagtcgtgataggcaatgacactacccattacataattgatgaccttgaacctgctagtaactacaccttctacatagtcgcatacatgcctatgggagcctcccagatgagcgatcatgtcactcagaataccctggaagatgtgcctctgaggcctcccgagattagcctgacaagtcgatcccctaccgatattttaattagttggctgccaatccccgccaaatatcggcgtggtcaggtggtgttgtatagactcagcttccgactgtctaccgagaattccatccaggttttggaattaccgggaactacccatgagtatctactggaggggcttaaacctgactcggtctacctggtccgcatcaccgcagctactagagtcggacttggagagtcatccgtctggacttcacaccgaacccctaaggctacatccgtaaaggcgcccaaaagccccgagctgcaccttgaaccactgaattgtacaacgatctcggtgagatggcagcaagacgtggaagacacggcagctatccagggatataagctctattataaggaggagggccagcaggaaaacggaccaatcttcctggatactaaagatctcctttatacactgagcgggcttgaccccagacggaagtaccacgttcgtctcttggcttacaataacattgacgatgggtaccaggcagaccaaacggtgagtactccagggtgcgtgtcagtgcgtgaccgcatggtgcccccaccccccccacctcatcacctatacgctaaggcgaatacttctagctctatctttctccactggaggaggcctgcgttcacggccgctcagattattaattacactatccggtgcaatccggtcgggctgcaaaacgcgagtctggtgctgtacctgcagacctccgagacgcacatgctggtgcagggcctcgagccaaacaccaaatatgaattcgctgttaggctccatgtggatcaactaagtagcccatggagccctgtcgtttatcattcaaccctgcctgaggccccagcgggccctcctgtgggcgtgaaggttacgctgatcgaggatgacactgcactggtttcatggaaaccacccgatgggcccgagactgtcgtgacccgatataccatactgtatgcaagtcgcaaggcatggattgcaggagaatggcaagtgctgcacagagagggcgcgatcacaatggctctgctggagaatctagtggcaggtaacgtctacattgtgaaaataagcgcttcgaacgaggttggggaggggccattttctaactcagttgaactggctgtgctccccaaagaaacgtctgaatccaaccagcgccccaaaagacttgactctgccgatgctaaggtgtactctggctactatcatctagaccagaaaagcatgactggaatcgcagtgggcgtggggatcgcgctcacctgcatcttgatatgcgtgttgatcctgatttaccgatcaaaggctcgaaaatcttctgcttctaaaactgctcagaacggaactcaacagcttccccggacgagcgccagtctcgcctctggcaacgaagtgggcaagaacctcgaaggagcggtgggaaatgaagagagccttatgcctatgatcatgcctaactcctttatcgacgccaagggcggaaccgatttaatcattaatagctatggacccatcatcaaaaataactccaaaaaaaaatggttcttcttccaggatagcaagaagatacaggttgaacagccccagcggcgattcaccccagcggtatgtttctatcaacccggaacaaccgtgttgatctcagatgaagatagccctagtagcccagggcagactaccagcttttctcggccgttcggggtggctgccgacactgagcactccgccaacagcgaaggctctcacgagacgggcgactctgggcgcttcagccacgagtcaaatgatgagattcatctgagctctgtgatctccaccacaccgccaaatctgtag

SEQ ID NO: 131185 - DNA, 1434 bp, Artificial Sequence
  Description of Artificial Sequence: Synthetic coding sequence
atggggcgtactgtggtggtgctgggaggagggatttccgggttagcagcctcataccacctgagccgtgccccttgccctcccaaagtcgtcctggtggagagttccgagcgactggggggctggattagaagcgtacgcggaccaaacggagccatattcgaactcggtccacggggaatcagacctgctggagccctgggcgccaggactctgcttctagtctctgagctgggactggattctgaggtcctgcctgtccggggtgaccatccagctgcacagaaccggtttctctacgtgggcggcgctttgcatgccctgccaactggcttacggggcctgctgcgcccgagccctcctttctctaagcccttgttttgggcaggcctgagggaactgactaagcccagaggcaaggagccggacgagaccgttcactctttcgcacagcggaggcttggcccagaagtcgcaagtctggccatggattccctgtgtcgaggcgtgtttgcaggaaactccagggagcttagcatccgttcctgtttccccagtcttttccaggctgaacagacacatagatctattctattaggactcttactgggtgcaggcagaaccccacagccagacagtgctctaattcgacaagccctcgcagagcggtggagccagtggtctctcaggggtggtctggagatgcttccccaagccttggagacccatttgactagcaggggagtctcggtgctcagaggtcaaccggtgtgtggcctgtcactgcaggcagagggtaggtggaaagtgagtctgcgtgactcctcacttgaagccgatcatgtcatcagcgcaattccagcatctgtgctgtccgagctgctgccagctgaagcagctccactggccagggcactgtccgccatcactgccgtgtcggtggcagtagttaacttgcaataccaaggtgcccatttaccagtgcaaggttttggacacctggttccaagttctgaggacccgggggtcctgggtatcgtgtatgactctgtggcattcccagaacaggacggcagtccacccggactaagagtgactgtgatgctgggggggtcttggttgcagacactcgaagctagcgggtgcgtgctgtcacaggaactgttccagcagcgcgcgcaggaggcggctgcgacacagctaggcttaaaggaaatgccctcacactgcctggttcacctacataagaactgcatcccccaatacaccctcgggcactggcagaaattagagagtgctcgtcaattcctcaccgcccaccggctacctcttaccttggccggcgctagctatgagggggtggcagtgaacgattgcatcgaatctgggcgccaggccgccgtctccgtcttagggacagaacctaatagttag

SEQ ID NO: 131186 - DNA, 1434 bp, Artificial Sequence
  Description of Artificial Sequence: Synthetic coding sequence
atgggccgcacggttgttgtcctaggggggggtatttctgggctggcagccagctatcacctgtcacgggccccgtgcccgcctaaagtcgtgctcgtagaatcctccgagagactgggcggatggattagaagtgtgaggggtcccaacggcgcaatctttgaactgggaccaaggggcataaggccagccggggctctgggcgcaaggacattattgctggttagcgagctgggactcgattccgaggtgttacctgtgcggggcgatcatccagcggctcagaatcggtttttatacgttggaggcgcgcttcatgctttgccaaccggcctgcgaggactgctgagaccctccccacccttctctaaacctttattctgggcaggtctcagggagttgaccaagccacgcggcaaagaacccgacgaaactgtgcactcttttgctcagcgacgactgggtccggaagtggcctccttggccatggacagtctttgccgaggcgtgtttgccggtaacagccgggagctgagcatccggtcatgcttcccatcactcttccaagctgaacagacacatcgctctatcctgttgggactgcttttgggcgccgggcgcactccacaaccagactccgctctgattcggcaagccctagctgagcgctggtctcagtggtccctgcggggaggactagagatgctcccacaagccctcgagacccacctcaccagtagaggagtgtcagtgctgcgaggccaacctgtctgtggcctgtcgctacaggccgaaggccgctggaaagtgagtctcagggatagctctcttgaagccgatcatgtcattagtgcgattcccgcaagcgtgctatccgagctgttaccagctgaggctgccccactggccagagcgctgagcgcgattactgccgtttccgtggcggtcgtgaatctgcagtatcaaggcgcccaccttccagtccaaggctttgggcacttggtgcccagcagcgaagatcccggtgtcttaggaattgtgtatgattctgtggccttcccagaacaggacggatctccgcccgggctgagggtcacggtaatgttaggcggtagctggttgcagacccttgaggctagcgggtgtgtcctgtcacaggagttgtttcagcagagggctcaggaagcagctgccacccaacttgggctaaaagaaatgccatcacactgtttggtccacctgcataagaattgtatcccccaatataccctcggacattggcagaagctggaaagcgccagacagtttctgacagcccatagacttcccctgaccctcgccggagcgagctatgaaggagtggcagttaatgactgtatcgagagcgggcggcaagcagcagtcagtgtgctcggaacagaaccaaattcctag

SEQ ID NO: 131187 - DNA, 717 bp, Artificial Sequence
  Description of Artificial Sequence: Synthetic coding sequence
atggggcgaaccgtcgttgtattaggaggcggaatctcagggctggccgcgtcttatcatcttagcagagccccatgccctccgaaagttgtgctcgtggagtcttccgagaggcttggcggctggatccggagcgtgcgaggccctaatggagccatttttgagctcggcccgaggggcatacggcccgcaggtgccctcggcgcccgtaccctcttgctggggttcggacacctggtccctagttcagaggatcccggagtgctgggcattgtgtatgacagcgtggctttccctgaacaggacggcagcccgccaggtctgcgagttaccgtaatgcttggaggaagctggctgcaaacactggaggcctcgggatgtgtcctgtcccaggaactgtttcagcagagggcgcaggaggccgcagccacacagctcgggctcaaagagatgccctcgcactgtctggtccacctccacaaaaccaagaaccagctcaagtggcggcaatctcacgatcgaacggtggagtggccgaaggagtatccaggccggagcaggaagcaggcgccatccatactgcacgtgccaggatgtcagttactccggtgtcgggatagagaccatttaggagccgtcagtgagcagccccgctcttcagcagaatcccgagtaggagtggcctcgtccacgtttagcactttccccctcttttag

SEQ ID NO: 131188 - DNA, 1335 bp, Artificial Sequence
  Description of Artificial Sequence: Synthetic coding sequence
atggggagaactgttgtcgtcctgggaggagggatcagtggtctcgccgctagctaccaccttagtcgggctccttgcccaccaaaggtcgtcttagtcgagagctccgaaagacttggcgggtggatccgcagcgtacgcggtccaaatggcgctatctttgaacttggtcctcgtggcatccggcctgccggtgctctgggagcaagaacgttactgctggcatgcggggaacaggtaagcgaactagggcttgattccgaagtccttcctgttagaggagaccatcccgctgcacagaaccggttcttgtatgtggggggggccctacacgccctcccaacaggcctctcacctagcctcactctcaaggtagcctccctggctatggacagcttgtgccgcggcgtgtttgccgggaatagccgagaactgagtatacgaagctgttttccaagcctcttccaggccgagcagacccatcgctccatcctgctaggcttactcttaggtgcagggcgtacccctcagcccgatagcgcactgataagacaggctctggcagagagatggtcccaatggtctctgcggggtgggctggagatgctcccccaggcccttgagacccatctgactagccgtggggtttcagtgctgagaggacagccggtgtgtgggctgagtctgcaagccgagggcagatggaaggtgagcctgcgtgacagctccctagaagctgatcacgtcatctccgctatccctgcttccgtgctgtcggaattgctgccagccgaggccgcacctctggccagggctctgtccgccatcacagcagtgtccgtggccgtcgtgaacctgcagtaccaaggcgcacatctacctgtgcaagggttcggccatctcgtccccagctctgaggacccaggggtgttaggaatagtctacgattccgtcgccttccctgagcaggatggatctccgccaggtttacgagtgacagtcatgcttggcggatcatggctgcagacactggaagcgtcgggatgcgtcctgtcacaggagctgttccagcaaagggcccaggaggccgcagcaacccagttaggcctgaaggaaatgcccagccattgcctcgtacatctgcacaagaattgcatcccccagtacacactgggacactggcaaaaactggagtccgcaagacagtttctgacggcacatcgcctcccactcacattggccggcgcatcatatgagggcgttgcagtgaatgactgcatagagtctggaagacaggccgcggtctcagtgctgggtaccgaaccgaattcgtag

SEQ ID NO: 131189 - DNA, 144 bp, Artificial Sequence
  Description of Artificial Sequence: Synthetic coding sequence
atggacatcctcaaatccgaaatcttacgcaaacgacagttagtagaggatcggaacctcctcagtgagagcatgtgtgccaatgatgcttacttgcaaatggcgatcggtaacgctccatggccgattggcgtgacgatgtag

SEQ ID NO: 131190 - DNA, 504 bp, Artificial Sequence
  Description of Artificial Sequence: Synthetic coding sequence
atgatccgaacctttcctggagaaaataagaaatatttcaagcgcagtgaacttgcaaagaaggaggaggaggcatacttcgagaggtgtggttataagatccagccgaaagaagaggaccagaagccactcacatcgtctaatcccgtgctcgagctggagctggctgaggagaaactccccatgacactgtcaagacaggaagtgatcaggcgtcttagggagcgcggggagccaatcaggctgtttggcgaaacagactatgatgccttccagcgactgcggaagattgaaattcttacgccagaagttaataaaggcctacgcaatgatctcaaggcagccttggacaagattgatcaacagtaccttaatgaaattgtgggcggacaggaacctggcgaagaagatacccagaatgacctcaaggtacacgaagaaaatactacgatcgaggagctggaagctcttggagagtcacttggcaagggggacgaccattag

SEQ ID NO: 131191 - DNA, 750 bp, Artificial Sequence
  Description of Artificial Sequence: Synthetic coding sequence
atgattcgtacctttcccggggaaaacaaaaaatacttcaaaaggagcgaacttgctaagaaggaggaagaggcctattttgaaagatgtggatataaacctatcaacgagaagccgagcggagagatacagcccaaggaggaggaccagaagccactgacttcatccaacccagtacttgaactggagctggctgaggaaaagctgccaatgacgctgtcccgacaggaggtcattcgaagactgcgggagcggggcgagccaatccgactgttcggcgagacggattacgatgcttttcagcgcctcagaaagatcgagatactgacacccgaagtgaataaagggctccggaatgaccttaaggccgccctcgacaagatagatcagcagtatcttaacgagatcgttggggggcaggaacccggggaggaagatacacagaatgacttgaaggtccacgaagaaaacaccacgatcgaggaacttgaggctctgggtgagagcttgggaaagggtgatgatcacaaggatatggacataattaccaagttcctgaagtttctactgggggtgtgggccaaggaactgaatgctagggaggactacgtcaaacgctcagtacaaggaaagctgaattcggcgacacaaaaacaaaccgaatcatatttgcggccgctcttccggaagttacggaagaggaatcttcctgccgacatcaaggaatctattacagacattatcaaatag

SEQ ID NO: 131192 - DNA, 1029 bp, Artificial Sequence
  Description of Artificial Sequence: Synthetic coding sequence
atggatatcctcaagtctgaaatcctccggaagcggcagctggttgaggaccgaaacttactcgttgaaaataagaagtatttcaaaaggagcgaattagctaagaaggaggaggaggcatattttgaaaggtgtgggtacaagattcaaccgaaggaagaggaccagaagccattgacctcgtccaacccggtgttggagctggaactagctgaagaaaagctgcctatgacactgtcaagacaggaagtcataaggaggctaagggagaggggagagcctatccgcctcttcggagagactgactacgacgcgttccagagactgcgcaaaatcgagatcttgacgccggaagtcaacaaggggctcaggaatgacttgaaggccgctctggataagatcgaccagcaatacctgaatgaaattgtgggtggccaagagcccggagaggaggacacccaaaacgacttgaaagtgcacgaagagaatacaacgatcgaggaactggaagcacttggtgaatctttgggtaagggggacgatcacaaagatatggatatcattacaaaattcttaaagttcctgctcggagtgtgggctaaggaactcaacgctcgagaagactatgtcaagcggagcgttcagggtaagctaaatagcgccacacagaaacagacagagtcctatctacgaccgcttttccggaagctgcgcaaacgtaatttgccggcggatatcaaggaatctatcaccgatataattaaattcatgctgcaacgcgaatacgtcaaagctaacgatgcctatttgcagatggccattggaaacgccccttggccaataggagttaccatggtcggcatccacgcaaggaccggccgggagaaaatcttctcaaagcacgtggcacatgtgctgaacgatgagacccagcgcaagtacattcagggccttaaaaggctaatgactatctgccaaaagcatttcccaactgatccaagtaagtgcgtcgagtacaatgcgctgtag

SEQ ID NO: 131193 - DNA, 750 bp, Artificial Sequence
  Description of Artificial Sequence: Synthetic coding sequence
atgatcaggacttttcccggcgagaataagaaatacttcaaaagatcagagttggccaaaaaagaagaagaggcttacttcgaacggtgcggctataagccaatcaatgagaaaccatctggagaaatccagcccaaagaggaggaccagaagcccctaacctccagtaaccctgtcctggagctcgagctggcggaggaaaaattacctatgacactttcgaggcaggaggtgatccggagacttagggaacgcggggagcctatccggctgttcggagagaccgattacgacgcctttcagaggttaagaaagatcgaaatcctgacacccgaggtgaataaggggcttcggaacgacctgaaggctgccctggataagatcgaccagcagtaccttaacgaaatcgtaggtgggcaggagcctggagaggaagacacgcagaacgatctcaaggttcatgaggaaaatacaaccatcgaggagctggaagcacttggggaatctctaggcaaaggagatgatcataaggatatggatataatcaccaaatttctcaagttcttgctgggcgtatgggctaaagaacttaatgcacgtgaggattatgtgaagcgatccgtacaggggaagctgaactccgcgacccaaaagcagaccgagtcctatttgcgtccacttttccggaaactgaggaaaagaaatctgcccgctgatatcaaggaatccataacagatataataaagtag

SEQ ID NO: 131194 - DNA, 1083 bp, Artificial Sequence
  Description of Artificial Sequence: Synthetic coding sequence
atggatacaccgttgagacggagccgaagattgggtggtctccgacctgagtcccccgaatccttaacatccgtgtccaggacaagacgcgcactcgtcgagttcgagtctaatccggaggaaacgagagagcctggatcacccccatctgtccagcgcgcagggctgggcagtccagagagaccaccaaaaacttcacctggatctcctcgtttgcagcagggagccggtctggaaagcccccagggacagcccgagcctggagccgctagcccgcagcggcagcaggaccttcatttggagtcaccccagaggcagcctgagtattctcctgagtcaccacgctgtcagcccaagccctccgaagaggctcctaaatgttcacaggatcagggagtgctcgcctccgagttggctcaaaacaaagaagaacttaccccgggggcaccccagcaccagttacctccggttcccggctcccccgagccctaccccgggcagcaggcacccggccctgaaccaagtcagccactgcttgagctaacaccacgcgcaccaggatctccacggggccagcacgaaccctccaagcctccccctgcaggcgagaccgtgacaggcggatttggagctaagaaacgaaagggcagtagcagtcaggcccccgcatcaaaaaaactgaataaggaggagttaccagtgataccaaaaggtaagcctaaatcgggcagagtctggaaagacaggtcaaaaaagcgcttcagccagatgctccaggataagcccctgcgaactagttggcagaggaagatgaaggagaggcaggagcggaaactggctaaagatttcgcacggcatctggaggaagaaaaagagcgacggaggcaggagaaaaagcagcgcagagcagaaaatctgaaacggcgtttggaaaatgaaagaaaggctgaagtggtgcaagttattaggaacccagctaagttgaagcgcgccaaaaagaagcagctgaggtcaattgaaaagagagacacacttgcgttgttacagaagcagccaccccagcaaccagcggcaaaaatctag

SEQ ID NO: 131195 - DNA, 1095 bp, Artificial Sequence
  Description of Artificial Sequence: Synthetic coding sequence
atgagtctggctgatgagctgctcgccgacctggaagaagctgccgaggaggaagaaggaggtagctacggcgaggaagaggaggaacctgccatagaagacgtccaagaagaaacacagctggacctgtcaggagatagcgttaaaacaattgccaaactctgggactcaaaaatgttcgctgagattatgatgaaaatcgaggagtacatttcaaagcaagccaaagcctcagaggtcatgggcccagtggaagcggccccagagtaccgcgttatcgtcgacgctaataatctcaccgtcgaaatcgagaacgagctgaacatcatccacaaattcatccgagacaagtacagtaagaggttcccggagttagagtccctggtaccaaacgccctcgactatattcgaacagtcaaggagctgggcaacagcctcgataagtgtaagaacaacgagaacttgcagcaaatccttaccaacgccaccatcatggtggtgagcgtgacagcaagtactactcagggacagcagctgagcgaggaggagctggagcggttggaggaagcctgcgacatggcacttgagctgaacgcatctaaacaccgcatttacgaatacgtggagtctcggatgtcatttattgcaccgaacttgtcaatcatcattggagctagcactgctgctaagataatgggggtggcagggggcctgaccaatctctcaaaaatgccagcttgcaatatcatgctcctgggcgctcagcgaaagacgctgtcgggcttcagctcaacctctgtcctccctcatacaggttacatttaccattcagacatcgttcagtctttgccacccgacctgcgcagaaaagccgcgcgcctcgtggctgctaagtgcaccctggcggctagagtagactcatttcatgagagcacagaaggtaaggttgggtacgagctgaaggacgagatagaacggaagttcgacaagtggcaacgacgcagatggctacggcctactagaagcatttcacctgcctggctgtcctcatctagatccagggcccggcgagttgctctatgccctcctgaatag

SEQ ID NO: 131196 - DNA, 1500 bp, Artificial Sequence
  Description of Artificial Sequence: Synthetic coding sequence
atgtctctcgcagatgaacttctcgccgacttagaggaagctgctgaggaagaggagggtggctcttacggagaggaggaagaggagcctgcgattgaagacgtgcaggaggaaacacaacttgacctcagcggcgactctgtgaagaccattgcaaaactgtgggactccaaaatgttcgcagaaataatgatgaagatagaagaatatatcagtaagcaagcaaaggccagcgaagttatgggtcctgtggaggcagcccctgaatatcgagtcatcgtggacgccaacaatctgacggttgagattgagaacgagcttaatatcatccacaagtttatacgagacaagtacagcaaacggttccctgagttagagagcttggtgccaaatgccctggactacatcaggaccgtgaaggagttgggaaactccctagacaagtgcaaaaacaacgagaacctacaacagattttgacaaatgctaccattatggtcgtctccgtaaccgctagcaccacacaaggccagcaactatcagaagaggagctggagcgtctggaagaggcttgtgatatggctctagaacttaatgctagcaaacatcgtatatatgagtatgtcgagtccaggatgtctttcatagcgcccaatctttcaataattatcggcgcatcaactgctgctaagatcatgggcgtcgcgggtggattaacaaacctatctaaaatgcccgcttgcaatatcatgctactcggggcccaaagaaaaaccctgtcagggttctcttccacgtcagtgctcccccacactggttacatctaccatagcgatatcgtgcagagcctgcctccggatctgaggagaaaggccgcccggctggtggcggctaaatgtacactcgccgctcgggtagactctttccatgagagtactgagggaaaggtgggctatgagctgaaggatgaaatagaacgaaaatttgataagtggcaggagccgccacccgtgaaacaggtgaaaccattaccagccccattggacgggcaaagaaagaagcgggggggcaggaggtaccgtaaaatgaaggagcgcctcggcctgactgaaattcggaaacaggccaatagaatgagcttcggcgagatcgaggaggatgcctaccaagaggacctcggattttccctcggtcatctgggcaaatcaggcagcggcagagtgcggcagacacaagtaaatgaggccaccaaggcccggatttcgaaaactttgcagagaaccttgcagaagcagtctgtggtttatgggggaaagagcacgataagggataggtcttcgggcaccgcttcaagcgtagccttcacgccactgcagggcttggaaattgttaaccctcaagccgccgagaaaaaagtggccgaggctaatcagaagtatttcagttcaatggcggagtttctcaaagtgaaaggagaaaagagcggcctgatgtccacttag

SEQ ID NO: 131197 - DNA, 1353 bp, Artificial Sequence
  Description of Artificial Sequence: Synthetic coding sequence
atgagtctggccgacgaactactcgctgatcttgaggaagctgccgaggaagaggagggaggatcctacggtgaagaggaggaggagcctgccatcgaggacgtgcaggaggaaacacagcttgatcttagtggtgattccgtaaagacgatcgcaaagctgtgggattcgaagatgttcgccgaaatcatgatgaagattgaagaatacattagcaaacaggcaaaagcttctgaagtgatggggcccgtggaagccgctccagaatacagagtgatagtggacgcaaacaaccttaccgtggaaattgaaaacgaactgaatataattcacaaatttataagggataaatacagcaagcgttttccggagctggaaagcctggttccaaatgctctcgactatattcgcaccgtcaaagaattgggtaacagtctggataagtgcaagaacaacgagaatctgcagcagatcctcaccaatgctactattatggttgtctcagtgactgcctctactactcagggacagcagctgtccgaggaagaactggaaaggttggaggaagcatgcgatatggctctggaactgaatgcatctaaacacaggatttatgagtatgtggaaagccgcatgtccttcattgcacccaacctgtctatcattattggtgcgtcaaccgccgctaagatcatgggagtggccggcggactcacaaacctgagtaagatgcccgcttgcaatatcatgctgttgggggcccagagaaaaaccctgtcaggcttttcaagcaccagtgtcctcccccatactggttatatttatcatagcgatatagttcagtccctacctccagacctgagaaggaaggccgccaggctggtcgcggctaagtgtacattggcagcccgcgtagattcattccatgagtcaactgaaggcaaagttgggtacgagctaaaagacgagattgaacgcaagttcgacaaatggcaggaaccaccccccgtcaagcaagtgaaaccactgcctgctccattagatggccagcggaaaaaacgcggggggcgccgctaccggaaaatgaaagagcgccttgggctgacggagattaggaaacaagccaacagaatgtcattcggcgagatagaagaggacgcatatcaagaggatttaggcttcagcctcggccacctggatgcagcagccgatccagcggaggctgagcgtcgcatatggcgggaagtccaccatccccgccccttgctaggccacggtctccaacgtggcctacatccgacacctggccccggagactgtgagcctaccggtgggcgggaagaaggtggatag

SEQ ID NO: 131198 - DNA, 831 bp, Artificial Sequence
  Description of Artificial Sequence: Synthetic coding sequence
atgtctctcgcggatgaacttttagccgacttggaagaggctgccgaggaggaggaaggcggttcctacggggaggaagaagaagaacctgctattgaggacgtgcaagaagagactcagctggatctctcaggcgactcagtgaagaccatcgccaaattgtgggatagtaaaatgttcgcagaaatcatgatgaaaattgaggaatacatctccaagcaggccaaggcctctgaggtgatgggccccgtcgaggccgccccagagtacagagtcattgtagacgccaataacctgaccgtagaaattgaaaatgagctcaatataatccacaaattcattagggataaatactcgaaaaggtttcctgagctggaatcactggtccccaacgctctcgactatattcgcacagttaaagagttgggcaacagcttggataagtgtaaaaacaatgagaatttgcagcagattctcacaaatgctacaattatggtggttagcgttacagcctccaccactcaagggcaacagctgagcgaggaagagctagagagactggaagaggcctgcgatatggctctggagttaaacgcttctaagcatagaatttatgagtatgttgaatccagaatgtcctttatagcaccgaacctgtctattatcatcggtgcatccacggcagctaaaatcatgggagtcgctggcggtctgactaatttgagcaagatgcctgcatgcaatataatgttgctgggcgcccagcgcaagacactgtccggcttttcttcaactagtgtcctcccacacactggatatatatatcactag

SEQ ID NO: 131199 - DNA, 855 bp, Artificial Sequence
  Description of Artificial Sequence: Synthetic coding sequence
atgtctctcgccgacgaactactcgccgacttggaggaggccgcggaggaggaagaaggaggaagctacggagaggaggaggaggagccagcaatcgaagacgtgcaggaggaaacacaactggacctgtctggggattcagtgaagacaattgcgaagctttgggactctaaaatgttcgctgagatcatgatgaaaatcgaagagtatattagcaaacaggcgaaggcctctgaggtgatggggcctgttgaggcagccccagagtatagagttattgtggacgccaacaacctgaccgtggaaattgagaacgagttaaatattatacacaaattcatcagagataagtattcaaagaggtttccagagcttgagagcctggtgcctaatgcactggactatattaggaccgtaaaggagctaggtaatagcctggataaatgcaagaacaatgaaaacttacagcagatcctgacaaacgcaacaattatggtggtgtccgtgaccgcctcgactacgcagggacagcagctgtccgaagaggaattggagaggttagaagaggcctgtgacatggctcttgaactgaatgccagcaaacaccgtatttacgagtacgtcgagagcagaatgagtttcatcgcccccaatttgagcatcataatcggagcctcaacagcggccaaaattatgggcgtagccggcgggctgacaaatctgagcaagatgcccgcctgtaatataatgttgctaggggcccaacggaagactctaagcggattttcatccacttcagtcttaccacataccgggtacatctaccatagcgacatcgtacagagcctgccgtag

SEQ ID NO: 131200 - DNA, 786 bp, Artificial Sequence
  Description of Artificial Sequence: Synthetic coding sequence
atgagtctggccgacgaactgctagccgatctggaagaagccgctgaggaggaggaaggaggatcatatggcgaggaggaggaagagcccgcaatcgaggacgttcaggaggagacacagctcgatttgagcggcgattccgtaaaaacgatcgccaaactctgggactctaaaatgtttgcagaaatcatgatgaaaatagaagaatacatctccaagcaggctaaggcttccgaggtgatgggcccagtcgaagccgctcccgaatatagggttatagtggacgcaaacaatctcacagtggagattgagaacgagctaaacatcatccacaagtttatacgggacaaatattcgaagaggttccctgagctcgaatccctcgttcctaatgccctcgactacatacgcacagtgaaggagctgggaaattctctggataagtgcaagaataacgaaaacctgcagcagattctgaccaacgctactatcatggtggtctctgtgacagcaagcaccacccaggggcagcagcttagcgaagaggagcttgagcgactcgaggaggcctgcgacatggcccttgagctcaacgcatctaagcaccgtatctacgagtacgtcgagtctagaatgtcgttcatcgcccccaatctatcgatcattattggggcttccacagcagcaaagataatgggagtcgccggcggcctgactaatctgagcaaaatgcctgcgtgtaacattatgctgctgggtgcccagcggaagacactttcaggatag

SEQ ID NO: 131201 - DNA, 1569 bp, Artificial Sequence
  Description of Artificial Sequence: Synthetic coding sequence
atggctagtagtagggcaagttcaacccaggcaaccaaaactaaagcacccgatgacctggtagctcccgtcgtgaagaaaccacatatttactacggaagcttggaggagaaggagagagagcggctcgcgaagggggaatctggaatcctggggaaggatggactgaaggccgggatagaggcagggaatattaacatcacgagcggcgaggtgttcgagatagaggagcacatttctgaaagacaggcggaagttcttgccgagttcgaacgtaggaaacgcgcccgccagattaatgtgtctaccgatgactctgaggtgaaggcctgtttacgcgctctgggagaaccaatcaccctcttcggcgaaggaccagccgaacgccgcgagaggctccgcaacattctgagtgtcgttggcaccgatgcacttaagaagaccaagaaagacgacgaaaagagcaagaagtccaaagaggagtaccagcagacttggtatcacgagggaccgaacagcctcaaggtggccaggctgtggattgcaaattactcactgccgcgcgccatgaagcgcctggaggaagctagattgcataaggagatcccagaaaccaccaggacatcccaaatgcaagagttacataagtccctgcgcagcctcaataatttctgctcccaaataggagatgacaggcctatcagctactgccatttcagtccaaacagtaaaatgttggcgaccgcttgctggtcagggctctgtaaattgtggtccgtcccagattgcaacttattacacactctccgaggccacaacactaacgtgggggctatcgtgttccatcctaagtctacagtctctctggatcctaaagatgtgaacctggcctcgtgtgccgcggatgggagcgtgaagctctggtcgctagacagcgacgaacctgtggccgacatcgaaggccacacagtccgagttgcccgcgtaatgtggcaccctagcggaagattcctcggaaccacgtgttacgatcgttcctggagactgtgggacctggaagctcaggaggaaatcttacaccaggagggtcacagcatgggtgtgtacgacatcgcctttcaccaagatggtagtctggccggcaccgggggcctagacgctttcggacgagtgtgggacctgcgcactgggagatgcattatgttcctcgagggccatctaaaagagatctacggaattaatttctctcccaacgggtaccacattgcaacaggatctggcgataacacatgcaaggtgtgggatctgcgacagcggaggtgtgtttacactatacccgctcatcagaacctcgtgactggggtgaaatttgagcccatccacgggaacttcctgctgactggagcttacgataatactgctaagatctggacccatccaggatggagtcctctcaaaacattggccggacatgaaggcaaggtgatggggctggatattagtagcgacggccaactaattgccacctgtagctatgatcggacatttaagctgtggatggcggaatag

SEQ ID NO: 131202 - DNA, 1566 bp, Artificial Sequence
  Description of Artificial Sequence: Synthetic coding sequence
atggctagctctcgtgcgagctccacagctacaaaaactaaggcccccgacgaccttgttgctcccgtcgtgaaaaaaccacacatctattatggtagcctggaagagaaagagcgggaaaggctcgcgaagggagagtccgggattctgggtaaggacggtctgaaggctgggatcgaggccggtaatatcaatattacctccggtgaagtcttcgagatcgaggagcatataagcgagaggcaagcggaagttctcgctgagtttgaaaggcgtaagagggcgagacagatcaacgtctccaccgacgactccgaggttaaggcctgtctacgagcactgggcgagcctatcacactctttggagagggcccggccgagcgcagagagcgcctgcggaatatcctctcagtggtgggcactgacgccttaaagaagacaaagaaggatgatgaaaaaagcaagaaatctaaggaagagtatcagcaaacatggtaccatgaaggcccaaatagcctgaaagtcgcccgcctgtggatagcaaattatagcttgcctcgggctatgaagaggttagaagaggcgcgcctgcacaaggaaatccccgagacgacccggacgtcccagatgcaggaactgcacaagtccctgcggtccttgaacaacttctgtagccagatcggtgatgatagacccatttcgtactgccatttttcccccaattcaaagatgctggcaactgcctgctggagcgggctctgcaagttgtggtccgtcccagattgtaatctgttgcacacactgcggggccacaacaccaacgtgggtgctattgtgttccatcctaaatccacggtctctttagatccaaaggatgttaacttggcatcctgtgcggctgatggctcggtcaaactgtggagtctggatagtgatgaacctgtggccgatatagaagggcatacagttcgagtggctagggtgatgtggcacccctcaggtagattcctgggaactacgtgctacgaccgcagctggcgtctgtgggacctggaagcacaggaagagatcctccatcaagaagggcactcaatgggagtttatgacattgcatttcatcaagatggaagcttagctggaaccgggggcctggacgcatttggcagggtgtgggacctcaggacaggcagatgcatcatgtttcttgaaggacatttaaaagagatatacggaattaacttttctccgaacggctatcacatcgccacaggatcaggcgataacacttgtaaagtttgggacctgcgtcagcggcgctgcgtatacacgatcccagcacaccagaatctggtcacaggtgtcaagtttgagcccatacacgggaatttcttgttgacaggagcctacgataacaccgccaaaatttggacccacccgggctggagccctttgaaaaccctggcaggtcacgagggaaaggtgatgggcttagatatctcttctgacggacaattgatagcaacctgttcttacgatagaacctttaaactttggatggccgagtag

SEQ ID NO: 131203 - DNA, 3024 bp, Artificial Sequence
  Description of Artificial Sequence: Synthetic coding sequence
atggctgccgctgagacccaatccttgcgggagcagccagagatggaagacgcaaattccgagaaaagcataaacgaagaaaacggtgaggtgtccgaggatcagagtcagaacaagcacagtcggcataagaagaagaaacataagcaccggtccaagcataagaagcataagcacagttccgaggaagataaggataaaaaacataaacacaagcataagcacaagaaacataagagaaaggaaatcatagatgcctccgataaagaggggatgtcacctgctaaacgcactaagttggacgacctggcattgctggaggacctggagaaacaacgagctctgataaaggctgagctggataacgagcttatggagggaaaagtacaatctggaatgggcctcatcctgcagggctatgagagcggttctgaggaagagggggagatccacgagaaagcccgaaatgggaatagaagttccaccagaagttcatcaaccaaaggtaaactggagctcgttgacaacaaaatcactacgaagaaacgatctaaatctcgctctaaagaacgcacacggcatcgttcggacaagaagaaatcaaagggcggaatcgagattgtgaaagaaaagaccacaaggagtaaatctaaagagaggaagaagagtaagtctccttcaaaaaggtccaagagtcaggatcaagctaggaagtccaagagccctacgcttagacgaaggagccaggaaaagattggtaaggcgagaagtcccactgatgataaggtaaagatcgaggacaagtctaagagtaaagatagaaaaaagtccccaataattaatgaaagcaggtctcgagatcgggggaagaagtctcgatctcctgtggacttaaggggaaaaagtaaggatcgtaggtctcgcagcaaggagagaaagagcaagcggtccgagacggacaaagagaaaaaaccaatcaaatctcctagtaaggatgcatcatccgggaaagagaaccgcagcccgtctcgtcggcccggccgcagtcccaaacgacggtcactttcccccaagccccgggataaatcccggaggtctcgctccccccttttgaatgatcggaggagcaaacagtcaaaatctccctcccgtaccctcagtccaggcaggagggccaaaagtcgcagcctggagaggaagcggagagaaccagaacgcagaaggctcagctctccccggacaagacctagggatgacattttgagccggagagaaagaagcaaggacgcctcccccataaatcgatggtcccctaccaggagacggagcaggtccccgattaggagaaggtcaaggtctcctctccggagatctcggtctccccgacgcagatctcgaagtcctcgtagacgggacaggggcaggaggtccagaagccgtttgagaaggaggtctaggtcacgggggggacgccgccgtcgctctcggagcaaggtgaaggaggataagttcaaaggctccctatcagagggaatgaaggtggaacaggagagcagcagtgatgacaacctggaagatttcgatgtggaggaagaggatgaagaggccctcatcgagcagaggcggatacaaagacaggccatcgtccagaagtataaatatcttgcggaagactcgaatatgtccgtgccctccgaacctagtagccctcagagttccactcgcacacgctcaccctcgcctgatgatattctggagcgggtggccgctgacgttaaagagtacgagagagagaatgtggacacctttgaggcctcagtcaaagctaaacacaatctcatgaccgtagaacaaaataacggctcctctcaaaaaaagttgcttgctccagatatgtttacagaatccgatgacatgtttgcagcatatttcgattctgccaggcttcgcgctgcgggcataggtaaggacttcaaggaaaacccaaatttgagagacaattggactgatgcagaagggtactacagagtgaacattggcgaagtgttagataagagatacaatgtttacgggtatactggccagggtgtgttctccaacgtcgttagggcacgcgacaacgcaagggccaatcaggaggttgctgtcaaaataattaggaacaacgaactgatgcagaaaactggactaaaggagctggagttcttgaagaagttgaacgatgctgatccggatgacaagttccattgtctgcgcttatttcggcacttctaccataagcagcacctctgcctcgtgtttgagcccttgtccatgaatctgcgcgaagtgcttaaaaaatacggaaaggatgtcggactgcacatcaaggcggttcggagctacagccagcagttgtttctcgctctgaaactgcttaaacggtgcaatatccttcatgcagatattaaaccagataacatcctcgttaacgagtccaaaaccatcttgaaactgtgtgactttggttctgcatcccacgtggcggacaacgacatcacaccgtaccttgtttctagattttatcgggccccagagatcatcattggaaagtcatacgactacgggatcgacatgtggtccgttggctgcacgctgtacgaattgtacacaggcaaaatacttttccccggaaaaaccaacaaccacatgctgaaactagcaatggacttaaaagggaaaatgcctaataagatgatcaggaaaggggtattcaaagaccagcactttgaccagaatttgaactttatgtacattgaagtagataaagttaccgagagggagaaggtgactgtgatgagcacgatcaaccctacaaaggatctgctggccgatttaataggctgccaaagacttcctgaggatcagagaaagaaagttcaccagcttaaggacctactggatcagatcctcatgctggatcctgcaaagaggatctccatcaaccaggctttgcagcacgccttcattcaggaaaagatttag

SEQ ID NO: 131204 - DNA, 3024 bp, Artificial Sequence
  Description of Artificial Sequence: Synthetic coding sequence
atggccgccgcggagactcaaagtctgcgggagcagccagagatggaggacgctaattcagagaaaagtattaatgaagagaacggtgaagtgagcgaagatcagtctcaaaacaaacactcccgacacaaaaaaaagaagcataaacacaggagtaagcacaagaagcacaagcatagcagcgaggaagacaaggacaagaagcacaaacacaaacacaaacataagaagcacaagaggaaggagattatagatgccagcgacaaagaggggatgagtcctgcgaagcggaccaaactggatgacctggcgcttctggaagacttggagaagcagcgggctctaatcaaggcggagctcgacaacgagttgatggaaggtaaggtacagtctgggatggggctcattctgcagggctatgagtctgggagtgaagaggaaggcgagatacacgagaaggcaaggaacggcaaccgcagctctaccaggagttcctccacaaagggtaaactggaactcgtggataataaaattactaccaagaagcgatccaaatctagatccaaagagaggacccgccacagatctgacaagaaaaagtctaaaggcggcatcgaaatcgtgaaagagaagaccaccagatcaaaatctaaagaacgaaaaaaatcgaaaagcccttctaagaggagtaaatctcaggatcaggctcggaagtcgaagagccccacacttaggcggcggtcccaagagaagatcgggaaggcccgctcgcccactgatgacaaggtcaaaattgaggacaaatctaagtccaaggaccgcaaaaagagtcctatcataaacgagtcacggtcccgcgatagagggaagaaatcaagatctccagtggatctgcgcggcaagtctaaggaccggcgttcgcggtccaaggagaggaaatccaaacgttccgagacagataaggagaagaaacctatcaagtctcccagcaaggacgcctctagcggaaaagagaaccgctccccctcccggagacccggtcggtcacctaaaaggcgtagccttagtccgaagccaagggacaaaagccgcaggtctcgctccccactgttaaatgaccgtcgctcaaaacaatccaaatctccttcccgcactctcagcccaggcaggagagcgaaaagtaggtccctggagcgaaaacggagggaacctgagcggagacgtctgtctagcccaaggacgagaccaagggatgatatcctgtctcggcgcgagcggtccaaagatgcttctccgataaaccggtggtcgcctacacgccgcaggtcaagatctccaatacgccgtcgttccaggtctccactccggcggtcgcggtctccccgacgtcgctcacgatctccgaggcggcgtgacagaggtcgccgctctagaagtagacttagaaggcgcagtaggtctcgaggggggcgcaggcgccggtcaagaagcaaggtgaaagaggacaaatttaagggctccctgagcgagggaatgaaggtagagcaagaatcttccagcgacgacaacctggaagattttgacgtcgaggaagaggacgaagaggcactcatagagcaaagacgcattcagagacaagccattgtccagaagtataaatatctggccgaggacagtaacatgagtgttcctagcgaaccaagctcaccccaaagctcaactcgaacaaggagcccctctcctgatgacatactggagcgggtagctgcggacgtgaaggagtacgaacgtgagaacgtggacacttttgaagcctccgtgaaggccaagcacaacttaatgaccgtggaacagaacaacggatcttcacagaagaaattacttgcaccagatatgtttacagaaagcgatgacatgttcgccgcgtacttcgacagcgccaggctgagagctgcaggcattgggaaggacttcaaagaaaatccaaatctccgtgataactggacggatgccgaagggtactaccgcgtcaatattggggaagtgctcgacaaacggtacaatgtgtacgggtacactggccagggcgtttttagtaacgtggttagagctagggataacgcgcgggccaatcaggaggttgcagtgaagattattaggaacaacgaactgatgcagaagactgggcttaaagagctggagtttctcaagaagctcaatgatgctgatccggatgacaagttccactgcctgagactctttcggcacttttaccacaagcagcatctatgtttagtgttcgaacccctgtccatgaatctgagagaagtgctgaagaaatatggtaaggacgtgggtctgcacattaaggcagtccgtagctactcacagcagttattccttgcgcttaaactactgaagaggtgtaatatcctccacgctgatatcaagccagacaatatattagtcaacgaatcgaagactattttgaaactttgcgatttcggaagcgccagtcacgtggcagacaatgacatcaccccttacctggtcagcagattctatagagcgcctgaaatcattatcggcaagagctatgactatggaattgatatgtggtccgtgggttgtaccctctatgagctttacacaggcaaaatcctgttcccagggaaaacgaacaaccacatgctgaagttggcgatggatctgaaaggtaagatgcccaacaagatgataagaaaaggtgtgtttaaggaccagcattttgaccagaaccttaactttatgtacatagaagtggacaaagtgaccgaacgggagaaggtgacggttatgagcaccattaacccaacaaaagatcttttggccgatcttataggttgtcagcggttgccagaggaccaaagaaaaaaagtccatcagctgaaggacttattagatcagattctgatgcttgatccggcaaaacggatctccatcaaccaggcgctgcagcacgcatttatacaagaaaagatctag

SEQ ID NO: 131205 - DNA, 2982 bp, Artificial Sequence
  Description of Artificial Sequence: Synthetic coding sequence
atggaagacgcaaactccgagaagtccattaatgaagaaaatggcgaggtctccgaagatcaaagccagaataagcattctcgccacaagaagaaaaaacacaagcacagaagcaagcataaaaagcataaacacagttccgaggaggataaggacaaaaagcataaacataaacataaacataagaagcacaagcggaaggagattatagatgctagcgataaagagggaatgtctcccgcaaaacgcacaaagctggacgacctggctctgctggaggatcttgagaaacagcgcgctttaattaaggctgagctggacaacgagctgatggagggtaaggtgcagagcgggatgggtctcatcttgcaaggctacgaatcaggaagcgaagaggagggcgagattcacgaaaaggcacggaatgggaaccgcagttctacacgatctagctccaccaagggtaaactggaactggtggacaacaagatcacaacaaagaaaaggtctaaaagtcgaagtaaagaacgtactagacatcgaagcgataaaaagaagagtaaaggagggattgagattgtcaaagaaaaaaccactcgaagtaagtccaaggagaggaagaaatccaagtcaccttcgaagaggtcaaagagccaggaccaggctagaaaatctaaatctccgaccctccgccgtagatcacaggagaaaataggaaaagctcggtctcccaccgacgacaaagtgaagatcgaggacaaaagcaaatctaaagatcgcaaaaagtcacccattatcaacgagagccggtcaagggatagggggaagaagtcccgctctcctgttgatctccgcgggaaatccaaagatcgcagatcacgatctaaggagcgcaagtcaaagcgatcagagacagataaagaaaagaaacccataaagtctccttcgaaggacgcctccagtggcaaagaaaataggagtccatccaggcgccctgggagaagtcctaagcgtcgcagcctttcacccaaaccacgtgacaagagcaggcgatctagatctccgttgttaaacgatcgcagaagcaagcaatctaaatctccttccagaaccctcagccctggcaggcgggccaagagcaggtcacttgaaagaaagcgcagggaacctgagcggcgccgtctcagtagtccacgaacgcgccctagagacgacattctgtccaggcgagaacggtctaaagatgctagccctatcaataggtggtctcctactcgaaggagaagtcggagcccaataagacggagatcgagaagcccgctccggcggagtcgttctccaaggcggcgttctagaagcccccggagaagggacagagggagacggtcaagatctcgcttgcgtcggagaagcaggtcacgcgggggccggcggcgccgcagcaggagtaaggtcaaggaggacaaatttaagggttccctgtccgagggtatgaaggtagaacaggaatcctcctcagacgataatcttgaagactttgacgtcgaggaggaggacgaagaagcgctgattgagcaacgcaggatccaaagacaggcaatcgttcaaaagtataaatatctggccgaagacagcaatatgagcgtgcccagtgaaccctccagcccccagagctcaacacgcacaagaagcccttctcctgatgacatcctagagagggtagccgctgacgtaaaagaatacgagcgtgaaaatgtcgatacttttgaggcatcagtgaaggctaaacataatctaatgactgtcgagcagaacaatggatcctcccagaagaagctgctggctccagacatgtttaccgagagtgacgatatgttcgccgcctatttcgacagcgctagattgcgcgcagccggcatcggcaaagactttaaggagaaccccaatcttagggacaattggactgatgccgagggttattatcgcgtgaacattggggaggtcctggacaagagatataatgtctatggctatacggggcagggggtgtttagtaatgtggtgagagcgagagacaatgccagggccaaccaagaggttgcggtgaagatcattcggaacaacgagctaatgcaaaaaaccggtctcaaagagctggagtttctgaaaaagcttaatgatgccgaccctgacgataaattccactgtcttcgactgttccggcacttttaccataagcagcacctttgccttgtttttgagcctctgagtatgaatttgcgtgaggtcctgaaaaaatacggcaaggatgtgggacttcatataaaagctgttaggagctacagtcagcagctgttcctcgcactcaagctgcttaaacgctgcaatatcctgcacgcggatattaagcccgataacattctggtgaacgagagtaagaccattttgaagctttgcgattttggctcagcttcccatgtcgcggacaacgacattacaccctatctggtctcaaggttctacagagctccagagataatcatcgggaaaagctatgactacgggatcgatatgtggtccgttggctgtaccttgtacgaactgtacaccggcaagattctgttccccggcaaaactaataatcatatgttgaagttagcaatggatcttaagggtaagatgcctaacaagatgataagaaagggtgtgtttaaggatcagcacttcgaccaaaacctaaatttcatgtatatcgaggtggataaagtgaccgagcgcgaaaaggtcacagtgatgtccacaataaatcccaccaaagatcttttagcggacctcatcggatgtcaacggctgcccgaggaccaaagaaagaaagtccaccagcttaaagatcttttggatcaaattctcatgctggatcccgccaaacgcatctcaatcaatcaggctctacaacacgctttcatccaggagaagatttag

SEQ ID NO: 131206 - DNA, 2820 bp, Artificial Sequence
  Description of Artificial Sequence: Synthetic coding sequence
atgagacctgggaccggcgcagagagaggcgggctcatggtgtccgaaatggaatcccatccccctagccagggtccgggcgatggggaacgcaggctgtccggatcaagcctgtgcagtggcagttgggtcagcgctgacgggttcctgcgaagaagaccaagtatggggcatccgggcatgcactacgcccctatgggaatgcacccgatggggcagcgggcgaatatgccaccagttccgcatggcatgatgccccagatgatgccacccatgggcggcccacctatgggacagatgccagggatgatgtcttcagtgatgcctggaatgatgatgtcccacatgtcacaggccagtatgcaacccgcactcccccccggggtcaactccatggatgtggccgcaggcacatacactctttataagagcatgtggacagaacacaagtctccagacggaaggacatactactataacaccgagaccaagcagagtacctgggaaaagccggatgatctcaagacacccgctgagcagctgttatccaagtgcccatggaaagaatacaagtcagacagtggcaagccatactactataattcacaaacaaaagagagccgctgggctaaacccaaggagttggaagacctcgaagggaaaatgggaaagattaagtactctaagcaagaggagtgtaccacaacctcaactgcaccagtcccaaccaccgagatccctacaacaatgagcactatggctgcggccgaggccgctgccgctgttgttgctgcagcggccgctgccgcagccgccgctgcagccgcgaatgcgaacgcttctacatctgcatctaatacagtttccgggaccgtgccagtcgtgcccgagcctgaagtaacaagcatagttgcaactgtggtggataatgagaataccgtcactatatcgaccgaggagcaagcccagctgacctcaactccagctatccaggaccagtcagtggaggtgtcttctaatactggcgaggagacatccaagcaagaaaccgtggccgatttcacaccaaagaaagaggaggaggaatcacagcccgctaaaaaaacgtacacttggaatacaaaagaggaggcaaagcaggcgttcaaggagctgctcaaagagaaaagggtcccctccaatgcctcttgggaacaagccatgaagatgataatcaacgatccaaggtattcggcactggcaaagctttccgaaaagaagcaagcctttaatgcttacaaggtgcagaccgagaaggaggagaaagaagaagcccggtcgaagtacaaggaggcaaaagagagcttccagcgatttctcgagaaccatgaaaagatgacaagtacaactagatacaagaaagcggagcagatgttcggggaaatggaggtctggaatgccattagtgaaagagatcgcctggagatttacgaggacgtgctattcttcctcagcaaaaaggagaaagagcaggccaagcagctgaggaagcgtaactgggaggccttgaagaatattcttgataatatggctaacgtgacttatagtacaacttggtcggaagctcagcagtacctcatggacaatccaacttttgctgaggatgaggagctccagaatatggataaagaggacgcacttatttgctttgaggagcacattagggccctcgaaaaagaagaggaggaggagaagcagaaaagcctgcttagggaacggcggcgtcagcgaaagaaccgggaaagcttccaaatcttcctggatgagctgcacgagcatggacagttacactctatgagcagctggatggagttataccccactatttcctctgacattagattcacaaacatgctgggccagcccggatctaccgcgcttgatttgtttaaattttacgtagaagatctgaaggctaggtaccatgatgagaaaaaaatcatcaaggatattctgaaggataaggggttcgtggtggaggtgaatactacatttgaggatttcgtcgcaataatatctagtaccaagcgctcaacaacactcgatgcaggcaatataaagctggcatttaatagcctcctggagaaggcagaggcgcgcgaaagggaaagagaaaaagaggaggcaaggaagatgaagaggaaggaatccgcctttaaaagcatgctgaagcaagctgcaccgcccatcgagttggacgccgtgtgggaagacatcagggagcgctttgttaaagagcccgcctttgaggatatcacccttgaatcagaaaggaagcggattttcaaggattttatgcatgtgctggagcacgaatgccaacatcatcattccaagaacaaaaaacattcaaagaaatctaagaaacatcaccggaagcggtcaagatctcgtagcggttccgactccgacgacgacgacagccattcaaaaaaaaaaagacaaaggtccgagtcaagatcggcttcggagcatagttcatccgcagagtcagagcgttcatacaagaaaagcaaaaaacacaagaagaagtccaagaaaaggcgtcacaagtctgattcccccgaaagcgacgccgagcgcgagaaagataagaaggagaaagaccgtgagagcgagaaggatcgaacccgccaaaggtcagaaagtaaacacaaatctcctaagaaaaagacgggcaaagactcaggtaactgggatacatccggtagcgagttgagcgaaggtgagttagagaaaaggcgcagaaccctgttggagcagcttgacgacgatcaatag

SEQ ID NO: 131207 - DNA, 2451 bp, Artificial Sequence
  Description of Artificial Sequence: Synthetic coding sequence
atgtgtagtggctccgggcgccggagatccagtctctccccaaccatgcggcccggcactggcgccgaaagaggcggcctcatgatgggccaccctggcatgcattatgctcctatggggatgcacccaatgggacagagggctaacatgccaccggtgccacacggcatgatgccacagatgatgcctcccatggggggcccccccatggggcaaatgcccggaatgatgtcaagcgtcatgcctggcatgatgatgtctcacatgagtcaggcgtctatgcagccagcactccctcagttactttcaaagtgcccctggaaagaatataaatcagactcgggaaaaccatattattacaactctcagaccaaggaaagccgatgggcaaaaccgaaagaactggaagacctggagggataccaaaatactattgttgctggttcgttaatcacaaagtctaacctgcatggcatgctgactgaactgaagtattccaagcaggaggaatgtactactaccagtacagcccccgtgccaacaactgaaatccccaccacaatgtcgactatggccgccgccgaagcggccgccgctgtggtggctgcagccgctgccgcagcagccgcagcggcagctgccaatgccaacgcatccacttctgcaagcaacacagtctccgggactgtgcccgtggtgcccgagcctgaagttacctctatcgtggccaccgttgttgataacgagaatactgtcaccatttcaaccgaggagcaggcccagttgacatctactcctgccatccaggatcaatcagttgaggtgagcagtaacactggggaggaaacatcaaagcaagaaaccgtggccgactttacaccaaagaaagaagaggaagagagccagccggcaaaaaagacctatacctggaatacaaaagaggaggcaaagcaagcatttaaagagttgcttaaagaaaagagggtgccttctaacgcctcatgggagcaggccatgaagatgattattaatgatccccgctattccgccctcgcaaagctgagcgagaaaaagcaggcgttcaatgcttacaaggtacagactgagaaggaagagaaagaggaggctagatccaagtataaggaggcgaaagagtctttccaaagattccttgagaaccatgagaagatgacttccacgactcggtataagaaggcagagcagatgttcggggaaatggaagtctggaacgccatttcagaacgagatcgcctcgagatatatgaggatgttctgttctttctctccaaaaaggagaaggaacaagctaagcagttgaggaagcgaaactgggaagcactcaaaaacattctagataacatggcaaatgtgacatactctacaacttggagcgaggcccagcagtatctgatggacaatcccacttttgcagaggacgaagaactgcaaaacatggacaaggaggatgccctgatctgttttgaggagcatatacgtgcccttgaaaaagaagaagaggaggagaaacagaaatcccttctgcgcgaaagacggcgccaacggaagaaccgtgagtctttccagatctttctggacgaactccatgagcatggacagctccacagcatgtcttcttggatggaactttacccaaccatctcatcagatatccgttttacaaacatgctaggacagcctgtgtttagtcttggcagtacagccctggatctgttcaaattctatgttgaggatttgaaggctagatatcacgatgagaagaaaattattaaagatatccttaaagataagggattcgtggtcgaggtaaatactacctttgaggatttcgtggccatcatctcatccactaagcgcagtacaacactggacgctggtaacatcaagctggcctttaactcccttctggagaaggcggaggctagagagagggagagggaaaaagaagaggcccgaaaaatgaagagaaaagagagcgccttcaagagcatgctgaaacaggctgcccctccaattgaattggatgccgtatgggaggatattcgcgaacgcttcgtaaaggagccggccttcgaagacatcacattggagagtgaaagaaagcgaatattcaaggatttcatgcatgttctagagcacgagtgtcagcaccaccattccaagaacaagaaacacagcaagaaatctaaaaaacaccatagaaaaaggagcaggagccgcagcggctccgacagtgacgatgatgactcgcactctaaaaagaaaagacagcgctctgagagccggagcgcctctgagcattcatccagtgccgaaagtgagcgcagttacaaaaaatcaaagaagcataagaagaaaagcaagaaacggcgccataaatctgattcacctgagagcgacgcagaacgttag

SEQ ID NO: 131208 - DNA, 2793 bp, Artificial Sequence
  Description of Artificial Sequence: Synthetic coding sequence
atgtgctccggctcaggacgacgaaggtctagcttgtctcctaccatgcggcccggtaccggcgctgaacgcggaggcctgatgatgggccacccgggaatgcactacgccccaatgggcatgcatcccatgggccagcgcgcgaacatgccccccgtgcctcatggcatgatgccccagatgatgcccccaatgggtggaccccccatgggccagatgccaggtatgatgtcgagcgtgatgcctggtatgatgatgtcccacatgtcgcaggcctctatgcagccagcccttccacccggcgtcaacagtatggatgtggcagctggtactgcttctggggcgaagtcgatgtggacagagcataagtctccggatgggcgaacgtactactacaacacagagacgaagcaatccacctgggagaagccagatgatttgaaaacgcccgcagagcaactgctaagcaagtgcccctggaaggagtacaagtcagactcaggcaaaccttactactacaattcccagactaaagaaagcaggtgggcaaagccgaaagagctcgaagatcttgagggatatcagaacaccattgtggccggatcactcattactaaatcaaacctgcacgctatgatcaaagccgaagagtccagcaagcaggaggagtgcacaacaacctcaacagctccggtccctaccaccgagatacctaccacaatgtctaccatggcggctgcagaggcagcagcagccgtggtcgctgccgctgcagctgcagccgctgcagctgccgctgccaacgccaatgcatcaacttcagctagcaatactgtctccggaaccgtgcctgtggtgccagaaccggaagtcacctctatcgtcgctaccgtcgtagataacgagaacaccgtcacaatcagtactgaagagcaggcccagctaaccagcacacccgccatacaggatcaatctgtggaagtgtccagcaatacaggagaagaaacatccaaacaggagaccgtcgcagacttcactcctaaaaaagaggaggaggagtcacagccggccaagaagacgtacacttggaacaccaaggaggaggctaaacaggcctttaaggagctcctgaaggaaaagagggttccatcgaacgcttcctgggagcaggctatgaaaatgatcatcaatgacccgcggtattccgccctggccaagctgtccgagaagaaacaggcatttaacgcctataaggtgcagactgagaaggaagagaaagaggaggctcgctctaaatataaggaggccaaagagagttttcagaggttcctggagaatcacgagaagatgacctccactactcggtacaaaaaagcggaacagatgttcggcgagatggaggtttggaacgctatttctgagcgggatcgtctggagatctacgaggatgttctatttttcctaagcaaaaaggagaaggaacaggctaaacagcttagaaagagaaactgggaagctctgaaaaacatccttgacaatatggcaaatgtcacctacagcacaacatggagtgaggcacaacagtacttaatggacaaccccacctttgccgaggatgaagagcttcaaaacatggataaagaagatgcccttatatgttttgaggaacatatacgggctctagaaaaagaagaagaagaagagaagcagaaaagcctcttgagagagcggcgccggcagcggaaaaatcgcgagtcatttcagatctttttggatgaacttcacgagcatggacaacttcattcgatgtccagctggatggagctgtaccctaccatcagcagtgacatccggttcacaaacatgctgggtcaacccgggtccaccgcgctagatctcttcaagttttatgtcgaagacctaaaggcaaggtaccatgacgagaagaagatcatcaaggatatcttaaaagataaggggtttgtggtggaagtgaataccacgtttgaggacttcgttgctatcatctcgagtaccaaacgatcaactacattggatgcagggaacataaagcttgccttcaacagccttctggagaaagcggaggcccgtgagcgggagcgcgaaaaagaagaggccagaaagatgaaacggaaggaatctgctttcaaatctatgcttaagcaggccgctccacccattgaactcgacgcagtgtgggaggacataagagaaaggttcgtgaaggaacctgctttcgaggacattaccctggagtccgagagaaaaagaattttcaaagacttcatgcatgtcttggagcatgagtgtcagcatcaccactcaaagaataagaaacacagcaagaagagtaaaaagcaccacaggaagaggagccggtctagatcaggcagcgactccgacgatgatgacagccactcgaagaagaagcggcagcgaagtgaatcccggagtgcaagtgagcatagctcttccgcagaatctgagcgatcttacaagaaatcaaagaaacacaaaaaaaaaagtaaaaagagacggcacaagtcggacagccctgaaagcgacgcagagcgggagaaggataaaaaagagaaggaccgggaaagtgagaaggatcgcactaggcagaggtccgagagtaagcacaaatctcccaagaaaaagaccggcaaggactccggaaactgggatacatctggttccgagctaagtgaaggcgaactggagaagcgccgtagaaccctgttagagcagctagatgatgaccagtag

SEQ ID NO: 131209 - DNA, 2481 bp, Artificial Sequence
  Description of Artificial Sequence: Synthetic coding sequence
atggacgtcgccgccgggaccgcatccggcgccaaatcgatgtggacggagcacaagtcccctgatgggcggacttattactataatacagagaccaagcaaagcacctgggaaaagccggatgatctcaagacccccgccgaacagttgttgtcaaaatgtccgtggaaagagtataagtctgatagcgggaaaccatattactacaactctcaaactaaggagtcaaggtgggccaagccaaaagagcttgaagacctagagggctaccaaaatactattgtcgctggaagtctcatcacgaagagcaatctccatggaatgttgaccgagttgaagtactcaaagcaggaagaatgtacaacaacgagtaccgcccctgtgccgacgacagagatcccgactaccatgagcaccatggccgccgcagaggcagctgcagccgtggttgctgccgccgcagcggccgctgctgcggcagcagccgctaacgcaaatgccagtacgtctgcttctaacactgtaagtggtaccgtcccggtcgtcccagagcctgaagtgacgtccatagtggccacggtagtggacaatgaaaatactgtgactataagtaccgaggaacaggcccagctcacttctaccccagctattcaggaccagtccgtggaggtgtcgtctaacactggagaggagacttctaagcaagaaacggtggctgactttacccccaaaaaagaggaggaagagagccagcccgctaagaaaacttacacctggaacacaaaggaggaagctaagcaagcattcaaggaactattgaaggaaaaaagagtcccctccaatgcctcgtgggagcaagcaatgaagatgatcatcaacgatcccagatacagcgccctggcaaagctgagtgaaaaaaaacaggccttcaacgcttacaaggtgcagaccgaaaaagaggagaaggaggaggcaagaagcaagtataaggaggccaaggaatcatttcagcgttttttagagaatcacgaaaagatgacaagcaccaccagatataaaaaagccgaacagatgtttggagagatggaagtctggaatgctatctctgagcgggacagactcgaaatatatgaggatgtgctgttttttctatctaaaaaggagaaggaacaggctaaacagctgcgaaagcgcaactgggaggcactgaagaatattctagacaacatggccaacgtgacatattctactacttggagtgaagcccagcagtacctgatggataatcccaccttcgctgaagacgaggaactacaaaatatggacaaagaggatgccctgatatgtttcgaggagcatatcagagcccttgagaaggaggaggaggaagagaaacagaagagtttgctgcgcgagagacgacgacagagaaaaaaccgcgaaagcttccagatctttttggatgagctccacgaacacggacagctccattctatgagtagttggatggaactctaccctaccattagttcagatatccgctttaccaacatgcttggacaaccagggtctactgccctagacctgttcaagttctacgtcgaggatctgaaggcaaggtaccatgatgaaaagaagattataaaggacatcttaaaagacaaaggcttcgtggtcgaggttaatacaaccttcgaggactttgtggccatcatcagcagcaccaagagatctaccaccttggatgccgggaacatcaagctcgcatttaacagcctcctggaaaaggctgaagctagggagcgtgaacgcgagaaggaggaagctagaaagatgaagcgtaaagagtccgccttcaagtcaatgctgaagcaggctgccccaccaatcgaacttgatgctgtctgggaggatattcgggagagatttgttaaagagccggcgttcgaagacatcacacttgaatctgagagaaaacgcattttcaaagactttatgcatgttctagaacatgagtgccagcatcaccattctaagaacaaaaaacactccaagaagtccaagaaacaccaccgcaaacgtagccggagcaggagcggaagcgatagcgacgacgacgattcgcatagcaaaaaaaagcgccagcggtccgagagcagatccgcatccgagcactcaagctctgccgagtccgagcggagctataagaaatcaaaaaaacacaaaaaaaaaagcaaaaagcgcagacataagagcgactctccagagagcgacgccgaacgtgaaaaagataaaaaggagaaagatcgggagtccgagaaagaccgcacacgccagcgttctgaaagcaagcataagtcgcctaagaagaaaaccggaaaggattccggcaattgggatacttcaggctcagagctttccgagggcgagctggaaaagcgtaggcgaaccctgctcgagcagttggatgacgatcaatag

SEQ ID NO: 131210 - DNA, 1347 bp, Artificial Sequence
  Description of Artificial Sequence: Synthetic coding sequence
atgcgcccaggaacgggcgcagagcggggcggcttaatggtgtccgaaatggagtctcatccaccatcgcaagggccgggggatggggaacgccggttatccggcagctcactctgcagcgggtcatgggttagcgctgatggcttcctgcggagacgtccgagtatgggccatcccggtatgcactatgcacctatggggatgcatcccatggggcaaagggctaatatgcccccagtgccacatgggatgatgccgcagatgatgccccccatgggtggtcccccgatgggacaaatgccagggatgatgtcgtctgtcatgcccggaatgatgatgtcgcatatgagccaagcgtccatgcagcccgctttaccacccggggtaaacagtatggacgtggcagccggaacagcgagtggggcgaagtcaatgtggacagagcataaatcccctgacggtcggacatactactataacaccgagactaagcagtcaacttgggagaagccagacgatctcaaaacgccagcagagcaattgctgagtaaatgtccatggaaagagtataaaagtgattctggcaagccctactactacaattctcagacaaaagagagccgctgggctaaaccaaaagagctcgaagatctggaagggtaccaaaacaccatcgtcgctggatctttgataactaagtcaaaccttcatgccatgatcaaagccgaagagagtagcaagcaggaagagtgtaccacaacctcaacagctccagtacctacgactgagattcccacgacaatgtctacgatggcagctgcagaggcagcggccgccgttgtggccgctgctgccgccgcagccgcggccgctgcagcggctaacgccaatgcctccactagcgcctcgaacacagtgagcgggaccgtaccagtggtaccagaaccagaagtgacatctatagtcgctaccgtggttgacaatgagaacaccgttaccatctccacagaggagcaggcccagttaactagcaccccagcaatacaagatcaatctgttgaagtgtccagcaatacaggtgaagaaacatccaaacaagagaccgttgccgattttacacctaagaaggaagaggaggagtcccagccagccaagaagacatacacgtggaatactaaagaagaggcgaagcaggcttttaaggaactgctgaaagagaagcgcgtaccttcgaacgcctcttgggagcaggcgatgaagatgatcattaatgaccctcggtactctgcgttggccaaattatctgagaaaaagcaggcattcaatgcatacaaagtgcagacgtag

SEQ ID NO: 131211 - DNA, 2826 bp, Artificial Sequence
  Description of Artificial Sequence: Synthetic coding sequence
atgaataaaaaaaaaaaaccctttctaggaatgcctgctccgctagggtatgtgccaggacttgggagaggtgctacagggttcactacgagaagtgacattgggccagctcgagatgctaatgacccagtggacgaccggcacgccccccccggcaaacggaccgtcggtgaccagatgaaaaagaatcaagccgcagacgatgatgacgaagatctgaacgacacaaactacgatgaattcaacggatatgccggctccctcttctcaagcggaccttacgagaaggacgacgaggaggccgatgccatttatgccgccctcgataagagaatggacgaaaggcgcaaggagaggagagagcagagagaaaaggaagaaatagaaaaatacagaatggaaagaccaaagatccagcaacagttctccgaccttaaacgaaagctcgcggaggtgacagaggaggagtggttatcaatacccgaggtcggagacgcccgcaacaagaggcagcgcaacccccggtacgagaagctcactcccgtgcctgacagcttctttgcgaaacatctccagactggcgagaatcatacaagcgtggaccctcggcagacccagttcgggggactgaacacaccatacccaggaggactgaataccccctatcccggcgggatgacccctggattgatgacaccaggcacgggagaactcgatatgagaaagatcggccaggccagaaacaccttgatggatatgaggttaagccaagtatccgactcagtttccggccagaccgtggtggatccgaaaggatacctaaccgacttaaatagcatgatacccacacatggaggggacattaatgacataaagaaagcaagattgttacttaaatccgtccgagaaaccaacccccaccatcccccagcatggatagcctcagcacgcctggaggaagtgactgggaagctgcaggttgctcgaaacctcatcatgaaaggaacggagatgtgtcctaagagcgaggatgtgtggttggaagccgccaggctgcaaccaggggatactgccaaggctgttgtcgcccaggcagtgagacacctgccacagtctgtccgcatctacatccgtgcggctgagctggagactgacattcgagccaagaaaagagttctgagaaaggcgctagagcacgtgcccaattctgtacgtttatggaaagcggcggtggagctggaggagcccgaggacgcaagaatcatgctgtctagggccgtcgaatgctgccccacttccgttgagttgtggctggcccttgcccggctggagacttacgaaaatgcccggaaggtcctaaataaggcgagagaaaacattccaacagaccgccacatttggatcaccgcagccaaattggaggaggccaatgggaatacccagatggttgagaaaatcattgaccgagctattacatcattgagagctaacggagtcgagattaatagggaacagtggattcaggatgcagaagagtgcgatagggcaggttcagtagccacctgccaggccgtgatgagggctgtcatcggcattgggattgaagaggaagacaggaaacatacttggatggaggatgctgactcctgcgtcgcgcacaacgctctggaatgcgctcgggcaatatacgcctatgcgttgcaggtttttccttcaaaaaagagcgtatggctcagagcggcatactttgaaaagaatcacggcacgcgcgaaagcttagaggctctcctgcaacgcgctgtggcccactgtcctaaagcggaggttctctggttgatgggcgcgaaaagtaaatggcttgcaggggacgttccagcagcacggagtattctggcactcgccttccaggctaatcccaacagtgaggagatttggctcgcagccgttaaactggagagcgagaatgacgagtacgaacgggcccggcggctgttggctaaagcccgcagtagtgcaccaaccgctcgtgtgttcatgaaaagtgtcaagctggaatgggtgcaggacaacataagggccgctcaagatttatgtgaagaagccttgaggcactacgaagacttccccaagctctggatgatgaagggtcaaatcgaagagcaaaaagagatgatggagaaggcccgtgaggcttataatcagggtctcaaaaagtgcccacatagtacaccgctatggctgttgctatctaggctggaggagaaaattggacagttgacgcgggccagggcgatcttagagaaatcccgactgaagaaccctaagaaccctggtttgtggctcgagagtgttaggcttgagtatagagccgggcttaagaacatcgctaataccttgatggccaaagccctgcaggagtgccccaacagtggcatcctttggtcagaggcaatctttcttgaagcccgccctcagcgccgaaccaagtctgttgacgctttaaaaaaatgcgaacatgacccacacgtgttgctcgctgtggcgaagcttttttggagccaacgcaaaatcacgaaagctagggagtggttccataggacagtgaagattgactcagacctcggagatgcctgggcctttttctataaattcgagttgcagcacggtacagaggaacagcaagaggaggtgcgtaaacgatgtgaaagcgctgaaccgaggcacggagaactgtggtgcgccgtgtcaaaggacatagccaactggcaaaaaaagattggagacatcctgcgccttgtagcgggccgaatcaaaaataccttttag

SEQ ID NO: 131212 - DNA, 2706 bp, Artificial Sequence
  Description of Artificial Sequence: Synthetic coding sequence
atgaataaaaagaaaaaaccctttctcggcatgcctgctcccctcgggtatgtccctggccttggtaggggcgcaacggggttcactacccgatcagatattggccccgcaagagatgctaacgaccccgtcgatgacaggcatgcacctccaggtaagcgaaccgtaggagaccagatgaaaaagaaccaggccgccgacgatgatgatgaggatctcaatgacacaaactacgacgagtttaacggatatgcggggtcgctgtttagttccggcccttatgagaaagatgacgaagaagcagacgcgatctacgctgcactggataagcgtatggatgagcgccgcaaggagcgcagagagcaacgagagaaggaggaaatagagaagtaccgaatggagcgcccgaagatacaacagcagttcagcgacctgaaacgaaagctggcagaagtgaccgaagaggagtggctcagtattcccgaggtcggggatgcacgcaacaaacgacagcgcaaccctcgttacgagaaactaacacctgtgcccgattctttttttgccaagcacctacagactggggaaaaccacaccagtgttgaccctagacagacacaattcgggggcctcaatactccatatcctggggggctgaacactccttatcccgggggcatgactcctggactcatgactcctggcactggcgaacttgatatgcgtaaaataggccaagcacgcaatacactcatggacatgaggctgagtcaagtcagcgactccgtgtctggtcaaaccgtcgtggatccaaaaggatacctcacagaccttaacagcatgattccaacccacggaggcgacattaacgatattaaaaaggctagactgctcctgaaatccgtaagagagacaaacccccatcatccaccagcctggattgcatcagctcgactggaggaggtcacaggtaaactgcaagtggcccgaaacctgatcatgaaagggacagagatgtgccccaaatcggaagacgtgtggctcgaggccgcacggttacaaccaggcgatacggccaaggccgtagtggcccaagctgtccgacacctgccacagtcagtgagaatttatataagagcagctgagctagagacggatatccgagccaagaagcgggtcctccgtaaagcccttgagcacgttccaaattcagtgagactgtggaaggccgcggtggagctggaggaaccagaagatgcgcgcatcatgctgagcagagccgtcgagtgttgccctacatcagtcgaactgtggttagcactcgcaaggttggagacgtatgagaacgcgcgcaaggtcctcaataaagcccgggagaatattcccacagaccgacatatctggataacggcggccaaattggaggaggctaatggtaacacacagatggtagaaaagattattgaccgggcaattacatctctacgggccaacggggttgagattaatagggaacagtggattcaggatgccgaggagtgtgatagggcaggatccgtcgctacatgtcaagccgtgatgagagccgttatcgggattggcatagaagaggaggatcgcaaacatacttggatggaggacgcagattcatgtgtggctcacaatgccctggagtgtgcccgggccatctacgcctatgctctccaggtgttccctagtaagaaatcagtgtggctgcgggccgcctatttcgaaaagaaccacggaacaagggagtccctggaagcacttctccagagagctgtggcacactgccctaaggctgaagtgctctggctgatgggcgcgaagtcaaaatggctagccggcgatgttccggcagctaggtccatcctggcactggcttttcaggttttcatgaagtctgtgaaacttgagtgggtgcaagataatataagggctgcccaggacctttgtgaggaggccctgcggcattacgaggactttccaaagttgtggatgatgaagggacagatcgaagagcagaaagagatgatggaaaaggccagggaagcctacaaccagggactcaagaagtgtccacacagcacgcctctgtggctcctgctgagtagactggaggagaaaataggccagctgacccgcgccagggccatcttagagaagtcccgtctgaagaacccaaaaaaccctggcctgtggcttgaatccgtcagactcgagtaccgggctgggttgaaaaacatcgcaaatacattaatggctaaggccctgcaggaatgcccaaacagtgggatcctctggagcgaagcaatcttcctggaggcgcgtccacagcgtcggacgaagtctgttgatgcattaaaaaagtgtgagcacgacccacatgtactgctcgcagtggccaagctcttctggagccaacgtaaaataacaaaggcacgtgagtggttccacaggacagtaaaaatagatagcgatctgggtgacgcgtgggcctttttctataaatttgagctgcagcatggaacggaggaacagcaggaggaagtcagaaagcgttgcgagagcgcagagccgcggcatggtgagctctggtgtgctgtgtccaaagacatagcaaactggcagaagaaaatcggcgacatcctgaggctggtggctggacgcattaagaacactttctag

SEQ ID NO: 131213 - DNA, 7008 bp, Artificial Sequence
  Description of Artificial Sequence: Synthetic coding sequence
atggctggggtgttcccctatcgcggaccggggaacccggtgcctgggcccttagcccccctcccagactacatgagcgaagagaagctgcaagaaaaggcgcgcaagtggcaacagttacaggcaaagcggtacgctgaaaaaagaaagtttggcttcgtggacgcgcaaaaagaggatatgcctcctgagcacgttaggaaaattataagggaccatggcgacatgacaaacagaaagtttcggcatgataaacgcgtgtacctcggcgcccttaaatacatgccacacgcagtcttaaagctgctggagaacatgccgatgccatgggaacagatcagagacgtgccggtcctgtaccacattactggtgctataagtttcgtcaacgaaatcccgtgggtgatcgaaccagtatatattagccagtggggctccatgtggattatgatgcggagagagaaacgcgatcgccgtcacttcaaaaggatgcggtttccaccattcgacgacgaggagcctcctctcgattacgcggacaacatccttgacgttgagccattggaggctattcagctggaactcgatcccgaagaagatgcccctgttctcgattggttctatgatcaccagcctctgagggattcaagaaaatacgtgaatggctccacgtaccagcgatggcaattcaccctgcctatgatgtcgaccctgtacaggctagccaaccagctcctaactgatctcgtcgacgacaactatttttacttattcgacttgaaagcattctttacatcgaaggccctgaacatggccatacccggaggacccaaattcgagcccctcgtccgggatatcaacttacaggacgaagattggaatgaattcaatgacataaataaaatcatcatcagacaaccgattagaaccgaatacaagattgcctttccatatctgtacaataacctaccccaccacgtgcacctaacatggtaccacacccccaatgtggttttcattaaaaccgaggatcccgatctacctgccttttacttcgaccctctcatcaatcccattagccatcgccatagcgtaaagagtcaggagcccctgccagacgacgatgaggaatttgaacttcctgaattcgtggaacccttcctcaaagacacgcctctatataccgataacacggcaaatgggatcgctctactctgggctccaagaccttttaacctccgctccggtcgcacccggagagccctcgatatcccattggtgaaaaattggtaccgggagcactgtcctgctgggcaacctgttaaagtgcgcgtcagctaccaaaagctccttaagtattacgtgctcaacgcactcaagcaccgaccgccaaaagcccaaaaaaagaggtacctctttcggtcgtttaaagccacgaagttttttcaaagtacaaagctggactgggtggaggtgggcctgcaggtgtgcaggcagggctataacatgcttaatctactgatccacaggaagaatctcaactatctacatctcgactataatttcaaccttaagcctgtgaagaccctgaccaccaaagagaggaaaaaatctagattcggcaacgcattccatctgtgccgtgaagtcctccgtttgacaaaactggtggtggactcgcatgtgcagtatcggctgggcaacgttgacgcctttcaattagccgatgggctgcaatacatatttgcccacgtcggacagctaactgggatgtacaggtacaagtacaaactcatgcggcaaatcagaatgtgtaaagacctcaagcacttgatctactaccggtttaacacaggtcctgtcggtaagggcccaggatgcggattctgggcagctggctggcgggtatggctcttcttcatgaggggtatcactcctcttcttgagcgctggttaggcaacctgctggctcgacagttcgagggccgccacagcaaaggggtggcaaagacggtcacaaaacagcgcgtggaaagccatttcgatctggaacttcgcgccgccgtaatgcatgatattctcgatatgatgccagagggcattaagcagaacaaagcaaggaccatcctccagcatcttagcgaggcttggcggtgttggaaggcgaatattccttggaaagtccccggattgcccacccccattgagaatatgatcttgaggtacgtcaaggcaaaggccgattggtggaccaatacggcccattataaccgcgaacgcatccggaggggagctaccgtcgataaaaccgtttgcaaaaaaaacttaggccgcctgactcgcctgtacctgaaggccgagcaggagcgacaacacaattacctgaaagacgggccatacatcaccgccgaggaggctgtggccgtgtatacaacgacagtgcactggctggagtcccgcaggttctcccccatacctttcccgcctcttagctataagcatgacactaaactgctcatcctggccttggaacgactcaaagaggcctactccgtgaagtcaaggttgaaccaaagccaacgtgaggagttgggtttgatcgaacaagcgtacgacaaccctcatgaagccttgtcgcggattaagcggcacctgctcacacagcgcgcattcaaagaggttggcattgagttcatggatctctactcacatctggttcctgtctacgatgttgaacccctagaaaaaattaccgatgcgtatctggaccaatatctttggtatgaggctgacaaaaggagactattccccccatggatcaaaccagccgatactgagcccccaccactgcttgtttataaatggtgtcagggcatcaataatcttcaggatgtgtgggaaacaagtgagggagagtgtaatgtcatgctggaaagcagatttgagaaaatgtacgaaaagattgacctgactttactgaacagattgctccggctcatcgttgaccacaacattgccgattatatgaccgcaaagaacaacgtggtcataaactacaaggacatgaaccatacgaattcctatggcatcattcgaggcctgcaatttgcctcgttcatcgtccaatattatggacttgtgatggatttactggtccttggattgcaccgcgcctccgaaatggcaggcccgccccagatgcctaacgatttcttgtcgttccaggacatcgctactgaagcagcccacccaatcagactgttttgccggtatatcgatagaatccacatcttttttcgcttcacagctgatgaggcacgagatttaatccagcgatatctgactgagcatccagatcccaacaatgagaatatcgtgggctataacaacaagaagtgttggcctcgcgacgcgaggatgcgcttgatgaaacacgatgtcaacctgggtcgggcagtcttttgggatattaagaataggttacccaggtccgtgacaacagttcagtgggaaaattcctttgtctccgtatatagcaaggacaatcctaacctcctcttcaatatgtgcggctttgagtgtagaattctgccaaaatgccgcacctcttacgaagaattcactcacaaagacggcgtttggaatttgcagaacgaagtgacgaaagagcggaccgcccaatgttttctgcgcgtggatgacgagtccatgcagcggtttcataatagggttcggcagatactgatggcctccggctccactacattcactaaaatagtgaacaagtggaataccgccctgataggactcatgacatattttagagaagctgtggtcaatacacaggaattactcgatctgctggtcaaatgcgagaacaaaatacagacccgtataaagattggtttaaatagcaagatgccaagtcggttccctcccgttgtgttctataccccaaaggagctgggcggactggggatgctctcaatgggacacgtcctaatcccacagtccgatctcaggtggtccaaacagaccgatgtgggcatcactcactttcgcagcggcatgtcccacgaggaagaccagctgatccctaacctatataggtatatccagccctgggaaagcgagtttatcgactctcagagagtctgggctgagtatgctcttaagagacaggaggccatagcccaaaaccggaggcttacgctcgaagatttggaagactcttgggacaggggcatcccccgcataaacaccctcttccaaaaggataggcacactctggcatacgacaaggggtggagggtgcggacggatttcaaacagtaccaggtcctgaagcagaatccattttggtggacacatcagcgccacgacgggaagctctggaaccttaataattacaggactgacatgatccaggctctggggggggttgaaggcatactcgagcacactctcttcaaaggcacttattttcccacctgggagggcctcttttgggagaaagcttcaggcttcgaggaatccatgaagtggaagaagctcacaaatgcccagcgcagtgggctcaaccaaattcccaaccgacgatttacactttggtggagtcccaccatcaatcgcgccaacgtttatgtcggttttcaagtgcagctagatttaacagggatctttatgcacggcaagataccaacattgaaaattagccttattcaaatcttccgggcacacttgtggcaaaaaatacatgaatccatcgtcatggatctctgtcaggtgttcgaccaggagctggatgcattagaaatagaaactgttcagaaggagacaatacatcctcggaaaagctataaaatgaatagtagttgcgctgacatattgttgttcgcatcttacaaatggaacgttagccgcccctccttgcttgccgacagcaaggacgtgatggactcaactaccacccagaaatattggatagacatccagctaaggtggggggattacgatagccacgatatcgagagatatgccagggctaagttcctcgactacacgaccgataacatgtctatctacccatctccaacaggtgttctgatcgcaattgatctggcctacaacctgcacagcgcatacggcaattggttcccaggcagcaagcccctgatacagcaagccatggccaaaataatgaaggccaacccagctctgtatgtattgagagaaagaatccggaagggtttacagctatatagcagcgaaccgacagaaccatacttgtctagccagaattatggagaactcttctccaatcaaatcatttggtttgtcgacgacacaaacgtgtaccgggtgaccatccataaaactttcgaaggaaacctgactactaaacctattaacggcgcaatattcatcttcaatccaagaacaggccagttgtttctgaagattatacatacatcagtatgggcaggacagaaaagactgggacagctcgccaagtggaagaccgctgaggaggttgccgcactgatccgaagcctcccagtggaggagcaaccaaaacaaatcatcgtcacccgtaaaggaatgctggacccattggaagtgcatttgctggacttcccgaatattgtgataaagggatccgagctgcaactccccttccaggcttgcctgaaggtagaaaagttcggagacttgatcctgaaggccactgagccccagatggtactgttcaacctgtatgatgactggctgaaaacaattagctcatatacagctttcagccgattgattttaatcttacgtgcattgcatgtcaacaatgatcgcgcaaaagttattctcaagcccgacaaaactactatcacggagccccaccatatttggcccaccctgaccgacgaagagtggatcaaagtggaagtccaattaaaggacctgatactcgctgactacgggaaaaagaacaatgtgaacgttgcttcgctcacccagtcagagatcagagacatcatcctcggtatggaaatctccgctccttcccagcagaggcagcagatcgccgaaatcgaaaagcaaacaaaagagcagtctcagcttaccgctacccagactcgcaccgtgaataagcatggggatgagatcattacatcgaccacaagtaactacgagactcagacgttcagttccaagaccgaatggagggtgcgggcgatcagcgctgctaaccttcacctgagaacaaaccatatctacgtgtcctccgatgatatcaaggaaaccggctatacatacattttacctaaaaacgtcctcaagaagtttatatgtatcagcgacctgcgcgctcaaatagcaggttacttatatggggtctcgccacccgacaaccctcaagttaaagaaattcgatgcatagtcatggttccccagtggggaacccaccagacagtgcatctgccggggcagttgccacaacacgagtatttgaaggagatggagccgcttggttggattcacacccagccaaacgagtctccacagctctctccccaggacgtgaccacacatgctaaaattatggcagataatccatcttgggacggggagaaaactatcatcataacatgttcttttaccccagggagttgcacattgaccgcctacaaactcaccccatcaggttatgaatgggggaggcagaacactgataagggtaataatccaaaaggatacctaccttcacattacgaacgagtccagatgcttctgagcgatcggtttttgggattctttatggttcctgcccagtccagctggaactacaactttatgggagttcgccacgatccaaacatgaaatatgaactccaacttgctaatcctaaggagttttaccacgaggtgcatcggccatcccacttcttgaacttcgcactacttcaggagggcgaagtatacagcgcggatagggaggacctctacgcatag

SEQ ID NO: 131214 - DNA, 1392 bp, Artificial Sequence
  Description of Artificial Sequence: Synthetic coding sequence
atgattcaggcactaggcggtgtagaagggatcctggagcacacccttttcaagggaacctacttccctacttgggagggcctgttctgggaaaaagcatcagggtttgaggagtcaatgaaatggaaaaagctcactaacgcccagagaagcggcctaaaccagattcctaataggcgctttaccctgtggtggagcccaaccatcaatagggccaacgtttacgtcggctttcaggtgcagctcgatctgaccggaatcttcatgcacggaaaaattccaacactgaagatttcgctgatccagatctttcgggcgcacttatggcagaagatccacgaatcaattgttatggacctatgccaggttttcgaccaagagttagatgcactagaaatcgagaccgtccaaaaagagactatccaccccagaaagagttacaaaatgaattcttcttgcgcagatattctgctgttcgccagttacaagtggaacgtctcaagaccctctctcctggccgacagcaaagatgtcatggactccaccactactcaaaagtactggattgatatacagctgagatggggcgactacgattcgcacgatatcgaacgatacgctagagcgaaattcctggactacacaaccgataatatgtctatctacccttccccaaccggtgtgctgattgctatcgatctcgcatacaatctgcatagttactctgaggtaggctcgctgcagcaggcgagccatactacaggagcaaaaattatgaaagccaatccagccctgtatgtgctcagagaaaggatacgcaaaggcctgcaactatattcctcagagcccacagagccctatctgtcatcccagaactacggggaattattctctaaccagatcatttggtttgttgacgacacaaacgtataccgggtgaccattcataaaaccttcgagggaaatctgaccaccaaacctatcaacggcgccatcttcatttttaaccccagaaccgggcagctgttcctgaaaattattcacacatctgtctgggccggccagaaaagactcggacaactagcgaagtggaaaaccgctgaggaggtggctgccttgattcggagtctgcccgtggaggagcaaccaaagcagatcatagtgactagaaaaggcatgttggaccctcttgaagtgcaccttctggattttccaaatatcgtcatcaaggggtcagagttgcagctcccttttcaggcttgtctgaaagtcgagaagttcggcgacttgatactgaaggccacagaacctcagatggtgctgtttaatctgtatgacgactggctgaaaaccatctcctcatatactgccttttcgaggctaattctttag

SEQ ID NO: 131215 - DNA, 2727 bp, Artificial Sequence
  Description of Artificial Sequence: Synthetic coding sequence
atggcggacggaggtggcccgaaagacgcacctagcctccgctcatcccccgggcctgcccctcgtgtgcctcgtgctgtagggcctagtggtggtggaggagagactccacggaccgcagcacttgccctaaggttcgataagcccattaagcaagccttttacaatacaggggccgtgctcttcgtgtgcctgtgctgcggggcagccgttctggtatactttatcctggaagcctttctacggcctctcctttgggcagtcctgtgtggaaccttcctgcatccttttaaatcgtcgctgaccagactcggccgtcactggctgcagcgtctgcaccgggcgcatacaccgatcgtccttgctgccttgctcctccctctctgctttgtggactacggtgtagaggcgctcggggagcaggcgctgcgcaggcggaggctgttattacttctcggcgctggcggacccctcctgtatgggctgtattgcttgggtagttatctgggcgtgcaggtcttgctcgtccatgccgcaactctgatatgtaggggactggattatttctcttcgctctggatttggactctggttgtgggttatgtgctgaccgttagctttaagtggaacgcttcaacagagcggtacctgcgggctgtttctattcccgtgtggatcatactgctgttccatctggcttctctggctggcagctggaggattccagtgttcctggtgatcgttttcttaatgtccgtcggcacactgtacgaaaaacagaacggtaaggaaagctctggcgccgagctgcccggccaggtgatctccatggctgcatcgacactcgctaacttggcgatttctataactggctacgagtctagttctgaagaccagccctcaacccaacctgctgaagcagtcgatcggggagaaagcgcgccaacgctctcaaccagcccctctcctagtagcccctcacccacttcacctagtccaaccctcggcagacggcggcctgaaataggtacctttctcagaaagaagaagaccagcgatatctattttgtgagcctggtttgggccatagtggtaatgcagatttggcttaacctgtggatcgtccagctgctacctgtccccatcgcagtgtggatacttaaaaagctcgtcatccacttcggagtagtcgactttcttgaaaaaagatatcatgtctggtggggcatcatcgagtcattcttaaaggagcggcagggtgctttagcaccttggcctatcgttggactcggcaagttccttctgaaagttgattccaaactgtggcattggctcaacaagaaaatgataatctggctcgaaaagatgctggataaaattatctcaattttcattatatttcttctcgtgattggcacactgctgctagcccttctcctgacagcaaaggtccaccaagagagcgtacatatgatagaggtgacatcgaatctgattaacgaaacgttggccaaccatcctgagtgggcaaattggttacccgaagcacaggtcgtgcagcgcgctttaaatagcgccgccaacaacgtttatcaatatgggcgggagtggatcacacataaactgcacaagatcttaggcgacaaggtgaacaatactgcagtgatcgaaaagcaggtgttagagctgtgggacagactgtaccatagctggtttgtgaagaacgttacacattccgggagacataaaggtcaaaagctgcacgtgtcccggcagaacagctggcttggtgacattctcgattggcaggatatagtgagtttcgtgcatgagaatatagagaccttcctgagtattttggagagcctttggattgtcatgagtagaaatgtttccctgctgttcaccacggtcactacgttgcttaccatactgttctattccggtacagcgctcctgaattttgtcctcagtctcatcattttccttactaccctgttctatttgttgtcgtctagcgatgagtattacaagcccgtaaagtgggttattagcttgacgccgttgtcccagccagggccctcctcaaatattattgggcagtctgttgaagaagctattaggggagtgttcgacgccagcctgaagatggccggtttttacgggttatatacctggttaacccatacaatgttcgggattaatattgtttttatacctagcgcccttgcagccatactaggagctgttccattcctcggtacttattgggcagctgtccccgcagttctggacctgtggctgacacaggggctcgggtgcaaggccatcttgttactcattttccatttgctacctacttacttcgtggacactgccatctattcagatatatccgggggaggacatccttacttgaccggcctggcagtggcaggtggagcatactacttgggcctcgagggtgctattatagggcctattctgctgtgtatcctagtggtggcttctaatatatatagtgccatgctggtcagccccaccaactcagtgccaacccctaaccagacaccctggcctgcgcagcctcagagaacatttcgggacatcagccgctccgaaatattttctgtcgatgttgtgtctagcgcagttattttccgcaagttcaagttcgattccgaattctcctctgccgttgcattgtgcccttctagctgcgcatag

SEQ ID NO: 131216 - DNA, 1062 bp, Artificial Sequence
  Description of Artificial Sequence: Synthetic coding sequence
atgcttaaaagctgttctcgggcctcgttctctcccagcgtccgaaaaccacctcttattcttcggcgattgctgtctgaggatgtgggcatggatattccctttgaggagggagtcctgagcccaagtgccgcagatatgagaccagagcctcccaactcacttgacctgaatgacactcatccaagacgaatcaaacttaccgcccccaatatcaacctctccctggaccagagcgaggggtccattctgtccgacgacaacctcgattccccagacgagatcgatattaacgtggacgagctggatactcctgatgaggctgactccttcgaatacactgggcacgaagatcccaccgccaacaaagacagtggccaggagagcgagtctatccctgagtatactgccgaggaagagagggaagacaatcggctttggaggaccgtggttattggtgagcaggaacagaggatcgacatgaaagtgatcgaaccataccggagggtaattagccacggaggatactacggagatgggctcaacgccatcattgtgttcgctgcctgttttctacccgacagctctagagctgactatcactatgttatggagaacttattcctctacgtcattagtactctggaattgatggtcgcagaagactacatgatagtttatctcaacggggctacaccgcgcagacggatgcctggactcggctggatgaaaaaatgttaccagatgatagatcgcaggctgcgcaaaaatctcaaatccttcatcatagtgcacccgtcatggtttataaggacgattctggccgtaacaagacccttcatcagttccaagttcagttccaagattaagtacgtgaactctctctcagagctcagtgggctcatccctatggattgtatccatattccggaatctatcatcaagctcgacgaggaactgagagaagcaagcgaagccgccaaaacaagctgtctctacaacgaccctgagatgtccagtatggagaaggatatagacctgaaactgaaagagaagccgtag

SEQ ID NO: 131217 - DNA, 9267 bp, Artificial Sequence
  Description of Artificial Sequence: Synthetic coding sequence
atggaagagttcttgcaacgcgccaagagcaaactcaacaggtctaagcggttggaaaaggtgcatgtggtgatcggccctaagtcctgcgatctggacagtctgatcagcacatttacttatgcttatttcctagataaggtatcaccgcccggcgtgctttgcctgcctgtgcttaatatcccacgaactgagtttaattattttactgagacgaggtttatactggaagaactgaatatctccgaatccttccacatatttcgggacgagattaatctacaccagcttaacgatgagggcaagctgtccattaccttagtaggtagcagtgtgctggcttcagaagacaagaccttggagagcgccgtcgtgaaagttataaatccagtagagcagtctgacgcgaatgtggagttccgtgaatcttcctcaagccttgtcctgaaggagattctgcaggaggccccggaactaattactgagcagctcgctcaccgactaaggggctccatcctgtttaaatggatgacgatggagagcgaaaagatctccgagaagcaggaggaaattctctcaatactcgaagagaagtttccgaatttgcctcctcgagaggatatcatcaacgttctccaagagacacagttcagcgcgcagggactgtcgatcgagcagaccatgctgaaggatctgaaagaactaagtgacggagagatcaaggtagcgatttccactgtttctatgaatctggaaaattgtctgtttcactctaacatcacgtcggacctcaaggctttcaccgacaagtttggcttcgatgttctcattctgttctcctcttacctgagcgaggaacagcagcctcgccggcaaatagctgtttactccgagaatatggagctgtgtagccagatttgttgcgaattggaagagtgtcaaaatccttgtctggaattggaacctttcgattgtggctgcgacgagatcttggtataccaacaggaagacccaagcgtcacttgtgatcaggtagtactggtggtcaaagaggtgatcaaccgacgttgtcccgagatggtttccaattcacggactagctctaccgaagcagtggccggctctgctcccctgtcccagggctcgagtgggattatggaactgtatggctcagacattgagccccaacctagcagtgtgaattttatagagaacccgcctgatctaaacgactctaatcaggctcaggtggatgcgaatgtggatctcgtgtctccagactccgggctggctacgatccgatccagccgctcttcaaaggagtccagcgtgttcctgtccgatgattctccagtgggcgaaggtgctggacctcatcacactctgctgcccggcctcgattcttattctccaattcctgaaggcgccgtggccgaggaacacgcctggtcaggagaacacggtgagcattttgacttgtttaacttcgaccctgctcctatggcctcaggtcagtcacagcaatcttcccattccgccgactacagccccgccgacgatttcttcccaaatagcgatctgtccgaggggcaattacctgccggtccagaggggctggacgggatgggtacaaacatgagcaattacagttcgagttctctgctatcaggtgcaggcaaggattccctcgttgagcatgacgaggagtttgtacagagacaggactcacccagggataactctgaaagaaacttatccctaaccgatttcgtcggcgacgagtcaccaagcccagaacgcctgaagaacacggggaagaggatcccaccgacaccaatgaatagcctcgtggaatctagcccctctactgaagaacctgctagtttatacacagaggacatgacacagaaggcaaccgataccggccacatgggtccgccacagacacacgctaggtgttccagttggtggggtggattggaaatcgactcaaagaatattgccgatgcctggtcaagtagtgagcaggaatccgtattccaaagcccagaatcgtggaaggaacacaagccctccagtattgataggagggcctctgacagcgtattccagccaaaatctttggaatttactaaatcaggtccatgggagagcgagtttggacagcctgaattaggaagcaatgacatccaggacaaaaacgaagaatccctgcctttccagaaccttcccatggagaagagcccacttcctaatacttctcctcaagggacaaatcacctaattgaagactttgctagcctttggcacagcgggaggagcccaaccgctatgcctgagccgtggggaaacccaacggacgatggagagcccgctgccgttgccccattccccgcatggtctgccttcggaaaggaggaccacgatgaggcactgaagaacacatggaacttgcaccccacctcaagtaagaccccttccgtgcgagaccctaatgaatgggccatggccaagagcgggtttgccttttcctcctccgagctgctcgataactctcctagcgagatcaacaatgaggctgctcccgaaatttggggcaagaaaaacaacgactcaagggaccacatattcgccccaggaaatccttcttcggacttggaccacacatggaccaactccaagcctcccaaggaggatcagaacgggttggttgaccccaagacaagagggaaagtgtatgaaaaggttgatagctggaatctttttgaggaaaatatgaagaaaggaggctcggacgtcctggtgccctgggaggacagctttctgtcttataaatgctcagactacagtgccagcaatctgggagaggactctgtgccgtctcccctggatactaactactctactagcgatagctacacttcacctacttttgccggcgacgagaaggagaccgaacataagcccttcgctaaagaagaaggtttcgagagcaaagacgggaattctaccgccgaggagactgacatcccaccacagagtctccagcagtcctctagaaacaggatcagcagcggtcctggcaatctcgacatgtgggccagtccccacactgataactccagtgagattaacaccacccacaacctggacgagaacgagctcaaaacagagcacacggacggcaaaaatatctcgatggaggatgacgtgggggagtctagccagtcctcttacgatgatccatctatgatgcagctttacaatgagactaacagacagttgacgttgctgcactcatctacaaatagcagacaaaccgcgcccgactcacttgatctgtggaatagggtgattctggaggatacacagtcaacagcaaccatcagcgacatggacaacgacttggactgggatgattgtagcggcggtgctgccatcccttccgacggccagactgagggctacatggcagagggctccgaaccagagacgagattcactgtgcgccagctcgaaccatggggattagagtaccaagaagcgaatcaggtcgattgggagctccctgcctcagatgagcacacaaaggattcggccccaagcgagcaccataccctcaacgaaaagtccggacagctgatcgctaacagtatctgggactccgttatgagagacaaggatatgtcatcctttatgctgcctggctcttcccacattactgattccgagcagcgagaattaccccctgagatcccgagccacagtgcaaacgtgaaagatacccactccccggacgctccagcagcatcggggacctcagagagtgaagcactgatctcccacctcgataaacaagatactgagagggagactttgcagtccgacgcagcatccctggccacacgcctggaaaatcctggttatttcccacaccctgacccttggaagggacacggcgacggccagagcgagtctgaaaaggaggcacagggagccaccgaccggggtcatctcgatgaggaggaggtcatcgcctccggggtggaaaatgcctcaggcatttccgagaagggccaatctgaccaggagctaagttctttagtcgctagtgaacaccaggagatctgcattaaatccggtaagatttcctcattagcggtgacgttcagtcctcagaccgaggagccggaggaggtactggagtatgaggagggctcatataatttagactcgcgggatgtgcagacaggcatgagcgccgacaatctacagccaaaggatacacacgagaagcacttgatgagtcagaggaattcgggcgagaccaccgagaccagcgacggaatgaatttcaccaagtatgtcagtgtccccgagaaagacctggagaaaacagaagagtgtaactttctggaacccgagaacgtgggcgggggccccccacaccgggtgccacgttcattagactttggagacgttcctatagattccgacgtgcacgtgtcctccacctgcagtgagatcacaaagaaccttgatgtgaaaggaagcgaaaacagtctaccaggggccggatcaagtgggaactttgaccgagacacgatctctagtgaatatacacactcttctgcctcatcccctgagttgaatgatagttctgtggccttatccagctggggccaacagcccagtagcggataccaagaagaaaaccagggtaactggtccgagcaaaaccatcaggagtccgaactgatcaccaccgatggacaggtggagatagtgaccaaggttaaggacttggagaagaatcgcattaatgagttcgaaaaaagcttcgatcgtaagaccccgacattcttagagatttggaatgattccgtcgacggggatagctttagttctctatctagtcctgaaaccgggaagtatagtgagcattcgggcacccaccaggagtccaatctcatcgcatcttatcaggagaaaaatgaacacgatatctcagctactgtacagcccgaggatgcaagagtgatatctacatcctccggatccgacgatgacagcgtcggaggggaggagagtatcgaagaagagatacaggtggccaactgtcacgttgccgaggatgaatccagggcatgggacagtctaaacgaaagtaacaaattcctggtgaccgccgacccaaaaagtgaaaatatttatgactacctcgacagtagcgagccagcggaaaacgaaaataagtcaaacccattctgtgataatcagcagtcatcccctgacccatggacatttagtcctctgacggaaaccgaaatgcaaatcaccgctgtagagaaagaaaaaagatcctcaccagagacaggtacgacaggcgacgtagcatggcagatctcacccaaggcgtcatttccaaaaaatgaggacaattctcagctcgagatgctcggtttctctgcagatagtacagaatggtggaaggcttccccacaggaagggcgcctcatcgagagccctttcgagcgggagttgagtgacagtagtggcgtgctcgagatcaactcctccgtgcaccagaatgcatccccctggggcgtacccgtgcagggtgacatcgaaccggtcgaaactcactataccaaccctttcagcgacaaccatcagtccccttttttagaaggcaacggaaaaaacagtcatgaacagctgtggaacatccagccgcggcagcccgacccggatgccgataagtttagccagctcgtgaaactagaccagattaaggagaaggactctagagaacagacctttgtgtccgctgcgggcgacgagctgactcctgaaacccccacgcaagaacagtgccaggatactatgctgccagtgtgcgatcaccccgacacagcattcactcacgcagaagagaattcctgcgtcaccagcaacgtgtcaactaatgagggacaggaaacaaaccagtgggagcaagagaagtcctatctgggggaaatgacgaacagtagcatcgccacagaaaattttcctgcagtatcgagccccacccagttaataatgaaaccaggcagcgagtgggacggcagtaccccatcagaggattccagagggacttttgttcccgacattctccacgggaattttcaggaagggggacagctggcctccgctgcacccgacctgtggatcgacgcgaagaaacccttcagcctcaaagctgatggagagaatcccgatattctcacccattgtgagcacgacagcaacagtcaggccagcgactcacctgacatttgccatgattccgaagccaaacaggagacagaaaagcatttaagcgcatgcatggggccagaggtcgagtcatcagaactgtgcctgacagaacctgagatcgatgaagaacctatctacgagccgggacgagagtttgtgccatcaaacgccgaacttgactctgagaatgctacagtcttaccccccattggttaccaggcggatattaaagggagctctcaaccagcatcccacaagggttccccggaaccttccgagatcaatggagacaatagcactggtctccaggtaagtgaaaagggagctagtcccgatatggcacccatccttgaaccagtcgatcgcagaattccccggatcgagaatgtcgccacctccatttttgtcactcatcaggaacctacccctgagggggatggaagctggatcagcgacagcttctctccagaatcccagcccggagctagagctttgttcgacggagacccacatttatcgactgagaacccagcactggtgccagatgcactgctggctagtgacacatgcctagacatcagcgaggcagcgttcgaccatagttttagcgacgcctctggtcttaacacatctacagggaccattgacgatatgagcaagctgactcttagcgagggacaccctgaaaccccagtggacggcgacctcggaaagcaggacatttgtagcagcgaggctagctggggagatttcgaatatgacgtgatgggacaaaatatcgatgaagacctgctcagggaacccgagcattttttgtatgggggggatccgcctttggaagaggattccctcaaacagagcctggccccctacactcctcccttcgatctgagctacttaacggagcccgcgcagagtgccgagactatcgaagaagctggatctcctgaagatgagtctctgggctgtagggccgctgaaattgtactgagtgcattgccagatcggaggtctgagggcaaccaggcagaaacaaagaaccggctccccggttctcaacttgccgtccttcacatccgggaagaccccgagtccgtttatcttccagtcggggcgggtagcaacattctgagcccatctaacgtggattgggaagtcgagacggataacagtgacttacctgcagggggggacattggaccaccgaatggagcgtcaaaggaaatctctgaactggaggaggagaagaccattcccaccaaagaaccagagcagataaagtccgagtataaagaagaacgatgtacagagaaaaacgaggatcgccatgccctgcatatggattatatccttgtgaatcgagaggagaactcccattccaagcccgaaacctgtgaagagcgcgaaagcatcgcagaacttgagctgtacgttgggtctaaggaaactggactgcagggcacgcagctggccagctttcccgatacatgtcaacctgcctcactgaacgagagaaagggcctcagtgcagagaagatgtcttctaaaagcgacaccagatccagtttcgagtcccccgctcaagaccagtcgtggatgtttcttggccattccgaggtcggagatcctagcctagatgcacgagattccggcccaggctggtccggtaagaccgtggaaccattttctgagctcggtttgggagaaggcccacaactacagatactcgaggagatgaaacctctggaaagcctcgctcttgaagaagcttcgggtccagtcagtcagtcccaaaagtccaaaagcagagggcgcgctggccctgatgctgtgacccttcaggcggtgacacacgataatgaatgggagatgctgagccctcagcctgtgcagaagaatatgatccctgatacagagatggaggaggaaaccgagtttcttgagctgggaacgcgtatcagtagaccaaacggattactcagcgaggatgtgggaatggacattccatttgaggagggggtgctttctccaagcgctgccgacatgaggccagaacctcctaactctttggacctgaacgacacacacccaagaagaattaagctcaccgccccaaatatcaacttgagcctagaccagtcagagggatcgatcctttcagatgacaatttagatagtcctgatgaaatagatatcaacgtggacgagctggatacccccgacgaggccgactcattcgaatacacaggacatgatcctactgcaaacaaggactcggggcaggagtccgaatctatcccagaatataccgccgaagaggaacgcgaagacaataggctatggcgcacggttgtcattggcgagcaggaacagcgaatcgatatgaaggttatcgagccataccgtcgggtgatctcacacggcggctactatggagatggtctgaacgctatcattgtgttcgcggcttgctttttacctgacagctccagagctgactaccattatgtgatggaaaacctctttctttatgtcatcagtaccttagagcttatggtggccgaggactatatgattgtgtacctgaatggggcgaccccccgccggagaatgccaggcctcggatggatgaagaaatgctaccagatgatcgatcgaaggttacgcaaaaacctcaagagcttcatcattgttcacccatcgtggttcattagaaccatcctggccgtcactcgaccctttatctcctccaaatttagttccaaaatcaagtacgtgaatagcctgtccgagttatcgggactgatcccgatggactgtatacacattcctgagagtataatcaaactggatgaggaactcagggaggcttcagaggccgccaagaccagttgtctatataacgatcctgaaatgagcagcatggagaaagacatcgatctgaagctcaaagaaaagccatag

SEQ ID NO: 131218 - DNA, 9165 bp, Artificial Sequence
  Description of Artificial Sequence: Synthetic coding sequence
cgtaacttgatgcacagaatgaaggagagcgagaatcgcagcaagcgcctggagaaagtgcatgtcgttatcggaccaaaatcttgtgacctggattctctgatctcaacatttacgtacgcatacttcctcgacaaagtctccccaccgggagtgctttgcctgcccgtcctcaacattcccaggaccgagttcaactacttcacagagactcgatttattttggaggagcttaacatatccgaaagctttcacattttcagggacgaaattaacctgcaccagctgaacgatgaggggaagctttctataaccctggtcggatcatctgtcctggcaagtgaagacaaaactcttgaatcggcagtggtgaaggtgataaacccagtggaacagtcagacgccaacgttgagttcagagagagtagctctagtttagtgctaaaggagattctccaggaagctcccgagctcattacagaacaactggcacaccggcttcgtggcagcatcctttttaagtggatgacaatggagtccgaaaaaattagcgaaaagcaggaagagatcttaagcattctggaggaaaaattccccaacctccccccccgagaagatattatcaatgtcctgcaggaaacacagtttagcgcacagggactgtctatcgagcaaacgatgctgaaggacttgaaggagctcagtgacggcgaaatcaaagtggcgattagcacagtgtcaatgaacctggagaactgcctgttccactcaaatataacctctgatctgaaagcattcaccgacaagtttggcttcgacgttttgatcctcttcagtagttatctgagcgaggaacagcagccacgtcggcagatagctgtctattctgagaatatggaactatgttcgcagatttgctgtgaactggaagaatgtcaaaatccgtgtctggagttggagccttttgactgtggctgtgacgagatactggtatatcaacaggaagacccttcggtgacttgtgatcaagtggtgctggtggtgaaggaggtcattaaccgccggtgtccagaaatggtcagcaactcacgcactagctccactgaagcggtggctggcagtgcaccccttagccagggaagctccggaatcatggaactctacgggtcggacatcgaacctcagccaagcagcgtcaacttcattgaaaatccgccagacctgaacgactcaaaccaggctcaagtcgacgcaaacgtggatttggtgtccccggactcaggccttgctaccattaggtcttctcggtcttctaaggagtcttccgttttcctgagtgatgatagccctgtgggggagggagcaggcccacaccacacactgctgccgggcttggattcttatagtcccatacctgaaggcgccgtcgcggaggaacacgcctggtccggcgaacatggagagcacttcgatctgttcaatttcgaccccgcaccaatggctagcgggcaatcccaacaatctagccatagtgccgactattctccagccgacgacttcttccccaattccgacttaagcgaggggcaactacccgctggccccgaaggattagatggaatgggaaccaacatgagcaactattcatcttcttcactcctctctggtgccggcaaggactctctagtagagcatgatgaagagttcgtccaacgccaagattcaccaagagacaatagtgaaagaaatctgagcctaaccgactttgtgggcgacgaatcaccatccccagaaaggcttaagaacacgggcaagcgaatacctccaacacccatgaactctctggtagaatcctccccctcaaccgaagaacccgcgtccctgtacactgaagatatgacacagaaagccacagatactggccatatggggcccccacagacacatgctcgctgttccagctggtgggggggcttggagattgacagcaagaacatcgcggatgcttggtcgtcaagcgaacaggaaagtgttttccagtcccctgaaagctggaaagaacataagccatcttccattgacagaagagcctccgattcagtctttcagcccaaatcactcgaattcaccaaaagcggcccgtgggagagtgaatttggacaaccggagctgggcagcaatgatattcaagacaagaatgaagaaagtctgcctttccagaatcttcctatggagaagtcccctttaccaaataccagcccgcagggaactaaccacctaatcgaagatttcgcatctctgtggcattcaggtagaagcccaacagccatgcccgaaccatggggaaacccgacagatgacggggagcctgccgccgtcgcgccgtttccagcctggtccgcatttggtaaggaggatcacgacgaggctctcaagaatacgtggaatctccaccccacatcttctaaaaccccctcagtccgagacccgaacgagtgggccatggcaaagtccggtttcgccttcagcagtagcgaactgctggacaattcaccgagtgagattaataatgaggcggcgccagagatttggggaaagaaaaataatgatagtcgcgatcatatatttgcccctggaaaccctagcagcgacctggaccatacatggaccaactccaagccccccaaagaggaccaaaacggacttgtggatccgaagactagagggaaagtgtacgaaaaggtcgactcttggaacctgtttgaggagaatatgaaaaaaggcggttcagatgtgctggtgccatgggaagactcattcctgtcttacaagtgctcggactactctgccagtaacctgggggaggactccgtaccttctccgctggatacgaattattcaacatccgattcgtatacatcccccacatttgctggtgacgaaaaagagacagagcataagccgtttgcaaaagaagaaggattcgagtccaaagatggcaacagtacagcagaggaaacagatatccccccacagtcactgcagcagtcctccagaaataggatctcttcaggtcccggaaatctcgatatgtgggcgagtccccataccgacaactcatcagaaatcaacacaacccacaatctcgacgaaaatgagttaaagaccgaacataccgatggaaagaatataagcatggaagatgatgtaggggagtctagccaatcatcgtatgatgatcccagcatgatgcagttgtataatgagaccaaccgccaactgacacttctgcactcttccactaattctagacagaccgccccagatagtctggatctgtggaaccgagtgatcttggaggatacccagtcgaccgctacaataagcgatatggacaatgatcttgattgggacgactgctctggaggagcagcaatcccttccgacgggcaaacagaaggctacatggccgaaggatctgaacctgagaccaggttcactgttcggcaattagaaccgtggggcctggagtatcaagaggcgaatcaggtggattgggaactcccagcgtccgatgagcacactaaggatagtgccccctccgaacaccacaccttgaatgaaaaatcaggacagttgatcgcaaacagcatctgggatagcgttatgagagacaaggacatgagtagcttcatgctccccggctccagccacattaccgactctgaacagagagagctgccgcccgagataccgagccacagtgccaatgttaaggacacacacagcccggatgctcccgcagccagcggcacttcagagtccgaggctttgatctctcatctcgacaagcaagacacagaaagagagaccttgcagtcagacgccgcttccttggcaactcgactggaaaaccccgggtacttcccccatcccgatccttggaagggccacggtgatggccaatccgaaagcgaaaaagaggcccagggagccacagataggggacatctggacgaggaagaagtgatcgcttctggcgtagaaaacgcatctggaatctccgaaaaggggcagagcgaccaggagctgtcttccctcgttgcctcagagcatcaagaaatctgtatcaaatcaggaaaaatttcctctctggctgtcacattctcccctcagactgaagagccggaagaggtattagagtacgaagaggggtcatacaaccttgacagtagggacgtccagaccgggatgtctgcggacaatctgcagccaaaggacacacacgagaaacatctcatgtcgcagcgtaactctggagaaactactgaaacttcagatggaatgaacttcaccaaatatgtctccgtgccagagaaggatcttgaaaagactgaagagtgcaattttctcgaaccagagaatgtcggtggcggtccaccgcacagggtgcccaggagtctggactttggggacgtgccaatagactccgacgttcacgtgtccagtacctgcagcgagatcactaaaaacctagacgtgaaaggttccgagaattcccttcctggggctggctccagtggtaatttcgatcgagacacaatcagttcggagtacacacattcctcagccagttccccagaattaaatgattcctccgtggcccttagctcctgggggcagcagccttcatcaggctatcaggaggagaatcaggggaattggagcgaacagaaccaccaggagtctgagttaataacaaccgatggccaggttgagatcgtgacaaaggtaaaggacctggaaaagaaccgaatcaatgagtttgaaaagagcttcgatcggaagacccctaccttcctcgaaatctggaacgattcagttgatggcgactcattctcttccctttcttctccagagacaggaaaatactccgaacatagcgggacccatcaggagagtaatctcattgcctcttatcaggagaagaatgagcacgatatcagtgccaccgttcagccagaagacgcccgagtcatcagtacaagctcgggcagcgacgacgactccgtgggcggcgaggagtccatcgaggaagagattcaggtagccaactgccacgtggccgaggatgagtctagagcgtgggacagcttgaacgagagcaacaaatttctggttaccgcggatcctaaaagcgaaaacatttacgattatctagacagcagcgagcctgccgagaatgagaataagtctaatccattttgtgataatcagcagtcaagccccgatccctggactttctccccccttaccgagacagagatgcaaatcactgcggttgagaaagagaagcgttcctctcctgaaactggcaccaccggggatgtggcctggcagatcagtccaaaggctagtttccccaaaaatgaggataactcccagctagagatgctgggattcagcgccgattctacggaatggtggaaggcctcccctcaggaaggtcggttaattgaaagccccttcgaaagagagctgtcagatagcagcggggttctagagattaactcctctgtgcatcagaacgcctccccgtggggggttcctgtgcagggcgacattgaaccggtggaaactcattatactaaccctttttccgataatcaccaatctccttttctggaagggaacggcaagaatagccacgagcagctgtggaacatccagcccagacagcctgaccccgacgcagacaagttctcccaactcgtgaagctggaccagattaaggagaaagacagccgggagcaaacattcgtcagcgcggccggggatgaattaaccccagaaactcccacacaggagcagtgccaagacacaatgctgccagtctgcgaccatccagatacagcttttactcatgctgaggagaattcgtgcgttacatccaacgtgagcacaaacgaaggccaggagacaaatcaatgggaacaagagaaaagctacctcggggaaatgaccaactcctctattgcaactgaaaatttccccgcggtgtccagccccacccaacttataatgaagcctggatcagaatgggatggcagcacacctagtgaagacagcagggggaccttcgttccggatatactccacggaaatttccaggagggcggacaactcgcaagtgctgcccccgacctctggatcgacgcgaagaagccttttagcctcaaggctgacggagagaaccctgatatactgacacactgtgaacatgattctaactcgcaggcctctgattcccctgacatctgtcacgacagcgaagccaagcaggaaacagagaaacacctgtcagcatgcatggggccagaagtggagagcagcgagctgtgtttaaccgagccagaaattgatgaagaacctatctacgagcccggccgggaattcgtccccagcaacgcggagctcgacagcgagaacgctaccgtcctcccccccattggataccaagcggatatcaagggatcaagccagcctgccagccacaaaggaagcccagagccttctgagattaatggcgataattcaactggcttgcaggtgtccgagaagggtgcctcccccgatatggcccccattctcgagccagtggataggcggatcccccggattgaaaatgtggcgacatcaatattcgtgacacatcaggagccaacccccgaaggcgatgggagttggatctctgatagcttcagtccagagtcccaacctggcgcacgggccctgtttgacggggatccacacctgagcaccgagaaccctgccttggttcctgacgctctccttgcctccgacacttgcctcgatatctctgaagctgcttttgaccacagtttttccgatgccagcggtctgaacacttcaaccggcacaattgacgacatgtctaagttaacgctgtcagaaggacaccctgagacacccgtcgatggagacctgggtaaacaggacatctgtagctctgaagcatcctggggggacttcgaatacgacgtgatgggccaaaacatcgacgaggatctcctccgggagcccgagcattttctatacggcggcgatccccccctcgaagaagatagtctgaaacagagcctcgccccatacacacctccatttgacctgagttatcttactgaaccggctcagtctgctgaaaccatcgaggaggccgggtccccagaagacgagagccttgggtgcagggcagcagagatagttctatccgccctgccagacagaagatctgagggcaatcaggccgaaacaaagaatcgtcttccgggctcgcaactggccgtgctgcatatccgggaggatccggaaagtgtttatctgcctgtaggcgccgggagtaacatattaagcccaagtaatgtcgattgggaagtggagactgataattcagatctgccagccggcggcgacataggtccccccaacggggctagcaaagagatctctgaactcgaagaagagaaaacgatccctacaaaagaaccagagcagataaagtcagaatataaggaggagaggtgtaccgagaaaaacgaggatcgtcacgcccttcacatggattacattctcgtgaacagggaggagaactcacactctaaacctgaaacttgcgaggagcgcgagtcgattgcagaactggaactttacgtcggctcaaaggaaaccggcctacagggaacccaacttgcctcttttccagatacttgccaaccagcctcactgaatgaacggaaggggctgtcagccgaaaagatgtcgtcgaaaagcgatacaagaagctcattcgagagtccagcccaggaccaatcttggatgttcttggggcacagtgaggtgggtgatccctctctggacgccagagacagcgggcctggatggtctgggaaaacggtagagccattttccgaacttggccttggcgaagggccacaattgcagatcctggaggagatgaagccattggagtctctagctttagaagaagctagcggcccagtgtcgcagtcccaaaagagtaagtctcggggccgcgccggcccagacgccgtgacgttgcaggccgtgactcacgacaatgaatgggagatgctgagcccacaacccgtccagaaaaatatgataccagatactgagatggaggaagaaacagagttcttggagcttggaacccggattagtcggcctaatggtcttttatccgaagatgtgggtatggacatcccctttgaagagggagttctgtctccttcagctgcggatatgaggcccgagccaccaaattcactggatctgaacgatacccatccacggcggattaagttaactgcaccaaacattaacctcagtctcgaccagagtgagggaagcatcctgtccgatgataatcttgattcgccagacgagattgacattaatgtggacgagttagatactccggacgaagcggattccttcgaatacaccgggcacgaggaccccacagctaacaaggacagcggccaggagagtgagagtatccctgagtacacagccgaagaggagcgagaggataaccgtctgtggcgcacagtcgtaatcggcgagcaagaacaaagaattgatatgaaagtgatcgagccctatagacgggtcatttcacacggaggctcaagggggtattacggtgacggtctcaacgctatcattgtctttgctgcctgctttctcccggacagctctcgggctgattaccactatgtgatggagaatctgtttctttatgtcattagcacactcgaattaatggtagcagaggactacatgatagtttatctcaacggggccacaccgcgaagaaggatgcccggcctcggatggatgaagaaatgctaccaaatgatcgatcgacgtctccgtaaaaacctcaagagcttcattatcgtgcacccttcttggttcattcggacgatactggcagtcaccaggccatttatctccagtaagttctccagcaagataaaatacgtaaatagcctcagcgagctgagcggccttataccgatggactgcattcacattccagagtctatcataaattattag

SEQ ID NO: 131219 - DNA, 783 bp, Artificial Sequence
  Description of Artificial Sequence: Synthetic coding sequence
atcgatataaacgtagacgagctggacacccctgatgaggctgatagctttgaatataccggccacgaccctactgctaataaggatagtgggcaggagagcgaatccattcccgagtatacagccgaagaggaaagggaggacaaccggctctggagaacagtggtcatcggggaacaggaacagcgaattgatatgaaggtcatagagccctatcgccgtgtgatttcccatggaggcgactccggatattacggcgacggactgaatgcaattatcgtatttgctgcttgtttcctccctgattcctccagggcggactatcactacgtgatggaaaatctgttcctttatgtgatctcaaccttggaactaatggtggctgaggattatatgatcgtgtacctcaatggagctaccccccgaaggagaatgccagggctgggatggatgaagaaatgttaccagatgatcgatcgtagactgcggaaaaacctgaaatcttttatcatcgtgcatccaagctggttcattagaacaattctggcagtgactaggccattcattagctctaagttcagttcaaagattaagtatgtgaactccctttccgagttatcagggctcattcccatggactgcatccacatccccgagtccataattaagtatgatgaggagagatcatataagcgcagtgtgcgaacatcttgtctgtacaacgaccccgagatgagctctatggaaaaggacattgatctgaagctgaaagaaaaaccctag

SEQ ID NO: 131220 - DNA, 7155 bp, Artificial Sequence
  Description of Artificial Sequence: Synthetic coding sequence
tgattccagagccctgaaagttggaaggagcataaacctagctctatagaccggagggcttctgatagcgtctttcagcccaagagcttggaattcacaaagtctggcccatgggagtccgagtttggccagccagagctgggcagtaacgacattcaggacaagaatgaagaatccctacccttccagaatctgccaatggaaaaatcacctctgcccaatacatccccacaggggacaaatcatcttattgaggactttgcctcgctctggcattccggccgaagtccaaccgccatgcctgaaccctggggaaatcctactgacgatggagaacctgccgcagtggccccatttcctgcctggagtgcctttggaaaggaagatcacgacgaggccctgaagaatacgtggaacctgcatccgacctcctctaaaactccgagtgtgcgagaccctaacgaatgggctatggccaagtcagggttcgcgttttcgtcttctgaactgctcgacaactccccctccgaaattaataatgaggcggcccctgagatttggggcaaaaagaacaacgactcccgcgatcacatttttgcccccggtaacccatcaagcgacttggaccacacatggaccaattcgaagccccccaaggaagatcagaatggtctggtcgatcctaagacacgtggtaaagtgtacgaaaaggtggactcttggaatctgttcgaggagaacatgaagaagggaggtagcgacgtcctggtcccctgggaggactcgttcctctcatacaaatgcagcgactattcggcatcgaacctgggggaagattctgtaccctctcccctcgatactaattacagcacttctgacagttacacatcccccacctttgcaggcgacgagaaagaaactgaacacaagcctttcgccaaggaggagggattcgagagcaaagacggaaacagtactgctgaggagaccgacatccctccccaatctttacagcagagtagccgaaaccggataagttccgggcccggaaacttagacatgtgggcgtctcctcataccgataactcttccgaaattaatacaacgcataatctggatgagaatgaactaaagaccgaacacaccgacgggaaaaacatctccatggaggacgatgtcggggagtctagccagagttcttatgatgacccatcgatgatgcagctgtacaacgagacaaacaggcagctgacgctgctgcactcctcaacaaattcacggcagaccgcccctgattcactggacctgtggaatagggtgatcctggaagatacacagagtactgctacaatatcagatatggataacgatctcgactgggacgactgcagtggaggagcagcaatacctagcgacggccagactgaaggatacatggccgaaggatccgaaccagagacaaggtttactgttcgacaactggaaccctggggacttgaataccaggaggccaatcaggttgactgggaacttcctgccagcgatgaacacacaaaggattccgctccatcagaacatcatacactgaacgaaaaaagcggtcagctgattgccaacagcatttgggacagtgttatgcgggataaggacatgtcgagcttcatgttgcctgggtccagccacatcaccgattcagagcagcgcgagctgcccccagagattccttctcatagtgctaacgtcaaagacacacatagccccgacgctcccgctgcgtcaggcacttctgagtccgaggccctgatctcacacctggacaagcaggacaccgaacgggagacgcttcaaagcgacgccgccagtctggcgacaaggttggaaaaccccggatacttcccacaccccgatccttggaaaggccatggagacggacagtctgagtcagagaaggaagcacaaggcgccaccgacaggggccacctagacgaagaggaggtaattgccagcggtgtcgagaatgcatctggtatttccgaaaagggccagtctgatcaagaactcagtagcctggtagcatctgagcatcaggagatttgcatcaaatcaggtaagatcagtagcctggctgtcacatttagtccacaaactgaggagccagaggaagtgctcgaatacgaggaagggagctacaaccttgactcacgggacgttcagacagggatgagtgccgataatctccagccgaaggacacacatgagaagcacttaatgtcccagaggaacagcggggagacaacagagacatccgatggcatgaatttcactaagtatgtctcggtacccgagaaagacctggagaagactgaggaatgtaattttctggagcctgagaacgttggtgggggcccgccccacagagtcccacgctcgcttgacttcggcgatgtccctattgactctgacgtgcatgtgtcctccacctgctccgaaatcactaagaacctggacgtcaaagggtctgagaatagtctacctggagctggttcaagcggcaatttcgacagggacacaatttcctcagagtatacgcactcatccgctagttctccagagcttaacgacagctccgtggctctttcgagttgggggcagcagccatcctctggataccaggaggagaatcagggaaattggtctgagcaaaaccatcaggagagcgaacttatcaccaccgacggccaggtggaaatcgtgaccaaagttaaggacttggaaaagaatcggattaatgagtttgaaaaatcgttcgaccggaagacgccgacatttctcgaaatctggaacgactccgttgacggcgactctttcagcagcctgagtagcccagaaactggaaagtatagtgagcactccggcacacatcaagagtcgaatttgattgcatcctatcaggaaaagaatgagcatgacatttcggctaccgtgcagcccgaagacgctcgtgttattagcacttcatcgggctccgacgatgactcagttggaggcgaggagtctatagaagaagagattcaggtggccaactgccatgttgcggaggacgaaagcagggcctgggactcgttaaacgaatctaacaagttccttgtaactgccgaccctaagtctgaaaatatctacgactaccttgattccagcgagcctgcagaaaacgaaaacaagagtaaccctttctgcgacaaccagcagagtagtcctgacccttggactttttcccccttaactgaaaccgaaatgcagattacagctgtagaaaaagaaaaaagaagttcacccgagacagggactacaggcgatgtggcatggcagatttcaccaaaagcaagctttcccaagaacgaggacaattcccagcttgaaatgctcgggttttcggctgattccacagaatggtggaaggctagcccacaagaggggcgactcatcgaatcccctttcgagcgggagcttagcgactccagtggagtactggaaattaattcttctgtacatcagaatgcatctccatggggtgtcccagttcagggcgatatcgagcccgtcgaaacgcattataccaatccgttcagtgacaaccaccagtcaccattcctggaggggaacggaaaaaactcgcatgagcagctgtggaatatccagccccgccagcctgatcccgacgctgataaattttctcagctcgtaaaactggatcaaatcaaggaaaaagacagccgagaacagacattcgtgtcggctgctggtgatgagttaacacccgagacgcccactcaggagcagtgccaagacactatgttaccggtgtgtgaccatcctgatacggcctttacccacgcagaggaaaactcctgcgtaacgtctaacgtgagcacgaatgagggtcaagaaactaatcagtgggagcaagagaagagttatcttggggagatgacaaattcatccattgccactgaaaatttcccggccgtgagctctcctacacagcttatcatgaagcccgggtctgaatgggacggcagcactccatccgaggattctcggggcacgttcgttcccgacatcctgcacggaaattttcaggagggcggtcagctggcttccgccgcacctgatctctggattgacgctaagaagcctttttcactgaaagccgatggggaaaatcccgacatcttgacccattgtgagcatgactctaactctcaagcctcagacagtccagatatctgtcacgactccgaagctaagcaggagacggaaaagcacctttctgcttgtatgggccccgaagtggagagctcagaactctgcttaactgaacctgagattgacgaggagccaatttacgagcccggacgggaatttgtcccatctaacgcagagcttgatagtgagaacgcgacagtcctgcctccaatcggctatcaggccgacattaagggcagtagccagccagccagccacaagggatcccctgagcctagtgagattaatggtgacaattccacaggtctgcaggtgagcgagaagggtgctagcccggatatggctcccatcctggagcccgtggacagaaggatcccccggatcgaaaatgtcgctacttcaatatttgttacccaccaagaacccacaccagaaggagatgggtcctggatatcggattcattttcaccggagtctcagccaggcgctagggctctctttgatggagatcctcacctttctaccgaaaaccctgcgttggtgcccgacgccctgctcgctagcgatacctgcctagacataagtgaagcggctttcgaccactcattctccgatgcatcaggattaaatacctctacagggactatagatgacatgtcaaaacttaccttatccgaaggacatcccgagacccccgtggatggagacctggggaaacaagatatctgtagctcggaggccagctggggcgatttcgagtacgacgtgatgggccaaaacattgatgaagatttgctgcgcgaacctgagcattttctgtatggaggcgacccccctcttgaggaagatagtctgaaacagtcccttgctccctataccccaccgttcgacctgtcctatttgacagagcctgcgcagagcgccgaaactatcgaggaggccggctctcctgaggatgagtccctgggatgtagagccgccgagattgtgctgtctgctctgcccgataggcgctctgagggaaatcaagccgagacaaagaaccgtcttcccggctcgcagctggcagtattacatattagagaagacccggagagcgtctacttgcctgtgggcgcaggaagcaatatcctgagcccttccaacgtggattgggaagtggaaaccgacaactcagacctgccagccggaggcgacattggcccgcccaacggagcttcgaaggaaatctccgaacttgaggaggagaagaccatccccacaaaggagcctgagcagatcaaatccgaatacaaggaagagagatgcaccgaaaagaacgaggaccgacacgctctgcacatggattatatcctggttaatagagaagagaatagccattcgaagccagagacctgtgaggaacgggagtcaatcgccgagctggaactctatgtgggtagcaaagagactggattgcagggtacacagctggccagcttcccggacacatgccagccagccagcctaaacgagcggaaggggctctccgccgaaaagatgtcctccaaaagtgatacaagatcctctttcgaatctccagcacaggaccagtcctggatgttcctggggcactcagaggtcggcgatccgagtttggacgccagggatagtggacccggatggagtggtaaaacagtcgaacctttctccgaactgggactgggggaaggtcctcagttacaaattttggaggagatgaaaccactggaaagtttggcgttagaggaagcctcgggcccagttagccagtcccaaaagtccaagagtcggggccgcgccggccccgatgccgtgacattgcaggctgttacacacgacaacgaatgggaaatgttgagtccacaacccgtgcagaagaacatgattcctgacacagaaatggaggaagaaaccgagttcctggaactgggcacaaggatttcgcgccctaacgggttgctttccgaggatgtgggaatggacattccctttgaggagggcgtactctctccatctgccgcagatatgagaccagaacctcctaactcactggacctgaatgacacacatcccagacgtattaaactcaccgcacctaacataaatcttagcctggaccaaagcgagggctctatcctctccgatgacaaccttgactctcctgatgagatcgacatcaatgtcgacgaactggacactcctgatgaggcggacagtttcgaatacaccggccacgaccccactgctaacaaagactctggtcaggagtccgaaagcattcctgaatataccgccgaggaggaacgggaggacaaccgtctctggaggaccgtggtgattggcgagcaagaacagaggatagatatgaaagttatagaaccttatcgtagggtgatttcccacggtggggactcaggttactacggggacggcttgaatgctataatcgtttttgccgcctgtttccttcccgattcctccagagctgattatcactacgtgatggagaatctttttctgtacgtgatctcaacactcgagctaatggtcgctgaagactatatgatcgtgtatttgaatggcgctactccacgtcgtagaatgcccggtctgggttggatgaagaagtgctaccagatgatagacagaaggctcaggaagaatcttaagagtttcattattgttcacccctcctggtttatacgaaccattctcgcggttacacgcccatttatctcttccaagttttcttctaagattaagtatgtgaactccctctctgaacttagtgggctaattcccatggattgtattcatattcccgagtcaatcattaacatcgatctcaaactcaaggaaaagccctag

SEQ ID NO: 131221 - DNA, 8193 bp, Artificial Sequence
  Description of Artificial Sequence: Synthetic coding sequence
atggtctccaatagccgtaccagttccactgaggccgtggcaggctccgctccactcagtcaaggctctagcggcatcatggaactttacgggagcgatattgagcctcagccatcttccgttaatttcatcgagaaccctcccgaccttaacgacagcaatcaggcacaagttgacgcgaacgtcgacctggtgtcccctgactctggcttagctacaatcaggagttcaaggagcagcaaggagtcaagcgtgtttctgtcggatgattcccctgtcggagagggcgccggcccccatcatactctgctccccggcttggatagctactctcccattcctgagggtgcagtggctgaagaacacgcctggtccggtgagcacggagagcatttcgatctcttcaatttcgatccagcccccatggcttctgggcagtctcagcaatcttcccattccgctgactacagcccagctgacgacttttttccaaactccgacctttcggaggggcaactgcccgctggcccagaaggcctggatggcatgggcaccaacatgtcaaactacagcagctccagcttacttagcggtgccggtaaggatagcctagtcgaacatgacgaggaatttgtgcaacgccaggattctcccagagataatagtgaaagaaatctgtcactcactgactttgtaggagacgagagcccctcacctgagaggttaaagaacaccggcaagaggatacccccaacacccatgaactccttggttgagtcctccccatctactgaagaacccgcttctctatataccgaggacatgacccagaaggctacggacacagggcacatgggcccccctcaaactcacgcccggtgttccagttggtggggcggcctggaaattgacagtaagaatattgccgatgcctggagctcttcggaacaggaaagcgtttttcagagccccgagtcctggaaagaacacaaaccctcatctattgatagacgcgcatcagattcagtatttcagccgaagagcctggagtttactaaaagcgggccgtgggagtcagagtttggccaacccgaactgggaagcaacgatattcaggataagaatgaggagtctctgcccttccaaaatttacccatggagaaaagcccactgcccaatactagcccccagggcacgaaccatctgattgaggattttgctagcttgtggcatagcgggcgctccccaaccgccatgcccgaaccctggggtaacccgaccgatgatggcgagcctgcagctgtggcacctttccccgcttggtctgctttcggtaaggaagatcatgatgaggcgctgaaaaacacctggaacttgcatccgacgagcagtaagactccgtctgtgcgagatcctaatgaatgggctatggcgaaaagcggctttgctttctcaagctctgaactgttagacaattctccctctgaaatcaataacgaggccgccccggagatttgggggaagaagaacaacgacagtagggatcacatcttcgctcctggaaaccctagttccgatcttgaccacacttggacaaatagtaaacccccaaaggaggatcagaacgggctcgttgaccccaaaacccgtgggaaggtctacgaaaaggttgacagttggaatctgttcgaagaaaacatgaaaaaagggggatctgatgtcctagtcccttgggaagatagcttcctgtcctataagtgtagcgattacagtgctagcaatcttggtgaagactccgtaccgtcccctctggacactaactatagcacatccgattcctatacatcccccacatttgccggggatgagaaagaaactgaacacaaaccatttgccaaagaggaaggctttgagtctaaagatgggaactccacggccgaggagacagacattccacctcagtctttgcagcaatccagtcggaatcggatctccagcggtccggggaacctggacatgtgggctagcccacacaccgacaactcctccgagatcaatacaacgcacaatctggatgagaacgaattgaagacggagcatacggacggcaaaaatataagtatggaggatgatgtgggagagagcagccaatcgagttatgatgatccgtcgatgatgcagctgtacaacgagaccaaccggcagctgacattactccactcatccacaaattcccggcagaccgcgccggattcccttgacctctggaatcgagttattctggaggacacacaaagcactgcaacaatcagcgacatggataacgatctggattgggatgattgcagcggtggcgccgcaattccgagtgacggacagaccgaagggtacatggccgaggggagcgaacctgagactcgatttacagtgaggcaactcgagccctgggggctggaatatcaggaggcgaaccaagtggactgggagctaccggcaagcgacgaacatactaaagatagtgccccctctgagcatcacactcttaatgagaagagtgggcagctaatagctaactctatatgggatagcgtgatgagggataaagatatgtcctccttcatgttaccaggctcatcacacatcacagatagcgaacagcgcgagctgccacctgaaataccttctcactcagcaaacgtgaaggatacccactctccggatgccccagcagccagcgggaccagtgagtcagaggccctgatcagccacctggataagcaggatacagagcgggagaccctccagagcgatgccgcaagtcttgctacaaggctagagaatccgggctacttccctcatcctgacccttggaaaggacatggcgacgggcagtctgaaagtgaaaaagaggctcagggcgcgacagatcgcggacatctggacgaggaagaggtaatcgcatcaggcgttgagaacgcctcagggattagtgaaaaaggacagtcggaccaggagctgagctccctcgttgcctctgaacaccaggagatctgcattaaatccgggaagatttccagcctagccgtgaccttttccccccagacagaggaacctgaagaagtgctggagtacgaagagggctcctataatctcgacagcagggatgtgcagaccggaatgagcgctgataacctccagcctaaggacacccacgaaaagcatctgatgtctcaaaggaactccggggagaccaccgaaaccagtgacgggatgaatttcaccaaatatgtatctgttcccgaaaaggaccttgagaaaacagaggaatgcaactttctggaacccgagaatgtgggaggagggcccccgcaccgcgtgcctcgctctcttgacttcggcgacgtacctatagatagcgacgttcacgttagctcgacatgtagcgagattaccaaaaatcttgacgtgaagggctccgagaatagcctgcccggcgccgggtcctctggtaactttgacagagatacaatcagttcggagtacacacactcttccgccagctcacctgaattgaatgattcttctgtagccttgtcttcctggggccaacagcccagctctggataccaggaggagaaccagggaaactggtctgagcagaatcaccaagagagcgagctgatcactaccgatggccaggtagagattgtgacgaaggtaaaagatctagaaaaaaaccgcattaacgagtttgagaagagcttcgaccgcaagactcccactttccttgaaatttggaacgacagcgtggatggggattcctttagctccctgtccagccccgaaacaggcaagtactccgagcacagcggaacacaccaggagagcaatctgatcgctagttaccaagaaaaaaatgagcacgatattagcgcaaccgttcagccagaagacgcgagggttatatccacaagttccgggtctgatgacgattcagttggcggagaggagtcgatcgaggaggaaattcaggtggctaactgccacgtagctgaggatgagtcccgcgcctgggattcgcttaatgagagcaataaatttctggtgactgccgacccaaaatctgagaatatttatgattatctcgatagcagtgagccggcagaaaatgaaaataaatccaaccctttttgtgataatcagcagtcctctccggacccctggacctttagtcccctcaccgaaaccgagatgcaaatcaccgctgtggagaaagagaaaaggagctcgcctgagactggaaccaccggtgacgtggcctggcagataagtccaaaagccagttttccaaaaaacgaagataacagccaactcgagatgctgggcttttctgctgatagcacagaatggtggaaagcatctccccaggagggcagactaatcgagagccctttcgaacgagagctgtccgatagcagcggagtcctggagatcaactcttctgtacaccaaaacgcttcgccctggggagtgcccgtacagggagatatcgagcctgtagagacacactacacaaatccgttctctgacaaccaccaatctccttttcttgaaggaaacggcaaaaactcccacgaacagctctggaatatacagccacgccagccggatcccgatgccgataaattttcacagctggttaaactggatcaaatcaaagagaaagactctcgagagcaaacatttgtctcagcggcaggagatgaactcaccccagaaaccccaacccaggagcagtgccaggacactatgcttcctgtgtgcgaccacccagacactgcattcacacacgctgaagaaaacagttgcgtgaccagcaatgtgagtaccaatgaagggcaagaaaccaatcaatgggagcaggagaaatcgtacttgggcgaaatgacaaatagctctatcgctaccgagaacttccccgcggtgtcttcgccgacccagctgatcatgaagccagggtctgagtgggatggcagcacaccctcagaggattctcgcgggacattcgtccctgatatcctgcacgggaattttcaggaggggggccaactcgccagtgccgcacctgacctgtggatcgatgcaaagaagccgtttagcctaaaagcggacggggagaaccctgacatcctcactcactgtgaacacgactccaatagccaagcctcagacagccccgatatctgccacgattcagaagccaagcaggagaccgagaagcatctgagcgcctgcatgggcccagaggtggagtccagtgagctctgtctcaccgaaccagaaatcgatgaagagcccatctacgaaccaggcagggagttcgttccatctaatgctgaactggatagtgaaaatgctacagtgctgcctcccatcgggtatcaggccgacataaaagggtcttcacagcctgcttcacacaaaggcagcccagagcctagtgaaataaatggcgataattctaccggcctacaagtgagcgagaagggggcaagccccgatatggcaccaattttggagcccgtggaccgaagaattcctaggattgaaaatgtcgccacatcgatatttgtgacccatcaggaaccgacccccgagggggacggaagctggatcagcgactccttttcccccgagtcgcagccaggagcccgcgccctcttcgacggggacccccacttgtcgaccgagaatcccgctttggtcccggatgctctgctagcctccgatacatgtctcgacatctcagaagccgcttttgaccacagtttttccgacgcctctggcctgaacacctctactgggactatcgatgacatgtccaagttgaccctgtccgagggtcacccagagacaccagtggacggagacctgggcaaacaagatatctgtagcagtgaggcctcctggggggacttcgaatatgatgtaatgggccagaatattgatgaagatcttcttagggagcccgagcacttcctgtacgggggggatccaccactggaggaagactctctgaaacaatccctcgcgccctacactcctcccttcgatctctcatacctgactgaacccgcccagagtgctgaaacaatagaagaagcgggctcacctgaggatgagagcctgggctgtagggcagcagagatagttttgtccgccctgccagaccgtaggtctgagggcaatcaagccgagactaaaaatagacttcctggatctcagctagccgtgctccacattcgagaggatccagaaagtgtttacctgcctgtgggtgcaggtagtaacatcctctctccatccaacgtggactgggaggttgaaactgacaacagcgatctgcctgcgggcggagatattggccctcccaatggtgcttcaaaggagatctccgaactcgaggaagagaagaccataccaaccaaggagcctgaacagataaagtctgagtacaaagaggagaggtgtaccgagaagaatgaggatagacacgccctacacatggactatatcttagtcaatagggaagagaatagtcactcaaaacctgagacctgtgaagaacgcgagagcattgccgaattagagctgtatgtgggatccaaggagacaggtctgcaggggacacagctggccagttttccggacacctgtcaaccagctagccttaacgaaagaaaaggtctctccgccgagaaaatgtccagcaaatcagatacccgcagttcgttcgaaagtcccgcccaggaccagagctggatgttcttggggcactccgaagttggagatccaagcctggacgcccgcgactctggcccagggtggtcagggaagaccgtggaacccttcagcgagctgggactgggcgagggaccccagctgcaaattctggaggagatgaaacccctcgaaagtctggctctggaagaggcaagcggtccagtgagccagtcccagaagagtaagtcccgcggacgggcaggaccggacgccgtaaccctccaggcggtaacccacgacaatgagtgggaaatgctgtctccccagcctgtccagaagaatatgattccagataccgagatggaagaagagacagagttcctcgaacttggtaccagaatctcaaggcccaacgggctattaagcgaggatgtgggaatggatattcctttcgaggagggagtcctgtcaccgagtgccgcagacatgcgacctgagccccccaacagcctagatctcaatgacacacaccccagacgcataaagttgaccgcccccaatatcaatctcagcctggatcagtccgaaggttctatcctgtccgacgacaatctggacagtccagacgagattgatatcaatgtggatgaactcgatactccagacgaggcagattcattcgaatataccggccacgaggaccctaccgccaataaggacagcgggcaggagagcgaatcaatacccgagtatacagcagaagaagagagggaagacaatcgcttatggagaaccgtggtgattggagaacaggaacagcgtatcgatatgaaggttatcgagccctatagaagggtgatttctcatggaggatactacggcgacggcctcaatgccatcattgtctttgccgcctgtttcctgcccgattcgtctcgcgcagattatcactacgtgatggagaacctattcttatatgtaatttccactctcgagctgatggtggctgaagattatatgattgtataccttaacggggctaccccccgtagacggatgccaggactggggtggatgaaaaagtgttaccaaatgatcgatcgtagactccgcaaaaacttgaaaagctttattattgtacaccctagctggtttattagaacaatcttggccgtcacacgcccttttatttcttccaagttctcatctaagatcaaatacgtcaatagcttaagcgagctgtccgggctgataccaatggattgcatccacatccctgagagcattataaagctcgacgaggagctcagagaagcttccgaagctgcgaagacatcttgtctgtacaatgacccagagatgagctctatggagaaggatattgatctgaaactgaaggaaaagccgtag

SEQ ID NO: 131222 - DNA, 927 bp, Artificial Sequence
  Description of Artificial Sequence: Synthetic coding sequence
atgaggccggaaccgcccaattcattagacctaaacgatactcacccccggcggatcaaactgactgcccctaacatcaatctcagcctggatcagagtgagggcagtatcctgagtgatgataatttggacagccccgatgaaatcgacattaacgtcgacgagcttgacacccccgacgaggctgacagtttcgaatacacaggccatgatcctacggctaacaaagacagcgggcaggaatccgaatctattcccgaatatactgcagaagaggaaagagaagataatcgtctgtggcgcacagtggtcatcggtgagcaggagcagaggatagatatgaaagtgatagagccctaccgcagagtgatctcccacggcgggaaattgcggtattacggagatgggttgaatgcgattatcgtctttgcagcctgtttcctgcctgactcctccagggccgattaccactatgttatggaaaaccttttcttgtatgtgatctccacactggaactcatggtggcagaggattatatgattgtgtacctcaatggggctacgccgcgacgcagaatgccaggactgggttggatgaaaaagtgttaccagatgatcgaccggagattgaggaagaacctaaagtcttttataatcgtccacccgagctggttcattcgaacaatcttggcggttacccgcccatttatttcaagcaagttttcttcaaagatcaaatatgtaaactctctctctgagctgagtggcctgatcccaatggactgcatccatatccctgaatccattattaaatacgacgaagagcgtagttacaaacgctccgtacgcacttcatgtctgtataatgatcccgagatgagctctatggaaaaggatatcgatttaaagttgaaggagaagccctag

SEQ ID NO: 131223 - DNA, 1014 bp, Artificial Sequence
  Description of Artificial Sequence: Synthetic coding sequence
atgaatggcctccgaaacaagcagctcctctccgaagacgtcggcatggacatccctttcgaggaaggagtgctgtcacccagcgccgccgacatgaggccagagccccccaactcgctcgatcttaatgacacacatccgcggagaataaagctgaccgcgcctaatataaatctgtctctggaccagtccgagggttctatcctgtctgatgacaacctcgactctcccgatgaaatagatatcaatgtggacgagctggacacaccggacgaggccgattctttcgagtataccgggcatgaccccacggctaataaagacagcgggcaggaatccgagtcgatccctgagtatactgccgaagaggagcgggaagataatcgcctgtggagaactgtggtcattggggagcaggaacagcgcatcgatatgaaggtgattgaaccttatcggcgagtcatcagtcatggaggatattacggagatggactgaatgctataatcgttttcgcagcctgcttcctgccagactcatccagggctgattatcattatgtgatggagaacctttttctgtacgtgatttctacgctcgagcttatggtggctgaggactacatgattgtgtatctgaacggtgctacccctaggagacgcatgcccggcctgggctggatgaaaaaatgctaccagatgattgatagaaggctgcgcaagaatctgaagagctttatcatcgtgcatccctcttggttcatccgtacaattctcgcagtgacccgcccatttatctcaagcaagttctcaagcaaaataaagtacgtaaattctcttagtgagttgagtggcctcattccaatggattgtatccatataccagagtctatcatcaagctggacgaggagctgcgcgaggccagcgaagccgctaaaacttcgtgtctgtacaatgatcccgagatgagctcaatggaaaaagatatcgacctgaaactgaaagaaaaaccgtag

SEQ ID NO: 131224 - DNA, 1155 bp, Artificial Sequence
  Description of Artificial Sequence: Synthetic coding sequence
atggctgggaacgcagaaccccctcccgccggcgcggcttgccctcaagacagaaggtcctgtagtggccgcgctgggggggacagagtgtgggaagacggggagcaccctgcaaagaagctgaagagtggcggtgatgaagagaggcgggagaagccccccaaacgcaagatcgtcctgctgatggcttactcaggcaaggggtatcatggcatgcagcgcaacgtgggctcatcacaattcaaaaccatagaggatgatctggtgagtgccctggtgaggtccgggtgtatcccggagaaccacggggaggacatgagaaagatgtctttccagaggtgcgccaggaccgacaagggggtctcagctgcgggtcaggttgtgtcacttaaagtttggctgatcgacgatatcctcgagaagatcaacagtcatctcccgagtcatatcagaatcctcggtctgaagcgtgttactggagggttcaattctaaaaacagatgcgacgcacgtacatactgctacctgcttcctactttcgctttcgcccataaggaccgggatgtacaggatgaaacgtaccgcctgtccgcagaaactctccagcaggtcaaccggttgctggcatgttacaaaggcacgcacaactttcataactttaccagccagaagggccctcaggaccctagcgcctgtaggtacatattagaaatgtattgcgaagagccctttgtccgggagggtctcgagtttgcagtcattcgcgtgaagggccagagttttatgatgcaccagatcagaaaaatggtggggctggtggttgccatcgttaaaggctatgctccagagtcagtgttggaacgctcctggggcacagaaaaagtcgacgtccccaaggcccccggactgggcctggtgctggagcgtgtccacttcgagaagtacaaccagaggtttggaaacgatgggctccatgagcccctagattgggcccaggaggaaggcaaagtagctgcgttcaaggaggaacacatttatcctacaatcattggcactgagagagatgaacgtagcatggctcaatggttgagcactctgccaattcacaatttcagtgccacagcccttacagccgggggcaccggggctaaatag

SEQ ID NO: 131225 - DNA, 1284 bp, Artificial Sequence
  Description of Artificial Sequence: Synthetic coding sequence
atgggactgcagctgagggccttactcggtgccttcggcagatggaccctaaggttagggcctcgacccagctgttctccgcggatggcaggcaacgctgagcccccccctgcaggagccgcgtgtccccaggatcgtagatcatgctccggtcgtgccggcggcgatagagtatgggaggatggggaacatcctgccaagaagctgaaaagcggcggcgacgaagaaagacgagaaaagcccccaaagcgcaagattgtcctactaatggcctattcgggtaagggctaccatggcatgcagcggaatgtaggtagttctcaattcaaaaccatagaagacgatctggtgtccgcccttgttagatccggctgcatccccgagaaccatggcgaggatatgcggaagatgtcgttccagcgctgtgctcgcacggacaagggcgtgtcagcagcgggacaggtcgtgagcctgaaagtgtggctgatcgacgatatcctggaaaaaataaatagccatctgccaagccatatccgaatattgggacttaaacgcgttacaggcggctttaactccaaaaaccgttgcgatgctagaacttactgctacctgctgcccacatttgccttcgcccacaaagaccgcgacgtgcaggacgaaacatatcgactgtccgccgagactctgcaacaggtcaatagactgctcgcctgttataagggcacccacaacttccacaacttcacttcacagaagggaccacaggaccccagtgcctgtagatacatcttagagatgtactgtgaagaaccatttgtgcgagaagggttagagttcgccgtaataagggtcaaaggtcagtccttcatgatgcaccagatcaggaagatggtggggctggtagttgccattgtgaagggctatgcacccgaatcagtcctggagagatcttggggaactgagaaagtggatgttcctaaagcgcctgggttgggcctggtacttgagcgggtgcacttcgagaaatacaatcagcggttcggcaacgatggactgcacgagcctctcgactgggcccaggaggaaggaaaagtggccgctttcaaagaggagcacatttatcccactattatcgggaccgagagagatgaacgcagtatggcccagtggctatcgactttacccatccacaactttagcgcgacagccctgaccgccggtggcaccggtgccaaagtcccttcaccactggagggaagcgagggtgatggagacacagattag

SEQ ID NO: 131226 - DNA, 1200 bp, Artificial Sequence
  Description of Artificial Sequence: Synthetic coding sequence
atggccggaaacgccgaacctcctccagcgggagcggcctgtccacaggaccggaggagttgtagcggtagagctggtggggacagagtgtgggaggatggagagcatcccgccaagaaactcaagtctggcggggatgaggaacggcgggagaagcctccaaagagaaaaatcgtactgttaatggcgtactccgggaagggctaccacgggatgcagcgcaacgtgggctcttcccagtttaaaacgattgaggatgacctcgtttctgccttagtcaggagcgggtgcatccccgaaaaccatggagaagatatgcggaagatgtcgttccagcgatgtgctcgaaccgacaagggagttagcgccgctgggcaagtcgtcagcctcaaggtgtggctgattgatgacatccttgagaagattaattcacacctccctagtcatattaggatattaggcctgaagagagtgactggagggttcaatagcaaaaatcgctgcgatgcacgtacgtactgttacctcctgccaacatttgctttcgcacacaaggatcgggatgtgcaagatgagacttacagactgagcgctgagacgctgcagcaggttaatcgactgctagcttgctacaagggaacccacaactttcataatttcacttcgcagaagggaccccaggaccctagcgcttgccgatacattctggaaatgtactgtgaagaaccatttgtaagggagggactggagttcgcggtaatcagggtgaagggccagtcattcatgatgcatcaaattaggaagatggtgggtcttgtcgtcgctatcgtgaagggctacgcccccgagtcagtgttagagaggtcttggggtactgagaaagtggacgtgccaaaggcacctggtctcggcctggtcctggagagggtgcactttgaaaagtataatcaacgcttcggtaacgatggcctccacgaacccctggattgggcacaggaggaaggcaaagtcgcagccttcaaagaggaacacatctacccaacaattataggaaccgagagagatgagcggtccatggctcagtggctttcaactctgccaattcataattttagtgcaacagccctcacagccggtggcacgggagccaaggtaccttctcctctcgaggggagcgaaggagacggggacaccgattag

SEQ ID NO: 131227 - DNA, 1200 bp, Artificial Sequence
  Description of Artificial Sequence: Synthetic coding sequence
atggcggggaatgcagaacccccccctgccggtgctgcctgtccacaggaccggcgctcgtgctccggacgggcgggaggtgatcgagtctgggaggacggggagcaccccgcaaaaaaactgaagtccggaggagatgaagagcgaagggaaaagccaccgaagcgaaagatcgtcctgttgatggcctactcggggaagggctatcacggcatgcaacgtaacgtcggttcttctcagttcaagacaattgaggacgatcttgtcagcgcattggtgcgctccgggtgtattcctgagaaccacggggaggatatgcggaagatgagctttcagcgatgcgccagaaccgataaaggggtgagcgctgctgggcaggtggtgagtctaaaggtgtggcttatcgatgacatacttgaaaagataaacagtcatctgcctagccacattcggatactgggtctaaagcgggtgactggcggtttcaacagtaaaaatcgatgcgatgcaagaacttactgctatctccttcctacattcgcttttgcacacaaagatcgggatgtgcaggatgagacttataggctgtctgcggagacactgcagcaagtgaatcggctactagcctgttataaaggaacccataatttccacaacttcactagtcagaagggtccacaggatcccagcgcttgtaggtacatcttagaaatgtactgtgaggagccttttgtgcgcgaagggctggagtttgccgtgattcgcgttaaggggcagtcattcatgatgcaccagattaggaaaatggtaggtctcgtagtggccattgtcaagggctacgccccagagtctgtgttggagcggtcatggggaaccgagaaggtagacgtccctaaggctcccggtctaggcctggtgctcgagcgggtgcacttcgagaaatacaaccagagattcgggaacgacgggctccacgaaccattagattgggctcaggaggagggaaaagtggccgcatttaaagaggagcacatctaccccacaattatcggtactgagcgagatgagcgctctatggcccagtggctgtctactttgcccatccacaatttcagcgctaccgccctgacagccgggggcaccggtgctaaagtacccagccctctcgaggggtctgaaggcgatggcgacaccgactag

SEQ ID NO: 131228 - DNA, 465 bp, Artificial Sequence
  Description of Artificial Sequence: Synthetic coding sequence
atggccggtaatgctgagcccccacccgcaggcgccgcctgcccacaggacagaagatcatgtagtgggcgtgccgggggtgatcgggtctgggaagacggcgagcatcccgcaaagaaattaaagtcaggcggggatgaagaacgaagagagaaaccacccaagcgcaagattgtactgttaatggcctactccggaaagggatatcatggaatgcagagaaatgtcggaagttcccagtttaagactatcgaagacgacctggtcagtgcactggtccgcagcggctgtatccccgagaatcatggtgaagatatgaggaaaatgagctttcaaaggtgtgcaaggacagacaaaggcgttagtgcagcagggcaggtggtgtccctcaaggtctggctgattgatgacatcctggaaaagattaactcacatcttcctagccacatcaggatactaggatag

SEQ ID NO: 131229 - DNA, 618 bp, Artificial Sequence
  Description of Artificial Sequence: Synthetic coding sequence
atgagcaaaggccgggccgaggccgcagccggcgctgccgggattctcctgagatatcttcaggagcagaaccggccttatagttcccaggatgtttttggcaacctgcagagagagcacggcctcgggaaagccgtcgtggtgaaaacgctggagcagctggctcaacaggggaaaatcaaggagaaaatgtatggcaagcaaaagatctacttcgctgaccaggatcagtttgatatggtttctgacgccgatctacaggtactggacggtaagatcgtggcacttacggctaaagtgcagtcactccagcaatcatgtcgatatatggaagctgagatgcaaaaggagattcaagaacttaaaaaggagtgcgccggttacagagagagacttaagaacattaaagccgcaacaaatcacgtcacccctgaagagaaggaacaggtgtatcgcgagcggcagaagtactgtaaggagtggcgtaagaggaaacgaatggcaaccgaattgagtgatgctatcctggaaggctaccctaaatcgaagaaacaattcttcgaagaagttgggatcgaaaccgatgaggactataatgtgaccctccccgatccctag

SEQ ID NO: 131230 - DNA, 654 bp, Artificial Sequence
  Description of Artificial Sequence: Synthetic coding sequence
atgtctaaaggccgagccgaggcagccgctggagcggccggcatcctcctgaggtatttacaagagcagaatagaccctactctagccaagacgttttcgggaatttacagagggaacacggtcttggaaaggcagtggtggttaagaccctagaacagttggctcagcaaggaaagatcaaagagaaaatgtacggcaagcagaagatctattttgctgaccaggaccaattcgatatggtctctgatgctgacctgcaggtactggacggtaagattgtcgctctgacagcaaaggttcaatccctgcaacagagctgcagatacatggaggctgaacttaaggaactcagttctgctctgactacacccgaaatgcaaaaagaaatacaagaactaaagaaagagtgtgctgggtatagggaaagactgaagaatatcaaggctgctacgaaccacgtgacccctgaggagaaggagcaagtgtatcgagaacgccagaagtactgcaaagagtggaggaagcggaaacgtatggccaccgagctcagcgatgcgatcctcgaagggtaccccaaatccaaaaagcagttctttgaggaagtgggaattgagacagatgaggattacaacgttacactcccggacccctag

SEQ ID NO: 131231 - DNA, 465 bp, Artificial Sequence
  Description of Artificial Sequence: Synthetic coding sequence
atgtatggcaagcaaaaaatctacttcgctgaccaggatcagtttgacatggtctctgacgcagatttgcaagtgttagacggaaaaatcgttgctttgaccgccaaggtgcagtctctgcagcaatcttgtcggtatatggaggccgaactgaaggaactttcttcagcacttacgactcccgaaatgcaaaaagaaatccaggaacttaaaaaggaatgtgcgggttaccgcgaacggctcaagaacattaaggccgccaccaaccatgtaacaccagaagaaaaagaacaggtctatagagagagacagaagtattgtaaagagtggcggaagcggaaacgaatggccaccgaattgtctgatgctattctcgaaggctaccccaagtccaaaaaacagtttttcgaagaggtgggaatcgaaaccgatgaggactacaacgtcactttacccgacccttag

SEQ ID NO: 131232 - DNA, 915 bp, Artificial Sequence
  Description of Artificial Sequence: Synthetic coding sequence
atgttctccgtactgtcatacggtcggctcgtggcccgggctgtgctgggcgggctgtctcagaccgacccacgggctggaggcggggggggaggagactacgggttagtaaccgccggctgtgggttcggcaaggactttaggaagggcctgctgaagaagggagcctgttacggagatgatgcctgctttgttgcccggcaccgatctgcagatgtgctgggcgtcgcagatggcgttgggggatggcgagattatggcgtggatccaagccagttcagcggtacacttatgcgtacctgtgaaagacttgtcaaggaaggaagatttgtgccatctaacccaattggcatcctcaccacctcctactgtgagttgctgcaaaacaaagtgcctctacttggatcttctacagcttgtatcgtcgtgctggatcgcacttcacacaggcttcacactgcaaatctgggggattcaggattccttgtcgtccgtggcggcgaggttgttcacaggtctgacgaacagcagcactactttaacacaccgttccaactttccatagccccccccgaagccgaaggcgtagtgctcagcgatagccccgacgctgccgatagcacttccttcgacgtgcagctgggggacatcatcctgactgctactgatggcctctttgacaacatgcccgactatatgatattgcaagagctaaaaaaattaaaaaattccaattatgagagtatacagcagaccgcccggagtatagctgaacaggcacatgaactggcgtacgacccaaattacatgtcacctttcgcacagtttgcctgcgacaatggactgaatgtgcgtggagggaaacctgacgacattacggtgctgttgagcatcgtggccgaatacaccgattag

SEQ ID NO: 131233 - DNA, 1746 bp, Artificial Sequence
  Description of Artificial Sequence: Synthetic coding sequence
atggcagttagacaagccctcggccgtggactgcaactgggacgcgcactgttactcagatttaccggcaagcccggaagggcctatggtttgggccgccccgggccggcagcaggctgcgtacggggagaacggccaggttgggctgctgggccaggcgccgagccacggcgtgtgggtctcggtcttcctaaccgccttaggttcttccgtcaatctgtcgcagggctggctgcccggttacaaaggcagtttgtggttcgtgcatgggggtgtgctggcccttgtggtcgtgctgttttcctcgcgttcggccttggcctgggcctgatagaggaaaagcaagccgagtccaggcgcgccgtctcagcatgtcaggaaatccaagcaatcttcacccagaagtctaagccgggccctgatccattggacacccgtcgcctgcagggattcagactggaggaataccttattgggcagagcattgggaaaggctgttccgctgccgtctacgaggccacaatgcctaccctccctcaaaacctggaggtgaccaagtccactggattgctcccaggtcgaggccctgggaccagcgcgccaggggagggccaagagagagccccaggggcacccgcctttcccctggctatcaagatgatgtggaacatttctgcaggtagcagtagcgaggccattctcaatacaatgtcccaagaactagtaccagccagcagggttgctctggcgggagaatacggcgccgtcacatataggaaatcgaagagagggcccaagcagcttgctccccatcccaatatcattagagtgctgagggccttcacctcatccgtacctctactgccaggagcccttgtcgattaccccgacgtcctgcctagcaggctacatcctgagggactcggtcacggtagaaccttatttctggtgatgaagaattatccgtgcaccctgaggcagtatctttgtgtgaacactccttctcccagactggccgctatgatgctcctccaactgttagagggcgtcgaccacctcgttcagcagggaatcgcccacagagatctcaagtctgacaatatattagtcgaactcgaccctgatggctgcccctggctggtgatagccgacttcgggtgttgtttggctgacgagtcaatcggcctgcagcttccattctcctcttggtacgttgatcgtggcggtaatgggtgtctcatggctcctgaggtgtccacagcccgccccgggccacgggccgtcatcgactacagcaaggctgatgcctgggcagtaggggcaattgcttacgagatctttgggctagtgaaccccttttatggtcagggaaaggcccatttggagagtagatcctaccaggaagcacagcttccagccctccccgaaagcgtgcctcccgacgtccgccagctggtgagggcgcttttacagagggaggccagtaaacgtccaagcgcccgagttgcagcaaacgtgctccacctgagtctgtggggcgagcacatcctcgctctcaaaaaccttaaactggacaaaatggtgggctggctgctccagcaatctgcagctaccctgctcgcaaatcggctgactgagaaatgctgcgtggagaccaaaatgaagatgctcttcctagctaatctcgaatgcgaaaccctgtgccaggctgccctgctcctatgctcgtggcgtgccgccttgtag

SEQ ID NO: 131234 - DNA, 393 bp, Artificial Sequence
  Description of Artificial Sequence: Synthetic coding sequence
atggccgccgttcttggtgccctgggggctacacggcggctgctcgctgccctccgtggccagagtcttggcctcgccgccatgtccagcggaacacatcgcttgaccgctgaagaacggaaccaggccatcctcgaccttaaggcagccggatggtctgaactttccgagcgcgacgccatctacaaagagttcagtttccataatttcaaccaggctttcggattcatgagcagagttgctctccaagctgaaaaaatgaatcaccatccagagtggtttaatgtttacaacaaagtgcagattactcttacctcccatgactgtggggaactgaccaaaaaagatgtgaagctggccaaatttatcgagaaggccgccgcctccgtctag

SEQ ID NO: 131235 - DNA, 393 bp, Artificial Sequence
  Description of Artificial Sequence: Synthetic coding sequence
atggcagctgtgctgggagctctgggtgcaactaggagactactagctgccctgagaggacaaagtctggggttagcggcaatgagctccggcacacacaggctgaccgcggaggagaggaaccaagccatcctagatctgaaggccgctggatggtctgagttatcagagcgcgatgccatctacaaagagttctccttccataacttcaatcaggcattcggctttatgagtcgagtggcccttcaagcagaaaagatgaaccatcaccccgagtggttcaatgtgtacaataaggtgcagattacactaaccagccacgactgcggagaattgactaagaaagacgttaagctggcgaagttcatcgaaaaggcagcagcctcagtgtag

SEQ ID NO: 131236 - DNA, 1041 bp, Artificial Sequence
  Description of Artificial Sequence: Synthetic coding sequence
atggccctgctcaaagtgaaatttgatcaaaagaagcgagtcaaactggcccaggggctatggctgatgaactggttttccgtgctcgccggcattatcattttcagcctcgggttattcctgaaaatcgaactgcggaagaggtccgatgtgatgaataattcggaatcccacttcgtgcccaacagtctaattggaatgggagtgcttagctgtgtattcaacagcttagccggcaaaatttgttatgatgctttggacccagctaagtacgcgcgatggaaaccatggctcaagccatacttggctatctgcgtgctgttcaatataatcctcttcctggtcgccttgtgttgttttctactgcgtgggagtctggaaaataccctggggcagggcctgaagaatggtatgaagtactaccgcgacacagacacccccggccggtgtttcatgaaaaaaactatcgacatgctgcagatcgaatttaagtgctgcggaaacaatggcttcagagattggttcgaaatccaatggattagtaacaggtacctcgatttcagctcaaaggaagtgaaggatcgcatcaagtcaaacgtagatgggcgatatctcgttgacggggttcccttttcttgttgtaatccttcatcaccacgcccgtgtattcagtatcagatcacaaacaacagtgcgcactatagttacgaccaccaaacagaggagttaaatctctgggtcagagggtgtagagctgccctcctgtcttactatagcagtctcatgaattccatgggggtcgtcacactcctgatctggctgttcgaggtaaccatcacaattgggctcaggtatcttcagacttcactggatggcgtttccaatcccgaagaatcagagtcagagtcccaaggatggctgttggaacggtcagtgccagaaacgtggaaggctttcttggaatccgtcaagaagctgggcaaaggcaatcaagtggaggcagagggcgctgatgcgggccaggcccccgaagccgggtag

SEQ ID NO: 131237 - DNA, 1191 bp, Artificial Sequence
  Description of Artificial Sequence: Synthetic coding sequence
atgccgttgttcgaaccacgggtgttcactgcagggagtgaggagagagtgacgtgtttgcccccaaaagggttacccgagccttcagtctggtgggagcacgcaggcgtcagacttccaactcacggcagggtgtaccagaagggccacgagctcgtcctggccaatatcgcagagtctgacgcaggcgtgtatacgtgccacgccgctaatctggctggccaaagacgccaggacgtcaatattaccgtggcaaccgtcccaagctggctgaaaaaacctcaggacagccaactcgaggaaggaaagccgggctacctggactgtctgacacaagccactccaaaaccgaccgtcgtgtggtaccggaatcaaatgctgatttccgaggacagcaggtttgaagtgttccttgcaaaagctcagggactggaagagggcgtggcagaaacactagtgctcgtaaagtcgctgcagagcaaagacgaacagcaacagctggattttaggcgcgagctagagatgtttgggaagctgaaccatgccaacgtcgtgaggctgttggggctgtgccgcgaagcagagccccactatatggtgctcgaatatgtcgatctgggggatctgaagcagttcttgcggatctcaaaatccaaggatgagaagttgaagtcccaacccctaagcactaaacaaaaagtagcactgtgtacccaggttgcactaggcatggaacaccttagcaataacagatttgtgcataaagatttagcagcacgcaattgcctggtctctgcccagcgccaggtcaaagtgtccgctcttggactgagcaaggacgtgtacaattcagagtattatcactttcggcaagcatgggtccctctccgctggatgtccccagaggctatcctagaaggagacttcagtacaaagtcagacgtctgggcattcggtgttctcatgtgggaggtatttacgcatggcgagatgcctcatggaggccaggctgatgacgaagttttagctgatcttcaggctggcaaggctaggctacctcagcctgagggctgtccctctaaactgtatcgtctcatgcagagatgctgggctctcagccctaaggacagaccaagcttttccgagattgcgtctgcactcggcgatagcacagtagattcaaaaccctag

SEQ ID NO: 131238 - DNA, 3093 bp, Artificial Sequence
  Description of Artificial Sequence: Synthetic coding sequence
atgggtgctgcgaggggatccccagctcggccacgacgtctccctcttctgtccgtacttctgttacctctgttgggcgggacccaaacagcaattgttttcattaaacagccgagtagtcaggatgcgttgcaaggacgacgagcactgctccgctgtgaggtagaagctccggggccagtgcacgtgtactggctgctggacggtgcccctgtccaggacacggagcgaagatttgcccaggggagctcgctgtcttttgccgccgtggatcgcctgcaggattcaggcacttttcagtgcgtagcacgcgatgacgtcactggagaggaagccaggagcgccaacgcctcctttaatatcaagtggatcgaagctggccccgtggtgctgaagcaccctgccagcgaagccgaaattcaacctcaaactcaggtcaccttgcgctgccacattgacggacacccgagaccgacatatcaatggttccgggacggaacaccattgtcagatggacagagtaatcacaccgtgtcttctaaagaacgcaatctcactttgcgtcccgccggtcctgagcactccgggctgtactcctgctgtgctcatagcgccttcggccaggcctgttccagtcagaattttacactgtcaatcgcagacgaatccttcgcgagagtggtactggccccccaggatgtcgtcgtggcccgctatgaggaggccatgttccactgccagtttagtgcccagccccctccctcactccaatggctattcgaggacgagacacccatcaccaatcggtcaaggccacctcatctcaggagggctacagtcttcgctaatggatcccttcttctgacacaagtgcgaccgcgcaatgcaggaatatataggtgcatagggcagggacagcgtggtccccctattatcctggaggcaaccctccacctcgcggaaattgaagacatgcctctctttgaaccacgcgtattcacggcgggttctgaggagagagtgacatgcttgccacctaaaggattgccggaaccttccgtttggtgggaacatgccggagtacgtttgcccacgcacgggcgggtttatcaaaaaggccatgagttagtactagcaaatattgcagagtctgacgccggcgtgtatacatgccacgcagctaatctggcagggcagaggcggcaagacgttaatatcacagtcgccactgtaccgtcctggttgaagaaacctcaagactcccagttagaggagggaaagccaggatacctggattgtctgacccaagcaacccccaagcctactgtggtgtggtacaggaatcagatgttaataagcgaagattccagattcgaggtttttaagaatggaacgttaaggataaacagcgtggaggtttatgacgggacctggtacaggtgtatgtctagcacccccgcgggctctatcgaggcacaggcccgcgtgcaggtgctcgacggttctagcttacccgagtgggtgacggataacgcaggaacgttgcacttcgctcgggtgactcgggacgacgccggtaactacacatgtatcgccagcaacggcccccagggccagatccgtgctcacgtccagctgacagtggcagtcttcattacattcaaggtggagccagaacgcacaacagtatatcagggccacacggccctcttgcagtgcgaagcccaaggggaccccaaacccctcattcagtggaaaggcaaagacagaatcctggatcccacaaaactgggaccacggatgcacatcttccaaaatggcagtcttgtcatccacgatgttgctcctgaagatagcgggcgctatacttgcatcgctggtaactcttgtaatataaagcatactgaagctcccctgtatgtagtcgataaacctgtgcctgaagaatcagaaggccccggatcgccccccccttataaaatgatccaaacaatcggacttagcgtcggtgctgccgtcgcttacattatagccgtactgggactcatgttctattgcaagaagcgatgcaaggccaagcgcttgcaaaaacagcctgagggggaggagccggagatggaatgcctcaatgggggtcctttgcagaacggccagccatctgctgagatccaggaagaggtggccctcaccagtctgggcagtggacctgcggccaccaacaaacgccactctacttcagacaaaatgcacttcccgaggtcatctttgcaaccgattactactctgggcaaatctgagttcggcgaagtcttccttgctaaggcccaaggactggaagaaggagtggccgaaacactggtgctcgtcaaaagcctgcagagtaaagatgaacagcaacagctagatttccggagagaactcgagatgtttgggaaactgaatcatgctaatgtagtgcgactcctcggactctgccgcgaggccgagcctcactatatggtgctggaatacgtggacctcggtgacctgaagcaattcctcaggatttcaaaaagcaaggatgaaaaactcaagtcccagcctctgtcaaccaaacaaaaagtggcgctatgtacccaagtggccttaggaatggagcacctgagcaacaaccggttcgtgcataaagatctggctgcccgtaactgtctcgtaagcgcccaacggcaggtcaaagttagtgcactggggttaagtaaggatgtttacaacagcgagtattaccattttcgacaagcctgggtgccactgagatggatgtccccggaggccattctggaaggggacttctccactaagagtgacgtctgggctttcggcgtactcatgtgggaggtatttacacatggtgaaatgcctcatggtggccaggccgacgacgaggtcttggccgaccttcaggctggtaaggctaggttaccccagcctgaggggtgtccctcaaaactgtatcgcctgatgcaacgatgttgggccctttctcctaaagatagacctagcttctctgagatcgctagcgccctgggagactcaactgtggattcaaaaccttag

SEQ ID NO: 131239 - DNA, 2823 bp, Artificial Sequence
  Description of Artificial Sequence: Synthetic coding sequence
atgggggctgccagaggcagtcccgcaaggcctagaagactgccgttgttaagtgtgctgctccttcccctcctgggcggaactcagaccgccattgtgttcatcaaacaacccagcagccaggacgccttgcaaggtcgccgggccctgctgcgctgtgaagtagaagccccaggccccgttcatgtgtattggctgttggatggagccccagtacaggatactgagcgccggtttgcccaggggagctccctcagtttcgcagccgtggatagactgcaggattcaggaacatttcaatgtgtcgcgcgggatgacgtgaccggagaggaagctcggagcgcgaacgctagcttcaacattaaatggatcgaggcggggcccgtcgtgttaaagcaccccgcttccgaagccgagatccaacctcagacgcaggtgaccctaaggtgccacatagacggacacccccggcccacttatcaatggttcagggacggcacacctctaagcgatggccaatcaaaccacaccgtttcatcaaaagagcgcaatctgacgctccggccagccggacccgaacacagcggactgtactcatgttgcgcccactctgctttcgggcaagcctgttcttctcagaatttcacgctgagcatcgccgatgagtcattcgctcgggtggttctggcccctcaagacgttgtagtcgcgcgctacgaagaagccatgtttcactgccaattttctgctcagcccccaccatcactccaatggctttttgaggacgagaccccaataaccaatcgatcaaggcctcctcatctcagaagagctactgtttttgctaatggcagtttactcctcacacaggtgcggcctagaaatgctggtatttatagatgcatcggtcaggggcaacggggtcctcctataatactagaggcaaccctccacctcgcggagatcgaggacatgcctctattcgagcctcgagtgtttacggctggtagcgaggaaagggttacttgtctgcctccgaagggcctgcctgagccaagcgtttggtgggaacacgcgggcgtgaggttgcccacccatggaagagtgtaccagaaaggccacgagctggtcctggccaatatcgcagagagtgatgccggagtgtacacgtgccacgctgctaacttggccggacagagaaggcaggacgtgaacatcactgtggcgaatggttcaagcctgcctgagtgggtgacggacaacgccggcacactgcatttcgcaagagtgaccagagatgacgccggaaactatacctgcattgcttccaacgggccccagggacagatacgcgcgcatgtgcagttgacggttgccgtgtttatcacattcaaggtcgagcccgagagaacaactgtataccagggacacacggcactgctgcagtgcgaagcacagggcgatcccaaacctctcatccagtggaaaggcaaggatagaatccttgaccctacgaaactggggcctcgtatgcacatattccagaatggctcgctggtgattcacgacgttgcccctgaggattccggcaggtatacctgcatagcaggtaactcctgcaatataaagcacactgaagcccctttgtacgttgtagacaagcccgtgccagaggagtccgagggccctggcagcccgcctccttacaaaatgattcagaccatcggcctgagcgttggggcggccgtcgcctacattatcgcagtgttaggtctcatgttttattgcaagaagaggtgtaaagctaagaggctgcaaaagcagccagagggagaggaacctgaaatggagtgccttaatggaggccccttacaaaatggccaaccctccgccgagattcaggaggaggtggctttgaccagtctgggttccggccccgccgcgacaaataagcgtcattccacttccgacaaaatgcatttccctcggagcagtttacagcctattaccacactcggaaagagcgaattcggcgaggtgtttctggcaaaagcccaggggctcgaagaaggggtagcagaaactcttgtgctggtgaagagtctgcagagtaaagacgaacaacagcagctggactttcgccgggagctggaaatgttcggcaaattaaatcacgctaatgtggtgaggttgctcggactctgcagagaggccgaaccacactatatggtccttgaatacgttgaccttggggatttgaaacagtttctgaggatttcgaaatcaaaagacgaaaagctgaaatcccagccactgtcaaccaagcagaaggtcgccctgtgtacgcaggtagctctgggtatggagcacctgagtaataaccgcttcgtgcacaaagacctcgctgcacgtaactgcttggtgtcagcacagcgccaggtcaaggtttctgctcttggtctgtctaaagatgtgtataactccgaatactaccattttcgccaggcttgggtgccacttaggtggatgtcgcccgaggctatattggaaggggacttttcgaccaaatctgacgtgtgggctttcggtgtgctgatgtgggaagtattcactcacggcgagatgccacacggaggacaggccgatgatgaagtactcgccgacttgcaggcaggcaaagctcgcttgccgcagccagagggctgcccaagcaaactgtacagactgatgcagcgatgctgggccctgagtcccaaagaccggccaagcttcagcgaaatcgccagcgcactgggtgacagcaccgtggactcaaaaccttag

SEQ ID NO: 131240 - DNA, 3045 bp, Artificial Sequence
  Description of Artificial Sequence: Synthetic coding sequence
atgggagcagcacgcggcagcccggctcgaccaagacgcctgcctctcctaagcgtattactgctgcccttattgggaggcacacagactgccatagtgtttataaaacagccctcttcgcaagatgccctccaggggcgacgggccctgttgaggtgtgaggtggaagcccccggccctgtacacgtctactggctactcgacggtgcccctgtgcaggacacagagaggcggtttgcccaaggttcctccctcagctttgcagccgtggatagattgcaggactccggcacttttcaatgtgtcgcccgagatgacgtaacaggggaagaggcgagatctgccaatgcttcttttaacatcaagtggatcgaggctgggcctgtcgtccttaaacaccccgcttcagaggccgagatccaaccccagacacaggtgactttgcggtgccatatcgacggacacccaaggccaacctaccagtggttcagagatggcacacctctttccgacggacagagcaatcacacagtgtcatcaaaagagaggaacctcacccttcgtcctgccgggcctgagcattccggcctatacagctgttgcgctcacagcgcattcggacaggcctgctcttcgcagaattttaccctgtccatcgccgatgagagctttgccagagtggtgctggccccccaggatgtagtcgtagctagatacgaggaagccatgtttcactgtcagttcagtgcccagcctcccccttctctccagtggctcttcgaggacgaaacacctattacaaaccgtagccgccctcctcacctgcgcagggcaaccgtgttcgcaaatggatctcttttgttgacccaggtccgcccaagaaatgccggcatctatcggtgcataggccagggccagcgaggtcctccaatcatcctggaggcaaccttgcacttggcggagatagaagatatgcccctgtttgagccacgggtgtttactgctggaagcgaggaacgcgtgacatgtctgccgcctaaggggctgccagagccatcggtgtggtgggaacacgctggagtgaggctgcctacacacggccgcgtctatcagaagggtcatgagctggtgttggcgaatattgccgagtccgacgccggcgtgtatacatgtcacgcagctaacctggccggccaacgcaggcaggacgtaaacatcaccgtcgctaccgttccctcctggctcaagaagccacaggactcacagctagaagaaggaaaacctggctaccttgattgcttgacacaggcaacacccaagcctactgtcgtgtggtatagaaatcagatgcttatctccgaagactccagatttgaggtgttcaagaacggcacactccggataaactcagtggaggtgtacgatggcacctggtacaggtgcatgtcttcgacgccggccggttccatagaggctcaagcgagagtgcaggtgctcgaaaaacttaagttcactcccccgccacagccccagcaatgcatggaattcgacaaggaggccaccgtcccatgtagcgccaccgggcgcgaaaagccaactatcaagtgggagcgagcagatgggtcatctctcccagagtgggtgacagataatgccggcactttgcatttcgctcgcgtgacgagggatgacgccgggaattatacctgtattgcttcaaacggcccccaggggcagattagagcgcacgtgcagctgaccgtggcagtatttatcactttcaaagttgagcctgaacgtactactgtttaccagggacacaccgcacttttgcagtgtgaggcccagggagacccaaagcctttgattcaatggaaggacaagcccgtgcctgaggagagcgaggggcccgggtccccacccccatataaaatgattcagaccatcgggctatccgtgggggccgcggtggcatatatcattgctgtgctcggcctgatgttctactgcaaaaaacgctgtaaggccaaacgcttgcagaaacagcccgaaggggaggagcctgagatggagtgtttgaacggcggccccctacagaacggacagccaagtgctgagatccaagaggaagtggcattgacatcccttggctcgggcccagcagcaactaataagcgtcatagtacctcggacaaaatgcattttcccagatcttccctgcagccaatcacaacactaggcaagtctgagtttggggaggtatttctggccaaagctcagggccttgaggagggagttgccgagactttggtgctggtcaaatctttacagagcaaagatgaacagcaacagttagattttcgcagggagttagaaatgttcggcaaactcaaccacgctaacgtggtgagactcctcggtctgtgccgcgaagctgagcctcattatatggtgctggagtatgttgacctgggtgaccttaaacagttcctcaggataagtaaatcaaaggacgagaagctgaaaagccagcccctttccaccaaacagaaggtggccctgtgcacccaggtggctcttggaatggagcatctcagcaacaataggttcgtccacaaagacctagctgctcggaactgcctggtctcggctcagcgtcaagtgaaggtgtcggccctgggcctcagtaaggacgtttacaatagcgagtattatcactttcgccaggcatgggtgccactaaggtggatgtcccctgaagccatattagaaggggacttctctacaaaatcagatgtgtgggcattcggtgtgctgatgtgggaagttttcacacatggcgaaatgccacatggcggccaggcagatgacgaggtactcgctgatctacaggctggcaaggctcgactaccccagcctgagggttgtccatctaaactctaccggctaatgcagagatgttgggcattgtcaccaaaggataggcctagcttctcggaaattgccagcgccttgggtgattccacagtggattccaagccgtag

SEQ ID NO: 131241 - DNA, 1212 bp, Artificial Sequence
  Description of Artificial Sequence: Synthetic coding sequence
atgggtagcttccttagcggggaaaaacgaccaagcgcccctacagtcggatccgcaatggaaaaaaaagaatttcccacgcctcctggtcgagttggaccagggacccagacagcgatcgtgttcatcaagcagccctcttctcaggatgctcttcaggggcgccgcgcacttcttagatgtgaagtggaggcacccggacctgtccacgtgtattggctcctcgatggcgcccctgtacaggacactgaacgacgctttgctcagggttcgtccttatccttcgctgctgtggatcggcttcaggatagtggcacattccagtgcgtcgcccgcgatgatgttactggcgaagaggccaggagcgctaatgcgtcttttaacattaagtggattgaagccggtccggttgtcttgaaacatcccgcaagcgaggccgaaatccagccccagactcaggtgacgctcagatgtcatattgacggccatccaagaccaacgtatcagtggttccgtgacgggaccccactctctgacggacaatctaatcataccgtgagctcaaaagagcgaaatctcaccttgagaccggccggccctgagcactccggtttgtattcctgctgcgcgcatagtgccttcggccaggcttgcagttcacaaaattttaccctgagtatcgcggacgaaagttttgcgcgtgtggttctggccccgcaggatgttgtcgtggccagatacgaagaagccatgttccattgccagttttccgcccagcctccgccatccctgcagtggttgtttgaagatgaaactcccattacaaatcgatctcggcccccccatctccgccgtgcaacagtctttgctaacggaagtctgctgctcacacaggtacgaccccgaaatgccggaatttaccggtgtattggtcagggacagcggggacctcctataatcctggaggcaactctgcatctcgctgaaatcgaggatatgcctctgtttgaacctcgagtctttaccgctggatctgaggagagggtgacttgtcttcctccaatggcagggagtactcgtcgcgcaacgagttggtgttggccgatcttgttgaaagtaatgttggtcagcactcccgctacaagacccacttggctggtatcaggggatcgaatgtcaacctcgctgtggccactgtgtccccccggctag

SEQ ID NO: 131242 - DNA, 810 bp, Artificial Sequence
  Description of Artificial Sequence: Synthetic coding sequence
ttctcagctcagccccctcccagtttacagtggctttttgaagacgagacccccattacaaaccgaagccgccccccacatctgaggcgagccacagttttcgccaacggtagcctactgctgacccaggtccgccctcgtaacgcagggatctaccggtgcatcggtcagggacagaggggacctccgatcatactcgaggcaactctgcacctggctgagatcgaagacatgcccttgttcgagcccagggtcttcacggccggctcagaagaacgggttacctgcctgccaccaaagggtctgccggagcccagcgtctggtgggaacatgccggagtccgcctgcccacacatggccgtgtataccaaaagggacacgagctagtactcgcgaacattgctgagtcagatgcgggtgtctatacttgccatgccgcaaatctggctggccagcgccgccaagatgtaaacattacagtggcgtcagagcatctctgccccgagggccagggggaggtggaaggaaatacaggtttgggggttatggatcgtggatttcccgccgttcccagctggctcaagaaaccccaggattcgcagctggaagagggaaagcctggctacttggactgcttgactcaagccactcccaagcctactgtcgtttggtaccggaatcagatgctcataagcgaagacagtcgcttcgaggttttcaagaacggtacactgcggattaattcagtcgaagtatatgacggaacttggtatagatgtatgtcaagcacgcctgccgggagcatttag

SEQ ID NO: 131243 - DNA, 444 bp, Artificial Sequence
  Description of Artificial Sequence: Synthetic coding sequence
atgggcgcgacaggcttgggcttcttgctatcttggcgccaggataatttgaacggcacagattgtcagggttgcaatatcctgtacttttctgagactaccggcagcatgtgtagtgagctgtccctgaaccggggtctcgaagctaggcgaaaaaaggacctgaaagacagttttctgtggcgctacggaaaagtgggctgtatctctctccccttgagggagatgacagcatggatcaacccgccacaaataagcgagatatttcagggatatcatcagagagtgcacggggccgatgcactgtccctgcagaccaatagcctccggtcacgtctaagttctcaatgcctcggccaaagttttctcctgaggacgcttgagaggggccgggggttccgagcactgggagatatctgtgggcacgtgcacgaggaggactag

SEQ ID NO: 131244 - DNA, 216 bp, Artificial Sequence
  Description of Artificial Sequence: Synthetic coding sequence
atgggtgccacaggtttgggttttctgctgtcctggaggcaggacaatctcaacggcaccgactgtcaaggctgtaacattctctacttcagtgaaactactggatctatgtgcagcgaactttctctcaacagaggactcgaggcccggcgcaagaaggatttaaaagatagcttcctgtggagggatggagtcagcccatgtctaccgtgctag

SEQ ID NO: 131245 - DNA, 444 bp, Artificial Sequence
  Description of Artificial Sequence: Synthetic coding sequence
atgggagcgacaggactcgggttcctgttgtcttggcgccaggacaaccttaatggcacagattgtcagggctgtaatattctatattttagcgaaaccactggcagcatgtgctctgaactgtcccttaacaggggtctagaggcacgacgcaaaaaggacttgaaggattctttcctgtggagatacgggaaagtcgggtgtattagtctccctttaagggaaatgacggcctggattaacccccctcagatcagcgagatcttccagggataccaccagcgcgttcacggcgcggatgccctctccctccagacaaactccctgaggagccggctttctagccagtgtctcggtcagtctttcttgctgagaaccctagaacgcggccgcgggtttcgcgcattaggtgatatttgcggccacgtccatgaggaggactag

SEQ ID NO: 131246 - DNA, 216 bp, Artificial Sequence
  Description of Artificial Sequence: Synthetic coding sequence
atgggggccaccggcctcggattcttgttaagctggaggcaggataacctcaacggcacagactgccagggttgcaacattctgtacttctccgagacgaccggttctatgtgtagcgaacttagtcttaaccgtggcctggaggcaagacgaaagaaggatctgaaggactcgttcctctggagagatggtgtgtccccctgtctcccttgctag

SEQ ID NO: 131247 - DNA, 3561 bp, Artificial Sequence
  Description of Artificial Sequence: Synthetic coding sequence
atgtccgtggcttgcgtgttgaagagaaaagccgtgttgtggcaggatagtttttcaccacacctgaaacaccaccctcaggagcccgctaaccccaacatgcctgtagtcctgactagcggcaccggctcacaggcacagccgcagcccgctgctaatcaggcactcgctgccggaacccattcatcgcctgtacccggaagtattggcgtggcaggccgatctcaggatgacgcaatggtggattacttcttccagagacaacacggcgaacagttaggaggtggcgggtccggcggtggaggctataacaacagcaagcaccggtggcctaccggcgacaacatccacgccgagcaccaggttaggagcatggatgagttaaaccacgactttcaagctctggctcttgaaggcagggcgatgggtgaacagctgctgccagggaaaaagttttgggagactgatgaaagctcaaaagacggccccaaaggtatcttcctcggagaccaatggagagactccgcctggggcaccagcgaccactcggtgagccagcccattatggtgcaacggagacctggccagagcttccatgtaaattccgaggtaaactccgtgctttcaccccgttccgagtcaggcgggctgggcgtttctatggtggagtacgtgttatccagcagtcctggagattcatgcttgcgcaaagggggattcgggcccagagacgccgattccgatgagaacgacaagggagaaaaaaagaataaggggacgtttgacggggataaactgggcgaccttaaggaagaaggggacgtgatggacaaaacaaacggactgccagtacagaacggcatagacgccgatgttaaagattttagccgcactcccggcaattgtcagaacagcgcaaacgaagtggatcttttgggacccaatcagaacggcagcgaggggctggctcagctgacatcaacaaacggagctaagccagtggaagatttcagtaacatggagtcacagagcgtgcctctagatcctatggagcatgtgggaatggaacccctgcagtttgactactctggaacacaagtcccggtcgattccgctgccgccactgtgggcctgtttgattacaattctcagcagcagctgttccagcgaccaaacgctctggcagtgcagcaactgacagctgcccagcagcaacagtacgcattagcagcagctcaccaaccccatatcggactcgctccagcagccttcgtgccaaacccatacatcatctcagcagcccccccgggcacggacccgtataccgcaggcctagccgccgctgctacattggggccagccgtggtaccacaccaatactacggcgtaaccccatggggtgtctatcctgcttcactgtttcaacagcaggcagctgcggctgccgctgctaccaactctgccaatcagcaaacaacaccacaggctcagcagggccaacagcaggtgctgaggggcggagcctcacagagacctttaacgcccaatcagaaccagcagggccaacagactgaccctctcgtcgcggctgccgccgtgaacagcgcactggcatttggtcagggtttagcagccggcatgcccggctatcccgtcctggcgcccgctgcttactacgatcagactggggcactggtcgtcaacgctggcgccagaaatggcctgggcgcccccgtgcgcctggtggcacccgcccctgtgattattagcagttcggccgctcaggccgctgtagccgcagctgccgcctcagcaaatggagctgcgggaggcttagcaggcacaacaaacggtccatttagacccctcggtacccagcagcctcagcctcagcctcaacagcagcccaacaacaatttggcgagctcatcgttttacggcaacaatagtctgaactccaacagccagagcagttcactgttcagtcaaggtagcgcccagccagcaaacaccagccttggatttggaagcagctcaagtctgggcgctactcttggtagcgcactggggggtttcggcactgcagtggccaacagcaacacaggcagcgggagccgccgcgacagcctgacaggatcgtcagacctatataagcgaacctcatcctctcttacccctattggtcacagtttctataacggcttgtctttcagctcaagtcctgggccagttggcatgcccctgccgtcccagggtcccgggcacagtcagacccctccacctagtctctcctcccacggttctagcagtagcctgaatttaggcggattaacaaacggcagcggtaggtacatttctgcggcccccggagcggaagctaagtatagatcggcttccagcgcatcttccttgttttctccaagttctaccctgtttagctcctccagattgcgatacgggatgagcgatgtcatgccatcaggccgctcacgcctgctagaggacttccggaacaaccgttaccctaacctacagctgcgagagatcgccggccatatcatggaattctctcaggatcagcatggctcccgctttattcagctgaagctcgagagggccacacctgccgaacggcaactggtgtttaatgagattttacaggccgcgtatcagttaatggtcgatgttttcgggaattatgtcattcagaaatttttcgagtttggctctctcgagcagaaacttgccctggcagaacgcatacgaggccacgttctgagcctggccctgcagatgtacggttgtagagttatccagaaagccctagagttcattccctcagaccagcagaatgaaatggtgcgcgaactggatgggcacgtcctcaaatgcgttaaagaccagaacggcaatcacgttgtacaaaaatgcatcgagtgtgtccagcctcagtccctacaattcatcatagatgcatttaaaggccaagtcttcgcgctgagcactcacccatacggctgccgggtgatccagaggattttggaacactgcctgccagatcaaactctgcctatcctggaagagctgcaccaacatacagaacagttagtacaagatcagtacggtaattatgtgatccagcatgttctcgagcatggtcgccccgaggataaaagcaaaattgtggctgagatacgggggaacgtgttggtcctgagccagcacaagtttgcaagtaatgttgtcgaaaagtgcgtcacacatgcctctagaactgagcgcgccgttttaattgacgaggtgtgcacaatgaacgacggcccacactctgctctgtacaccatgatgaaggaccaatacgcaaactacgtggttcagaaaatgatcgatgtcgccgagcctggacagcggaagatcgtgatgcacaagattaggccgcatattgccaccctgcgaaaatatacatatggcaaacatattctggccaaactggagaagtattacatgaaaaacggcgtggatctgggccctatctgcggacccccaaacggaataatctag

SEQ ID NO: 131248 - DNA, 2781 bp, Artificial Sequence
  Description of Artificial Sequence: Synthetic coding sequence
atgtccgtagcatgtgtgctgaaacgtaaagccgtcttgtggcaggatagctttagcccacatctaaagcaccacccacaggagcccgccaatcccaacatgcctgtggtcttaacctccgggacaggtagtcaggcacagccccaacctgctgccaaccaggctctggctgcgggtacacattcttcgccggtcccagggtcaatcggcgtggccggacggagtcaggatgacgctatggttgactacttttttcagaggcagcacggagagcagctgggtggcggaggctctggtggtggggggtacaacaacagcaaacatcggtggcccacaacagttggtttattcgattacaatagtcagcagcagttgttccagcgccctaacgcattggcagtgcagcagttgaccgccgcccagcagcagcaatacgccttagccgctgctcaccagccccacattggcctggctcccgccgctttcgttcccaatccatacattatctcagctgccccgccgggcacagatccctatactgcgggtctggctgccgccgcaactttggggcccgccgtggtgccccaccagtattatggcgtaactccgtggggagtctacccggcttcactgttccaacagcaggccgccgccgccgcagccgccacaaatagtgctaatcagcagactacacctcaggctcagcagggccaacagcaagtactgagagggggcgcttcccagcgccccctgacccctaatcagaatcagcagggccagcagacagatcctttagtcgccgccgctgctgtgaactctgccttggctttcggccaggggttagccgccggcatgcctggataccccgtccttgcaccagcagcctactacgatcagacaggcgcccttgtcgtaaacgctggggcacggaatgggctgggcgcccctgtaaggctcgtagcaccagcacctgtgattatctctagcagcgccgcccaggcggccgtggcagccgcagccgcttccgctaatggggctgctggcggtctcgcaggcacaacaaacggaccctttcggccactgggaactcagcaaccgcagccccagcctcaacaacagcctaacaacaatctggcatctagctccttttacggcaacaatagcctgaattctaacagtcaatctagcagccttttctcacagggatctgcccagccggccaacacttccctcggttttggatccagctccagcctgggggccacactggggagcgcccttggaggcttcggcactgcagttgcaaacagcaacaccggctccgggtctcgcagagatagcttaaccggatcatcagacctatataagaggacatcatcatctttgaccccgatagggcactctttctacaacggtctatccttctcatccagtcccggccctgtgggtatgcccttgccctcccaggggccaggtcacagccagacaccgcctccatctttaagctcacatggctccagttctagtttgaacctcggcggattaactaatgggtcagggaggtatatttctgccgctcccggagctgaagccaaataccggagtgcttcaagtgcctcatccctgtttagtccatcatcgaccctctttagttcctcccgcctgagatacggtatgtcagatgtaatgccttctgggaggtcccgcctccttgaggacttcagaaataaccggtacccaaacctccagctgcgcgagatcgctggccacatcatggagttctctcaggatcagcatggcagcagatttatccagctgaaactggagagagccactcccgccgagcggcagctggtctttaatgaaattcttcaggccgcctaccagctaatggttgatgtgttcggcaactacgtgatccagaagttttttgagttcggaagcttagagcagaagctcgctctagccgaacggatccgtgggcacgtgctcagtttggcactacaaatgtatgggtgtcgggtaattcagaaggccctggaatttattcctagtgatcagcaggtgattaatgaaatggttcgagaactggacggacacgtcctgaagtgtgtcaaggaccagaatggcaaccatgtggtgcagaagtgtatcgaatgcgttcagcctcagtctctgcagtttataattgacgcgtttaaaggacaggtcttcgccctctctacccatccctatggatgtcgtgtgatccaacggatcctggaacattgcctcccagatcagacactgcccatactggaagaacttcatcaacacacagagcagctggtccaggatcagtatggcaactacgtcattcagcatgtcctggagcacggacgccctgaagataaatcaaaaattgttgccgagattcgagggaatgtgcttgtcctgtctcagcataaattcgcttccaacgtggtcgagaagtgcgtgacccacgccagcaggacagagagggcagttttgatcgatgaggtttgtactatgaacgacggcccacactccgccttgtacaccatgatgaaggatcagtacgcaaattatgtcgtacagaagatgatcgacgtcgctgagcccggccagcgcaagattgtgatgcataagatccggccacatatcgcgacacttagaaaatatacttacgggaaacacatattagccaagctcgagaagtactacatgaaaaacggcgtggacctgggccctatttgtggacccccaaatgggattatttag

SEQ ID NO: 131249 - DNA, 3135 bp, Artificial Sequence
  Description of Artificial Sequence: Synthetic coding sequence
atgagcgtggcctgtgtgttgaagagaaaggccgtcctgtggcaggattcatttagcccacatctgaagcatcacccacaagaaccagctaaccctaacatgccagttgtgctgacaagcggcacgggtagccaagcccagcctcaacccgctgcaaatcaagctcttgcagccggcacccatagcagccccgtgcctgggtccattggagtcgcaggtcggagccaggatgatgcgatggtggactacttcttccagcgccagcatggtgagcagctcggcggaggcggcagtggaggtggcggttacaacaattcaaagcacagatggcccaccggggataacatccacgccgagcatcaggttcggtctatggatgagctgaaccatgattttcaggcactagctctcgaagggcgtgccatgggagagggaccacgcgacgccgactctgacgagaacgacaagggcgagaagaagaataagggcactttcgacggggacaagctgggtgatctcaaggaagaaggagacgtcatggataaaaccaatggcttaccagtgcagaatggcatcgatgccgatgtcaaagatttcagccgtacccccggcaactgtcaaaactccgctaacgaggtcgatctcttaggacctaaccagaacgggtcagagggactggcccaactgacttctaccaacggcgctaaaccggtggaggattttagcaacatggaaagccagagcgtgcccctcgaccctatggagcacgttgggatggagcccctccagttcgactacagcggcactcaggtacccgtggattccgccgcagccacggtcggcctgttcgactataattcccaacaacaactgttccagagacccaacgctcttgccgtgcaacaattaacagccgcccagcagcagcagtacgctctggctgccgcccaccagcctcacatcggtctagccccagcggctttcgtgcccaatccttatatcatttccgcggccccacctggcacggacccctacacagcaggcctagcagccgcggctactctgggccctgcagtggtccctcaccagtactacggtgtgacaccatggggcgtgtatcctgcgtcgttgtttcaacaacaggcagctgccgccgccgctgccacgaactcagctaatcagcaaacaactcctcaggcccagcagggtcaacagcaagttctacgcgggggggctagtcagcgaccactgactccgaatcaaaatcagcaaggccaacagacagatcccctcgtagcagcagctgccgtgaacagcgcgctagccttcggtcagggcctcgctgctggaatgccagctgtcgccgccgccgccgccagcgcgaacggtgccgccggtggcctggcaggtaccacaaatggaccattccgccctctgggcacgcaacaaccccaaccccagccccagcagcagcccaacaataacttggcctcttcttctttttatggtaacaattccctgaacagcaattcccagagttcttccttgttcagtcaagggtccgcccagcccgcaaacacaagcctcggcttcggctccagtagcagcctgggcgcaactctaggatcggcattggggggattcggcacggcggtcgcaaactcgaacaccggttctggaagccgacgtgactcgctgacgggtagctcggacctctacaagaggacaagttccagtctcacaccaattggccactcattctataacggactgagcttttccagttctccaggcccagttggaatgccactgcctagtcaaggtcccgggcatagtcagaccccgccgccttccctctcaagtcacggaagttcaagctccctgaacctggggggtctgactaacggttccgggcggtatatttcagccgcaccgggagcggaagctaagtatcggtccgccagtagcgcatcttccctgtttagcccttcaagtacacttttttcctcctctcgcctccgatacggcatgtctgatgtaatgccatccgggagaagcaggctgctcgaagacttccggaacaaccggtacccaaatttgcaactgagagaaatcgctggacatatcatggagttctctcaagaccagcacggctcgcgcttcatccagctgaaactggagagggcaactcctgcagaaaggcagttggttttcaatgaaatattacaagcagcgtatcagcttatggtggacgtgtttggcaattacgtgatccagaaattcttcgagtttgggtctctggaacagaaactcgcgcttgctgagagaatcagggggcatgtgctgtctttagcgctccaaatgtacgggtgccgagtcattcagaaggccctggaatttattccaagtgaccagcaggtgattaatgaaatggtgcgcgagctggacgggcacgtcttgaagtgcgtgaaggaccagaatggcaaccacgtggtccagaagtgcattgaatgtgtacagcctcaaagtctacagtttatcatcgatgctttcaagggccaggttttcgccctctcgacccacccctacgggtgccgggtcattcagcgcattctcgaacattgtttacctgatcagacattgcctattttggaggaattgcatcaacacaccgagcagctggtgcaggatcaatacgggaactatgtcatccagcacgtcctcgagcatggcagaccagaggacaaatctaagatagtcgcggagattcgggggaacgtgttggttcttagccaacataagttcgcctctaatgtagtggaaaagtgtgtgacacacgcttcacgcacagaaagagctgttctgattgacgaggtatgcacaatgaacgacggcccccactctgccctgtacacaatgatgaaagatcagtacgctaactacgtggttcagaagatgattgacgtggcagagcccgggcagcggaaaatcgtcatgcacaaaattaggcctcatatcgcaactctaagaaagtatacatacggcaaacacatccttgcaaaattagagaagtactacatgaagaacggtgtggacctggggccgatctgtggtcctccaaacggtatcatctag

SEQ ID NO: 131250 - DNA, 3567 bp, Artificial Sequence
  Description of Artificial Sequence: Synthetic coding sequence
atgtccgtcgcctgcgtgctgaagagaaaggctgtactctggcaggattccttttccccacacctcaagcaccacccacaggaacctgctaatccaaatatgcctgtcgtgctgactagcgggacaggctcccaggcccagccacagcctgccgccaatcaagcgctcgccgccggcactcattcaagtccagtgcccggatccatcggcgtggccgggcgatcccaagacgatgcaatggtggattatttctttcagcgccaacacggcgagcaactgggaggcggagggagtggcggtggaggatataataattcaaagcacaggtggcccactggcgataatattcacgccgaacaccaagtgcggtccatggatgagttaaaccacgattttcaagcactggccctagaagggcgcgcgatgggcgagcaactgctcccaggtaagaagttttgggagaccgatgagtccagcaaggatggtcccaaagggatttttctgggcgatcagtggagagacagcgcatggggcacaagcgaccactcggtgtcgcagcccataatggttcagaggcgtcctgggcagagtttccacgtcaattccgaagtgaattccgtcctgagtcctcggtctgaaagtggggggctcggagtctcaatggtggaatatgtgctgtcctcttcccccggagactcttgtcttcggaaaggagggtttggacccagagacgccgactctgacgagaacgacaagggagaaaaaaaaaataaaggaactttcgacggcgacaagctgggcgacctgaaagaggagggggatgtcatggataagaccaatgggttgcccgtccagaacgggatcgacgccgatgttaaggacttttccagaacacccggaaactgccagaacagcgctaatgaggttgacttattagggcctaaccagaacggaagcgagggcttggcccagctaacctcaaccaatggagcaaaacctgtggaagacttcagtaacatggagtcacagtccgttcctcttgacccgatggagcatgtcggaatggaacccctgcaatttgactattccggcacacaggtgcctgtggatagtgcagccgccacagtgggcctttttgattacaacagccaacagcagctgttccagcggcccaacgcgctcgccgtgcagcagctcacagctgcccaacagcaacagtatgcacttgctgccgcccatcagccccatatcggtctggcaccagcagcctttgtaccgaacccttacataatctcagcagcacccccgggaactgacccctataccgcaggactcgctgcagcagccactctcgggcctgccgtggtgccacatcaatattatggcgttactccatggggggtgtatcccgcaagcctcttccagcagcaggcggcagctgcagcggctgcaacaaacagcgctaatcagcagactactccccaggcccagcaggggcagcagcaggtgctgcgcggcggtgcatctcagagaccgttgacgcctaatcaaaatcagcaaggacagcagacagatcctctagtcgccgcagccgccgttaatagcgccttggcctttggacagggcttggctgccggaatgccaggatacccggtgctcgcccctgcagcctactacgaccaaaccggcgcattggtcgtcaatgccggtgccaggaacggccttggagctcctgtgagactagtcgcaccagctccagtgattatttcaagctcagccgcacaggctgcagtggctgctgcggcagcctctgctaacggcgctgccgggggattggcaggcacgactaatggcccatttcgccccctgggcacacagcagcctcagcctcagccccagcagcaaccaaacaataacctcgcatcatcctccttctatggaaacaacagtctgaattcaaatagccagtcctcctcccttttctctcagggcagcgcccaaccagccaatacctctctgggttttgggagctcatcgagcctgggtgctaccctcgggagcgccctgggtggcttcggcactgctgtggccaacagcaacaccggctctgggagccggcgggactcactaactggctcttccgacctgtacaagagaacttcctcttctcttacacccatcggccacagcttctacaatgggctcagtttttccagtagtccaggaccggtcggtatgcccctgccaagccaaggtcctggccactcccagacccctcctccttcactgtcctcacacgggtcctcgtcctcgctaaacctcgggggccttaccaatggtagcggccgctatatctcagccgccccaggcgcggaggctaagtaccgaagcgcctctagcgccagctctctgtttagtcctagctccaccctgtttagcagtagcaggctccggtatgggatgtctgatgtcatgcccagcggacggagtaggctgctggaagacttccggaataaccggtacccgaaccttcagctgcgcgaaatcgcaggacatattatggagtttagccaggatcagcacgggtctcgtttcattcagctgaagctggagcgcgccacacccgcggaacgacagctcgtcttcaacgaaatcctgcaagctgcataccaactgatggtcgacgtgttcgggaactatgtaatccagaaattcttcgaattcggttcactggagcagaaactggccttagctgaacggattagaggtcacgttcttagcctggccctccagatgtacgggtgtagagtgatccagaaagctctagaatttattccgtcagaccagcaggtcattaatgaaatggttagggagttggatggtcatgtcttgaaatgtgtcaaggaccagaatggaaaccacgtggttcagaagtgcatcgagtgcgttcagccacaaagcctgcagttcattattgacgcctttaagggacaagtgtttgccctgagcacgcacccgtatggctgccgggttatccaaagaattttagaacattgtctgccagatcagacattacctattctggaggagctgcatcagcatactgagcagctcgtccaggatcagtatggcaattacgtcatccagcacgtgctggaacatgggcgcccagaggacaagagcaagatcgtcgctgaaatcagggggaatgtgcttgtgctcagccaacataagtttgcatcgaatgtcgtggagaaatgtgtgacacacgcctctcgtaccgaacgggccgttttgatcgacgaggtgtgtaccatgaatgacggcccccattctgccctgtacaccatgatgaaggatcagtacgcaaactatgttgtccagaagatgatagacgtggcagaacctggacaaagaaagatcgtaatgcacaagatccgcccacacatcgccacgttacggaagtatacatatgggaaacatatcctagccaaactggaaaagtattacatgaagaatggggtggatctggggcccatatgcggccctccaaacggcatcatatag

SEQ ID NO: 131251 - DNA, 3489 bp, Artificial Sequence
  Description of Artificial Sequence: Synthetic coding sequence
atgtcagttgcatgtgtccttaagaggaaggctgtcctctggcaggattcattcagcccccatctcaagcaccacccccaggaacccgccaacccaaatatgccggtagttttgactagtgggacaggatcgcaggctcagccacagccggccgcgaaccaggccctggccgcaggaacgcactcctctccagttcccggcagtattggcgtagccggtcgctcccaggacgatgcaatggtcgactatttcttccagaggcaacacggtgaacaactgggcggcggcggtagcggcgggggaggatataacaattctaagcacagatggcccacaggcgacaacattcatgccgaacatcaggtcagatccatggacgagcttaaccacgacttccaagctctcgcactggaaggcagagccatgggagagcagctgctcccaggcaaaaagttttgggaaacagacgaaagctcgaaggatggtcctaaaggcatctttctgggtgaccagtggagggatagtgcgtggggcacatccgaccatagcgtttcacagcctatcatggtgcagcggcgcccaggacagagctttcacgtgaattcagaggtgaatagtgtcctgtctcctcgaagcgagagcgggggcctcggcgtgagcatggtcgagtacgtgctctcgtctagtcctggagatagctgtttacgaaagggtggttttgggccacgggatgccgactcagacgagaacgacaaaggcgaaaagaagaacaaaggaacctttgatggtgacaagttaggcgatttgaaggaggagggcgacgttatggataagacaaacggcctgcctgtacagaacggaatagatgcggacgtgaaggacttctcacgcacccccggcaactgccaaaacagcgcaaacgaggttgacctcctgggcccaaaccagaatggctctgagggactggcacagcttaccagcaccaacggagcaaagccagtggaggacttcagcaacatggaatcccaatccgtgcccttagatcccatggagcacgtaggtatggaacctttacagttcgactacagtgggacccaggtgccagtggactcagctgccgcaactgtagggctctttgactacaactctcaacaacagctgttccaaaggcccaatgccttagctgtacagcagttaacagccgcccagcaacagcaatacgccctggcagccgcccaccagcctcacattgcaggccttgctccggcagcatttgtacccaacccgtacatcatcagtgccgccccccctggcaccgacccgtacacagctggcctggctgcagctgctaccttggggccggccgtagtacctcatcagtactatggggtgacaccttggggggtgtacccggcctcgctgttccagcagcaagctgccgccgccgcggcagcaacgaatagcgccaatcagcagaccacccctcaggcacaacagggtcagcagcaagtgctgagaggaggagcctcccagcgacctctcacaccaaatcagaatcagcagggacaacagactgatcctctggtagccgctgctgctgttaactccgccttggcttttgggcagggcctcgccgcgggcatgcctgggtatccagtgctcgcccctgccgcctactacgaccagacgggcgccttggtggtgaacgccggcgcccgaaatggactgggcgctcctgttcgcctagtggcccccgcccctgtcatcatttcttcatcagccgcccaggctggcacccaacagcctcagcctcaaccccagcaacagccgaacaataatttagcctcttccagtttctatggtaacaatagcctcaacagcaacagccagtcctcgtccttgttctcgcaggggagtgcacagcctgctaacacttctctgggcttcggttccagttcttccttgggagcaacccttggaagcgctctgggcggattcggtactgccgtggccaatagtaataccggttccggcagccggagagactctctaaccggtagctcagacttgtacaagcggacctctagttctctgactccaatcgggcattcattttataacggactcagcttttctagctcccctggccctgttggtatgcccctccctagtcaggggcccgggcactcccagacacctcccccgtccctttcttcacatggctctagcagcagcctgaacctcggaggcctgactaacggcagcggtaggtacatctccgccgcacctggggcagaagctaaatataggagcgcgtccagcgccagctccctgttctcaccaagcagcacccttttttcctccagcaggttgaggtatggaatgagcgacgttatgccatccggaagaagcagactgcttgaggattttcgcaataaccggtatcccaacctccagctccgagaaattgcaggacatatcatggagttcagccaggatcagcatggctctagattcatacagctcaaactcgaacgcgctactcccgccgaaagacaactcgttttcaacgagatattgcaggccgcttatcagctgatggtggatgtgttcggcaactatgtaatccagaagttttttgaatttggatccctggagcagaaactggccctggccgaacggatcaggggacatgtcctttcgctggccctacagatgtatggatgcagggttattcagaaggccctcgaatttattccaagcgaccagcaggttattaacgaaatggttcgcgagctcgatggtcacgtcttaaagtgtgtgaaagaccagaacgggaatcatgtggttcagaaatgtattgaatgcgtgcagccccagagcctgcagttcattatcgatgcctttaaaggacaggtgtttgcactttcaacccacccgtatggctgcagggtcatccaacgtatccttgaacactgcctgcctgatcagactctccccatcctggaagaacttcaccagcatactgaacagctggtccaagatcaatacgggaactacgtgattcagcacgtgcttgagcacggcaggcccgaagataaatcgaagatcgtcgctgagatccgggggaatgtactggtcttgtcccaacacaagtttgcctctaatgtagtggaaaaatgtgtaacccacgcctctcgcacagagcgtgctgtgctgatcgatgaggtctgtacaatgaacgatggtccccacagcgcgctttatactatgatgaaagaccagtacgctaactacgtagtacagaaaatgattgatgtcgccgagcctgggcaacgaaaaattgtgatgcacaaaattcgcccacatatagctaccttgcgtaaatatacttacggaaaacacatccttgccaaactggaaaagtactatatgaaaaacggtgtggatctcggccccatctgcgggcctcccaacggaattatttag

SEQ ID NO: 131252 - DNA, 291 bp, Artificial Sequence
  Description of Artificial Sequence: Synthetic coding sequence
atgtctgttgcttgtgtactgaagcggaaggccgtgctgtggcaggacagttttagtcctcatctgaagcatcatccccaggaaccggccaaccctaacatgccagtcgttctgactagcggaaccggcagccaggctcagccacaacccgccgcaaatcaggctcttgctgccggtacccattccagccccgtgccaggctccattggcgttgctgggcgcagtcaggacgatgctatggtggattacttcttccagcggcagcatggtgagcagctgggcgggggttag

SEQ ID NO: 131253 - DNA, 1551 bp, Artificial Sequence
  Description of Artificial Sequence: Synthetic coding sequence
atgagtgtggcatgtgtgctgaagcgcaaagcggtgctctggcaggactcctttagcccccatcttaagcaccacccacaggagcccgctaaccctaacatgcccgttgtcctgacaagcggtacaggatcacaagcgcaacctcagcctgcggccaaccaggcccttgctgccggcacacattccagtccagtgcctggatccatcggggtggccggacgctcccaggacgacgctatggtggattatttctttcagcggcaacacggcgaacagctgggcggcggaggcagcgggggcggaggatataataattccaagcacagatggcctaccggggataacattcacgcagaacatcaggtgagatccatggacgaattaaatcatgactttcaagcccttgcgctggagggccgggcgatgggggaacaactcctgccaggtaagaagttttgggagaccgacgaatcctcaaaggacggcccgaaaggcattttcctcggagaccaatggcgggactctgcctggggcacctcggatcactctgtctctcagcccattatggttcaacggaggcccggccagtcattccacgtaaattctgaggtcaattcggtgttgagtccccggtctgagtctggcggtctgggtgtaagtatggtggagtatgtcctctcatcaagccccggagactcatgcctgaggaagggcggatttgggccccgggatgcagactccgacgaaaacgataaaggggaaaagaaaaacaaaggcaccttcgacggcgacaaattaggagatctgaaggaagagggcgacgtcatggacaagactaatggccttccagtccagaacggcatcgatgcagacgtgaaagatttcagtcgcacccctggcaactgccagaattccgcaaatgaagttgacctattagggcccaatcagaatggcagcgagggattagcccagctgacatcgacaaacggagcgaaacccgtggaggatttctccaacatggagtcccagagcgtgcctcttgatccaatggagcacgtgggcatggagcccttgcaattcgattactctggtacacaagtgcctgtcgatagcgctgcagccacggtcgggctctttgactacaattcccagcagcagctgttccagagaccgaatgctttggctgttcagcagctcaccgccgcacaacagcagcagtatgcactcgcggctgctcaccagccgcatatcgggttggccccggccgcttttgttccaaacccgtacattatctccgcagcaccgccaggcaccgacccttatacggccgggctggccgcggccgccacattgggtcctgcggtagtgcctcaccagtactacggagtgacaccctggggagtttatccagccagcctgttccagcagcaggctgccgccgccgcagccgcaacaaattctgccaatcagcaaacaacgcctcaggcccagcaggggcagcagcaaaccgaattctgcttctgttgtccagggtggagcgcgatggtgtag

SEQ ID NO: 131254 - DNA, 2964 bp, Artificial Sequence
  Description of Artificial Sequence: Synthetic coding sequence
atgaaccatgatttccaggcactggccctggagtcaaggggtatgggagaactactgccaacaaaaaagttttgggaacccgacgactccacaaaagacgggcaaaaggggatcttcctgggagacgatgagtggagggaaacagcctggggtgcctcccaccacagtatgtcccagccaatcatggtgcagaggaggtccggccagggattccacgggaattccgaggtgaatgctatactttctccgcgaagcgagtcaggagggctgggcgtgagtatggttgagtatgtgctgtcctccagcccggccgacaaattggactcaagatttcggaaaggcaattttggaacccgagatgccgagactgatgggccagaaaagggggaccagaagggcaaggcttcgcctttcgaggaagaccaaaacagagatctcaagcagggcgatgatgatgactctaaaatcaatggccggggtctgcccaatgggatggacgcagattgtaaggattttaaccggacgcccgggtcccgccaggctagccctaccgaagtcgtggagcgactgggtcccaacaccaatccgtctgaaggattaggtccactgccgaatcccaccgcgaacaaacctctagtggaggagttctctaatccggaaacccagaacctggacgctatggagcaggtgggtttggagagtctgcagttcgactaccctgggaatcaggtgccaatggacagtagcggtgccaccgttggactcttcgattacaacagtcagcaacagctctttcagcggaccaacgctcttacagtgcagcaattaaccgccgcccagcagcagcagtatgccctggctgccgcacagcaacctcacattgctggtgtgtttagcgcaggcctggccccagccgcatttgttccaaacccctacatcatttccgctgcccctcctggcacagacccatacaccgccgccggcttagcagcagctgcaaccctcgctggtccagccgtcgttcctccacagtattacggagtgccatggggcgtgtatcctgcaaacttgttccaacagcaggcagccgccgctgccaataatactgcgtcccagcaggcagcctctcaagcccagccgggacaacaacaagtcctcagggctggggccggacagagacccttaacacctaaccaaggccaacaaggacagcaggccgaatctctggcagccgctgctgctgcgaaccctacattggcctttggccagggtcttgcaacaggaatgccaggatatcaggtgctagctcccacggcatactatgatcagaccggtgcattggtcgtgggtcccggggctcgcaccggcctcggggccccagtaagactgatggcacctacaccagtgctcataagttccgccgcagcacaagctgccgctgcagcggccgccggtggtaccgcaagctccctgaccgggtctacaaatggcctgtttagacccataggcactcaaccaccacagcaacagcagcaacaaccatctacgaacctgcagtccaatagtttttacggctccagttcccttactaactcttcccagtcttcctccctgttctcccatggcccggggcagccgggctccacaagcctgggatttggctccggcaactcattgggcgccgccattggctccgctctgtccgggttcggatcctcagggggcttaaccaacggctcagggcggtacattagcgccgcacctggcgcagaggccaagtacagatcggcatcttcaacaagttcattgtttagcagcagcagccagctcttccccccttctcgcctgagatacaaccgcagtgatattatgccctcgggcaggtcccggttactggaggattttcgcaacaatcggttccccaacctgcaactgcgggatcttatcggccatatcgtagagttcagtcaggatcagcatggctccaggtttatccaacagaaactagagcgggctacaccagcggagcggcagatggtcttcaacgaaattctgcaggcagcctaccaactgatgactgacgtcttcgggaattatgtgattcagaaattctttgaatttggctccctggaccagaagctggctctggctacccggatccgtggccatgtcctgcctttggcactgcagatgtacggttgtagggttattcaaaaggcacttgagtctatctcaagcgaccagcaagttattagcgagatggtaaaggagctggatggtcacgtcctcaaatgtgttaaggaccaaaatggtaaccacgtagtgcaaaagtgtatcgagtgtgtacagccacaatcactgcagttcatcatcgacgcattcaagggacaggtcttcgtcttgagcactcatccgtatggatgccgagtcatccagaggattctggagcactgtaccgctgaacaaacattgcccatcctcgaagagctgcaccagcataccgagcaacttgtgcaggaccagtatggcaattatgtcatacaacatgtgctggagcatggtcggcctgaggataagtccaagatagtttcagagattagggggaaagtgctggccctatctcaacataagtttgcctccaacgtggttgagaaatgtgtcacgcatgcatccagggccgaaagggctctgctcatcgatgaagtgtgctgtcagaatgacggccctcactcagctctgtacacaatgatgaaggatcaatacgctaattacgttgtccaaaagatgattgatatggctgagccagcccagcgcaagattatcatgcacaagattagaccccacataaccacactgcgcaaatacacatacgggaagcacatcctggccaagctggagaagtactatttgaagaacagtcccgacctggggcccattggcgggcctcccaacgggatgctctag

SEQ ID NO: 131255 - DNA, 3195 bp, Artificial Sequence
  Description of Artificial Sequence: Synthetic coding sequence
atgaaccatgattttcaggcactggcactcgagtccagagggatgggggaactgctccctactaagaagttctgggagccagatgactcaacaaaggatggccagaaaggaatcttcctcggagatgatgagtggcgagaaacagcatggggggccagccaccactcaatgagtcagcccatcatggtgcaaagacggagcggccagggattccacgggaatagcgaggttaacgcaatcctaagcccacgctctgagtctggcggtctgggtgtgagcatggtcgagtacgtactgtcatctagtccagcagataagctggattctaggttccggaagggtaacttcggcacaagagatgctgagactgacggcccggagaagggagatcagaaaggaaaggcgtcccctttcgaagaggaccagaaccgggatcttaagcagggggatgatgacgactccaagataaacggccgaggattacctaacggcatggacgcggactgtaaggatttcaatagaacgcctggcagtagacaggcgagccctactgaggtcgtagaaagactgggtcctaataccaacccatcagaggggctaggtccccttcctaatcctacagcaaataaacctctcgtggaggaattttcaaatcctgagacacagaatctcgatgcaatggagcaagtgggcctcgaaagtctgcagtttgattaccctggaaatcaggtccccatggattcctcgggagcgaccgtggggctgttcgattataattctcagcagcagctcttccagagaacaaacgctctaaccgttcaacagctcaccgctgcacagcagcaacagtacgcactcgctgcagcccagcaaccccatattgccggggtgtttagcgcaggacttgcccccgccgcattcgttccaaatccatatatcattagcgccgcaccccccggcaccgacccctacaccgcagcagggctggctgcggccgctacccttgcaggccccgcagttgttccaccccaatattacggggtgccctggggcgtgtatcccgcgaacctcttccagcagcaggcagcagccgcagccaacaacacagcgagccagcaggcagcatcccaggcacaacctggacagcaacaggtgctgcgagcaggcgccgggcaacggccgctaaccccaaatcagggccaacagggacagcaggctgagtccctggctgccgccgccgccgctaaccctaccctggcattcggacagggtctcgccactggaatgccaggctatcaggtgctcgctccaaccgcatactacgaccagacaggcgccctagtggttggacccggtgcccgaaccggactcggagcgccagttaggttgatggctccaacacccgtgctgatctctagcgccgctgcgcaagctgctgcagccgcagctgcgggcggcactgcctcctcactcaccgggagtaccaacgggttattcagacccatcggtacccaaccacctcagcagcagcagcagcagccgagtacaaacttgcagtcaaacagcttttacggctcatctagccttactaacagctcccagagcagctccctgttttctcatgggcccggacagcctggttccacgtctctggggtttggctccggcaatagtctaggagctgctatcgggtcagctctgtctgggttcggctcttctgttgggtcctccgcttctagtagcgctacccgccgagagagcctctccacatccagcgatctgtacaagagatcctcatccagcttggcgccaatcgggcagccattttacaacagtttggggttttcgagctccccttcaccgattgggatgcctctgcccagccagacacctggacatagtctcacacctccccccagtctgagctcccacgggtcctctagcagcctacacctggggggtctcacgaacggctcaggccgatacatcagcgcagcaccaggcgctgaggcaaaataccggagtgcctctagtacttcatctttattttcctcttcctctcagctttttccaccatctcggctacgatataataggtcggatatcatgcctagcggcagatctaggctcctggaagactttcgcaataaccggtttcctaacttacagcttcgggacctgatcgggcacatcgttgagttctctcaggaccagcacggttctcgcttcatccagcaaaaactggagagagctacacccgcagagaggcagatggtgttcaacgagattttacaggctgcgtatcagcttatgacagacgtgttcggtaactatgtaatccagaaattttttgaattcggtagcctcgatcaaaagttggctttggcaaccagaattagaggccacgtgctcccacttgctttacaaatgtatggttgtcgggtgatccagaaagcccttgagagcatatcctccgatcagcaatcagaaatggtgaaagagctggacggacatgtcctgaaatgtgtaaaggatcaaaatgggaaccacgtcgtgcagaagtgcatcgaatgcgtgcaaccccaatccctgcagtttattattgatgcattcaagggacaagtgtttgtcctgagtacacacccgtacgggtgtcgggttatccagagaatcctggaacactgtacagccgagcagactcttcccattctcgaggaactccaccagcacaccgaacagttggtgcaggaccagtatggaaactacgtgatccaacacgtgttggagcatggtaggcccgaggataagtccaagatagtgtctgagatccgaggtaaagttttggcattgagccagcataagttcgcttcaaacgtggtggaaaagtgcgtgacgcacgcttcccgcgcggagcgtgcattgctgatcgacgaggtttgctgtcagaacgatggcccacattccgctttatatactatgatgaaggatcaatacgctaattacgtggtccagaaaatgattgacatggccgagcctgcgcaacgcaagattataatgcataaaatccgacctcatatcaccaccctaaggaaatacacctatggaaagcatatccttgccaagttggaaaaatattacctcaaaaattctccggacctagggccaataggggggcccccaaacggaatgctgtag

SEQ ID NO: 131256 - DNA, 3201 bp, Artificial Sequence
  Description of Artificial Sequence: Synthetic coding sequence
atgaatcacgatttccaggcactggctttggaatctcgggggatgggcgaattactgcccacaaagaagttctgggagcctgatgattctaccaaggacggtcaaaaggggatattccttggcgacgacgaatggcgggaaactgcttggggcgccagtcaccactccatgagtcagccgatcatggtgcaacggcgtagtggtcagggctttcacggaaattctgaagtcaacgcgattttgtctccccgcagcgagtctggcgggctgggggtgagcatggtagagtacgtgctttcttccagtcccgctgataaacttgacagtaggttccgtaagggcaattttggcacaagagacgctgagaccgacggacccgagaagggtgaccagaagggcaaagcaagcccatttgaggaggaccagaaccgggacctgaagcagggagatgatgacgactctaagattaatggacgggggttgcctaacggaatggacgccgattgtaaggactttaaccgcactcctgggagccgccaggctagccctacggaagtcgttgaacgattgggtccgaatactaatcctagcgagggactaggcccgctgcccaatcctaccgccaacaagcccctagtcgaggaattctctaatccggaaacacagaatctggacgcaatggaacaagtcggactagagtccctgcagtttgactatccaggcaaccaggttcctatggactcttcaggggctactgtcggcctctttgactataacagtcaacagcagctgtttcagcgcaccaacgctctcaccgtgcagcagctgactgcagctcagcagcagcagtatgcactcgctgctgcacagcagccacacatcgccggggtattttccgcagggttggcgcctgcggcctttgtaccaaacccatatattatctctgccgcacctcccggcacagatccatataccgctgctggactcgccgcagccgcaaccttggctgggcctgccgttgtaccaccgcagtattacggagtgccatggggagtgtatcctgcaaatttgtttcaacagcaagctgctgcagcagctaacaatacagcttcccaacaggccgcctcacaggcacagcccgggcagcagcaggtcctgcgtgctggggctggtcagaggcccctaacgccaaatcagggacaacaggggcagcaggcagaatcactggctgcggcggcagcggcgaatccaactctggcgttcgggcaaggattagccaccggaatgcccggctatcaggttctggcaccaacagcctattacgaccaaacaggagctttggtggtggggcccggagcccgaaccggcctgggcgctccagtgcgacttatggcccctacacccgtgttaatcagcagcgcagcagcccaggctgccgccgctgcggcagccggtggcaccgcgtcttcccttaccgggagcacgaatggattgttccgtcctatcgggacccagccccctcagcagcaacaacagcagccgagtaccaatttacaatcaaactctttctacgggagctcatccttgactaactctagccagagctcttcactgtttagtcacggcccaggccaacctggctctacgagcctcggcttcgggtcgggcaatagtctgggagcagctattggcagcgcactgtccggatttggtagttccgtgggatcttctgcttcatcttctgccactcggcgagaaagcctgtccacctcgagtgacctgtacaaacgcagcagtagtagccttgcacctattgggcaaccattttacaactcattaggtttctcttcctccccaagcccaatcggaatgccactgcctagccagactcccggacattccctcacaccccccccctccctgagttcacacgggtcatcctccagtttacacttgggaggcctaactaacggaagcgggcgttacatttctgcggccccaggagctgaagcgaagtaccgatcagcatcctcaacaagctctctgttttcgagttcctcgcagcttttcccaccaagcaggctgagatataatcgaagcgatatcatgccttctgggaggtcgcggcttctggaagatttcaggaacaataggtttcctaatctgcagctgcgcgacctgattgggcacatcgtggagttttctcaggatcagcatggcagccggttcattcagcagaagctcgaaagagccacacccgccgagcgccagatggtttttaacgaaatcttgcaggccgcgtaccagcttatgacagacgtttttggaaactacgtcatccagaagttttttgaatttggctcattggatcagaaactggcactcgccacacggattcgcggccacgtcctcccactggccttacagatgtacggttgtcgtgttatccaaaaggccctggagtctattagttccgaccagcaggtgatctcagagatggtgaaagaactcgacgggcacgtcctaaagtgcgtgaaggaccaaaacggaaaccacgtggtacaaaaatgcattgaatgcgtgcagccacagtcactgcagttcatcatcgatgccttcaaaggtcaggttttcgtgctgtcgacccatccctatgggtgtagggtcattcagcgcatcctcgaacactgtactgcggaacagacgttaccaatccttgaagagcttcatcagcacactgagcagctcgtgcaagaccagtatggcaactacgttatacaacatgtcttggagcacggacgtccagaagataaatccaaaattgtcagtgagatcaggggcaaagtgctggctctaagccaacacaaattcgcatccaacgtcgttgaaaagtgcgtgacccacgcaagtagggcagagcgagccctacttattgacgaagtttgctgccagaacgatggacctcacagcgcgttatacacaatgatgaaagatcaatacgccaattacgtggtgcagaaaatgattgatatggccgaaccggcacagcgcaagatcattatgcataaaattcggccgcacatcactaccctgcgcaaatacacctatggtaagcatatattggcaaagctggaaaagtactatcttaagaatagccccgacctcggacccataggcggccctccaaatggtatgctgtag

SEQ ID NO: 131257 - DNA, 3195 bp, Artificial Sequence
  Description of Artificial Sequence: Synthetic coding sequence
atgaaccatgacttccaggcgctcgcactggagagcagaggaatgggcgaactgctgccgacgaagaaattctgggagccagatgactccacaaaggatggacagaaagggatcttcctgggcgacgatgagtggcgggagacagcgtggggggccagtcatcatagcatgagccagccaattatggttcagagacgctccggacaggggttccatggcaatagcgaggtcaacgcgatactgtcccctcgctccgaaagcggcggcctgggggtgtccatggtggagtatgtcctcagcagctcgcccgccgataagctagattcccggttcaggaagggaaacttcggcaccagggatgccgagactgacggcccggagaagggtgaccagaagggaaaggcttcgcctttcgaggaagaccagaaccgggacctcaagcagggcgatgacgatgactctaaaattaatggaaggggcctgccaaatggaatggatgctgactgtaaggactttaatagaacacctggctccaggcaggcatcaccaacagaagtggtagaaaggctcggcccaaacaccaatccatccgaggggctgggtccgctgcccaatcctaccgctaataagccactggtggaggagttctccaaccccgagactcagaacctggatgcgatggagcaagtaggactcgaatcccttcagttcgattatcctggaaaccaggtgcccatggacagttctggcgccacggtggggctattcgactataattcccagcaacagctctttcagcggacgaacgcattaaccgtgcagcagctcacagctgcccagcagcagcagtatgctttggctgccgcccaacagcctcatattgccggggtattttccgcagggcttgcaccggccgcgttcgtgccaaatccctacatcatcagcgctgctccacccggaacggatccttataccgcagccggcctggcagctgctgccactcttgctggccccgcggtcgtgccaccccagtattacggggtaccatggggggtgtaccctgcaaacctgtttcagcagcaggctgctgcagcagccaacaatacagcttcccagcaggccgcctctcaggcccagccaggacagcaacaggtcctgagagctggagctgggcagagacccctaacaccgaatcagggacagcagggccagcaagctgagtctcttgcagctgcggcagcagccaaccccactcttgccttcgggcagggactagcaactggcatgcctggctatcaagtgttggccccaacagcttactatgaccagacaggagcgctagttgtggggcccggagcccggacgggcctcggagcgcctgtaagacttatggctccaacccccgtgctgattagctcggctgctgcccaggcagccgccgccgcagcagccggcgggacagcttcctctctaacaggaagcacgaacggcctattccgcccaataggaacacagccaccccagcagcagcagcagcaaccatcaactaacctgcagagtaacagcttttacggcagtagctcattgacgaactcctcccagtcttcctcacttttcagccatggcccagggcagcccggatcaacatctctgggcttcggctctggaaacagtctaggagctgccattggatcagctcttagcgggttcggatcatccgtgggttcttcagcatccagcagtgccacccgtcgagaaagcctttcaacgagcagcgatctgtacaaacgctctagtagcagcctggctcccatcggccagccattctacaatagcttgggtttcagcagcagcccctcccctattggcatgccactacccagccagacccctggccattccctgactcctcccccaagtctgagctcacacgggtcctcctcctccctgcatctcgggggtctgaccaacggcagtggtaggtatattagcgccgcgccaggagccgaggccaaatacagaagcgcatcttccacttcatctctcttctcctccagcagtcaactgttcccaccgtcacgtctgcggtataatagatctgatattatgccctcaggccgatcacgcctgctggaggacttcaggaacaatagatttcccaacctccagcttcgggacttaataggccacattgttgaattttcccaggatcaacacggctctcgattcatccagcagaagctggagcgtgccacaccagcagagcgccagatggtgttcaatgaaatactccaggctgcttatcaattgatgactgatgtgtttggaaattacgtcatccagaaattctttgagtttgggtctcttgaccaaaagctagctctggcaacgaggatccggggccacgtgttacccctggccctccaaatgtatggatgccgcgtcatccagaaagcactcgaatctatctcatctgatcagcagagcgaaatggttaaggaattagatggacacgtcttaaaatgcgtgaaggaccagaacggaaaccatgtcgtccaaaagtgcattgagtgcgtacagcctcaatcattgcaattcatcattgatgcgttcaaggggcaggtgtttgtcctttctacacacccttatggttgtagagtgattcaacgtattctggaacactgcactgccgaacaaacactgccaatcctggaggagctgcaccaacatacagagcagcttgtccaggaccagtatggtaactatgtcatccagcacgtgctggaacatggccggcctgaagataaaagcaagattgtgtccgaaataaggggtaaagtgcttgcgctaagtcagcacaaattcgcgagcaacgtggtcgagaaatgtgttacgcacgctagccgagcagagcgcgcattattaattgatgaagtatgttgtcagaatgacggcccacattctgccctatatacaatgatgaaggatcagtatgccaattatgtggtacaaaagatgattgacatggcggagccagcccaaaggaaaatcatcatgcacaaaattcgaccacatatcaccacactgaggaaatacacttacggtaaacacatcctggccaaactagaaaagtactacttaaagaatagcccagatttgggcccaatcggaggccccccaaatggaatgctgtag

SEQ ID NO: 131258 - DNA, 105 bp, Artificial Sequence
  Description of Artificial Sequence: Synthetic coding sequence
atgaatcacgattttcaagctttagctcttgaatctcgcggcatgggggaattgcttccaactaaaaaattttgggagcccgacgactccacaaaggacgggtag

SEQ ID NO: 131259 - DNA, 882 bp, Artificial Sequence
  Description of Artificial Sequence: Synthetic coding sequence
atgaaccatgacttccaggccctggctctggagtcacggggcatgggggaacttctccccacaaagaaattttgggaaccagatgacagtaccaaggacgggcaaaagggtatcttcctgggtgatgacgagtggcgtgagaccgcttggggggcctcccaccattctatgtcccagcctatcatggttcagcgacggtccggacaaggctttcacggcaatagtgaggtgaatgccattttatcgcccagatctgaaagcggagggctgggggtcagcatggtagagtacgtgttaagttccagtccagccgacaagctagacagccgtttcaggaagggcaactttggcacccgggatgccgaaacagacggccccgagaaaggggaccaaaagggaaaggcctcaccattcgaagaggaccaaaaccgcgatctcaagcagggcgatgatgatgatagcaaaatcaacggacggggcctgccaaatggcatggacgccgattgcaaagactttaatagaacccctggtagtcgccaggcaagtcctacagaggtagttgaaagacttggccccaatacaaatccatccgagggcctcggtcccttacccaaccccaccgccaacaaacccctcgttgaggaattctcaaatcccgagacgcagaaccttgacgctatggagcaggtcggactggagtcactacagtttgactatcctgggaaccaagttcctatggacagttccggggcaacggtcgggctgttcgattataacagccagcaacagctgttccagaggactaacgctctgacagtgcaacagctgaccgcagcacaacagcagcagtatgcactggccgcagctcagcagcctcattag

SEQ ID NO: 131260 - DNA, 3027 bp, Artificial Sequence
  Description of Artificial Sequence: Synthetic coding sequence
atgtcccagcccattatggttcagcggaggagcggccaggggtttcatggcaactccgaagtgaatgcgattctgtctccccgaagtgagtcggggggactgggggtatcgatggtggaatatgttctgtccagcagcccggctgacaagttagatagccgtttcagaaaggggaattttggcactcgcgatgctgagacagatggtcctgaaaaaggcgatcagaaggggaaggcgtcaccctttgaagaagaccagaaccgcgaccttaagcagggcgatgacgatgactctaaaataaatggtcgcgggctgcccaatggaatggacgctgactgcaaagactttaatcgcactccagggagcagacaggcaagcccaactgaagtggtggagcgcctggggccaaatacaaacccgtctgaggggcttgggccactgcccaacccgacagccaataagccactcgttgaggaattctccaatcccgagacgcaaaatctggatgccatggaacaggtcggtctggagagcctgcagtttgattatcccggaaatcaggtacctatggactcctctggtgctacagttggcctctttgactataattcgcaacaacagctgttccagcgaaccaatgcactgaccgtgcagcagttgaccgcagctcagcaacaacagtacgctctggccgccgcacagcagcctcatatcgctggggtattttcagcaggcctcgctccggcagcattcgtccccaacccctatattatcagcgctgcccctccggggaccgacccctatactgccgccgggctcgccgcggctgctacgcttgctggacccgccgtcgtacctccccaatactacggcgtcccctggggcgtgtatcctgcgaacttgtttcaacagcaggcagccgctgcagccaacaacaccgcatcacagcaagctgcctctcaggctcagcccggccaacagcaggtgctgcgcgcaggcgctggtcaacgacccctgacccccaaccaggggcagcaggggcaacaggcggaatcactggccgcagccgctgctgctaatccaaccctggccttcggccaggggctcgcaaccggtatgcccggctatcaggtgttggctcccacagcctattatgatcaaacgggtgccctcgtggttgggccaggcgctagaaccggcctgggagcccctgtcaggctgatggcccctaccccggtgctcatctcttccgccgccgcccaggctgccgccgcagccgcagcagggggaaccgccagctccctgactggctccacaaacggactgttcaggcccataggaactcaaccaccgcaacagcagcagcaacagcccagcacaaaccttcagtcaaactctttttatgggtcttcttctcttacaaatagctcgcagtcaagttccctatttagtcacgggccaggtcaaccaggctccacttccctcggtttcgggagcggtaatagcttaggagcagccattggatctgcgctgtcagggtttggtagcagcgtcggcagcagcgccagttcttcggctactagaagggagtccttgagcacatctagtgatctctacaagagatcttcctccagtctagcaccaatcggacagcctttttataatagtctgggttttagttccagtccgagccctatcggcatgccactcccctctcagacacccggtcactctcttacaccacctccaagcctgagttcgcatgggtcctcttcctcactccacctcggggggctcaccaacggatccgggaggtacatttctgctgccccaggcgccgaagcgaaataccggtcagcaagttctacatcctccctgtttagcagctcttctcagttgttccctccgtcccgcctaaggtataacagaagcgatattatgccaagtggacgcagtcggctgttagaagattttcgaaacaatcgttttcctaatctccagctgcgcgacctcattggacatattgtggaattcagccaggatcagcatggtagccgctttatccagcaaaaacttgaaagagcaacccctgccgagcgtcagatggtctttaacgagattctccaagccgcgtatcagctcatgactgatgtctttggaaactatgtcatccagaagttttttgagtttgggtccctggaccaaaagctggccctggcaactcgcattagagggcatgttttaccactggcacttcagatgtacgggtgccgcgtgatccagaaggcactggaaagtatttccagcgatcagcagtcagaaatggttaaagaattagatggccacgtgctgaaatgtgtgaaggaccagaacggcaatcatgtggtgcagaaatgtatcgagtgcgtgcaaccacagtctctgcagtttatcatcgacgcattcaaaggccaggtgttcgtgcttagtacccatccatacggctgccgggtcattcagcgaattttggaacattgcacagccgagcagaccctgccaatcttagaggagcttcaccagcacaccgagcagctcgtccaagaccagtacggaaactacgtaatacaacacgttctggaacacgggcgaccagaggataagagcaaaatcgtctctgaaattaggggcaaagttctggcactgagccagcataagttcgcgtctaacgttgtggagaaatgcgttactcacgcctctagggctgagagagccctcctcattgatgaagtttgctgtcaaaacgatgggccacactctgccttgtatacgatgatgaaggatcagtacgccaattacgtcgtgcaaaagatgattgacatggctgagcctgctcaacgcaagatcattatgcacaaaatacgtcctcacattactaccctccggaagtacacctacggcaagcacatacttgctaagctggagaaatattatttaaaaaacagtccagacctaggacccattggggggcccccgaatggtatgctgtag

SEQ ID NO: 131261 - DNA, 870 bp, Artificial Sequence
  Description of Artificial Sequence: Synthetic coding sequence
atggagaatggctacacctatgaagactataaaaatacggctgagtggctactcagccacacgaagcaccgcccacaagttgccattatctgtggatctggcctggggggtttaaccgacaaactaacccaggcgcagatttttgattacggggagattcccaactttcctcggtctaccgtcccagggcacgctggacgcctggtgtttggctttcttaacggaagggcttgcgtgatgatgcaggggagattccacatgtacgagggatacccactgtggaaggtgacatttccagtgcgcgtatttcacctgctgggtgttgacacgttggtagtgactaatgccgccggagggctgaatcccaagttcgaagtgggcgatatcatgctcattcgggatcacatcaatcttcccgggtttagcggccaaaatcccctccgcggccctaacgacgagcgattcggagataggttcccagctatgtcagatgcttacgatcgcacgatgagacagcgggcgctgagtacctggaaacagatgggagagcaaagagagctgcaggaaggcacttatgtaatggtagctggcccttccttcgagaccgtggcagaatgtcgtgttttgcagaagctgggggctgacgccgtggggatgtctacagtgccagaggtgatcgtcgcccgccactgtggcctgagggtatttgggttcagtttgattacaaacaaggtgatcatggattacgagagcctggagaaagctaatcacgaagaggtactggcggctggcaaacaggccgcccaaaaactcgagcaatttgtctctattttaatggctagcatccctcttccggacaaagcgtcttag

SEQ ID NO: 131262 - DNA, 282 bp, Artificial Sequence
  Description of Artificial Sequence: Synthetic coding sequence
atggagaatggttatacttacgaagactataaaaatactgcggagtggctactctcacacaccaagcatcgcccacaagtggcaataatttgtgggagcggcttgggcggcttgacagataagcttacacaggcacagatatttgactacggagagattccaaactttccacgctccactgtcccgggtcatgcagggcgactcgtatttggctttctaaatggacgagcatgcgtgatgatgcaggggcgtttccatatgtacgagggctaccccttgtag

SEQ ID NO: 131263 - DNA, 375 bp, Artificial Sequence
  Description of Artificial Sequence: Synthetic coding sequence
atgtcgtatattcccgggcaacctgtgactgccgtggtgcagcgggtcgagatacacaagctacgccagggcgaaaacttgattctcggctttagcattgggggggggatcgaccaggacccctctcagaatcctttcagtgaagataagactgacaaagggatctacgtcacgcgggtttctgaggggggcccagctgagattgctggactccaaatcggggataaaatcatgcaggtcaatgggtgggatatgacaatggtgactcacgaccaagctcgaaagaggttgacaaagcgctccgaggaagtggtgaggctcctggtgactagacagagcctgcagaaagccgttcagcagtcaatgttgtcctag

SEQ ID NO: 131264 - DNA, 1194 bp, Artificial Sequence
  Description of Artificial Sequence: Synthetic coding sequence
atgaactgtatcagcgacttttttacctacgagactacaaaatccgttgtcgttaagagctggactatcgggatcattaaccgcgtggtgcagttgttaatcatttcctattttgtggggtgggtgttcctgcacgagaaagcataccaggtgcgagataccgctattgagtcatccgtcgtgacaaaagtgaagggttctggtctgtacgccaatcgcgtcatggacgtgtcggattacgtgacaccccctcagggaacatctgtgttcgtgattatcactaaaatgattgtgactgaaaaccagatgcaagggttctgtcccgagtcagaagagaagtatagatgcgtgtccgacagccagtgtggtccagaacgtctgccaggagggggtatcctcaccggcagatgcgtgaactacagctctgtgctgagaacatgcgaaatccagggatggtgccccaccgaggtagatacagtcgagacccctattatgatggaagccgagaactttacgattttcatcaaaaactcaatcagattccctctgttcaatttcgaaaaagggaacctcctcccaaatctcaccgcccgcgacatgaagacgtgccgcttccaccccgataaagatccattttgtcctattttgcgcgtgggagacgttgtgaagttcgccggtcaggattttgcaaaactcgctcgaacagggggggtgctggggattaaaatcggctgggtatgcgacttggataaggcctgggaccagtgtatcccaaagtacagcttcacgcgcctagactcagtatctgaaaagtcatcagtgtctcctgggtataacttcaggttcgcaaaatattataaaatggagaacgggagcgaatacaggactctactgaaggccttcggaattcgtttcgatgttctagtgtacggcaacgccggtaagttcaacattatccctactatcatcagctcagttgccgcctttacttccgtcggggttggtaccgtcttatgtgacattatcctgctgaattttctgaagggagctgatcaatataaagcaaaaaagtttgaagaggtcaacgagacgaccttgaaaatcgccgcactcacgaaccctgtatatccatcagaccagaccaccgccgagaaacagtcaactgattcgggcgccttctctatcggccactag

SEQ ID NO: 131265 - DNA, 1191 bp, Artificial Sequence
  Description of Artificial Sequence: Synthetic coding sequence
atgaattgcatttccgatttttttacatacgaaaccacgaagtccgtggtggtcaagagctggacgatcggcatcatcaatagggtagtccagttgctgattatttcttatttcgtaggatgggtttttctccatgagaaggcatatcaggtccgcgacacggctattgagtcgagcgttgtcactaaggtcaagggctccgggctctacgccaaccgtgttatggacgtatctgactatgtgaccccaccacaggggacatctgtgtttgtcatcattaccaaaatgatcgtaaccgaaaatcagatgcaaggcttctgtccagaatccgaggagaaatacagatgcgtatccgattcccagtgcggtcccgaaaggctaccgggcggcggtatcctcacaggcaggtgcgttaactacagtagtgtccttcgaacgtgcgaaatccagggctggtgtccaacagaagtagacactgtggaaacccccatcatgatggaggcagagaattttacaatattcatcaaaaacagcatcagattcccgcttttcaattttgaaaagggtaacctactacctaatctgactgcccgggacatgaaaacctgtagattccacccggacaaggatcctttctgtccaatactgcgggtgggggacgtcgtcaaatttgctgggcaggattttgctaagttagctaggactggcggtgttttgggcataaagatagggtgggtgtgtgacctggacaaggcatgggaccagtgcataccaaagtactccttcactaggctggatagcgtgtcagaaaaaagttccgtgtccccaggctacaatttcaggtttgcaaagtattacaaaatggagaacggatcagaataccgcactctgctgaaagcctttggaatccgcttcgacgtgctatatacgggcgcagggaagttcaatatcataccaaccataatttcgtccgttgccgcattcactagcgttggcgtgggcaccgttctctgcgacatcattcttttaaacttcctgaagggggcagatcagtacaaggccaaaaaatttgaagaggtgaatgaaacaaccttgaagattgccgcacttactaaccctgtgtacccttccgaccagaccaccgcggagaagcagtcgactgactccggcgctttctctatcggacattag

SEQ ID NO: 131266 - DNA, 1167 bp, Artificial Sequence
  Description of Artificial Sequence: Synthetic coding sequence
atggccggctgctgcgcagccctggctgcttttttgtttgagtacgacacaccccgtatagtgttaatcagatccagaaaagtgggcctgatgaacagggcagtgcagctactcatcttagcctacgtcataggttgggtatttgtctgggagaaaggatatcaggagacagacagtgttgtttcatccgttaccactaaagtgaagggtgtagctgtcactaacacctccaaactgggcttcaggatatgggacgtggcagattatgtgatccccgctcaggaggaaaatagcctatttgtgatgactaacgttatccttactatgaatcaaacacaaggactttgtccagagattcccgacgctactaccgtatgcaaatctgatgcctcttgtacggccgggtccgcgggtactcatagtaatggcgtgtctactggaagatgtgtggctttcaacggatccgtgaaaacatgcgaagtggccgcctggtgcccagtggaagatgatacacatgtgccgcagcctgcttttctcaaggccgcagaaaactttactctcctggttaaaaacaacatttggtatcccaagtttaacttttcaaaacgcaacatcctgcccaacatcaccacgacgtatctcaagagctgcatctatgacgccaagacagaccccttctgtccaatcttccgccttggcaaaattgtggagaacgccgggcacagtttccaggatatggctgttgaggggggaatcatgggaattcaggtcaactgggactgtaacctcgaccgtgcagcatcactctgcctgccgaggtactcctttagacggctcgatacccgcgatgtcgaacacaacgtctcgccaggatacaacttccgctttgcgaaatactatagggacctcgcaggcaatgaacagcgcacactgatcaaagcatacgggataaggtttgatatcatagtgtttggtaaagcagggaagttcgacattatccccaccatgatcaacatagggtccgggctggctctgctgggcatggctacagttctctgcgacataatcgtgctttactgcatgaagaagaggctgtattatagagaaaagaagtacaagtacgtggaggattatgagcagggcttggcatcagaactggatcagtag

SEQ ID NO: 131267 - DNA, 1215 bp, Artificial Sequence
  Description of Artificial Sequence: Synthetic coding sequence
atggctgggtgctgcgctgctttggccgcctttcttttcgagtacgacacaccgaggatcgtcttgatccgatcccggaaggtaggcttgatgaatagagcagttcagctgctaattctcgcctacgtgatcggctgctaccatcctcatttagcagaggttgagatggaaagccctaggcgctgggtgttcgtatgggaaaaaggctatcaagagaccgacagtgtggtgtcttctgtgacaacgaaggtgaaaggagtggctgttactaatacgtccaaactcggattccgtatttgggacgtggcggattacgtgattcccgcccaggaggagaactctctcttcgtgatgactaatgtcatcttaacgatgaaccagacgcagggcctgtgtccagaaattcctgacgctaccacagtttgtaaatctgatgcctcttgtaccgctggatctgcgggaactcactccaacggggtttctactgggcggtgcgtcgctttcaatggaagcgtgaagacctgtgaagtcgctgcatggtgccccgtcgaagacgacactcacgtcccacagcctgccttcctcaaggcggccgagaacttcaccctcctggtgaagaacaacatttggtatcccaagttcaacttcagcaagcggaatatactgccaaatatcaccaccacttatctcaaatcttgcatctatgacgccaagacagatcctttttgccccatattccgtctgggaaaaatcgtggagaacgctggccactcttttcaggacatggccgtagagggcggcatcatgggtattcaagtcaactgggattgtaacctcgacagagccgctagcctttgcctccccaggtactcctttcgccggctggacactcgagatgttgagcacaatgtaagccccggctacaattttcggttcgccaagtactatcgcgacttagcaggaaacgagcagcgaactcttatcaaagcctacgggatccggtttgacatcattgtatttggtaaggccggaaagtttgatattatccccactatgatcaacattgggagcgggctcgccctactgggcatggccactgtattatgtgacatcattgtgctgtattgtatgaagaagcgcctttattacagggagaaaaaatacaagtatgttgaggattatgaacaaggactcgcctccgagctggaccagtag

SEQ ID NO: 131268 - DNA, 441 bp, Artificial Sequence
  Description of Artificial Sequence: Synthetic coding sequence
atggcagggtgctgcgccgcacttgcagcatttttgttcgaatacgatactccccgaatcgtcctcattagatctcggaaggttgggctgatgaatagggccgtccagctgttgatcctggcctacgtgataggctgggtgtttgtgtgggaaaagggttatcaggagactgatagtgtggtcagttctgtaaccaccaaagtcaagggagtcgcagtcaccaatacatctaaattgggatttcggatctgggacgtggcagattatgtgattcctgcccaggaggagaactcacttttcgtgatgaccaacgtgatactaactatgaaccaaacacaaggcttatgccctgaaattccagatgccacaacggtgtgtaagtcagacgcgagctgcaccgccggctccgccggcacccactctaatgacctgctcttttag

SEQ ID NO: 131269 - DNA, 1086 bp, Artificial Sequence
  Description of Artificial Sequence: Synthetic coding sequence
atggccggatgttgtgctgctctggccgcttttctgtttgaatatgacacaccgcgaatcgtgctgatacggagccggaaagtcggtctaatgaatcgcgccgtccagctcttaatcctggcctatgtgattggctgggtgtttgtatgggaaaaggggtatcaggagaccgattcagtcgtcagtagtgtgactactaaggtgaaaggagtggccgtcaccaacacctctaaactggggttcaggatctgggacgtggccgactacgtaatccccgcccaggaggagaatagtctcttcgtgatgactaacgtgatcctgacaatgaatcagactcaagggttatgtcccgagattcctgacgcaacgactgtatgcaagtccgacgcctcttgcaccgctggttcagccggcacacattccaacggggtgtctactggtcggccagccttccttaaggccgctgagaacttcaccctgctagttaaaaacaacatttggtaccccaagttcaacttctctaaaagaaatatactcccgaatatcacaactacttacttgaaaagctgtatttatgatgccaagacagaccccttctgccctattttccgccttggtaagattgttgaaaatgctgggcactcgttccaggatatggccgtggagggagggattatgggaatccaggttaattgggactgcaatctagacagggctgccagcctgtgtcttcctaggtattccttcaggcgcctggatacgcgagatgtagaacacaatgtctcccctgggtataacttccgcttcgcaaagtactatcgagatttggcagggaatgaacaaagaaccctgatcaaggcgtacgggatcagatttgacatcatcgtgtttgggaaggccggaaaattcgacatcatcccaactatgattaatattggatctggccttgctttactaggcatggcaacagtgctttgtgacattatcgttctgtattgtatgaaaaaacgactctactatagggagaagaagtataaatacgttgaagattatgaacaggggctggcgagtgaactcgatcagtag

SEQ ID NO: 131270 - DNA, 864 bp, Artificial Sequence
  Description of Artificial Sequence: Synthetic coding sequence
atgaccaatgtaatcttaactatgaaccaaacacagggcttgtgcccggaaatacctgacgcaaccactgtgtgtaaatcagacgcatcgtgtacggctggcagcgccgggactcattctaatggagtttctacagggagatgtgtggccttcaatgggagtgttaagacgtgtgaagtagccgcatggtgtcccgtcgaggatgatacgcatgttccccagcccgcctttctgaaggcagctgagaactttacactgctggtaaaaaataacatatggtaccccaaatttaattttagcaagaggaatatcttgccaaacattaccacaacctatctgaagtcttgtatatacgatgcaaagactgaccccttttgtccgatcttccgattgggcaagatcgttgagaacgctggccattcctttcaggatatggcagtggaaggcggcattatggggatccaagtgaactgggactgcaatctggatcgcgcagccagcttgtgcctgcccagatatagttttcgtcgcctggacactcgcgacgtggaacacaatgtgagtccaggctataacttccgtttcgctaagtactacagagacttagctggcaacgaacagcgaacgctgattaaggcttatgggatccgatttgatattatcgtcttcggtaaagcaggcaagtttgatattatccccaccatgattaatattgggtccggattagccttactgggcatggccaccgtgctgtgcgatatcatcgtcctatactgcatgaagaaacggctctactatagagagaagaagtataaatatgtggaggactatgagcagggcctggccagcgaactcgatcaatag

SEQ ID NO: 131271 - DNA, 1278 bp, Artificial Sequence
  Description of Artificial Sequence: Synthetic coding sequence
atggatggccccgccgagcagcgcccggcactgctcaattccgccgaaaactttaccgtcctcataaagaataatattgattttccaggacataattatactactagaaatatcctccctgggctgaacattacgtgcacctttcacaagacacagaatcctcagtgtccaattttccggttgggggacatcttccgtgagaccggggacaatttctcagatgtagctattcagggtggcatcatgggaattgagatctactgggactgcaatctagaccgctggtttcatcattgtcgcccgaaatatagttttagaaggctcgatgataaaactacgaacgtaagcctctaccccggttataattttagatacgccaaatattataaggagaataatgtagagaaaaggacattgatcaaggtgtttggtatcagatttgatattctcgttttcggcactggtgggaagttcgatattatacagctggtggtttacataggcagcactctgtcatacttcggtttagccgctgtgttcatcgactttttgattgacacgtattccagcaactgctgcaggagccacatctacccttggtgcaagtgttgtcagccttgcgtcgtcaacgagtattactacaggaaaaagtgcgagagtatcgtagagcctaaaccaacactgaagtacgtgagttttgtggatgaaagtcatattcggatggtcaatcagcagctgttagggagaagcttgcaggatgtgaaaggacaggaagtgccacgcccagccatggactttactgacctgtctcgtctccctcttgcccttcacgacacccctccgatcccaggtcagcccgaagaaatccagctgctaagaaaagaagccaccccaagaagtagagattcaccagtttggtgtcaatgcggcagctgccttccatctcagctcccagagtcacacagatgcttagaagaattgtgttgtcgcaagaaacccggagcttgtatcacgacctccgagttgtttcggaaattagtcctgagcaggcacgtgcttcagtttctgctgttgtaccaggaaccactcctggcattggacgtcgactccaccaacagtcgcctgcgtcactgtgcataccggtgttatgccacctggaggtttgggtcccaggatatggcagattttgcgaatctgcctagctgctgccggtggcgtattcgcaaggaatttccgaagtctgagggccagtattcagggtttaaatccccctactag

SEQ ID NO: 131272 - DNA, 828 bp, Artificial Sequence
  Description of Artificial Sequence: Synthetic coding sequence
atgcctgcttgctgcagctgtagcgacgtctttcagtatgaaacaaataaagtgactaggatccagagcatgaactatggcactatcaaatggttttttcatgtcattattttcagctacgtgtgctttgccttggtgtctgacaagctctaccagcgtaaagaaccagttatcagctctgtgcacacaaaggttaaaggaattgccgaggtaaaagaagaaatcgtcgagaatggagtgaagaagttggtccactccgtatttgataccgcagactacactttcccactgcaagggaattcattctttgtgatgaccaattttctgaagactgagggccaggagcagcgcctctgccccgagtaccctacacgccgcaccctgtgtagctccgatcgaggctgcaagaagggttggatggacccccaatctaagggtattcagacgggtagatgcgtagtgtatgaaggcaaccagaaaacgtgtgaagtctcagcatggtgtccaattgaggctgtcgaggaagctcctcgtcccgccctcctcaattctgcagagaactttacggtgctgatcaagaacaatatcgactttccaggacacaactatacaacatatgcgaaatattataaagagaacaacgtcgaaaagcggacccttattaaagttttcggcattcggttcgatatactggtgtttggcactggtggcaagtttgacatcattcaactggtcgtatacatcggttctacactgagttatttcggcctcgtgcgggacagcctgttccacgcacttgggaaatggttcggtgagggctccgactag

SEQ ID NO: 131273 - DNA, 1518 bp, Artificial Sequence
  Description of Artificial Sequence: Synthetic coding sequence
atgactcctggagatcactcgtggggtaattctttttttgtgatgaccaactttttgaagacagagggtcaggagcagcggctctgcccggaatacccgactcgccgcaccctgtgttcatctgacagaggttgtaagaagggctggatggatccacaaagcaaaggcatacagacaggcagatgcgtggtgtatgagggaaaccagaagacttgcgaggtaagcgcatggtgccctattgaagccgtggaggaagcaccccgccctgccctgttaaacagtgcagagaacttcaccgtgttgattaagaacaatattgactttcccggccacaattacaccacccgtaacatcttgcctggcctgaacatcacatgcacctttcataaaacacaaaaccctcagtgccccatctttaggctgggcgacatttttcgggagacgggggataatttctctgatgtggcaattcagggcggcattatgggcattgaaatctactgggattgcaatttggaccgatggttccatcactgccgtcccaaatattcttttcgccggctggatgataagaccactaatgtgtccctatacccagggtataacttcaggtacgccaaatactacaaagaaaacaatgtcgaaaagcggaccctgattaaagtgttcgggatacggtttgatattctggtttttggtactggcggcaagtttgatatcatccagctggtcgtttacatcgggtccaccttatcttatttcggtctagctgcggttttcatcgacttccttatcgacacatattctagtaattgctgccgctcccatatttatccctggtgtaaatgctgtcagccatgcgttgttaacgaatactattaccggaagaagtgtgaatcaatagtggagccaaaaccaaccctgaaatacgtcagttttgtggacgaaagccacatccggatggtgaaccagcagctcctcgggcgctcactacaggacgtgaaaggtcaagaagtaccccgcccagccatggattttacagacttgtcccgcctgccattagcactccacgatacccctccgatccccggccagcctgaggagatccagctcttgcgcaaggaggcgacgccccgctccagagattcgccagtatggtgtcaatgcggctcttgcttacctagtcagcttcccgaaagtcatcggtgtctggaagaactgtgctgtagaaaaaaaccaggtgcctgcatcaccacaagtgagctgttcagaaaattggttctttctcggcacgtgctgcagttcctgcttctttaccaggagccactgctagccctcgacgtcgactccactaattcccggctgaggcattgtgcctatagatgctatgctacctggagattcggaagccaagatatggctgattttgccaatctgcccagttgttgccggtggaggattcggaaagagttccccaaaagcgaagggcagtatagcggattcaagtcaccctactag

SEQ ID NO: 131274 - DNA, 387 bp, Artificial Sequence
  Description of Artificial Sequence: Synthetic coding sequence
atgccagcctgttgcagttgctctgatgtttttcagtacgagaccaataaagtgacaagaatccagtcaatgaactatgggacgatcaaatggttttttcatgtgatcatcttcagctatgtctgttttgccttggtgtcggataagctgtatcagcggaaggagccagtgattagctctgtgcatactaaggttaaggggatcgcagaagtcaaagaggaaattgtagaaaatggtgtcaaaaaactcgttcattccgtgttcgataccgcagattatacctttcccctccagggcaattcatttttcgtaatgacaaacttcttaaagaccgaaggacaggagcagagactgtgtcctgaagagttccggcctgagggggtctag

SEQ ID NO: 131275 - DNA, 921 bp, Artificial Sequence
  Description of Artificial Sequence: Synthetic coding sequence
atgtggcagtttaggtacgcgaagtattataaagaaaacaacgtggagaagagaactttgattaaggtcttcggcatcagatttgacattctggtgttcggcactggaggaaaatttgatatcatccagctcgtcgtctacattggaagcaccctaagttactttggccttgccgcagtgttcattgactttcttattgacacctactcctcaaattgttgtcgctctcatatctatccatggtgtaaatgttgtcaaccctgcgtagtaaacgaatactattacaggaagaagtgtgagtccatagtggaacccaagccgactctcaaatacgtctcgttcgtggacgagtcgcacataaggatggtgaatcagcagcttttgggcaggtccctccaggacgtgaaaggccaagaggtaccgcgccctgctatggactttactgacctgagtaggttgccactggcccttcatgatacaccaccaattccaggacaaccagaagagatacaactgctgagaaaggaggcaacaccaagatctcgtgactctccggtttggtgccaatgtggcagctgcctgccatcacagcttcctgagagccacagatgtcttgaagagctctgctgtcgaaaaaaacctggcgcctgtattaccacgtccgaacttttccgcaaactggtcttgtcccggcatgtgctgcagttcctgctcttgtatcaggagcccctcctggctctggacgtcgattcaactaattcgaggctgagacattgtgcgtaccgttgctacgccacttggcgatttgggtcccaagacatggctgatttcgccaatctgccatcctgctgcaggtggcgcatacggaaggaattccccaaatctgaggggcaatatagtggcttcaagagcccctactag

SEQ ID NO: 131276 - DNA, 387 bp, Artificial Sequence
  Description of Artificial Sequence: Synthetic coding sequence
atgccagcctgctgcagctgcagcgatgtctttcaatacgaaactaataaggttacaagaatacagagtatgaactatggtaccatcaaatggttctttcacgtgatcatcttcagctatgtgtgctttgctctcgtctccgacaaactgtaccagagaaaggaaccagtgataagttctgtgcatacgaaggtcaagggcatagccgaagtaaaagaggagatcgtcgagaacggtgtgaaaaaattagtgcattctgtgtttgataccgctgattatacttttccactgcagggaaactcattctttgtcatgaccaacttcctaaagaccgaaggccaggagcagagactgtgcccggaagagttccgtccagagggtgtgtag

SEQ ID NO: 131277 - DNA, 1788 bp, Artificial Sequence
  Description of Artificial Sequence: Synthetic coding sequence
atgcctgcatgttgcagctgctccgacgtctttcagtatgagactaataaggtgaccaggatacagtcgatgaactacgggaccatcaaatggttttttcacgtcatcatattctcgtatgtgtgctttgccttggtgagcgacaaactctaccagcggaaggagccagtcatttctagtgtgcatactaaagtcaagggcatcgccgaggtaaaagaagagatcgtggagaatggggtaaaaaagttggtgcatagtgtctttgacactgccgactacacgttcccgctccagggcaacagcttcttcgtcatgacaaactttctgaagactgaggggcaggaacagcgtctttgccccgaataccctaccagacggactttgtgcagcagcgatagaggatgtaagaagggctggatggatccccagtcaaagggcattcaaacagggagatgtgttgtatacgaagggaaccagaagacttgcgaggtgagcgcatggtgcccaattgaggcggttgaggaggcaccacggcctgcgttgctgaatagtgccgaaaatttcacagtgcttatcaagaacaacatcgattttcccggccacaactacacgacgcgcaacattctccccggtctgaatatcacttgcacttttcacaagactcagaatcctcagtgtccaattttccgtctgggagacatatttcgggagacaggcgacaatttcagtgacgtagctattcagggagggatcatggggatcgagatctactgggattgtaacctggaccggtggttccaccactgcagacccaagtactccttccgtcgtctggacgacaagaccaccaacgtatccctgtaccccggctataactttcgatatgctaagtactacaaagagaataatgtggagaagcgcacccttatcaaagtctttggcatcagattcgatatccttgtattcgggaccgggggaaaatttgatatcatccaattggtggtttacattggctctaccctttcctattttgggctggcagctgtcttcatcgacttcctgattgatacgtacagcagcaattgctgtcgttcccacatttacccatggtgcaagtgttgccagccttgcgtggtgaatgagtattattaccggaaaaaatgcgagagcattgtcgaacccaagcccacactgaaatacgtgtcgtttgtggacgagtcacacattaggatggtgaaccagcaactcctggggcgctcactgcaggatgtgaagggacaagaagttccaaggccggccatggattttaccgacctaagtagactcccactcgccttgcacgatactcctccgattccaggccagcccgaggagatccaacttttacgaaaagaagctacaccaagatcgcgggacagcccggtgtggtgccagtgcgggtcctgtctgccttcccaattgcccgaatctcatagatgtcttgaggagctttgttgtcgcaaaaaacccggagcctgtatcacaacctctgaactcttccgtaagcttgtgctgtccaggcatgttctgcagttcctgctgctgtaccaggaacccctgctggccttggatgtcgactcaacaaacagtcggctacggcactgtgcctaccgctgctacgcaacatggagattcggatcccaggatatggccgactttgcaaatctgcccagctgctgccggtggagaatcagaaaagagttccccaaatcagaaggacagtactccggctttaaatcaccctattag

SEQ ID NO: 131278 - DNA, 1122 bp, Artificial Sequence
  Description of Artificial Sequence: Synthetic coding sequence
atgactgaggttttatggccggctgttcccaacgggacagatgctgccttcctggccggacccgggtcgtcctgggggaactcaaccgtagcgtctactgctgccgtcagttcaagcttcaagtgtgccctgactaagacggggtttcagttttattacctgccagctgtgtacatcctggtgttcattattggtttcttgggtaacagcgttgctatttggatgtttgttttccatatgaagccctggagcggaatcagcgtctatatgttcaacctggctctggccgattttctctacgtgctgacactgcctgctctcattttttactactttaacaagacggattggatttttggtgacgccatgtgcaagctgcagagatttattttccacgtgaatctctacggttcgatcctattcttaacatgtatttctgcacacagatatagcggcgtggtgtatcccctcaaatcactgggtcgacttaagaaaaagaacgctatttgcatcagcgtgcttgtatggctgattgttgtcgtggcgattagccctattctgttttactctggcaccggagttcgtaagaacaaaactataacctgctatgacactacttcagacgaatatctccgcagttatttcatttactcaatgtgcaccactgtcgctatgttctgtgtgcctctggttctgattctgggctgttacggactaattgtcagagcactcatatacaaggacctggataatagtcccctgagaaggaagtctatatatctggtaattatcgtcttaaccgtctttgctgtgtcatatattccgtttcatgtcatgaaaaccatgaacctaagagcacggctggatttccagacccccgcaatgtgcgccttcaacgaccgtgtctacgccacgtatcaagtcacaaggggtttagcatccctaaactcatgcgtggatcctatactttattttctggccggcgataccttccgcaggcgactctctcgagctacaagaaaagcctctagacgcagcgaagcgaacctccagtcaaaatccgaggacatgaccctgaatatattacccgaatttaaacagaacggagatacatctctgtag

SEQ ID NO: 131279 - DNA, 1125 bp, Artificial Sequence
  Description of Artificial Sequence: Synthetic coding sequence
atggctgcaaacgtgagcggggcaaaatcttgccccgccaactttctagctgctgctgacgacaagctcagtggattccagggagactttctctggcccatactagtggtagaatttctagttgccgtagcctccaatggactcgccctctatcgcttttctatccgtaaacagagaccatggcaccctgccgtggtttttagcgtccagctcgctgtctccgacttactatgcgccttaacactaccccctcttgcagcatacttgtaccctccaaaacattggcgctatggagaagctgcctgcaggctggaacgcttcctgttcacctgtaatctcctgggatcagtgatctttattacctgtatttctctgaaccgctatcttggtattgtgcatcccttctttgcaaggtctcatctccggcctaagcacgcctgggctgtgtccgccgctggatgggttttagccgctctactcgctatgccaactttgagtttctcacatctgaagcgcccacaacaaggggcaggcaattgctcagttgcccgtcccgaggcctgtatcaagtgcctcgggacagcagatcacggtctggctgcttaccgggcatacagcctggttctagcaggcctcgggtgcgggttaccgctgctccttaccctggctgcctatggcgccctgggcagggctgtcctgcgctccccaggtatgaccgttgctgagaaactgagggtggcagcactagtggctagtggggtggccctgtacgcatcatcctacgtgccttaccatattatgcgcgtgctcaacgtggacgcccggaggcgctggagcacccgatgtccgtcgttcgcagacatcgcacaggctacagccgcgctggaacttggaccctacgttgggtatcaggttatgaggggactgatgcccctcgctttctgtgtccatccattactgtacatggccgctgttccatccctaggctgctgctgccgccattgtccgggctacagggattcctggaaccctgaagatgcaaagagcacgggccaggcccttccactgaacgccacggctgctccaaaaccgtccgagccacagtctcgagagctgtcccagtag

SEQ ID NO: 131280 - DNA, 1029 bp, Artificial Sequence
  Description of Artificial Sequence: Synthetic coding sequence
atgcaggctgtagataacctcacatctgccccggggaatacttccttgtgcacaagagattataagataacacaggttctgttccccctactctacacagttctgttctttgtgggattaatcaccaatgggctagcaatgagaatattctttcagattcggtctaaaagcaacttcatcattttcttgaaaaacacggtgatctcagacctgctgatgattctgacattcccgtttaaaatcctgtccgatgccaaacttgggacagggcctctcaggactttcgtatgtcaggttaccagcgtgatcttctactttaccatgtacatcagcatttcttttctgggtctaatcactattgataggtaccaaaagaccacccgaccgtttaagacatcgaatccaaaaaatctactcggcgctaaaatcctctccgtagtgatctgggctttcatgttcctgttaagtcttcccaacatgattctgaccaacagacagcctcgggacaagaacgtgaagaagtgttccttcttgaagtcggagttcggactcgtgtggcacgaaatcgttaactatatttgtcaggttatcttctggatcaacttcttgatcgtgatcgtttgttacaccctaattacgaaagagctttaccggagctacgtgcggaccaggggggtcggaaaggtgcctcgcaagaaggtcaatgtaaaggtgttcataattattgccgtcttctttatttgctttgtgcccttccatttcgcacgcatcccgtacacactgagccagacaagggacgtatttgattgcaccgctgaaaacacactgttctatgtcaaggagtccaccctttggctaacgtcactgaatgcatgcctcgatccatttatttacttctttctgtgcaagtcattccgaaactcactcatttcgatgctcaagtgtccaaatagcgcgacttccctctcacaggacaacagaaaaaaggagcaggatggaggtgaccctaacgaggagacaccaatgtag

SEQ ID NO: 131281 - DNA, 738 bp, Artificial Sequence
  Description of Artificial Sequence: Synthetic coding sequence
atgcaggccgtcgacaaccttacaagtgctcccggaaatacatctctgtgcaccagagactacaagatcactcaggtcctgtttccactgctgtacaccgtgttgttttttgtggggctcataaccaacgggctagccatgaggatcttctttcagattcgctctaagagcaacttcattatatttctgaaaaatactgtcatctccgatttgttgatgatactgaccttcccttttaagattctctccgatgccaagttgggaactggtcccttgagaacctttgtgtgtcaagttatattttggatcaactttttaatcgtgattgtttgctataccctcatcactaaggagctctataggtcctatgttaggactcggggcgtcggtaaagttccgcgaaagaaggtgaatgtaaaagtgtttatcattatagccgtgttctttatttgcttcgtcccgttccactttgcaagaatcccctatactcttagccagacaagagatgtcttcgactgtaccgctgagaacaccctattctatgtcaaagagtctactctctggctgacctccctgaacgcctgtcttgatccctttatttacttcttcttgtgcaagagtttcagaaactcccttatttccatgttaaagtgcccaaattccgcgacctctttatcacaggataaccgtaaaaaggagcaggatggaggagatcctaatgaggagactcccatgtag

SEQ ID NO: 131282 - DNA, 1134 bp, Artificial Sequence
  Description of Artificial Sequence: Synthetic coding sequence
atggccgcagacctgggcccctggaatgatacaattaacgggacatgggatggggacgaacttgggtatagatgtagatttaatgaggatttcaagtacgtcttgctgccagtatcctatggagtcgtgtgcgttcctgggttatgcttaaatgctgtggccctttacatcttcctttgtagattaaaaacttggaatgcgagcactacatacatgttccatctggcagtatccgacgctctctacgctgcgtctctcccgttacttgtgtactattacgccagaggagatcattggcccttcagcactgttctctgtaaattagttcggttcctcttctacacaaacctttactgctccattttatttttgacgtgtatttccgtgcacagatgcctcggcgtgctgcgccctctacgaagccttcgctggggacgcgcgcgatatgcaagaagggtggctggcgccgtttgggtcctcgtgctggcctgccaggcccccgtgctatattttgttactacgtctgcaaggggggggagggtgacatgtcacgacaccagtgccccagagctgttcagtcgatttgtcgcctattctagcgttatgctcggactcctcttcgcagtaccattcgccgtgattctggtgtgttacgtattgatggcccggaggctgctgaagcctgcttatggaacgtccggagggctccctcgtgcaaaaagaaagagtgtccggactattgccgtggtactggccgtttttgccctttgcttcttaccctttcacgtgacccgcactctgtactactcatttagatctctagacttatcttgccataccctgaatgctatcaacatggcgtataaagtaacaagaccactggcgtccgccaatagttgcctggatccggtgctgtatttcctagccggccagaggcttgtcaggtttgcccgcgacgcaaaaccccccaccggtccatcaccggccacccctgcaagacgacggttagggctgcgcaggtctgataggaccgatatgcagagaattgaagatgtacttggatcatcagaagattccaggcgaacagagagcactcctgcaggatctgagaatacaaaagatatcaggttgtag

SEQ ID NO: 131283 - DNA, 1134 bp, Artificial Sequence
  Description of Artificial Sequence: Synthetic coding sequence
atggcagcggaccttggaccctggaacgatacgatcaatgggacctgggacggcgacgagctcggttaccggtgcagattcaatgaggatttcaaatatgtactcctcccagtatcatacggcgtcgtgtgcgtgcccggcctgtgtctgaacgccgtggcactctatatctttctgtgcagactcaaaacgtggaacgcttcgacgacatacatgttccacctggccgtgtccgatgcactgtacgcggcatctctccctcttctggtgtattactacgcacgtggagaccactggccctttagcactgttctttgtaaactggtgcggtttctgttctatactaacctctactgcagtatcctttttctaacttgcattagcgttcaccgctgtctgggcgttctaagaccgttgcgatccttgcgctggggacgtgctcgttatgcccgccgtgtggcaggcgcagtatgggtcctggtgcttgcttgtcaagcccccgtgctgtactttgtgactacctctgcccgcggggggagagtgacgtgtcatgacacctccgccccagagctctttagcaggttcgtggcttattctagcgtgatgcttggcctactcttcgcagtgcccttcgccgtgatcctggtttgctatgttctgatggctcgccggttgctgaaacctgcatatggcacctccggcggcttgccaagggccaaacgcaaatcagtcaggactatcgccgtggtcctggcagtgtttgctctctgctttctgccctttcacgtcacaaggactctgtactattcttttcgatctctggacctgtcatgccacacccttaacgctatcaacatggcctataaggtgaccagaccgctggcttctgcaaatagctgtctggaccctgtgttgtatttcctcgcagggcaaaggcttgtacgatttgctcgggatgcaaagcccccgaccggtccgtcacctgccaccccagccagaaggagactgggactgcggcggtcggacagaaccgatatgcaacggattgaggacgtcctcggctccagcgaagacagccggcgaacagaatcaactcccgcggggtctgagaatacgaaggacattaggttgtag

SEQ ID NO: 131284 - DNA, 1134 bp, Artificial Sequence
  Description of Artificial Sequence: Synthetic coding sequence
atggctgccgatctaggaccttggaacgatacaattaatggcacatgggatggcgacgagttaggatatcggtgcaggtttaacgaagattttaaatacgtgttactgcccgtgagctacggcgtcgtctgcgttcctggactgtgccttaatgccgtggctttatatatcttcctatgcaggcttaagacttggaacgctagtaccacttatatgtttcatctggcagtcagtgatgccctgtatgcggcatccttaccattgctggtctactactatgctcgtggcgatcattggccattctccactgtcttatgcaagctcgtccgattcctattttataccaacctgtattgttcgatcctcttcctgacttgcatctctgtccaccgttgcctcggggtgctgcggcctctgcgatcacttaggtggggcagggctagatatgcgcgtcgagtagccggagcggtctgggtgctcgtgctggcctgccaggctcccgtcctttattttgttaccacctctgcaaggggggggagggtgacttgccatgacacctccgcccccgagttattctctagatttgtcgcttactcgtccgtgatgctgggacttctctttgctgtcccttttgccgtcatcctggtttgctatgttctaatggcccgcaggcttctgaagcccgcctacggcacatctggaggattgccccgggctaagagaaagagtgtgagaacgatagcagtggtgttagcagtgttcgccctgtgtttcctgcccttccatgttacccggaccctgtactactccttccgctctttggatctgagttgtcacaccctgaacgcaataaacatggcatataaggtgacccgcccactggcctcagcaaattcttgtctcgatcctgtgctctactttcttgccggacagagactagtcagattcgcacgagacgccaaacctcctacaggaccttcaccagcaactccggccaggagaagactgggactgagaagaagtgaccgcactgatatgcagcggatagaagacgtgctagggtcgagtgaagactcaagacgcaccgagtcgacgcccgcaggatctgagaacacgaaggacattcggctgtag

SEQ ID NO: 131285 - DNA, 1080 bp, Artificial Sequence
  Description of Artificial Sequence: Synthetic coding sequence
atgcaggtgccaaacagtaccggcccagacaacgctaccctgcagatgctgcggaaccccgcgattgcagttgccttgcctgtggtctatagtctcgttgccgccgtgagcattcccgggaaccttttctctctctgggttctgtgtcgccggatgggtcctcgctctcctagcgtgatctttatgatcaatctgtccgtgaccgacctaatgctggcatccgtgctgccctttcagatttattaccactgcaatagacatcactgggtgtttggagtgctactgtgcaatgttgtgacagtagctttctatgcaaatatgtactcctctattcttactatgacctgtatatctgtggaaaggttcctaggtgtcctttacccgctgtctagtaagaggtggaggaggcgacggtacgcggtcgcagcatgcgccggtacctggttgcttctacttacggcactttctccccttgcgcgcacagaccttacctatcctgtgcatgcactgggaattatcacttgtttcgacgtgctgaagtggacgatgctaccttccgtggccatgtgggctgtgttcctgttcactatctttattctgctgttcctgatcccattcgtgataacagtggcctgctacacagctaccatcctgaaactcctcaggaccgaggaagcacacggaagagaacagcggcgtagagctgtcggtttggccgcagtggttcttctggcattcgtgacgtgctttgctcccaataatttcgtgctgctggctcatatcgtctcacgcttgttctacggtaaatcttactaccatgtgtacaagctcacactgtgcctgagctgcctcaataattgtcttgacccattcgtgtactattttgcatcacgggaattccagctccgtcttcgagagtacttgggctgtcgacgcgtaccacgagacaccctggatacgcgccgagagtctctcttctccgctcgtacaacaagtgtcagaagtgaggccggggctcatcctgagggaatggagggcgcaactcgtcctggcctgcaacggcaagagagcgtgttctag

SEQ ID NO: 131286 - DNA, 189 bp, Artificial Sequence
  Description of Artificial Sequence: Synthetic coding sequence
atgagtgagaggcaaggagcaggtgccaccaacggtaaggataagactagcggcgagaacgatggacagaagaaagtccaggaggaatttgatattgacatggacgccccagagacagagcgggccgccgttgccattcaatctcaattccgcaagttccagaagaagaaggccgggtctcagagttag

SEQ ID NO: 131287 - DNA, 1914 bp, Artificial Sequence
  Description of Artificial Sequence: Synthetic coding sequence
atggcttcaaacgagagagatgctatctcctggtatcagaagaagataggagcttacgaccagcagatatgggagaaaagtatagaacagacccaaattaagggattgaagaacaagcctaagaaaatggggcacatcaaacccgatttgatcgacgttgacctgattcgcgggtcgaccttcgcgaaggctaagccagagatcccttggacgtctcttactaggaaggggctagtgcgcgtcgtcttctttcccctttttagcaattggtggatccaggttacatcactcagaatctttgtttggttactactgctttattttatgcaagtgatcgctatagtgctttatctgatgatgcctattgtgaatatctctgaggtcctgggcccactctgtcttatgctcctcatggggaccgtccattgtcagattgtgtctactcagattactcggccctcaggcaataatggcaatagaagaagacggaaactgcgcaaaacagtaaacggagatggcagccgggagaacggtaataactctagtgataaggttaggggtatcgaaacactcgagtcagtgcccataattgggggtttctgggagaccatattcggcaaccggatcaaacgcgtcaaattaatctcgaataaaggtactgagaccgacaacgatccttcgtgcgtgcatccgatcatcaaaagacgccagtgccggcctgaaattaggatgtggcagacgcgggagaaggccaaattttcagatggcgagaagtgcaggcgtgaagcgttcaggaggctgggcaatggagtgtccgatgatttgtcctccgaggaagatggagaggcccgcacacaaatgatcctcctgcgcaggagtgtggagggtgcaagctccgacaacggatgcgaggtgaagaataggaaatccatactctcccgacacctgaacagccaggtgaagaaaacaactacacgatggtgtcacatcgttcgagactctgactccctagctgaatccgaattcgagagtgcagccttcagccaggggagccgaagcggggtgagtggcgggagccgaagcttgaacatgagccgaagagactccgaaagcacacgacatgattctgaaaccgaagatatgctctgggacgacctcctgcacggacctgaatgccggagttcagtcacctcagattctgaaggagcccatgtcaataccttacatagcggcacaaagcgggatcccaaggaggacgtgttccagcagaatcacttgttttggctgcagaatagtagcccctcctccgatagggtgagcgccattatatgggagggcaacgagtgcaaaaaaatggatatgtcggtcttggagatttctgggatcattatgtctcgggtcaacgcgtaccagcaaggagtaggttatcagatgctgggcaatgttgtgaccattggcctggccttttttccattcctgcatcggctcttcagagagaagagtctggaccaactgaagtctatttctgcggaggagattcttacactgttctgtggcgcacccccggtaacgcctattatagttctctccatcattaacttcttcgagcggctgtgtctcacatggatgttcttctttatgatgtgtgtagccgagcgcacctataagcagcgctttctatttgctaagttgttttcacatatcacatccgctagaaaggccagaaagtatgaaataccacacttcagattaaagaaagtggagaacattaaaatatggctctcgctgcgaagctatctgaagagacgcggaccacaacgcagtgtggacgtggttgtctcttcggtgttcctgttaaccttgagcatcgctttcatttgttgcgcccaggtgaaagtcagccacttgctgtag

SEQ ID NO: 131288 - DNA, 2130 bp, Artificial Sequence
  Description of Artificial Sequence: Synthetic coding sequence
atggctagcaatgagagagacgccatttcatggtaccaaaaaaaaatcggggcctatgatcagcagatttgggaaaaaagtattgagcagacacagatcaaagggcttaaaaacaagcccaagaaaatgggtcatatcaagccggatcttatcgatgtagacttgatacgcgtcattgccattgtgttgtatctgatgatgccgatagtcaatataagcgaggtcttggggcccctgtgtctcatgctcttgatggggaccgttcattgccaaattgtgagtacccaaattacccgtccttccggcaacaacggtaatcgcagacgtaggaaattgagaaagactgtgaatggcgatgggagcagggagaatggaaacaatagctccgacaaagtgcgaggcatcgagaccctcgagtccgtgccaatcattggtgggttctgggaaaccatctttggtaaccggatcaagcgcgtgaaattgatatctaataaagggactgaaaccgataatgatccaagctgcgtccatcctatcatcaaacggcgccagtgtcgcccggagattagaatgtggcagactagagagaaggctaaatttagcgatggtgagaagtgccggcgagaagctttcagacggttggggaacggagtcagtgacgatctctcaagtgaggaggatggcgaggccaggactcagatgatcttgttgaggcgatcggtggagggtgcatccagcgacaacggctgcgaggtgaaaaacagaaagtccattctgagcaggcacttaaacagccaagtgaagaaaactactacacgatggtgtcatatcgtccgtgactctgactctcttgctgagagcgagttcgagtctgccgcgttttctcaagggagcagaagcggagtttctggaggttcgcggtccctgaatatgtctagacgtgactccgaatcaacccggcacgactcagagactgaagatatgctttgggatgacttactgcacggacccgagtgtcgcagctctgtgacatccgattctgagggtgcccacgtgaataccctgcattctggtaccaaacgcgatcccaaagaggacgttttccagcagaatcacctgttctggctgcagaactcaagcccgtcgagtgatcgtgtatccgcaattatctgggagggtaacgagtgtaagaaaatggacatgagcgtcctagaaatctccggcatcatcatgtcacgcgtgaatgcttaccaacagggcgtgggatatcagatgctgggcaatgtggtgaccatcggactcgcattctttccattcctccatcgattgttccgcgaaaaaagccttgaccagctgaaatcgatcagcgcagaggagatccttacactcttctgtggagctccgcctgtgacgcctattattgtactgtccatcattaacttttttgagagattgtgtcttacctggatgttttttttcatgatgtgtgtggcagaaagaacgtataaacagcgattcttgttcgccaagctgttcagtcatattacgagtgcaagaaaagctcgcaaatatgagatcccacatttccgactcaagaaggtcgaaaatatcaagatttggctttcattacggtcatatttgaagagaaggggtccacaaaggtctgtggacgtggtagtcagctcagtgttcctactaacactgtccattgcatttatttgctgtgcacaggtgctccaggggcataagacctttctgaatgatgcctataattgggagtttttgatatgggaaacggccctgctgctcttcttgctgcgtctcgctagcctcggcagcgagactaataaaaaatacagcaacgtgagcatcctgctcactgagcagatcaatctctatctgaagatggagaaaaaacctaataagaaggaacagctgacactcgtgaataacgtgctgaaactgtccacgaaactgctgaaagagctggacacaccgtttcggctgtacgggctaacaatgaacccgctcatttacaacattacaagggtggtgattttgagcgccgtgagcggagtgatctcagacttgttaggattcaatatccggctctggaagatcaaatcttag

SEQ ID NO: 131289 - DNA, 2154 bp, Artificial Sequence
  Description of Artificial Sequence: Synthetic coding sequence
atggcctctaatgagcgagatgctatctcctggtaccagaaaaaaataggcgcctatgatcagcaaatttgggagaagagcatcgaacagactcagattaagggactgaaaaacaagccaaagaagatgggacatattaagccagacttgattgatgtggatctaattagaggctccacattcgctaaagcaaagcctgagataccatggacctctttgacaaggaagggactcgtgagagttgtcttcttcccactcttttctaattggtggattcaggtcacatcattaaggatcttcgtctggctgttactgctgtacttcatgcaggtgatagcaatcgtcttgtatcttatgatgccaatcgtaaacatttccgaagtgctgggtcctctgtgcctgatgctgctgatgggtaccgtgcactgccaaattgtcagcacccaaattacgagaccttccggcaacaacggcaatcggaggcgacggataaagagagtaaaactaatctctaacaagggcaccgagactgacaacgatcctagctgtgtgcacccaattattaaacgcaggcagtgccggcctgaaatcaggatgtggcagactagggagaaggccaagttcagcgacggagagaaatgcaggcgcgaggccttcagacgcctagggaatggagtttccgatgatttatcttccgaggaagatggcgaggcacgcacccagatgattctcctaagaaggagcgtggagggagcaagttcagacaacggttgcgaagtgaagaaccgcaaaagcatactgtcgcgtcacctgaactctcaggtcaaaaaaacaaccactcgctggtgccacatcgtgcgtgactccgattctttggcagaatctgagtttgagagtgccgctttttcccagggctctaggtcaggtgtttccggggggtctcgttcactgaacatgtctagacgcgattctgaaagtacccggcatgatagcgaaactgaggatatgctgtgggatgatcttctgcacggccccgaatgcaggagttccgtcacttcggactctgagggtgctcacgtaaacactctgcatagcggcacaaaaagagatccaaaagaggatgttttccaacagaatcaccttttctggcttcagaactctagtcccagttctgaccgcgtgagcgccattatttgggagggtaacgagtgcaagaaaatggatatgtctgtcctcgaaatcagcggcataatcatgagcagagttaatgcttaccagcaaggagtcggctaccagatgttaggcaacgtggtcactataggcctagcattctttcctttcctccacaggctcttccgcgaaaagtccttggatcaactgaaaagtatttcagcagaggaaatactgactctgttttgtggagcccccccagttactccaatcattgttctcagtataatcaacttcttcgaacgcctctgtctgacctggatgttttttttcatgatgtgcgtagctgagcgcacttacaaacagcgtttcttatttgcaaagctgttcagtcacataacctcagcccgtaaggcgagaaagtacgagataccacattttcggctcaagaaagtggaaaacattaagatatggttgagcttacgcagctatcttaaacgtcgggggcctcaacgcagcgtggatgtggtggtgagcagtgtgttccttctcactctgtcaatcgctttcatttgctgtgcacaggtcctgcagggacataaaaccttcctcaatgacgcctataactgggagttccttatttgggagacggccctcctactcttcctactgaggctggctagcctcggttctgaaacgaataagaagtacagcaatgtcagcattctacttaccgagcagattaatctgtacctgaaaatggaaaagaagcccaataaaaaggaacagctaactttggtaaataacgtgctgaagcttagcacaaagctcctgaaagaactcgatactccctttcgactgtatggtctgactatgaatcccctcatttacaacattacgcgggtagtcatactgtccgcagtaagcggggtgatcagcgacctgctgggtttcaatattagaatttggaagcactccagctag

SEQ ID NO: 131290 - DNA, 2154 bp, Artificial Sequence
  Description of Artificial Sequence: Synthetic coding sequence
atggcttctaacgagcgcgatgccatcagctggtatcaaaaaaaaatcggggcatatgaccagcagatctgggaaaaaagcatcgagcagacccagatcaaaggcttgaagaataagcccaagaaaatggggcacattaagcctgatctgatcgacgtggacctgatcagaggttctaccttcgccaaagctaagcccgagatcccttggacttcccttaccaggaaggggctggtacgggtggtgtttttccccctgttcagcaactggtggattcaggtgacttctctgcggatctttgtttggctgttacttctctactttatgcaggtcatcgcaatcgtcctctatctgatgatgcctatcgtgaacataagtgaggtgctggggcccctctgtctcatgctgctgatgggtactgtgcactgtcaaatcgtgagtacacagataacaagaccgtcaggcaacaacggtaaccgacgccgtaggatcaagagagtgaagcttatcagtaacaagggaacagaaactgacaatgatccctcatgcgtccaccccatcattaagcgacggcagtgtagacctgagatccgcatgtggcagactcgggaaaaagcgaagtttagtgatggtgagaaatgcagaagagaagctttccgtaggcttggtaatggcgttagtgatgatctgagctctgaggaggacggcgaggctcggacacagatgattctgctgcgtaggagcgtcgaaggagcctcttcagataacggatgtgaggtgaaaaataggaagagcatactgagtcgccatcttaacagtcaggttaagaagactaccactcgatggtgtcacatagtgagggattctgacagcttggctgaatctgaatttgagtccgccgcattctcccagggatctaggagtggcgtgagcggcggaagccgctctcttaatatgtctaggcgcgactccgaatccacaaggcatgattctgagacagaggatatgttgtgggacgatctgctgcatggcccagagtgtcgctcctcggttacaagcgattccgagggtgcccacgtgaacactcttcattcaggcacaaagagggaccccaaggaggacgtgtttcagcagaaccacctattctggctgcagaacagttccccatcaagcgaccgggtgagtgcaatcatctgggaaggcaacgagtgtaagaagatggacatgtccgtactcgagatatcaggcattatcatgagcagggtgaacgcataccagcaaggcgtaggctaccagatgctcggtaatgtcgttacaattggccttgccttttttccattcctgcaccgactctttagagaaaagtccctcgatcaactgaagtctatcagcgctgaggagattctgactctattttgtggcgcaccacctgtcactcctatcatagtgctgtcgattatcaattttttcgaaaggctgtgcctgacttggatgttttttttcatgatgtgcgtggctgaaaggacatacaagcagcgctttctcttcgctaaactgttttcacatattactagtgcaagaaaggcccgcaagtatgaaatacctcatttccgccttaaaaaggttgagaacatcaaaatttggctgtccctgcgaagttatttgaagagaagaggtccgcaaaggtcagtcgacgtggtggtgagcagtgtttttctgctgaccctgtcgatcgcctttatttgttgcgcacaagtgttgcagggtcacaagacgttcctaaacgatgcctataactgggagtttctaatctgggagacggccctcctcctgtttctactgagactggcctcactgggaagtgagaccaacaaaaaatatagcaacgtgagtatcctgctcactgagcagatcaacctgtacctcaaaatggaaaagaagccaaataagaaggagcagctgacgcttgtgaacaacgtattaaagttgtcaacaaagcttctgaaagagctggatacaccattccggttatatgggctgacaatgaatcccctgatttacaacatcacaagggtggtcattttgagcgccgtcagcggggttatttcggatctgctggggttcaacatcaggctgtggaagataaaatcatag

SEQ ID NO: 131291 - DNA, 2130 bp, Artificial Sequence
  Description of Artificial Sequence: Synthetic coding sequence
atggcatcaaacgaacgagacgccatctcttggtatcagaagaagataggcgcgtatgaccagcagatctgggaaaaaagtatagaacagacccagataaaaggtctgaagaataagcctaagaaaatgggtcatattaagccagatctgattgacgtggatctgatccgagtgattgctattgtgctgtatctgatgatgcccattgtgaacatatctgaagttttgggtcccctctgtctgatgcttttgatgggtactgtccattgccagatagtctccacacagattacaaggcccagcggcaataatggcaataggcgccgccggaaactgcgcaagactgtgaacggcgatggctcccgagagaacgggaacaactcaagcgacaaggttagaggtattgagacgctggaatctgtgcccatcattggaggtttctgggagactatttttgggaatagaatcaaacgcgtcaaattgatttccaataaagggaccgaaactgataacgatcccagttgtgtccatccgatcattaagagacgccagtgccgccccgaaattaggatgtggcagacacgagaaaaggcgaagttttctgatggggaaaagtgtagacgggaagcgtttcgcagattgggtaacggcgtttctgatgacctttcctccgaggaagatggtgaagcgagaacccagatgatactgctgcgcagaagcgtggaaggggcctctagcgataatgggtgtgaggtaaaaaacagaaagagtattttgagcagacacttgaactcccaggtgaaaaagaccacaacccgctggtgtcacatcgtgcgcgacagtgacagcctagcagaatccgagtttgaatctgccgcttttagtcaaggcagccggtctggcgtgtccggcggatcaagatccctgaatatgtctcggagggacagcgagtccacacgccatgatagcgaaacggaagatatgctgtgggacgatctcctgcacggccccgaatgtcgatcctccgttacaagcgacagcgaaggagcccacgttaacactctgcacagcggtactaagagggacccaaaagaagacgtgttccagcaaaatcatctgttttggttgcagaacagctcaccttcttccgatagagtttccgcaatcatttgggaagggaacgaatgtaaaaaaatggatatgtctgtactggaaattagcggtattatcatgtctagagtgaacgcataccagcagggcgtgggctaccagatgcttggaaatgtcgtcaccatcggcttagctttctttccctttctgcatcgactctttagagagaagtccctggaccaactgaagtcaattagcgctgaggaaattctcaccctcttctgcggggcccctcctgtcacccccataatcgttttgagcataattaacttcttcgagagactctgtctgacttggatgttcttttttatgatgtgcgtggctgaaaggacctataagcagcggttccttttcgctaagcttttctctcatattacaagcgcacgcaaggcacgtaaatatgagatcccgcacttccgactaaaaaaggtcgagaacattaagatttggcttagcctgagaagctatctgaagcggagaggaccccagaggtccgtggatgtggtcgtatcctcggtattcctcctgaccttgtccattgcttttatttgttgcgctcaggtcctgcagggccataagaccttcttgaacgatgcctataattgggaattcctcatttgggaaaccgctctcctccttttcctgctgagactggccagtttgggaagtgagactaataagaagtacagcaacgtgtccatcctgcttaccgagcaaattaacctttacctgaagatggagaagaagcctaataagaaggagcagttgacactggtgaacaacgtgctcaagctgagtaccaagctgctgaaggagctggatacacccttccgcctctatgggcttacgatgaatccactcatttataatatcacgcgcgtagtaatactcagcgcggtatcaggagttatatccgacctgctgggattcaatatccgcctatggaagatcaagagctag

SEQ ID NO: 131292 - DNA, 2289 bp, Artificial Sequence
  Description of Artificial Sequence: Synthetic coding sequence
atggcctccaacgagcgggatgcaatcagttggtaccagaaaaaaattggcgcatacgatcagcagatatgggaaaaatcgattgaacagactcaaataaaaggactcaagaacaagccaaagaagatgggccacatcaagccagatcttatagatgttgacctcatacgtggaagtaccttcgccaaagcaaaaccagagatcccttggacttctctgacgcgcaagggtctagtgagagttgtattttttccgttgttttcaaactggtggatccaggtgaccagcctacgaattttcgtgtggctgctcttactgtacttcatgcaggtgatcgctattgtcctgtacttaatgatgccaatcgttaatatttcagaggttcttgggcctctctgcctcatgctactgatgggtaccgttcactgccagatagtaagtacacagatcacaagaccatcagggaacaatggcaacaggcgtcgtagaaagttacgtaagactgtgaatggagatggctctagggagaacgggaacaacagttctgataaagtgaggggcattgaaacacttgagtctgtgcccataattggtgggttttgggaaacaatatttgggaatcgcatcaaaagggtgaagctaatttctaacaagggaacggaaaccgataacgatccctcgtgtgtgcaccccatcatcaagagaaggcagtgtagacccgagataaggatgtggcagaccagagagaaggccaagtttagtgatggggagaagtgccgacgagaggccttccggagactggggaacggagttagcgatgatttgagttctgaagaggacggagaagccagaacacaaatgatcctgctaagaaggagcgtcgagggtgcctcctcagacaatgggtgcgaggtgaagaatcgaaaatccattctttcccgccaccttaacagtcaggtgaagaaaacgaccacccgttggtgtcacatcgtcagagattccgactcactcgctgagagtgagtttgagtcagcagccttctcgcaaggaagtcggagtggggtcagcggaggaagccgatcacttaatatgtcccgaagagactctgaatctacgcgtcacgacagcgagacagaggatatgttgtgggatgacttgctgcacggccccgagtgcagaagctctgtcacaagcgactctgaaggcgcgcacgtgaataccttgcacagcgggacaaagcgtgatcctaaggaagatgtgtttcagcaaaatcacctgttttggctgcaaaattcaagtccttcaagtgatcgcgtgagtgccatcatctgggagggaaatgagtgcaaaaagatggacatgtcagtgctagaaattagcgggatcataatgtcgagggtgaacgcctaccagcagggtgtgggttatcagatgctgggaaatgtggtgacaatcggcttggctttctttcctttcttgcacagattgtttagggagaagagcctggatcagctgaagtccatatcagcggaggagattttgacccttttctgcggggctccccctgttactcccattatcgtattaagtatcattaacttcttcgagcgcctttgcctcacctggatgttctttttcatgatgtgcgtggcagaacgaacctataaacagcgatttctgtttgccaaactgttctcacacattacttccgcacggaaagctagaaaatatgaaattccccattttaggctgaaaaaagttgaaaatattaagatctggctgagcctgcgatcatacctgaaaagacgcgggccacaacgctcagtggacgttgtggtgagtagcgtgttcctgctgaccctgtccattgcttttatatgctgcgcccaagtgctccagggccacaaaaccttcctgaatgacgcttacaattgggagttcttgatttgggagacagctctgctgttgtttcttctcagactagcatcattaggctccgagaccaataaaaaatactccaacgtcagtattctgctcacggagcagattaacctttaccttaagatggagaaaaagcccaacaagaaagagcaactgaccctggtcaataacgtgctaaagctgagcacaaaactgcttaaagaactcgataccccctttcgtttatacgggcttacaatgaatccactgatatataatatcacacgcgtcgtaatcttgtcagctgtaagcggcgttattagcgatttgctgggcttcaatatccgcctgtggaaaatcaagtcctag

SEQ ID NO: 131293 - DNA, 2289 bp, Artificial Sequence
  Description of Artificial Sequence: Synthetic coding sequence
atggcaagtaatgagagagacgccatcagttggtaccagaaaaagataggcgcttatgaccagcaaatttgggagaagtccatcgagcaaactcagataaaaggcctgaaaaataagcctaagaaaatgggtcacatcaagccagatttgatagacgtcgacttgattcgtggctcaactttcgctaaagctaagcccgagatcccatggacaagtctcacaagaaaaggactggtcagagtggtcttcttcccccttttctccaattggtggattcaggtaacaagcctacgaatcttcgtctggctccttcttttgtacttcatgcaggtgattgctattgtgctttaccttatgatgcccatcgtcaacatctctgaggttctcgggcctttgtgtttgatgctcctgatggggaccgtgcactgccagatcgtttccacacagattacccgcccgtctggcaacaatggcaatagaagaagacgcaagctgaggaaaactgtgaacggcgacggaagtcgagaaaacgggaataacagctccgataaggttcgcggcattgaaactctggagagcgtgccaatcatcgggggattttgggagaccattttcggcaaccgcataaaaagagttaagctgatctccaataagggaaccgagactgacaacgatccttcttgcgtccatcccattattaagcgcagacagtgtagacctgagatccgcatgtggcagaccagggagaaggctaaattttctgatggggagaaatgcaggagagaagccttccgaaggctgggcaatggcgtttccgacgatctgtcctccgaggaggacggtgaggcgcgaacccagatgatcctcctacgaagaagcgtggagggggcttcttcggacaacggctgtgaggtaaaaaaccggaaaagtatcctgagtcgccatctcaactcgcaggtgaagaaaaccacaactcgctggtgccatatagtgcgggattcggacagcttggccgagtccgagtttgaatcagcagcattcagccaaggatctagaagcggggtcagcggagggtcccgaagcctcaacatgtctagaagagattccgagtctacaaggcacgactccgaaacagaggacatgctttgggatgatctccttcacggacctgagtgtagatctagtgtaacgagcgatagtgagggggctcatgtgaataccctgcacagcgggaccaagagagatccaaaggaggatgtcttccagcaaaatcacctgttttggctccaaaattccagccctagttccgatagagtttctgcaatcatatgggagggcaatgagtgtaaaaaaatggatatgtccgtgctggagataagtggaattataatgtcccgggtaaatgcgtaccaacagggggtgggatatcagatgttgggcaatgtcgtaacaatcggcttggcgttctttccatttctacatcgtctgttcagggagaagagtcttgaccagcttaagtcaatatccgccgaggagattctcacgctgttctgtggagccccaccggtcactcccattatcgtgctgagtatcataaatttcttcgagcgcctttgtcttacctggatgtttttttttatgatgtgcgttgccgaaagaacttacaagcaacgatttttattcgcgaaattattcagccacattacgtccgccagaaaagccagaaaatatgaaattcctcacttccgattgaaaaaggttgagaacatcaagatctggctctccctgagaagctatctgaaacgtagaggtcctcagcgaagcgtagacgtcgtggtatcttctgtctttctcctgaccctgagtatagcattcatatgctgcgctcaggtccttcagggccacaagaccttccttaatgacgcctataactgggagttcctgatctgggagaccgccctgctgttatttttgctccgcctcgcatccctgggttcagagacaaacaagaagtattccaatgtatccatactcctgaccgaacaaattaacctgtacctgaaaatggagaagaagccaaacaagaaagaacagctgacgctggtaaacaatgttctgaaactgtctacgaaattattgaaggaacttgatactccttttcgactctatggcctcaccatgaacccactgatctacaatataactcgcgtggtcatcctgtccgcagtatctggcgttatttctgatctgttggggtttaacattaggctctggaagatcaaatcttag

SEQ ID NO: 131294 - DNA, 996 bp, Artificial Sequence
  Description of Artificial Sequence: Synthetic coding sequence
taacaaactcgggagaaagctaaatttagcgatggcgaaaaatgtagaagggaagccttcaggagactgggtaatggagtgtccgacgatctttctagtgaggaagatggggaggcccgtacccaaatgattttactgcggagatcggtggagggcgctagctctgacaatggatgtgaggtcaagaaccgaaaatccatcctgagcaggcacctgaactctcaggtcaagaagaccaccacgcggtggtgccatatcgtgagagacagcgattccctggctgagtccgaatttgaatccgcggcatttagccagggctcacggtccggcgtttcgggaggatctagaagcctgaatatgagtcgcagggacagcgagtctactcgacacgacagtgaaaccgaagatatgttatgggatgacctgctgcatggtcctgaatgtagatcatccgtcaccagcgactccgagggcgcccacgtcaataccctgcactccggcacgaaaagagatcccaaagaggatgtgtttcaacagaaccatttgttttggctgcaaaattcatctccctcttctgacagggtgagcgccataatttgggagggcaatgaatgcaagaaaatggatatgagcgtgttagagatatctggtattataatgtccagagtcaacgcttaccaacaaggcgtgggctaccagatgctgggaaacgtggttaccattggcttggccttctttccctttttgcaccggctgttccgggagaagtcactggatcagctcaagtctatctcagccgaagagattttaacacttttttgcggagctccccccgtaacgcccatcatcgtcctgtccattatcaacttctttgagcggctgtgtcttacttggatgttctttttcatgatgtgtgtggccgagcggacttacaagcaggtgtctggcgaaattagaaagattttctatttgttcctgtatatgatctttcattag

SEQ ID NO: 131295 - DNA, 318 bp, Artificial Sequence
  Description of Artificial Sequence: Synthetic coding sequence
atggccagcaatgaacgcgacgctatctcgtggtatcagaagaagataggggcctacgaccagcagatctgggagaagtcaattgagcaaacgcagatcaagggacttaaaaataagcccaaaaaaatggggcatataaagccagatctgatcgacgttgacctgatcaggggttctacctttgcgaaggctaaaccagaaatcccttggactagtctcaccagaaaaggactagtgagggtggtttttttcccactcttttcaaattggtggattcaagtcacctccttgcgcatatttgtgtggttactgctgtag

SEQ ID NO: 131296 - DNA, 702 bp, Artificial Sequence
  Description of Artificial Sequence: Synthetic coding sequence
atggcatccaacgagagagacgcaatttcctggtaccagaagaagataggagcctacgatcagcagatctgggagaagtcgattgaacagacccagataaaagggctgaagaacaagccaaagaaaatggggcacataaagccggatctgatcgatgttgacctgataaggggcagcacctttgccaaggcaaagccagagatcccttggacttcactgaccaggaaagggctggtgagggtcgtgtttttccctctctttagcaattggtggatccaggtgacttcactccgcatcttcgtctggctcttgctgttgtatttcatgcaagttatcgcaatagtcctctacctgatgatgcctatcgttaatatcagtgaagtgctaggacccctgtgtttgatgctcctgatgggcaccgtgcactgccagatcgttagtacacagattacccgaccctctggcaataacggtaaccgtcgtaggcgaaagctgaggaagacggtaaatggagacggcagtcgagagaacggcaataacagctccgataaggtcaggggaatcgagacgctcgagtcagtgcccatcatcggcggcttctgggaaaccatcttcggaaatcggcgcctgctgggagtgtgggtgatgggctgtctgatgacttgtcaggtcaaaaaaatggtgaaacacggccataggtag

SEQ ID NO: 131297 - DNA, 2760 bp, Artificial Sequence
  Description of Artificial Sequence: Synthetic coding sequence
atgaaattcgcctaccggttctctaacctgcttgggaccgtttacagacgaggtaacttgaattttacctgcgacggtaatagcgtcattagtccggtgggcaacagagtgacagtgttcgacctaaagaacaacaagagtgataccctgcccctggcaactcggtacaacgtaaagtgtgtgggcctcagtcccgacggacgattagccattatagtggatgagggtggtgacgcccttctagtaagtctggtctgccgtagtgtattacaccactttcacttcaaaggcagcgtgcacagtgtgtccttcagcccggatggtcggaaattcgttgttactaaaggaaatattgctcagatgtaccacgcccccgggaaaaagagggagtttaatgcttttgtcctggacaaaacctacttcgggccttacgatgagaccacatgcatcgactggacggacgacagcagatgctttgtggttgggtctaaggacatgtcgacctgggtctttggcgctgagcggtgggataacttgatctactatgcactaggcggccacaaagacgcaatcgtcgcatgctttttcgaatccaattcccttgacctttacagtttatcccaggatggcgtgttgtgtatgtggcaatgcgatacaccacccgaggggcttaggctaaaacctccggcgggatggaaagctgacctgctgcagcgcgaagaggaggaagaggaagaagaggatcaggaaggcgaccgcgaaacaaccataagaggaaaggccacacccgcagaagaagagaagacagggaaggtgaagtattcccgtttagccaagtatttcttcaacaaggagggagattttaataacctgaccgctgcagccttccacaagaagagtcacctccttgtgaccgggtttgcatctggaatctttcacctgcacgagctaccagagttcaacctgattcattccctttctatctcagatcagagtatagccagtgtggcaattaactctagcggagactggattgcatttggatgttctggcctggggcagctccttgtatgggagtggcagtccgaaagttatgtgctgaagcagcagggccactttaatagcatggtggcgctggcctattcaccagacggtcagtacatcgtgacaggcggcgatgatggcaaggttaaggtgtggaatactctgagcgggttttgcttcgttaccttcacagagcactcatcaggtgtcaccggcgtcacctttaccgctacgggctatgtggttgtgaccagcagcatggacgggaccgtaagggcattcgatctgcaccggtataggaatttccgaacttttacatccccccggcctactcaatttagctgcgttgccgttgacgcctccggggaaatcgttagtgcgggggcgcaggactcgtttgaaatttttgtctggagcatgcaaacaggccgcctcctggacgtgttgtctggacacgaggggcccatcagtgggctgtgcttcaaccctatgaaatccgtgctcgcaagcgcctcctgggacaagactgttagactgtgggacatgtttgacagttggcgtacaaaagaaaccttagcgctgacttccgacgcactagcagtaacatttcgacctgacggggccgaactcgccgttgcaaccttgaactctcagataaccttttgggatccggaaaacgctgtgcagaccggaagcatcgagggtagacacgacctcaagacgggtcgaaaggagctcgacaaaattactgccaagcatgccgctaaggggaaagccttcacagccctctgctactccgctgacggtcactctatccttgccggcggaatgagcaagtttgtctgtatataccatgtgagggagcaaatcctgatgaagaggttcgagatctcttgcaacctgtccctcgacgccatggaggagtttcttaatcgccggaaaatgacggaattcggcaatttagctttgattgaccaggacgcaggtcaggaggacggcgtggctataccactgcctggtgtcaggaaaggcgacatgtcttcccgccacttcaaacccgagatcagggttaccagtctcagatttagcccaactgggagatgctgggcagccaccactaccgagggtctgttaatttactcccttgacacccgtgtgctgttcgaccctttcgagctggacacttcagtgactccgggtagggtgagagaggctctgaggcagcaggatttcacacgggctattctgatggcactccggcttaatgaatctaaactggtgcaggaggccctggaggctgtgcccagaggcgaaatcgaagttgtgacttcttctctcccggaactgtatgtagaaaaggtgcttgagttcttagcctctagcttcgaggtgagtagacacttggagttctatctgctctggacccacaaacttctgatgctgcacggccagaaactcaagtcccgcgccgggaccctgctcccagtcatccagttccttcagaaatctatccagcggcacttagacgacctgtcaaaactgtgctcctggaaccactacaacatgcaatatgctctggccgtcagcaaacagagggggactaagagatctctggatcccttaggcagcgaagaggaagccgaagccagtgaggacgattcactgcatctgctggggggcggtggcagagactcagaggaggagatgctcgcctag

SEQ ID NO: 131298 - DNA, 1686 bp, Artificial Sequence
  Description of Artificial Sequence: Synthetic coding sequence
atggcattcatggagaaaccacccgcgggaaaggtgctgcttgatgacaccgttccactgactgccgccattgaggcttcccagtcgctccaatcacataccattgtgaggaggtattccgattttgatctccttaataattcgctacagattgctgggttgtccttgcccctgcccccaaagaaactcattggaaatatggatagggagttcattgcggagaggcaaaagggcctgcagaactacctcaacgtgatcaccacaaatcacatcctgagtaattgcgaactcgtgaagaagttcctggatccaaataactacagcgctaattacacagagatcgctttacaacaagtcagcatgttcttcaggtctgaacccaagtgggaagtggttgaaccactcaaagacatcggttggcgcatacggaagaaatactttctgatgaagataaaaaatcagcctaaggagcgcctggtcctgtcatgggccgatctggggcccgacaaatatctttccgacaaggatttccagtgtttgatcaagttgttgcctagttgtctgcacccctacatttatcgtgtgacctttgcaacagctaatgaaagctctgccttgctgatccgaatgtttaacgaaaaggggactctgaaggatctcatttacaaagccaaacctaaggatccattcctaaagaagtactgcaatcctaagaaaattcaaggacttgagctgcaacagatcaagacctacgggcggcagatacttgaagttcttaagttccttcatgataaaggattcccatacgggcacctccatgcctctaatgtaatgttagatggcgatacttgccgactgctggacctcgaaaacagtctcctgggcctaccctcgttctaccggagctacttttcacaattccggaagatcaacacccttgagtccgtggatgtgcattgctttggccatcttctctacgaaatgacctacggaagacccccagactccgtgcctgtggactctttcccaccagctccatctatggctgtagtggcagtgctagaatcaactctgagttgcgaggcttgcaagaacggcatgccaaccatctcacgcctgcttcagatgcccttattcagtgacgtactcctcaccacatctgagaagcctcagtttaagattcctaccaagttgaaagaagcgctgcgtatcgctaaagaatgcattgagaagcggttgatagaagagcagaaacagattcatcaacatcgtaggctgaccagagcccagtcacaccacggttcagaggaagaacgcaaaaaaagaaaaatcctggcgcgaaaaaaatcaaaacggtcagccttggagaacagtgaggagcattccgcgaagtatagcaattccaacaactcggcagggtcaggagcctcttcgcctctgacttccccctccagccctactcccccctccacgtcagggatatctgctcttcctccaccccccccaccaccaccacctccagcagctccgctaccgccagcatccaccgaagcgccagcacagctgtccagtcaggcagtgaacgggatgagtcggggcgccctgctgtctagcatccaaaattttcagaaaggaactctccgtaaagcaaagacctgtgatcactccgcacccaagataggctag

SEQ ID NO: 131299 - DNA, 1737 bp, Artificial Sequence
  Description of Artificial Sequence: Synthetic coding sequence
atggctttcatggaaaagccaccggctggcaaggtgctgttggatgacactgtgcctctgaccgcagccatagaagcatcacagtcgttgcagagtcatacagagtacatcattagagtgcaacgaggaataagcgtggaaaatagctggcaaatcgtccgtcgctacagcgactttgatctgctgaacaattctctccagatcgcaggcctctctctcccactcccaccgaaaaagctcattggaaatatggacagagagtttatcgctgagcggcagaaaggcctccagaactatttgaacgtcataactaccaaccacattcttagcaattgcgagttggtaaagaagttcttagatcccaacaattactcagccaattacaccgagatcgcactgcagcaggtttctatgttttttagatcagagcccaaatgggaagttgtcgagccactgaaagatatcggctggcgcatcagaaagaagtactttctcatgaaaattaagaaccagccaaaagagcgtttggtgttatcctgggctgacctcggaccagacaaatacctgagcgacaaagattttcagtgcctcattaagttactgccaagctgtttacacccctacatatatagagtcaccttcgctaccgccaatgaaagctcagcgttattgattcgcatgtttaacgaaaaagggaccttgaaagacctgatctacaaggctaagcctaaggacccgtttttgaaaaagtactgtaaccccaaaaagattcagggccttgagcttcagcaaattaagacctatggaagacaaatcctggaggtgttaaagttcctccacgacaaggggttcccctatggacatctgcacgccagcaacgtcatgctggacggggacacctgtagactgctggacctagagaactcccttctgggcctccctagcttctaccggagctattttagccagtttagaaagattaacaccctggaatctgttgacgtccattgttttggacacctgctttatgagatgacctatggcaggcccccagattccgttccggtggactcatttcccccggctccttccatggccgtggttgctgtgctcgagagcacgctctcctgcgaggcatgcaagaatggcatgccgacaatctccagattgcttcagatgccacttttctccgatgtcctcctgactacaagcgagaagccccagtttaaaatccccacgaagcttaaggaagcactccgcatagccaaggaatgcattgaaaaaaggctgattgaagagcagaaacagatacaccagcataggcggttgactagagcacaatctcatcacgggtccgaagaggagcggaagaagagaaagattttggctcgcaagaagtccaagcgaagcgccctggaaaactccgaggagcattccgccaagtattcgaactcaaataatagtgctggctctggggcttcaagccccctgacttcaccgtcttctccaactccacccagcacttctggcatttccgccctgcctccgccaccgccccctccaccacctcctgccgctccattaccgccagcatcaacagaagccccagcccagctctcctctcaggcagtgaacgggatgtccagaggtgcccttctgagctctattcagaacttccaaaaaggcaccctgcggaaagccaagacctgcgatcactcggctccaaagatcggatag

SEQ ID NO: 131300 - DNA, 1638 bp, Artificial Sequence
  Description of Artificial Sequence: Synthetic coding sequence
atggcctttatggagaagccccccgcaggaaaggtcctgctagacgacacagtgccactcacagcagctattgaggcgagccagagcctccagagtcacaccattgcgggactgtccttgcccctgccacctaagaagctgatcggcaatatggacagagaatttattgctgagcggcagaagggcctccaaaattatcttaacgtgatcaccactaaccacatactgagcaactgtgaactggtgaagaagttcctcgacccaaacaattattctgcaaactatacggagatagccctccagcaggtctcaatgttctttcgtagcgagccgaaatgggaggtagtggagcctctcaaagacatagggtggaggatcagaaagaaatacttcctgatgaagattaaaaatcagcccaaagagcgacttgtcctgtcttgggcggacctgggacccgacaaatacctgtcagacaaggatttccagtgtttaataaaactactcccctcttgtcttcacccatacatctaccgcgttacgttcgcaaccgctaacgagagtagcgcactattaatcagaatgtttaacgagaagggtacactgaaagatctgatttataaagccaaacccaaggacccattcttgaagaagtactgtaatccaaagaagatccagggactggaacttcagcaaatcaagacctatgggcgccagattttggaagtgcttaaatttttgcatgataaggggttcccctacggtcatctccatgcttcgaatgttatgctcgacggcgacacatgtaggttgctggaccttgaaaatagccttcttgggctgccctcattctaccgctcctacttcagccagttccggaaaatcaacaccctcgagtcagtggacgtgcactgctttgggcacctcctgtatgagatgacttatggccgacccccggattccgtccctgtagacagcttccccccagctcctagcatggccgttgtggccgtacttgaatcaaccctatcttgcgaggcctgcaagaatggcatgcccacgatctctcgcctgctgcagatgcccctgtttagcgacgtgttactgacaacaagcgaaaaaccacagttcaagatccctactaaactcaaagaagcccttagaatcgcaaaggaatgtatagagaagagactgatcgaggagcagaagcagattcaccagcatcgacgacttacccgggcacagtctcaccacggctcagaggaagaacgcaaaaagagaaagatccttgcaagaaagaaatcgaagcgttctgccctcgagaactccgaagaacactccgccaaatattcgaactctaacaatagcgccggttctggtgcttccagtccattgacaagcccttcttcccctactccaccctccacctccggcatatcagcactcccaccgccccccccacctccccctccgccagctgccccattgccccctgctagtactgaagctcctgcccaactgtcctcacaggccgtcaacgggatgtcccgcggagctctccttagcagcattcagaacttccaaaaaggcactttgaggaaagccaagacgtgcgatcactctgctcccaagattggatag

SEQ ID NO: 131301 - DNA, 1548 bp, Artificial Sequence
  Description of Artificial Sequence: Synthetic coding sequence
atggctttcatggagaagcccccagcggggaaagtcctgctggacgacacggtgccactgactgccgcaatcgaggcctcccagagcttacagtcccatactgaatacatcattcgcgttcagcgtggaattagtgtggaaaactcatggcagattgttcgccgatattccgatttcgacctgttgaataacagtctccagatcgcaggtctgtccctccctctgccacccaagaagctaatcggaaacatggaccgggagtttattgccgagagacaaaaaggcctgcagaattacctgaacgtgatcaccacaaaccacatactttccaattgtgagctggttaagaaattcttggatccaaacaattactctgcaaattatacagaaatcgccctgcagcaggtcagcatgttttttcgaagtgagcccaagtgggaagtggtggaaccactgaaagatattggttggcgcatccggaaaaagtattttttgatgaagatcaaaaaccagcccaaggagagactggttctcagctgggccgaccttgggcccgataagtatctctccgacaaagattttcaatgtttgatcaagctcctcccctcttgtctgcacccctacatctaccgggtgacatttgctaccgcaaatgagagttctgccttgttaatccgcatgttcaacgagaagggcacactgaaagatctaatttataaggcaaagccaaaagatccttttttgaaaaaatattgtaaccccaagaagattcagggtctggagttgcagcaaataaagacgtacggaagacaaatattggaagtgctgaagttcctacacgataaaggctttccctatggtcacctgcacgcctctaatgtgatgctggatggagacacctgccgcctgctcgacctggaaaactctttgcttgggctcccaagtttctataggtcatatttcagccagttccgtaagatcaacacactagagtccgttgacgtgcattgcttcgggcacctgttgtacgaaatgacctacggccgcccgcctgacagtgttccagtggatagcttccctcccgcacctagtatggctgtggtagctgtcctggaaagcacgctgagttgtgaagcttgtaagaatggcatgcccaccattagcaggctcctccagatgcctttgttttcggatgtgttgctcacaacgtcagaaaaacctcagtttaagataccaactaagctgaaagaggctcttcgaattgcaaaagagtgcatcgaaaaacgtctgatagaggaacagaagcaaatccaccaacacaggcgccttacgagggctcagtcgcaccatgggagcgaagaagagcgaaagaagaggaagatcctcgcaaggaagaaatccaagcgcagcgctctggagaactccgaggaacactctgccaaatattccaactcaaacaattcagctgggtccggcgcttcttcacctcttacctcgccttcctcgcccacgcctccgagcacctccgttgagcacgcacccttttag

SEQ ID NO: 131302 - DNA, 1326 bp, Artificial Sequence
  Description of Artificial Sequence: Synthetic coding sequence
atgttcttccgctccgagccgaaatgggaggtcgtggagccactgaaggacatcgggtggaggattcgcaaaaagtactttcttatgaagatcaagaaccagccgaaagaacgcttggtcctcagttgggctgacttaggcccagacaaatatttgtctgacaaagattttcagtgtctaatcaagcttttaccaagctgcctccacccatacatttatcgggtgaccttcgctacggcaaacgaatctagcgctctgttaatcagaatgttcaatgagaaaggcactctgaaggacctcatctacaaagctaaaccaaaggaccccttcctgaaaaagtactgtaaccccaagaaaatccagggcctcgagctacagcagattaagacgtatggccgccaaattcttgaggttttaaagtttctgcacgacaagggcttcccctatggccacctccacgctagcaatgtgatgctggatggcgacacatgtcgacttctggatttagagaactctctgcttgggctgccgagtttctaccggtcttacttttcgcagtttcgcaagatcaacaccctcgaatctgtggacgtacactgttttgggcacctgctgtacgagatgacgtacgggcgaccccccgactcagtgccagttgacagctttccgccagctccgagtatggctgtggtggctgttttggagtccacactgagttgcgaagcctgcaaaaatggcatgcccactatttcaagactgctgcagatgcctctgttctcggatgtgctcctgactacttcggagaaaccgcagttcaagattccaacgaagctgaaagaggcccttcgcatagccaaagaatgcatagagaaaagactcattgaagagcagaagcagatccatcagcatcggaggcttactagagcccagagccaccatggctccgaagaagaacgaaaaaagcgcaaaatcctagcgcgcaagaagtcaaagcgcagcgccctagagaactccgaagaacattcagccaagtactccaacagtaataattccgctggctccggggcttcctctcctctcacatctcccagctcccctacaccgccgtctaccagcggtatcagcgccctgcccccccctcccccacctcctccccctccagccgctcctctgccacctgcatccaccgaagctcccgcacagttgtctagccaggcagtgaatggtatgtctcgcggggcactactatcctctatccagaacttccagaagggcaccctcaggaaagcaaagacatgtgaccatagtgccccaaaaatagggtag

SEQ ID NO: 131303 - DNA, 1005 bp, Artificial Sequence
  Description of Artificial Sequence: Synthetic coding sequence
atgtttttcaggtctgaaccaaagtgggaggtggttgagcctctcaaggacatcggctggagaatacggaaaaaatatttcctgatgaaaataaaaaaccaacctaaggagagactggttctttcatgggctgacctaggaccggacaaatacctctccgacaaggacttccaatgtctgataaaactgctgccttcatgccttcacccctatatctacagggtgactttcgcaaccgctaatgagtcctctgcgttgctgataaggatgttcaatgagaaaggaactctcaaggacctgatctataaggcaaagccaaaagatcccttcctgaagaagtactgcaatcctaagaaaatccagggtctagagcttcagcagatcaaaacctatggccgtcagatccttgaggttctgaaattcctgcacgacaaaggcttcccgtacggtcacctacacgctagtaacgtgatgcttgacggcgacacatgtagactcctcgacctggaaaattctctgctaggactgccttctttctatcgatcttatttctcacagttccgtaagataaacactcttgaatccgttgatgtccactgttttggacatctactgtatgagatgacttatggaagaccgcccgattcagttcctgtggactccttccccccggccccatcaatggctgtggtggccgttctagagtcaacactcagttgtgaggcgtgcaagaatgggatgccaacgatttctagactgctccagatgcctctgttcagcgatgtgctgctgaccacgtccgagaaaccacagttcaaaatccccactaaactgaaagaggcgcttaggatcgcaaaagagtgcatcgaaaaaaggctgatcgaagagcagaagcagatccaccaacatcggaggctgacccgagcacaaagtcatcacggctcggaagaggagcgcaagaaaaaagatttcagcagcaaggaagtgaagacaatttgctcctag

SEQ ID NO: 131304 - DNA, 1110 bp, Artificial Sequence
  Description of Artificial Sequence: Synthetic coding sequence
atgaaatcccctgaaaagaagcggcggaagagtaacacacagggacccgcctattcacacctgaccgagtttgctccacctcccaccccaatggtggatcacttggtagcatcaaacccatttgaagatgattttggggccccgaaagtgggagtagccgctccaccattcctcggctcccctgtgccattcggcgggttcagagtgcagggaggcatggcagggcaggtcccccctggctacagtacaggtggcggcggcgggccccagcctctgcgccggcagccacctccattccctccgaatcccatggggcccgccttcaatatgcctccacagggtccaggctacccccccccaggtaacatgaatttcccaagtcaacccttcaaccaaccattagggcaaaacttcagtcctccatctggccagatgatgcccgggcccgtaggcgggttcgggcccatgatatctcccactatgggccagccccccagagctgagttggggccccccagcttgtcccagcgctttgcccagccaggagccccatttgggccttccccgctgcagcgaccaggtcaaggactgcctagcctgccacctaacacatcaccctttcctgggccggatcccgggttcccaggccccggaggcgaggacgggggtaagcccttgaatccccccgcatctacagccttcccccaggagccacacagcggctctccggcagctgcggtgaatggcaatcagccaagcttcccccccaactcttccggtcggggcggcgggacaccagatgctaattctttggcacctcctggcaaggccggcggcggatccggaccccagcctcccccgggactagtgtacccctgtggtgcttgccgttccgaggtgaacgacgaccaggacgccattctgtgtgaggcttcatgccaaaaatggttccaccgcgagtgtacgggcatgactgagagcgcttatggattactgaccactgaagcctcagctgtgtgggcttgcgacctgtgtctaaagacaaaggagatccagtcagtgtatattcgtgagggaatggggcagcttgtcgctgccaacgacggctag

SEQ ID NO: 131305 - DNA, 1221 bp, Artificial Sequence
  Description of Artificial Sequence: Synthetic coding sequence
atggccgcttctgcacctccaccacccgacaagctggaaggcggcggtggccctgccccaccacctgctccaccttccacaggacggaagcagggcaaggcaggcctgcagatgaaaagccccgagaagaaaaggaggaaaagcaacacacaggggcctgcttatagtcacctgacggagtttgcgcccccccccaccccaatggttgatcatcttgtcgcctctaacccctttgaggatgacttcggggctcctaaggtcggcgtggcagcaccaccctttctgggatccccagtcccgttcgggggattccgcgttcagggcggcatggcgggacaggtgccaccgggctactctacaggaggtggaggaggaccccaacctctacggcgccagccccctccatttcctcccaaccctatgggaccagccttcaatatgccacctcagggcccaggctatccgccccccggcaatatgaatttcccatcccagcccttcaaccaacctttggggcaaaacttctctccgcctagcggccaaatgatgcccggtccggtggggggatttgggcccatgattagccccacgatgggacagccccctagagccgagctgggcccaccttcactaagccaacggtttgcacagcccggcgcaccgttcggtccctcacccctccagaggccgggccaagggcttccttcgctcccacctaacacctcgccctttcccggcccagacccagggtttccggggcccgggggggaggatggcggtaagccgttgaacccccctgctagtaccgcctttccgcaggagccccacagcggtagtcctgccgctgccgtcaatgggaatcagcccagctttcctcctaactcttccgggagaggcggaggaacgccggatgcaaatagcctggctcccccggggaaagccggaggaggatcggggccccagccaccccctggcttagtctacccttgcggcgcctgtcgaagtgaggttaacgacgatcaagacgccattttgtgtgaagcctcctgtcagaagtggttccatagagaatgcactggtatgacggaatcagcctacggccttctgacgacggaagccagcgcagtctgggcctgtgatttgtgcctgaagactaaagagatccagagtgtctacattagagaggggatgggacagctcgtggctgccaacgacggttag

SEQ ID NO: 131306 - DNA, 939 bp, Artificial Sequence
  Description of Artificial Sequence: Synthetic coding sequence
atggaagaggaatgcagggttctgtccattcagtcacatgtgataagaggctacgtcggtaaccgcgcggccaccttccctctccaagtgctcgggtttgaaattgatgccgtgaatagcgtccaattcagcaatcacaccgggtacgcacattggaagggccaggtgcttaatagcgacgagctccaggagctgtatgaaggtcttaggcttaacaacatgaacaaatatgactatgtcctcacaggttatactagagacaagagctttttggccatggtggtggacatagtgcaggaattgaagcaacagaatcctaggcttgtgtacgtgtgcgaccccgtgctgggcgacaagtgggatggagagggatccatgtacgtgcctgaagacttgctccctgtgtacaaagagaaagtcgtccccctggctgatataattacacccaatcagttcgaggcggagctcctgtctggccgtaagattcacagccaagaggaggcgctaagggttatggatatgctccactctatgggccccgataccgttgttattacttcaagcgatctgccaagccctcaaggaagcaattatctcatcgttcttggttcgcagcggcgcaggaacccggccggaagcgtggttatggaacggatcaggatggatatacggaaagtcgacgccgtgttcgtagggactggtgacctgttcgctgccatgcttctcgcttggacccacaagcaccccaataatttaaaggtggcttgcgagaaaaccgtgtcaactctgcatcatgtgctgcagcggacaattcaatgcgcgaaggcccaggccggcgagggcgttagaccgagtccaatgcagcttgaactgcgtatggtgcagagcaagcgagatattgaagaccctgaaatcgtagtgcaggcaaccgttctgtag

SEQ ID NO: 131307 - DNA, 855 bp, Artificial Sequence
  Description of Artificial Sequence: Synthetic coding sequence
atggaggaggaatgtcgcgtgctgtcaatacagtcccacgtcatccgaggctatgtgggaaaccgcgcggccactttccctctacaggtgctgggctttgagatcgatgccgtgaactctgttcagttttcaaaccacaccggatacgctcattggaagggccaggtgttgaactccgatgagctgcaggaactgtatgaggggcttcggttgaacaatatgaataagtatgactacgtcttgaccgtgtgcgaccctgtgctcggggacaagtgggatggtgaagggtctatgtatgtcccagaggacttgctgccagtctacaaggagaaggtggttccgttggccgacatcatcaccccaaatcagttcgaggcagagctgctgagcggtcgaaagatccacagccaggaagaagctctgcgtgtgatggacatgctgcactcaatgggtccggacaccgtggtgattacttcaagcgacctgccatcccctcagggttcaaactatctgatcgttctaggttcccaacgaagacggaaccccgccgggagcgtggtgatggagcggataagaatggatattcgcaaagtcgacgcggtattcgtgggaaccggagacttgttcgcagcgatgctcttagcttggacccacaagcacccaaataacctgaaagttgcttgcgagaagacagtgtcaactctgcatcacgtcctgcagaggacgatacagtgtgcgaaagcccaggcaggtgaaggcgtgagaccctcaccgatgcaactggaactcaggatggtgcaatctaagcgagatatagaggatccagaaatcgtagtgcaggcgacagtcctgtag

SEQ ID NO: 131308 - DNA, 2322 bp, Artificial Sequence
  Description of Artificial Sequence: Synthetic coding sequence
atgggcaagaaccttaaagaagcggtcaaaatgttggaggattcccagcgcaggactgaggaggaaaatggtaagaaactaatttctggtgacatccctggacccctgcaggggtcaggccaagatatggtctcaatcctgcagctagtgcaaaacttgatgcacggcgatgaagatgaagagccccagagtccccggatccagaatatcggagaacaggggcacatggccctccttggtcactccctgggggcttacattagcacattggacaaggaaaagttgagaaaactcactacaaggatattatccgataccacgttatggctctgtcgcatcttcaggtatgagaacggttgcgcctatttccacgaggaggagagggaagggctcgctaagatttgtcggctggccatccactcccgctacgaggactttgtggtggacgggttcaatgtgctgtataacaaaaagccagtgatttatttatctgccgccgcacgccccggactgggccagtatctttgcaaccagctggggctgccattcccctgcctgtgccgggtgccctgcaacactgtgtttggcagccagcaccaaatggatgtggccttccttgagaaattgattaaggacgacattgaacgtgggcgcctgccactcctgctggtggccaatgctgggactgccgctgtgggacacacagacaagataggcagattaaaagagctgtgtgaacaatacggcatctggctgcatgtagagggagtcaatctggcaactctggccctcggatatgtttcaagcagtgtcctggctgcggcgaaatgtgatagtatgaccatgacacctgggccctggctgggactccccgctgttcctgcagtaaccctgtataaacacgacgatccagccctgactttagttgcagggctgacttcgaacaaacccactgataagctgagggccctgccactgtggctgtccttgcagtacctgggccttgatgggtttgtcgaaaggatcaagcacgcctgccagctgagtcagcgattgcaggaaagcctgaaaaaggttaattatattaaaattctagtcgaggatgaactgtctagcccagtcgtcgtgtttcgattttttcaggaactgcccggctcggacccagtgttcaaagcagtgcccgtccccaacatgactcccagcggggttggacgggagcgccattcatgcgatgcgctcaaccggtggctgggcgaacaactcaagcagttagttcctgctagtggtctaactgtaatggaccttgaggctgaggggacttgtctgcgttttagtccgctgatgacggccgcagttcttggaacccgtggcgaggatgtcgaccagctggtcgcctgcatcgagagtaagctgcccgtgctgtgttgcaccctacagctccgagaggaatttaagcaagaggtcgaagcaaccgcgggcctcctgtatgtcgacgatccaaactggtctggaatcggcgtggtgaggtatgagcatgcgaacgacgataagagcagcctgaagtccgacccggagggggagaacatccacgccgggctcttgaagaagctgaatgagcttgagtcagatttaaccttcaagatcggccctgagtataaaagcatgaaatcgtgcctttacgtgggtatggcatccgacaatgtggatgcagcggaacttgtagagaccatcgctgcaaccgcccgagagattgaagaaaattcgagattgttagagaatatgacggaggtggtaaggaaggggatccaagaagctcaggtggagcttcaaaaagctagtgaggaacgcctccttgaagagggagtactccggcagattccagtggtgggaagtgtgctgaactggttcagccctgtacaggcactgcaaaagggtaggactttcaatttgactgcagggagcctggaatctacagaacccatctacgtctataaagctcagggcgccggagtaaccttgccacccacccccagcgggtcccggaccaagcagcgcctgccaggccaaaaaccatttaagcgatccctgcgaggttctgatgccctgtctgagacctcatccgtttcccatattgaagacttggaaaaggtggagaggctgagtagtggacctgaacagattacactcgaggcctccagcacggaggggcatccaggagcaccttctccacagcacacagatcagacagaggcttttcagaagggcgtgcctcatcctgaagacgaccatagtcaagtcgaagggcccgaaagcctccgctag

SEQ ID NO: 131309 - DNA, 2367 bp, Artificial Sequence
  Description of Artificial Sequence: Synthetic coding sequence
atggatgcgtccttagaaaaaatcgccgaccctacactggcggagatgggcaaaaacctcaaggaggctgttaaaatgttggaagactcacagagacgaactgaagaggaaaacggcaaaaagctgatttccggagacattccaggccccttacagggctcaggacaggacatggtaagtatcttgcagcttgtgcagaacctgatgcacggggatgaagacgaggaaccgcagtcccctcgtatccagaatattggagaacagggtcacatggctctgctggggcactcactcggcgcatacattagcacactggataaagaaaagctgcggaaacttactaccaggattctgtcagacacaactctgtggctttgcagaatcttcaggtatgagaacggctgcgcctacttccacgaagaggagcgagagggcctcgccaaaatctgtaggcttgccattcacagtcggtatgaagactttgtcgtggacggatttaatgtcctctataacaagaagcccgtgatatatctcagcgccgccgccaggcccggactggggcaatacctctgcaaccaattgggcctaccctttccttgtctgtgcagggttccttgcaacaccgtttttggtagccagcaccaaatggacgtggccttcctggaaaagcttatcaaggatgacattgaacgcggccgcttacctctgcttctcgtggctaacgccggcaccgctgcggtcggtcacacagacaagataggaagactgaaagagttgtgtgaacagtatggtatatggctgcacgtggaaggagtgaatctcgccacactggccctcgggtacgtctcatcgtctgtgttagccgcagcaaaatgtgatagtatgaccatgactcctggtccctggctggggctgcccgcggtccctgcggtgactttgtataaacacgatgacccagccctgactctggtagctggcctgacgagtaacaaacccacggataaattaagagccttacccctctggctgtctctacaatacctcggcctggacggctttgtggagagaattaagcacgcttgtcagctcagccagaggctgcaagagagcctgaaaaaggttaactatataaaaatccttgtggaggacgagttgagctcccccgtagtggtctttagattttttcaggagctgcccggcagcgatcccgtgttcaaggctgtgcccgtgccaaatatgacccccagcggcgtgggcagagagagacatagttgtgacgcactcaaccggtggctaggggagcagctcaaacagctggtccctgctagtggactgactgtgatggatctggaggctgagggaacctgtttgagattcagcccgcttatgaccgcggccgtgctgggaacacgcggcgaagacgtggaccagctggtagcttgtatcgagagcaaactcccggtgctctgctgtaccctgcaactgcgtgaggagtttaaacaggaggtggaagccactgcaggccttctatatgtcgacgatcccaattggtccgggataggtgtggtgcggtacgaacatgccaacgacgacaaatcttctctcaaaagcgaccctgagggagaaaatatacacgctggactgttgaagaagcttaatgagcttgaatccgatcttaccttcaagattgggcctgagtataagtctatgaaatcttgcctctacgtgggcatggcctctgataacgtcgacgctgctgaattggtcgagacgatagcagctactgcaagggaaatagaagagaattcaagactgctggagaatatgacagaggtggtcagaaaaggtattcaggaggcccaagtcgaactgcagaaagcgagcgaagagagactgcttgaagagggcgtcctgcgacaaatcccagtcgttggctctgtccttaactggtttagccccgtgcaggccctccaaaagggaaggacttttaatctgaccgccgggagcttggagtccacagaacccatttacgtctataaggcccaaggcgcaggtgtgacactacctcccacaccttcagggagtaggacaaaacagcggttacccggacaaaagccttttaaaagatcactgcgcggcagcgatgccctgagcgagacatcaagcgtgagtcacatcgaggatctggaaaaggtcgaaagactaagctctggtccggagcagattacactggaggcttcatccacggaagggcatcccggcgctccctccccacagcatactgaccaaactgaagcttttcaaaagggggttccacaccccgaggatgaccatagccaagtggagggaccagaatctcttcgctag

SEQ ID NO: 131310 - DNA, 2094 bp, Artificial Sequence
  Description of Artificial Sequence: Synthetic coding sequence
atgggcaaaaatcttaaagaggcggtgaagatgctcgaagattcgcagcgtcgcaccgaggaagagaatggcaagaagctcatctccggagatatccccggcccacttcaagggagatacgaaaatggctgcgcctattttcacgaggaagagcgcgagggccttgcgaagatttgccggttagcaattcactcacggtatgaagattttgttgtggatgggttcaatgtgctgtacaataagaagccagtcatttacctttccgcagccgcaaggcctggcttaggccagtatttgtgcaaccagctcgggctcccttttccttgtctttgtcgcgtaccctgcaatacagtgtttgggagtcagcaccaaatggacgtggcatttttagagaagctgatcaaggacgatatagagcgcgggagattgcctctgctgctggttgcaaacgctggcacagcagccgttggacacacagacaaaattgggaggcttaaagagctgtgtgaacagtatggcatctggctgcatgttgagggcgtaaaccttgccactctggccttgggatatgttagttcttcagtgctggccgccgctaagtgcgacagtatgactatgacccctggtccgtggctgggcctgcccgctgtgcctgccgttactttgtacaaacatgatgacccagcactgaccctggtggcggggctgacatcaaataagcctacggataagctgagggccctgcctctctggctgtcgctgcagtaccttggcttggatggctttgtcgagcggatcaagcacgcatgtcagctctctcagagattacaggagtccctgaaaaaagtcaattatatcaaaatcttggtggaggatgagctgagcagcccggtggtggtgtttcgcttctttcaagaactgcctgggtccgaccctgtgttcaaggcagtccctgtgcctaatatgaccccctcaggcgtggggcgagaaagacactcatgtgacgccttaaaccggtggctgggggagcagttgaagcaattggtacctgcctccggcctcacagttatggatctggaagcggaagggacctgcctgcgctttagccccctgatgaccgcagctgtgttgggcacaagaggcgaggacgtggaccagctggtggcctgtatagagagcaaactccctgttctgtgctgtacgctacaattgagagaggaattcaaacaggaagtggaggctaccgcgggattgctgtacgtcgatgatcccaattggtcaggaattggcgtggtccggtatgaacacgctaatgacgataaatcgtccctcaagagcgacccagagggtgaaaatatccacgctggactgttgaagaaactaaatgaactcgaaagcgaccttacctttaagatcggccccgagtacaagtctatgaagtcttgcctgtacgtgggcatggcttctgataacgtggatgcagccgaattagtggagaccatagctgccaccgccagagagatcgaggaaaactctaggctcttggagaacatgacggaagttgtgcggaagggcatccaggaggcacaggtcgaattgcagaaggccagcgaggagagactccttgaggagggcgttctgcggcagatacctgtcgtcggttcagttctcaattggttttctcccgttcaggcgttgcagaaagggcggacttttaacctgaccgcaggctccttagagagcaccgagccaatatatgtgtataaggcacagggggccggggttaccttgcccccgacccctagcggaagccgaacaaaacagaggctgccagggcaaaaacctttcaaaaggagccttcgtggctcagacgccctttctgagacctcaagcgtctctcacatagaggatctggaaaaagtggagagactttcttctggaccagagcagattacccttgaagcctcctcaacagaagggcacccgggcgctccttcgccgcagcacacagaccagaccgaggcctttcagaaaggcgttccacatcccgaggacgatcacagccaggtggaaggccctgaatccctgagatag

SEQ ID NO: 131311 - DNA, 2283 bp, Artificial Sequence
  Description of Artificial Sequence: Synthetic coding sequence
atggacgcaagcctggagaaaattgccgatcctactctggctgagatggggaaaaacctgaaggaggcagtgaagatgctggaagatagccagcgcaccgaagaggagaatggtaaaaaactgatctccggcgatatccccgggccgctccagggccgcattcagaatatcggcgaacaagggcacatggccctcctgggccacagtttgggcgcttacatatctaccctggataaagaaaaactccggaaattgaccacccggatcctgtccgacactaccctgtggctttgccgcattttccggtacgagaacgggtgcgcttactttcacgaagaggagagggaggggctcgcgaaaatctgtcggctggctattcactcgcgctacgaagatttcgtcgttgatgggtttaacgtcctctataacaagaaaccggtcatttacttgtcagccgcggcacgtccgggactcggacagtatctgtgcaaccaacttgggctgcctttcccgtgtctgtgccgggtgccttgtaacacagtatttgggtcccaacatcagatggacgtggcctttttggaaaaacttatcaaggacgacattgagcggggaaggctgccgctcctccttgttgcaaacgctgggacagcggcggtaggacatactgataaaatcggccgactgaaagaattatgtgagcagtacggaatttggttgcatgtcgagggtgtaaacttggctaccttagcattgggatacgtgtccagttctgtgctcgccgccgccaagtgcgactcaatgactatgacccctgggccttggttgggtctccccgccgttccagcagtcactctatataagcatgacgatccagcgttaacgctggttgccggacttaccagtaataagcccacagacaaactacgggctctgcctctttggttatcccttcaatacctgggcttggatggattcgttgagcgaattaagcacgcctgccagctctcccagcggttgcaggagagtctgaaaaaggtgaattacattaaaattcttgttgaagacgaactgagcagcccggtggttgtgttccggttctttcaggagcttcctggaagcgaccccgtgtttaaggcagtgcctgtacccaacatgacaccctccggggttggcagagagaggcactcatgcgacgcactgaatagatggttgggagaacagctcaagcagttggtgccagccagcggactcactgttatggatctagaagcagagggcacctgcctgcggtttagtcccctcatgacagcagctgtactgggcacgcggggcgaagacgtcgatcagttggtagcctgcatcgagagtaagctgccagtcttatgctgcacactccagctgcgtgaggaatttaagcaagaggtggaagccaccgccggtctgctgtatgtggatgaccccaattggtctggcataggagtcgtgcggtacgagcacgctaacgacgacaagagctcgctgaaaagcgaccctgagggagagaacatccacgctggtctacttaaaaagctgaatgaactagaatctgatttaaccttcaagattggccccgaatacaagagtatgaagtcatgtctttacgttggtatggctagtgacaatgtggacgctgccgagctcgtcgagacaatagcggccacagccagagaaattgaggaaaactccagactcttggaaaacatgacggaggtggtacggaaaggtatccaagaggcacaggtggagcttcagaaagcatcagaggagagattgctggaggagggcgtcctaagacaaatacctgtggtggggtcagttctgaactggttttctcccgttcaggctctgcagaaagggaggaccttcaatttgactgcgggatctttggaatcaaccgaacctatctatgtatataaggcacagggggccggggtgactcttccacccacccccagtgggagtagaacaaagcaacgcctaccgggacagaagccgttcaagcgatccctcagaggcagcgacgcactcagcgaaacttcctctgtgagtcatatagaggacctagaaaaagtggagaggttgagcagcggtcctgaacaaatcacgttagaggcatcttccaccgaaggccaccccggagcgccgtccccgcaacatacagatcagacggaagctttccagaaaggagttccccacccggaagacgaccacagtcaagtggaaggccccgagtctctcagatag

SEQ ID NO: 131312 - DNA, 1290 bp, Artificial Sequence
  Description of Artificial Sequence: Synthetic coding sequence
ctgtcctccacactgagacggatagcggatcccaccctagcagaaatggggaaaaacctgaaggaggctgtcaagatgctggaagactcgcagcggcgcactgaagaagagaacggcaagaagctcattagcggagatattccaggccctctgcaggggagcggtcaagacatggtcagtatcctgcaactcgtgcagaacctaatgcacggcgatgaggacgaggagcctcagagtccacggattcagaacattggcgagcaggggcatatggctctgctcggccacagcctcggagcttatataagcactctggataaggaaaagctaagaaagctcacaacacgtattctctcagacactacactctggctctgtcgaatctttaggtatgagaacggttgtgcatactttcatgaagaagagagggaaggcctcgccaaaatctgtcgcctggccatccacagtcgatacgaggactttgttgtggatggatttaacgtgctttataacaaaaaacccgtcatttatctgtctgctgcggcccgcccgggcctcggccagtatctgtgtaaccaggacgtggctttcttagagaagctgatcaaagacgatatcgagcggggccggctgcctctactcctggtcgctaatgcaggtaccgccgctgtcggccatactgataaaatcggtagattgaaggagttgtgcgaacaatacggaatttggctccatgtcgagggggtgaatcttgcaaccctcgcactggggtacgtgtccagcagcgtgctcgccgcggccaagtgcgatagcatgactatgactccgggcccatggctgggcctgccagctgtccctgctgtgactctgtacaagcacgacgacccagccttaaccctggtcgccgggcttacctctaataaacccactgataaacttagggcgttgccactctggctctcactccagtatcttggactggatggattcgttgaacgcatcaagcatgcctgccagctcagccagcgtcttcaggaaagcctgaaaaaggtcaattatatcaagatcttagtcgaggatgaattgagctctccggtggttgtttttcgattcttccaggagctacctggctccgatccggtttttaaagctgtgcctgtacccaacatgacaccctccggagtgggacgggaacgacactcctgcgatgccctgaacagatgggtaaggatggccgtgactcccctaagctttcaggtcccagtgcaccaccaccctacatgttggtag

SEQ ID NO: 131313 - DNA, 1497 bp, Artificial Sequence
  Description of Artificial Sequence: Synthetic coding sequence
atggacgcctccctggagaaaatcgcagatccaaccctcgccgagatgggcaaaaatttaaaagaggccgtgaagatgctggaggactcacagcggaggactgaagaagagaacgggaagaagctgattagcggcgatattcctggacccctccagggcagcggacaggacatggttagtattctgcagctggtgcaaaacctgatgcatggggacgaggatgaagagccccagagtcccagaatccaaaacatcggggaacaggggcacatggctctgcttggtcattcactcggcgcttacatttccacattagacaaggaaaagctgcggaaattgacaacaagaatactcagcgacaccacgctttggttgtgcaggatctttcgctacgaaaacggatgtgcctacttccatgaggaggaaagagagggcctggctaagatctgccgtctggccatccactctcgatatgaagacttcgttgtggatgggttcaatgtgctttacaacaagaaaccagtaatttacctgagcgccgccgccagaccgggtctgggacagtatctgtgtaatcagctgggactgccattcccttgtctgtgtagggtcccttgcaatacggtgtttggaagccaacatcagatggacgtagccttcctggagaagctcattaaggacgacatagagagagggaggctcccactgctgcttgtggccaacgccgggactgcggccgtgggacacacagacaagatcggccgcctaaaagagctttgcgagcagtatgggatttggctgcatgtggagggcgtgaacctggccactctggctctgggatacgtttcatcatccgtgctagccgcggccaaatgtgatagcatgaccatgacgcccggcccatggctcggcctgcccgcagtacctgcagtaacattgtacaagcatgatgatcctgccctgacactggttgctggacttactagtaacaaaccaaccgataaactgagagctctccctttgtggctctctctgcagtatctgggcttggatggcttcgtggagcgaataaaacatgcctgtcagctttcccagcggctccaagaatccctcaaaaaggtgaactatatcaaaattcttgttgaggatgagctcagctcccccgtggtggtcttccgattcttccaggaactcccagggtccgatccagtttttaaggcagtgccggtgcctaacatgactccttccggagttggtcgcgagagacacagctgtgacgcactgaataggtggcttggcgaacagctgaaacagctcgtcccggcatcaggcctgacggtgatggacctcgaggcagagggaacttgcctgaggttctccccactcatgacagccgctggctggagtcactgcggaacaaccacacggtacgactgcgtcaggagccggttaacaacaagattgccgggttccaccggcgaacaagctcccccctag

SEQ ID NO: 131314 - DNA, 615 bp, Artificial Sequence
  Description of Artificial Sequence: Synthetic coding sequence
atgactatgacacctggcccctggctgggcttaccagcagtgccagccgtgaccctgtacaagcatgatgatcctgccttaactcttgtcgccggcctgactagcaataaaccaactgataaactgcgtgctctccccctgtggctgtcactacagtacctgggcctagatggtttcgtggagcgaatcaaacacgcctgtcaactgagccagagactgcaggaatctctgaagaaggtgaactacattaaaatcctggtggaggatgagctttcaagtccagtcgttgtgttcaggttctttcaagagcttccaggtagtgaccccgtcttcaaagctgtccctgtgcccaacatgactccgtccggtgttggccgtgagaggcattcgtgcgacgcactgaacaggtggctgggggagcagctaaagcagctcgttccagcaagtggtctcactgtcatggacctggaggccgaaggtacatgcctgagattcagcccattgatgacggcggccggctggtctcattgcggaaccactaccaggtatgattgcgttcggtccagactgactacaaggctgccaggctctacaggggaacaagcacccccatag

SEQ ID NO: 131315 - DNA, 642 bp, Artificial Sequence
  Description of Artificial Sequence: Synthetic coding sequence
atggatcccctcttccaacaaacacataaacaggtgcacgaaatccagtcctgtatgggccgacttgaaaccgccgacaagcaaagcgttcatatagtcgagaacgaaatacaggctagcatcgaccaaatcttttcacgcctggaacgccttgagatattaagcagcaaggaaccacctaacaagcgacagaacgcacgacttcgcgtcgatcaacttaagtacgacgtgcaacacctccaaactgctctgcggaacttccagcatagaagacatgccagggagcagcaggaacgacaacgtgaggagttactgtcacgcacttttacgactaatgactcggataccactattcccatggatgaaagccttcagttcaatagtagtctgcagaaggttcacaatggcatggatgatcttattcttgacggacataacattctggacgggcttcggacgcagcgcctgacattgaaagggacccagaagaaaatcctcgacattgccaacatgctcggtttgtccaacacagtcatgcggttaattgagaagcgggcattccaagacaagtactttatgatcggaacacagggatcatgccaaactgcccattttggtgggcgatcagcgggttcctcttag

SEQ ID NO: 131316 - DNA, 657 bp, Artificial Sequence
  Description of Artificial Sequence: Synthetic coding sequence
atgacatgctggctgcggggcgtgacagccacttttggaagaccagcagagtggccaggatacctcagtcacctttgcggccgctctgccgcgatggatctgggccccatgcgcaaatcatacaggggagatcgtgaagccttcgaggagacacacctaaccagcctcgatcccgtgaagcaatttgctgcatggtttgaggaggccgtacagtgcccggacattggtgaagcaaacgcaatgtgtttggctacatgcactcgcgatgggaaacctagtgccaggatgttgttgcttaagggattcgggaaagatggatttcggttcttcaccaacttcgaaagccgcaaggggaaggaattggattctaatccgttcgccagcctcgttttctattgggagccgctcaatagacagtacctcaggaaaaaaaacgaggaattagagcaactgtatcaggatcaggaggtgccaaaaccaaaatcttgggggggatatgtactctacccccaggtgatggagttttggcaggggcagacaaatagattgcacgaccgcattgtcttcagaagagggcttccaactggcgacagcccactgggacccatgactcacagaggggaggaggattggttatacgaacggctcgcaccttag

SEQ ID NO: 131317 - DNA, 501 bp, Artificial Sequence
  Description of Artificial Sequence: Synthetic coding sequence
atgctgctgctcaagggctttggtaaggatggcttcagattcttcactaactttgagagccgcaaagggaaagagctggacagtaatccctttgccagcctggtgttctactgggaacctctgaatagacaggtgcgtgtagagggccctgtcaagaaattgccagaggaagaagccgaatgctatttccactcaagaccgaagtcttcacagattggcgccgtagtttctcatcaaagcagcgtgatccctgatcgcgaatatctgcggaagaaaaatgaggagctggagcagctctatcaggaccaagaagtcccgaagcccaaaagttgggggggctacgtgctatacccccaggtgatggagttttggcaggggcaaactaaccgcttgcacgacaggatagtcttcaggagggggctgcccactggcgacagcccgctggggccgatgactcaccgtggagaagaagattggctgtacgagagactggctccctag

SEQ ID NO: 131318 - DNA, 732 bp, Artificial Sequence
  Description of Artificial Sequence: Synthetic coding sequence
atgacctgctggctaaggggggtgaccgccacttttggtcgaccggccgagtggccgggttatcttagccatctgtgcgggagatctgccgcaatggatttagggccaatgcgcaagagctataggggcgacagggaagcttttgaggagacccatttgacgtcccttgatcccgtcaagcaattcgctgcttggttcgaggaggctgtccaatgtccagacatcggcgaagcgaatgcaatgtgccttgctacctgtaccagggacgggaaaccctcagcacgcatgctcctgctgaagggttttggcaaggacggatttcgcttcttcacaaactttgagagccgtaaagggaaggaactggtgcgcgtggaagggcccgtgaaaaaactgcctgaggaagaagcagagtgttatttccatagtagacctaaaagcagccagattggtgccgtagtgtcacatcagtcgagcgtgataccagatcgcgaatatcttagaaaaaagaatgaggagctcgagcagctttatcaggatcaggaagtccctaaaccaaaaagctggggcgggtacgtgctgtatcctcaagtgatggagttctggcagggccaaaccaacaggctacatgataggattgtgtttcgccgcggcctgcctacaggagattcacccctggggccgatgacccaccgaggggaggaagactggctatacgagaggctagcaccatag

SEQ ID NO: 131319 - DNA, 1098 bp, Artificial Sequence
  Description of Artificial Sequence: Synthetic coding sequence
atggcatctaccgaaagcagtcttctcaggtctctcggcctgagccccggcccgggcagttccgaggtagagcttgattgttggtttgatgaggacttcaaattcatactgttgcctgtgtcatatgcagtggtcttcgtgttgggcctgggcctcaacgcaccaactttatggttattcattttccgactgcggccctgggacgccaccgccacttatatgttccacctggccctgagtgacaccctctatgttttgtcccttcccaccctaatatactattatgccgcacataaccactggcccttcggaactgagatctgtaagtttgtgcgcttcctgttctattggaacctgtactgctcagtgctttttctcacgtgcataagcgtacaccggtaccttggcatttgtcacccattgagggccctgcggtggggaagaccccgcctagctggcctgctgtgcttagccgtctggctcgttgttgcagggtgcttggtgccaaacttatttttcgtgaccactagtaataagggcacaacagtgctgtgccatgatactaccaggcccgaagagttcgaccattatgttcatttcagcagcgcagtgatggggttgttattcggagtgccgtgcctcgtgaccttagtttgttacggcttaatggctagacggttgtaccagcctctgcccgggagcgctcagtcatcctctaggcttcgctccctgcggaccattgctgtggttctcacggttttcgctgtgtgtttcgtgccatttcatattacacgcactatatattacctcgcgaggctactggaagctgattgtcgcgtcctcaacatcgtcaacgtggtatacaaggtgacacggccactcgcttcggccaatagttgcctagacccagttctctatctgttaaccggggacaaatataggaggcaactccgccagctgtgtggtggcggaaagcctcaacctagaacagctgccagctccctcgccctcgtcagcttacccgaggacagctcatgtcgctgggcagccacgccacaggatagcagctgcagcacacccagagcagataggctgtag

SEQ ID NO: 131320 - DNA, 987 bp, Artificial Sequence
  Description of Artificial Sequence: Synthetic coding sequence
atggaatgggacaatgggaccggacaggccctgggcttgccccccaccacctgcgtttaccgcgaaaactttaaacagcttcttctaccaccagtctattctgccgtgctcgccgccggtttgccattgaatatctgtgtcatcacgcagatctgtaccagtcgccgcgctctgacacggactgctgtgtacacattaaatctggccctggcggatctgctgtacgcttgttcacttccgctcctgatatataattatgctcagggtgatcattggccttttggtgactttgcttgtcggttggtgcgcttcctgttttacgcgaacctgcacgggtcaatcctgttcctgacatgcatcagcttccaacgctatttaggcatctgtcatcctctggccccttggcataaacgtggcgggaggcgtgcggcttggttggtgtgtgtagctgtatggctggctgtgacaacacagtgcctgcctactgcaatctttgctgcaacgggaattcaaaggaatagaaccgtctgctacgacctgagcccacctgcccttgccacccattacatgccctatggtatggccctgaccgtgataggttttctgcttcccttcgctgcgctgctggcatgctactgtcttctggcttgccgactgtgtaggcaggatggacctgctgaacctgtagctcaggaaagaaggggaaaggcagctcgtatggccgtcgttgtggcagccgcgtttgctatcagtttcctccctttccacatcaccaagacagcttatctggcagttagaagcacacctggcgtgccttgcaccgtcctcgaagcctttgcagcagcctacaaaggaacccgtcccttcgctagcgcaaacagtgtcctggaccccattctgttctattttacccagaagaagtttcggagacgcccacatgagcttctccagaaactaaccgctaaatggcaacggcagggcagatag

SEQ ID NO: 131321 - DNA, 987 bp, Artificial Sequence
  Description of Artificial Sequence: Synthetic coding sequence
atggagtgggacaatggcaccgggcaggccctgggcctgccccccaccacttgcgtgtaccgagagaatttcaaacaattgctcctgccacccgtgtacagtgccgttctcgccgcgggtcttcccctcaatatctgcgtcatcacacaaatttgtacaagccgccgggccctgactaggaccgcagtgtacacactgaacctagccctcgcagatctgctctatgcatgcagcctgccactcctcatctacaactatgcgcagggcgaccattggccttttggcgatttcgcatgccgactggtcagattcttgttctatgccaatttacatggcagcatactttttcttacttgtatctcttttcaacggtaccttggaatttgtcacccattggccccatggcacaaacggggagggagacgggccgcttggttggtctgcgtcgcagtctggctggcagtgaccacccagtgcctgcccacagcaatcttcgccgcaactggtattcagagaaacagaactgtgtgctatgacctttctccacccgccctcgccacacattacatgccatatggaatggcactgacggtgatcggctttttactgccttttgccgctcttttggcttgctactgtctgttggcttgtcgactgtgtcggcaggatggcccggccgagccagtcgcacaggaacgccgtgggaaggcggcacggatggcagtggtcgtcgccgccgcattcgctatttctttcctgccattccacattaccaagacagcctacctcgcagtccgctcgactcccggagtgccatgcaccgtgctggaagcattcgccgcggcctataaaggaaccaggcccttcgccagcgccaatagtgttctggatcccatcctgttttacttcactcagaagaaatttcgaaggagacctcacgagttgttgcagaaacttacggctaaatggcagcgacaaggtaggtag

SEQ ID NO: 131322 - DNA, 987 bp, Artificial Sequence
  Description of Artificial Sequence: Synthetic coding sequence
atggagtgggataatgggaccgggcaggctctggggctgccccccaccacctgtgtctacagggaaaattttaagcagttgctgctgccgccagtatactctgccgtgctggctgcgggactgccattaaatatttgtgttatcacgcagatatgcaccagtcggcgagccttgacgcggacggcagtgtacacactcaacctggccctcgcggatttgctgtacgcctgctctttacctctgctcatctacaattatgcccagggggaccattggccgtttggggactttgcctgtagactggttaggttcctgttctatgccaatctgcatggcagcattctatttctgacttgtatctcctttcagcgatatctgggaatctgccatccactcgccccatggcataagcgggggggtagaagagctgcctggctcgtttgcgtggctgtatggcttgctgtaactactcagtgcctcccaaccgcgatttttgcagcaacaggcattcagcggaaccgaaccgtgtgctacgacctgtcgccgccagctcttgctacccactatatgccatacggaatggctttgactgttatcggcttcctgttgccgtttgccgcattgctggcctgctattgtttgctcgcttgtaggctgtgccgccaagatggcccagccgagccagtagcccaagaacggcgtggaaaagccgccaggatggccgtggttgtggcagccgccttcgccatcagcttcctaccttttcacataacaaaaacagcatatctcgcagtgcgatctacacctggtgtgccctgtacagtgcttgaggccttcgcagcagcatataagggcactcggcctttcgcctctgctaatagtgtgctagacccgatcctgttttattttacccagaagaagtttaggcgcagaccacacgagctccttcagaaattgacggccaagtggcagcggcaaggccgatag

SEQ ID NO: 131323 - DNA, 987 bp, Artificial Sequence
  Description of Artificial Sequence: Synthetic coding sequence
atggagtgggataatggcactggtcaagccttaggactgccgccaaccacctgtgtgtaccgggagaacttcaagcagctgctccttccaccggtatacagcgccgtgctagctgcagggctgcctctcaacatttgtgtcataactcaaatctgtacttcacgtcgcgccctgacccgtacagctgtgtacactcttaatctggccttggccgacttgctatatgcatgttccctgccactcctcatctacaactacgcccagggcgaccactggcctttcggagattttgcctgcaggttggtgcgctttctcttttacgcaaaccttcatgggtctatactgttcctgacttgcattagcttccaacggtatctcgggatttgtcacccccttgcaccctggcataaacgcgggggccgccgtgcggcctggttggtttgcgtagcagtctggttggcggtaacgactcaatgcctgcccactgccatctttgcggccacagggattcagagaaatagaactgtgtgctatgacttgtcccctccagctttagccacacactatatgccctatggaatggcccttacagtgattggcttcctgctaccgttcgcagctttgctggcctgttactgcctcctggcgtgtcggctatgtcggcaagacgggccggccgagccagttgcccaggaacgtcgcggcaaggccgcccggatggccgtggtagtggcagctgcctttgctatcagctttctcccatttcatatcactaaaactgcctacctggccgtgcgttccaccccaggggtcccatgcaccgtgcttgaagcttttgctgcagcttataaaggtactcgaccattcgcgtcagccaattcggtcctagacccgatcttattttactttacccagaaaaagtttaggcgcaggccccacgaattgttgcagaaactgacggctaagtggcagcgacagggacgttag

SEQ ID NO: 131324 - DNA, 738 bp, Artificial Sequence
  Description of Artificial Sequence: Synthetic coding sequence
atggagtgggataatggcacaggccaggcactgggattgcctcccactacttgtgtataccgggagaacttcaaacagctgctcctacctccagtgtatagcgccgtgctcgccgcgggcctccccctcaatatttgtgtcattactcaaatctgcactagccggagggccctcacgcgtaccgctgtgtacactctcaacctggcactagccgacctactctatgcctgttcgttgcccctcctcatatataattacgcccagggtgatcactggccatttggggatttcgcgtgcaggttggttcgcttcctgttttacgctaatctacacggttccattctgtttttaacttgcatttctttccaacgctacctgggcatatgtcacccactggctccatggcacaaaagaggtggccgccgggccgcctggctggtctgtgttgcagtgtggttagccgtcaccacccaatgtctcccaaccgccatatttgcagccacaggcattcagcgaaataggacagtctgctacgatctatccccgccagcccttgcaacacactatatgccttacggcatggccttgacagtgatcggctttctgctcccattcgccgccctgctggcgtgttactgcctcctggcatgtcggttgtgcagacaggacggccccgccgagccggtggcacaagagagaaggggcaaggcagctcggatggctgtagttgttgcctag

SEQ ID NO: 131325 - DNA, 987 bp, Artificial Sequence
  Description of Artificial Sequence: Synthetic coding sequence
atggagtgggacaatggaactggacaggcgttaggactgccccctacaacttgtgtttacagggagaactttaagcagctgttgctgccccccgtgtactctgctgtgctcgcagccgggcttcccctgaatatttgtgtgatcacgcagatatgcacctctagacgcgccctgacccggactgctgtgtacaccctcaatttggctctagctgacttgctgtatgcatgctccctgccactgttaatatataattatgcccaaggcgaccactggcccttcggtgatttcgcgtgcaggcttgtgaggttcttgttctacgccaacctgcatgggtccattcttttcttgacctgcatcagcttccagagatatctggggatctgtcatccactggcaccttggcacaagcggggcgggagaagagcagcttggctcgtttgcgtcgctgtgtggctggccgtgaccactcaatgtctgcccaccgcaatttttgctgcgaccggcatccagagaaaccgtaccgtctgttacgatttgtctccaccagcccttgcgacccattacatgccatacgggatggctctgactgtgataggattcctcctcccattcgccgcattgctagcgtgttactgtctgcttgcctgtcggctgtgccgacaggacggcccggccgaacctgttgcccaggaaaggcgggggaaagccgctcgcatggctgttgtggtcgcagctgcgttcgccatttcgtttctcccatttcatattactaaaactgcctacctggccgtgaggagcaccccaggggttccctgtacagttctggaggccttcgccgcggcctataaaggtactcgcccatttgctagcgcaaattccgtgttagacccaatactattctacttcacgcagaaaaaatttcgtcggcgcccccacgaactactgcagaagctgacggcaaagtggcaaagacaaggcaggtag

SEQ ID NO: 131326 - DNA, 987 bp, Artificial Sequence
  Description of Artificial Sequence: Synthetic coding sequence
atggaatgggataatgggacaggccaagctctgggattgcctcccacgacctgcgtctatcgggagaacttcaaacagctacttcttccacccgtgtattccgctgtgttggccgcaggtcttcctttgaatatctgtgttattactcagatttgtacatcccggcgggctcttacaaggacggccgtctatactctcaacctggccttggcggatctgttgtatgcatgttctctgcccctgctcatctacaactacgcccaaggagaccactggccatttggcgatttcgcttgtcggttggttcggtttctcttctatgccaacctgcatgggagcatactattcctgacatgtatttcatttcagagatacctggggatatgccaccccttagcaccatggcacaagcgcggtgggcgtcgcgctgcttggttggtgtgcgtggccgtgtggcttgccgtgacaacccagtgcctgcctaccgccatctttgccgccacggggattcagaggaatcggaccgtgtgctacgacctgtcaccacccgcactagcaactcattacatgccttacggcatggccttgacagtcatcggcttcctactgccattcgccgctctgttggcttgttattgcctcttggcttgtaggttgtgccgccaggatggccccgcagagccggtagcacaggagcgacgagggaaggctgcacggatggccgtggtcgtggcagctgctttcgccatcagttttctgccatttcacataacaaaaaccgcatacctggccgtgcgatcaacacccggcgtcccctgtacggtactggaagcgttcgccgccgcttacaaaggaactcgtccctttgcctccgccaactccgtgttggatccgattctcttctatttcacacaaaagaagtttcgccggcgcccacacgagctcctgcagaagctgacagcaaagtggcaaagacaggggcgttag

SEQ ID NO: 131327 - DNA, 987 bp, Artificial Sequence
  Description of Artificial Sequence: Synthetic coding sequence
atggagtgggacaacggcacagggcaggcccttggcctgcctcctacaacctgtgtgtatcgagaaaattttaagcaactcctgttaccccccgtgtactcagcggtacttgccgctggacttccgctcaacatatgcgtgattacacagatttgtacaagccggcgggcgctgacacgcacagctgtttacactcttaatctggccttggccgacctgctctacgcctgcagcctgcctttgttgatttacaactatgcccaaggagatcattggccttttggcgacttcgcttgcaggctcgtacgctttttgttctatgcaaatctccatggcagcattctgtttttgacttgcatctcatttcaacgatacctcggaatctgccatccactggctccctggcataaacgcgggggccgcagggctgcctggttagtgtgcgtggcagtgtggttagccgtgacgacccagtgcttgcccactgctatcttcgccgcaactggaattcagaggaatcgtacggtgtgttacgatctatcgccacccgccttagccacacattacatgccttacggaatggccctgaccgtgattggatttctgctgcctttcgctgccttgctcgcgtgctactgcctgcttgcctgcaggctctgtcggcaagatggccccgccgagccagtggcacaggaaaggcgtggaaaagccgcgcggatggctgtggtcgtcgccgctgctttcgctataagctttctcccatttcatattaccaaaacagcctatctggccgttagatcaactcctggtgtaccttgcacagtcctggaagcatttgcggctgcatacaaaggaactcggcctttcgcaagtgcaaatagcgtgctcgatcccattctgttctattttacccagaaaaaatttcgacggcggccacatgaacttctgcagaagctgacagcaaagtggcagagacagggtcgatag

SEQ ID NO: 131328 - DNA, 987 bp, Artificial Sequence
  Description of Artificial Sequence: Synthetic coding sequence
atggagtgggacaatgggactggtcaagcactcggtctcccgcccactacatgtgtctatcgtgagaatttcaagcagttattactgccacccgtgtattcagcggtgcttgctgccggcctcccactgaacatatgtgtgattactcagatttgcacttcccgaagggccttaacaagaaccgctgtgtataccctcaacctcgcgctcgcggacctcttgtatgcctgtagcctaccactcctgatttacaattacgcccagggcgatcactggccattcggcgattttgcctgccggttagtacgtttcctgttttacgccaacctccatggtagcatcctcttcctgacatgcatatctttccagagatacctcggaatatgtcatcccctggccccatggcacaaaagagggggccgcagagcagcctggctcgtctgtgtagctgtttggctcgcggtgacgacccaatgtttgcccacagcaatattcgccgctaccggcattcagcggaatagaacggtatgctacgacttgtcccctcctgccctggccacccactacatgccttatggcatggcattgactgtgattggatttctccttcctttcgccgccctgctggcttgctattgcctgctggcatgtcggctctgtcggcaggatggtcccgccgagcccgtagcccaggaacggcgcggcaaagctgcaagaatggcggtggtggttgccgccgcctttgccatttccttcttgccatttcatatcaccaagactgcttacctcgcagtccgctccaccccaggcgtcccctgcactgtcctggaagccttcgcagccgcctataaaggtacccgcccctttgcttccgcgaattccgtcctggatccaattctgttctatttcacccagaagaaatttagaagacgaccacacgagttacttcaaaagctcacagcaaaatggcagagacagggacgctag

SEQ ID NO: 131329 - DNA, 387 bp, Artificial Sequence
  Description of Artificial Sequence: Synthetic coding sequence
atggaatgggataatgggaccgggcaggcactgggcttgcctccaaccacttgcgtgtaccgagagaactttaagcaattacttctccctccggtgtatagtgccgtactggcagccggtcttcctcttaacatctgtgttattactcagatttgtacctctcgacgcgccctgacacggactgctgtgtataccctgaatctggccctggccgatctcctgtacgcctgctctctgccattgctcatttataactacgcgcaaggagatcattggccatttggagatttcgcttgtcgccttgtgcgcttcctgttctacgctaatctccatgggtcaatcttatttctgacttgtatcagcttccagcggtatctgggcatttag

SEQ ID NO: 131330 - DNA, 738 bp, Artificial Sequence
  Description of Artificial Sequence: Synthetic coding sequence
atggccaataattataagaaaatagtgctgctcaaaggactagaggttataaacgattaccactttcggattgtgaaaagcctgttaagtaacgatcttaagctgaacccaaagatgaaagaagagtacgacaaaattcagattgcagacctgatggaggaaaagttccccggcgatgctggcctgggtaagttgatcgagttctttaaagagatccccacactgggtgacctggctgaaactctaaaacgggaaaagctgaaggtggctaacaagattgagagcattcccgtcaagggcataatacccagtaaaaagactaaacaaaaggaggtgtacccagccaccccggcttgtacaccttcaaacaggctcacagccaagggtgccgaagaaacactagggccccagaagcgaaagaagccctcagaagaagaaaccgggacaaagcgatctaagatgtcaaaagagcagacgaggccgtcctgcagtgcaggtgcatccaccagtaccgccatgggcagatccccccctccacagactagcagctccgccccgcccaatactagttcaaccgaggcctacctaatgaatctcaccttaagcctgactgctggtagctttttgtcttgtgcagtgtggggaagggatagggagttgcgcaatttggagctgagcgctactgattctctgagcaccgctccaatttactatacgcccataccattcgctcattag

SEQ ID NO: 131331 - DNA, 1452 bp, Artificial Sequence
  Description of Artificial Sequence: Synthetic coding sequence
atggccaacaactacaaaaagattgtgttgctaaaggggctcgaagtcatcaatgactatcacttcaggatcgttaaatcgctgctttcaaacgatcttaaactcaaccctaaaatgaaggaggagtacgacaagattcagattgcagatcttatggaagagaaatttcccggggacgctggactcgggaagctaatagagtttttcaaggagatcccaactcttggagaccttgctgagacgctcaagagggagaagctcaaagtgaagggcattatcccatctaaaaagacaaaacaaaaggaggtgtaccccgctacacctgcctgtacaccctccaaccgtcttacggcaaagggggcggaggagaccctgggaccacagaagcgtaaaaagccatctgaggaggagacaggcaccaagcgtagcaagatgagtaaagagcaaacgcggccctcctgcagcgcaggagcttctacttccacggctatgggcaggtcaccaccaccccagacctcatcctccgctccacctaatacctcctccacagagtcactgaaaccccttgcgaatcgtcatgcaacagctagcaagaatatttttcgtgaggatcccattattgctatggtcttaaacgcaaccaaagtgttcaagtatgagagcagtgagaacgaacaacggcgcatgtttcacgctaccgtggccacacagacgcagttcttccatgtgaaggttctcaacatcaacctgaaaaggaaatttatcaagaagcggatcataatcatatccaactactccaagcgcaactctctgctagaagtcaacgaggcctcatcagtatctgaggccggtcccgaccagacttttgaggtcccaaaagatataattagaagggctaaaaaaataccaaaaatcaacatactccacaaacagacatcaggatatatcgtatatggcctctttatgctccacacaaaaattgtaaatagaaagacaactatttatgaaattcaggacaagaccggatccatggccgtcgtgggaaaaggcgaatgccataatataccctgcgaaaagggcgacaaactccggctgttctgcttccgcttaagaaaacgcgagaacatgtccaaacttatgagcgagatgcacagtttcattcagatacagaaaaacacaaaccagaggtcccatgactcacgcagtatggctctccctcaagagcaaagtcagcaccctaagccatctgaggccagcacaacactgccagagtctcacctcaagactccccagatgccacccacgactccgagttctagttcatttacgaaaaaggacgaaacacacccgggcgctcagagttctcccgcaaattttaggattacatcacccaccgtggccccccctctatcaagtgatacttctactaatcggcaccccgcagtcccgtag

SEQ ID NO: 131332 - DNA, 1479 bp, Artificial Sequence
  Description of Artificial Sequence: Synthetic coding sequence
atggctaacaattacaaaaagatagtgctacttaaggggctcgaggtgatcaatgattaccacttccgtattgttaaaagcctactgagcaacgacctcaagctgaatccgaaaatgaaagaggaatatgacaaaatccagattgccgatctgatggaagaaaagtttcccggggacgcgggtctgggaaagctgatcgagtttttcaaggaaatccccactctgggagaccttgcggagacactgaaaagagagaagttgaaggtcgccaacaaaatagaatccattccagtaaaaggcatcattccatctaagaagacgaagcagaaggaagtttaccccgctacacctgcctgcactcccagtaataggttgaccgccaaaggcgccgaggaaacactgggacctcagaagcgcaaaaaacctagcgaggaggagactggaaccaaaaggtccaagatgtctaaggaacagaccagaccatcatgtagtgccggcgctagcacttcaaccgcaatggggcgctccccaccacctcaaacctcgtcctctgcacctccgaatacctcttctactgaaagtctcaaacctctcgctaaccgtcatgcaaccgcatctaagaacattttccgcgaggacccgataatagcaatggtccttaatgccacgaaggtgttcaaatacgaatccagcgaaaacgaacagcgcaggatgtttcacgcaactgttgcaacccagacccaattcttccacgtcaaagtgctgaacattaatctgaagagaaagtttataaagaagagaattattattattagtaactattctaaaagaaactccctcctggaggtgaacgaggcatcctctgtgtcagaagccggacccgaccagacctttgaagtccccaaagatataatcaggcgggccaagaagatccctaagattaatatactccataagcagacatctggatacattgtgtacggactcttcatgttacatacaaaaatcgtgaaccgtaagaccactatatacgagatccaggataaaactggaagtatggccgtggtcggcaagggtgagtgccataatatcccctgtgagaaaggtgacaaactccgcctgttttgtttcaggttgcgaaaacgagagaatatgagtaaacttatgagcgagatgcattcttttatacagatacaaaaaaatacaaatcaaagatctcatgacagtcgctctatggctcttccacaggagcaaagtcagcaccctaaacctagcgaggctagtacgactctccctgaatcccatcttaagaccccacaaatgccccccaccaccccatcttccagttcctttaccaagaaggacgaaacccacccaggggcccaatctagcccagctaatttcagaatcaccagtcccacagtagcccctcctctgtcaagcgataccagtaccaatcgccaccccgctgtgccatag

SEQ ID NO: 131333 - DNA, 1359 bp, Artificial Sequence
  Description of Artificial Sequence: Synthetic coding sequence
atggccaataattataaaaagatagtactgcttaagggcctggaggttattaatgactatcacttccggattgtgaaatcgttattgtccaacgatctcaagttgaatcccaaaatgaaggaagaatacgataaaatccagattgcggatttaatggaggagaaattccccggcgacgccgggttgggcaagttgattgagttttttaaggagatcccgaccttaggagatctggcagagaccctcaagcgagagaagctaaaggtaaagggcattataccttcaaaaaagactaagcagaaagaggtgtaccctgcaacacccgcctgcactccttctaatcggctgacagctaagggtgctgaggagacactggggccacagaaacgaaagaaacctagtgaggaggaaacggggacaaagagatcaaaaatgtcaaaggaacaaactcgccctagttgttcagccggcgcttccacaagtactgccatggggagaagtccacctccccagacatcctcttctgcaccccccaatacaagctcgaccgagtccctgaagcctctagctaatcggcacgccactgcatccaaaaacatctttagagaagatcccattatcgctatggtgctgaacgccacgaaggtgttcaaatatgaaagtagcgagaatgaacaacgcaggatgtttcatgccaccgtcgccacccagacccaattttttcatgtgaaggttctcaatattaaccttaagaggaaattcattaaaaaaagaattatcatcatctctaattacagcaaaaggaattcgttgctcgaggttaatgaggccagttctgttagtgaggccggtcccgatcaaacattcgaagtgccgaaggatattataagaagggccaagaaaatccctaagatcaacattctccacaagcagacatctggatatattgtttacggtcttttcatgcttcacacaaaaattgtcaataggaagaccactatttacgagattcaggacaagacggggtctatggcggtggttggcaaaggcgagtgccacaatattccctgtgagaaaggcgacaagctgaggctcttttgttttcgcctcaggaaacgcgaaaatatgtccaaattaatgagcgaaatgcatagcttcattcagatccaaaaaaacacgaatcagagatcccacgatagccggagtatggccttgccccaggagcagagccagcacccgaagcccagcgaggctagcaccaccttgcctgagtcccaccttaaaacaccacagatgccgcccactacccccagctcaagctcctttacgaaggttacaaaggacaaggatatcaagtag

SEQ ID NO: 131334 - DNA, 1386 bp, Artificial Sequence
  Description of Artificial Sequence: Synthetic coding sequence
atggcaaataactacaagaaaatcgtcttgctaaaaggactggaagtcatcaacgactatcatttccggatcgtcaagtcactgttgtcaaacgacttgaagctcaaccccaagatgaaagaggaatatgacaagatccagatagcagacctgatggaggaaaagtttccaggcgacgcgggattggggaaactgattgagttcttcaaagaaatcccgacacttggggatctcgccgaaaccctgaagcgtgaaaagctgaaggtggccaacaaaatcgaatccattcctgttaagggtattatcccatctaagaagaccaagcaaaaagaagtgtaccctgccactcccgcatgcaccccatcaaaccgactgacggcaaagggagcagaggagaccctggggccacagaagaggaagaaaccttctgaagaggagaccggaaccaagcgatccaagatgtcaaaggagcagactagaccatcatgttccgcaggcgcctccacaagcacggcaatgggacgatcgcctcctcctcagacctcatctagcgcccctccaaacacctccagcacagaatccttgaaacccttggccaaccgacacgccaccgctagcaagaacatatttcgcgaagaccccattatagcaatggtgctgaatgcaactaaagttttcaaatacgaaagttctgaaaacgagcagcgcaggatgtttcatgctactgtggccacgcagactcagttcttccacgttaaggtgctgaacatcaacttaaagcgcaagttcataaagaagcgcatcataataatttctaactattccaagcgcaactcccttttagaggttaatgaggccagctcagtgagcgaggcaggccctgaccaaacttttgaggtacctaaggacattatacggagggccaaaaaaattcctaagattaatatcttacataaacagaccagcggctatatcgtctacggcctgttcatgcttcacactaaaattgtgaataggaaaactaccatttatgagatccaggacaagactggctctatggcagtagtcgggaagggcgagtgccacaatataccttgcgagaagggggacaaactgcgacttttttgtttccggctgagaaaacgggagaacatgagtaagctgatgtctgaaatgcacagttttatacagatacaaaagaacacaaaccagaggtcgcatgactctcgaagtatggcactgccacaggagcagtctcaacatccgaaaccatctgaggcctccaccacactccccgaaagtcacctgaagactccccaaatgccgccaactacgccgtctagctccagttttacgaaggtgaccaaagacaaggacatcaaatag

SEQ ID NO: 131335 - DNA, 453 bp, Artificial Sequence
  Description of Artificial Sequence: Synthetic coding sequence
atggcaaataactataagaagatcgttctgctgaagggtcttgaagtcatcaacgactatcattttcggatcgtgaagagtctgctttcaaatgatctgaagctgaatccgaagatgaaggaggagtacgacaagattcagatcgccgacctcatggaagagaagttccccggggacgccgggctgggaaaactcatcgagttctttaaagagatcccaacactgggagacttggccgaaaccctgaagcgcgagaaacttaaggtggccaataagatcgagtctatccccgtcaaagggattattcctagcaagaagactaagcagaaggaggtttaccctgccacacctgcctgtactccaagtaaccgattaactgccaagggggcggaggagaccctcggcccccagaaacgcaagaagccctccgaggaggagacaggcacgaagtag

SEQ ID NO: 131336 - DNA, 399 bp, Artificial Sequence
  Description of Artificial Sequence: Synthetic coding sequence
atggctactaccgtcacattggagaaatgtggtcacaataaggggtataaaggattggacaactgccggttctgtcccgggtctcagtgttgtgtggaagacggtccagagagcattgattcgatcatagatatggacgctgtgtgtaaacgtgttactaccctgggactcgatgtcagcgtcacaatttctcaggatgcaggtcgctatctgtgcgacttcacgtactacacctccctttaccagagccatggcaggtctgcattcgtgcacgttccacccctgggaaaaccctataatgcagaccagctcgggagggccttgcgcgccatcatcgaagaaatgttagatctccttgagcagagcgagggcaagatcaactactgtcacaagcattag

SEQ ID NO: 131337 - DNA, 630 bp, Artificial Sequence
  Description of Artificial Sequence: Synthetic coding sequence
atggagcagccacgaaaggccgtggtagtgacaggcttcggcccctttggtgagcataccgtaaatgcgtcgtggatagccgtgcaggagctcgagaagcttgggttaggcgacagcgtggatctgcacgtttatgaaattcctgttgagtaccaaactgtacagagactgattcctgcactgtgggagaagcactcgcctcagctggtggtacacgtcggggtaagcgggatggcaaccacggtaacgctggagaaatgtggccacaataaggggtataagggactggacaactgtcgcttctgtcccggcagtcagtgctgtgtcgaggacgggcctgagtctattgacagtatcatagatatggacgcagtttgtaagcgggtgactacactcggcctagatgtatctgtgacaatctcacaggacgcgggcagatacctatgtgactttacatactatacctccctttaccagtcccacggcaggtcggcgtttgtccatgtgccacctctcggaaagccatataatgctgatcagttagggcgggccctaagggcaataatagaggagatgctcgacctgctggagcagtcggaagggaagattaattactgtcataaacattag

SEQ ID NO: 131338 - DNA, 609 bp, Artificial Sequence
  Description of Artificial Sequence: Synthetic coding sequence
atgaagaaggcaagaaatgacgaatatgagaatctctttaatatgattgtggagatacccagatggaccaacgcgaaaatggaaattgctaccaaggaacccatgaaccccatcaaacagtatgtcaaggacggaaagttgcggtacgtggcaaacattttcccgtacaaaggctacatttggaattacggcacattaccacagacctgggaagacccgcatgaaaaggacaagagcacaaattgtttcggggacaacgatccaatagacgtttgcgaaatcggctcaaagattttatcctgtggcgaggtgatccacgttaagattctgggcatacttgctttgatagacgagggtgaaacagattggaagttgatcgcaattaacgccaatgaccctgaagcaagtaagtttcacggactccggaacattcctgtgtatacgattaatcgcattgtgatcctccctagtctggatcggagccagacatctagcctgtcttatctgcccgcccaccaggattcatgcgtgccattagacgcagcgttgcatgtggtgctgtacttttgttcactgctcggtctgcagtcgtacctctcatgcttctag

SEQ ID NO: 131339 - DNA, 1005 bp, Artificial Sequence
  Description of Artificial Sequence: Synthetic coding sequence
atgagtgccctgctcagactgttgagaactggcgccccggccgctgcttgtctaagactggggacttctgcgggtacagggagccggcgcgctatggccttgtaccatacggaggaaagagggcaaccgtgctcacagaattaccgactgttctttaagaacgtaaccggacattatatttccccattccacgatatacctctgaaagttaatagcaaagaagaaaacggaatcccaatgaaaaaggcgagaaatgacgaatacgaaaacttattcaacatgatcgtcgagattcctcgctggacgaacgcgaagatggagattgctaccaaggagccaatgaatccaatcaaacagtatgtgaaggacggcaaactccggtacgtggctaatattttcccttacaaaggttacatctggaattacggaaccttgccacaaacctgggaagacccgcacgagaaagacaaatccaccaattgcttcggagataacgatcccatcgacgtatgcgagatcggctcgaaaatcctgagttgcggtgaagttatccatgttaagatcctggggatactggccctcatagacgagggagagactgactggaagcttatcgctattaatgctaatgatcctgaggcttctaagtttcacgatatagacgacgtaaaaaagtttaagcctgggtacctagaggcaaccctgaactggttcagactgtataaggtgcctgacgggaagccggagaatcagttcgcttttaacggcgaattcaaaaacaaagcttttgccctagaagtaatcaagtctacacaccagtgctggaaagccctgttaatgaagaagtgcaacggcggcgctatcaactgtaccaatgtgcagatctcggattcaccttttaggtgcacccaggaggaagcccggtcgctcgtggaatctgtgtcatcgtctcctaacaaagagtctaatgaagaggagcaagtttggcatttcctcggtaaatag

SEQ ID NO: 131340 - DNA, 918 bp, Artificial Sequence
  Description of Artificial Sequence: Synthetic coding sequence
atgagcgccctgctgaggctcttaagaactggtgcccccgccgcggcttgcctacgcctgggcacttctgcaggcacgggaagcaggagagccatggcgctctaccataccgaggagaggggtcagccttgttcacaaaattaccgactgttcttcaagaacgtaacgggtcactatattagtccattccacgatatccccttaaaggtgaattcaaaagaggagaatggtattcccatgaaaaaggcacgcaatgacgagtacgagaatttattcaacatgattgtggagattcctcgctggacaaatgccaagatggaaatagccaccaaagaaccgatgaatcccataaagcagtacgtaaaggatgggaagctgcgctacgtggcaaacattttcccttacaaagggtacatatggaactacggcactcttcctcaaatcctgagttgcggggaagttatacacgttaaaatacttgggatcctggcactcatagatgaaggggagaccgattggaaactgattgcaattaatgcgaacgaccccgaagcgtctaaattccacgacattgacgatgtgaaaaagttcaagccaggctatctcgaggctactctgaattggttcaggctgtataaggtgcccgacggaaaacccgagaaccagtttgccttcaacggagagtttaagaataaggcgtttgcccttgaggttattaagagtacacatcagtgttggaaagctttactgatgaaaaaatgcaatggaggggcgattaattgcacaaacgtgcagatcagcgacagcccctttaggtgcacacaggaagaagcacggagtctcgtcgagagcgtcagctcctcacctaacaaagaatctaacgaagaggaacaggtgtggcattttcttgggaaatag

SEQ ID NO: 131341 - DNA, 507 bp, Artificial Sequence
  Description of Artificial Sequence: Synthetic coding sequence
atgtcggccctgttgcggctgttgaggactggggcccccgccgccgcatgcctgagactcggcacaagcgcaggcaccggatcccggagagccatggcactgtaccataccgaggaaaggggacaaccatgctcacaaaactaccggctctttttcaatatcgatgacgttaagaaattcaaacccggttatctagaggccacactcaactggttccgcctgtacaaagtacccgacggaaaaccggagaatcagtttgcctttaatggtgaatttaagaacaaggcatttgccctcgaagttatcaaatcgacccatcagtgttggaaagctctcctcatgaagaagtgtaacggtggcgctattaactgcaccaatgtgcagatctctgattccccattcagatgtactcaggaagaggcgcggtctctggtagagtcggtgagctccagccctaacaaagagtccaacgaggaggagcaggtctggcacttcctgggcaaatag

SEQ ID NO: 131342 - DNA, 1050 bp, Artificial Sequence
  Description of Artificial Sequence: Synthetic coding sequence
atgtcggcactgctgaggctgctcagaaccggggctccagctgccgcgtgtttacgcctcggtactagcgctggcactgggtccagacgcgcaatggcactgtatcacacagaagagaggggacagccctgttctcaaaactatcgcctttttttcaaaaatgtaacaggacattatatttcccctttccatgacatcccacttaaggtgaattccaaggaggatacagaggcacaggggatttttattgacctttccaagatctgggagaatggcattccaatgaaaaaagcacggaatgacgagtacgaaaacctttttaacatgattgtggaaattcccagatggacaaacgcaaaaatggagatcgctacaaaggagccaatgaacccaataaagcagtacgtgaaggatggcaaactgcggtatgttgccaacatctttccatacaaggggtatatctggaactatggcaccctgcctcaaacatgggaggatcctcacgaaaaagataaaagcaccaactgcttcggcgacaacgatcctatcgacgtctgcgagatcggctctaaaatactcagttgtggagaggtcattcatgtaaaaatcttaggcatccttgcgctgatcgacgagggtgagactgactggaagctgatagctattaatgctaatgatcccgaggcctccaagttccatgacatcgatgacgtgaaaaaattcaagcccggatacctggaagccacgctgaattggttccgcctttataaagtgcctgacggcaagccagagaaccaattcgcttttaatggcgaatttaagaataaggcgtttgcactggaagtaattaagtcaactcatcagtgttggaaggcgttgctgatgaaaaaatgtaacggcggggctatcaattgcaccaatgtccaaatctccgatagcccatttcgctgcacccaggaagaagctagaagcctggtcgagagtgtctcctctagcccgaataaggaatccaacgaggaggaacaagtgtggcactttctcggtaaatag

SEQ ID NO: 131343 - DNA, 951 bp, Artificial Sequence
  Description of Artificial Sequence: Synthetic coding sequence
atgagtgcactgcttcgcctgttacggacgggtgctcctgcagccgcatgtctgcggcttgggacctccgctggaactgggtcacgccgcgcaatggccctttatcacaccgaagagagaggccaaccatgttcgcaaaactacagactctttttcaagaatgtgactggccattacatcagccccttccacgatattccattgaaagtaaactctaaggaggagaacggtatccctatgaagaaagcacgtaacgatgagtacgagatcgccactaaggagcccatgaaccctataaaacagtacgtgaaggatgggaagttacggtatgttgctaatatcttcccttataaaggatatatctggaactacggcactctcccccagacttgggaggacccccacgagaaggacaagtctacaaactgttttggtgacaatgaccctatcgatgtgtgcgagataggatccaaaattctgagctgtggtgaggttatacacgtcaaaatcctgggaattctagcacttatagacgaaggagagaccgattggaaattaattgctatcaatgctaacgacccagaggcatcaaagttccatgatatcgacgacgtgaagaaatttaagcccggctacctcgaagcaacccttaactggttcaggctgtacaaagttcctgatgggaaaccagaaaaccagttcgcctttaacggcgaatttaagaataaggcgtttgccctagaggtcattaaaagtacccaccaatgctggaaagcactcttaatgaagaaatgtaatgggggggcaatcaattgtacgaacgtgcagatctcagacagcccgttcagatgtacccaggaggaagctagaagtctggtcgagagtgtctcgagctccccaaacaaagaaagcaatgaggaggagcaggtctggcacttcctaggcaaatag

SEQ ID NO: 131344 - DNA, 699 bp, Artificial Sequence
  Description of Artificial Sequence: Synthetic coding sequence
atgagtgcactgctcagactcctccgaactggagccccagctgccgcttgtcttcgcttggggacctccgccggaactggctctcgccgcgcgatggccttgtaccataccgaggaacgcggtcagccctgctcccagaattatcgactgtttttcaagaacgtgactgggcattacatctctccattccacgatatccccttgaaggtaaacagcaaggagatcctctcttgtggcgaggtgatacatgtgaaaatcctcggcattctggcgctgatcgacgagggtgagaccgattggaaactgatagcaatcaacgccaatgacccggaagcaagcaaattccacgatattgacgatgtgaaaaagttcaagcctggataccttgaggcgacacttaactggttccgcctttataaggtaccagacggcaagcctgagaatcagttcgcttttaacggagagttcaagaacaaggcgttcgcattggaggtgattaagtccactcaccagtgttggaaggcgctcctcatgaagaagtgcaatgggggagccatcaactgtacaaacgtccaaatttcagacagcccatttcgttgcactcaagaagaagcacggagccttgtggaatccgtcagtagcagcccaaacaaggagagtaacgaggaagagcaagtctggcacttcttgggcaagtag

SEQ ID NO: 131345 - DNA, 960 bp, Artificial Sequence
  Description of Artificial Sequence: Synthetic coding sequence
atgtctgtggggtttatcggcgctgggcagctggcattcgctctggccaaaggtttcactgcagcaggtgtgctagccgcgcacaagattatggcaagcagcccagatatggatctcgctacagtgagtgccctccggaaaatgggagtcaaacttacccctcacaacaaggagacagtgcaacattctgatgtcctcttcttggccgttaagccgcacatcataccttttatcctagacgaaatcggggccgacattgaagaccgccacattgtggtgagctgcgccgccggcgtgactatcagctcaattgagaaaaagctgtccgcttttcgacccgctccacgagtgattagatgcatgacaaatactcccgttgtggttagggaaggtgctaccgtatacgcaacgggcactcacgctcaggtggaagatggccgcctgatggagcaactgctaagcagcgtcgggttttgcacggaggtcgaggaggatctaattgacgctgtaacaggcctttctggaagcgggcccgcttacgcgttcacagcactcgacgccctcgctgacggaggggtgaagatgggactaccacgaaggctggccgtaagactgggagcccaggcgctgcttggagccgccaaaatgctgctgcatagcgagcaacatcctggccagcttaaagataacgtgagcagtcccgggggagctactattcacgccttacacgtgctcgaaagcggcggattcagatccttgttgataaacgccgtggaggcctcctgtattagaacacgagagctccagagcatggctgatcaagaacaagtgagccccgcagccatcaagaagacaatattggacaaggtgaaattggactcaccagcagggacagctctctctccttctggtcatactaagctgcttccccggtcactggcaccagccggcaaagactag

SEQ ID NO: 131346 - DNA, 951 bp, Artificial Sequence
  Description of Artificial Sequence: Synthetic coding sequence
atgtctgtggggtttatcggagcagggcagctggccttcgctctggcaaaggggttcaccgccgccggagtgctggcagctcacaagatcatggctagtagcccggacatggacttggctaccgtgagcgcgcttaggaaaatgggtgtaaagctcacaccccacaataaggaaactgtgcaacactccgatgtgctatttcttgccgtgaaaccacatatcatcccctttatactcgacgaaattggagctgacattgaggaccgacacatcgtggtgtcttgcgcagccggcgtgactatttcttccatcgagaagaaattgtccgcctttcgcccggctcccagggtgattagatgtatgaccaacaccccagtggtggtacgcgaaggagcaaccgtgtacgccaccggaacacacgcacaagttgaggacgggagattgatggagcaactcctttcaagtgtgggcttctgcaccgaggtggaggaggatctcattgatgctgtgacaggcctgagcggaagcggccctgcctatgcctttaccgccctggacgcactcgcggacggcggggtcaagatgggcttgccacgacgcctggctgtccgcttgggcgctcaggctctcttaggcgctgcaaagatgctgctacatagcgagcagcaccccggccagctgaaagacaacgttagcagcccaggaggggctacaatccacgcccttcacgtgttagagtccggtggattcagaagtcttcttatcaatgctgtggaggccagctgtattcgaacccgggaactccagtccatggccgatcaagaacaggtgagccccgctgctatcaagaaaactattctggacaaggaccatctgcccctggagctgggttccccagaaggtttgcatccattactactgcagtaccagctggcccgcgccccttcatag

SEQ ID NO: 131347 - DNA, 1041 bp, Artificial Sequence
  Description of Artificial Sequence: Synthetic coding sequence
atggtgggcggggggagacgtgttgggagggacgaacctgtccctagcgtcggagctctgggtcaggggagcccagactccatgagcgtgggattcataggggctggccagttggcattcgccctagccaaaggattcaccgccgccggcgtcttggcggcacataagatcatggcctcctcccccgatatggatctggctaccgtatctgctctgcgaaagatgggcgttaaactaactcctcataataaggaaactgtccagcattcagatgtcttgttcctggctgtgaaaccacacatcattccttttatcctggacgagatcggtgccgacattgaagacagacacatcgtcgtgtcctgcgctgcgggggtaacaatcagctcaatagaaaaaaagctctccgcattcagacccgccccaagagtgatcagatgtatgactaatactcccgtggtggttagagagggcgccacagtctacgctacgggtacccacgcgcaggtggaggacggccggctgatggagcagctgctgagttccgtgggattctgtaccgaagtggaagaagatctgatcgatgcggtgacagggctgtctggttcaggacccgcctatgcctttactgcactggacgccctcgccgatggtggcgtaaagatgggcctgccgcggagactagctgttcggctaggcgcccaggcactgctgggcgccgccaagatgcttctccacagtgagcagcatcctggtcagctgaaggataacgtgagtagccctggcggtgccacaatccatgccctccacgttctcgagagtggcggcttcagatcacttttaatcaatgccgtggaagcctcatgtatccgaacacgggagctacagtccatggctgatcaagagcaggtgtctcccgcagccattaaaaaaactatcctggataaagtgaagctcgatagcccagctggaactgcgctctctccaagcggacacaccaaactccttcccaggtcacttgcccctgccggtaaggattag

SEQ ID NO: 131348 - DNA, 819 bp, Artificial Sequence
  Description of Artificial Sequence: Synthetic coding sequence
atgtctgtgggcttcattggtgccgggcagctggctttcgcccttgccaaaggattcaccgccgctggggtgctggccgcccataagattatggccagttcgcctgacatggatctggctactgtatcagcgctccgaaagatgggcgtcaaacttacccctcataataaggaaacagtgcaacacagtgatgtgttgtttcttgccgtaaagccccacatcatcccctttatccttgacgagatcggcgcagatattgaggacaggcatattgtcgtcagctgtgcagcgggggtcacaattagctctatcgaaaagaaactcagcgccttccgccctgcgcctagggtgatccgctgtatgactaacactcctgtggtcgtacgagagggcgctaccgtgtatgccaccggcacccacgcccaggtggaggatgggagattaatggaacaactcctgagctctgtcggcttctgcacggaggtggaggaagacctaatcgacgccgttaccgggctatcaggttccgggccagcttacgctttcactgccctggacgctctggctgatggtggggtgaaaatgggcctgcctcgcaggctggccgttcggctcggcgcccaggcattactgggaggttgtcaagacgcagcagcccttcgaaccgcccctcgcccggcacaaggccagcgacagctgtcctggtggggccaccacccttgcctggcgtgtgcaggcgagtgggggctcccactcccggcccatcagcggtgcggggggctgctgcatccccacacaggagccgcagtccacggatag

SEQ ID NO: 131349 - DNA, 723 bp, Artificial Sequence
  Description of Artificial Sequence: Synthetic coding sequence
atgtcagtggggtttattggggcgggccagttggccttcgcgctggccaagggcttcacagctgccggcgtcttggcagcacacaagattatggcgtcctcgcctgacatggacctcgcaacagtttccgctctgcgcaagatgggggtgaagcttacaccacacaataaagagaccgtccagcactctgacgtcttgtttctcgccgtgaaacctcacatcatcagtatcgagaaactcagtgccttccgtcctgctcccagagtcatccgttgcatgaccaataccccagtcgtcgtacgcgagggcgccaccgtgtacgcaacgggcacccatgcgcaagtggaggatggcagattgatggagcagcttctgagttcagttggtttctgcacggaagtcgaggaagacctgatcgatgctgtgacaggcttgtcaggatcaggccccgcgtacggcgctgccaagatgctcctccactctgagcagcacccagggcagctcaaagacaacgtttcaagcccaggcggagccacaatccatgctttacatgttctggagtctggaggcttccgcagccttcttatcaacgctgtggaggcatcttgtattcgcacacgttgggcccccgcacttccagcgtctctcgtctccagtccttgtatggcggaagcctccctgacacatatatgcagcttcactcacagcgctgacacatattag

SEQ ID NO: 131350 - DNA, 1590 bp, Artificial Sequence
  Description of Artificial Sequence: Synthetic coding sequence
atgctgaagttccgaacggtgcatggagggctgcggcttctcggaatcaggcggaccagcacagccccggccgcaagcccaaacgtgaggcgattggagtacaaacccatcaaaaaggtgatggtggcgaatagaggggagatcgcaattcgagtgttcagagcttgcaccgagctgggcattcgaaccgtcgctatctatagcgagcaagacaccggccaaatgcaccgccaaaaagccgacgaggcttatttgatcggccgaggcctggctccggtgcaggcttacctgcacatccctgatataatcaaggttgctaaagagaataatgtagatgcggtgcaccccggttacgggtttctgagcgagagggccgattttgcacaagcttgtcaggacgccggagtcaggtttatcggaccgagccccgaggtcgtgaggaagatgggggacaaagtggaagcacgagccatcgcaattgccgcaggcgtaccggttgtcccggggactgacgccccaatcacctcccttcatgaggcacacgaattctctaacacatacggattccccatcattttcaaagctgcctacggaggcggagggcgaggaatgcgcgtggtacatagctatgaggaacttgaagagaattacacaagggcctactcggaagccctggctgcttttggtaacggggccttgttcgtagagaagtttatcgagaagcccaggcacattgaggtgcagatcttgggcgaccaatatggaaacatcctccacctgtatgagcgcgactgctccattcagagaaggcatcagaaagttgtcgagatcgctcctgccgcccacctagatccccagctaaggaccagactcaccagtgactccgttaagctggcaaagcaggtcggctacgagaatgccggtactgttgaattcctggttgatagacatggcaagcactatttcattgaggtgaactccagattgcaggtggagcacaccgtcactgaagagattaccgacgtggacctcgtccatgcccagatccatgtggcggaggggcgcagtctccctgatctgggtctgcgtcaggagaacattcgtattaacgggtgcgcaatccagtgccgagtcacgactgaggatcccgcacggtccttccaacctgatacgggtaggattgaggtcttccgcagcggtgagggcatgggcatccggctggataatgcctccgctttccagggtgctgttatttctcctcactatgattcccttctggtgaaagtaatcgcccatggcaaggaccaccccacggccgcgactaaaatgtcacgagcactggccgaattcagggtgcgcggtgtgaaggtaagacgtcaccaggcccagccccttgctgctgctttaggcaggccttgtggtcaggaggccagaaggccccaggccgcagtcacagctcctaccggaccaggcagccccacactggtgcgagtcccccccgcagccagagttttgtcaagtcgcctgggagggccctcccagaccacgccagagacatccacagaagtgtctcctaccattttgctttag

SEQ ID NO: 131351 - DNA, 3537 bp, Artificial Sequence
  Description of Artificial Sequence: Synthetic coding sequence
atgttaaagtttagaactgtccatggcgggctgaggctcctaggaatccgcaggaccagcacagcacccgctgctagccctaacgttcggaggttagagtacaaaccaatcaaaaaagtcatggttgccaatcggggggaaatcgcgattagagtatttagagcatgcacggagctgggtataagaactgttgccatatatagcgaacaggacaccggtcagatgcatcgccaaaaagcggacgaggcttacctgattgggaggggtcttgctcctgtccaggcatacctgcatattcctgacattatcaaggtggccaaggaaaataatgtcgacgctgttcatccggggtatggctttttgtctgaaagggccgattttgctcaggcctgccaagatgccggagtcagattcataggccctagtcccgaagtggttaggaagatgggcgataaggttgaggccagggcaattgccatcgcagccggagtcccggtggttcctggaacagatgcacccatcacttccctgcatgaagcccacgaattctctaatacctacggctttccaatcatttttaaagccgcttacggtggtggcggccggggaatgcgcgtcgttcactcctacgaggagctcgaggagaattacaccagagcctactcagaagctttggctgcttttgggaatggagccctgttcgtggaaaaattcatcgaaaagcctaggcacatagaggttcagatcctgggcgatcagtatggaaacatcttacacctctatgagcgcgactgttcaatccagcgcaggcaccagaaggtggtggaaatcgcaccagccgcccatttggatcctcagctgaggacgcgcctcacaagcgattcagtcaagctggcgaagcaagtgggatacgaaaacgccggtactgtggaatttctggtggaccggcatgggaagcattatttcatagaggtgaactctcggttacaagtagagcacaccgtgaccgaagaaatcactgatgtggacctagttcacgcgcagatacacgtggcagagggacgcagtctgcctgatcttggcctcagacaggagaatatcagaatcaatgggtgcgccatccagtgtagggtgacaaccgaagaccctgcaagatcgtttcagcctgatactgggaggatcgaggttttccgaagcggggagggcatgggaattaggcttgataacgccagcgcctttcagggtgctgttatctctcctcactatgattcactcctggtgaaggtcattgcccacggtaaggaccaccccaccgctgctaccaagatgtcaagggccttagcagaattcagagtgagaggcgtcaaaaccaacatagcctttctccagaatgtgctgaacaaccagcaatttctcgcaggaactgtggacacccaatttatcgacgagaatccggagctatttcagctgcgccccgcgcagaatcgggcacagaagcttctccattacctgggtcatgtaatggtcaatggccctaccacccctattcccgtaaaggcctccccctcacctaccgaccccgtggttcctgcagttcccatcggccctccccccgctggtttcagggatatccttttacgcgaaggccccgagggatttgcaagggccgttcggaatcatcctggacttctgttaatggacactacatttagggacgcacaccagtcgctgctggctacccgcgttcgaacccacgatctcaaaaagatcgccccctatgtcgcacataatttttccaaactgttctccatggaaaattggggtggcgctacattcgacgtggcaatgcgatttctttacgagtgtccatggagacgtttgcaagaattgcgagagctcattcctaacataccatttcagatgctgctgagaggtgcaaacgctgtgggatataccaactatccagataacgtggtgtttaaattctgcgaggtggctaaggagaatgggatggacgtattcagggtattcgactcgttaaattatctaccaaatatgctcttaggcatggaggccgccgggtcagctggtggcgtcgtggaggccgccatctcgtacaccggagacgttgctgacccatcaagaaccaagtatagcctgcagtactatatgggcctggctgaagaactcgtgcgggcagggacccatatactgtgcattaaggatatggccggcctgctcaagcctacggcatgcacaatgctcgtatctagtctgcgcgacagatttccagatctgcccttgcacatccacacgcatgacacttctggcgcaggggtggcagccatgctcgcctgtgcccaggctggggcagatgtggttgatgtcgccgcagatagcatgagcggtatgacctcacagccctctatgggtgccctcgtcgcctgtacaagaggtacccctctggacacagaggtccccatggagcgcgtttttgattattctgagtactgggaaggcgccagggggctgtacgccgcattcgattgcactgctactatgaagtcagggaacagcgatgtgtacgaaaacgaaatacccggtggccagtatacaaacctccacttccaagcccactctatgggtctgggatctaagttcaaggaagtcaagaaagcttacgtggaagccaaccagatgcttggggacttaattaaagtcacgccatcatctaagatcgtcggcgatctggcacagtttatggtccaaaatggactctccagggcggaggctgaggcccaggcagaggagttatctttcccgagatcagtggttgaatttttacaggggtacatcggagtcccgcacggaggcttcccagaaccttttagaagtaaagtactcaaggacttacctcgggtggagggacgccctggagctagtctccctccccttgatctgcaggccttggagaaagagttggttgatcgtcatggagaagaagtgaccccagaggacgtgctgtcagccgcaatgtacccggacgtgttcgctcacttcaaagacttcaccgctactttcggcccccttgacagtctaaatacaagactgttcttgcagggcccaaaaattgccgaggagttcgaagtggagctggaaagggggaagaccctgcatattaaggccctagcggtgagcgatttaaacagagccggacagcgacaggtgtttttcgagcttaacgggcagctgcgttctattctcgttaaagacacccaggctatgaaagagatgcatttccacccaaaggcgctgaaagatgttaaggggcagataggagcacccatgcccgggaaggtcattgatatcaaagtcgtggcaggggctaaagtagccaagggccagcccctatgtgtactctccgcaatgaagatggaaacggtggtcacatcccccatggaaggcactgtacgcaaagttcacgtcaccaaagacatgaccctagaaggtgatgatctcatactggagatagagtag

SEQ ID NO: 131352 - DNA, 3537 bp, Artificial Sequence
  Description of Artificial Sequence: Synthetic coding sequence
atgctgaagtttagaacagtgcacggagggctcaggctcctcgggattcgaaggacttctactgcccctgcagcgtctcctaacgtgcgtagactagagtacaagcctattaaaaaggtgatggtggccaaccggggggagattgcgattcgagtatttcgagcttgcactgaactgggaattcggaccgttgcaatttactcagaacaggacactgggcaaatgcacagacagaaggccgatgaggcctacttgattggacgcgggctggctcctgttcaggcttacctccacatccctgacatcatcaaagtggcaaaggaaaataacgttgatgccgtccacccaggttacgggttcctgtccgagcgcgcggattttgctcaggcgtgccaggacgctggtgttaggttcattggtccttctccagaagtcgttcgaaaaatgggagataaggtggaggccagagccatcgcaatcgctgccggagtgcccgtggtacctggaacggatgcaccaattaccagtttgcacgaagcccatgagttctcaaacacatacggtttccccatcattttcaaggcggcttacggaggagggggaaggggcatgcgggtagttcatagctatgaagagcttgaagagaattacactcgggcttactcagaagccctcgctgcatttggcaacggcgcattgtttgtggagaagttcatcgaaaaaccacgacacatagaagttcagatactgggtgatcaatatggaaacatcctgcacctctatgagcgagattgtagcatccagcggcggcaccagaaggtggtggagattgcaccagccgcccaccttgacccccagttgagaaccagacttacttctgatagcgtcaaattggcgaagcaggtgggttatgagaacgccggtacggtggaatttcttgtggaccgtcacggaaagcattatttcatcgaggtgaatagtagactgcaggtagagcatacagtcacagaggagattaccgatgtggacctggttcatgctcagattcacgtagctgagggaagaagtctgccggacctggggctaagacaggagaatattcggataaacggttgcgccatccagtgtagagttactaccgaggacccagctcgctcattccagcccgatacaggacggatcgaagtattccgtagcggagaggggatggggattcgactggataatgctagtgccttccagggagcagttatatccccccactacgatagcttacttgtgaaagtgatagcacacggtaaggaccaccctacagcagccaccaaaatgagccgcgcactggccgagtttagggtccgcggcgtgaagaccaacatcgcctttcttcagaatgttttgaataatcagcagttcctcgccggaacagtcgatacgcagtttattgatgagaaccccgaactgttccagctccggcctgctcagaaccgggcccagaaacttctgcattacctcggccatgtaatggtgaatggcccaacgacacctatccctgtaaaagcctctccttcacctactgacccagtagtgcccgccgtaccaatagggcctcctccagcaggctttcgcgacatcctactgagggagggtcccgaggggtttgctagagctgttcggaaccatcccggactactccttatggatactactttcagggacgctcaccaatccttgctggctacccgcgtgcggacacacgacctgaaaaagatcgccccatatgtagcccacaactttagcaaacttttttccatggagaactggggtggcgctacattcgacgttgcaatgaggtttctgtatgagtgtccctggcgtcgactgcaagagctgcgggagctcatacctaacatcccctttcaaatgttgttaagaggagctaatgctgttgggtatacaaactaccctgataatgtcgtgtttaagttttgcgaggtggccaaggagaatggaatggacgtctttcgtgtattcgactctctcaactacttgccaaacatgctgctcggcatggaggccgcaggaagtgccggcggtgtggtggaggctgctatcagctatactggggatgtagccgatcctagtaggacaaagtacagtctgcagtattatatgggccttgccgaagaactcgtgcgggccggtacccatattttgtgtatcaaagatatggccggcttgctgaaaccaaccgcttgcacaatgctggtatcatctctaagggatcgttttccggacctccccctgcatatccatactcacgatacctccggagctggagtcgcggccatgctggcatgtgctcaagccggcgcagacgtcgtggatgtggccgctgacagcatgtccggcatgacctcccaaccatctatgggggccttggtcgcttgtaccagaggaacgccgctcgatacagaggtacctatggagagagttttcgattatagcgagtattgggagggcgcccgaggactgtacgccgcatttgactgcacggccacgatgaaatcaggcaatagcgatgtgtacgaaaacgaaataccaggcggtcagtacacaaacctgcacttccaggcccactccatgggacttggcagtaagttcaaagaagtgaagaaagcctacgttgaggcaaatcagatgctgggagacctgattaaggtgactccttcctccaagatcgtcggcgacctggcacaattcatggtacaaaacggcctcagtagagctgaggccgaggcccaggccgaggaactgtcgttcccaagatctgtagtagagttcctccagggctatatcggcgtgccccacggtggcttccccgaacccttccgatctaaggtgttaaaagatctgccacgagttgaagggaggcctggagcctcgctgcccccgctggatctgcaagcccttgagaaagagttggttgatagacacggggaagaggtcacccctgaggacgtgctgtcagccgcaatgtaccctgatgtcttcgcccacttcaaagattttacagcaacttttggccccctagacagtctcaatacccgtctcttcttgcaggggcccaaaatcgccgaagagttcgaggtcgaactggaacggggaaaaaccctgcacattaaggcccttgccgtctctgaccttaacagagctgggcagaggcaggtcttctttgagctcaacggacagttgagatcaatcctggtgaaggatactcaggcgatgaaagagatgcacttccaccccaaggccctgaaggacgtgaagggccagattggggcgcccatgccaggcaaagtgattgacatcaaagtcgtcgctggagctaaggtggctaagggccagcccctgtgcgtgcttagcgccatgaagatggaaacagtggtcaccagccctatggaaggaactgtgcgtaaggtacacgtaaccaaggacatgactctggagggagacgacctgatactggaaatagagtag

SEQ ID NO: 131353 - DNA, 3537 bp, Artificial Sequence
  Description of Artificial Sequence: Synthetic coding sequence
atgctgaagttcagaactgtccatggaggactgcgccttcttggcatcaggcggacctctacagcgcctgccgcatcccccaacgtgcggagactggagtataagcccattaagaaagtgatggtggccaaccggggcgagatcgctattagggtctttcgggcctgcacggagctggggatcaggaccgtcgcgatttactcagagcaggacacaggccaaatgcatcgtcaaaaggcggacgaggcctacctcatcgggcgcgggctggcccctgtgcaggcctacctgcacatccccgatattattaaggtggctaaagagaataacgtagacgccgtacatcccggatatggcttcctgtccgaaagggctgatttcgctcaggcttgccaggacgctggcgtccgcttcataggtcccagtcctgaggtggttcgaaagatgggggataaggtggaggcaagagccatcgctattgccgctggcgtgccagtggtgccaggcaccgatgctccaatcacgtcgctgcacgaggcacatgaattttcgaacacctacggttttcccataatattcaaggctgcctacggaggcgggggccgaggcatgcgggtggtccattcatacgaagaactggaggaaaactacactagggcatacagtgaggccctggccgccttcggaaacggtgcactgttcgtggagaaatttattgaaaaacccaggcatatagaggtgcagattcttggcgatcagtacggtaacattcttcacttgtacgagcgcgattgttcaattcagcgtcggcatcagaaggttgtggagattgccccagccgctcatctcgaccctcaattaaggactcgtctgacctccgactccgtcaaattagcaaagcaggttggatatgagaatgccggaaccgttgaattcctcgtggacaggcacggaaagcattatttcattgaggttaattcaagactgcaggtggaacacaccgtcacagaagaaatcacagacgtagacctggtgcacgcccagatccacgtggccgagggtagatcattgccggatctaggactgcgacaggaaaacattagaattaatggttgcgccatacagtgtcgcgtcaccacagaggacccagcccggagtttccagcctgatactggtaggatcgaagttttccggtcaggggagggaatggggatcaggttggacaacgcaagcgcctttcagggcgcagttatcagcccacattatgactcattactcgtcaaggtcatcgcccatggcaaagaccaccctacggctgccactaaaatgtccagggctctggctgagttccgcgttcgcggggtgaaaaccaacatcgcttttttacagaacgtgctgaacaaccaacagtttctggctggaacagtcgatactcagttcattgatgaaaaccctgaactgttccagctccgaccagcacagaatcgggcccagaagctcttacactatctagggcatgtcatggttaatggtcccactacacccatccctgtgaaagctagcccctccccaacagacccagtcgttcctgctgtgcctatcggccctcccccggccggctttcgcgatattttgctgcgggaaggtccagaaggattcgcccgcgctgtgagaaaccacccgggcctgctgctgatggacacaacctttcgcgacgcacatcagtctctcctcgccacacgagtgcggactcacgatcttaaaaaaatcgcaccctacgtggcccacaacttcagtaagttgttctctatggagaactggggcggcgcaaccttcgacgtggcaatgagattcctgtatgaatgtccctggcgtagactgcaggaactgcgggagctgattcccaatatcccgttccagatgctgctgaggggggcgaacgccgtgggctatactaattacccagacaacgtggtgttcaaattctgtgaagtagccaaggaaaacggcatggacgtctttagggtatttgattcactaaattacttaccaaatatgctgctgggtatggaggcagctggaagcgccgggggtgtggttgaggctgcaatcagttatacaggggacgtggcagatccctctagaacgaagtactcacttcaatactatatgggactagctgaagagctcgtgcgagcaggtacacacatcttgtgcataaaggatatggccggactgctcaagcctaccgcctgtacgatgttagtgtcttcgcttcgcgaccgcttcccagacttgcctctacatatccatacacacgatactagcggtgcaggcgttgctgctatgcttgcatgcgcacaagccggagcagatgtagtggatgtggcagccgattcaatgagcgggatgacctcccaaccttccatgggagcacttgtggcatgcactaggggcaccccgctcgacacagaagtgcctatggagcgcgtgtttgactactccgaatattgggaaggagccagagggttatacgccgcctttgactgtaccgctaccatgaagtccggaaactctgatgtctatgaaaacgagatccccggcggacagtacaccaacctccactttcaggcccactcaatgggacttggcagcaaatttaaggaagtgaagaaagcctacgtggaagcaaaccagatgctaggagacctcattaaagtcaccccaagtagcaagatcgtgggcgaccttgcccagttcatggtccagaacgggctttccagagctgaggcggaagcccaggcagaggagctcagtttccctcgttccgtggttgagtttttgcaggggtacattggcgtgccccatggtggattccctgaaccattccgcagcaaagtattgaaggacttgccacgagtcgaggggcggcccggcgccagtttgcctcccctcgatcttcaggcattagagaaggaactggtagaccgacacggcgaagaggtgacgcccgaagatgtactatcagctgcaatgtatcccgatgtttttgcgcacttcaaagactttacggcgaccttcggaccactcgatagccttaacacccgcctctttttgcaagggcccaaaattgcagaggagtttgaagtggaattagaacgcgggaaaaccctgcatatcaaggcactggcagtcagcgatcttaacagagcggggcaacgacaagtgtttttcgagctcaacggtcaactgaggagcatccttgtgaaagatacacaagctatgaaggaaatgcactttcacccaaaggcactcaaagacgtcaaaggtcagataggagctcccatgccgggaaaggtcatagatatcaaggtggtggccggggccaaggtggccaagggacagcctttgtgcgttctgagtgctatgaagatggaaaccgttgtgaccagcccaatggaagggacagtgcggaaagtccacgtcaccaaagatatgaccctggaaggggacgacctgatactggagatcgagtag

SEQ ID NO: 131354 - DNA, 615 bp, Artificial Sequence
  Description of Artificial Sequence: Synthetic coding sequence
atgaggaaaatgctggctgcggtgagccgcgtactcagcggagcttctcagaaaccagccagccgggtgctagtcgcatcgagaaattttgcgaacgatgctaccttcgagatcaaaaaatgtgatcttcaccgactcgaagaagggccacccgtgacaacagttctgactagagaggacggtctgaagtattaccggatgatgcagacagtgagacggatggaactgaaggccgaccagctgtacaaacaaaagattatccgaggattctgccatctgtgtgacggccaattcctgctcccactgacccaggaggcttgctgcgtgggcctggaagcagggattaaccccactgaccatctcattaccgcatacagagcccacggttttactttcactcgggggttgtctgtgcgggagatcctcgcggagctgacagggcgcaagggtggatgtgccaagggaaaagggggttccatgcatatgtatgctaaaaatttttatggtggcaatgggatcgtgggtgcacaggttccgctcggcgctgggattgcgctcgcatgtaaatataacgggaaagatgaagtctgcctgaccctgtatggcgatggatag

SEQ ID NO: 131355 - DNA, 330 bp, Artificial Sequence
  Description of Artificial Sequence: Synthetic coding sequence
atggagttgcagacttatcgctatcacggacattcgatgtctgacccaggtgtgagctatagaactagggaagaaatacaggaagttcggagcaaatccgatccaatcatgttactcaaggatcgaatggttaattctaacctggcatctgtggaggagctcaaagagatcgatgtcgaagtgcgaaaggagatcgaagatgctgctcagttcgcgaccgcagatcccgagcctccccttgaggagctggggtatcacatctattcttcagatccgccttttgaggtgcgaggggccaaccagtggataaagttcaagagcgtgtcctag

SEQ ID NO: 131356 - DNA, 543 bp, Artificial Sequence
  Description of Artificial Sequence: Synthetic coding sequence
atgagaaagatgctagctgctgtctcaagagtgttgagtggcgcaagccagaagccagcctcaagagtgttagtcgcctctcgaaattttgcaaatgatgctacgtttgagataaaaaaatgtgatctgcacaggctcgaggaaggcccacccgtgacaacggtactgacgagggaggacggcctgaagtattatcggatgatgcagacggtcaggaggatggagctaaaggcagatcagctgtataagcagaagattataagaggattctgccacttatgcgacggacaagaggcatgctgcgtggggctcgaggctggaatcaatccaaccgatcatcttataaccgcctaccgtgcacatggctttacatttacaaggggtctcagtgtgagggagattctggccgagctcacggggagaaaagggggatgtgctaagggaaaggggggctctatgcacatgtacgccaaaaatttttacggagggaacggaattgtgggcgcccaggtcgtcaaggacgaagactgcgtgctcctgtag

SEQ ID NO: 131357 - DNA, 1287 bp, Artificial Sequence
  Description of Artificial Sequence: Synthetic coding sequence
atgaggaagatgctcgccgcagtttcccgggtgttgtccggcgcaagtcagaaaccaaggcatggtctggctacactaccttccctcgtgagcatctccaggttgaaacagtcttctcacctcggtctaccaaaatgctgggattactcccattcattgaaaacacgccaggcatctagagttctggttgccagccgcaacttcgccaatgatgcaaccttcgagatcaaaaagtgtgacctacatcgattagaggaaggccctcccgtcacaactgtgctcactagagaagatggcctgaaatactatcgaatgatgcagaccgtgagacggatggaactgaaagcggaccagctatacaagcagaagattattcgcgggttctgccacctgtgtgatggacaggaagcctgctgcgttgggctggaggccgggattaaccccacagatcatctcatcacagcctatcgcgctcatggcttcacattcactaggggactatcagtgcgggaaattctcgccgagctgactgggaggaagggcggttgcgccaaaggcaagggtggatctatgcatatgtacgctaaaaacttttacggtggcaacggtatagtgggcgctcaagtcccactcggtgctggaatcgctctggcttgtaagtacaacggaaaggatgaggtgtgcctgacattatatggggacggcgccgcaaatcaaggccaaattttcgaagcctacaatatggccgcattgtggaagctgccttgcatcttcatttgcgagaataataggtacggaatgggcacctcagttgaaagggccgcggcaagcacagattactacaagcggggagattttattcctggcctgagggtcgacggaatggatattttgtgcgtgagagaggccacccgattcgcggcggcgtattgtcggagcggcaaggggccaattctgatggagctgcagacctatcgttatcacggacacagcatgtccgaccctggcgtcagttatagaactcgtgaggaaatccaggaagtaaggagcaagagtgacccaataatgcttcttaaggatcgcatggtgaacagtaaccttgccagtgtggaagagctcaaggaaattgacgtggaagttagaaaggagatcgaggacgcagcacagtttgccacggccgacccagagccccccctcgaggagttaggatatcacatatacagctctgacccccccttcgaggtgcggggagcaaaccagtggattaaattcaagagcgtctcttag

SEQ ID NO: 131358 - DNA, 366 bp, Artificial Sequence
  Description of Artificial Sequence: Synthetic coding sequence
atgagaaaaatgttggccgctgttagcagggtcctcagtggcgcttctcagaaaccgttcgccggcagcccgcctcctagacacctgaccgtggggagaaagctttcttccagatatgaagtaacctttgaatccgcccaggccagccgagtgctcgttgcttcccgcaattttgccaatgatgcaactttcgagatcaagaagtgcgacctccaccgtttagaggagggcccacctgtcaccaccgttctgacccgcgaggacggcctgaaatattaccgaatgatgcaaactgttaggagaatggagctgaaggccgatcagctctacaagcagaagatcattaggggcttctgccacctctag

SEQ ID NO: 131359 - DNA, 366 bp, Artificial Sequence
  Description of Artificial Sequence: Synthetic coding sequence
atgaggaagatgctagcagctgtttccagggtgctgagtggggccagccagaaaccgtttgctggtagccctccccctaggcacctcactgtggggcgcaagctgagttccaggtatgaagtcacctttgaatctgcacaggcctcacgagtgctcgtcgcaagcaggaattttgccaatgatgccaccttcgagattaagaagtgtgacctgcatcgcctcgaagaaggaccccccgtgacgacggttctaacacgggaagatggtcttaagtactaccgcatgatgcagactgttcggagaatggagctcaaagctgatcagctttacaaacagaaaattatccgaggtttttgccacctctag

SEQ ID NO: 131360 - DNA, 1173 bp, Artificial Sequence
  Description of Artificial Sequence: Synthetic coding sequence
atgaggaaaatgttggcggccgtgtcacgggtcctgtcaggagcgtcgcaaaaaccagcctctagggtcctggttgcatcaagaaatttcgctaatgatgcaacattcgaaatcaaaaaatgcgaccttcatcgcctggaagagggccccccggttactacggtactgactcgcgaggatggacttaagtattatcgtatgatgcagacagttcgaagaatggaactgaaagccgaccaattgtataaacagaaaataatcaggggcttctgtcacctttgcgacgggcaggaggcttgctgcgtaggactggaggcagggatcaaccccaccgaccatctgattacagcttacagagctcacgggttcacatttaccagggggctttcagtgcgggagattttggccgagctgactggcagaaagggggggtgtgccaaggggaaaggcgggtcaatgcacatgtacgcaaaaaacttttacggtggcaatgggatcgtgggcgcccaagttcccctcggagccggcatcgccctggcctgtaagtataacggcaaagatgaggtctgcttaacactttacggagatggggctgccaaccaggggcagatctttgaggcatataacatggctgcattgtggaaactcccctgtatctttatttgtgagaataatcgctatgggatggggacgagcgtggagcgggccgcagcttcgactgattactacaaaaggggtgactttatccccggccttcgggtcgacggcatggacatcttgtgtgtgagagaggccacgcgattcgctgccgcctactgccggtcaggcaagggacctatcctgatggagctgcagacctatagatatcacggccacagcatgagtgatccgggagtctcctacagaacccgcgaggagattcaggaagtgcgctcgaagtctgacccaattatgctactcaaagaccgcatggtgaattccaatctggcttccgtagaagagctcaaggagattgatgtcgaggtgcgcaaagagattgaagacgcagcccagtttgccacggccgaccctgagccacccctcgaggagttagggtatcacatctacagttccgatccaccattcgaggttcggggagctaaccagtggattaagttcaaatcagtttcatag

SEQ ID NO: 131361 - DNA, 618 bp, Artificial Sequence
  Description of Artificial Sequence: Synthetic coding sequence
atgaggaagatgctggccgctgtatctagggtgctatcaggtgcaagtcaaaagccaagacacggcctcgccaccttgccctccctggtatcaattagtcgtctcaaacaaagttctcacttgggtcttccaaagtgctgggattatagtcacagcctgaaaacacgccaggcatcccgggtgttggttgcctcacggaacttcgccaacgacgcaaccttcgagatcaagaaatgcgacctccaccgcttggaagagggacctcccgtcacgaccgtcctcactcgagaggatgggctaaagtactatcgaatgatgcaaacagtgcggcgcatggagctgaaggctgatcagctctacaagcagaaaatcatccgaggattctgccatttatgtgacggacaagaggcttgctgtgtgggtctggaggcagggatcaaccccactgatcatctgattactgcctatcgagctcacggctttaccttcacccgcgggttgagcgtccgtgagatactggctgagctgacagggcgcaagggtggttgtgccaagggaaaagggggcagtatgcatatgtacgcgaaaaacttctatggcggcaacgggatcgtttag

SEQ ID NO: 131362 - DNA, 1080 bp, Artificial Sequence
  Description of Artificial Sequence: Synthetic coding sequence
atgcgcaaaatgctggccgccgtttcaagggtcttgtcaggcgccagccagaagccagcatccagggttctggtggcaagccgtaactttgcgaacgatgctaccttcgaaattaagaagtgcgacctccatcgactcgaggaagggcctcctgtcaccaccgtattgacccgcgaagacggcttgaagtattatcggatgatgcaaactgtgcgccgcatggagctgaaggccgatcagttgtacaagcaaaagattatcaggggcttctgccacctctgcgacgggcaggaagcctgctgcgttgggctcgaagcaggcattaatcccaccgatcacctgataactgcatacagggcacacggttttaccttcaccagaggtctgagcgtgagagaaattctcgccgagttaaccggtaggaagggagggtgcgccaaaggcaaaggaggctctatgcacatgtacgccaaaaatttttacggcgggaacgggatagttggggctcaggggcagatcttcgaggcgtataatatggccgctctgtggaaactgccctgcatctttatatgcgagaataaccgctacggtatgggaacgtccgttgagagagccgccgcctcaacggactattacaaacgcggagactttatccctggtctgcgggtcgacggaatggatattttgtgtgtgagagaggcaacacgcttcgccgcagcttactgtagaagtggaaagggaccaattttgatggaactgcagacctatcggtaccatggccattcaatgagcgaccctggagttagctaccgcacacgggaggaaatccaagaggtccggagcaagtcagatcccataatgctgctgaaagaccgtatggtgaactccaatctggcgagcgtagaagagttaaaagagatcgatgtagaggtgagaaaagagatcgaggatgcggctcaattcgccaccgcagaccccgagccacccttggaagagctcggataccatatttacagtagtgatcctcctttcgaagtgcgaggggcaaatcaatggattaagttcaagtccgtttcgtag

SEQ ID NO: 131363 - DNA, 129 bp, Artificial Sequence
  Description of Artificial Sequence: Synthetic coding sequence
gctaatcagtggattaagttcaaaagtgtgaaggggagaaggaggagaggttatactttcagggggttgcccgacagcgtgctgaacttggtgaaggaagaagagaatccggtgaacgaaatccagtag

SEQ ID NO: 131364 - DNA, 1194 bp, Artificial Sequence
  Description of Artificial Sequence: Synthetic coding sequence
atgcgcaagatgctcgccgctgtgtcccgagttctaagcggcgcctctcaaaaacctgctagccgggtgctggtggctagtcggaacttcgcgaacgatgcaaccttcgagattaaaaagtgcgatctacatcgcctggaagagggaccccccgtgacaaccgtcctgacacgcgaggatggcctgaagtactatcgtatgatgcagacagtgaggcgcatggagcttaaagcggatcaactatacaagcagaagattatccgggggttctgtcacctgtgcgatggacagtttctgctccccctcacacaggaagcttgttgcgtagggttggaggccgggattaacccgaccgatcatttgattaccgcctatagagctcatggctttacattcacacgcggactgagcgtgagagaaatacttgctgagctgaccggaaggaaaggggggtgcgccaaaggaaagggggggagcatgcatatgtatgccaagaatttctacggaggcaacggtatcgtgggagcccaagtgcccctgggtgctggaattgctctggcttgcaagtataacgggaaagacgaagtttgccttaccctgtacggcgatggtgccgctaatcaaggccagattttcgaagcctacaatatggcagccctatggaaactgccttgcatcttcatatgcgaaaataaccggtacggcatgggaacctctgtcgagagggctgccgcgtccaccgactattacaagaggggcgactttatccccgggctgcgagtggacgggatggacatcctttgcgtacgggaggccactaggtttgctgctgcctactgtaggagtggcaaaggacccattcttatggaactgcaaacctacagataccatggccattctatgagtgaccctggagtgtcctaccgaacccgcgaggaaatccaggaggtaagaagcaagagcgatccaatcatgcttctgaaggaccgcatggttaattctaacctcgcttctgtggaagagctgaaagaaattgacgtggaggtgcgaaaggagatcgaagatgccgcacagttcgccacagcagaccctgagccacctctggaggaattagggtaccatatttactcctctgatccacccttcgaggtgcgcggagccaaccagtggatcaaattcaagtctgtatcatag

SEQ ID NO: 131365 - DNA, 1167 bp, Artificial Sequence
  Description of Artificial Sequence: Synthetic coding sequence
atgctggcagccttcattagccgcgttctcaggcgcgtcgcccaaaaaagcgctagaagggtgttagtcgcttcccggaattcaagtaacgatgcgacattcgagataaagaaatgtgacctttatctgctggaggagggtccgcccgtcaccactgtgctcacacgggcagaagggttgaaatactacaggatgatgctgaccgtacgtcgcatggagttgaaggccgaccaattgtataaacagaagttcatccggggattctgtcatctgtgcgacggacaggaagcttgttgcgtggggctagaggccggcattaaccctagcgaccacgtaataacatcctatcgcgcgcacggagtgtgctacaccagggggctgtcagtgcggtcaatcctcgccgaactgacaggacggcgcggcggctgtgccaagggtaaaggcggcagcatgcacatgtatacaaagaacttctatggggggaacggaattgtgggcgcccaggggcccttgggtgctggaatagctcttgcgtgtaaatacaagggcaatgacgagatttgcctgacactatatggcgacggcgctgcaaatcagggccaaatcgctgaggcctttaacatggccgccctgtggaaactcccttgtgtatttatttgtgagaacaatctctacgggatgggcacgtccacagagagggcagccgcatccccagattactacaaacgcggaaattttatcccgggcctcaaggtggacggaatggatgtattgtgcgtacgcgaggcgacgaaattcgctgcgaactactgtcgcagtggcaaaggacccattctgatggagttgcagacctacaggtatcatggacactccatgagcgacccaggcgtgtcatacagaactcgagaggaaattcaggaagttcgctccaagcgggacccaatcattattctgcaggacaggatggtgaacagcaagcttgcaactgtggaggagctgaaagagattggcgcagaggtgcgcaaagaaatagatgacgctgctcagttcgcaactacagatcctgagccacacctggaggagttagggcatcatatatacagttccgatagctcttttgaggtgagaggagccaatccctggattaagttcaaatctgtctcgtag

SEQ ID NO: 131366 - DNA, 1080 bp, Artificial Sequence
  Description of Artificial Sequence: Synthetic coding sequence
atggctgcagtttccgggctcgttcgccgaccactgcgtgaggtgtcaggattgttgaagcgaagatttcactggaccgctcccgccgcacttcaggtgaccgtccgcgacgccatcaaccagggaatggacgaagaactggaacgcgacgaaaaagtgttcctgctcggtgaagaggtcgctcagtacgacggagcctacaaagtgtcgaggggcttatggaaaaaatacggcgacaaaaggatcatcgacacacccatttctgaaatggggtttgctgggatcgccgtgggggccgcaatggctggtctgagacccatttgcgaattcatgactttcaacttttccatgcaggccatcgatcaagtgatcaatagtgccgctaagacatattacatgtccggaggcctccagccagtccccatagtgtttagggggcccaacggagcctccgccggggtggctgcccaacactcgcaatgtttcgcagcatggtacggacactgccccggcctaaaggtggtgtctccatggaattctgaggacgcaaaaggattgataaaaagcgccatcagagataacaatccagtggtggtgctggagaacgaattgatgtatggcgtgccattcgaattccctcccgaggcccaaagtaaggatttcttgatcccaattgggaaagcaaagattgagaggcagggaacccacataaccgtggtgagccattcaaggccagttggtcactgtttagaggccgccgccgtgctcagtaaggagggcgtagaatgcgaggtgattaatatgcgaaccatcagacctatggacatggagacaatagaagcctccgtgatgaagactaatcacctggtcacagttgagggcggttggccacagtttggtgtgggggcagagatatgtgcacggatcatggagggccctgctttcaacttcctggatgctccagcggtccgcgttaccggggccgatgttcccatgccctacgccaagattctggaggacaactcaatcccccaggtaaaggatattatattcgcaatcaagaaaacgctgaacatttag

SEQ ID NO: 131367 - DNA, 1026 bp, Artificial Sequence
  Description of Artificial Sequence: Synthetic coding sequence
atggccgccgtgtctggcttggttaggaggccactgagagaagttacggtccgggacgccattaatcaggggatggatgaggagctagaacgcgacgaaaaggtttttttgttaggggaggaggtcgctcaatacgatggggcttataaggttagccgagggctttggaaaaagtacggagacaagagaatcattgatacacccattagcgaaatgggatttgctgggattgcagtcggtgcggccatggctggcttgcgaccaatctgtgagttcatgacatttaacttctccatgcaagctattgaccaggtgatcaatagtgcagccaagacatattacatgtccggtggtctccaacccgtcccgatagtattccgtggcccaaacggggctagtgcaggtgtggccgctcagcattctcagtgtttcgccgcatggtacgggcactgccctgggttaaaagtggtgagcccctggaacagcgaggacgccaagggactgataaaatccgccattcgggataacaatccagtggtcgtgttagagaacgagttaatgtatggagttccctttgaatttcccccagaggcccagagcaaagactttctcatacccatcggcaaggcgaagatagagcggcagggcacccatatcacagtcgtttcacattcccggcccgttggccattgcctggaggcagccgctgtgctctccaaggagggcgttgagtgtgaggtcataaatatgagaactataaggccaatggatatggagacaattgaggccagcgtcatgaaaactaatcacctagtgactgtggaaggcggatggccccagttcggcgtcggcgccgagatatgtgccaggattatggaaggacccgcatttaacttcctggacgccccggccgttcgagtaactggagccgatgtccctatgccatacgccaaaattctagaagacaattccattccccaggtcaaggacatcatcttcgccatcaagaagacactgaatatctag

SEQ ID NO: 131368 - DNA, 1026 bp, Artificial Sequence
  Description of Artificial Sequence: Synthetic coding sequence
atggccgcagtgagcggacttgtgaggagaccactcagagaggtgagtgggcttcttaagcggcggttccactggacagcgcctgccgctttgcaggtgaccgtgcgcgacgccatcaatcaggggatggatgaggagttagaaagagatgagaaagtgtttctgcttggggaagaagtggcacagtatgacggggcctataaagtctctcgaggactatggaaaaaatacggggacaaacgaatcatagatacaccaattagtgagatgggcttcgccggcatagccgtgggcgctgctatggcagggctccgccccatttgcgagtttatgactttcaacttttccatgcaggctatcgatcaagtgattaattctgccgctaaaacatattatatgtccggcgtggccgcccagcactcacagtgtttcgccgcttggtatggccactgtccaggcctaaaggtcgtgtccccctggaatagcgaggatgcaaaggggctgattaaaagtgccattcgggacaataatcctgtagtggtactcgagaacgagttgatgtatggggtaccatttgaatttccgcccgaagcacagtccaaggattttctgatccctatcgggaaagccaaaatcgaacgacaggggacacacatcactgtcgtctcacacagccggccagtcggacattgtttggaggctgccgctgtgttgagcaaggaaggcgtggaatgcgaagtgattaatatgaggactattcggcccatggatatggagaccattgaagcaagcgtcatgaaaacgaatcacttggtaactgttgaggggggatggccacagtttggagtcggggccgaaatctgcgcacgtatcatggagggtccagcttttaatttccttgacgctcctgcagttagagtcaccggggcagacgtgcctatgccatatgccaaaattctggaagataattccattccacaggtgaaggatattatcttcgccattaagaaaacgttaaatatctag

SEQ ID NO: 131369 - DNA, 1236 bp, Artificial Sequence
  Description of Artificial Sequence: Synthetic coding sequence
atgaaggccgccagatttgtccttcggtcagccgggtccctgaatggggctggcctggtccctagagaagtcgaacatttttcaaggtattccccatctcctctctctatgaaacaactccttgacttcggctctgaaaatgcctgcgagcgtacctcatttgcctttctgaggcaggagctaccggttcgtctggccaatatattaaaagaaatcgacatcctgccaacacagctggtaaacaccagttctgttcagttagtgaagtcctggtacatccagtccctgatggatctcgttgagttccatgagaaatcccctgatgaccaaaaggctcttagtgacttcgtcgatactctgataaaggtgaggaatcgccatcacaacgtggtacctaccatggcacaagggattatcgaatacaaggatgcctgtaccgtggaccccgtgaccaatcaaaacctgcagtacttccttgacagattctatatgaatcggatctcaactagaatgctgatgaatcaacatatcctcattttctcggattctcaaacaggcaaccctagccatatcggaagcattgaccctaactgtgatgtggtggctgttgtgcaggatgcctttgaatgcagcagaatgctgtgtgatcagtattatctgtcatctcccgagctgaaactgacccaagtaaatgggaaattcccggatcagcctatccacatcgtgtatgtgccgtcacatctccatcatatgttatttgaactctttaaaaatgcaatgagagccaccgtggaacatcaggagaatcaacccagcctgaccccaattgaagtcatcgtggtattgggcaaagaggacctcaccatcaaaatctcagatagaggcggcggtgtaccgctgcgaattatagacagactgtttagctacacatactcaaccgcgcccacccctgtaatggacaattctagaaatgcgccactggccggcttcggttatggactgcccattagccgcctgtacgccaaatacttccagggagatctgaacctttactctttaagcggctacggcaccgatgctattatctacttaaaggcgctctcttcggaatctatcgagaagctgccggtttttaacaaatctgcctttaaacattaccagatgtccagcgaggctgacgactggtgcatcccgtcaagagagccgaagaacctggcgaaagaggtggccatgtag

SEQ ID NO: 131370 - DNA, 1128 bp, Artificial Sequence
  Description of Artificial Sequence: Synthetic coding sequence
atgaagcagttgttggacttcggaagtgaaaacgcatgtgagagaactagctttgcttttttaagacaggagctccccgttagattagccaacatcttaaaggagatagatatcctgccgacacagctagtgaatacctcttcggtgcaactcgtaaagagctggtatatccagtctttgatggacctcgtggaatttcatgagaaatcccctgatgaccagaaggcactcagcgattttgtagacacgctcatcaaggtgcgaaatcgtcaccacaacgtagtccccaccatggctcaggggattatagaatacaaagatgcatgtactgtggaccctgtcacgaatcagaacctccagtattttctggatcgcttttacatgaaccgaatatcaacacgcatgttgatgaatcagcacatcctgattttctctgactcccagactgggaatccttcacacatcggatctatagatcctaattgcgacgtagtggcagtggtgcaggacgcatttgagtgctctcgtatgctttgcgatcagtactacctctcatctccagaactgaagctgactcaggtcaacggtaaattccctgaccaaccaatccacattgtgtatgtcccctctcacttgcaccacatgctcttcgagctgtttaaaaacgctatgcgtgctacggtcgagcaccaggaaaaccagccttcactgaccccgattgaagtgatagtggttttgggaaaggaggacctgacaatcaaaatttccgaccgaggtggaggagttccattgcgtataattgacagactctttagttacacatatagtaccgcaccaacgcccgtgatggacaatagccggaacgctccattggctgggttcgggtatggactcccaatatcaagattgtacgcaaagtatttccagggggatttgaacctgtatagcctgtcagggtacggcactgatgctattatctatctgaaagccttgtcctctgaatctatagagaagctgcctgtgttcaacaagtcagccttcaaacattatcaaatgagttcagaggccgatgactggtgtattccttccagagaaccaaagaatttggcaaaggaggtggctatgtag

SEQ ID NO: 131371 - DNA, 1614 bp, Artificial Sequence
  Description of Artificial Sequence: Synthetic coding sequence
atgcctgcacccacccagcttttttttccactgatacgtaactgcgagctgtcacggatttatggcacagcctgttattgccaccacaagcacctgtgctgctcctcttcttacattccgcagtcgaggctgaggtatactcctcaccctgcgtacgcaactttctgcaggccaaaggagaactggtggcagtatacacagggcagacggtacgccagcacgccccaaaaattctatttgacacccccccaggtgaatagcattctaaaggccaacgaatactcttttaaagtgccagaattcgacggtaaaaacgtgtcgagtatccttggtttcgactccaaccagcttccagcgaacgctcctattgaggaccgcaggtccgccgctacatgcttgcaaactagaggaatgttgttaggcgtctttgatggccacgcagggtgcgcgtgtagtcaggccgtgtccgagaggttgttttattatatcgccgttagcctattgccacatgagacgcttctggagatcgagaatgcggttgaaagtggccgcgcactgctccctatcctgcagtggcataagcacccaaatgattatttttccaaggaagcaagcaagctgtactttaattctctccggacttactggcaagagctgatcgatctcaataccggtgagagcaccgacattgacgtgaaagaagctctaattaatgcatttaagaggcttgataatgacatcagcctggaggcccaagtaggtgatcctaacagcttcctaaactatctggtgcttcgcgtcgccttcagcggggcaactgcatgtgtagcccacgttgatggcgtggatttacacgtagctaacacaggcgacagtcgggccatgctaggcgtgcaggaagaagatggaagctggtccgcagtgaccctttctaatgatcacaatgcccagaatgaaagggagcttgagcggctaaagctagaacaccctaaatcagaagccaagtctgtggttaagcaagacaggcttctcgggctgctcatgccgttccgagcgttcggagacgtcaaattcaaatggagcatcgacctgcagaagcgagtcatcgaatcaggccctgatcagctaaatgataacgagtacacaaagttcattccacccaactaccacacccccccatatctgactgccgagcctgaggtgacttatcaccggctgcgaccccaagataagtttctcgtgctggctaccgatggactctgggagaccatgcatcgccaggacgtggtgcgaatcgtgggtgagtaccttactgggatgcatcaccagcagcccattgccgtgggggggtacaaagtgaccctcgggcagatgcacggtctgctgacagaacggcgcactaagatgtccagcgtatttgaggatcagaatgccgccactcatctcattaggcacgctgtgggcaataatgaatttggaaccgttgatcatgaaaggctgtccaaaatgttgagcctcccagaggaacttgcaaggatgtaccgagacgatattacaatcattgtcgtgcagtttaatagccatgttgttggggcctatcagaatcaagaatag

SEQ ID NO: 131372 - DNA, 1689 bp, Artificial Sequence
  Description of Artificial Sequence: Synthetic coding sequence
atgtgcgtctgcccaggccctcgtcgtatcggcatccccgttagaagctcctcactgcctctgttcagcgatgctatgccagcccctacacagctgtttttcccactgatacgtaattgtgagctgtcaaggatttacggaaccgcctgttattgccaccataaacatctgtgctgttcgtcgagttacatccctcagtccaggcttcgatacaccccccatcccgcatatgccaccttctgtcgaccaaaggagaattggtggcagtacacacaggggaggagatacgcctccaccccgcagaagttttacctaacaccacctcaggtgaactccatcctcaaggccaacgagtatagctttaaggtccctgagtttgatggcaagaacgtaagctctattttgggtttcgattccaatcaactgccagcaaacgcccctatcgaggaccgcagaagtgccgcgacatgccttcagacccgcggcatgttgcttggggtcttcgacgggcacgctggctgcgcctgttcccaagctgtcagcgagcgactgttctattacattgctgtgagtctcctgccccacgagaccctgcttgagatagagaatgctgtcgaatccggacgcgctttgttgcccattctgcagtggcacaagcatcccaatgattacttttctaaggaagcatccaagctgtactttaactccctacgtacgtattggcaggagttaatcgaccttaacacaggtgagagtactgacattgacgtgaaagaagcactgattaacgccttcaaaaggctggataacgatatcagccttgaggcccaggtcggagatccgaattctttccttaactatcttgtcttacgtgtggcttttagcggtgctaccgcctgtgtggcccatgtggatggcgtggatttacacgtcgccaataccggagactctcgggccatgttgggagttcaagaggaagacgggtcctggtctgcagtgacgctgagcaacgatcacaatgctcagaatgaaagggaacttgaacgcctcaaactggaacacccgaaatctgaggcgaagagcgtggtgaaacaagacaggctgctgggtctgctgatgcccttcagggccttcggcgatgtcaaatttaagtggtccatcgatttgcaaaagcgtgtgatcgaatcaggcccagaccagctgaatgataatgagtataccaaattcataccccccaactatcacacgcccccctacttgactgcggagcccgaggtgacttaccatcgcctgcgaccccaagataagtttctggtcctggctaccgacggactttgggaaacaatgcaccgccaggatgtcgtgaggatcgtgggagaatacctgaccggcatgcaccaccagcagcctatcgccgtgggcgggtataaggtgactcttggccagatgcatggactgctcacggaacgcagaacgaaaatgagcagcgttttcgaagatcagaatgcagcaacacacttgatccgtcacgcagttggcaataacgagtttggcacagttgaccacgaacgtctctcgaaaatgctttctctgccagaggagctcgccaggatgtaccgggacgatatcacgatcatcgtggtgcagtttaattctcatgttgtgggcgcctaccagaaccaagagtag

SEQ ID NO: 131373 - DNA, 1614 bp, Artificial Sequence
  Description of Artificial Sequence: Synthetic coding sequence
atgcctgcccctacgcagctgtttttcccgcttatccgcaattgcgagctctctaggatttacgggactgcctgctactgtcaccataagcatctgtgttgttcatctagttacattccccaatctcgactacgctatacaccccatcccgcttacgccacattttgccggcctaaggagaattggtggcaatacactcaaggccggcgttatgcttcaacccctcagaagttctacctgacacctccccaggtgaacagtatcctgaaagcaaacgaatattccttcaaagtgccagaattcgatggaaaaaacgtttctagcatcctgggcttcgacagcaatcagcttcctgcaaacgcgccgattgaggatcgaagaagtgccgccacatgcctgcagacccgcgggatgctattgggggtctttgacggccacgctggctgcgcttgtagtcaggccgtaagcgagcggctgttctactacatcgcagtgagcttgttaccgcacgaaaccctgttggagattgagaatgctgttgaaagtgggagggctctcctccccattcttcaatggcataagcatcccaatgactacttttccaaagaagcgagcaaactgtactttaacagcctgcgcacttactggcaggaactgattgatctgaacaccggcgagagtactgacattgatgttaaagaggccctgattaatgctttcaagagattggataacgacatcagcctggaggctcaagtcggggatccaaactctttcctcaattatttagtgcttcgcgtggcatttagtggagctacagcctgtgtagcccacgtggacggagtggaccttcatgtggccaataccggcgattcccgagccatgctgggtgtgcaggaggaggatggatcctggagcgctgtgacactgtccaatgaccacaacgcacagaacgaacgggaactggaacgcctgaagctggagcaccctaaatccgaggctaagtccgtcgtcaagcaggatagactcctgggactgctcatgccgttccgcgccttcggggatgtcaaattcaaatggagcatagacctccagaaacgcgtgattgaatctgggcctgaccaactcaacgataatgagtacacaaaattcattcctcctaattaccacacacctccttatctcactgcagagccggaggtcacatatcatcgcctcagaccgcaggacaaattcctcgtactggccacggatggcctctgggagacaatgcatagacaggatgttgtgaggatcgtaggagagtatctgacaggaatgcatcaccaacagccgattgcagtaggggggtacaaggtgacactaggtcagatgcatggtttgctgacagagcgcagaaccaaaatgtcctccgtgtttgaggatcaaaacgctgctacccatttaattaggcatgctgttggaaataatgaatttggtacagtggatcacgagcggctgtctaagatgctttctctgccagaagaactggctagaatgtaccgggacgatattaccatcatcgttgttcaatttaatagccatgtcgtgggggcctatcagaaccaggaatag

SEQ ID NO: 131374 - DNA, 231 bp, Artificial Sequence
  Description of Artificial Sequence: Synthetic coding sequence
atgcctgcccccactcagttgttcttccctcttatacggaactgtgagttaagcaggatttacggaacagcatgttattgtcaccacaaacacctgtgctgctcttcttcatatattccccagtcccgcctacgatacactccccacccagcctatgcaacattctgtagacccaaggaaaattggtggcagtatacacaaggcaggcggtatgccagcacccctcagtag

SEQ ID NO: 131375 - DNA, 387 bp, Artificial Sequence
  Description of Artificial Sequence: Synthetic coding sequence
atgcccgctccaacacaactcttcttccccttaatacggaactgtgagctcagccgtatatacggtacagcatgttattgccaccacaagcatctctgctgctcctcgtcatacattccacagtcgagactgcggtacactcctcatccggcttacgcaaccttttgtcggcccaaagagaattggtggcagtatacacagggacgccggtacgcctccactccccagaagttttaccttaccccaccccaggtgaactccatcctcaaggccaatgagtacagttttaaggtgcctgaatttgacggaaaaaacgtctcttctatccttggcttcgactcgaaccaactccccgcaaacgcccctatagaagaccgcagaagctag

SEQ ID NO: 131376 - DNA, 699 bp, Artificial Sequence
  Description of Artificial Sequence: Synthetic coding sequence
atgccagctccaacgcagctgttctttccgctcatccgcaattgtgaactttctaggatctatggaaccgcctgttactgccaccacaagcatctctgctgttcttcaagctacatcccgcagtccagactgcgctacaccccccaccccgcctacgcaacattttgtagaccaaaggagaactggtggcagtacacgcagggtcgtaggtacgcttcaacaccccaaaaattctacctgacccccccacaagtaaatagcattctcaaggctaatgaatactcctttaaggtgccagagttcgacggcaagaacgtgtctagcatcttgggcttcgacagcaaccagcttcctgccaatgcgcctattgaagatcggagaagcgctgctacgtgcctccagacacgcgggatgctgctgggcgttttcgacggccacgccggatgtgcctgctctcaggctgtttctgagcggctgttctactatatagccgtctcattgctgccgcatgaaactctgctcgaaatcgaaaatgctgtcgagtctgggagagcgttactccccattctgcaatggcacaaacacccaaatgattatttctctaaggaagccagcaagctttattttaacagcctgaggacgtattggcaggaacttatagatctaaatacgggggagtcgacagacatcgatgtgtag

SEQ ID NO: 131377 - DNA, 219 bp, Artificial Sequence
  Description of Artificial Sequence: Synthetic coding sequence
atgcccgcacctacacaattattctttccacttatcagaaattgtgagctgtcacggatttacggcacagcatgttactgtcaccacaagcatctgtgttgcagcagcagctacattcctcagagtcgactgcgctatactccccatccagcctatgcaaccttttgtagacctaaagagaattggtggcagtacactcaggggaggaggtacgcttag

SEQ ID NO: 131378 - DNA, 1614 bp, Artificial Sequence
  Description of Artificial Sequence: Synthetic coding sequence
atgcctgcccctacacagctctttttcccgctgatcaggaattgcgaactttccagaatatatggcaccgcctgctattgccaccataagcatctctgctgcagtagcagctacatcccccagagtcgactccgctatactccacatcctgcatatgccactttttgcaggcccaaagagaactggtggcagtacacccagggacgccggtacgcgagcacaccccagaaattctatctgactccaccccaagtgaatagtattctcaaagccaatgagtacagcttcaaggtgcctgagttcgatggcaagaatgtgagctccatcttgggatttgactccaaccagttgcccgcaaacgcccccatcgaagatcgtcgatccgccgccacttgcctccagacacgaggtatgcttctcggagtctttgacgggcacgccggctgtgcctgcagccaggctgtgtccgaaagactcttctactacattgcagtgtctttgttgcctcacgagactctgcttgaaatcgagaacgccgttgagagcggtagggccctgctccccatactgcagtggcacaagcacccgaacgactacttcagcaaggaagcaagtaagctttatttcaatagcctcagaacttattggcaggagctgattgacctaaacaccggcgaatctactgacatcgatgttaaggaggccttgattaatgcctttaaaagattggacaatgacattagtctcgaggcacaggtgggtgaccccaactctttcctcaactatttggttcttcgcgtcgcctttagtggagccacggcatgtgtcgcacatgtcgacggtgtagatctacacgtggctaacaccggagattcaagggccatgctcggagtgcaggaggaggacggatcctggagcgccgtgactctctccaatgaccacaatgcacaaaatgagcgggagctggaacgattaaagttggagcacccgaagtctgaggccaagtccgtggtgaagcaggacaggctgctggggttgctgatgccttttagggcgttcggagacgttaagttcaaatggtcaatcgacttgcagaaaagggtcatcgaatcaggccctgaccagctcaatgacaacgaatacactaaatttattccacctaattaccacacccccccctacctgacagccgagccagaggtgacctaccaccggctgcggccccaagacaaattcctagtgcttgctaccgatggcctgtgggagacgatgcacagacaggacgtggtacggatcgtgggtgagtaccttaccggaatgcaccatcagcagcctatcgcagtaggcggttacaaggttaccttaggtcagatgcacggtcttttgactgaacgacgcaccaaaatgagcagcgtgtttgaggaccagaacgcggccacgcacctgatcagacacgcggtagggaataacgagtttgggacagtggaccacgaacggctgtcgaaaatgctaagtcttcccgaggaactggcgaggatgtatcgggatgatattacaatcatcgtcgttcagttcaatagtcacgtggttggagcttaccagaaccaagaatag

SEQ ID NO: 131379 - DNA, 444 bp, Artificial Sequence
  Description of Artificial Sequence: Synthetic coding sequence
atgccagccccaacgcaacttttcttcccacttattcggaattgtgagctcagtcggatctacggcaccgcatgctattgccaccataagcacttatgttgctcttcttcctatatcccccagtcgaggctgcgttataccccacaccctgcatacgccacgttttgcaggcccaaggagaactggtggcaatatacacagggacgccgctatgcctcaacccctcagaaattctacttgactcccccacaggtgaattctattttaaaagctaacgagtattcctttaaagtgccagagtttgatggaaagaatgtttcctcaatattggggtttgattctaaccagttgcctgcaaacgctcctatcgaggatcgaaggtctgcggcaacatgtctacagaccagaggaatgctgctaggggtgttcgacggccatgcgtag

SEQ ID NO: 131380 - DNA, 1467 bp, Artificial Sequence
  Description of Artificial Sequence: Synthetic coding sequence
atggctgatacattcttagagcacttatgccttcttgacatagatagtgaacccgttgcagcccggtccacgtccattatcgcaacgattggccccgcttcccgctcagtcgagcgtttgaaagagatgattaaagcaggcatgaacattgcgagattgaacttctcccacgggagccatgagtaccatgcggaatccatcgccctggacaccaaaggacccgaaatccggacggggatcctacagggaggccccgagagtgaagtggagctggtcaagggttctcaggtgctggttacagttgatccagcttttcgcactcggggaaatgcaaatacagtgtgggttgattatccaaacatcgtgagggtagtcccggttggtggaaggatctacatcgacgacggccttatctccctggtggtgcaaaagataggcccggagggcctggtgacacaggtcgagaatggcggcgtgctcggcagcaggaagggtgtgaatctgcctggggcgcaggtggatttgccaggcctgtcagagcaggatgtgagagacctgcgctttggtgtagaacacggtgtggatatcgttttcgcctcatttgtgcgcaaggccagtgatgtggccgccgtgcgggccgccctgggacctgagggtcacggaatcaagattatcagcaagattgaaaaccacgagggcgtaaaaagattcgatgagatcttggaggtttccgatggtattatggtggcccgcggggacctgggcatcgaaatccctgctgaaaaggtgttcctcgcgcagaagatgatgataggccggtgcaatttagctggcaaacccgtggtttgtgcaacgcagatgctggaatctatgatcacaaaacccagacccacacgggcggagacttctgacgtggcaaatgccgttttagacggggccgattgtattatgttgagcggagaaacggccaaaggtaattttcccgtagaagcagttaaaatgcagcatgccattgctcgcgaagccgaggccgcagtgtatcacagacaactgtttgaagagctccgaagagctgcacccctgagtagagatccaacagaggtcaccgctatcggcgccgtagaggccgccttcaagtgctgcgctgcagctatcattgttctgaccaccaccggccgtagtgcgcaactgcttagccggtatagacctcgagcagctgtgatcgcagtgactcggtccgcccaggcagcgcggcaagtgcacctctgcaggggagtgttccctctcctctacagggaaccgccagaagctatatgggcagatgatgtcgatcgtagagtgcagttcgggatagagtctggtaagcttcgcgggttcctgcgcgtgggcgacctggtgatcgtagtaacgggctggagaccaggaagtggctacaccaatatcatgcgggtgctgagtattagctag

SEQ ID NO: 131381 - DNA, 1725 bp, Artificial Sequence
  Description of Artificial Sequence: Synthetic coding sequence
atgtccattcaggaaaacattagttccctgcagctcagatcatgggtcagcaaatcccagagggatctggcaaaatcgatactgatcggcgcccctggaggaccagcgggatatttaaggcgggcctcagtggcccagctgacccaggagcttggaacggccttttttcagcaacagcaactgcccgcggccatggcagacacttttctggagcatctgtgcctgttagacattgacagcgagcccgtcgccgctcgctctaccagcataattgccacaatcggaccagcttcacggtctgtcgagcgcctgaaggagatgatcaaggctgggatgaacatcgctagactgaatttctcccacggtagtcatgagtaccacgctgaatcgatagccaatgtgcgtgaagccgtggagtcattcgccggaagtcccctgtcctaccggcccgtggcaatcgcactggatacgaaagggccggagatcagaacgggaatcctacagggcggccctgagtctgaagttgagctggtgaagggatcacaagtcctagtgactgtcgaccctgcattccgaacccgcgggaacgccaacaccgtatgggtcgattatcctaatatcgttcgggtggtccccgtcgggggccgcatatacatagatgatggcttgatatcgctggtggttcagaaaatcgggcctgagggcctggtgacgcaagttgaaaatggcggagtgctcggcagcaggaagggggtaaacctacccggggcacaagtcgatctcccgggtttatcggaacaagacgtccgggaccttcggttcggcgttgagcatggcgttgacatagtgttcgcatccttcgtacgcaaagctagcgacgtcgcagccgtgagagctgccctaggtcctgagggtcatgggataaaaatcatatctaaaatcgaaaaccacgaaggcgtgaagagattcgacgagattctggaagtttccgacggcatcatggtggctaggggagacctcggcattgaaatcccagccgagaaagtattcctggcccaaaagatgatgattggaagatgtaatctcgctggcaaacctgtggtgtgcgcaacccaaatgctcgaaagcatgatcacgaaaccacgccccactcgcgcagaaacgagcgacgtagccaacgccgttctggacggagcggattgtattatgctctctggagagacagctaaagggaatttccccgtggaggcagtgaagatgcagcatgccatagcacgtgaggcagaggctgctgtgtaccatagacagctattcgaagaattgcggcgcgccgcccccctgtcccgtgatcccacagaagtcactgccattggcgctgtcgaggctgcatttaagtgctgtgccgctgctattatagtgctcacaacgaccggccggagcgctcagctgctatccagataccgtcctagggctgctgtcattgctgtgactcggagcgcacaggctgctagacaggtgcacctgtgccgcggggtgttcccattactgtatagagagccccctgaagccatatgggccgatgatgtggaccgcagggttcagtttggcatcgagagtggcaagcttcggggatttctgcgcgtgggcgacctggtaattgtcgtgacaggctggagaccagggagcggatacactaacatcatgcgagtgctcagcatatcttag

SEQ ID NO: 131382 - DNA, 1632 bp, Artificial Sequence
  Description of Artificial Sequence: Synthetic coding sequence
atggagggccctgctggctaccttagaagagccagcgtggctcagctaacgcaggagctaggtacagctttctttcagcagcagcagctaccagcagctatggctgacacatttctggaacacctgtgcctattggatatcgattctgaacccgttgccgcaaggtcgacaagcattatcgcaacgatcggaccagcatctcgatcagtggagcgccttaaagagatgattaaagccggtatgaatatcgcccgcctgaacttttcgcacggctctcacgagtatcacgctgagagtattgctaacgtccgagaggctgtcgaaagcttcgcggggtctcccctgagctacagaccggtcgcgattgcccttgatacaaagggccctgagatccggacaggtatccttcaaggcggtcccgagtctgaggtggagctcgttaaagggagtcaggtgctagtaaccgtcgatccagccttccgtactagaggtaatgctaacacagtgtgggtcgattatccgaacatcgtgcgagtcgtgcccgtgggaggtagaatttacattgacgatggactgatatccttggtggtccagaagattggccccgaagggttagtcacccaggtcgaaaacgggggggtcctgggatcaaggaaaggcgtgaatttgcccggggcccaggtggatctccctggattatccgagcaagatgttcgtgacttgcgttttggggtggagcacggagttgatattgtgttcgcctcctttgtgagaaaagcctccgatgtggcagccgttcgtgctgcattgggtcccgagggccacggtatcaagattatcagcaaaatagagaatcatgagggagtaaagagatttgacgagatcctcgaggtctcagacggtataatggtggcaagaggcgacctgggcattgaaatccccgctgaaaaagtgttcctggcgcagaagatgatgattggacggtgtaacctcgccggcaaacctgtggtttgcgcgacccagatgctcgagtctatgattacaaagccacgaccaaccagagcagaaacaagtgacgttgccaacgccgtgctggacggcgccgactgtatcatgctttctggtgagacggccaaaggaaactttccagtagaggccgtgaagatgcaacacgccatcgcaagggaagcagaggcagcggtgtatcataggcagctgtttgaggagttaaggcgagctgcaccacttagtagagatcctacggaggttacagccatcggcgccgtcgaagccgcatttaaatgttgcgcagccgctattatcgttctaacgacgactggcaggtctgcccagttgctgtcacggtaccgccctcgggcggcagtgatcgccgttacaagaagtgcacaagccgccaggcaagtgcacctgtgtagaggggtgttcccccttttgtacagagagcctcctgaagcgatctgggcggatgacgtggacaggagggtgcagtttgggatcgagtccggaaagttgagaggctttctgcgcgttggggatctggtcatcgttgtcaccggttggagaccaggctcaggctacaccaatataatgcgcgttctttccataagctag

SEQ ID NO: 131383 - DNA, 1800 bp, Artificial Sequence
  Description of Artificial Sequence: Synthetic coding sequence
atgagcatacaagaaaatattagtagcctccagttgaggtcttgggtttcaaaatctcagcgagacctggccaagagcatcctcattggcgcccccggcgttccactgaccactcagcagtgtggcgccgacccccaaaggggaaggccccgagaggtctgctccggaatggagggacctgcgggatacctgagacgtgcttcagtagcccagctcactcaggaattgggtaccgccttttttcaacagcagcaactgcctgccgccatggcagacactttcctggagcatttgtgtctgcttgatattgactccgaaccagtcgcagccagatctacaagtatcatcgccaccatcggaccagccagcaggtcagtggaaagactgaaggaaatgattaaggcaggtatgaacattgccagattgaacttcagccacggatcacacgaataccatgcggagtccattgccaatgtgagagaggccgttgagtcgttcgccggttctccgctgagttaccggccagttgcaattgccttagatactaaagggccagagattcgtactggtattctgcagggcgggcccgagagtgaggtggagctagtgaaaggctctcaggtccttgtgaccgtcgatcccgccttcagaacccgtggtaacgccaacaccgtttgggtagactaccctaacatagtccgggtggtgcccgtgggaggaagaatctacatagatgatggactgattagtcttgtggttcagaagatcgggccagagggactggtgacacaggtggagaacggaggcgtcctcggctcacggaagggcgtgaatctccccggagctcaggtcgacttgccaggactgagcgagcaggatgtgagggatcttcgctttggagtagagcacggggttgacatcgtgttcgcctcctttgtaagaaaagcatccgatgttgctgctgtcagagctgccttggggccggaaggccacggcatcaagatcatttcaaagatcgagaaccatgaaggggtgaagcggttcgatgagatcctggaggtgagtgatggcatcatggtggccaggggtgatctcggaatcgaaatccctgccgaaaaggtgttcctggctcaaaaaatgatgataggcaggtgcaacctggctggaaagcctgtggtctgtgcaacccagatgcttgagtccatgattacaaaaccacggccaactagagcagagacttcggatgtggccaatgctgttctggacggagcagattgtatcatgttatccggcgagacagcaaagggtaactttcccgttgaagccgtaaagatgcagcacgccatcgctcgggaggccgaagctgcggtttatcatagacagctgtttgaggagctgcgacgtgccgcccctctgagccgcgatccgacggaggtaactgcaatcggggcagtcgaagcagccttcaagtgttgcgcagcggctattatcgttcttactactactggcaggtccgcgcagctcctgagtcgctatagacccagggctgctgttatagctgtgactcgctccgcgcaagccgcacgccaggtgcacctttgtaggggggtgtttcctctactctaccgggagcctccggaagccatttgggctgacgatgtggatcgacgtgtgcaatttggcatagaaagcggtaaactacgcgggttcctgagagtgggcgacttagtgatcgtcgtgactggatggagacccgggtctggatacacaaatattatgagggttctcagcataagctag

SEQ ID NO: 131384 - DNA, 1596 bp, Artificial Sequence
  Description of Artificial Sequence: Synthetic coding sequence
atgagtaagcctcacagcgaggcaggaaccgctttcatacagacacagcagctgcacgctgccatggccgatacattcttggagcatatgtgccgattggatatcgattcccctccgattactgcccgtaataccggcattatttgtaccatcgggcctgcatcccggagtgtagagaccctcaaagagatgatcaaaagcggcatgaatgttgcaagacttaacttcagtcacggaactcacgagtatcatgctgagacaattaagaatgttagaactgccacggaatcctttgcatcggacccaatactgtacagacccgtcgccgttgcactggacacgaagggacccgagataagaacaggactgattaagggctctggcacggcagaggtagagctcaaaaaaggcgccaccctcaaaataacacttgataacgcatacatggagaagtgcgatgaaaacatcttatggttagactacaagaacatttgcaaggtcgtggaagttgggtcaaaaatctatgttgatgacgggttgatatcactccaggtcaagcagaagggagccgacttcctcgtgacagaagtggagaacggcgggagcctcgggagcaagaaaggggtgaatctccccggagccgcagtagaccttcctgccgtgtccgagaaggacatacaagaccttaagttcggggtggaacaagacgtggatatggtgttcgcctccttcattcgcaaagctagcgacgttcacgaagtgaggaaagtgctgggagagaaaggtaaaaatataaaaattatatcaaaaatcgaaaatcatgagggcgtgcggagattcgacgaaatactggaggcctccgacgggattatggtagcacgcggcgatctcgggatcgagatcccagccgaaaaagtcttcctggctcaaaaaatgatgatcgggaggtgcaatcgcgctggaaagccagtgatctgcgctacgcagatgcttgagtccatgattaaaaagcctcgccccaccagagccgagggctccgatgtggctaatgccgtgctcgacggcgcagattgtattatgctgtccggggagaccgcaaagggcgattatcccctggaggccgtcaggatgcagcacttgattgcccgtgaagcagaagccgcaatgttccacagaaaactttttgaggagcttgtgcgggcaagctcccattccactgatcttatggaagccatggccatggggtcagtggaggcctcatacaagtgtctcgctgctgctctgattgttttaactgaaagtgggcgtagtgctcaccaagtcgcccggtatagaccccgggctccaatcatcgctgtgactaggaacccccagacggctcgccaggcccatctgtacagaggtatttttccagtgttatgtaaagaccccgtgcaggaagcgtgggcagaggacgtggaccttcgggtcaactttgcaatgaacgtgggaaaggctcgggggttttttaaaaaaggagatgttgtaattgtactgacagggtggcgcccaggctctggttttacaaacaccatgagagtagtgcccgtgccgtag

SEQ ID NO: 131385 - DNA, 1101 bp, Artificial Sequence
  Description of Artificial Sequence: Synthetic coding sequence
atgagtaagcctcactctgaagcaggtacagctttcatccagacccagcaactccacgcagcaatggctgacacgtttcttgagcacatgtgtaggctggatatcgactcacccccgattaaaaagggcgttaatcttccaggagccgctgtcgatttgccggccgtgagtgagaaggacattcaagacctgaaattcggggtggagcaggatgtggatatggtgtttgcctcatttatccgcaaggcttcagatgttcacgaggttagaaaagtgctcggagaaaaaggaaagaatattaaaattatctcaaaaattgagaatcatgaaggcgtaaggaggtttgacgaaatcctggaggcgtcagacggcataatggttgctcgaggcgacctgggtatcgaaattcccgccgaaaaggtgtttctcgcacagaaaatgatgattggcaggtgcaacagagccggaaagcctgtaatctgcgccacccaaatgctagagagtatgattaagaaacccaggcccactcgagcagagggatcagatgttgcaaatgccgtccttgatggagctgactgtatcatgctgtcaggagagacggccaaaggcgattaccccttggaggccgtaaggatgcagcacctcatagctcgagaggcagaggccgcaatgtttcataggaaactgttcgaggagctggtgcgagcctcatcccactccactgatctaatggaagcgatggcgatgggctcggtagaggcttcttacaagtgtctggcggccgctttgatcgtgttgacagagagcggccgaagcgcccaccaggtcgcgagataccggcctcgagctccaattatcgcggttacaagaaatcctcaaactgcacgccaggcgcacttgtataggggtatttttcctgtgctctgcaaggaccctgtgcaagaggcctgggctgaggatgttgatctgcgggtgaattttgctatgaatgtgggcaaagctcggggctttttcaagaagggcgatgttgtcattgtgctgaccggctggagacccggatcaggattcactaatacgatgagggtagtgccagtgccctag

SEQ ID NO: 131386 - DNA, 1596 bp, Artificial Sequence
  Description of Artificial Sequence: Synthetic coding sequence
atgtcaaagccacattcagaagccggcactgccttcatccagacccagcagctccatgccgccatggccgatacattcctggaacatatgtgcaggcttgatatcgactcacctcctattacagcccggaacaccgggatcatttgtaccatagggcccgcctctcgctcagtggagacactgaaggagatgatcaaatccggtatgaacgtggccagactgaacttttctcacgggacccacgagtaccatgcggaaacgattaagaatgtgcgcactgcaaccgagtcctttgcctcggacccaattctctacaggccagtggccgtggctctcgacaccaagggacccgagataaggacaggattgataaagggaagtggaactgccgaggtcgagctgaaaaaaggggcaacgttgaagattacattggataacgcttatatggaaaagtgcgacgagaacatcctgtggctggattacaagaatatctgtaaagtggtggaagtgggaagcaaaatctacgtagacgatggtctgatcagtctgcaggtaaagcagaagggggccgattttctggtcacagaagtcgaaaatgggggatccttaggttcaaaaaagggcgttaaccttccaggggcagctgtggacctccctgccgtgtctgaaaaagacatccaagatcttaaatttggcgttgagcaggacgtggacatggtttttgcctccttcatcagaaaggcttctgatgtgcatgaagtgcgaaaagtgctgggggagaagggaaaaaacattaaaattatctccaagatcgagaaccacgagggtgttcgacgatttgacgaaatcctggaagccagcgacgggattatggtcgcccgaggggacctcgggatcgaaattcctgccgagaaagtctttctggcccagaagatgatgatcggtagatgtaacagggctggtaagcctgtgatttgtgcaactcagatgctggaatccatgatcaaaaaaccaagaccgactcgtgccgaaggaagcgatgttgccaatgccgttctggacggcgcggactgcatcatgctctcaggtgaaacagctaaaggcgactacccgctggaagccgtgcggatgcagcacctaattgctagagaagccgaggccgcgatttatcatttgcagctgttcgaagaattaaggcgcttggccccaatcacttctgatcctactgaagctactgctgttggagctgtcgaagcttcctttaagtgttgctctggagcaatcatcgtactgaccaaaagtggacgctcagcccaccaggttgcaaggtatcgccccagagcgcctatcattgctgttacacgaaatccccagacagcgcgccaggctcacctatatagggggattttccctgtactgtgtaaggatcccgtgcaggaagcctgggcagaggatgtcgatctgcgcgtgaatttcgccatgaacgtgggtaaagccaggggcttcttcaagaaaggcgatgtcgtcatcgttctgacaggttggcgtccaggttccggttttacaaacactatgagggttgtacctgtcccatag

SEQ ID NO: 131387 - DNA, 1596 bp, Artificial Sequence
  Description of Artificial Sequence: Synthetic coding sequence
atgtcaaaaccccattccgaggccggcaccgccttcatacagactcaacaattgcacgcagccatggcggacaccttcctagagcacatgtgtcggctggatatcgactcaccaccaatcacagctcggaacaccggaattatttgcaccatcggtcccgctagcagaagcgtggaaactctgaaagagatgatcaaatcgggaatgaatgtcgctcggttgaatttcagccatggcactcatgagtatcacgcagaaaccatcaagaacgttcgtacagctaccgaaagcttcgcctccgaccccatcttatatcgaccggtggccgtggcacttgacacaaaggggccagagatcaggaccgggctgatcaagggatcaggcaccgccgaagtcgaacttaaaaagggtgcgacactcaaaataaccctcgacaacgcatacatggaaaagtgcgacgagaacatcctgtggctggactacaaaaatatctgtaaagtggtggaagtgggctccaagatctacgtggacgatgggctgatcagtctgcaggtgaaacagaagggagctgattttctggttaccgaggtggaaaatggcggctcactgggctccaaaaaaggtgtgaatcttccaggagccgctgtcgatctccctgcggtaagtgagaaggacattcaggaccttaagttcggggtagagcaggatgttgacatggtgtttgcatcttttattcgtaaggcaagtgacgtacacgaggtgaggaaagtgttgggcgaaaaggggaagaacatcaagattattagtaaaattgaaaatcatgagggtgttaggcgctttgacgaaattctggaagcatctgacggaattatggtggctcgaggagacctgggcatcgagatccctgcagaaaaggtattcctggcgcaaaagatgatgattggacgatgcaacagggcaggcaagcctgtgatttgcgctacacagatgctcgaaagcatgatcaaaaaacccagacctacgagagcagaaggttccgacgtggcaaatgccgtgcttgatggagccgactgcattatgttgtcaggagagaccgctaaaggggactatcctttggaagccgtaagaatgcaacacctcattgctagggaagctgaggcagcaatgtttcacaggaagcttttcgaagagttagtgagggcttctagtcatagcacggacctcatggaggctatggccatgggcagtgttgaggcttcatacaagtgcctcgccgctgctctgattgtgctaactgagtccggccggagcgcccaccaagtcgctcgataccggccgagggcccccattattgccgtcacccgcaaccctcaaaccgcccgccaggcacacctgtataggggcatcttccccgtcctctgtaaagatcccgtgcaggaagcatgggcagaggacgtggacctgcgtgtcaacttcgcgatgaacgtgggcaaggccagaggctttttcaaaaaaggggacgtcgtgatcgtcctgaccggctggagaccgggatctgggttcacaaatactatgagagtagtcccagtgccttag

SEQ ID NO: 131388 - DNA, 1377 bp, Artificial Sequence
  Description of Artificial Sequence: Synthetic coding sequence
atgagcaagccccacagcgaggctggcaccgccttcattcagacacagcaattgcatgccgccatggctgacacatttctggaacacatgtgtcgcctggatatcgacagccctccgatcactgcccggaatactgggataatctgtactatcgggcccgctagcagatcagaggttgaactgaagaagggagccacgctgaagatcactctcgacaacgcctatatggaaaagtgtgatgaaaacatcttatggcttgactataagaacatctgcaaagttgtcgaggtgggcagcaaaatttacgttgatgacggtctaatttctctccaggttaaacaaaaaggagctgacttcctggtgacagaagtggaaaacggcggaagtctcgggagcaagaagggagtgaatctccccggtgcggccgtggatctgcccgctgtgtctgaaaaagacatccaagatctgaaattcggagtcgaacaggacgtagacatggtcttcgctagttttatcaggaaggctagtgatgtgcatgaggtgcgaaaggtgctaggagagaaaggcaagaatattaaaatcattagtaagattgaaaaccacgagggcgttcggagattcgatgaaatcctcgaagcctccgatggtatcatggtggctagaggcgatttggggatcgagatcccagcagagaaggtcttcctcgcacagaagatgatgatcggccggtgcaaccgggccgggaaacctgtaatatgcgcaacccagatgttagagagcatgataaaaaaacccaggcccacccgcgccgaagggagcgacgttgccaatgctgtcttggacggcgctgattgtatcatgctcagcggcgagaccgcgaagggcgattacccgttagaagcagtcagaatgcagcacttgatagcacgcgaggccgaggccgctatttatcatctgcagttattcgaggaattgaggaggctcgccccaattacctcagatccaaccgaagccacggctgttggagcagtggaggcatcatttaagtgttgctccggcgctattattgtgttgacaaaatcgggccgctcagctcaccaggtcgcaaggtaccgcccccgagcaccaatcatcgcagtgacacgcaacccccagactgcacggcaggcccacctctacagagggattttccctgtcctttgtaaggaccctgtgcaggaggcctgggctgaagatgtcgatctgagggtcaacttcgctatgaatgtgggaaaggccagaggcttctttaaaaaaggggacgtcgtcatagtgcttaccggctggcggccaggaagcggattcactaataccatgcgggttgtcccagttccttag

SEQ ID NO: 131389 - DNA, 1551 bp, Artificial Sequence
  Description of Artificial Sequence: Synthetic coding sequence
atgagcccagaagcacaaccacaacgcacaaagggcccccagcagccgtgccggagcccaatcgtgaagcccggcctgccttcgtttagaccatcatcttgcacccagccctggctaacacacagctggtccacttgcgccgcctggacacttatccaccacccatcccagccaggcaccttggcctcttccgtgcctctgtatcatgctgagacaattaagaatgtccggactgctacggagagcttcgcatctgatccgattctatacagacctgttgctgtcgcactggatacgaagggtcccgagatcagaaccggtctgataaagggatctggcactgctgaggttgaactgaaaaagggtgcaacgcttaagatcacgcttgataatgcatacatggagaagtgtgatgagaatatactatggctggattataagaacatttgtaaggtcgtggaggtcggctccaaaatttatgtggacgatggacttatttcccttcaggtcaagcagaagggagccgattttttagtgaccgaggtggagaacggagggagtctaggcagcaaaaagggtgtgaacctacccggcgccgccgtcgatctgccagccgtcagcgagaaggacatccaggacctgaagttcggtgtagagcaggatgtggacatggtttttgcctccttcattcgtaaggcttcagatgtgcacgaagtgcgcaaggtactgggcgaaaagggcaagaatattaagatcatttccaaaattgaaaaccatgagggagtgcggagattcgatgagatcctggaggcctcagatgggattatggtggccaggggagatctaggcatcgagataccagcagaaaaggttttcttggctcaaaaaatgatgattggacggtgtaacagggcaggaaaacctgtgatatgcgcaacccagatgttggagtcgatgattaagaaacccaggccaaccagagctgaaggctctgatgttgccaatgccgtgttggacggggcggactgcattatgctgtccggcgaaaccgccaagggtgactaccccctggaagccgtgcgcatgcagcatttgatcgccagagaggccgaagcagctatctaccatctgcaactcttcgaggagctcaggcgtcttgcacctataacttccgatcctacagaagcaacagctgtgggcgcggtagaagcttcattcaagtgctgcagcggcgcaatcatcgtgctaacaaagtccggacggagcgcccatcaggttgcgaggtaccgtcctagggcgccgataattgcggttacccggaaccctcaaacggcccgccaggctcacctataccgaggcatctttccagtgctctgtaaggatcctgtgcaagaggcctgggccgaggatgtagacctgcgagtgaacttcgcgatgaacgtgggcaaagctcgaggattcttcaagaagggcgatgtggttatcgtactgaccggatggcgccccgggagtggattcaccaacacgatgcgggtggtcccagtaccttag

SEQ ID NO: 131390 - DNA, 1212 bp, Artificial Sequence
  Description of Artificial Sequence: Synthetic coding sequence
atggctggagccgccacccaggccagcctggagagcgctcctaggattatgcgattagttgcagaatgttcaaggtctcgagctcgggccggcgagctgtggctccctcatgggaccgtagctacaccagtgtttatgccagtcggcacccaggcaacgatgaagggcattacaacagaacaattggacgccttagggtgccggatttgtttgggaaacacgtatcatctgggtctcaggccaggaccagaattaattcagaaggcaaacggactgcacggttttatgaattggcctcacaacttgctgaccgatagcgggggatttcaaatggtgtcgctcgttagcctttccgaggtcacagaggaaggggtgaggtttcgctctccttacgatggcaatgaaaccctcctcagccccgaaaagagtgtccagatccagaacgctctaggttccgacataataatgcagttagacgatgtggtgtcttctaccgtcacaggtccccgtgttgaggaggcgatgtaccgcagtatcagatggctcgacagatgcatagcagcccaccagagacctgataaacagaacctgtttgccatcatccagggcgggctcgacgccgaccttcgtgccacctgtctcgaggagatgactaagagagacgttcccggatttgccatcggaggtttgtctggtggagagtctaaatcccagttttggcgcatggtggctctgagtacaagccgtctccccaaggataaaccacggtacctgatgggcgtaggatacgcaacagatttagtggtgtgcgtggccctggggtgcgacatgtttgactgcgttttccctacgcgcaccgcacgctttggaagcgccttggtacccactggcaacctgcagcttaggaagaaagttttcgagaaagacttcggccccatcgatcctgaatgtacatgccccacatgccagaaacacagtcgcgcctttttgcacgcactactgcactctgacaacaccgccgccctgcaccatctcacagtgcacaatatcgcctatcagctgcaattgatgtctgcagtcagaacatccattgtggaaaaaagattccccgactttgttcgagacttcatgggcgccatgtatggcgaccccactttgtgcccaacttgggcaacggatgccttggcttctgtgggcatcactttgggctag

SEQ ID NO: 131391 - DNA, 678 bp, Artificial Sequence
  Description of Artificial Sequence: Synthetic coding sequence
atggccggtgcagctacacaggctagtctggagtctgctccacgcattatgagactggtcgctgaatgttccaggtcccgtgcacgtgctggcgagctatggcttcctcatggaacagtcgcgaccccggtatttatgcctgttggcactcaggccacgatgaagggaattaccacagagcaactagacgccttaggctgcaggatttgtctgggcaacacttatcatctcgggctccggccagggccagaactgatacagaaagcaaatggccttcacgggttcatgaattggccccacaatttgctgaccgacagcggaggctttcagatggtcagccttgtttcccttagcgaggtcaccgaagaaggagtgaggttccggtccccatacgacggaaatgaaacccttctgtcccctgagaaatccgtgcagatccagaacgcattgggatctgacatcattatgcagcttgacgacgtggtgtcctcaacagttaccggaccaagggtcgaagaggccatgtatagaccactcggtctggttacaggtgcgctcctgcaggttaacccactggccggccccgtgcactgctcgccgtccgcagccggacaggccgaacctctgcgacattatccgggatgggccggccgccgatcgccggggcatcttccctag

SEQ ID NO: 131392 - DNA, 2097 bp, Artificial Sequence
  Description of Artificial Sequence: Synthetic coding sequence
atggccgccgctggggccgctgtggcgcgtagccccggcattggagctggtcccgctctgagagcccggcggagcccgcccccgcgggccgcaagactaccaaggttattggtgctgctggccgccgctgcagtgggcccaggcgcagggggtgccgctaggctgtacagggcaggcgaagatgcagtctgggtgctcgactccgggagcgtccgtggtgctactgccaattcatccgcagcctggctggtccaattttattcatcatggtgtggccattgtatcggctacgcacctacctggagagcgctggcaggggacgttagagactgggccagcgcaatcagggtcgccgcgctagattgcatggaggaaaaaaaccaagctgtctgccacgactatgacatccatttctacccaacgttcaggtattttaaggccttcaccaaagaatttacaaccggcgaaaatttcaaggggccagaccgggagctccgtactgtaaggcagactatgatcgatttcttgcagaatcatacggaaggatcccgtcctccggcatgcccaaggctggatccaatccaaccttccgacgtactgtctcttctcgacaataggggatcccactacgttgcaatagtgtttgagagtaactctagttatctcggcagggaagtcatcctggatctcattccttatgagagcatagttgtgacccgtgccctcgacggcgacaaggcattcctggagaagctgggggtgtctagtgttccatcatgctacttaatttatccaaatggctcccacggactgataaacgtggtgaaacccttgcgcgcattcttttcctcctacttgaagagtctgcccgacgtcagaaaaaaatcattacctttgccagagaaaccacacaaggaagagaacagtgaaatcgtggtttggcgggaattcgacaagagcaagctgtacaccgttgacctcgagtctggtctgcactaccttttgagagtggaattggcagcacacaaatcactcgcgggggccgagctgaagactctcaaggactttgtgaccgttctcgccaagttgtttcccggaaggcctcccgtgaaaaaactgctcgagatgctgcaggagtggctcgcatcactgcccctcgaccggatcccctacaatgccgtgctcgacctagtaaacaacaaaatgagaatatcaggtatttttctgaccaatcacataaagtgggtgggctgtcagggcagcaggtccgagttacgcggatacccttgctctctgtggaaactgttccacacgcttaccgtcgaggcctcgacccacccagacgcactggtgggaactggttttgaagatgatccccaggcagtattacagaccatgcgccgctatgtccacacgtttttcggatgtaaagagtgtggagaacacttcgaggagatggctaaagagtcgatggactcagtgaagacaccagaccaagctatcctgtggctgtggaagaaacacaatatggtgaatgggcggttagccggacacctgagcgaagacccgcgatttcccaagctgcagtggccaactcccgatctgtgcccagcctgtcacgaagaaattaaagggctggcctcttgggatgaagggcatgtcctgacattcttgaaacagcactacgggcgcgataacctccttgacacatacagtgcagatcaaggagacagctctgagggaggtacgctggcccgcggagaggaggaagagaagcggctgacgcctcccgaggtttcccatggggaccgcgacactcagagtgtgaggccaccgggcgcattggggccccgcccagcactgcccgagtcccttcaccacagcttagatggaaagctgcagtctctggacggcccaggagcacataaggaggtcggtggagcggcaccattcctgggagtagatttctcaagcctcgatatgagtctgtgtgtggtcctgtatgtggccagttctttattcttgatggtcatgtatttctttttcagagtacggtctcgtagatggaaggtgaaacatcatcacccagctgtgtag

SEQ ID NO: 131393 - DNA, 948 bp, Artificial Sequence
  Description of Artificial Sequence: Synthetic coding sequence
atggaagaaaagaatcaagcagtgtgtcacgattatgatatccatttttatcctacattccgctattttaaagcatttaccaaagaatttacaactggcgagaattttaaggggcccgacagggagctgcggactgtgagacagacaatgattgatttcttgcaaaaccacactgaggggagtcgacctcccgcatgcccaagactggatcccattcatgtgaaacccctgagggcttttttttcaagctacctcaaatcgcttccagacgtgcgcaagaagagcctcccccttcccgagaaaccccacaaggaagaaaattcagaaatcgtggtctggagagaattcgataaatctaaactttacacagtagacctcgagagcggattgcattacctgctgcgagtagaactcgcggcacataaatctctggccggagctgaattaaaaactcttaaagattttgttaccgtccttgccaaactgtttccagggcgcccccccgttaagaaattgctcgagatgttacaggaatggctggccagcctgcccttggaccgcattccttataatgccgttctggatctggtgaacaacaagatgcggataagtgggatattccttaccaatcatataaagtgggtgggttgtcaaggatctcgatctgaactgcgaggatatccctgttcactctggaaattattccacactttaaccgtggaagcctctacacaccctgacgcactggtcggtaccggattcgaggacgacccccaggcagtgctgcagacaatgaggagatatgttcacactttcttcggatgcaaagagtgtggcgagcactttgaagaaatggcgaaggaatctatggatagcgtcaagacacctgatcaggcgatcctgtggctgtggaagaagcacaacatggtgaatggaagacttgcttag

SEQ ID NO: 131394 - DNA, 735 bp, Artificial Sequence
  Description of Artificial Sequence: Synthetic coding sequence
atggccgccgcagccgcagccggcgaggctcgaagggtactggtgtacggcgggcgcggtgccctgggctccagatgtgtgcaggcatttcgtgcccgcaattggtgggttgcctctgttgatgtggttgagaatgaagaagccagcgctagtatcatagtgaagatgaccgactcattcacagaacaggcagatcaggttaccgctgaagttggcaagctgctgggcgaggaaaaagtagatgcaattttatgcgtagccggcggatgggcgggcggcaacgccaaaagcaaatctttgttcaaaaactgtgatcttatgtggaagcagtcgatttggacgagcaccatcagctcccatctggctacaaaacatctgaaggagggaggactgcttactctggcgggagcaaaggccgccctggacggaacaccgggaatgatagggtacggtatggcaaagggtgctgtacaccagttgtgtcaatctctggctggtaagaactctggaatgccacccggggccgccgccatagccgtgctgcccgtgactctggatacaccaatgaaccgaaaatcaatgcctgaggcagactttagctcctggacacctttggaattcttggtggagactttccacgattggatcactggaaagaaccgaccttctagtggcagtttgatccaggttgtgaccaccgaggggaggacagagttgacaccggcatacttttag

SEQ ID NO: 131395 - DNA, 681 bp, Artificial Sequence
  Description of Artificial Sequence: Synthetic coding sequence
atggccgctccactgcttcatacccgactcccaggagacgctgccgctagcccttcagccgtgaaaatgctgggagcctctcgcactgggatttctaacatgcgagctctcgagaatgactttttcaattcgcctccaaggaagactgtgcagtttgggggcaccgtgacagaggtgctcttgaaatataagaccggcgaaactaacgatttcgaacttctgaaaaaccaattgctggacccggacatcaaagacgatcagatcatcaattggctgctggaattccgtagctccatcatgtatctcacgaaagatttcgagcaattgatttccatcattcttcgtctgccttggttaaataggtcccagactgtagtggaggagtatttagcatttctgggaaatctggtgtcagcccagacagtgtttctcagaccatgcttgagcatgattgctagccacttcgtaccccccagagtaattattaaggagggggacgtcgacgtcagcgatagcgacgatgaagacgataacttgccggccaactttgacacctcacagtctctcgccaataatagcaagatttgtacaattgacaccgtggtctctcacgctaatacaggtggaaaaatctccatctgttccaagatccgggaaaatacagggatgttgcgatcttag

SEQ ID NO: 131396 - DNA, 894 bp, Artificial Sequence
  Description of Artificial Sequence: Synthetic coding sequence
atggatgcagagggcctggctttgttattacccccagtgacattggccgcccttgttgattcttggctcagagaagattgtcccggtctcaactatgctgccctggtgagcggtgcaggaccgagtcaggcagcactgtgggctaagtcaccaggtgtcctggcaggacagccattcttcgacgccatctttacacagctgaactgtcaagtctcatggtttttaccagaagggtcaaagctggtgcctgtcgctagagtggctgaggttcggggacccgcgcactgtctcttgcttggggagcgggtggcactgaataccctagcccgctgctcagggatcgcatccgcagcggctgctgcagtggaggccgctcgtggcgccgggtggactggccacgtcgcaggcaccaggaaaaccacacccggttttcggctggtcgaaaagtatggactgcttgtgggcggcgctgctagccaccggtatgacctggggggtctggtgatggtgaaagataatcatgtagtcgcagcaggtggcgtggagaaagcagtcagagccgctaggcaggctgccgattttaccctgaaagttgaggtggagtgcagctccctgcaggaagccgtgcaggcggccgaggctggcgccgatctggtcctgctcgataactttaaacctgaagaactgcatccaaccgctactgtgttgaaagctcaatttcccagcgtcgctgttgaagcatccggaggaattactctcgacaatctgccacagttttgtggaccacacattgacgttatttctatgggtatgctgacacaggcggccccagcgctggatttttccctgaagctcttcgcgaaggaagtagcccccgtccccaagatccactag

SEQ ID NO: 131397 - DNA, 498 bp, Artificial Sequence
  Description of Artificial Sequence: Synthetic coding sequence
atggacgctgagggcctggcccttctcctgccccccgttacactggccgcactggtggatagttggctaagggaagactgccccgggctgaactatgcggccctagtgagcggtgcgggcccgagtcaggccgcgttatgggctaagagccccggcgtcctggctggtcaaccattcttcgacgccatttttacacaactcaattgtcaggtgagctggtttctccctgaggggtcgaagttggtgcccgtagcccgcgtggctgaagtgcgaggccctgctcactgtctcttgctgggggagcgcgtggcactgaatactctggctcggtgctctggtatcgcctccgcagctgccgccgctgtcgaggccgcacggggcgccggctggaccggtcatgtagctggtacccgcaagactacacctgggtttagacttgtagagaaatatgggttactcgtgggtggagccgccagtcacagatatgacctcggatag

SEQ ID NO: 131398 - DNA, 2154 bp, Artificial Sequence
  Description of Artificial Sequence: Synthetic coding sequence
atggcagttgcggttcgtacactccaggagcagctggagaaagctaaagaatccctgaaaaatgtggacgaaaacatccgaaagttaactggtcgcgaccccaacgacgtaagacccatccaggcgcggttattggccctttccggcccaggaggcggaaggggacgaggtagcttattgctccgcagggggttctccgattcaggaggaggaccccccgctaaacagagagacctcgaaggcgcggtgagcaggctgggcggggagaggcggactcggcgcgagtcacggcaggaatctgatcctgaggacgacgatgtaaaaaaacctgccctgcaatctagtgtggtggcaacatctaaggagcgtacaaggagggatctgatccaggatcagaacatggacgagaagggaaagcagagaaatagaagaatttttggattattaatgggaactctccaaaagttcaagcaggaaagcacagtggcaaccgagcgtcagaaaaggcgacaagaaattgagcagaagctggaagtccaggccgaggaggagcggaagcaagttgagaacgagcgccgtgaactgtttgaggaaagaagggccaaacagaccgagctgaggctgttggaacagaaagttgagctggcccagttacaggaggaatggaacgagcataatgccaagataatcaaatacatccgtacgaaaactaaacctcacctcttttacatacccggaagaatgtgccctgctacacagaagctgattgaggaatcccagagaaagatgaacgctcttttcgaggggaggagaatagaattcgctgagcagatcaacaaaatggaggcaaggcccaggaggcagtcaatgaaggagaaagagcaccaagtggttaggaatgaggaacagaaggctgaacaggaggagggaaaggttgcacagcgggaggaggagctggaggaaaccgggaaccagcacaacgatgtagagatcgaggaggcaggggaagaggaggagaaagagattgcaatcgttcacagtgatgcagagaaagaacaagaggaggaggaacagaaacaagagatggaggttaagatggaagaggagaccgaggtgcgggagagcgaaaagcaacaggattcgcagccggaagaggtgatggatgtgctcgaaatggtggagaacgtgaaacacgtgattgcggatcaggaggtaatggagactaaccgggttgagtctgtcgaaccctctgagaacgaagctagtaaagagcttgagcccgaaatggaattcgaaatcgagcctgataaagaatgcaaaacattgagcccaggcaaagagaatgtgtccgctttagacatggagaaagagtcagaagagaaagaagagaaggagtctgagccccagccagagcctgtcgctcagcctcagccccagtctcaaccacagttacagctgcagagtcagtcacagcctgtgctgcagtcccagccaccatcgcagcctgaggatttgtcccttgctgtcttacagcccaccccccaggtgactcaggaacaggggcacctcttgccagagaggaaggattttcccgttgaatcggttaagctaactgaggtgcctgtggaacctgtattaacagtacatcccgaatccaagtccaaaaccaaaactaggtcacgtagcagaggcagggcacggaataaaacctcaaagagtagaagtaggtccagttcctcctcctcgagcagctcaagtagtacgagcagcagcagcggaagttctagctccagtggatcatcctcaagccggagttcatcttcgagctcttcttctacatctggcagtagcagccgtgacagcagttcgagcacctctagctcctccgaatctcggtcacggtctagaggaagaggccacaacagagaccggaagcacagaagatcagtggacagaaagaggcgagatacttcgggcttggagcggagtcacaaatctagcaaaggtggctcatcccgagatacaaaagggtcaaaggataagaacagccggagcgatagaaaacgatctatctccgaatccagtcggagcggtaagcgatcatccagaagcgagcgcgatcgcaagtcagacaggaaggataagcgcaggtag

SEQ ID NO: 131399 - DNA, 1704 bp, Artificial Sequence
  Description of Artificial Sequence: Synthetic coding sequence
atgcatggccggctgaaggttaagacgtcagaggagcaagcggaggcaaagcgcctggagcgggagcagaaattgaagctctatcagagtgcgacccaagcagtattccagaaaaggcaggctggggagctagacgagagtgtcttagagctgacatctcagattctgggcgccaatcccgacttcgccactctatggaattgccggcgtgaagtgctgcagcaactagagacccaaaagagccccgaagagctcgcagcactcgtgaaggcggaactcggcttcttagagtcttgtctcagggtcaacccaaaatcctacggcacatggcaccaccggtgctggcttctgggtaggctgcctgaacccaactggactagggaactggaactgtgtgctcggttccttgaggtggacgaaaggaactttcattgttgggattatagacgattcgtcgcaacccaggcagcagttcccccggctgaagagttggcgttcaccgattccctaattacacggaattttagcaattattcatcctggcattacaggagttgcctgctcccccagttgcatccccagccagattctggtcctcagggaagactgccggaggacgtcctcttgaaagagctcgagctcgtgcagaatgccttcttcaccgatcctaacgaccagagcgcttggttctatcatcgctggctgcttggtcgggccgacccacaggacgctctcagatgcttacacgtgtctcgggatgaagcctgtctcacggtgtccttctctcgccccctgttggtcgggtcgcgtatggaaatactgctactgatggtagacgatagccctctgattgtggagtggcggacaccggacggtcggaatcgaccgtcccatgtgtggttgtgcgacctcccagctgcatccctgaacgaccaactgccacagcatacctttagggttatctggacggccggagatgtccagaaggagtgcgttcttctcaagggccgtcaggagggctggtgccgtgacagtacaactgacgagcagctgtttagatgtgagctttcggtagaaaaatccaccgttttacagtcagagcttgagagctgtaaggagctgcaggagttagagcctgagaacaagtggtgcctcttgacgataatattgctcatgcgagccctggaccccctcctgtatgagaaagaaacactgcagtacttccaaacactgaaggcagtcgacccaatgagggccacttacctggacgacctgcggagtaaatttctcttggagaattccgtgctgaaaatggaatatgcggaggtccgggttctccaccttgcccataaagacctgactgtcctatgccacttagagcagttgctgctggtcacccatcttgacctgtcacacaacaggctgaggacactgccccccgccctcgcagcattgcgctgcctggaggtgttacaggcgagcgataatgcaattgaatctctggacggagtgacaaatctgccaagactgcaggagttactgctctgcaacaatcgcctacaacagcccgccgtcctgcaaccgctggctagctgcccaaggctagtgttactgaaccttcagggaaaccctttgtgccaggctgtgggtatcttggaacagttagctgaactactgccctctgtgtcctctgtgcttacatag

SEQ ID NO: 131400 - DNA, 996 bp, Artificial Sequence
  Description of Artificial Sequence: Synthetic coding sequence
atgggtactccgcaaaaagacgtgattattaagagcgacgcccctgacaccttgctgttggagaagcacgctgactacatagcctcttatggctcgaagaaggacgattatgaatactgtatgtcagaatacctaaggatgtcaggcatttactggggcctgactgtcatggatcttatggggcagctacatcggatgaatcgcgaagaaatattagcatttatcaaaagctgccagcacgagtgtggtggcattagtgccagcatagggcacgaccctcatctgctgtacacattgtcagctgtccagattctgactctttacgacagtattaatgtgattgatgtgaacaaggtggtagaatatgtgaagggtctccagaaagaagacggctcatttgccggagacatctggggagagatcgataccagattctccttctgcgcagttgccacccttgcactgctcgggaaattggacgccataaatgttgagaaagctatcgagtttgtgctaagctgcatgaacttcgacggcggctttggatgtcggcctggaagcgagtcacatgccggacagatatattgctgtaccgggttcctcgctatcactagccagcttcaccaagtgaactcagacctgctgggctggtggctgtgcgaacgccagcttcccagcggcgggttaaacggccggcccgagaaactccctgacgtctgctacagttggtgggtactcgcatcacttaagatcattggcagactgcactggattgaccgtgagaaactgaggaatttcattctcgcctgccaagatgaggaaaccggtggtttcgccgaccggcccggtgatatggtcgaccccttccacaccctgttcggcatcgcaggtctgtccctcttaggcgaagaacaaatcaaacccgtaaaccccgtcttctgcatgccggaagaggtcctgcagagagtgaacgtgcaacctgagttagtctcttag

SEQ ID NO: 131401 - DNA, 963 bp, Artificial Sequence
  Description of Artificial Sequence: Synthetic coding sequence
atgggtaccccgcaaaaggatgtgattattaaaagcgatgcgcctgatacactgctcctcgaaaagcatgctgattacatcgcttcttacggctctaagaaggatgattacgagtattgcatgagcgagtatttgaggatgagcggtatttattggggtctgacggtgatggatttgatgggccagctccatcgtatgaacagagaggagatcctggcgttcataaagagctgtcagcacgaatgcggaggaattagcgcttctataggacacgatcctcaccttctctatactctgtccgcagtgcagatactcactctttacgactccattaacgtaattgatgtgaacaaagtggtagagtacgtgaagggtctccagaaagaagacggatcctttgcaggtgatatatggggcgaaatagacacaaggttctccttttgtgctgtcgcaaccctagctctattgggcaagctggatgccatcaatgtcgagaaggctattgaatttgtactgagttgtatgaactttgacggcggcttcggctgcagacccggatccgaatcccacgccggtcagatctattgttgcaccggattcttggcgatcaccagccagctgcaccaggtaaatagtgatctactgggatggtggttatgcgaaagacagctcccctctggcggcctgaatggacgacccgaaaagctgccagacgtgtgttattcctggtgggtgctcgcatctctgaaaattatcggccgactgcattggatagaccgcgagaagctcaggaatttcatcctggcatgtcaggatgaagaaacgggagggtttgcggatcgtcccggcgatatgcactttatctaccagaactatcccaagaaggaattgtccagcaacaaggagaccctgacagaatcgctactacctagattggaacgcagttccacaatatctgcctag

SEQ ID NO: 131402 - DNA, 459 bp, Artificial Sequence
  Description of Artificial Sequence: Synthetic coding sequence
atgggtactccacaaaaagatgtgattatcaagtctgacgcacccgatactttgcttctcgagaagcacgccgactacatagccagctacgggagtaaaaaagacgattacgaatattgtatgtccgaatacttacggatgagcggaatttattgggggttaactgtcatggatctaatggggcaacttcatcgcatgaaccgcgaggagatacttgcattcattaaatcttgtcagcatgagtgcggtggaattagtgcgtcaataggtcatgatccccacctcctgtacaccctatccgcagttcagatccttacgctgtatgacagcattaacgtcatcgatgtgaataaagtggttgaatatgtgaaaggcttacagaaagaagatggcagcttcgccggggacatttggggcaacgtgagattctctcctttctatcccaaataccaatattag

SEQ ID NO: 131403 - DNA, 474 bp, Artificial Sequence
  Description of Artificial Sequence: Synthetic coding sequence
atgaacttcgacggaggcttcggatgcagaccgggttccgaaagccatgctgggcagatctattgctgcactggcttcctagccattacttcacaactgcaccaggtgaactctgatctactaggatggtggctttgcgagcgacagctgccatccggcgggcttaacgggcgtccagagaagctgcccgatgtgtgctattcctggtgggtgctggctagcctcaaaatcatcggcagactgcactggatcgatcgagagaagctgcgcaacttcatcctggcatgccaggatgaggagaccggcgggtttgccgaccggccgggagatatggtagatcctttccacacactgtttgggatcgctggcctgagcctcttgggagaagagcaaattaaacctgtgaaccctgtgttctgcatgcctgaagaggtgttgcagagagtaaatgtccagcccgaactggtgagttag

SEQ ID NO: 131404 - DNA, 1476 bp, Artificial Sequence
  Description of Artificial Sequence: Synthetic coding sequence
atgtctctgaaaagcgagaggagaggtatacacgtcgatcagtccgacttgctgtgtaagaaagggtgcggctattacggcaatcccgcttggcaggggttttgctcgaagtgctggcgcgaggaatatcacaaggcaaggcagaagcagatccaagaagactgggagttggcggagagactccaaagagaagaggaagaagcttttgcctctagccagtcatcccagggggcccagtccctgacctttagcaaattcgaggagaagaagactaatgagaaaacaagaaaggtgacaaccgtcaaaaaatttttttcggcatcatcacgcgttggctccaagaaggaaatccaggaggccaaagccccgtcaccgagtatcaatcgccagaccagtattgagactgacagagttagcaaggaatttatcgaattcctgaagacattccacaagaccgggcaagagatttacaaacagacaaagttgttcctggaaggcatgcattacaagcgcgatctgagcatcgaggaacagagcgagtgtgcacaagatttttatcacaacgttgcagaaagaatgcagacacgcgggaaagtaccacctgagagagttgagaagatcatggatcagatcgaaaagtacatcatgactcggctatataaatacgtgttctgtccagagacgaccgatgacgaaaaaaaagaccttgccattcagaagaggattcgcgccctgaggtgggtcacgccccaaatgctctgcgtgcctgtgaacgaagacatccccgaggtttcggacatggtggtgaaagccatcaccgatattattgagatggacagcaagagggtgcctagagataaactggcttgcatcactaagtgttccaaacacatctttaacgcaatcaagataaccaagaatgagcctgcgtcggcagatgactttctgccaacactgatctatatcgtactgaaggggaaccctccccggctgcaaagtaacattcaatacattacccggttttgtaatccatcccgactcatgaccggcgaagacggttactattttacaaatctgtgctgcgccgtggcgtttatcgagaagctggacgcgcagagcctaaacctctcacaggaggattttgacagatatatgtccggacagacctcccctagaaagcaggaggctgaaagctggagcccagacgcctgtctgggcgtgaagcagatgtacaagaatctggacttactgagccagctgaacgagcggcaggagaggatcatgaatgaagcaaagaaactagagaaagacctgattgattggaccgatgggattgccagggaagtgcaggacattgtggaaaagtatcctcttgaaataaaacccccaaatcagcctctcgcggccatagactctgagaatgtggagaacgacaaactaccccccccccttcagccccaggtctacgcaggctag

SEQ ID NO: 131405 - DNA, 1518 bp, Artificial Sequence
  Description of Artificial Sequence: Synthetic coding sequence
atgatggcctcctcctaccacgaagtggtgagcagaaaaaaaatgtcactgaagtccgagaggaggggtatccacgttgatcagtctgacctcctgtgtaagaaagggtgcggatactatggaaatcctgcatggcagggattctgttccaagtgctggagggaggagtatcacaaggccaggcaaaagcagatacaggaagattgggagctcgctgagagattacagcgggaggaggaagaagcctttgccagttcacagtccagtcagggcgcccagtctctcaccttctcaaaatttgaagagaagaaaacaaatgaaaaaacacgcaaagttactacagttaaaaaatttttttctgcatcaagccgagtaggctctaagaaagaaattcaggaagcaaaggctccgagtccttcgattaaccggcagacatctatcgagaccgaccgggtcagcaaggagtttattgaatttctcaagacatttcacaaaacaggacaggaaatctataagcagacaaagctgttcctggaaggtatgcactataaacgcgacctaagcatcgaggagcagtcagagtgtgcgcaggacttttatcataacgtggctgaaaggatgcaaactagagggaaggtgccacctgagcgggtcgagaagatcatggatcagatagaaaagtacatcatgaccagactgtataaatacgtgttctgtcccgaaactaccgacgacgaaaagaaggatcttgccatccaaaaacgaatcagagcactgcgatgggtgaccccccagatgctctgtgtgcctgtgaacgaggacatcccggaggtgtccgatatggtggtcaaagctattacagacataatagagatggactccaaacgggtccccagagataaactggcctgcattacaaagtgttcaaagcacatcttcaacgccatcaagattaccaagaatgagcctgcctccgcggacgactttctgcctacactgatttacattgtgttaaaaggcaatcctccacgtctgcaatccaatattcagtatattactcgcttttgcaacccatctaggctgatgaccggagaggatgggtattacttcactaacctgtgttgcgctgtggccttcatagagaaactggacgctcaaagcctcaacctgtcacaggaggactttgataggtacatgtccggccaaacgtctcctagaaaacaagaggcagagagttggagccctgatgcctgtctcggagtgaagcagatgtacaaaaacctagatctgttatcccagttaaacgaacgtcaggagaggataatgaacgaagcgaagaagctcgagaaagatctgatagattggacagacggtatcgcaagagaggtccaggatatcgtggaaaagtacccattagaaattaagccgccgaaccaaccactggctgcgatcgactccgagaatgtggagaacgataagctgccaccaccattgcagccccaagtgtacgccgggtag

SEQ ID NO: 131406 - DNA, 138 bp, Artificial Sequence
  Description of Artificial Sequence: Synthetic coding sequence
atgtctctgaagagcgagaggcggggcattcacgtcgaccaatcggatttattgtgtaagaaaggctgtggctactatgggaatcctgcttggcaggggttctgtagcaagtgttggagggaagagtaccacaaatag

SEQ ID NO: 131407 - DNA, 1476 bp, Artificial Sequence
  Description of Artificial Sequence: Synthetic coding sequence
atgtctctaaagtcagagagacgcggaatacacgttgaccagagcgacctgttgtgtaaaaaaggctgtgggtactacggtaatcctgcgtggcagggattttgctcaaagtgctggcgggaggagtaccataaggcccgacaaaaacagattcaggaggattgggaattggccgagaggctgcagagggaggaggaggaagccttcgctagctcacagtccagtcagggggcccaatccctgactttttctaagtttgaagaaaaaaaaaccaacgagaaaactcgtaaagtgactacagtgaagaagttcttcagtgcgagctcccgcgtgggtagtaaaaaggaaatacaggaagccaaagccccctcaccaagcatcaaccggcagaccagcatagagaccgacagggtgtccaaggaattcattgagttcttgaaaacatttcacaaaaccggtcaggaaatttataagcagactaaactgtttcttgaggggatgcattacaaaagggatcttagtatagaggagcaaagcgagtgtgctcaagacttttaccataacgtggccgagagaatgcaaacccgtggaaaagtcccccctgaacgcgtcgaaaagatcatggaccaaatcgagaaatatatcatgactcgcctctacaagtacgttttttgccctgagacaacagatgacgagaaaaaagaccttgcaattcaaaagcgtatccgagctctgcggtgggtaacaccccaaatgttgtgcgtgcccgtgaacgaagatatcccagaggtgtccgatatggtcgtcaaagcaatcactgatattatagagatggatagcaaacgggtgccgcgggacaagctcgcatgcatcacaaagtgttcaaagcatatcttcaatgcaatcaagattacaaagaacgaacctgcgagcgcagacgacttcctgcccacccttatttacatcgtgctgaaaggcaacccaccccgcctgcaaagcaacatccagtatattacaagattttgcaacccttcaaggctgatgacaggtgaggacggctattattttacgaatctgtgctgtgcagttgcatttatcgaaaagcttgacgcgcagtcactcaacctgtcccaggaagacttcgacaggtacatgtccggtcagacatcacctcgcaagcaggaggctgagagctggagcccagacgcatgtttaggcgttaaacaaatgtataagaatctggatctcctgagccagcttaacgaacgacaggagaggattatgaacgaagccaagaaactggagaaagatctcattgattggacggacgggatcgcgcgcgaggtgcaagatattgtggaaaagtatcctctagaaattaaaccaccaaatcaaccccttgccgcaatcgactcagagaatgtcgaaaacgacaagttgcctcccccactgcaaccccaggtgtatgccggctag

SEQ ID NO: 131408 - DNA, 372 bp, Artificial Sequence
  Description of Artificial Sequence: Synthetic coding sequence
atggagccagctgagcagccaagtgaattagtgtccgccgaaggacgcaatagaaaggcagtactttgccaaaggtgcggaagtagagtccttcagcccggcactgcactcttttctcggaggcaactgtttctcccatccatgaggaagaagcccgccctgtcagatgggtctaaccccgacggtgatctgttacaggagcattggcttgtggaagacatgtttatttttgagaatgtgggattcacaaaagatgttggcaacattaaattcctcgtgtgtgctgattgtgaaattgggcccatcgggtggcactgtctggatgataagaatagcttctacgtcgctctggagagggtgagtcacgagtag

SEQ ID NO: 131409 - DNA, 1206 bp, Artificial Sequence
  Description of Artificial Sequence: Synthetic coding sequence
atggagcccaggcgggctgcgcctggtgttccaggttgggggtctcgggaagccgcaggatctgcctcggctgctgagctggtttaccacctggccggagctctcggcaccgagttgcaggatctggctcgccgattcggccccgaggcagcagccggcctggtcccacttgtggtccgcgcactcgagctgctcgagcaggccgcagtggggcccgcccctgacagtctgcaggtgagcgcccagcctgccgaacaagagctacgacgcttgagagaggaaaacgaaagactgaggagggaactgcgggccggccctcaagaagagcgggcactcctcagacagctcaaggaggtgactgatcgtcaacgcgacgagctgcgcgcccacaatcgagacttaagacagagaggccaggagaccgaagcactgcaggaacagctgcagcgactgctcctggtgaacgcagagttgcgccacaagctcgctgctatgcaaacccagttgagggccgcacaggacagagagcgcgaaagacagcagcccggagaagctgccacaccacaggccaaggaacgcgcccgaggccaagccgggaggcccggtcatcagcatggccaggagcctgaatgggccacagccggcgcaggggctccgggtaatccggaagacccagccgaggctgcccaacaattgggcagaccgtctgaagccgggcagtgccggtttagcagggaggaattcgagcagatactccaagaaaggaatgaactgaaggccaaggtgtttctgctgaaagaggaactggcctattttcaacgcgagctgctgactgaccaccgcgtgccaggtctcctgctggaggctatgaaagtagccgtcagaaagcagagaaagaaaatcaaagctaaaatgttaggaacacccgaggaagccgagagctccgaggacgaagccggtccctggatcctgctttccgatgataagggagatcatcctcctcccccagaatccaaaatccagagcttctttggtctctggtataggggcaaagctgagagctcagaagacgaaacaagcagccccgcccctagtaaactgggtggggaagaagaggcccaaccccaatcccctgcccccgacccaccttgttcagccctgcacgagcacctatgcctgggtgcttccgcagcacccgaagcttag

SEQ ID NO: 131410 - DNA, 1212 bp, Artificial Sequence
  Description of Artificial Sequence: Synthetic coding sequence
atggaggaagagcgtggcagcgccctggcagcagagtctgcccttgagaaaaatgtagctgagctcactgtgatggatgtctacgacatagctagtctcgtgggccatgaattcgagcgtgtgattgatcaacacggttgcgaggccatagcaagacttatgccgaaagtcgtgagagtcctggaaattctggaggtcctggtcagcaggcatcacgtggcgccggaactggacgagctgagactggagttggatagactccgcctggagagaatggatcgcatcgagaaggagcgaaaacaccagaaggagctggaacttgtggaggacgtctggagaggtgaagcccaggatttgctcagtcagattgcccaactacaggaagaaaacaaacagttgatgactaaccttagccacaaagatgtgaatttttccgaggaggaatttcagaaacatgagggtatgtctgaacgggaacgacaggtcatgaaaaagctcaaggaggtggttgataagcaacgggatgaaatccgcgcaaaagaccgggaattaggcttgaaaaacgaggacgtcgaggccctgcagcagcagcaaactcggctgatgaagattaaccatgatctccgccacagggtaacagttgtggaggcacagggcaaagcactcattgagcagaaggttgagttagaggcagacttgcagactaaggagcaagaaatgggatctctccgagcggaactaggcaagctcagagaacggctacaaggcgagcatagccagaatggagaagaggaacctgaaacggaacctgtgggggaagagagtatctcggatgccgagaaggttgccatggatctgaaggaccccaatcgtcctagattcacgcttcaggaattgcgtgacgtcttgcacgaacggaacgaactgaaatcaaaggtcttcttattacaggaagagctggcttattataaatctgaggaaatggaagaggaaaacaggattccccagcccccccctattgcacatccgcgcacttctccccagcctgagtccggcatcaaaagactgttctccttcttttctcgggataaaaagcggctggctaacacacagcggaatgttcatatccaagagtcattcggccagtgggccaatacgcaccgcgacgacggctacacggagcaagggcaggaggccttgcagcacttgtag

SEQ ID NO: 131411 - DNA, 636 bp, Artificial Sequence
  Description of Artificial Sequence: Synthetic coding sequence
atggaagagcctcctgtccgcgaggaagaggaggaagaaggtgaagaagatgaagagcgggacgaagtgggtcccgagggcgccctcggtaaatccccttttcagctgacagccgaggatgtgtacgatatcagctatctcctcgggcgtgagctcatggcgttgggttctgaccccagggtgacacagttgcagtttaaggtagtccgtgttctcgagatgcttgaggcgctcgtcaacgaagggtccctggctctggaggaattgaaaatggagcgggaccacctccgcaaggaagtcgagggattgcgccggcagtcacctcctgcatcaggcgaagtgaatctggggccaaacaaaatggtcgtggacctcacagaccccaacagaccccgcttcactctccaagaacttcgtgacgtactgcaagagagaaataaattaaaaagccagctactcgtggtgcaagaagagctgcaatgctacaagagcgggctcatcccaccacgggagggaccaggcggaaggagagagaaggatgcagttgtcactagtgcaaagaacgccggccggaacaaagaggaaaagactataattaaaaaactattcttctttcggagtggcaagcagacttag

SEQ ID NO: 131412 - DNA, 717 bp, Artificial Sequence
  Description of Artificial Sequence: Synthetic coding sequence
atggctgaagataagacaaaaccctccgagttggaccagggcaagtacgacgccgacgacaacgtcaagattatctgtctcggcgattccgcagtgggtaagtcaaaactgatggaacgcttcttgatggatgggttccagccccagcaactgtcgacttacgctttgaccttatacaaacacactgccacagtggacggtcgtaccattctcgtagatttctgggataccgccggccaggaacgtttccagtccatgcacgccagttattaccacaaagcccacgcatgtatcatggtgttcgatgtgcagagaaaggtaacttatcgtaatcttagcacctggtacaccgaactccgcgagtttcgaccagaaattccctgtatagtggtcgctaataaaatcgatgacattaatgtgactcaaaaatctttcaattttgcaaagaaattttcattgcctctttactttgtgtcagctgccgacggcactaatgttgtcaaagtgtggctgaccgcagaggtagcgtcaaaactgttcaacgacgccatccgcttggcggtttcctacaagcaaaactcacaggattttatggatgagatattccaggaactcgaaaatttctctcttgaacaggaggaagaggatgtgccagatcaggaacagtcctcatcgatcgaaaccccctcagaagaagccgcctccccacattcttag

SEQ ID NO: 131413 - DNA, 498 bp, Artificial Sequence
  Description of Artificial Sequence: Synthetic coding sequence
atggctgaagacaaaactaaaccctcggaactggatcagggaaaatatgacgccgacgacaacgtgaaaataatctgcctcggagactccgccgtgggaaagagtaagttgatggagcgcttcctgatggacgggtttcaaccacagcagcttagtacgtatgcgctgactctttataaacataccgctacagtagatgggaaaaccatcctggtcgctgacatcaacgtgactcaaaaatcatttaattttgccaaaaagttctctctgccactttacttcgtgtccgcggccgacggcacaaacgttgtaaagttattcaacgatgccataaggttagccgtatcatataaacagaacagccaagacttcatggatgaaatttttcaggaattggagaacttttcattagaacaggaggaagaggatgtccctgaccaggaacagtcatcatctattgaaactccatcagaggaggtggcaagcccccacagctag

SEQ ID NO: 131414 - DNA, 690 bp, Artificial Sequence
  Description of Artificial Sequence: Synthetic coding sequence
atggcggaggacaagaccaagccctccgagctagatcaggggaaatatgatgccgatgacaacgtgaagatcatctgcctcggagattcagccgtgggaaagagcaagctcatggagcggttcttgatggatggatttcagccgcagcagctgtctacctatgctttgactttgtataagcacaccgccacggtcgacggcaagacgatcctagtcgatttttgggacactgccggtcaggagaggttccagagcatgcacgcgagctattatcataaggcacacgcctgtataatggtgtttgatattcagcgaaaagtaacatacagaaacctctctacgtggtacacagagctccgcgagtttagacctgagatcccgtgcatcgtcgtcgccaacaagattgatgccgatatcaatgtaactcaaaaatcctttaattttgctaaaaagttttccttacctctgtatttcgtttccgcagcggatggcactaatgtcgtgaagttgttcaacgatgcaatcagactcgctgtgagttacaagcagaatagccaagatttcatggatgagatcttccaggaactcgagaacttctcactggagcaagaggaggaggatgtgccggatcaagagcagagttctagcattgaaaccccatccgaggaagtggccagtccccactcatag

SEQ ID NO: 131415 - DNA, 687 bp, Artificial Sequence
  Description of Artificial Sequence: Synthetic coding sequence
atggcagaagataagacaaaaccgtccgagctcgaccaggggaagtatgacgccgatgacaatgtcaagatcatctgtcttggggactctgcagtcggaaagtccaagctgatggaacgcttcctgatggacggatttcagcctcaacagctctctacctacgctctgaccttgtacaagcatacagccacagtggacggtaaaacaatccttgtggacttctgggacacagctggtcaggagcggtttcagtcaatgcatgcctcttactatcacaaagcccacgcctgcatcatggtctttgacatccagcgtaaagtcacgtaccggaatctgtcgacatggtataccgaattgcgcgaattccggccggagatcccatgcatcgtggtggccaataaaatcgacgacatcaatgtgacacaaaaatcctttaactttgccaaaaaattttcactcccattatattttgtcagtgcagctgacggcaccaatgtcgtaaagctctttaacgacgcaatacggctcgctgtctcctataaacagaacagccaagactttatggacgaaatcttccaggagctggaaaacttttccttggagcaggaagaggaggatgtgccagatcaggagcaatctagctccatcgaaactccctctgaggaggtggcctccccgcactcctag

SEQ ID NO: 131416 - DNA, 687 bp, Artificial Sequence
  Description of Artificial Sequence: Synthetic coding sequence
atggcagaggataaaactaaacccagtgaactcgatcagggcaaatatgacgccgacgacaacgtcaagatcatctgcctgggcgactcagcagttgggaagtctaaactgatggaacggtttctcatggatggtttccagcctcagcagctgtctacctatgccctgaccttgtacaagcatacagctacagtcgatgggaagaccattctcgttgatttttgggacacagcgggccaggagagattccagagtatgcacgcctcctattaccataaggcccacgcctgcatcatggtgttcgatatacagagaaaggtcacttacaggaacctgtctacgtggtacacagagctgagggagtttaggcctgaaatcccatgcatcgtcgtcgctaacaaaatcgacgacataaatgtgacacagaaatcttttaatttcgccaagaaatttagcctgcctttgtactttgtttctgccgcagatggaacaaatgtcgttaagctgttcaacgatgcgatccgactggctgtgagctataaacagaatagccaagattttatggatgagatcttccaggaactggagaatttctctttggagcaagaagaagaggatgtgcccgaccaggagcagagcagctccatcgaaacaccctctgaggaggtcgctagccctcattcctag

SEQ ID NO: 131417 - DNA, 717 bp, Artificial Sequence
  Description of Artificial Sequence: Synthetic coding sequence
atggccgaggataagaccaagccatccgagctagaccagggtaagtatgatgccgatgacaacgttaagattatatgcctgggcgacagcgctgtgggtaaatccaaattaatggagaggttcctaatggatggcttccagccacagcagctttcaacatatgctctgacactgtacaagcacaccgcaacagtcgatgggaagaccatcctcgtcgatttttgggataccgcgggccaggaacggtttcagagcatgcacgccagctattaccataaagctcacgcttgcatcatggtattcgatatccagcgtaaagttacctaccgcaatctttccacctggtacacagaactccgcgagttccgacccgaaatcccctgtatcgtagtggctaataagatagacgatatcaacgttacgcaaaaatcattcaatttcgccaaaaaatttagtttacctctatactttgtgagcgccgctgatggaactaacgtcgtgaaagtctggctgacggcagaggtcgctagtaaactgtttaacgacgcgattagactggctgtctcctataaacagaactcacaggattttatggatgagatctttcaggagctagagaacttctcccttgaacaagaggaggaagatgtgcccgaccaggaacagagttcttcaatcgaaaccccgtccgaagaagtcgcttctccgcattcctag

SEQ ID NO: 131418 - DNA, 345 bp, Artificial Sequence
  Description of Artificial Sequence: Synthetic coding sequence
atggctgaggacaagaccaagccttccgaactggatcaaggcaagtatgacgccgatgacaacgttaagatcatatgtctgggcgatagcgccgtggggaagagcaaactgatggagcggtttctgatggacggctttcagccacagcaactcagtacctacgcattaaccctgtataagcatactgctaccgtcgacggtaaaacaattctggtcgatttttgggacactgctggccaagagcgcttccagagtatgcacgcctcctactatcacaaggcgcacgcctgcatcatggtctttgatatacagcggaaggtgacctatagaaacctgtcgacctag

SEQ ID NO: 131419 - DNA, 306 bp, Artificial Sequence
  Description of Artificial Sequence: Synthetic coding sequence
atggctgaagataaaacaaagccatctgagttggatcagggtaagtacgatgctgacgataacgtgaaaataatatgcctgggagactctgccgtcggtaagtccaaactcatggagcggtttctgatggatggatttcagcctcagcagctgtccacttacgcactgacattgtataaacacaccgcaactgtggatggtaagactattttggttgatttctgggataccgccgggcaggaacgcttccagagcatgcacgcctcttactatcacaaggcgcacgcctgtataatgcagacatag

SEQ ID NO: 131420 - DNA, 690 bp, Artificial Sequence
  Description of Artificial Sequence: Synthetic coding sequence
atggccgaagacaagacaaaaccatcggaattggaccagggaaaatacgacgctgacgacaacgtgaagattatctgtctgggagattctgccgttgggaaaagtaaactgatggaacggtttttaatggacggatttcagccccagcagctgagtacttatgccctgacactgtacaaacacacggcgacggtcgatggtcgcaccatactggtggacttctgggataccgctggacaggagaggttccaaagcatgcatgcttcttattaccataaagcccacgcatgtataatggtattcgatgtccagagaaaagttacctacagaaatctctctacttggtatactgaactgcgcgagttccgccccgaaatcccatgtattgtggtcgctaataagatcgatgcggacataaatgttacgcagaaatcttttaattttgcgaaaaagttcagcctgccactgtacttcgtgtccgccgcagatggcaccaatgtggtgaaattgtttaacgatgccatccgcctggccgttagttacaagcagaactcccaggattttatggacgaaatttttcaggaattagagaatttctcgttggagcaggaggaggaagacgtacccgatcaggagcagtcgtcctctatagagactccatcggaggaggccgccagcccgcattcttag

SEQ ID NO: 131421 - DNA, 690 bp, Artificial Sequence
  Description of Artificial Sequence: Synthetic coding sequence
atggcagaggacaagaccaagccaagcgaattggaccaaggcaagtacgacgctgacgataatgtgaagatcatctgcttaggtgactctgccgtcggtaagtctaaacttatggagcggtttctcatggacggatttcaacctcaacagttgtccacctacgcactcactctttataaacatacagctacagtagatggcagaacaatcctcgtggatttttgggatacggctggccaggaaaggttccagtctatgcacgcatcctactatcacaaggcacacgcctgcatcatggtgtttgatgttcagcgaaaggtcacatatagaaacctgagcacctggtacacagagcttagagagttcaggcccgagattccatgcatcgtcgtggcaaacaaaatagacgccgacataaatgtaactcagaagagcttcaacttcgcaaaaaaattctctctgccgctttacttcgtcagtgctgctgacggtacaaacgtggtgaaattgttcaacgacgccattcggttagctgtaagctacaagcagaacagccaggactttatggatgaaatatttcaggaattggagaacttttctctggagcaggaggaagaagacgtacccgatcaggagcagtcttcctcaattgaaaccccttccgaggaagcggctagcccacacagttag

SEQ ID NO: 131422 - DNA, 687 bp, Artificial Sequence
  Description of Artificial Sequence: Synthetic coding sequence
atggctgaagacaaaacaaaacctagtgagctggaccaggggaagtacgatgcagatgataatgtgaaaattatctgtctcggcgactcagcagtggggaagagcaagctgatggaacgatttttaatggacggttttcagcctcaacaactttctacatatgccttaaccttatacaagcacactgctacagtggacgggagaaccatcttggtggacttctgggacactgcgggacaggagaggttccagagcatgcatgcaagttactaccacaaggcacacgcttgcatcatggtctttgatgtacagcggaaggttacttaccgtaatctcagtacctggtacactgagcttagagagtttcgcccagaaataccctgcatcgtggtggcaaacaagatcgatgatatcaacgtaactcagaaaagtttcaactttgccaaaaaatttagtctcccactgtatttcgtttctgcagctgacgggactaatgtggttaagctgttcaatgacgctatccgcctcgcagttagctataagcagaactcgcaagactttatggacgagattttccaggaactggagaacttttcactagaacaggaggaagaggatgtccctgaccaggagcaatcttcaagtattgaaaccccctctgaggaagccgcctccccccacagctag

SEQ ID NO: 131423 - DNA, 63 bp, Artificial Sequence
  Description of Artificial Sequence: Synthetic coding sequence
atggccgaggataaaacaaaaccaagcgagctggatcaagggaagtatgacgcggacgattag

SEQ ID NO: 131424 - DNA, 687 bp, Artificial Sequence
  Description of Artificial Sequence: Synthetic coding sequence
atggctgaggataaaacaaaaccatccgagctagaccaaggcaaatatgacgctgacgacaacgtaaaaatcatatgtctcggcgactctgcagtcggcaaaagtaaactgatggagagattcttaatggacgggtttcagccgcagcaactgtccacttatgcattgactttatataagcacacagctactgtcgatgggcgaaccattctagttgacttttgggataccgctggtcaggagcgatttcagagtatgcatgctagctactaccacaaggcccacgcctgtattatggtctttgacgtgcagaggaaggtaacctaccgcaatctttcaacatggtacaccgagctgcgagagtttagacctgaaatcccctgtattgtggttgcaaataagatagacgacattaatgtgacacagaagagttttaacttcgcgaaaaaattctccctgccactgtacttcgtgtccgcagcagacggtactaacgtcgttaagctcttcaatgacgcgatccggctggccgtttcttataaacaaaacagccaagactttatggacgagatcttccaggagctggagaatttttccttggagcaggaagaagaggacgttccagaccaggagcaatcttcgagcattgaaacccccagcgaggaggccgcaagccctcactcatag

SEQ ID NO: 131425 - DNA, 603 bp, Artificial Sequence
  Description of Artificial Sequence: Synthetic coding sequence
atggcaaagaaaacctatgatctcctgttcaaattgctgctgataggtgactctggagttggcaagacttgcgtattgttcaggttctccgatgacgcctttaacaccaccttcattagcaccataggcatcgatttcaaaatcaaaactgtcgagctgcagggcaagaagataaaattacaaatctgggataccgctgggcaggagcggtttcatacgattacaacgtcttattatagaggcgcaatgggcatcatgctcgtttacgatatcacaaatggaaagtcatttgagaatatctcgaagtggctacggaacatcgatgaacatgccaacgaggacgtcgagcggatgcttctcggaaataagtgtgatatggacgataagagagtggttcccaagggaaagggtgagcagatcgcaagggaacacggaattcggttttttgaaactagcgccaaagcgaatatcaatatagagaaagcctttctgacgttggccgaagatatcctgaggaagactcctgtgaaagaacccaattccgaaaacgtggacatcagtagcggcggtggggtgaccggatggaagagtaagtgctgctag

SEQ ID NO: 131426 - DNA, 1950 bp, Artificial Sequence
  Description of Artificial Sequence: Synthetic coding sequence
atgtctctgatggtgagtgctggaagggggctgggggctgtgtggtccccgacacatgtacaagtgacagtgctgcaggccagaggcctccgagcaaagggacctggcggcacgagcgacgcttacgcagtgatccaggtgggaaaagaaaaatacgccacttcagtgtccgagcggagccttggggcccccgtgtggcgcgaagaggcaaccttcgaactgcctagcctgctcagtagtgggcctgctgccgccgccactttacaattgaccgttctgcaccgggcattgttgggactggacaagtttctagggagagcagaagtcgatctgcgggatcttcaccgagaccagggtcgcagaaagactcaatggtacaaactcaagagcaaacccggtaaaaaagataaggagaggggcgaaatcgaggtggacatccagttcatgcggaataacatgaccgccagcatgttcgacttgagcatgaaggacaaaagccggaacccgttcggaaaactgaaagataagatcaagggaaaaaacaaggatagcggttctgatacagcctctgcaataatcccctccacaacaccgagtgtggatagcgatgacgagtccgtggtcaaggataaaaagaaaaaaagcaaaattaagacactgctctctaaatcaaatctgcagaagacccctctttcccaaagcatgagcgtgctgcccacctccaagcctgaaaaagtgttgctcagaccaggcgattttcaaagccagtgggacgaagacgacaatgaagacgaatcgagctccgctagcgatgtgatgagtcacaaacggacagcttcaacagatctgaaacagctcaatcaggtcaatttcaccctcccgaaaaaagaaggcttatctttcctcggagggttgcgatccaaaaacgacgtactgtcccggtcaaacgtctgtatcaatggcaatcatgtgtacttagagcaaccggaggcaaagggcgaaatcaaggattcatccccatcctcaagtccatctcctaagggttttcgaaaaaagcacctctttagtagcacagagaatctggcggccggatcttggaaggagcccgctgagggtggggggctctcctccgataggcagctgagtgaatcatcaaccaaagacagcttgaagtcgatgacactgcctagttataggcctgcccccctcgtaagtggagacttaagagagaacatggcccccgccaactccgaggccactaaggaagcaaaggaaagcaaaaagcctgaatccagaaggtcttctctgctgagcctgatgacgggaaaaaaggatgtagccaagggctcagaaggagaaaatccccttacggttcccgggcgcgaaaaagaagggatgctgatgggcgtgaagcccggggaagacgccagtggccctgctgaagatttagtacggcgctcagaaaaagacaccgctgccgtggtcagcaggcagggtagctcattgaacttgttcgaagatgtccaaatcactgagcccgaggcagaacctgaatcaaagtccgagccacggccaccaatctctagcccaagggctccccagacaagggccgtcaaacctcgcctgcatccagttaagcctatgaacgcaatggccacaaaggtcgccaactgttcgctgggtactgctaccataatttccgaaaatcttaataatgaagtgatgatgaaaaagtactccccgtctgaccctgcatttgcttatgcacagttgacacatgatgagctaatccaactcgtactcaagcaaaaggagactatcagtaagaaggagttccaagttcgtgagctggaggactacatcgataatcttttggtaagagttatggaagagacacctaatattctgcgaattccaacccaggtggggaaaaaagccggaaaaatgtag

SEQ ID NO: 131427 - DNA, 3852 bp, Artificial Sequence
  Description of Artificial Sequence: Synthetic coding sequence
atgtctctgatggtgagcgctggtcggggactgggggcagtatggtcaccaacacacgtacaagttaccgtgctccaggcacggggtcttagagctaaggggccaggaggaaccagtgatgcatacgcagtaatccaggtgggtaaagagaagtacgccactagtgtgtccgaaaggtccctgggagcccccgtgtggcgtgaagaggcaactttcgagctaccgtccttgctcagttctggaccggcagctgccgccacgcttcagctaacagtcctgcaccgagccctgctgggcctcgataagttcttaggacgggccgaggtggacctgagggaccttcacagagaccagggccgtcgaaaaacgcagtggtataagctcaaaagcaagccgggcaagaaggataaggagagaggggagattgaggtcgatatacagtttatgcgaaataacatgaccgcctcaatgtttgacttaagtatgaaggataagtcccggaacccattcggtaagcttaaggataagatcaagggaaaaaataaggattctggcagcgacaccgccagcgctataattccatctaccaccccatctgtggactccgacgatgaatcggttgtaaaggataaaaagaaaaaaagtaagattaagacgctgttaagcaaaagcaatctgcaaaaaactccactgtcgcaatcaatgagcgtgctgccgactagtaagcccgaaaaggtgctgctgagacccggggactttcagagtcagtgggacgaggatgataacgaggacgagagttccagcgcatccgacgtgatgtcgcacaagcggactgcatccactgacttgaaacagctgaatcaggtcaattttactctgccaaaaaaggagggactttcattcctgggtggactgaggagcaagaacgatgttctgtcacgaagcaacgtgtgtattaatggaaaccacgtatacctggagcaacctgaggccaagggggagataaaggatagcagcccttcctctagccccagccccaagggtttcaggaagaagcacctgttcagttcaacagaaaatctagctgccgggtcgtggaaggaaccagccgaaggggggggactgtccagtgaccgccaactcagtgagtcctctacaaaagattctctcaaatccatgacactcccatcttaccggccagcccctttggtatctggagatctgagggagaatatggcccctgctaacagcgaggccacaaaagaagccaaggaatcaaagaagccagaatcgcgccgtagctcccttctctcactgatgacagggaaaaaggatgtcgcgaagggatctgagggagaaaatccgctaacagtgcctgggcgtgaaaaggagggaatgctgatgggcgtgaaaccaggggaagatgcctccggacctgccgaggacctcgtcaggagatctgagaaagacacagccgccgttgtctcacgtcagggatcttcacttaatctgtttgaagacgttcagattacggagccggaagccgaaccggaatctaagtcagagccgcgaccgcccatttcttcccccagagcaccacagacccgcgccgttaagccaagactggaggtgtcccctgaagcacagcccactgctagacttccaagtccgaccgatagtccaagtagcctgccaccccttcctagcagtagtggtcaggcaagcgtgccatcggagctggggcatggggcagacactcagtcttcagaatcccctagtgtattcagcagtctctctagtccaatagccgctccaatctcaactagtacccccatcgaatcctggcctcttgtagatcgtgggcaggccaaatcggagggccccccactgttgcccaaagccgagctgcaaaccgagtccctcacacctgttcccaactccggaagctcagccttgggctcactgttcaagcagccatcattcccagccaacaagggaacggaagattccctaatgggtaggactagggagaccggaaccgaaaagaatacttcctccctggaacttgaggagtctctcccggagcagccggagactgggaggcaggaagaggaactgccccgcttcccatgtaagaaacaggactactcaccaagctctggggaggctcaggaggtgccctttgcactgagtttgtccagcgacggagccgtgtcccccgtcggggaactggctgcgggcggtgaccgggatcttgaaagtcaagctggctctcttgtggagtcgaaggctcgcgatgcagccgaggaagtcgccccaccattgccaatgggcgcatccgtgcccagtatagattcaatgatgcggaaactagaggagatgggcttgaacctgcggaaggatcagaagaagacaaagaagcgcgtttcattctctgagcagctgtttactgaagaagcggttgctggggccgctctactggtggaaggccatagctcttgtcctcaggaactgaaccccgcatggtcagtggctggtaatgcctccgatggagagccgcccgagtcccctcacgctgaggactccgaaagagagagcgttaccacccccgggcccgctacctgcggggccccggcttcacccgcagaccacctgctgctcccgagccaggaagagtccttcagcgaagtaccaatgagcgaagctagctctgccaaagatactcccctgttcaggatggagggggaggatgcccttgtgactcagtaccaaagcaaagcttccgatcacgaaggccttctgagcgatcccttatcagatttgcagctggtcagtgactttaagtcccccattatggcagacctgaatttgtcactgcccagcataccagaggttgccagtgatgacgaaagaatagaccaagtggaggacgatggtgatcaggtggaggatgacggcgagaccgccaagtcaagtactctagatataggagccctgtctcttggcttggtggtgccctgcccggagcgcggcaaaggcccctccggagaagcggacaggctcgtgttgggcgagggactgtgcgactttcgactgcaagccccccaggcatccgtcacggctccatccgagcagacaactgaatttggaattcataaaccgcacctcggcaagagctctagtctcgataagcaactgcccggaccaagcggcggggaggaggagaagcctatggggaacgggtcaccatctccacccccaggcacatctctggacaatcccgtaccatcgccctcaccaagtgagatatttccagtcactcatagcttccctagctccgcccattctgatactcaccatacatccaccgcagaaagccagaaaaaagcaactgccgagggaagcgccgggcgcgtcgaaaactttggcaagcggaagccccttttgcaagcttgggtgagtccctcagagacccatccagtgtctgcccagcccggggctgggaccgggtccgcgaaacaccgccttcacccagttaagccaatgaatgccatggcgactaaggtggctaattgcagtctgggaacagctactatcatcagcgagaatctgaacaacgaggtgatgatgaagaaatacagcccttccgatcctgccttcgcatacgctcagctaacccatgatgagctcatccagctggtactaaagcaaaaggagaccatctctaaaaaggagttccaggtgcgtgagttagaagattacatcgataacctgttggtgcgggtcatggaggagacaccaaatattttacgcatccctacccaagttggcaagaaagcggggaaaatgtag

SEQ ID NO: 131428 - DNA, 429 bp, Artificial Sequence
  Description of Artificial Sequence: Synthetic coding sequence
atgtccctgatggtgagcgccggacgtggccttggagctgtttggagtccgactcacgtgcaagttaccgtcctgcaggctaggggtcttagagccaaagggcctggcggaactagtgatgcatacgcagtgattcaagtgggcaaggaaaaatacgcgacatccgtgtccgaacgttctctgggcgcacctgtgtggagggaagaggctaccttcgagctgcccagcctgctctctagcggtcccgccgcggcggctactctccagctaaccgtgttgcatcgagctctgctggggctggacaagtttctcggacgggcagaagtggatctgcgggacttgcaccgagaccttggcaagagcttctttaaaaccctaaagaaaagagcctgggcgatattcctgagactttgcctgaaaaaaaactag

SEQ ID NO: 131429 - DNA, 1320 bp, Artificial Sequence
  Description of Artificial Sequence: Synthetic coding sequence
atgcggaataacatgacagcctccatgttcgatctctcgatgaaggataaaagccggaatccttttgggaaactcaaggataaaattaaggggaaaaacaaggactccggcagtgacaccgccagcgcaataatcccatctacgactcctagcgtggattcagatgacgaatcagtggtcaaagataaaaagaaaaagtcgaagatcaagacgctactgtccaaatccaacctccagaaaacacctctcagccagagtatgtcggttctgcccacttctaaacccgagaaagtactgctgcgtcctggtgactttcagagccaatgggacgaggatgataatgaggatgagtcatcttccgcctcagacgtgatgtctcataagaggaccgcaagcacggatttaaaacagttgaaccaagttaacttcacactcccaaagaaggaagggctcagtttccttggtggtctgagaagcaaaaatgacgtgctgtcccgatctaatgtgtgtattaatggcaatcatgtgtatttggagcagcccgaggccaagggcgagattaaagactcatccccaagctcctctccatctccaaaaggcttcaggaagaaacacctcttcagcagcacagagaatctggctgccggcagttggaaagagccagcagagggcggaggcctgtcctcagatcgacagctgtcagaaagttcgaccaaggacagcctgaagtcaatgacacttccatcatacagaccggcaccattagtgtccggtgacttgcgagagaatatggcccctgcgaattccgaagctacaaaagaagccaaggaaagtaagaaacccgagagcagaagaagtagtctgctgtccctgatgaccggaaagaaggacgtggccaaaggcagcgagggggaaaatccattgacggtgcctggaagagagaaggaaggaatgctgatgggggtgaagcccggtgaggatgctagcggacccgccgaggatttggtacggaggtctgagaaagatacagcagccgttgtgtctcggcagggctcgtccttgaatttattcgaggatgtccaaattactgagcccgaagcagagcctgagagtaagagtgaaccccgaccacccatttctagccccagagctccccagaccagggccgtgaaaccccggttgcaccctgtgaagcccatgaatgctatggccacaaaagttgcaaactgttctctgggcactgccacaatcatcagtgaaaacctgaacaacgaagtcatgatgaaggtatgccccctccgcagttggtgtgttcgttag

SEQ ID NO: 131430 - DNA, 1539 bp, Artificial Sequence
  Description of Artificial Sequence: Synthetic coding sequence
atgatgctatccgaacaggcccagaagtggtttccaacccatgtgcaggtcacggtgttgcaagccaaagacctgaagcctaagggaaaatccggcactaacgatacttatacgatcatccagttaggaaaggagaaatattctacttctgtggctgaaaagaccctggaacctgtctggaaagaggaagcttcttttgaactgccaggcctcttgattcagggatccccagaaaagtacattttatttttgatcgtcatgcacaggtcactggttggtctagacaagtttctgggccaggtggctattaacctcaatgatatcttcgaggataaacaaagaaggaagacagagtggtttaggctggaaagtaagcaggggaaaaggattaagaataggggtgagattaaggtaaatatccagttcatgcgtaacaatatgaccgccagcatgtttgacctttctatgaaagacaagacacggtctccattcgctaagctcaaggacaagatgaagggacggaagaatgacgggacctttagcgatacgtccagcgccatcattccgagcacacacatgcctgacgcgaattcagaattctccagcggcgaaatacagatgaagtctaagccaaagaagcccttccttctggggccccagagactttccagcgcgcacagtatgagtgacttgtccggatcacacatgagctcagagaagctcaaagccggcactattgggcaaactcacttattgggacaccagctggactcatttggcacagtcccagaatctggatcattaaagtctccacataggcgcactctctcctttgacacaagtaagatgaatcagcccgattcaattgtcgacgaaggcgaactctgttttggcagacagaatgatccttttactaacgttaccgccagcctgccacagaagttcgcaactcttccacgcaaaaagaacccattcgaggaaagcagcgagacttgggactcttcaatgaacctgttttcaaaacccattgagataaggaaagagaataaaagggagaagcgcgagaaggtttccctgtttgagagagtcactgggaaaaaggatagcaggagatccgacaagcttaataatggaggctcagattcgccctgcgatctgaagtcaccaaatgcatttagcgagaacaggcaggattatttcgactatgagtccaccaacccatttactgccaagtttcgagcaagcaacataatgccctctagctctttccacatgagccccacctcgaatgaagatctccgtaaaatccctgatagcaacccattcgacgccaccgctggctaccgctctctgacatacgaggaagttctccaggagctggtgaagcataaagaattgctgaggaggaaagacactcacattagggagctggaggactacatcgacaatctgctcgtgcgggtgatggaggagacaccctccatcctaagagtgccctacgagcccagtcggaaagccgggaagttttcaaacagctag

SEQ ID NO: 131431 - DNA, 1599 bp, Artificial Sequence
  Description of Artificial Sequence: Synthetic coding sequence
atgatgctgagtgagcaggcccagaagtggtttcccacccacgtgcaagtcacagttttacaagctaaggatttaaagccaaaaggtaagtcaggcacgaacgatacatacacaattattcagctcggcaaagagaaatacagtaccagtgttgcggaaaaaactctggaacccgtgtggaaggaggaggcgtcattcgagctgcctggtctgctgattcagggcagccctgaaaagtatatactgttcctgattgtgatgcatcgatcactggtggggctggataagttcctcgggcaagttgcaataaatctgaatgatatctttgaggataagcagcgaaggaagacagaatggtttcgtctggagagcaagcaggggaagagaattaagaatcgaggagaaatcaaagttaatatccagttcatgcgcaataacatgaccgcaagcatgttcgacctgagtatgaaggacaagactaggtctccattcgctaaacttaaggataagatgaagggtcggaagaatgatggcacgttctcagatacgtcatccgctatcatcccatccactcatatgcccgatgccaatagtgagttctcatccggcgaaatacagatgaagtcaaaacctaagaaaccattcctcctgggaccacagcgactgtccagtgctcactctatgtccgacctgtcaggttctcacatgtcatcagagaagctcaaagcaggcaccattgggcagacacatctcctgggccaccagttggacagctttgggaccgttcccgagtcaggctctctgaagtctccccataggaggacactgtcatttgacacaagtaagatgaatcaaccagactcaattgtcgatgagggagagctgtgcttcggacgtcagaatgatccatttaccaacgttactgcgagcttgccacagaagttcgcgacgttgcccagaaaaaagaatcctttcgaggagagctcagaaacctgggacagctccatgaatctgtttagtaagcctatcgagattcgcaaagagaacaaacgggagaaacgtgaaaaagtttctctgttcgaacgtgtcaccggaaaaaaggactcgcggaggtctgacaaactgaataatggagggagcgatagcccctgtgatctcaagtcccccaacgcttttagcgaaaatcgccaggactatttcgactacgagtccacgaaccccttcaccgcaaagttccgtgccagcaacattatgccatcctcaagaaataccctcctgacaccggctgttgctgaatggaggggcagcctgcgatgggccgaattgttccacatgtcccctactagcaacgaagatctgcgcaagattccggatagtaatccctttgatgctaccgccggctacaggtctctgacttacgaggaggttcttcaggaactcgtgaagcacaaggagctgctgcgacgcaaagacacacatatcagagagctggaagactacatcgataacctgttagtgagagtcatggaagagaccccctctattcttagggttccttacgaaccgtcgcgcaaagctgggaaattctccaatagttag

SEQ ID NO: 131432 - DNA, 2271 bp, Artificial Sequence
  Description of Artificial Sequence: Synthetic coding sequence
atggctagtgccccgcccgctagtcctcctggtagcgaacccccaggaccagatcctgaacctggcggacctgacggacctggagccgcacaacttgctccaggccccgccgaactcaggctcggggctcccgtgggcggccccgatcctcagagccccggcctggatgagcctgcaccaggagctgccgctgatgggggggctagatggtcagcaggtccagctcctggtttagaaggagggcctcgcgaccccgggccatctgccccgccaccgcggtctggcccccgcggtcaactcgcctccccagacgctcctggcccggggccccggagcgaagctcccctaccagagcttgaccctctcttcagctggacagaggaacctgaagaatgcggacccgcctcctgtccagaatcggcgccattcaggctacagggctcgagttcatctcacagagcccgcggagaagtggatgtgtttagcccctttcctgcccccaccgcaggcgaactggcactcgagcaagggcctggtagccccccccagcccagcgatctgtctcagacacatccactccctagtgaaccagtggggtcccaggaggatggaccccgcctgagagcagtttttgatgccctggatggcgatggggatggctttgtgagaattgaggatttcattcaatttgcaactgtatatggggctgagcaagtgaaggacctgacgaaatatctggatcctagtggcctcggcgtaatcagctttgaggacttctaccagggaattacggctatacggaacggagatcccgacggacagtgctacggtggtgtcgcctctgcacaggatgaggagcccttggcgtgccctgatgagtttgatgatttcgtgacttacgaggccaatgaagttaccgacagtgcatacatggggtcagagagtacctattctgaatgcgaaacattcactgacgaggacaccagcacccttgtgcatcctgagctgcagcctgagggcgatgccgacagtgctggcgggtcagctgtgccaagcgagtgtctagatgctatggaggagccagatcacggggctcttcttctcttaccaggtagaccccatccccacggccagtcggtgatcacagtcataggtggggaagaacatttcgaagactacggcgagggctccgaagccgagctttcccctgaaacactctgtaacggccagttgggctgtagcgatccagcctttttaacaccatcaccaaccaagagactgagcagtaaaaaagttgccagataccttcaccaaagcggggcactcaccatggaagccctggaagatcctagtcccgagctgatggaaggaccagaagaggatatcgccgataaagtggtgttccttgagaggcgagtactcgaattagagaaagacacagcggcgacaggcgaacagcactcgaggctcagacaggaaaatctccaacttgtccaccgagcgaacgctctggaggaacagttgaaggaacaggagctcagggcctgcgagatggttcttgaggagacgcgcaggcagaaagagctcctgtgcaaaatggagcgagaaaagtccatcgagattgagaatctgcaaactcgtctgcagcagctggacgaggaaaactccgaactcagatcctgtacaccgtgtctgaaggctaacattgaaagactggaagaggagaagcagaagttactggacgaaatagaaagtctgacactccggctgtccgaggaacaggaaaataaaaggcgcatgggtgatagactgagccacgagcgccaccagttccagagagacaaggaggcaacccaggaactaattgaagacctgcggaagcagctggagcatctgcagctccttaagctggaggcagaacagcgcagagggagatcctcatcaatgggtttgcaagagtaccattcaagggctcgcgagtcggaactcgagcaggaagtccgccgcctgaaacaggacaaccggaatctaaaagagcaaaacgaagaactgaatggacagataatcaccctgtcaatccagggagccaagagtctcttctccacagcattcagtgaatccctcgctgctgagatcagctctgtctcaagagacgaactcatggaagccatccagaagcaggaggagattaatttcagactgcaggactatatcgacaggatcatcgtcgcaattatggaaacaaatccttcaattctagaggttaaatag

SEQ ID NO: 131433 - DNA, 1383 bp, Artificial Sequence
  Description of Artificial Sequence: Synthetic coding sequence
atgtccttactgagagctaacgaggttacagactctgcttacatgggcagcgaatcaacgtactccgagtgcgaaacttttacagacgaagacacatccaccttggttcatcccgaactacagccagagggtgacgcagactctgctggaggcagcgcagtgccgtccgaatgccttgatgcaatggaagaaccggatcacggtgccctgttactgttgccagggaggccccacccacacggtcagagcgtgattactgtcatcggcggggaggaacacttcgaggattacggagagggcagcgaggcggagctgtccccggagacactgtgcaacggccagctcggctgtagtgatccagcctttttgactcctagtcccacgaagagactatcttcaaaaaaagtggctcgctacctacaccagagcggagctctgacaatggaagctctagaggatccttccccagaactcatggaggggccagaagaggacatcgctgataaggtagtcttcctagaaagacgggttctggagctagagaaagacacagctgcgactggcgaacaacattctagattgaggcaagagaatctccagctggtgcatcgtgcaaacgctcttgaagaacagctaaaagagcaggaactccgagcctgcgaaatggtcttggaggaaacacgcagacagaaagagttgctgtgcaagatggagagggaaaagtctattgagattgaaaatctgcagaccagattgcagcaactcgatgaagagaacagtgaactccgttcatgcactccatgtctgaaagccaacatagagcgcctggaagaagaaaaacagaaactattggacgagattgaatccctgaccttgaggttatccgaggaacaagagaacaagcgtcgcatgggcgacagactctcacacgagcgccatcagtttcagagagataaggaggcaacacaggagcttatcgaagatctcaggaaacagttagaacacctgcaactgctgaagttagaggccgaacagcgtcgcggccgtagtagcagtatgggtctacaggagtatcattctcgagcccgggaaagcgagctggagcaggaggtcaggagactgaagcaagacaatcggaacctgaaggagcagaacgaagagttgaacgggcagatcataactctcagtatccagggagcgaagtccttattctctaccgccttttctgagtccctggcagccgagatctccagtgtgtctagagatgagttgatggaggcaatccagaagcaggaggagatcaattttagactgcaggactatatagaccgcattatcgtggctatcatggagacaaacccgtccattcttgaggtgaagtag

SEQ ID NO: 131434 - DNA, 1383 bp, Artificial Sequence
  Description of Artificial Sequence: Synthetic coding sequence
atgccatttctgaaggcaaacgaggtgacggatagcgcatacatggggtctgagtcaacgtactcggagtgtgagacattcaccgatgaggacacttcgaccctcgtccaccctgagctgcagccagaaggcgacgcagactcagcggggggcagtgcagttccttctgaatgcctagacgccatggaggagcccgatcatggcgccctgctcctgttacccggtcgaccccaccctcacgggcaaagtgtgattaccgtgataggcggagaagagcattttgaggattatggcgagggaagtgaggccgagctgtcacccgagactctgtgtaacggccagttaggatgtagcgatccagcttttctgacgcccagtccaacaaaacgcctaagctctaagaaagtggcgcgttacctacaccagtcaggggccctgaccatggaggccctggaggatcctagcccggagttaatggaaggccctgaggaggacatcgccgacaaggtggtgttcctggaacggcgtgtgctcgagcttgagaaagatactgcagccacgggagagcagcatagcagattaagacaggagaacctgcaactggtgcaccgagccaacgcactggaggagcaactgaaagaacaagagctcagggcatgtgagatggtccttgaagaaacacggcgccaaaaggagttgttatgtaagatggagagggaaaaatcgatcgagatcgagaatttacagactcgtttgcagcagctggatgaggagaattcagaacttcggtcctgcacaccgtgtctgaaggctaatattgagcggctggaggaagagaagcagaagctgcttgacgagatcgagagtctgactctgcggctatctgaggaacaggaaaataagcggagaatgggtgaccggctgagccatgagcgccaccaattccagcgagataaggaggccactcaagaactgatagaagatctgcgcaaacagttggagcacctgcagctgctcaagttagaggccgaacagcgtaggggtcggagttccagtatgggattgcaggagtaccatagccgtgccagggagagcgaattagaacaggaagtgcggaggctgaagcaggacaataggaatctgaaagaacagaacgaagagctcaacggacagataatcacactgtccatacagggggccaagagcttattctctacagccttctcagagtccctcgccgctgaaatatcatctgtcagccgagacgagttaatggaggcaatccaaaagcaggaggaaattaattttcgtctgcaggattacatagaccggatcattgttgccataatggaaacaaatcctagcattctggaagtcaagtag

SEQ ID NO: 131435 - DNA, 549 bp, Artificial Sequence
  Description of Artificial Sequence: Synthetic coding sequence
atgggatcggaaagcacttactcagagtgcgagaccttcactgacgaagacaccagcaccctggtccatcctgaactccagcctgagggagacgccgactctgccgggggctctgctgtaccttcagagtgccttgacgcaatggaggagccagaccacggcgcgctgctacttctgccaggtcgccctcacccccatgggcagtcagtaatcaccgttataggcggggaagagcacttcgaagattacggagaagggtctgaagccgagctgagtccggagacgttgtgtaacggccagctaggctgcagcgacccagcttttttgacgccgtctcctacaaagcggctgtcctctaagaaagtcgctcggtatctccatcaatcgggtgctctgactatggaggcgttagaagatccaagcccagaactaatggagggccctgaagaagacattgcagacaaagtggtgttcctcgagaggcgtgtgttggagctggaaaaagatactgcagctactggagaacaacattctagactcagacagtag

SEQ ID NO: 131436 - DNA, 2406 bp, Artificial Sequence
  Description of Artificial Sequence: Synthetic coding sequence
atggccagtgctccaccagccagcccgcccggttcagaacctccaggtcctgaccccgaacctggcggtccggacggtcctggtgctgcacaattggcgcctggtccagctgaattaaggctgggtgcacccgttggcgggccagatccccagtcaccaggtctagacgagccagctcctggagcagcggcagacgggggggctaggtggagtgctgggcccgcacctgggttagaaggcggacctagagatcctggaccatctgcccccccaccccgcagtggtcctagagggcagctggcttccccagacgcaccaggccctgggcctagatctgaggccccactacctgagctggatccgctttttagttggactgaagaacccgaggaatgcgggcctgcgtcctgtccggagagcgcccccttccggctgcaaggttcctcatcgtctcacagggcacggggggaggtggatgtcttcagcccatttccagccccaactgctggagaattggccttggagcagggccctggcagtccaccacagcctagcgacttatcccagactcatcctttgccaagcgagcctgtaggatcacaagaagacggcccgcgactcagggcggtttttgacgcactcgatggtgatggtgacggttttgtgagaattgaggacttcatccagttcgccactgtgtacggagcagagcaggtaaaggacctgaccaagtacttggacccaagtggcctcggggtgatcagttttgaagacttttaccaaggtattactgcgatacgcaatggcgaccccgacggacagtgctatggtggggttgccagtgcccaggacgaggagcccttggcgtgccctgacgaatttgacgatttcgtgacttatgaagccaatgaggtgacggacagtgcttacatggggtccgagtcaacgtactctgagtgcgagacttttaccgatgaggatacctcaaccctcgtccaccctgagctgcagccagagggtgacgccgactctgcaggcggatctgctgtgccgagcgaatgtctggatgccatggaggagcctgatcacggtgccctcctcttgctgcctgggcgccctcatccccatgggcagtccgtcataaccgtgatcgggggcgaagaacattttgaggattatggagaggggtctgaagctgagctgtcccccgaaacattatgtaacggtcagctaggctgctctgacccggcatttctcaccccctcaacagaccccctggctgccaaactgcacagcattctcacagatgaggcgttcgagttttattgcagtcagtgtcataaacaaattaatcgcttagaggacctttccgcccggttgtccgatttggaaatgaattctccgaccaaaagattgtcttctaagaaagtcgcgcggtacctccatcagtccggcgcgctcactatggaggccttggaagatccttcaccggagctgatggaaggaccagaggaagacatagcggataaggttgtgttcctcgaaagaagagttcttgagctggaaaaggatacagcagccacaggggagcagcatagccgactccgtcaagagaatctacagctggttcaccgggccaatgccctggaagaacagctgaaagagcaggagttacgagcttgcgagatggtgttagaggaaaccaggcggcagaaagagctgctctgcaaaatggaacgggagaagtctatcgaaatcgaaaatttacaaacgaggctgcagcaactggacgaggaaaactccgaactcagaagttgtaccccctgcttgaaggcaaatattgagagattggaagaggagaagcagaaactgctcgatgaaattgagagcctcactctcaggctttccgaggagcaggagaataagcggcggatgggcgaccggttatcccatgagcgccatcagtttcagcgggataaagaggccactcaagagctcatcgaggatctgagaaaacaactggaacacctgcagctcctgaaattagaagccgagcagaggcgcggaaggtctagctccatgggcttgcaagaatatcattccagagctcgggagagtgagctcgaacaggaggtgagacgcctgaaacaggacaatcgcaacctgaaagagcagaatgaggagctaaacggacagattatcacactgtccattcagggggccaagtctctattcagcaccgcgttttctgagtcgcttgcagcggagatctcatctgtgtcgagggacgagctgatggaagcgatccaaaagcaggaagaaattaactttagactgcaggactacattgatagaattattgtggcaatcatggaaacgaaccccagcattctggaggtgaagtag

SEQ ID NO: 131437 - DNA, 1914 bp, Artificial Sequence
  Description of Artificial Sequence: Synthetic coding sequence
atggcaggcggggcaggctggagtggggcaccggcagccctgctccggagtgtgaggcgtctgcgcgaagtgttcgaggtgtgtggccgggacccagatggcttcctgcgggtagaaagggtggcggctttgggacttcgtttcggacaaggagaggaagtggaaaagctcgtgaaatacttggatcctaatgaccttgggcgaatcaattttaaggatttttgccgcggtgtcttcgcaatgaagggctgtgaggaactgctgaaggacgtactgtccgtggaatctgccggaacactgccttgcgcccctgaaattcccgattgcgttgaacaagggagtgaagtgactggaccaacatttgcagatggcgagctgattccgcgggagccgggtttcttccctgaggatgaagaagaggcgatgacattggctccccccgagggccctcaggaactgtacactgattctcccatggagtctactcagagtctggagggctctgtgggatctccagccgagaaggacggaggactgggcggcctgtttctgcctgaggataagtccttagtccatacaccctcaatgaccacgtcagacctgtcaacacacagtacaacttctctgataagcaacgaagaacaattcgaggattatggagaaggtgatgatgtggactgcgccccatcaagcccttgccccgacgatgaaactagaaccaatgtttactccgacctgggaagctccgtgtccagcagcgccggacaaacaccccggaagatgagacatgtgtacaacagcgagctgctagacgtctattgctcacagtgctgtaagaaaatcaatctcctgaatgatctcgaagcccgcctgaaaaacctaaaggccaactctcctaaccggaaaatttcttctacagccttcggcagacaactcatgcactccagcaacttttcctcctcgaatgggtctactgaggatctgtttcgagacagcattgactcctgcgataacgatattacggaaaaggtgtcatttctggagaagaaggtgaccgagctggagaatgacagcctgaccaatggcgatttgaagtccaagttgaagcaagagaatacacagctcgtccaccgagtgcacgagctcgaggagatggtgaaggaccaagaaacaacggctgagcaggccttagaggaggaggctagaaggcaccgtgaggcctacggaaagcttgagagagaaaaggcaaccgaggttgagcttctgaatgcccgagtacagcagcttgaagaggaaaacacagagctgagaacgacagtgacacgcttaaagtctcaaaccgagaagttggatgaggagcggcagcggatgtccgataggctcgaagatacctcactacgcctcaaggatgagatggatctgtacaaacgaatgatggataaattacgacagaaccgccttgagtttcagaaggagcgagaagctacgcaagaactcatagaggatctccgcaaagagctggagcacttacagatgtataaactagactgtgaacggcccggtcgtggacgctctgcttcctcagggctgggagagttcaacgcacgcgccagagaggttgaactggaacatgaggtcaagcggctcaaacaggaaaactacaagttgcgggaccagaatgatgacttgaacgggcagattttgtctctcagtctctacgaggcgaaaaatctcttcgctgcccagacaaaggcccaaagcctggccgccgaaattgacacagcttccagagatgagctgatggaggcactgaaagagcaagaggaaattaacttcaggttacggcagtacatggataagattatcctagccatcctggatcacaatccatccattctcgagatcaaacattag

SEQ ID NO: 131438 - DNA, 1914 bp, Artificial Sequence
  Description of Artificial Sequence: Synthetic coding sequence
atggcaggcggcgccggttggagcggtgcccccgccgcactcctgcggagtgtgcggaggctgcgggaggtctttgaagtttgcgggcgagaccctgacggctttctgcgggtcgaacgagtagccgccctagggctgcggtttggtcagggggaggaagtggagaaattggttaaatacctggatcccaacgatctgggtaggatcaacttcaaggacttttgtcgcggagtttttgcaatgaaaggatgcgaggagctcctgaaggatgtcctgtcagtggagagcgccggaacgctgccttgtgcgccggagatacccgactgcgtcgaacagggttccgaagtgaccggaccgacatttgcagacggagagcttatacctcgagagccggggttttttccagaggacgaagaagaggctatgaccctggctccccccgaaggccctcaggagctctacaccgactcacccatggagtcaacacagagtctggaggggtctgttgggtctccagcggagaaagacggggggctgggaggcctgttcctgccagaagacaaaagcctcgtacatacgccctccatgacgacgtctgacttatcaacacactccacaaccagcctcatttccaatgaggagcaatttgaagattacggcgagggtgatgatgtggactgcgcacctagcagcccctgccccgacgacgagacgaggaccaacgtgtattcggatctcggaagctccgtttcgagcagtgcaggccaaacgcctcggaagatgcggcatgtctacaacagcgaactgctggatgtctactgctctcagtgctgtaagaaaattaatcttctaaacgatctagaggcgcgcctcaaaaatctgaaagcaaatagcccgaacaggaaaatcagcagcaccgcatttggtcgtcaactgatgcattcttcaaattttagttcctccaacggaagcacggaagatctgtttcgcgacagcatagactcatgcgataacgatattaccgaaaaagtttcctttctggagaagaaggtcacagaattggagaatgactctctgaccaatggagacctcaagtccaagctgaagcaggagaacacccaattggtgcatcgggtccacgaactggaagagatggtgaaagaccaagaaacaaccgctgagcaggcccttgaggaagaggcccgccgacacagagaagcatatgggaagctggaacgggaaaaggccacagaggtagaactactcaacgcccgcgttcagcagctggaggaagaaaacacggaactgcgtactactgtgacgcggctcaagagtcagaccgagaaacttgatgaggagcgccagaggatgagcgacaggcttgaagatacttcactcagactgaaagacgagatggacctttataagaggatgatggacaagctgcgacagaaccggctcgaatttcaaaaggagagagaggctactcaggaactaatcgaggatttgagaaaagagctcgagcatctgcagatgtataaactggactgtgaacggcccggtagggggaggtcagcctccagtggacttggggagttcaatgcacgggccagggaggttgagttagagcatgaggtcaaacgcctgaaacaagagaattataagttgcgggatcagaacgatgaccttaacggccaaatcctgagtctgagtctttacgaggcgaaaaacttgttcgccgcccagaccaaagcccaaagcctagctgcggaaatcgatacggctagccgggacgagcttatggaagctttgaaggaacaggaagagattaacttccggctgagacagtacatggacaaaataattctggccattttggaccacaacccttcaatactggaaatcaaacactag

SEQ ID NO: 131439 - DNA, 651 bp, Artificial Sequence
  Description of Artificial Sequence: Synthetic coding sequence
atgggaactagagatgatgagtacgattacctctttaaagtggttctgataggggatagtggcgtgggcaagagcaatttactttccaggtttaccagaaacgaattcaacctagagagtaagtccacaattggtgtggagttcgccaccaggtcaatccaagtggacggaaagacaatcaaagcccagatctgggataccgccgggcaggagaggtatcgcgcgatcacatcagcatattatagaggtgccgtcggagccctgctggtatacgacatcgccaagcatctgacgtatgaaaacgtagagcggtggctcaaagaattgagggaccacgcggatagcaatatcgtcatcatgctggtcggtaacaagtcagatctccggcacctccgtgccgtccccacagacgaagcccgcgcctttgccgaaaagaatggcctctcgtttattgaaactagcgcattggactccacgaacgttgaggcagccttccaaacgattttaaccgagatttatagaattgtcagccagaagcagatgtccgatagacgggaaaatgatatgagcccatcaaataatgttgtacctatccacgtccctccgaccactgagaacaaaccaaaggtgcagtgctgccagaacatttag

SEQ ID NO: 131440 - DNA, 468 bp, Artificial Sequence
  Description of Artificial Sequence: Synthetic coding sequence
atggggactcgtgacgacgagtatgactacctgtttaaggtagtgctgattggtgactcgggagtggggaagtccaatctgctgagtcggtttaccagaaacgaatttaatcttgagtcaaagtcgactatcggcgtcgagttcgccaccagatccatccaggtagatggcaagactatcaaagcacaaatttgggatactgcgggccaggagagatatagggctattactagtgcctattatcggggggccgtgggagcactgttggtttatgatattgccaagcacttgacctatgaaaatgtggaacgttggcttaaagaactgcgtgaccatgctgattctaatatagtgattatgctcgtgggcaataaaagtgacctgcgccatctgcgcgcagttccaaccgatgaggcccgggcgtttgctggatataacaaggcgaatgtccgacaaacaaggaaatag

SEQ ID NO: 131441 - DNA, 612 bp, Artificial Sequence
  Description of Artificial Sequence: Synthetic coding sequence
atggcgaaggcttacgaccacctgttcaagctgctgctgatcggggatagcggcgtaggaaagacatgtctgataataagatttgccgaggataatttcaacaacacgtacatatccactattgggattgatttcaagattcgcacagtggacattgaaggtaaaaagatcaagctgcaggtctgggatacggccgggcaggagcggttcaagaccattaccactgcttactatcgtggcgcaatgggaattatattagtctacgatataactgatgagaaaagcttcgaaaatattcagaactggatgaaaagtattaaagagaacgcatcagccggggtggaacggctgctcctcggtaacaagtgcgacatggaagccaagaggaaagtccagaaggagcaagcagataaactcgctagggaacacggcattaggtttttcgagacatctgctaaaagttccatgaatgtggatgaggcgttcagtagtttggcgagggatatactactgaaatcgggcggacgcagatcgggcaacgggaacaagccgcccagtactgacctcaaaacatgcgataagaagaataccaataaatgtagcctgggatag

SEQ ID NO: 131442 - DNA, 648 bp, Artificial Sequence
  Description of Artificial Sequence: Synthetic coding sequence
atggccactgccccctacaactattcttacatattcaagtatataattataggtgacatgggcgtggggaagtcttgcctgttgcaccagttcaccgagaagaaattcatggctgattgccctcacaccatcggtgttgagtttgggacccggatcattgaggtgagtggccagaagatcaagctgcagatttgggataccgccggtcaggagaggttccgcgcggttactaggtcctattacagaggggctgctggggctctcatggtctatgatatcaccaggcggagcacatacaaccatctctctagttggttgaccgacgctcggaacctgaccaatcctaatacagtcattatcctaataggaaataaagcagacttagaggcacaaagagacgtgacatacgaagaagccaaacagttcgctgaagaaaatggcctgttgttcctggaggccagcgcaaagactggagaaaacgtggaagacgccttcctggaggccgctaaaaagatatatcaaaatatccaagacggctccctggatttgaacgccgccgagtccggggtgcaacataaaccttccgccccacagggaggaaggctgacaagcgagccccagccccaacgcgagggttgcggctgctag

SEQ ID NO: 131443 - DNA, 546 bp, Artificial Sequence
  Description of Artificial Sequence: Synthetic coding sequence
atggccactgcgccgtacaactactcatacatcttcaaatacataatcatcggggatatgggggtcggtaaaagctgtttgcttcaccagtttactgagaaaaaattcatggccgactgtcctcataccattggggtggaatttggcacacggatcatcgaggtaagcggacagaagataaagctccagatatgggacacagccggacaggagcgctttagggccgtgactcgctcctactatcgcggcgcagccggggccttaatggtgtatgatataactcggcgctctacgtataaccatctgagtagttggctcaccgatgcacggaacctcacaaacccgaatacggtgatcatcctgatcggcaacaaggctgatctcgaggcccagagggacgtcacatatgaagaggctaagcaattcgctgaagagaatgggctcctgttcctcgaggctagcgctaagacaggagagaatgtagaagatgccttcttagaggccgccaaaaaaatataccagaacatacaggatggcagtctgtag

SEQ ID NO: 131444 - DNA, 711 bp, Artificial Sequence
  Description of Artificial Sequence: Synthetic coding sequence
atgggccagaaagcctctcagcagctggcgttgaaggattcaaaagaagtgcctgtggtgtgtgaggttgttagtgaagcaattgtccacgctgcccaaaagctaaaggagtacctagggtttgaatacccgccctctaaactgtgcccagcagccaatacactgaatgaaatcttcttaatccacttcatcactttttgccaagagaaaggggtggatgaatggctgactacaacaaagatgacaaaacatcaggccttcttattcggagccgattggatttggaccttttggggctcaaataagcagattaagctgcaactggccgtgcaaacccttcagatgagcagccccccgcccgtcgagagtaaaccatgcgacctcagtaatcctgagagccgcgttgaagagtcttcctggaagaaatcgcgcttcgataagctggaagaattttgcaacttgatcggcgaggactgtctcggactcttcatcatctttgggatgcccggcaaacctaaagacattaggggcgtagtgctggattcggtcaagtcccagatggttcgatctcatctgccaggtggcaaagccgttgcccaatttgtcctagaaacagaagattgtgttttcatcaaggagcttcttcgaaattgcctttcaaagaaagacgggctgcgcgaggtggggaaagtttatatcagtattctctag

SEQ ID NO: 131445 - DNA, 639 bp, Artificial Sequence
  Description of Artificial Sequence: Synthetic coding sequence
atggcccaagcccatcgcacccctcagccccgcgctgccccgagccagcctcgggtttttaaactggtgctcttgggtagtggatcagtgggcaaatcctcgctggctctgcggtatgtgaagaatgattttaagtctatccttccgacggtgggatgcgctttctttaccaaagtggtggacgtgggcgctacctcacttaagctagaaatttgggataccgcggggcaggaaaagtaccatagcgtatgtcacctctacttcagaggcgctaacgccgctctgctggtttatgatatcactcgcaaagattcattcttaaaggcccaacagtggctcaaagacttggaagaggagctgcaccccggggaggtcctagtgatgctggttggaaacaagactgatctgagtcaggaacgagaagtaactttccaggaaggtaaggagtttgctgactcccaaaagctgctatttatggaaacctccgcaaagttgaatcaccaggtgagtgaggtgttcaacacagtcgcgcaggagctgttgcagaggtctgacgaagaggggcaggcattacgcggagacgctgccgtggccttgaacaaaggacccgcgagacaagcgaagtgctgtgctcactag

SEQ ID NO: 131446 - DNA, 258 bp, Artificial Sequence
  Description of Artificial Sequence: Synthetic coding sequence
atgctagttggaaataaaacagacctctcacaagagcgcgaggtcacctttcaggagggaaaagaattcgcagactcacagaaattactgtttatggagacctctgcaaaactgaaccatcaagtgtctgaggttttcaacactgtagcgcaggagctactgcaaagaagcgacgaggaggggcaagctttgcgaggcgatgccgcagttgcactgaacaaaggccctgctcgccaggctaagtgctgcgcccattag

SEQ ID NO: 131447 - DNA, 621 bp, Artificial Sequence
  Description of Artificial Sequence: Synthetic coding sequence
atggatgaggacgttctcactacccttaagattctgatcataggtgaaagtggcgtgggaaagtcctcgctattgctacgtttcacagatgacacgttcgaccctgaactggctgccactatcggagttgacttcaaagtgaagacaatcagtgtcgacgggaataaggccaagctggccatctgggacaccgccggccaggaacgcttcaggactctaacccctagctactacaggggcgcacaaggcgtgatcctagtgtatgatgtgaccaggcgtgacacctttgtaaagctggataattggcttaacgaactcgagacctattgtactcggaacgatattgtcaatatgttggtgggcaataaaattgataaagagaatcgtgaggtggacagaaatgaaggactgaagtttgcccgcaaacatagcatgttgtttattgaggcttcagccaagacatgcgatggcgtccagtgcgcctttgaagagctggtggaaaagatcatccagacccctggcctgtgggaatctgagaaccagaacaaaggtgtgaaactgtctcaccgggaagagggccagggcggcggggcgtgcgggggctactgctcggttttgtag

SEQ ID NO: 131448 - DNA, 486 bp, Artificial Sequence
  Description of Artificial Sequence: Synthetic coding sequence
atggatgaagacgttctgacaactctaaagatcttaattatcggggagagcggtgttggtaagtcatccctgctgctgcgctttaccgacgacacatttgaccccgagctggctgctactattgtgtatgatgtgactcgccgcgacacattcgtgaaactcgacaactggctgaatgaactcgagacctactgtacccgcaacgatatcgtgaacatgcttgtagggaataaaattgacaaggagaaccgagaggtggataggaacgagggcctcaagtttgcgagaaaacactcaatgctcttcattgaagccagcgccaagacatgcgatggcgttcagtgtgctttcgaggagctcgtcgagaaaattatccagaccccggggctgtgggaaagcgagaaccagaataaaggggtgaagctgtctcatagggaagaagggcaaggggggggtgcatgcggtggctattgctccgttctgtag

SEQ ID NO: 131449 - DNA, 876 bp, Artificial Sequence
  Description of Artificial Sequence: Synthetic coding sequence
tgacggttgccaggctcacgccctctgcctggcccaagcagcctcgggagaagcccctcttgttctgccgaaaaaacccccttccggggcccacctcttggtcgtcagtccgctgtgaaggagctggacttagtaacagcaggcaagtttcggttcagtgtgcgctccgaatgtttcagtcgggggccgcctctgaagatcaagtgtaattgctacttttctttttgccacatcctttggagacagaaaatctctgtggtgctgtcattctttaccttttccttgggcaaaatcatcctgacggttgagctctctatatcgctgttactcaggtttaccgacgatactttcgatccggaactggctgcaaccatcggcgtagacttcaaagttaaaactattagtgtagatggtaacaaggcgaaacttgccatctgggtgactctgcaccagcaaaccgccaactttttcctcaaaagtcagatcggaaattctccgatcctgaaatgggccatgtggcagtatgatactgccgggcaagagcgatttcggacacttactcctagttactacaggggcgctcaaggcgttatcctggtgtatgacgttacgaggcgggacacctttgttaagctggacaactggctgaatgagctggagacatattgcactagaaacgatatcgtgaacatgctggttggcaataagattgacaaagagaacagagaggtggatagaaatgagggtttaaagttcgctcgtaaacattcaatgttgttcatcgaggcaagcgcaaagacctgtgacggcgttcaatgcgcattcgaggaacttgttgaaaagatcatacagacccccggactgtgggaatcttag

SEQ ID NO: 131450 - DNA, 429 bp, Artificial Sequence
  Description of Artificial Sequence: Synthetic coding sequence
atggacgaggatgtcctaacaaccttaaagattctcatcattggggaaagcggggtcggaaagtcatcactcttgctgagatttactgatgacacattcgatcctgagctggccgcaaccataggggtggatttcaaagtgaaaactatctccgtcgacggaaataaagcaaagctggcgatctgggaaaatcgggaagttgaccgaaacgagggtctgaagtttgcccgcaaacatagcatgctgtttattgaagcttcagcaaagacgtgcgatggggtgcagtgtgctttcgaagaactggtggagaaaattattcagacacccgggctttgggaatccgagaatcagaataaaggcgtgaaattgagccaccgagaggagggccagggaggcggagcttgtggcggatactgttctgtcctgtag

SEQ ID NO: 131451 - DNA, 555 bp, Artificial Sequence
  Description of Artificial Sequence: Synthetic coding sequence
atggatgaggacgtgcttacaaccttgaaaatcctgatcatcggtgagtctggtgtgggcaaaagctcactccttctaaggtttacagatgacactttcgaccctgaactggcagcgactgacactgctggacaggagcgtttccgaaccttgacaccatcctattacagaggcgcacaaggggtgattttggtatacgatgtcaccaggagagatacctttgttaaacttgacaattggttgaatgagctggaaacctactgtacacggaatgacatcgtgaacatgctcgttggaaataaaattgataaagagaaccgggaggttgatcgcaatgagggtttaaagtttgcgagaaaacacagcatgctgttcatcgaggcgagcgccaagacctgtgatggcgtccagtgcgcattcgaggaattagtagagaagatcattcagactcctggcctgtgggagagcgaaaatcagaacaagggcgtgaagctaagccacagagaggagggacaggggggcggggcatgcggcgggtactgttccgtcctgtag

SEQ ID NO: 131452 - DNA, 390 bp, Artificial Sequence
  Description of Artificial Sequence: Synthetic coding sequence
atgagttcaatgaatcccgagtatgactacctgtttaaattactcctcataggggacagcggcgtaggaaagtcttgtctgctgctgcggttcgccgacgatacatacacagaaagctatatcagcacgataggagttgattttaagatacgcacaatcgaacttgacggtaagaccataaagttgcagatcgaatttgctgattccttgggtatacctttccttgagacttcggcaaaaaatgcgactaacgtggaacagtcttttatgaccatggccgctgagatcaagaaacgcatgggacccggagccactgctggcggagcggaaaaaagcaatgttaaaattcagtcaaccccagtgaaacagagtggggggggctgctgttag

SEQ ID NO: 131453 - DNA, 390 bp, Artificial Sequence
  Description of Artificial Sequence: Synthetic coding sequence
atgtcctgcctccatcctaccagcgactatctcttcaaactgttactcatcggagacagcggcgtcgggaagtcttgtctgttactcagattcgcagatgatacctacactgaaagctacatttcaacaatcggcgtggactttaagatccggaccattgaattagatggtaagacgatcaagctgcaaatcgagttcgcggactctcttgggattccatttctcgaaactagcgccaagaatgccacaaacgttgaacagtccttcatgacaatggctgcagagataaagaaacgtatggggcccggggccacagctggcggcgccgaaaaatccaacgtgaagattcagtctacacctgttaagcagtcggggggaggatgctgttag

SEQ ID NO: 131454 - DNA, 522 bp, Artificial Sequence
  Description of Artificial Sequence: Synthetic coding sequence
atgagctccatgaatccggagtacgactatttgtttaaacttcttcttattggagacagcggcgttggcaagagctgcctgctcctccgctttgctgatgatacctacacagagagttacatcagtacaattggcgttgacttcaaaattagaactatcgagctggacggtaagactattaagctacagatagagtcatttaataatgtgaaacagtggctacaggagattgacagatatgcaagcgagaatgttaataagctattggtcgggaataagtgcgacctgaccactaagaaggtggtcgattacacaactgcaaaagagtttgctgattcactggggattcctttcctggaaacctcagccaaaaacgcgacaaatgtggagcagtcctttatgaccatggccgccgaaattaagaaaagaatgggacccggagccaccgccggaggcgcagagaagagtaatgtgaagatacaatccacccccgtcaagcagtcaggcggagggtgctgctag

SEQ ID NO: 131455 - DNA, 522 bp, Artificial Sequence
  Description of Artificial Sequence: Synthetic coding sequence
atgagtagcatgaatccagagtacgattacctgttcaaactgttgctcattggcgactccggcgtgggaaagagctgtctcttgcttagattcgcatgggacaccgctggtcaggaacgattcaggacaatcacttccagttactatcgcggcgcccacgggatcatcgtggtttatgatgtgactgaccaggagtcatttaataacgtgaagcaatggctgcaggaaatagaccggtatgcctctgagaatgttaacaagctactcgtggggaataagtgcgatctgactacaaagaaggtggtggactacacaactgcaaaagagttcgccgattctctcggcattcccttcctcgaaacaagcgctaaaaatgcgaccaatgtggaacagtcattcatgaccatggcggccgagattaaaaaacgcatggggcccggcgccacggctggaggtgccgagaaatctaatgtgaagatacaaagtactccggtgaaacagtcgggaggagggtgctgttag

SEQ ID NO: 131456 - DNA, 618 bp, Artificial Sequence
  Description of Artificial Sequence: Synthetic coding sequence
atgtcctctatgaatcctgaatatgattaccttttcaaacttctgctgatcggtgactccggagttgggaaatcctgtttactgctgcggttcgctgacgatacctatacagagtcatacatcagtaccattggagtggatttcaagatcaggactattgagctggacggaaagacaatcaaactccagatttgggacaccgcaggtcaagagagattcagaaccatcacttcatcttattacagaggagctcacggaatcatcgtcgtatacgatgttaccgatcaggagtccttcaacaatgtaaagcaatggctgcaggaaattgatcgatacgcctcagaaaatgtcaacaagctgctagtcggtaataagtgcgacctcactaccaagaaggtggtggactatactacagccaaggagttcgcagactccctggggattccttttctggagacatcggccaagaacgccaccaacgtcgagcagtcgttcatgaccatggccgctgagattaaaaagagaatgggacccggggccacggcaggaggcgcggaaaagtccaacgtgaagattcagtccaccccagtgaagcagagcggtggcggatgttgttag

SEQ ID NO: 131457 - DNA, 426 bp, Artificial Sequence
  Description of Artificial Sequence: Synthetic coding sequence
atgagctccatgaatccagagtatgactacctgttcaaactgttacttataggagactcaggtgtgggtaagagctgtctactccttcgcttcgctgaatcatttaataatgtgaagcagtggctgcaggagatagatcgttacgccagcgaaaacgttaataaattgcttgttgggaataagtgcgacctgaccaccaaaaaggtggttgactacacaacagcaaaagagtttgccgacagcttaggcattcccttcttggaaacaagcgctaaaaatgccaccaacgtggaacagagtttcatgaccatggcagccgaaatcaaaaagagaatggggccgggcgctactgccgggggtgccgagaaatcaaacgtgaaaattcagagcacccctgtgaagcagtcaggcggaggatgctgctag

SEQ ID NO: 131458 - DNA, 606 bp, Artificial Sequence
  Description of Artificial Sequence: Synthetic coding sequence
atgaaccccgagtatgactacttgtttaagctcctgctcattggcgacagcggtgtggggaagtcttgcctgcttttacgctttgcagacgacacctacactgaatcctatattagcaccataggagttgatttcaagatccggaccattgagctggatggaaagacaataaaactgcagatctgggatacggccggacaggagaggttcaggaccattacaagctcatattacagaggggcccacggaatcatcgttgtgtacgacgtcacagatcaggaatcatacgcgaacgtaaaacagtggctccaggagatagataggtatgcctccgaaaatgtcaataaattattggtgggcaataagtcagatctgactactaagaaggtcgtcgataacactactgctaaagaattcgctgatagtttgggtatacctttccttgaaacctccgccaagaatgccaccaacgtggagcaggccttcatgactatggcggccgagatcaaaaagcgaatggggcccggcgccgcctcaggcggcgaaaggccaaacttaaaaatcgacagtacacccgtgaaaccggcgggcggaggctgctgctag

SEQ ID NO: 131459 - DNA, 489 bp, Artificial Sequence
  Description of Artificial Sequence: Synthetic coding sequence
atgaatccagaatacgattatctgttcaagcttctgctcatcggagacagcggagtcggaaaaagttgtctgctgttgcggtttgctgacgacacgtatacagaatcttacattagtacaatcggagttgacttcaaaattcgcacaatagagctggacgggaagacaattaaacttcaaatctgggataccgcaggtcaagagcgcttccggaccattaccagctcctattaccggggggcacatgggattatcgtcgtgtatgacgtgaccgaccaggaaagctacgccaatgtcaagcagggctgccgccggctaacggccatgcccgctcggacgtctatttcttcatggtgggcaacgcgtgccaccagcccgcctaggcggtggtggacaactccacaaccacgctcattacagacgctgtgggcctcaccctcatggaggcgggctcccagaatgccacccatgtcttcgcgtagaagttag

SEQ ID NO: 131460 - DNA, 360 bp, Artificial Sequence
  Description of Artificial Sequence: Synthetic coding sequence
atgaacccagagtacgactacctctttaagctacttctgataggagactcgggtgttggtaagagttgcctgctcctgagatttgccgatgacacttacactgaatcatacatatccacgattggggtggatttcaaaataaggaccatcgaactcgatgggaagacgatcaaactgcagatctgggacaccgctggacaagagagatttcgaacaatcacctcatcttattaccggggagcccatggaattatcgttgtctacgacgtgaccgatcaggagagctacgccaatgtcaaacagtggttacaggagatcgaccgatacgctagcgagaacgtaaataagctcctggtgtag

SEQ ID NO: 131461 - DNA, 678 bp, Artificial Sequence
  Description of Artificial Sequence: Synthetic coding sequence
atggcagccgccggcggaggtggcggtggagctgcagcagcaggcagagcctacagctttaaggtagttctactaggcgagggatgcgtagggaagacctccctcgtgcttaggtactgcgagaacaagttcaatgacaaacatattactactcttcaggcatcatttttaacgaagaaactcaatatagggggcaaacgagtgaatctggctatctgggacacggctggccaggagcggttccatgccttagggcccatttattaccgggattctaacggcgctattcttgtgtatgacatcactgacgaggactcttttcagaaggttaagaattgggtcaaagagctgagaaagatgttgggtaatgagatctgtctctgtatcgtgggtaataaaatcgatttggagaaagagcggcacgtatcaatccaagaagccgaaagctacgctgaatctgtgggagcgaagcattaccatacctcggcaaagcagaacaaaggcatcgaagaactctttcttgacttgtgcaaaagaatgattgaaactgcgcaggttgacgagcgggccaaaggcaatggtagttcacagcccggaaccgcaaggcgcggcgtgcagattatcgatgacgagccgcaggcccagacctccggaggcgggtgttgcagtagtgggtag

SEQ ID NO: 131462 - DNA, 585 bp, Artificial Sequence
  Description of Artificial Sequence: Synthetic coding sequence
atggcattacgtgaactgaaagtgtgtctgttgggcgacactggggtgggcaagagcagcattgtctggcgctttgtggaagatagcttcgaccctaacattaaccctactatcggcgcatccttcatgacaaaaaccgtccagtatcagaatgaattgcacaaatttcttatctgggacacagcgggccaggaacggtttcgcgcactggctccgatgtattatagaggctctgccgcggccattatcgtttacgacattacgaaggaagagaccttttccaccctgaagaactgggtgaaagaactgaggcaacatggcccccctaacatcgtggtggccatcgctggaaataaatgtgacttgattgatgtgcgggaagttatggaaagggacgccaaagactacgccgatagtattcatgccattttcgtggagacctccgcaaaaaacgcaatcaacatcaacgaattgttcatagagatttcccggcgaataccgagtaccgatgctaacctgccctccgggggcaaggggttcaaattgcgtagacagccctccgagccaaagcggagttgttgctag

SEQ ID NO: 131463 - DNA, 714 bp, Artificial Sequence
  Description of Artificial Sequence: Synthetic coding sequence
atgctggaggaggacatggaggttgcgattaagatggttgtcgtgggcaatggcgcagtgggcaaatctagtatgatccagcgttactgtaagggtatctttactaaggactataagaagacaataggagtggacttcctggagcgacaaatacaggtcaacgatgaagatgtcaggcttatgctgtgggataccgcaggacaggaagagttcgatgcgataactaaagcatattacagaggggctcaggcatgcgtcttggtattctccaccacagaccgcgagtcttttgaagcagtgtcatcctggcgtgagaaagtggtggccgaggtcggggatatccccacagtgcttgtgcaaaacaaaattgatctgctcgacgactcctgcatcaaaaacgaagaagcagaggccttggcgaaacgactgaagttgcgattctaccggacaagtgtgaaggaagatctgaacgtgaatgaggtctttaagtatttagctgaaaagtatctacagaagctgaaacagcagattgctgaggatcctgaactaacacattctagttctaataaaattggagtgtttaatacctccggaggcagccacagcggacagaacagcggaactctaaacggaggagatgtcattaacctgcgccccaacaagcagagaactaaaaagaatagaaatcccttcagttcatgctctattccatag

SEQ ID NO: 131464 - DNA, 714 bp, Artificial Sequence
  Description of Artificial Sequence: Synthetic coding sequence
atgctggaggaagatatggaggtggcaattaagatggtggttgtggggaatggcgccgttggcaagagctctatgatccagaggtattgcaaggggatctttaccaaggactataagaagaccattggagtggatttccttgagagacagatccaggtgaatgatgaagatgttcgcctgatgctgtgggacactgccggacaggaggaatttgacgctattactaaagcctactaccgaggtgcgcaggcctgcgtcctggtcttctctactacagacagggaaagttttgaggccgtgtcgagttggagagagaaagttgttgcagaagttggagatatacccacggtgctggtacagaacaagattgacttgctggacgattcatgcatcaaaaacgaagaagccgaggctctggctaaacgactcaagctcagattctatcgaacctctgtaaaagaggatctgaatgtgaatgaggtgttcaaatatctggcggagaaatacctgcaaaagctcaaacagcagattgctgaggaccccgaactcacccactcttcttccaataaaatcggcgtttttaacacctctggaggaagccactccgggcagaattctggcacactaaatggcggcgacgtaatcaacctccgcccaaacaaacagagaactaaaaagaataggaatcccttctctagctgcagcatcccctag

SEQ ID NO: 131465 - DNA, 612 bp, Artificial Sequence
  Description of Artificial Sequence: Synthetic coding sequence
atgagcggccagcgcgtcgacgtcaaggtggtgatgctcgggaaagagtatgtgggaaagacgtctctggtggagcggtatgtgcacgaccggttcctggtcgggccttatcagaataccatcggagctgccttcgttgccaaggtgatgtccgtaggcgatcgaacggtcactctgggaatttgggataccgcgggcagtgagcgatacgaagccatgtctcgaatctactatcgtggagccaaggcagccattgtatgctacgacttgaccgattcttcatctttcgagcgagccaaattctgggtgaaagagctacgctctctggaagaagggtgtcaaatctacctgtgcggaactaagagcgacctgctggaggaagatcgacggagacgacgtgtggactttcatgacgtccaagactacgccgataatatcaaagcacagctgtttgagaccagcagtaagacggggcaatctgtggacgagctcttccaaaaagttgccgaggactatgttagcgttgctgccttccaggtgatgacagaggacaagggtgtcgacctcgggcagaagcctaacccatacttttactcttgctgtcatcactag

SEQ ID NO: 131466 - DNA, 612 bp, Artificial Sequence
  Description of Artificial Sequence: Synthetic coding sequence
atgtcaggtcagcgagtagatgtgaaggtggtgatgctgggtaaggagtacgtgggaaaaacctcactggttgaaaggtacgtccacgaccggttcctggtcggcccctaccagaacactatcggcgccgctttcgtggccaaggtaatgtctgtgggcgaccgcacagtgactctggggatttgggacacggccgggtccgaaagatacgaggctatgtcgcggatctattaccggggagcaaaagcagccatcgtgtgttatgacttgaccgactcgtcaagtttcgagcgggccaagttctgggtcaaggagcttcgtagccttgaggagggctgtcagatctatctgtgcgggaccaaatccgatctgctggaagaggataggagaagaaggcgggtggatttccatgacgtgcaagactacgccgacaacattaaagcccagctgttcgaaacatccagtaaaaccggccagtcagtagacgagcttttccaaaaagtggccgaagactatgttagtgtcgcggcgtttcaggtcatgacagaggataagggcgtggacttagggcagaaacccaatccgtatttttacagctgctgccatcattag

SEQ ID NO: 131467 - DNA, 201 bp, Artificial Sequence
  Description of Artificial Sequence: Synthetic coding sequence
atgtccggtcagcgggttgacgtcaaggtggttatgctgggaaaggagtacgtggggaaaacaagccttgttgagcgctatgtgcatgatcgctttctggttggtccctatcagaatactatcggagctgccttcgtagcaaaagtcatgtccgtgggcgacaggaccgttacactgggcatctgggatactgcaggctag

SEQ ID NO: 131468 - DNA, 642 bp, Artificial Sequence
  Description of Artificial Sequence: Synthetic coding sequence
atggggaatggaactgaggaagattacaacttcgtattcaaggtagttctcatcggtgaaagcggagtaggtaaaacgaacctactgtctagattcacccggaatgagttttcccatgattctcgtactacaattggcgttgagttctccaccagaaccgtgatgctggggactgctgcagtcaaggctcagatttgggataccgctggattggaaaggtaccgggccatcactagtgcctattatagaggggcagttggggcgctcctggtgttcgaccttactaaacatcaaacttacgctgtagtggagcggtggcttaaggaactctatgaccacgctgaggccactatagtggtgatgctagtgggtaacaagagtgatcttagccaggccagagaagtcccgacagaggaagcccggatgttcgccgaaaacaatggactactgttcctggaaacgtctgccctggattccacaaacgtggagttggcgttcgagactgtgttgaaggaaattttcgccaaggtaagcaaacagcgtcagaacagcatccggacaaatgcaattacactgggcagtgcgcaggccggccaggagccaggcccaggggaaaaacgtgcttgttgcattagcctctag

SEQ ID NO: 131469 - DNA, 1110 bp, Artificial Sequence
  Description of Artificial Sequence: Synthetic coding sequence
atggaagggtccctggagagggaagcacctgctggagctttggccgctgtactaaagcactcttcaactctgcccccagagtcaacacaggtgcgtggttatgattttaatcgcggagtcaactaccgggcacttttggaagcctttggcaccacggggtttcaagccacgaatttcggtcgggcggtacagcaagtcaacgccatgattgaaaaaaagctagagcccctcagtcaggacgaagatcaacatgcagatctgactcagagcaggcgccctttgacgtcctgtaccatatttctggggtacacatccaacctgatctcatctgggatccgggagacgatccggtacctagtgcagcacaacatggtcgacgtgctcgtgactaccgccggaggggtagaggaagacctcatcaagtgtttggccccgacatatcttggggagtttagcctgcgaggcaaggagctgcgggaaaatggtatcaatcgtattggaaacctgctggtgcctaatgagaattactgtaaattcgaggactggctaatgcccatcctggaccaaatggtcatggagcaaaacacagaaggtgtcaaatggactcctagcaaaatgattgctcgacttgggaaggagattaataatcctgaaagtgtctactactgggctcagaagaatcacatccccgtgttcagccccgctttgactgatggctctttaggtgatatgatcttttttcactcatataaaaatcccggtctcgttctggacatcgttgaagacctccggctgataaatacacaggcaatttttgccaaatgcacaggtatgatcatcctggggggcggggttgtgaaacaccacatagccaatgccaacttgatgagaaatggggcagactatgctgtctacataaataccgcccaggaatttgatggatctgattcaggcgcccggccagacgaagccgtctcttggggcaaaatacgcgtggatgcccagccagttaaggtttatgccgatgcctcactagtctttcccctgctggtggccgaaacattcgctcagaaaatggatgcatttatgcacgagaagaacgaggattag

SEQ ID NO: 131470 - DNA, 573 bp, Artificial Sequence
  Description of Artificial Sequence: Synthetic coding sequence
atgctggtcggagatagcggcgtaggcaaaacctgtctgttggttcgctttaaggacggcgcctttctggcgggaacgttcatttctactgtgggaatcgactttcggaacaaagtcttggatgtcgatggagtgaaggtgaaactgcagatgtgggacaccgccggccaggagagattcagatctgtgacacacgcctactatcgagatgcccatgccctgctgttgttatacgacgttacaaacaaagccagctttgacaatatccaggcttggctgaccgagatccacgagtacgcacagcatgatgttgctctgatgctacttggaaacaaggttgatagtgcccacgaaagagtcgtgaaacgggaagacggtgagaagttggcgaaagaatatgggctcccttttatggaaacttctgctaagactggcctcaacgtggatcttgcctttacagccattgcaaaagaactaaaacagaggtctatgaaggcgccatccgaacccagattcaggctgcacgactacgttaaacgtgagggtcgcggggccagctgttgcaggccgtag

SEQ ID NO: 131471 - DNA, 666 bp, Artificial Sequence
  Description of Artificial Sequence: Synthetic coding sequence
atgagtgacggcgattacgattacctcataaagtttctagctctcggggactcaggcgtcggcaaaacctccgtgctgtaccagtacacagatgggaagttcaactcaaagttcattacgacagttgggattgattttagagagaagcgtgtggtctatagggctagcggacctgacggcgccaccggacggggtcagcgaatccacttgcagttgtgggacaccgcaggacaggagcgatttaggtcactcaccactgccttctttagagatgctatgggattcctattgttatttgaccttactaatgagcagagtttcctcaacgtcagaaactggatctcccaactgcagatgcacgcttattgcgagaatccagatattgtgctctgtgggaataaaagtgacttggaagaccaacgcgtcgtgaaggaggaggaggccattgccctcgccgaaaaatacggcattccatattttgagaccagcgccgctaatggcacgaacatttcgcaagcaatcgagatgctgcttgatcttatcatgaagaggatggagcgctgtgtggataagagctggatcccagagggcgtggtcagatccaacggtcacgcgagcaccgaccagctgagcgaagagaaggagaagggggcctgcggctgctag

SEQ ID NO: 131472 - DNA, 642 bp, Artificial Sequence
  Description of Artificial Sequence: Synthetic coding sequence
atgtcagacggtgactatgattacttgatcaaatttctggctctgggcgactcgggggtgggtaagactagcgttctataccaatatacagacgggaaattcaacagtaagtttattactaccgtagggattgacttcagagaaaaacgcgtagtctatagggcctccggcccagatggcgcgacaggacggggccagcgcatccatcttcagctgtgggacactgccggtcaagaacgcttcaggtccctgactacagctttttttcgagatgccatggggttccttttgctcttcgacctgactaacgagcagagttttctcaatgtacggaattggatttctcagctgcagatgcatgcttattgtgagaaccccgacatcgtgttgtgtgggaataaatccgacctggaagatcagagagtggttaaggaaaagtacggaatcccatactttgaaacatcggccgctaatggcacaaatattagccaggccatcgagatgctcctggacctgattatgaagcggatggagaggtgcgtcgataagtcttggatccccgagggggtggttcgcagtaacgggcatgcaagcaccgaccagctgtccgaagaaaaggagaaaggagcgtgtggatgctag

SEQ ID NO: 131473 - DNA, 666 bp, Artificial Sequence
  Description of Artificial Sequence: Synthetic coding sequence
atgagtgacggggattacgactacttaattaagtttctcgccctgggcgactcaggggtcggcaagacatcagtgctgtatcagtacaccgacggaaagttcaattctaagttcattactactgttggcatagactttcgggaaaagagagttgtgtaccgggcgtcaggtccagatggggccacggggaggggtcagaggatacacctccagctgtgggacaccgccggccaagagcgcttccgatccttgacaacagccttcttccgtgacgccatgggtttcctactccttttcgacctcacaaatgagcagagctttctcaatgtgagaaactggatcagtcagttgcaaatgcacgcgtactgtgaaaaccctgacatcgtgttgtgcggcaacaagtctgacttggaagatcagcgggtggtgaaagaagaagaggcaatcgccctggcagaaaagtacggcataccttacttcgagacatccgctgccaatggaacaaacatttcccaggcgatcgagatgttgctagatctgatcatgaaacggatggaacggtgcgtggataagtcttggattcctgagggtgttgtacgctcaaatggacacgctagtacggaccagctgtcggaggagaaggagaaaggtgcttgcggatgctag

SEQ ID NO: 131474 - DNA, 663 bp, Artificial Sequence
  Description of Artificial Sequence: Synthetic coding sequence
atgagcgactccgaagaggaatcacaagacaggcagctgaagattgttgtgctgggcgatggagcttccggtaaaaccagcctgaccacttgttttgcccaagagacctttggaaaacagtacaagcagactatcggcctcgacttcttcctcaggagaatcacacttccgggaaatctgaacgtgactttgcagatttgggacataggaggccagacgattgggggcaagatgctagacaagtacatctacggtgctcagggggtgctgctggtctatgacatcaccaattaccaatcattcgaaaacttggaggactggtacaccgtggtgaagaaggtgtctgaagaaagtgaaacgcagcctctcgtagcacttgtgggtaacaaaatcgatctggaacatatgcgcacaatcaagccagaaaaacacctacggttctgccaagaaaatgggttcagcagtcactttgttagtgccaaaaccggggattctgtcttcctgtgctttcagaaggtggcggctgaaatcttggggatcaagctcaacaaagctgaaattgaacaatctcagcgcattgtgcgtgcagagatcgtcaaatatcccgaggaggagaaccaacacaccacttccactcagagtaggatttgttcagtccagtag

SEQ ID NO: 131475 - DNA, 666 bp, Artificial Sequence
  Description of Artificial Sequence: Synthetic coding sequence
atgagtgattccgaagaggagtcacaagacagacagctgaagatcgtggtgctgggcgacggagcttcgggcaagacaagtttaactacgtgcttcgcccaggagactttcggcaaacagtacaaacagaccattggcctcgactttttccttcgcagaattacccttcccgggaatcttaatgtgaccctccagatatgggacatcgggggtcagaccatcggggggaagatgctggataaatacatttatggcgcacagggggttttgctcgtttacgacatcaccaactaccagtctttcgaaaacctggaagattggtatactgtggtgaagaaggtttctgaagagagcgagacacaacctctggtggcactggtgggcaacaaaatagacctggagcatatgcggaccatcaagcctgagaaacacttgcggttctgtcaagaaaatggcttcagtagccacttcgtctccgccaagactggggacagcgtttttctctgtttccagaaggtggcagcagagatcctcgggattaagttgaataaggctgagattgaacagtctcagcgtgtggtgaaagctgatatagtgaactacaatcaagagccaatgtcgcgtaccgtgaaccctccacggagtagcatgtgcgcagtgcagtag

SEQ ID NO: 131476 - DNA, 615 bp, Artificial Sequence
  Description of Artificial Sequence: Synthetic coding sequence
atgagtgacagtgaagaagaaagccaggaccggcagctgaaaatcgtggttctgggtgacggcgctagcggcaaaaccagtttgaccacatgttttgctcaggaaaccttcgggaagcagtataagcagaccattggactggatttcttccttcgccgcatcaccctgccaggcaatcttaacgtcacactccaaatatgggatattggcggtcagaccatcggaggcaagatgctggataagtacatatatggagcccaaggtgtactactagtatacgacattaccaactatcagtccttcgaaaatctcgaggattggtatacagtggtgaaaaaagtttcggaagaatctgagacccaaccacttgtggctttggttgggaacaagatagatcttgagcacatgaggaccataaaacccgaaaagcacctgcgcttttgccaggagaatggattttccagccattttgtctcggccaagaccggggatagcgtcttcctctgcttccagaaggtcgcagcggaaatcctgggtattaaactgaacaaggccgagattgagcagagccaaggccattttatcatctttatttcatctacaaacagggaatag

SEQ ID NO: 131477 - DNA, 288 bp, Artificial Sequence
  Description of Artificial Sequence: Synthetic coding sequence
atgtccgattccgaggaggaatcccaggatcggcagctcaagatcgtggtgctcggggacggcgcgtctgggaagacttccctgacaacctgtttcgctcaggagactttcgggaaacagtataaacaaaccattgggttggatttctttcttagacgcatcaccctgcctgggaacctgaatgtgacacttcaaatatgggatatcggcggacagaccatcggaggcaaaatgctggacaaatacatctatggggcacagctgatctggtcgatatgtgaacagtag

SEQ ID NO: 131478 - DNA, 639 bp, Artificial Sequence
  Description of Artificial Sequence: Synthetic coding sequence
atggcatacgcttatttattcaaatacataataattggggatactggtgtcggtaaaagctgtctcctgcttcagttcaccgacaagcgtttccagcccgtgcacgacctgactatcggtgtcgaatttggcgccagaatgatcacgatcgacgggaaacagattaagcttcaaatctgggacacagctgggcaggagtctttccggagcatcactaggagctactaccgaggtgctgccggagctcttctggtttacgatattacgcggcgggatacatttaatcatctgacaacctggctcgaggatgcgcgccagcacagtaattcaaatatggtcatcatgctgataggcaacaagagcgacctggaaagtcgccgggaagtgaagaaggaggagggggaagcctttgcccgagaacacggactgatctttatggagacgtcggccaagaccgccagcaatgtagaagaggctttcatcaacacagctaaggaaatctatgagaagattcaagagggagtcttcgatatcaataacgaagccaacggaatcaagattggaccccagcatgccgcgactaatgctacccatgccggcaaccaggggggacagcaggccggtgggggatgctgttag

SEQ ID NO: 131479 - DNA, 567 bp, Artificial Sequence
  Description of Artificial Sequence: Synthetic coding sequence
atggcttacgcctatctgtttaaatacataattatcggtgatactggcgtcgaatttggggccagaatgatcaccatcgacggcaagcagattaagcttcaaatatgggatacagctggacaggagtctttcagatccataacccgcagttactataggggggccgccggcgctctgttagtatacgacataactcgaagggatactttcaaccacctgacaacgtggctcgaagatgctaggcagcatagcaattccaatatggtgattatgctcataggaaacaaatccgatctggagtctcgaagagaagtcaagaaggaggaaggcgaggcctttgcacgagaacacggccttattttcatggagactagcgccaaaactgcctctaatgtagaagaagcattcatcaacacagcaaaggaaatctacgagaagatacaggagggggtttttgacataaacaatgaggccaatggcattaagatcgggcctcaacacgctgctacaaatgccacccatgctggaaatcagggcggacagcaagccggagggggatgctgctag

SEQ ID NO: 131480 - DNA, 501 bp, Artificial Sequence
  Description of Artificial Sequence: Synthetic coding sequence
atgattactatcgacgggaaacagataaaactgcaaatatgggacaccgcaggccaagaatccttccggagcatcacccgtagttattaccgaggggcagccggagcactgttggtttatgacataaccaggcgagatacatttaatcacctgacaacttggttggaagatgcaaggcaacatagtaacagcaacatggtcatcatgctcatcgggaacaagtctgatcttgaatcccgaagagaggtgaagaaagaggaaggggaagccttcgctagggagcacggccttatctttatggagactagcgccaagactgcatccaacgtcgaggaggcctttataaacactgcgaaagaaatctacgaaaaaatccaggagggggtctttgacattaacaatgaggctaacggaatcaaaattgggccgcagcatgccgctaccaatgccactcacgcgggcaaccaaggcggacagcaggccggtggtggctgttgctag

SEQ ID NO: 131481 - DNA, 630 bp, Artificial Sequence
  Description of Artificial Sequence: Synthetic coding sequence
atgacctatgcttacctcttcaagtatattattatcggtgacactggagtgggcaaatcatgcctgctcctccaatttaccgacaaacgctttcagcctgtgcatgatctgacaatcggagtagagttcggggccagaatggtcaatattgacggtaaacagatcaaactgcagatatgggacacagctggccaggaatcgttcagatctatcacacgatcctactacaggggggcagccggggctctgctggtgtatgacatcactagacgggagacattcaaccacctgacctcttggctggaagatgcccgacagcattcctcgagcaacatggtaataatgttgatcgggaacaaaagcgacctggagagccgaagagatgtaaagagagaagaaggggaggcgttcgctagagaacacggcctgatctttatggaaacatctgccaaaacggcttgcaatgtcgaggaagccttcattaatacagcaaaagaaatttataggaaaatacagcaggggctctttgatgttcataacgaggcgaacggtattaaaattggtccacaacagagtatttccacctccgtgggaccgtctgcatctcagtccgccggacttcaggtctag

SEQ ID NO: 131482 - DNA, 651 bp, Artificial Sequence
  Description of Artificial Sequence: Synthetic coding sequence
atgacatatgcctatctgttcaaatatatcatcatcggcgataccggggtgggtaagtcctgcctgctgttacaattcacagacaaacgttttcaacctgtacacgacctaaccattggggtggagttcggtgctagaatggtgaacatcgacggcaagcagatcaagctgcagatctgggatacagctgggcaggaatcattccgttccataacaagatcgtactaccgcggggctgcaggtgcacttcttgtgtatgacattacccgacgggagacctttaatcacctgacaagctggctcgaagatgccagacaacacagttcctcaaacatggtgataatgctcattggaaataaatctgatttggagtcgagacgcgatgtgaaacgggaggagggagaggccttcgctagagaacatggcctaatttttatggagacgagcgccaaaaccgcgtgcaatgtggaagaggcctttatcaacactgcaaaggaaatctaccgaaagatccagcagggtctgttcgacgtccacaacgaagcaaacggcatcaaaataggaccacaacagagcattagcacatctgtcggaccatcagccagccagaggaactcaagagacatcggtagcaactccggctgctgctag

SEQ ID NO: 131483 - DNA, 189 bp, Artificial Sequence
  Description of Artificial Sequence: Synthetic coding sequence
atgacctatgcatatctttttaagtacattataatcggcgacactggggtaggcaaatcctgcctcctattacagtttactgacaagaggtttcagccagtccatgacctcacaattggagtggagtttggagcacgcatggtgaacattgatggcaagcagatcaagttgcagatttgggacacctag

SEQ ID NO: 131484 - DNA, 2946 bp, Artificial Sequence
  Description of Artificial Sequence: Synthetic coding sequence
atggccgccgacagcgagccagagtcggaggtctttgagattactgattttaccactgctagcgaatgggagcgctttatctccaaggtcgaggaggtcctcaatgactggaagttgattggcaattcactgggcaaacctttagaaaagggaattttcactagcgggacatgggaagagaagtcagacgaaatttcattcgcggacttcaaattttctgttacccaccactacctggtccaagaaagcacagacaaggagggcaaagacgaactgctcgaagacgtagtaccacaatcaatgcaagacctgctgggtatgaacaacgattttcctccgcgtgcgcattgcctggtgaggtggtacggcttaagagaatttgttgttatcgctcccgccgcacattcagacgccgttctctcagagtccaaatgtaacctcctgctgagcagcgtcagcatcgctctgggaaataccgggtgccaagtgccactgtttgtgcagattcatcataaatggcggaggatgtatgtcggagaatgccagggaccaggagtacggaccgactttgaaatggtacacctgagaaaagtgcctaatcagtatactcatctgtctgggctgctggacatcttcaagagtaagattggttgccccctgactcctctcccccccgtgtcaatcgcaatccggtttacttatgtgctgcaggattggcaacaatacttttggcctcaacagccaccagatatcgatgcactggttggcggagaggtgggagggctggaattcgggaaacttccgttcggcgcttgtgaggatcccatttcagagctgcatcttgccactacatggccacacttgactgagggtatcattgtggataacgacgtctacagtgatcttgatccaatccaagctccccattggtcagtgcgggtgcggaaagccgagaatccccaatgcttgctaggcgatttcgtgaccgaattctttaagatatgtaggagaaaggaatccaccgacgagatcctgggaaggtcggccttcgaggaagagggcaaggagaccgcagacatcacccacgccctgtccaaactcacggagccagcctccgtgcctatacataaattgtcggtcagcaacatggtgcacaccgccaagaaaaagattcgaaaacatcggggtgtcgaagaaagccctctgaataatgatgttcttaacaccattctcctatttctctttccagacgccgtatcggagaaaccgttagatggcactaccagcaccgataataacaacccacccagtgaatctgaagactacaacctgtacaaccagtttaagtcggcaccatccgactccctcacatacaagttagctctgtgtctgtgcatgatcaatttttatcatggaggcctaaaaggtgtcgcccatttgtggcaagaattcgtcctggaaatgagatttcgctgggagaataatttcctgatccctggacttgcgtctggccctccggacctccgctgctgcctcctccaccagaagctgcaaatgctgaattgctgcatcgagaggaaaaaggctcgggacgagggcaaaaagacatccgcttctgacgtgaccaatatctatcctggcgacgctgggaaggccggggatcaactggtcccagataacctgaaagaaacagataaggaaaagggagaggtggggaaatcttgggactcatggtctgatagtgaagaggaattcttcgagtgcctgagcgacactgaggagctgaaaggtaacggacaggagtccgggaaaaaaggaggcccaaaggagatggcaaaccttcgaccggagggccggctttatcaacatggaaaactgactctgttgcataacggggagcccctgtatattcctgtcacacaggaacccgctccaatgaccgaagacctgctcgaggagcagtcagaagtcctcgcgaaactgggaaccagtgcagaaggcgcacacctgagagccaggatgcagtcggcatgcctcctgtctgacatggagagctttaaagccgcaaaccccggatgctccctggaagattttgtacgatggtacagcccgagagattacatcgaggaagaggtaatcgatgagaagggaaatgtggttctcaaaggggaattgtcagccagaatgaagattccttccaacatgtgggtcgaagcctgggagactgccaagcctattccagcccgcagacagagaagactattcgacgatacccgggaggccgagaaggtgttgcactacctggccatccagaaacccgctgatctggcaagacacctcctgccgtgcgtgatccacgcagctgtgctcaaggtcaaggaagaggagagtttggaaaacatatcctctgtaaagaaaattattaagcagattatctctcattctagcaaggtactgcacttccctaatcctgaagacaaaaagctggaggaaatcatccaccagatcaccaacgtcgaagctctcatcgcccgagccaggagtctaaaggcaaagttcggtacagagaaatgcgaacaagaggaggagaaagaagacctggaacgcttcgtgtcttgtctgctggagcagccggaggttttagtcacaggggcaggccgtggacacgccggccggattattcacaagttgtttgtcaatgcccagagggcagccgctatgactccccctgaggaggagctaaaacgaatgggatccccggaagagaggcgacagaacagcgtgtccgactttcctcccccagcggggcgcgagttcattctgaggaccactgtgcctaggccagcaccttatagtaaggccctgcctcagaggatgtactccgtcctgactaaggaggacttcagactcgccggagcattctccagtgacacatcttttttctag

SEQ ID NO: 131485 - DNA, 2808 bp, Artificial Sequence
  Description of Artificial Sequence: Synthetic coding sequence
atgttttcccttattagcggaatattcacgtcaggcacttgggaggaaaagtccgacgaaatctcatttgccgattttaagttctccgtgacacaccactatctggtacaggaatcaacggataaggagggcaaggatgagttgctggaggacgtggttccccagtcaatgcaggatctgctgggaatgaataatgacttcccaccacgtgcacactgtctggtgcgctggtatggcctcagagagttcgtagtgatagcgcctgccgctcacagtgatgccgtgttgagcgagagtaaatgcaatctcctgctttcctccgtaagtatcgcccttggcaacactgggtgccaggtgccactgtttgtccagatacatcacaagtggcgtcgtatgtacgtgggtgagtgccagggccccggtgtgcgaaccgatttcgaaatggttcacctgcggaaagtgcccaatcaatatacgcacttatctgggcttttggacatctttaagagcaagattggctgccccctgacacccctcccacctgtctcaatagctattcgtttcacatacgtgcttcaggattggcaacagtatttctggccacaacagccacctgacatcgatgcactggtgggtggcgaagtgggtggtctcgaattcgggaagctgccctttggggcttgtgaagacccaatcagcgagttgcatctcgctacgacatggccccatctaacagagggaattattgtagataacgatgtttattcagacctggatccaatccaggccccgcactggtcggtgagagtgcgcaaggcagaaaatccacagtgtctcctgggtgacttcgtcactgaatttttcaagatatgtcggcgcaaagaaagtacagatgagatacttggtagatccgccttcgaggaagagggaaaagagaccgcggacattacccacgccctgagcaagttaaccgaacccgcaagtgttcccatccacaagctgagcgtctccaacatggtccacacagccaagaaaaaaattcggaaacaccgtggcgtcgaggagtccccactgaataatgacgtgctgaacaccatactattatttctattcccagacgctgtgagcgaaaaaccactcgatggcacaaccagtaccgataataataacccaccttctgagagcgaagactataatctgtacaaccagtttaaaagcgccccttcggacagcttgacatacaaattggcgttgtgcttatgcatgatcaacttttaccacggaggactcaagggtgttgcacatctatggcaggagtttgttttagaaatgagattccgctgggaaaacaatttcctgatcccagggctcgcgtccggtccacctgatttaagatgctgtcttctgcaccagaaactgcaaatgctcaattgttgcatcgaaagaaaaaaggctcgagatgaggggaagaaaaccagcgcatccgacgttacaaacatatacccaggcgatgctggaaaggccggtgaccagctggtgccagacaacctcaaggaaacagacaaagagaagggggaagtaggaaagtcttgggactcttggagtgacagtgaagaagagtttttcgaatgtctgtccgacacagaagagctaaaaggaaatgggcaggaatctgggaagaaaggggggcctaaagagatggccaatctccggccagaaggtagactttaccagcacgggaaattgactctactgcacaacggagagcccctctacatccccgtgactcaggagccagctccaatgaccgaggatctcctggaggaacagagtgaagtattagctaagctcggcacatcggccgaaggagcccaccttagggcccgaatgcaaagtgcgtgcctgttgagcgacatggagtcctttaaggcagcgaaccctggttgcagcctcgaagattttgtgaggtggtactctcctcgggactatatcgaagaagaagtcatcgacgagaaaggtaacgtggtgctgaaaggcgaactgtctgcacggatgaaaatccccagcaatatgtgggtcgaagcatgggagaccgccaagcctatccctgcacggcgacagcgccgtctgtttgatgatacacgggaagccgaaaaggtcctgcactacctcgccattcagaagcccgccgacctagcacggcatctgttaccgtgcgtgattcacgccgcagttctaaaggtgaaagaggaagagagcctggaaaacatcagttctgtcaaaaagatcatcaaacaaatcatttctcattcctccaaggtcttgcacttccccaatccagaggacaagaaactggaagagattatacatcaaattacaaacgttgaagctctgatcgcaagggcccgttccttgaaggctaagttcggtacagaaaagtgtgaacaggaggaagaaaaagaagacctcgagaggttcgtgtcttgtctgctcgagcagcctgaggtgctggtgaccggagccggcagagggcacgccggccgaatcattcataaactattcgtgaatgcccagcgggccgcagctatgactccaccagaggaagagctgaaacgaatggggagccctgaagaacgtaggcagaactccgtgtccgacttccccccccccgccggaagggaatttatcttgcgcaccaccgtgcctcgtcccgctccttactcgaaggcgctaccacagcgcatgtactctgtgctgacaaaagaggacttcaggttggctgtgaagatcatagatggggatgtctag

SEQ ID NO: 131486 - DNA, 2967 bp, Artificial Sequence
  Description of Artificial Sequence: Synthetic coding sequence
atggcagccgactctgaacctgagtcggaagtgttcgaaatcaccgattttactacagcctccgaatgggagcgctttatatctaaagtagaggaggtgctgaatgattggaaacttatcggaaacagcctcgggaagccgttggagaaagggatttttacaagcggtacttgggaggagaaaagtgacgaaatctcattcgcagacttcaaattcagcgtcacacaccattatttggttcaggagagtaccgataaggagggcaaggatgagcttctggaggatgtagtacctcaaagtatgcaagatctgcttggcatgaacaatgattttcctccgagggcgcattgtttggtgcggtggtacggtctgagagagttcgtcgtcattgctcctgccgcacactccgacgcggtgctgtctgagagtaagtgtaatctgctgttaagctccgtgagcattgcgctcggtaacacaggttgtcaggtccctctgttcgtgcagatccaccacaagtggaggcggatgtatgtcggcgaatgccagggaccaggagttcgtactgattttgaaatggtgcacctgagaaaggttccgaatcagtatactcatctctcgggcctgcttgacatctttaaaagtaaaattggatgtcccctcacccctctgccgcccgttagcattgccatccgttttacttacgttcttcaagactggcagcagtacttttggccacagcagccccctgatattgatgctttggttggcggagaggtaggcggtctggagttcggaaagctgcccttcggagcatgtgaagatccaatcagcgagctccacctggctacaacatggccccacctaacagagggtatcatcgtggataacgatgtgtactccgatctcgacccaatccaggcgccacattggtcagtccgggtgaggaaagccgaaaaccctcaatgcctgcttggcgacttcgtgaccgaattcttcaagatatgcaggagaaaagagagcacagacgagattctggggagaagtgcattcgaagaggagggaaaagaaacggctgacataactcatgctctttcaaaactgaccgaacccgcttcggttcctattcacaagctgtccgtatccaatatggttcatactgctaagaaaaaaatccgcaaacacagaggtgtagaggagtcccctcttaataatgacgttctgaatacgatactcctgtttctgtttcccgacgctgttagcgagaaacccctggatggcacgacctcgacagacaataacaatcctcccagcgagagcgaagactacaacttatataaccagtttaaatccgcgcctagtgattcactgacttataagctggctctgtgtctgtgcatgatcaatttctatcacgggggtttaaagggcgttgcccacctatggcaggagttcgtgctggagatgcgatttaggtgggagaataacttcctgatccctggactcgcttctgggccacctgacctcaggtgctgcctgcttcatcagaaactgcagatgctgaattgttgcatagaacgtaaaaaggctagagacgagggcaagaaaacgtccgccagtgacgtcacaaacatttatccaggcgacgcgggcaaagctggcgaccagctggttcccgataacctgaaggaaaccgacaaagaaaagggggaagtgggcaagtcttgggattcctggtccgattccgaggaggagttcttcgagtgcctaagcgataccgaggagctcaaagggaacggccaggagtctgggaagaagggcggccctaaggagatggccaacttgagaccagaaggtagactttatcagcatggcaaactcactctgctgcataatggtgaaccactctatattcccgtcacccaggaacctgcaccaatgacagaggacttgctggaagaacagagtgaggtactcgccaaactaggaacgagtgccgaaggagctcatctgcgggcaaggatgcagagcgcttgtctcctttccgacatggaatcatttaaggctgctaatcccggctgctcgttagaagattttgtgagatggtatagtcctcgggactatatcgaagaagaagtgattgacgagaaaggtaatgtggtgcttaagggcgagctgagtgctcgtatgaaaatcccttcaaacatgtgggtggaagcgtgggaaacggcaaagccaatccctgctaggcgccagagaaggctgttcgacgatactcgggaagcagagaaggttctccattacctggccattcaaaaacctgcggaccttgcaaggcatttattgccttgcgtgatccatgcagctgtattgaaagtgaaggaggaggaatctctggagaatatctcatctgtcaaaaaaatcataaaacagataattagccattcctccaaggtccttcactttcctaatcccgaggacaagaaactcgaggagatcatccatcaaattacaaacgtggaggccctgattgctcgcgcgcgcagccttaaggccaaattcggcacggaaaaatgcgagcaggaggaggagaaggaagacttggaacgatttgtttcctgtctgctggagcagccggaagttctggtgaccggcgcagggcgaggccacgcaggccgcatcattcataaattgttcgtgaatgctcagcgtctgacggagagtagtgacgaggcggccgcaatgactcctccagaggaagagctgaaacggatgggatcccctgaggagcgtcgccaaaacagcgtgtcagactttcctcccccagcagggcgcgagttcatattgagaactactgtgccgcgtccagccccatattctaaagccctccctcagcgaatgtatagcgtgctgaccaaagaggacttccggttggcaggtgccttttccagcgacacctcatttttttag

SEQ ID NO: 131487 - DNA, 4182 bp, Artificial Sequence
  Description of Artificial Sequence: Synthetic coding sequence
atggcatgttcgatagtccagttttgctattttcaggatctgcaggcagcgcgggatttcctgtttccccatctgagagaggagattcttagtggcgctctcaggagagacccctccaaatctacagattgggaagatgacggatggggggcatgggaggaaaatgaaccccaagaacctgaggaagaaggaaacacttgtaagacacagaagaccagctggctgcaggattgtgttctttccctgtcaccaactaacgacctcatggtcatcgccagagaacaaaaggcagtgttcctggtccccaaatggaagtactcagataaaggcaaggaggaaatgcaatttgcggtcggctggtccggatcattgaacgtcgaagagggtgagtgcgtcacctcagctctctgtatcccccttgctagtcagaaaagatcaagtaccggacggccagattggacatgcatagtggtggggttcaccagtggttatgtgcgcttttataccgaaaatggagtgttattgcttgcccaattgctgaacgaagaccccgttctgcagctaaaatgccgaacctatgagatccctaggcatccaggagttacagagcagaacgaggagctgtctatcctgtaccccgccgctatcgtgacaatcgacggcttctctctctttcagagcctgcgagcctgtcgcaaccaagttgctaaggctgcggccagtggaaatgagaacatccagccacccccattggcctacaaaaagtggggacttcaggatatcgacactattatcgaccatgcgagcgtggggattatgaccctctccccattcgatcaaatgaaaacagcgtccaatataggggggtttaatgctgcaattaagaattcaccacccgcaatgtcacagtatatcactgttgggtccaatccatttactggctttttttatgccctcgaaggtagcacacagcctttgctctcccacgttgctctcgccgtggcatcaaaactgaccagtgcactcttcaacgctgcttctgggtggctgggttggaagtctaaacacgaggaagaagccgttcagaagcagaagccaaaggtagagcccgcaacccctctcgcagtaagatttggcctgccagacagccgtaggcatggggagagtatttgcctctctccctgcaatactctggccgccgtgaccgacgatttcggccgcgtgatcctactggacgtggctcgtggaattgccatcaggatgtggaagggctacagagacgcccagatcgggtggatccagacagttgaggatctgcatgagcgggtgccagagaaagcagacttctcaccattcggcaacagtcaagggcccagccgcgtagcccagttcctggtcatttatgccccacggagaggcatcttagaggtgtggagcactcaacagggccctcgggttggggcattcaatgtaggcaagcactgccgactgctctaccccggctacaaaattatgggactcaataatgtgacctcacagtcttggcagcctcagacttaccaaatatgtctggtggatcctgtgtccggctccgtcaagacagttaatgtacctttccaccttgcactgtcagataagaaatccgaacgagctaaagacatgcacctcgtgaaaaaactcgctgcactgcttaagacaaaatctcccaatctagatctcgtggagacagagatcaaggagctgattctggatatcaagtaccctgcaactaagaaacaagcactggagtccatcctagcctctgaacggcttcccttcagctgtctccgaaatataacccaaacactcatggacaccttaaagagtcaagaactggagtccgtggatgagggactgcttcagttttgcgcaaacaagctgaaactgttacagctgtacgagtccgtttcccagctgaattcactagacttccatctcgacacaccatttagcgataacgacctggccctcctgctgagattggacgaaaaagagttgctgaaactacaggccctgttagaaaagtacaagcaggagaacactcgaacaaatgtgcggttctcagacgacaaagacggggtgctgccagtgaaaacctttctggaatatctggaatatgaaaaagatgtgctgaacattaaaaagatcagcgaggaggagtacgttgcactaggcagtttttttttctggaagtgcttacacggggaaagttccaccgaagacatgtgccacaccctggagtccgcaggcctgagcccacaactgctgttatcgcttctactgagcgtctggctgagcaaggagaaagacatactcgacaaaccacagtccatttgttgtcttcacacgatgctctcactcctgtccaaaatgaaagttgctattgatgaaacttgggattcccagtccgtctccccctggtggcaacaaatgaggacggcgtgtatacaatccgaaaataatggcgctgccctcctctctgcacacgtggggcacagcgtggcagcccaaatatccaacaacatgactgaaaagaaattctcgcagacagtcttgggggctgatagtgaggccctcacagattcctgggaagccctgtcattggataccgagtactggaaacttctgctcaaacagctggaggattgtctaattctgcaaacactgctgcactcaaagggcaatacccaaacttccaaagtgtcttctctgcaggccgagcccctgccacgcttatcggtgaaaaagctgctcgaggggggcaaggggggtattgctgattccgtggccaaatggatcttcaaacaggatttcagtcctgaggttctcaagctggccaatgaggagagggatgctgaaaaccctgacgagccaaaagagggcgtcaatcgcagtttcctcgaggtcagcgagatggagatggacctaggggccatcccagacctcctccacctcgcatacgaacaattcccatgcagcttagagcttgatgttctgcacgctcactgttgttgggagtacgtggtgcagtggaacaaggaccctgaagaggcccgattcttcgtacgtagtattgaacatctgaaacaaatattcaacgctcatgtgcagaatggaattgcacttatgatgtggaacacctttctagtgaagagattttccgcagcaacataccttatggataaagtgggaaagtctccaaaggatcggctctgccgtagagacgtaggtatgtcagataccgcgatgacctccttcctgggttcatgcctcgatctcctacaaatcctcatggaagctgacgtctcacgggacgaaattcaagtgcctgtcttggatacagaagacgcgtggctgtcggttgaagggccaatctctatagtggagctggccttagagcagaaacatattcattatcctctcgtggaacaccactctatcctgtgtagtatcctgtatgccgtgatgagattctctttaaagaccgtgaagcccctgtctctgttcgattccaaaggtaaaaacgcatttttcaaagacctgacctctattcagcttctaccatcaggagagatggaccctaatttcatctccgtgcggcagcagtttctgctcaaggtggtgtccgcagccgtgcaggcccagcactcagcgaccaaggttaaggaccccacagaagaggccactccgacaccgtttggaaaagaccaggactggcccgcactcgcggtggacttggcgcaccacttacaggtgagtgaggacgtggtgagacggcactacgtcggtgaactatacaattacggtgtggaccacttgggggaagaggccatacttcaggttcacgataaggaagtcctggcctcccagctgctggtattaaccggtcaacggttggcgcacgcactgcttcacactcagaccaaggaggggatggaactgcttgctcgccttccacccactctctgtacttggctgaaagccatggatccccaggacctccaaaatactgaagtcccgattgcaacgacagcgaagctggttaataaggtgattgagctcctgcctgaaaagcacggccagtatggactggcattacatcttatagaggcagttgaggcgatcagcttacctagcctctag

SEQ ID NO: 131488 - DNA, 612 bp, Artificial Sequence
  Description of Artificial Sequence: Synthetic coding sequence
atgagtatggaggattacgacttcctatttaaaattgtgctcataggaaacgcaggcgtgggtaagacttgccttgtgcgccgttttacccaggggctgttccctcccggccagggggccacgataggtgtggacttcatgattaagaccgtggaaataaatggtgagaaggttaagctgcaaatttgggatacagccggacaggagaggttccgttccattacccaaagttactacaggtctgccaacgccctcatactaacctatgatattacatgtgaagagagttttcgttgtctgcccgaatggctccgcgaaatcgaacaatatgcgtccaacaaggtgatcactgttctggtaggcaacaagatagacttggctgagcgcagggaggtttcacaacagcgcgcagaagagttctccgaagcacaggacatgtactacctcgagacctctgcgaaagagtccgataacgtagaaaagcttttcctggatctcgcttgccgcttgatctccgaggcaagacaaaacaccctggtgaacaacgtgtccagccctctgcctggggagggcaaatctatcagctatctgacatgttgcaactttaattag

SEQ ID NO: 131489 - DNA, 345 bp, Artificial Sequence
  Description of Artificial Sequence: Synthetic coding sequence
atgtccatggaagactacgacttcctctttaagatcgtattgatcgggaatgccggagtcggcaagacgtgtttagttcgaagattcacacaagggctgttcccccctgggcagggcgctactattggtgtggacttcatgatcaagaccgtggaaattaatggggaaaaagtgaagttgcagatttgggacaccgctggccaggagaggtttcgctctatcactcagtcttactacagatccgctaacgcactcattctgacttacgatatcacctgcgaggagtcattccgatgtctgcccgagtggctgagggagatcgagcagtatgccagtaataaatag

SEQ ID NO: 131490 - DNA, 612 bp, Artificial Sequence
  Description of Artificial Sequence: Synthetic coding sequence
atgtctatggaagattatgatttcctgttcaaaatagtactgattggcaacgcaggcgtgggtaagacttgccttgtgcgcaggtttacccagggcctgttccctccaggacagggggccaccatcggggtcgactttatgatcaagaccgtcgagattaatggcgagaaggtgaagctccagatatgggataccgccggccaggagagattcagaagcatcacacagtcttattacaggagcgctaatgcactcatactcacgtacgacatcacttgtgaggaatctttccggtgcctgccagaatggctcagagagatcgagcagtacgcctcaaacaaggtgataacagtgctggttgggaacaaaatagacctagcggaaaggagggaggtttcacagcagcgggccgaagaattttcagaggctcaggacatgtactaccttgagacaagtgcgaaagagtctgataacgtcgagaaactgttcctcgacctggcctgcaggttaatatcagaagccagacaaaatacactcgtgaacaatgtgtcctcccccctacccggcgaggggaagtccatctcctatctgacttgctgcaattttaattag

SEQ ID NO: 131491 - DNA, 168 bp, Artificial Sequence
  Description of Artificial Sequence: Synthetic coding sequence
atgagcatggaggattacgactttctgttcaagattgtactaattggtaatgctggcgtgggaaagacgtgtcttgtccgccggttcacacaggggctgtttcctcccggtcagggggccaccatcggcgtggacttcatgataaagactgtagagattaacgggtag

SEQ ID NO: 131492 - DNA, 507 bp, Artificial Sequence
  Description of Artificial Sequence: Synthetic coding sequence
atgagtatggaggattatgacttcttatttaagatcgttctcataggtaacgccggagttgggaagacgtgcttagtgcgtcgcttcactcaaggcttgtttccacccggccagggcgcaaccatcggtgttgacttcatgatcaaaaccgtggagattaatggcgagaaagtgaagctccaaatatgggacacagccggacaggagcgcttccgatcaatcacacagtcatactacagatcagcaaatgccttgatactgacatacgacataacttgtgaggaatctttcagatgtctgcccgagtggctcagggaaatcgaacagtatgccagtaataaggtgataaccgtcctagttggaaataagattgacctggccgaacgccgcgaggtgagccagcaacgggcggaagagttttcagaggctcaggacatgtactacctagaaacctctgccaaggaatctgataatgttgagaagttgttcctggacctggcctgctag

SEQ ID NO: 131493 - DNA, 183 bp, Artificial Sequence
  Description of Artificial Sequence: Synthetic coding sequence
atgagcatggaggactatgacttcctgttcaaaatcgttctgattggaaatgccggagtgggcaagacctgcctggtgcggcgattcactcagggcttatttccgcccgggcagggagccaccatcggagtggattttatgatcaagaccgttgagatcaatggcgaaaaagtgaaactttag

SEQ ID NO: 131494 - DNA, 612 bp, Artificial Sequence
  Description of Artificial Sequence: Synthetic coding sequence
atgagcatggaagactacgacttcctctttaaaattgtgctgatcggaaacgctggggtgggcaaaacttgcctcgtgcggaggtttacacaggggttgtttcctcccggacagggggctacaatcggcgttgatttcatgataaagaccgtggagattaacggggagaaagtgaagttgcagatatgggacacagctggccaggagcgctttagaagtatcacccaaagttactacaggagcgcaaatgcccttatcctgacatacgatatcacatgtgaagaatcatttcgttgcctccccgaatggttaagagaaatcgagcaatatgcttccaataaggtgatcacggtgctggtcgggaataagatcgatctcgcagaaaggcgagaggtatcccagcagcgggctgaagagttcagcgaagcacaagacatgtattatctcgaaacatccgccaaagaatccgataatgtggagaagctgtttcttgacttagcctgtcggctgatatcagaagccagacagaacaccctagttaataacgtgtctagccccctacctggagagggcaagtctataagctacctcacatgttgcaatttcaattag

SEQ ID NO: 131495 - DNA, 303 bp, Artificial Sequence
  Description of Artificial Sequence: Synthetic coding sequence
atgtccatggaggactatgattttttgtttaagatcgtgctcattggaaatgctggcgtcggtaaaacctgcttagtgcggcggtttacccaggggttatttccacctggccagggtgcaaccattggagttgatttcatgattaagacagtcgagattaacggggagaaggtcaagcttcaaatttgggatacagccggacaggagaggtttagaagcattacccagagctattatcggagtgctaatgccctgatactcacctatgatatcacatgtgaagagagctttcggtgtttatag

SEQ ID NO: 131496 - DNA, 495 bp, Artificial Sequence
  Description of Artificial Sequence: Synthetic coding sequence
atgtctatggaggattacgacttcctcttcaaaatcgtgcttattggtaacgcaggagtcggtaaaacatgtctagtgcgacgattcacacagggcctgtttccgcctggtcaaggagctactatcggagtggatttcatgattaaaacagtggaaatcaatggagaaaaagttaagttgcagatttgggataccgctggccaagaacgattccgctctatcacccagagttattaccgctctgcgaacgccctgattctcacttacgacattacttgcgaagaatcgttcaggtgtcttccagagtggcttcgggaaattgaacagtatgcctcaaacaaggtgatcacagttcttgccactcgtttaacatggctgaaaggggaacgcttcccaagttctgagttgaagaactcccagaagttgaggacatgcattatctggcgccctcagccccgaaacttgataatgtggagaaactcaagtctgacctag

SEQ ID NO: 131497 - DNA, 420 bp, Artificial Sequence
  Description of Artificial Sequence: Synthetic coding sequence
atgagcatggaagactacgacttcctgtttaagatagttctaataggtaacgcaggagtaggtaagacctgcctggtgcggaggtttactcagggattgttccctcccggccagggtgctacaattggcgtcgactttatgattaagacagtggaaataaacggagagaaggtgaaacttcaaatctgggacactgccgggcaggagcgcttccgcagcattacacagtcctattacaggtccgccaatgccctcattcttacttacgacatcacctgcgaggagtcttttcgatgcctgcccgagtggctgagggagattgagcagtatgcttccaataaggttataaccgtgctagtggggaataaaatagaccttgcagaacggcgtgaagtgagccagcagagggccgaggagtag

SEQ ID NO: 131498 - DNA, 588 bp, Artificial Sequence
  Description of Artificial Sequence: Synthetic coding sequence
atgatggctattcgggaacttaaagtttgtctgttgggagataccggtgtgggcaaatcaagcatcgtatgcaggttcgttcaggaccactttgaccataatatctccccaactattggtgcctcattcatgaccaagaccgtcccatgcggcaacgagctacacaaattcttgatctgggacacagctggccaagagaggttccattccttggcacctatgtactatcgggggtcagccgcggctgtgatcgtttatgatattacaaagcaggacagcttctacactctgaagaaatgggttaaggagttgaaagaacatgggcccgaaaacattgttatggccatcgccggcaacaagtgcgacctctcagatatacgggaggtcccacttaaggacgccaaagagtacgccgagagcataggcgcaatagtcgtggagactagcgctaagaatgctatcaacatagaggagttgtttcaggggatcagccggcagatccctccactagatccgcacgagaacgggaacaatggtacaatcaaagtagaaaagccaacaatgcaggcatcacggcgctgctgctag

SEQ ID NO: 131499 - DNA, 561 bp, Artificial Sequence
  Description of Artificial Sequence: Synthetic coding sequence
tgcctcttaaatgataccggggtcggcaaatcctccattgtctgccgcttcgtacaggatcatttcgaccacaatatctcgcccaccattggcgcaagttttatgaccaagaccgttccatgtgggaacgaactccataagttccttatctgggacaccgccggacaggaacggtttcacagccttgcacccatgtactatcggggcagcgctgctgccgtgatagtttacgatattaccaaacaggactccttctacacactaaaaaagtgggttaaggagctgaaagaacatgggcctgagaacatcgttatggctatagccggtaacaagtgtgatctcagcgacattagagaagtgcccctgaaagacgcaaaggagtacgcggagtctattggggccattgtggttgagacaagtgcaaagaatgcgatcaacattgaggaactgttccaaggaatctctagacaaattcctccattggatccgcacgagaacggaaataatggaactatcaaagtagagaaacctactatgcaggccagccggcggtgctgctag

SEQ ID NO: 131500 - DNA, 678 bp, Artificial Sequence
  Description of Artificial Sequence: Synthetic coding sequence
atggcaggtggcggagcaggcgatcctgggctcggcgccgctgcggcaccggcccccgagacaagagaacacctgtttaaggtgctcgttatcggcgaactcggggttgggaagacctcaattatcaaacggtacgtgcatcagctcttttctcagcattatagagctaccattggcgtcgacttcgccctgaaagttctgaactgggactcaagaaccttagttcggctccagctatgggacatcgcaggccaagagcgattcggcaacatgactagggtctattataaggaagccgtcggggcctttgtcgtctttgacatctctcggagctctacctttgaggccgtgctgaaatggaagagtgaccttgattccaaggtgcatctacctaacggctcaccaattcccgccgtactgcttgccaataaatgcgaccaaaacaaagactccagtcagtcacccagccaggtggatcagttctgcaaagaacatggcttcgcaggctggttcgaaacttccgcaaaggacaatattaatatcgaggaagcagccagattcttggttgagaagatcctcgtaaatcatcaatcattccccaatgaagagaacgacgttgataagataaagcttgaccaggaaacgttgagagccgaaaataagagtcagtgctgttag

SEQ ID NO: 131501 - DNA, 714 bp, Artificial Sequence
  Description of Artificial Sequence: Synthetic coding sequence
atggctcaacccatcttaggacacggctcactgcagcctgcttcagctgcgggattagccagcctggagctcgatagttctctggaccagtacgtccagatcaggatcttcaagattatcgtgattggtgactccaatgttgggaagacctgcctgacattcagattttgcggggggacattcccagacaaaaccgaggcaaccattggcgtcgactttagagagaagacggtcgaaatcgaaggtgagaagattaaagtgcaggtgtgggataccgcgggccaagaaaggttcagaaagagcatggtggagcactattaccgaaacgtgcatgctgtggttttcgtttacgacgtcacaaaaatgactagcttcaccaacctaaaaatgtggatacaggagtgcaacggtcatgccgtgccccccctggttccgaaggtactggtcgggaacaagtgcgacctgagagagcagatacaggtaccctccaacctggctcttaaatttgccgacgcccacaacatgctgttgtttgaaacaagcgctaaggaccctaaggagagccagaatgtcgagtccatcttcatgtgcctggcctgccgcctgaaagcacagaaatctctgctgtatagggacgctgaaagacagcagggcaaagtgcaaaagcttgagtttccacaggaggctaactctaaaacctcctgcccttgctag

SEQ ID NO: 131502 - DNA, 714 bp, Artificial Sequence
  Description of Artificial Sequence: Synthetic coding sequence
atgaacattctggcacccgtgcggcgtgatcgcgtcttagccgaactgccacagtgtctccgcaaagaagccgctctacatggtcataaagacttccatccccgcgtgacctgcgcttgccaggagcataggaccggcactgtaggattctgcaaagatacctttgacaaaaactacaaagccacaatcggggttgacttcgaaatggagcgcttcgaggtcttggggatacccttctctctgcagctttgggacactgcagggcaggagaggtttaagtgtatcgcatcaacctactacagaggagcacaggcgataatcatagtcttcaacttgaatgacgttgcgagtttggaacacactaaacagtggctggccgatgccctcaaagaaaacgaccccagttctgtgctgttgtttttggtgggctcaaaaaaagacctgtctacacctgcccagtacgctctgatggagaaggatgcactgcaggtagctcaggagatgaaagcagaatattgggccgtcagctccctcaccggagagaatgtgcgtgagttcttcttccgtgtggcagccctaacctttgaagccaacgtgctggctgaactcgagaagagcggtgcccgaagaattggggatgtggtccgcattaattcggatgactccaacctctatctcacagcgtccaaaaaaaagccaacgtgctgtccgtag

SEQ ID NO: 131503 - DNA, 780 bp, Artificial Sequence
  Description of Artificial Sequence: Synthetic coding sequence
atgaacattttagcgcctgttagacgggaccgtgtactggccgagctacctcagtgtctaagaaaagaggccgcactgcatggacataaagatttccaccctcgggtgacttgcgcctgtcaggagcaccggacgggcactgtgggctttaaaatttctaaggtcatcgttgtcggcgatctgtcggtcggaaagacttgcctcatcaatcgattctgcaaggatacttttgacaagaactataaggccactatcggtgtcgattttgagatggagcgtttcgaagtgctcggcatccctttctccctgcagttgtgggacaccgcaggccaggaaaggtttaaatgtattgctagcacatattaccggggcgcccaggccatcattattgtgttcaatctgaacgatgtcgcatcactggagcacaccaaacagtggctggccgacgctctaaaggaaaatgacccctcatcggttctcctgtttttggtaggctctaagaaagatctgagcaccccggcccagtacgctttgatggaaaaagatgcccttcaggtagcacaggaaatgaaggccgagtactgggccgtgagctccttgactggcgaaaacgttagggagttcttcttccgcgtggctgccttgaccttcgaagcgaatgtgctagccgaactcgagaaatcaggcgccagaagaattggggatgtcgtacgcatcaactcagatgattctaacttgtacctgactgccagcaagaaaaaacctacctgttgcccatag

SEQ ID NO: 131504 - DNA, 636 bp, Artificial Sequence
  Description of Artificial Sequence: Synthetic coding sequence
atgaacatactcgcaccagtgaggcgagacagggttctggccgagctcccacagtgtctgcgtaaggaggctgcactccacggacataaggacttccaccccagggtcacttgcgcctgtcaggagcaccgtacaggcactgtcggctttaagatcagcaaggtgatagttgttggagacctttcagtcgggaaaacttgcctaatcaaccggttctgcaaggatacattcgacaaaaactacaaggccacgataggcgtcgattttgaaatggagcgctttgaggtgttgggaattccgttctcactccaactgtgggatacggccggtcaggagcgctttaagtgcatcgcgtctacttattatcgaggggctcaagcaatcataatcgtgtttaacttaaacgacgtggccagtctcgagcacacaaagcagtggctggccgatgctctgaaggagaatgatccatcatcggtcttactgttcctggtgggctccaagaaggatcttagtactcccgcccaatacgctctgatggagaaagatgctctccaagtggcacaggagatgaaagccgagtactgggcagtcagttctcttacaggagagaacgtccgcgaattctttttccgctag

SEQ ID NO: 131505 - DNA, 756 bp, Artificial Sequence
  Description of Artificial Sequence: Synthetic coding sequence
atgaacattctcgcccccgtgagacgcgaccgagtgctggccgagctgccacaatgtctcagaaaggaggcagccctccatggccataaggacttccaccctcgggtcacctgtgcctgtcaagagcacagaaccggcactgtcgggtttaagatttcaaaggttatcgttgtgggggacttatcagttggaaaaacctgtctgatcaatcgcttttgtaaggacacatttgacaaaaattacaaggcgacgattggcgtggactttgagatggaaagatttgaagtactcggaataccattttctttgcagctttgggatacggccggccaggaacgctttaagtgcattgcttccacctactatcgaggagcccaagccatcattatcgtttttaatctgaacgatgtagcaagccttgaacataccaagcagtggcttgcagatgcccttaaggaaaacgatccatcctccgtactgctgtttctcacgcccgcccagtacgcccttatggaaaaagacgccctgcaggtggcccaggagatgaaagcagaatattgggccgtctcctccttgaccggagagaatgtccgtgaattctttttccgagttgccgctctgactttcgaagcgaatgtgcttgctgaacttgaaaaaagtggggcacgaagaattggagacgtggtgcgtatcaatagtgacgactctaacctgtatctcactgcttccaagaagaagcctacgtgttgcccttag

SEQ ID NO: 131506 - DNA, 780 bp, Artificial Sequence
  Description of Artificial Sequence: Synthetic coding sequence
atgaatatcctggctcccgttcgccgcgatagggtgctagccgagctgccccagtgcctgaggaaggaagcggcgctccacggacacaaagattttcaccctcgcgtgacatgcgcctgccaggaacaccgcacgggaaccgttggcttcaagatcagcaaggtgatcgtcgtgggggacttgtctgttggaaagacttgcttgatcaacaggttctgcaaggatactttcgataagaactacaaagctacaataggagtagacttcgagatggagcgtttcgaggttctcggcatccctttttcgctgcagctgtgggatactgcggggcaggagagatttaagtgtatcgcttcaacttattaccggggagcccaagccattattatcgtctttaacctgaatgacgtcgcctccctcgagcataccaagcaatggctggcggacgctttgaaagagaacgacccgtcctctgttttgcttttccttgttggctccaagaaagacttatcgaccccagcccagtatgcgctcatggaaaaagacgcgttacaggtggctcaagaaatgaaggctgaatactgggctgtctcgagcctcaccggcgagaacgtgagagagttctttttcagggtggcagccttgacatttgaggccaacgtgctcgctgaactggagaagtctggcgcccggcggattggtgatgtcgtaagaatcaattctgacgatagcaacctctacctgaccgccagcaagaagaaacctacatgctgcccgtag

SEQ ID NO: 131507 - DNA, 636 bp, Artificial Sequence
  Description of Artificial Sequence: Synthetic coding sequence
atgaatattctggctccagtccgtagagatcgggtgctcgctgaattaccccagtgtcttaggaaagaggccgccttgcacggccacaaggacttccatccacgcgtgacctgcgcttgccaggaacatcggacgggcaccgtaggatttaaaatatcaaaggtgatcgtcgttggcgacctgtccgtgggaaagacttgtctcattaaccggttctgtaaggatacgttcgataagaactacaaagccaccataggcgtcgatttcgaaatggagcggttcgaagttctcggtattccattctccctgcagctttgggataccgccggccaggaacgctttaaatgcatcgcttcaacctattaccgtggggcccaagctatcattattgtctttaaccttaacgacgtcgccagtttagagcacacaaaacagtggctggccgacgctttaaaggaaaatgatccctcttctgtgctgctcttccttgtgggcagcaaaaaagatctcagtaccccagcccagtatgcattaatggaaaaagatgccctgcaggtagcgcaggagatgaaagcagagtattgggcagtgtcgagcttgacaggtgagaatgtaagagagttcttcttcagatag

SEQ ID NO: 131508 - DNA, 696 bp, Artificial Sequence
  Description of Artificial Sequence: Synthetic coding sequence
tgatcccttagatttcccatcaccaatagtgcaggcgcaccttgcaaggccgccggtcgcatgaatatcctggcccccgttcgaagagaccgagtcttggccgagctgccacagtgcctgcgcaaggaggccgcattacatggacataaggatttccacccaagggtaacctgtgcatgccaggagcatcgcactggcaccgtgggccgattcaaaatctcgaaagtgatcgtggtgggggacctgtccgtagggaaaacatgtctaatcaaccggttctgtaaggatacttttgataagaattacaaggccactattggagtcgatttcgagatggagcggttcgaggtgcttggaatccccttctcactgcagctgtgggacaccgctggacaggaacgttttaaatgtattgcatccacctattacagaggagcccaggcaattatcatcgtctttaatctgaacgatgttgcctcgttggaacacaccaaacagtggttggctgatgctctcaaagagaatgaccccagcagcgtcctactatttctagttggatccaaaaaagacttaagtactccagcccagtacgctctgatggagaaggacgctttgcaagtcgctcaagaaatgaaaacagtccagcggctgccatccccccgcgcactgtgccacccacatagttcacgcgcatag

SEQ ID NO: 131509 - DNA, 951 bp, Artificial Sequence
  Description of Artificial Sequence: Synthetic coding sequence
atgagccacttgccaggcttagagcttcggcgggaggctccccccttgttaggacctcttttgtctccttttccgctgccagctggatcgtggcacagacaaatgttgcgttcttctctcaggtttccaataactaactctgctggcgcaccttgtaaggctgcaggtcgcatgaatattttagcgcctgtcagaagggatcgggtgctggccgagttaccacagtgcctcaggaaggaagccgcgctgcacgggcataaagactttcatccaagggtgacttgcgcttgtcaagaacaccgaactggcaccgtaggctttaaaatttctaaggtgatcgtggtaggggatctgagcgtgggcaaaacttgcctgattaatcggttttgtaaggatactttcgataagaattacaaagcgacaattggagtggattttgaaatggagagattcgaagtactcgggatcccttttagtctccagctgtgggacaccgcaggacaagagcgcttcaaatgtattgcttctacttactacagaggagctcaggcaattatcattgttttcaatctgaatgacgtggcaagcctcgaacacaccaagcaatggctggccgatgcacttaaggaaaacgatccttccagtgtcctgctctttcttgtcggctcgaaaaaagaccttagcacacccgcacagtacgctctgatggagaaggatgcgctgcaggttgctcaagaaatgaaggccgagtattgggcagtctcttcactgaccggcgaaaacgtcagagagttctttttcagggtggccgcattgacatttgaagccaacgtgcttgcggaactcgaaaagagtggtgctcggcggattggtgacgtcgtacggatcaactcagatgattctaatttatacctgaccgcaagcaaaaaaaagcctacctgctgtccatag

SEQ ID NO: 131510 - DNA, 825 bp, Artificial Sequence
  Description of Artificial Sequence: Synthetic coding sequence
atgctcagaagttctttgaggttccccattactaactcggcaggtgccccgtgtaaggcggccgggcgaatgaacatcctcgcaccagttcgccgggatcgcgtgttagccgagctgcctcagtgcctgcgcaaagaggccgcactccatggccacaaagacttccacccgcgggtgacctgcgcatgtcaggaacaccggacaggcactgtggggttcaagatttcgaaggttatagtggtgggagacttaagcgtgggaaaaacctgcctcataaatcgcttttgcaaagacactttcgataagaactacaaggcaaccatcggagtagattttgagatggaacgattcgaggtattgggcattcccttttctctccagctctgggacaccgctggccaagagagatttaagtgtatagcttcgacttattataggggcgctcaggcaatcatcatagtcttcaatttaaacgatgtagcgtctttggagcacacaaagcagtggctggcagatgccttaaaagaaaatgatccttcctctgtgcttctgtttctgacaccagcccagtatgcgctaatggaaaaggacgccctgcaagtggcgcaagaaatgaaagcggagtactgggcggtatcatccctcaccggtgagaacgttcgcgaattcttttttagagtcgcagctcttacctttgaagccaacgtacttgccgaacttgagaagagcggcgcccgacgcatcggagatgtggtacgaatcaactcagatgactcaaatctctatctgacagcatccaagaaaaaacctacgtgctgcccttag

SEQ ID NO: 131511 - DNA, 807 bp, Artificial Sequence
  Description of Artificial Sequence: Synthetic coding sequence
atgagccacttgccaggtctcgagctgcggcgagaagccccgcctctgctcgggccattactctccccttttcccttgccagcaggcagttggcataggcagatgcttcgaagttccttgcgctttcctattaccaattcagccggagctccgtgcaaagctgctgggaggatgaacatcctcgcccctgtgcgtcgtgacagggtcctcgccgaactgccgcagtgtctcagaaaagaggccgcgttgcacggtcacaaggattttcacccccgcgttacatgtgcttgtcaggagcacagaaccggcaccgttggtcgattcaagatttctaaggtgatcgttgttggtgacctgagcgtagggaaaacctgtctgatcaatagattctgtaaggatacttttgataagaactacaaggctactataggtgttgacttcgaaatggaacggttcgaggttctcggaataccttttagccttcagctgtgggacacagccgggcaagagagatttaagtgtattgcttctacttattaccgcggagcccaagccatcatcatcgtgttcaacctgaacgacgttgcttctttggagcacaccaagcagtggcttgctgatgcactcaaggaaaacgacccctctagcgtgctgctcttcctcgtaggctcgaagaaggacctcagtacacccgcacagtatgccctcatggaaaaggacgcacttcaagtagcgcaagagatgaaaactgtccagaggttgccgtccccacgcgccctttgccaccctcacagtagcagggcctag

SEQ ID NO: 131512 - DNA, 1002 bp, Artificial Sequence
  Description of Artificial Sequence: Synthetic coding sequence
atggtaattgcaggggcatcctggatgctgggaagggcagctgcttctccgactcagacgcctcctactaccagcactattcgagtggccagaaggtcacgcgtagctcttgtagctatggtgattgctgcagccggttccgggggtcctggcagggcagaaccccagcttagccaaccatccctggactgcggcagaatgcgaagcagcctcacccccctcggtccgcccgtatctcgagatagagtgatcgcctcatttccgaagtggtatacaccagaagcgtgtttgcagctgcgggaacacttccatggccaggtcagcgccgcctgccagagacgcaacaccggtaccgtgggtctgaaactgagtaaggtcgtcgtcgttggagatctctatgtgggaaagacttccctgatccaccgcttctgcaagaacgtctttgaccgggattacaaagccaccatcggggtggactttgaaatcgagcgtttcgaaatcgcgggcatcccctatagcctacaaatttgggacacagcaggacaggaaaaattcaagtgcatcgcatctgcctactacagaggcgcccaagtgattatcacagcttttgacctgactgatgtacaaacacttgaacatacccggcaatggttggaggatgcacttagggagaacgaagctggatcatgcttcatcttccttgttgggacaaaaaaggacctgttatccggggcggcctgtgaacaggcagaggctgacgcagtacatctggctcgcgagatgcaggccgaatactggtccgtgtctgctaaaactggagaaaatgttaaggcattctttagccgtgtggctgcgctggcgttcgagcagtcagtgctccaagacttggaacggcagagcagcgccaggttgcaagttggaaacggggacctgatccaaatggaggggtcgcccccagagactcaggaatctaaacggccatcctccttgggttgttgttag

SEQ ID NO: 131513 - DNA, 936 bp, Artificial Sequence
  Description of Artificial Sequence: Synthetic coding sequence
atggtcattgctggcgcctcatggatgctcgggcgtgctgctgcctccccgacgcagacgcctccgactacctcaacaattagagtggctcgtcggtccagagtggcactcgtcgccatggtgattgcagcagctggttctgggggaccaggtcgtgccgagccccaactgagccaaccgtcactggactgcggtcgcatgcggagtagtctcacgcccctggggccaccagtcagtcgggacagagtgattgcaagtttccccaaatggtatacccccgaggcatgtctgcagttaagagagcactttcatggccaggtgagtgccgcctgtcaacggcgaaataccgggactgtcggtttctgcaagaatgtcttcgatcgcgactataaagccacaatcggagtcgatttcgagattgagcgattcgagattgctggcatcccttattctttgcagatttgggacactgccggccaggaaaaattcaagtgcattgcctcggcatactaccgcggagcccaagtgattattacagcttttgaccttaccgacgtacagacattagaacacactagacagtggcttgaagatgcactccgagaaaatgaggccggcagttgctttattttcctggttggcaccaagaaggacctgttgtcaggggctgcgtgcgaacaggcagaagccgatgccgttcacctggccagagagatgcaggccgaatattggagtgtcagtgccaagactggagaaaacgtgaaggcctttttttctagagttgcagcgctcgctttcgaacaatctgttttacaggatcttgaacgacagtccagtgctaggctgcaagtgggcaacggggatctcatccagatggaagggagccctcctgaaacgcaggaatctaaaaggccatcatccctaggatgctgctag

SEQ ID NO: 131514 - DNA, 498 bp, Artificial Sequence
  Description of Artificial Sequence: Synthetic coding sequence
atggtgatcgccgccgcaggaagcggcggccctgggcgcgcggaaccccagctgtcccaaccttctctggactgtggccgtatgaggtccagtctcacccccctcggtcccccagtctctcgggacagagttattgctagttttccaaagtggtatactccagaggcttgcctgcagctccgtgagcattttcatgggcaggtctccgctgcatgccagcggagaaatactggcaccgttgggctgaagctttccaaggtcgtggtggttggggatctctatgtgggcaagacaagcctcagtgcacagtatgctcacccgcagggctttctgaccgctatgaatcagccgcacagtcctcgtcccctgagcccgggctacgctcacagctcccacccctccagggccgttgcaagtagacgctggcgggcaccctgcaggcagcctagcgatcaatattgttctccgcgggcctggcatacggccgcagccctctag

SEQ ID NO: 131515 - DNA, 549 bp, Artificial Sequence
  Description of Artificial Sequence: Synthetic coding sequence
atggacctgcaaagacctgattcctatcagggcggcgccggaccagacttcaacgatcatgtactacataaaacgatcctggtgggagatagtggcgtaggcaaaacatctctgttagtgcaattcgatcaaggaaaattcatacctggcagctttagcgctactgtgggaattggtttcacaaacaaagtggtcactgttgatggcgttagggtgaagctccaaatatgggacacggcgggtcaagaacgcttccgatccgtgacacatgcttattaccgcgacgcccaggcactgctcctgctgtatgatatcaccaacaagagttcctttgacaacattagggcctggctcacagagattcatgagtatgcacagcgggacgtggtaataatgctgctgggcaataaggctgatatgtccagcgaacgggtcatccgcagcgaggacggggagacattggcccgggagtacggcgtcccattcctggagacctccgccaagaccgggatgaacgtagagctggcgtttcttgcgatcgctaaatag

SEQ ID NO: 131516 - DNA, 570 bp, Artificial Sequence
  Description of Artificial Sequence: Synthetic coding sequence
atgaccggaaccccaggcgctgtggctacccgtgatggtgaggctcctgaacgctcgccaccttgcagtccctcctacgacttaacgggcaaggttatgcttttaggtgataccggggtaggaaagacatgcttcctcatacagtttaaggatggcgcattcttgagcggcacatttatagctactgtgggcattgactttcgcaataaggtggttaccgtggacggcgttagagtgaaacttcagatctgggataccgccggacaggaaagattccgatcagtgacccatgcctactaccgggacgcgcaagctctcctgttgttgtatgacatcactaataagtcgtcattcgataacattagggcctggttgactgaaattcatgaatatgcacagcgggacgtagtcatcatgctcctgggaaataaggccgatatgtccagcgagagggtcatacgttcggaggacggagagactttggcacgcgagtatggggttccttttttagaaacctctgctaaaaccggtatgaatgtcgaactggcctttttggctatcgccaaatag

SEQ ID NO: 131517 - DNA, 561 bp, Artificial Sequence
  Description of Artificial Sequence: Synthetic coding sequence
atgacaggcaccccaggagcagttgccacaagggacggtgaagcaccagaacgtagtcctccttgctctccttcctatgaccttaccggaaaaaataaggtggtgacagtcgatggagtgagggtaaaactgcagatctgggacacagctggtcaggagaggttcagatctgtgacacatgcctactaccgagacgcccaggccctgctcctgctatatgatattacaaataagagctccttcgataatattcgagcatggctaactgagatacatgaatacgctcagcgcgacgtcgtgatcatgttattgggcaacaaagcggacatgtctagcgagcgggttatcagatcagaggacggggagactctggcccgcgagtatggcgtaccattccttgaaacgagcgccaagaccgggatgaacgtggagcttgcctttctggctattgcgaaagagctgaagtacagggcagggcatcaagcagatgagccgagctttcagattcgagactatgttgaatcgcagaaaaagaggagcagctgttgcagcttcatgtag

SEQ ID NO: 131518 - DNA, 672 bp, Artificial Sequence
  Description of Artificial Sequence: Synthetic coding sequence
atgaccggcactcccggagctgttgctactagagacggcgaagctccagaacgtagccccccttgttcgcccagctacgacctcacaggcaaggtcatgttgctgggcgacacaggggtgggtaagacctgctttctaatccaatttaaggacggagctttcctttcaggaacttttatcgctacggtgggaatcgatttccgaaacaaagtcgtgactgttgacggggtcagagtaaagctgcagatttgggacacagcggggcaggaacgattcagatccgtgacccatgcctactacagagacgcccaggcccttttgttactgtatgacatcaccaataaatccagtttcgataacattagggcatggctgactgagattcacgaatatgcccaaagggatgtcgtgatcatgctgctgggaaacaaagcagacatgtctagcgagcgggtcattaggtcggaggacggcgaaaccctagctcgagaatacggcgtcccctttctggagaccagcgccaaaactggaatgaacgtcgaactcgcatttctggctatcgcaaaggagctaaaatatagagctggacaccaggctgacgaaccgtcctttcagatcagggattacgtggagtctcagaaaaagcgctcttcttgctgctcctttatgtag

SEQ ID NO: 131519 - DNA, 687 bp, Artificial Sequence
  Description of Artificial Sequence: Synthetic coding sequence
atgtggctcatgagtgaagctcatggcgctgagcctgtactgttaagagaggcagccagaccatttacccagacgctcagactgtgtgttcctagcggaaatagcaaggttatgttattgggcgataccggcgtaggaaagacttgcttcctcattcagttcaaggacggagctttcttaagtggcacttttattgcaacagttggcattgactttcgaaacaaggtggtgactgtggatggtgtgagggtgaaacttcagatttgggacactgccgggcaggagcggtttcgctccgttacccacgcatactaccgagacgctcaggcactcctcttgttatatgatatcaccaataaaagtagtttcgataatatcagagcttggttgactgaaatacatgaatacgcacagagggatgtggtgattatgctgctcggaaacaaggctgacatgtcttcagagcgcgtcataaggtcagaggacggtgagacccttgcccgggaatacggcgtgcctttccttgaaacaagcgcaaagacaggcatgaatgtcgagctggccttcctggctatagccaaggagctcaagtacagggccggacaccaggcagatgaaccaagcttccagattcgagactacgtggagagtcagaagaagcgcagctcttgctgtagcttcatgtag

SEQ ID NO: 131520 - DNA, 576 bp, Artificial Sequence
  Description of Artificial Sequence: Synthetic coding sequence
atgtggttaatgtcggaggcccacggagcagagccagtcctgctgagggaagccgcacgtccattcacccagacgctgaggctttgcgtgccttcaggtaatagcaagaataaggtcgtcacggttgacggcgtccgcgtaaagctgcaaatctgggacaccgccggacaggagcgctttaggagtgttactcatgcttactatcgggacgcgcaggctttgttattgctgtacgatattacgaataaatcaagctttgacaatatccgggcatggctgactgaaatccacgagtatgcccagagagatgtggttatcatgttgctcggtaacaaggcggatatgtcctcggagcgagttattaggtcagaggatggcgaaactctcgcacgtgagtacggcgtaccctttcttgaaacttctgccaaaaccggaatgaatgtcgagctcgctttcctcgccatcgccaaagaactcaagtatcgtgctggccatcaggccgacgagcccagtttccagattagagactacgtcgaatcacagaagaaacggtcttcttgttgctcttttatgtag

SEQ ID NO: 131521 - DNA, 510 bp, Artificial Sequence
  Description of Artificial Sequence: Synthetic coding sequence
atggatttgcagcgtccagatagctatcaaggaggtgcagggcctgatttcaacgaccatgtgctgcataaaaccattctagtgggggactccggagtgggcaaaacctctctgttagtgcagtttgatcagggaaagttcattccaggatctttctcggccacagttggaatagggttcaccaacaaggtggtgacagtggacggcgttagggtgaagcttcaaatttgggacactgccggtcaggagagattcaggagtgtcacccacgcttattatagggacgcccaggcactgctcctgctttatgacataacaaataagtcttcctttgataatatccgggcatggctgaccgagatccacgagtacgcgcagagggacgttgtgatcatgctcctcggcaacaaggtatctggtagtggagctggcagcgcacagccttgtacgtctagcgccctggcagggcccattacgacccaggagcagctgagtagacacccctcctag

SEQ ID NO: 131522 - DNA, 651 bp, Artificial Sequence
  Description of Artificial Sequence: Synthetic coding sequence
atggacctccagcgacccgacagttaccagggcggcgcaggaccggattttaatgaccacgttctgcataagaccattctcgtcggggactctggcgtcggcaaaaccagcctgctggttcagttcgatcagggtaagtttatccctgggtcattctcggcaaccgtgggcatcggcttcacgaataaggttgttaccgtcgatggcgtgagggtgaagctgcagatttgggataccgccggccaagagcgttttcgctcagtcacccatgcctactatcgcgatgcccaggccctcctgctactctacgatatcactaacaagtcttctttcgacaacatccgcgcctggctgaccgagatccacgagtacgcccagagagatgtggtcattatgctgcttggcaacaaggcagacatgagctcagagagggtgattcgctctgaagatggcgagacactggctcgggagtatggtgttccttttctggagacgtccgccaaaacgggcatgaacgtggaactagctttcctcgcaatcgcgaaggagctcaagtatcgtgcagggcaccaggctgacgagccttccttccagattcgagattacgtggagtcccaaaaaaaaaggtctagttgctgctctttcatgtag

SEQ ID NO: 131523 - DNA, 651 bp, Artificial Sequence
  Description of Artificial Sequence: Synthetic coding sequence
atggatcttcaacggccggactcctatcagggcggcgcaggccccgattttaatgatcatgtgcttcataaaacaatcctggtgggcgattcaggtgtcggcaaaacaagcttgttggtgcagttcgatcagggtaagtttataccaggctccttcagcgcaaccgtaggtatcggatttactaataaagtggtgaccgtggacggcgtccgggtcaagctgcagatttgggacaccgcaggtcaagagagattccgcagtgtcacacatgcctattaccgagacgcacaggcgctattgctactctacgacataactaacaagtccagctttgacaacatccgggcttggctgaccgaaattcacgaatacgcccagagagacgtcgtgattatgttattaggaaataaagcagacatgtcatcagagagggtgatacgttctgaggacggagagactcttgcacgcgagtacggcgtgcctttcctggagaccagcgctaaaactgggatgaacgtggagctggcatttttggcaatcgcaaaagagctaaaatatcgggctgggcaccaggccgacgaaccttccttccagattagggactatgtggagtctcagaagaaacgtagctcatgctgctcttttatgtag

SEQ ID NO: 131524 - DNA, 672 bp, Artificial Sequence
  Description of Artificial Sequence: Synthetic coding sequence
atgacagggacccccggagccgttgcgactagagatggtgaggctccagagagatctccaccctgctccccttcctacgaccttaccggcaaggtcatgctgctgggggatactggagtaggaaagacttgctttctgattcagtttaaagatggggcctttctttcaggtacttttatcgctaccgtggggatagacttcagaaacaaggtggtgacagtggacggtgtgcgagtaaaattgcaaatctgggatacggccggccaggaacgcttcagaagcgtgacccatgcatactaccgcgacgctcaggcccttttactactgtacgacatcacaaataagtcctcttttgacaatatccgcgcttggttgaccgagatccatgaatatgcccagagagatgtggtgatcatgctgctggggaacaaagcagatatgagttcagagcgcgtgatcagatcggaagatggagagacgctggcgagagagtatggcgttccttttctagaaacgagcgctaaaaccggcatgaacgtcgagttggcctttctcgccattgccaaagagttgaaataccgcgcgggccatcaagccgatgagccctcatttcagatccgggattacgtcgaaagtcagaaaaaacgatcctcttgttgtagctttatgtag

SEQ ID NO: 131525 - DNA, 591 bp, Artificial Sequence
  Description of Artificial Sequence: Synthetic coding sequence
atgtgttgtaaagttatgctcttgggcgacaccggggtcggcaaaacgtgtttcttgatccagtttaaagacggagccttcctgtcaggcacatttatcgccacagttggtatcgattttaggaacaaagtagtgaccgtggatggtgtccgcgtaaagcttcaaatttgggacactgccggccaggagagatttcgctctgttacccacgcttactaccgggatgcccaggccctgctgttgctgtacgacatcacaaataaatcctcctttgacaacattcgggcttggctgactgagatccatgaatacgcgcagagggatgtggtaatcatgttactagggaataaggcagatatgagtagtgagcgcgtcattaggtctgaggacggcgaaacattggccagggagtatggcgtgccatttctcgaaacctccgctaaaacagggatgaacgttgagctcgcattcctcgctattgccaaggaattgaaataccgggcaggtcaccaggctgacgagccttctttccagatcagagactatgtcgagtcccagaaaaagcggtcctcgtgttgctctttcatgtag

SEQ ID NO: 131526 - DNA, 636 bp, Artificial Sequence
  Description of Artificial Sequence: Synthetic coding sequence
atgcaagcccctcataaggagcacctgtacaaactgctggtgatcggcgacttgggcgtgggtaaaacatctattatcaaacgatacgtccaccagaatttttctagccattatagagctaccattggtgtggattttgctcttaaggttctgcactgggatcctgagactgtggttcgcttgcagctgtgggatatcgctgggcaggaacggtttggcaatatgacccgcgtgtattatagagaggctatgggcgcgttcattgtgtttgatgtcaccaggcctgcaactttcgaggcagtcgcaaagtggaagaatgacctcgatagcaaactgtccttgccgaatgggaagccggtgtccgtggtgctccttgcaaacaagtgtgaccaaggaaaggatgtcctgatgaataatggtctgaaaatggaccaattttgtaaagagcatgggtttgtcgggtggtttgagacctcagccaaggagaacattaatattgatgaagctagccggtgccttgtcaagcacatcctggccaatgaatgtgatttgatggagtctattgaacctgatgttgtcaaaccacaccttacgagcaccaaggtggccagctgcagcggatgtgctaaatcatag

SEQ ID NO: 131527 - DNA, 642 bp, Artificial Sequence
  Description of Artificial Sequence: Synthetic coding sequence
atggaggcgatctggctatatcagttcaggttgattgtgatcggagatagcaccgttgggaagagctgcctgatccgacggtttactgaaggccggttcgcccaggtgagtgaccccaccgtgggagtggatttcttctcacgccttgtagaaatcgagccaggcaaaaggattaaactccagatttgggacacagcaggccaggagcgattccggagtatcacgcgtgcgtactacaggaattctgtaggtggactgctgctgttcgacattaccaacaggagatcatttcagaacgtccatgaatggcttgaagaaactaaagtacacgttcaaccttatcagatcgtgttcgtgctcgtcggacacaagtgcgacctggatacgcaaaggcaggtcactagacatgaagcagaaaagttagccgctgcctacggcatgaaatatatcgaaacttcagctagggacgctatcaatgtggagaaggcctttactgatctgacacgcgacatatacgagctcgttaagcgcggagaaatcactattcaggagggttgggagggggtcaaatccggtttcgtccccaacgttgtgcactcctctgaagaggtcgtgaaatccgagagacgctgtctgtgttag

SEQ ID NO: 131528 - DNA, 2187 bp, Artificial Sequence
  Description of Artificial Sequence: Synthetic coding sequence
atggcaggaccagagggttttcagtaccgggccttataccctttcaggcgagaacggcctgaggatctggaattgttgcccggggacgtgctggtcgtctctagggccgcgctccaggcactcggcgttgcagaaggaggtgagaggtgtcctcagtctgttggctggatgccaggactaaatgagcgcaccaggcagagaggggactttcctggaacgtacgtggaatttctcggccctgtcgcactggccaggcccgggccgagaccgcgtggcccccgtcctctccctgctcgacccagagacggtgcccccgagccaggtttaactcttccagacctgccagagcagttttcaccacctgatgtggcgcctccactgttagtaaagttagtggaagcaatcgagagaaccggcctggattctgaatcccattacagacctgaactacctgctccacggaccgattggtctctctcagacgtggatcaatgggatacggccgccctggcagacggcatcaaatcattccttctcgccctaccagctcccctggtgaccccagaagcttcagcggaggcgaggcgggccctgagagaggcagccggaccagtgggtcctgctctggagccacctacgctaccactgcatcgggcactaacattgcgttttctgctgcaacatttagggcgggtggccagtcgcgcaccagcactaggacccgcagtcagggctctcggtgcaacctttggcccccttctgctacgcgctccccctccccccagttcccctcccccgggtggcgcgccagatgggagcgaaccttcaccagacttccctgcccttctggtagagaaattgttacaggagcacctagaagagcaggaagtagcccctcctgcgctgccccctaagcccccaaaggctaaacctgcatcaaccgttctggccaatggcggatcccccccttctcttcaggatgcagaatggtactggggcgacatttcaagggaggaggttaatgaaaaactccgggacacacctgacggaaccttcctggtcagagacgcatctagcaaaattcagggggagtacaccctgactctgagaaagggaggtaacaacaaactcattaaggtgttccacagggacgggcattacgggttctcggagcctttaaccttttgctcagtggtcgatttgataaatcactatcgccacgagagcctggcacagtacaacgctaagctggacacccgtctcctttaccccgtcagtaagtaccagcaggaccaaatcgtcaaggaagattccgtagaggccgttggagcccagctgaaggtttatcatcagcagtatcaggacaaatcacgagaatacgaccagctgtacgaagagtacacgcgtacatctcaggaacttcagatgaagcgtactgcaattgaggccttcaacgaaaccataaagatttttgaagagcagggccaaacccaggagaaatgtagtaaggagtacctcgaaagatttcgtagggaggggaatgagaaagaaatgcagaggatactcctgaatagtgagcgattaaaatccaggatcgccgagatccatgagtcacggacaaagttggagcagcagctcagagcccaggcatcggataatagggaaatcgataagcggatgaatagcctgaagccggacctgatgcagttgaggaagataagagaccagtacctagtttggctaacacaaaaaggagctaggcagaaaaaaatcaacgagtggcttggaatcaaaaacgagacagaagatcagtatgcactaatggaggatgaggatgacctgccacatcatgaggagaggacatggtatgtgggcaaaataaaccgcacacaggctgaagagatgttaagcggtaaacgcgacgggactttcctgatccgggaatcctcacagagaggatgttacgcctgtagcgtagtcgttgatggagacaccaaacactgcgtaatatataggaccgccacaggtttcggattcgccgaaccctataacttatacggttctctgaaggaactcgtcctgcactatcagcatgctagcctggtgcaacacaacgacgccttgaccgttaccttggctcacccagtgcgtgcccccggtccaggccctccccccgcagcccgttag

SEQ ID NO: 131529 - DNA, 660 bp, Artificial Sequence
  Description of Artificial Sequence: Synthetic coding sequence
atggccagtgttactgacggcaaaacaggcgtcaaggatgcctctgaccagaatttcgactatatgttcaaacttttgattatcggaaatagctcagtgggcaagacatcttttctgttcaggtatgctgacgatacctttactcccgcgttcgtgtccacagtcgggattgacttcaaggtcaagaccgtgtaccgccatgagaagagggtaaagcttcagatttgggatactgcggggcaggaaagatatcgcactattacaaccgcctactacaggggagcaatgggattcattctgatgtatgacattactaacgaagagtctttcaacgccgtgcaagactgggctacacagatcaaaacatacagctgggacaatgcacaggtgatattggtcggtaataaatgcgatatggaagaggagcgtgtggtcccgactgaaaaggggcagctcctcgctgaacagctcggattcgatttctttgaagcgagtgctaaagaaaatatcagcgtgcgccaggccttcgaacgactagtcgacgccatttgtgacaagatgtccgattctctagacaccgatcctagtatgttgggctctagcaagaacacccgcttaagcgataccccccccctcctacaacagaattgcagctgctag

SEQ ID NO: 131530 - DNA, 660 bp, Artificial Sequence
  Description of Artificial Sequence: Synthetic coding sequence
atggccagcgtgaccgacggtaagactggagtgaaggacgcaagcgaccagaattttgactatatgtttaagctcctgattatcggcaactctagtgtggggaaaacaagtttcctgttcagatacgctgatgacaccttcacgccggctttcgtatccacagtggggatcgatttcaaggtaaagaccgtgtaccgtcacgaaaagcgggtcaaactccagatctgggacacagcggggcaggagaggtacaggacaattacgaccgcgtattataggggagccatgggatttattcttatgtacgacattactaacgaagaaagctttaacgcagtgcaagattgggctacacagattaaaacttatagctgggataatgctcaggtgatactggtcgggaataagtgcgacatggaggaggaaagggtggtgccgacagaaaaagggcagcttcttgccgaacagctgggatttgatttcttcgaggcttcagccaaggagaacatctctgtgagacaagcctttgagaggctcgtagatgcgatctgcgataaaatgtctgactccttggacaccgacccatccatgctggggtcttccaaaaatacacggctgagcgacaccccaccgcttctgcagcagaattgttcctgctag

SEQ ID NO: 131531 - DNA, 684 bp, Artificial Sequence
  Description of Artificial Sequence: Synthetic coding sequence
atgcgccatgaagcccccatgcagatggcttctgcccaggatgcccggtacggtcagaaagactcatctgatcagaatttcgactatatgttcaagcttttaattatcggcaactcatctgtgggaaagacaagcttcctgtttcgatacgcagacgattcttttacttctgccttcgtgagtacggtgggcattgactttaaggtgaagaccgtgtttaaaaacgagaaaaggataaagctccagatatgggatactgccggccaggaaagatacaggaccatcactactgcgtactaccgtggagcaatggggttcatactgatgtatgatatcaccaatgaggagagcttcaatgccgtccaggattggtccacacagattaaaacatactcttgggataacgcacaggtgatactggtgggcaacaagtgtgatatggaagatgaacgtgttatttctaccgaacgcggccaacacctcggtgaacagctcggctttgaatttttcgagacatcggctaaagacaacattaatgtcaagcagaccttcgaaagactggtggacattatctgtgataagatgagcgagtccctcgaaaccgatcccgccattacagcggccaaacagaacactcgtctcaaggaaacccccccccctccgcagcccaattgtgcctgctag

SEQ ID NO: 131532 - DNA, 783 bp, Artificial Sequence
  Description of Artificial Sequence: Synthetic coding sequence
atggccgggagcccactattatggggcccgcgggcaggtggagtggggctgctcgtcttgctcctgctcgggctgttcaggcccccccctgccctgtgcgcaaggcccgttaaagaacctagagggctttccgccgccagccccccactggcagaaaccggcgcacctcgcagattcaggaggtcagtcccacgcggtgaagctgcaggagcggtgcaggaactcgctagagccttagcccatttgctcgaggctgaacggcaggagcgcgctcgggccgaggctcaggaggcagaagaccagcaggctagggtgctggcacagttgttaagggtgtggggggcgccaaggaattctgaccccgctctcggattggatgacgaccctgacgcgcctgccgctcaactagcgagagccttgctaagagcacggctggaccctgccgccctcgcagcacagcttgttcctgccccggtacccgctgccgcactacgtccgcgccccccagtctacgatgacggcccagctggcccggatgctgaagaagccggagatgaaacacccgatgtggatcctgaactgctgaggtatctcctcggccgtatcctggcgggcagcgcggattctgaaggtgtcgcagcaccaagaagattacgccgagctgccgatcacgatgtgggttccgaactgcctcccgaaggggttctcggggctctacttagagttaagcggctggagacgcctgcaccccaggtgcccgcgagaagattgttgcctccctag

SEQ ID NO: 131533 - DNA, 657 bp, Artificial Sequence
  Description of Artificial Sequence: Synthetic coding sequence
atgagtcaaacggccatgtctgagacatatgacttcctgttcaagtttctggtcattggtaacgccggaacagggaagtcttgtcttctgcaccagtttatcgagaaaaagttcaaagacgactccaatcatactatcggggtggaattcgggagcaaaataatcaacgttggcggtaagtacgtaaaacttcaaatttgggatactgctggccaagaacggtttcggtctgtcacccgcagctactatcggggcgccgctggagctctgcttgtgtacgacatcacttccagggaaacttataatgcgttgacgaactggctcaccgatgcacgaatgttagctagtcagaacattgtcatcattctttgcggcaacaagaaagatctggatgccgacagggaggtgaccttcttggaggcttctaggttcgcgcaggaaaacgagctcatgtttttagagacttctgccttgacgggcgagaacgttgaggaggcttttgtccagtgcgccagaaaaatcctcaataagatagaatcaggcgagttggatcccgaaagaatgggcagtgggatccagtatggagacgccgccctgcggcagctgcgatctccaaggagggcacaggcccccaacgcacaagaatgtggatgctag

SEQ ID NO: 131534 - DNA, 648 bp, Artificial Sequence
  Description of Artificial Sequence: Synthetic coding sequence
atggcgtcccgaggcgcgaccagacccaatggaccgaacacaggcaacaaaatttgtcaattcaagctggtcctgctcggggaatctgctgtgggtaagtccagtctggtccttaggtttgttaagggccagtttcacgagttccaagaaagtaccatcggggccgcctttcttacacagaccgtctgtctagatgatacaaccgtaaaattcgaaatttgggacaccgctggccaggagcgctatcactctctagcacctatgtactaccgaggcgctcaagccgctatcgttgtgtatgatatcacaaacgaagagagctttgccagggcgaagaattgggttaaagagctgcaacgacaggcatctcccaacatcgttattgctctgtctggtaacaaggctgatctcgccaataagagagcagtggatttccaggaggcccagtcatatgctgacgacaattccttgctctttatggagacctcggccaagacctccatgaatgtgaacgagattttcatggcaattgcaaagaaactgccgaaaaacgaaccgcagaaccccggtgctaactctgcaagggggagaggcgtggatttgaccgaacctacacaaccaactcgcaatcagtgctgttccaactag

SEQ ID NO: 131535 - DNA, 606 bp, Artificial Sequence
  Description of Artificial Sequence: Synthetic coding sequence
atggcctcccgaggcgccacacgacccaatggtcccaatacaggaaataaaatttgtcagtttaaactggtcctcctgggagaatccgcagtgggaaagtccagtttagtcctgcggttcgtaaaggggcagttccacgaattccaggaaagcacaataggggtgaagtttgaaatctgggacaccgctggccaagagcggtaccatagtctcgctccaatgtactacagaggagcgcaggcggccattgtcgtgtatgatattacaaacgaagaaagcttcgccagggcgaaaaactgggtcaaagaactgcaacgccaggcttcacccaacatcgttatcgctctgagcggcaacaaagccgacctcgctaataagagagctgtcgacttccaagaggcccagtcctatgccgacgacaacagcctgctctttatggagacctctgcaaagacgagcatgaacgtgaatgagatttttatggccatagctaagaaattgcctaagaacgagccccagaacccgggagcaaatagtgcgagaggcagaggtgtggatttgactgaaccgacccaaccaacccgaaaccagtgctgttcgaattag

SEQ ID NO: 131536 - DNA, 48 bp, Artificial Sequence
  Description of Artificial Sequence: Synthetic coding sequence
atggcctcccgcggggcaacccgcccaaacggtcccaacacagggtag

SEQ ID NO: 131537 - DNA, 648 bp, Artificial Sequence
  Description of Artificial Sequence: Synthetic coding sequence
atgacctcaagatcaacagcgcgtcccaatggtcagccccaagccagtaagatctgccagttcaaattagtgctcttgggcgaatcagctgtgggaaaaagcagcctagttttgcgattcgttaaaggtcaattccatgaataccaggagagtaccataggcgctgcatttcttacccaaagcgtttgtctggacgacactactgtcaagtttgaaatctgggacaccgcaggccaggaacgctatcattccctcgccccgatgtactaccggggagcccaggcagccattgttgtgtatgacattacaaaccaagaaacattcgcaagggccaagacttgggttaaagagctgcaaaggcaggcttctccctccattgtcattgctcttgctgggaacaaggccgacctagctaacaagaggatggtcgaatacgaggaggctcaggcgtatgctgacgataactcccttttgttcatggaaacctccgccaagactgctatgaacgtcaatgatctcttccttgctattgctaaaaagctccctaagtccgagccccagaaccttgggggcgccgcgggacgcagtcggggcgtggacttacacgagcagtctcagcagaataagagtcaatgctgctcaaattag

SEQ ID NO: 131538 - DNA, 525 bp, Artificial Sequence
  Description of Artificial Sequence: Synthetic coding sequence
atgacctcacgctcgacagcccgaccaaatggtcagcctcaggcttccaagatttgccagtttaagctggtgctgctaggcgaatcagctgtcggaaaatcaagtctggtgctgagatttgtcaaggggcaattccacgagtatcaagaaagcaccataggcgcggccttccttacgcagtcagtttgccttgatgataccacagtaaagtttgagatttgggacactgcaggccaggaacggtatcactctctcgctccaatgtactatcggggagcacaagccgctatcgttgtgtatgacattaccaatcaggaggcacaggcgtacgctgatgacaactctctgctgttcatggaaactagtgccaagactgccatgaacgtcaatgacctcttcctcgccattgctaagaagctgccaaagtctgagccccaaaacctcggcggggcagccggacgatctcgcggggtggaccttcatgaacaaagccaacaaaacaaaagccaatgctgtagtaactag

SEQ ID NO: 131539 - DNA, 348 bp, Artificial Sequence
  Description of Artificial Sequence: Synthetic coding sequence
atgacctctcgtagtaccgcgagacctaacggccagccacaggccagcaaaatttgccagttcaagttagtactgcttggggaatctgccgtgggcaagagcagcttggtcctccggtttgtgaaagggcagtttcatgagtaccaggagtctacaattggcgctgcatttctgactcagtctgtgtgcttagatgacactactgtgaagttcgaaatttgggataccgcgggtcaagagcgctaccactccttggccccgatgtactatcgtggggcacaggccgcaatcgttgtgtatgacattaccaaccaggagacctttgcacgcgcaaaaacctgggtctag

SEQ ID NO: 131540 - DNA, 303 bp, Artificial Sequence
  Description of Artificial Sequence: Synthetic coding sequence
atgacctcacggagtactgctcgtccaaatggtcagccacaggcgtcaaaaatttgccagtttaagctggttctgctgggcgagtccgctgtgggaaagagcagtttggtgctacgctttgtgaagggccagttccatgagtaccaggagagcacaattggcgctgcatttttaacacaaagcgtgtgcctggatgatactactgtaaagttcgaaatttgggacactgccggccaagagaggtatcatagcctggcacctatgtactataggggggcccaggcagcaatcgttgtgtattag

SEQ ID NO: 131541 - DNA, 648 bp, Artificial Sequence
  Description of Artificial Sequence: Synthetic coding sequence
atgacttcccgcagtactgcgaggcccaacgggcagccgcaggctagcaagatctgtcagttcaagcttgtgctgctgggggagtctgccgtcgggaagagctcactggtccttaggtttgttaaaggacagtttcacgagtatcaggagagtaccattggggctgccttcctgacccaatcagtgtgcctagatgataccaccgtaaaatttgaaatctgggatactgccggtcaggaaagatatcattcactggcaccaatgtactaccggggtgcccaggctgctatcgttgtctacgatatcactaatcaggaaacatttgcgagagctaagacttgggtgaaggagcttcagaggcaagcctctcctagcatagtgattgccctcgctggaaacaaggctgatctcgccaacaagaggatggtggaatatgaggaggcacaggcatacgcggacgataactctttgctgttcatggagaccagtgccaagactgctatgaacgttaacgatctttttctggcaatcgcaaaaaagctgccaaagagtgaaccgcagaacctgggtggagcagcgggtcggtccagaggtgtggatttacacgagcaaagtcagcagaacaagtctcaatgctgtagcaattag

SEQ ID NO: 131542 - DNA, 651 bp, Artificial Sequence
  Description of Artificial Sequence: Synthetic coding sequence
atggctggccggggtggcgcagctcgacccaatggtcctgcggccggcaataaaatatgccagtttaagctggtcctgttgggggagtcagctgtcggaaagagctccctcgtgctgagattcgtaaaaggtcaattccacgagtaccaagagtcaacgattggtgccgcattcctgacacagaccgtgtgcctggacgatacaaccgtaaagtttgagatatgggacacagctgggcaggagagatatcactccctggctccaatgtactataggggggcccaggcagcaatcgttgtttacgatatcacaaatacagatacgtttgccagggcaaaaaactgggtcaaggaactgcaacggcaggcttccccaaatatcgtgattgctctggcagggaataaggccgatctggcttcaaagagagctgtcgagtttcaggaggcgcaggcatatgccgatgacaattccctgttgttcatggaaacctctgcaaagactgccatgaatgtcaatgaaatattcatggctatcgcgaaaaagctgcccaagaacgagcctcagaacgcaactggcgctcccggccgtaatcgaggtgtagatttacaggaaaacaatccggcatcccgctcccagtgttgcagtaattag

SEQ ID NO: 131543 - DNA, 651 bp, Artificial Sequence
  Description of Artificial Sequence: Synthetic coding sequence
atggccggacgaggaggggcggccaggccaaacggacctgctgcgggaaacaaaatatgccagtttaagctggtgctgcttggagagagcgccgtaggcaagtctagcctggtgctgcggtttgtgaagggtcagtttcacgaataccaagagagcaccattggcgccgccttcctcacgcaaacggtatgccttgacgataccaccgtgaaatttgaaatttgggacaccgccggacaagagaggtatcattccctcgctcccatgtattacaggggcgcacaagctgctatcgtggtgtatgacatcacgaatactgacacctttgctagggctaagaattgggttaaagagttacagcgccaggcttctcctaatatcgtgattgcgctagctgggaacaaagccgatctcgcctctaagcgcgccgtcgagtttcaggaagcacaggcctacgcagacgataattcactactgtttatggagacaagtgcaaaaaccgccatgaacgtgaacgagatctttatggctatcgcaaaaaaactaccgaagaacgaacctcaaaacgctactggtgctcccgggcgaaataggggggtagacctgcaagaaaataatcctgccagtcgctctcaatgttgctccaactag

SEQ ID NO: 131544 - DNA, 750 bp, Artificial Sequence
  Description of Artificial Sequence: Synthetic coding sequence
atggaactatcatggagatctcctagtccactctccgccagcttacactcgacctcaccccacccccatgcactgtggaccactaccgccggccgggccatggcgggtagagggggggcagctaggcccaacgggcccgccgcaggcaacaaaatatgccagtttaagctggtgttgttaggagagtcagcagtcgggaaatccagcctcgttttaaggttcgttaaaggccaatttcatgaataccaagagtccacaatcggggctgccttcctgactcaaacggtgtgtcttgatgacacgaccgtgaaattcgaaatatgggacactgctggtcaggagcgttaccatagcctcgctcccatgtattaccggggcgcccaagcagccatcgtcgtttacgatattacaaacaccgacactttcgccagagccaaaaactgggtgaaggagctgcagcgacaggcctcccctaacatcgtgatcgccttggcaggtaataaagctgatttagcctcaaagagagctgttgagttccaagaggcccaggcctatgcagatgacaatagcttgctgtttatggagacctctgcgaaaactgcaatgaacgtgaatgaaatcttcatggcgattgctaaaaagctccccaaaaacgaacctcagaacgccacgggcgcccccggtcgaaacagaggagtcgacctgcaggagaataaccccgctagtagatcccagtgttgtagcaactag

SEQ ID NO: 131545 - DNA, 225 bp, Artificial Sequence
  Description of Artificial Sequence: Synthetic coding sequence
atggcgggaaggggaggcgccgcccgccccaacggacctgctgctggtaacaagatctgtcagtttaagctggtgctactgggggagagcgcagtgggcaagtcatctctggtcctccggtttgtgaaaggccagttccatgaatatcaggaatctaccatcggcgcagcatttctgacgcagacggtgtgtctagatgatactaccgtcaaatttgaaatctag

SEQ ID NO: 131546 - DNA, 279 bp, Artificial Sequence
  Description of Artificial Sequence: Synthetic coding sequence
atggccggacgaggcggcgctgctaggcctaacggccccgcggccggtaacaaaatctgccaattcaagttggttctcctcggggaaagcgctgtgggtaaatcctccctagttctgaggtttgtcaaagggcagttccacgagtatcaggaaagcacgatcggagctgcttttttgacccagaccgtgtgtcttgatgacaccacggtgaagtttgaaatctgggataccgccggacaggagcggtatcactccctggcccctatgtactaccgctag

SEQ ID NO: 131547 - DNA, 375 bp, Artificial Sequence
  Description of Artificial Sequence: Synthetic coding sequence
atggccggtcgaggaggagcggcccgacccaacggaccagctgccggcaataagatttgccagtttaagctcgtgctcctcggggagtccgccgtgggtaaaagcagtcttgtgctcaggttcgttaagggccagttccacgagtatcaggaatctacaatcggggccgccttcctcacccagacagtgtgcttagacgatactacagtcaagttcgagatctgggataccgctggacaggagcgctatcacagccttgcaccgatgtactaccgcggcgcacaggcagctattgtagtgtacgatattacgaacaccgacacatttgctagggccaaaaactgggtgaaggagttacaacgtcaggccagctag

SEQ ID NO: 131548 - DNA, 627 bp, Artificial Sequence
  Description of Artificial Sequence: Synthetic coding sequence
atgtccacaggtggggatttcgggaaccccctgcggaagttcaaactggtttttctgggcgagcagagtgtgggtaagacgtcactgattacaagattcatgtacgattccttcgacaacacctaccaggctaccatcggcatcgatttcctgagcaagacaatgtatctggaagaccgtactatcagactacagctgtgggataccgcagggcaagaaaggtttcgatcactgatcccgagctatatcagggattcagccgccgcggtggtggtttatgatattactaacgtgaactcatttcagcaaacaactaagtggattgatgacgtgcgaactgagagaggcagtgacgtaattataatgctggtaggtaacaagacagacctggctgataaacggcaggtgtctattgaagagggagagcgaaaagcaaaagagctgaacgtgatgttcattgagacctcagctaaggctgggtataacgtaaaacaattattcaggcgtgtggcagcggcgcttcctggaatggagagtactcaagatagatcaagagaagacatgattgatataaaattggagaaaccccaggaacagcctgtgtcggagggaggctgcagttgttag

SEQ ID NO: 131549 - DNA, 627 bp, Artificial Sequence
  Description of Artificial Sequence: Synthetic coding sequence
atgagcacggggggcgactttgggaatcctttgagaaagttcaaacttgttttcctcggcgaacagagtgtagggaagactagcttgatcactagatttatgtatgactcatttgacaacacgtaccaagcaacgatcggaatagatttcttatcaaagactatgtacctagaggatcgcacagtgcgccttcaactgtgggacaccgctggccaggagaggttcagatctctgatcccttcctatatccgagactctacagtggcagtggttgtgtacgacatcactaacgtaaattccttccaacagacgaccaagtggatcgatgatgtccgaaccgaaaggggaagcgacgtgattattatgctagttggcaacaagacagacctggccgataaaaggcaggtgagtattgaggaaggcgaaagaaaggctaaggaactgaacgtgatgtttattgaaacaagtgcaaaagctggatacaatgtgaaacaacttttccgaagggtggccgcagccctgccggggatggagtcaacgcaggatcgctctagagaggacatgatcgatataaagttggaaaagccccaggagcagccagtgagcgaaggaggttgtagttgctag

SEQ ID NO: 131550 - DNA, 627 bp, Artificial Sequence
  Description of Artificial Sequence: Synthetic coding sequence
atgtctactgggggagacttcggaaaccctctccgaaaatttaagctggtgttcctgggcgaacagtctgtcgggaagacttctcttatcacccgcttcatgtacgattccttcgacaatacttaccaggccactattggcatcgattttctctcaaagactatgtacctggaggatagaacaataaggctgcaactttgggatactgccggccaggaacgattccggtccctgatcccaagttatataagagactccgccgccgccgtggtcgtttatgacatcaccaatgtcaattccttccagcagacaaccaagtggattgacgacgtcaggaccgaaaggggctccgatgtgatcatcatgctcgtggggaacaagactgatttagcagacaaaagacaggtctccatcgaggagggtgagagaaaagccaaagaactgaacgttatgtttatcgaaacatccgcgaaagccggctacaatgtaaagcaactttttagacgggtggcagcggcattacccggcatggaatcgacacaagatagaagccgggaagacatgatagatatcaaactcgagaagccgcaggaacagcctgttagcgagggaggctgctcttgctag

SEQ ID NO: 131551 - DNA, 525 bp, Artificial Sequence
  Description of Artificial Sequence: Synthetic coding sequence
tgaccactgagaaagttcaagcttgtcttcctgggggagcagagtgtgggtaagacatccctcatcactcgttttatgtacgattcgttcgacaatacgtaccaggccaccataggtatcgattttctgtcaaaaaccatgtacctggaggacaggacggtcagactgcagctgtgggacaccgccgggcaggagcggttccgatcactcatcccgtcatacattcgggatagtacggttgccgtggtggtgtatgatataacaaatgttaatagtttccagcaaaccacgaaatggattgacgacgttcggactgagcgaggcagcgacgtcattatcatgctcgttggcaacaagacagaccttgcagataaaagacaggtgagtatcgaagaaggtgaacggaaggccaaagaactgaacgtaatgtttattgagacctccgctaaagcgggctataacgtgaaacagcggatcggctcctgtcacgttgcacaggcttctctcgagctgcttgactcatag

SEQ ID NO: 131552 - DNA, 225 bp, Artificial Sequence
  Description of Artificial Sequence: Synthetic coding sequence
atgagcacagggggtgactttggcaatccgttgagaaaattcaagttggtatttctaggggagcaatccgttggcaagaccagccttataacccgttttatgtacgattccttcgataacacatatcaggcgaccatcggcattgacttcctgtcgaagacaatgtaccttgaggatagaacggtccgactccagctgtgggatacagcaggacaggaacgctag

SEQ ID NO: 131553 - DNA, 528 bp, Artificial Sequence
  Description of Artificial Sequence: Synthetic coding sequence
atgtacgattcctttgacaatacctatcaggccactattgggattgacttccttagcaagactatgtacctggaggatagaaccattaggttgcagctgtgggacaccgctggtcaggagcgcttccggagcctgatccccagctatatacgggacagtgccgctgcagtggtggtctatgacattaccaacgtcaactccttccagcagaccacaaagtggatagatgatgttcggactgagagaggctcagacgtcattatcatgttggtggggaataagacagatttggccgataagcggcaggtgagcattgaggaaggggagagaaaagctaaggaattgaatgtgatgttcattgaaacaagcgccaaggcaggttataatgttaagcagctgtttaggcgggttgccgcggccttgcccgggatggagagcacccaagataggtctcgggaggatatgatcgatatcaagcttgaaaagccgcaggagcaaccagtgagcgaaggaggctgctcatgttag

SEQ ID NO: 131554 - DNA, 429 bp, Artificial Sequence
  Description of Artificial Sequence: Synthetic coding sequence
atgtctactggaggagattttggcaaccctttacgtaaatttaagctggtattcctcggcgagcagtctgttggcaagacctctcttatcacgcggtttatgtatgactcattcgacaatacttatcaggctacaataggaatcgatttcctctcaaaaaccatgtatctggaagacagaactatccgccttcagctctgggatactgccggtcaggaaaggttcagatctcttatacccagctacatacgggactccgccgccgcggttgtggtctacgatatcacaaatgtcaacagcttccagcagaccaccaagtggatagacgatgtccgaacagagcgtgggagcgatgtaattattatgttggtgggcaacaaaaccgatctcgctgataagcgtcaggtcagcatagaagagggtgaatag

SEQ ID NO: 131555 - DNA, 315 bp, Artificial Sequence
  Description of Artificial Sequence: Synthetic coding sequence
atgagcacggggggagacttcggcaacccactgcggaaatttaaactcgtgttcctcggagaacagtctgtcggtaagacaagcctcattacacgctttatgtacgacagttttgacaacacatatcaggccaccattgggattgatttcctgtcaaagacaatgtatctcgaggatcgcaccctgtttcggagagtagccgcagccttgccaggcatggagtctactcaggatcgttccagggaagacatgattgacatcaagctcgagaaaccccaggaacaaccagtctccgagggggggtgctcctgttag

SEQ ID NO: 131556 - DNA, 606 bp, Artificial Sequence
  Description of Artificial Sequence: Synthetic coding sequence
tgagtgtttccaagagggcttgcacttcgctccgctgacgtggtggaggttggcaagacaagtctgattactaggttcatgtacgactcgttcgataacacgtatcaagctaccatcgggattgacttcctgagcaagacgatgtatcttgaggacaggaccattcggcttcagttgtgggacaccgctggccaggaacgcttcagatcactcatccctagctacattcgcgatagtgcggctgccgtcgtggtttacgatatcactaatgttaacagtttccaacagactaccaagtggatcgatgatgttagaacagaacggggttctgatgtcatcattatgctggtcgggaataagacggatctagctgacaaaaggcaggttagtatcgaggaaggtgaaaggaaggccaaggagctgaatgtgatgtttatcgagacctctgctaaagccggttataatgtgaagcagctcttccgacgggtggccgctgccttgcccgggatggagagtacccaagatcgcagcagagaggacatgatcgatatcaagctggagaaacctcaagagcagccagtgtcggagggcggatgtagctgttag

SEQ ID NO: 131557 - DNA, 144 bp, Artificial Sequence
  Description of Artificial Sequence: Synthetic coding sequence
atgagtactggtggggatttcggcaaccccctccgtaaattcaaacttgtattccttggagaacagagtgtggggaagacatcgttgatcacaagatttatgtacgattcgtttgacaacacataccaggcgacaattggatag

SEQ ID NO: 131558 - DNA, 765 bp, Artificial Sequence
  Description of Artificial Sequence: Synthetic coding sequence
atgagcgcagggggcgactttggaaacccacttagaaaatttaaactcgtctttcttggggagcagtccgtggccaaaacttccctcattactcgcttcagatacgattcctttgataacacataccaggctattattggtattgatttcttatcgaaaaccatgtacttggaggacggaacaattggcctgaggttatgggataccgcagggcaggagcgccttcgcagcctaattcctaggtatatcagagactcagcagccgctgtggtcgtatatgacattactaacgtgaatagctttcagcagacaacgaaatggatcgacgatgttagaaccgagcggggaagtgatgttatcattaccctagtgggcaatcggaccgacctggccgacaagcgacaggtctccgtagaggagggagaacgaaaggccaaaggactcaatgttacattcatcgaaacccgggcgaaagccggatataatgttaagcagctgtttcgcagagtcgccgccgccctcccagggatggagtcaacccaggatggcagcagagaggacatgtcagatatcaaactggaaaaaccacaggagcagactgttagtgagggaggatgctcctgctacagtcccatgtccagttccacactaccacagaagccaccgtattcttttatagattgttcagtcaacatcggactgaaccttttcccaagcttgataacattttgcaacagttcactgctccctgtttcctggcgatag

SEQ ID NO: 131559 - DNA, 612 bp, Artificial Sequence
  Description of Artificial Sequence: Synthetic coding sequence
atgggcagccgggatcacctcttcaaggtgttggtagtaggggacgctgcagtgggcaaaactagcctggtgcaaaggtactcgcaagattctttctcaaagcactataagtccacagtaggcgtggattttgctttgaaggtcctgcagtggagcgattatgagatagtgagattacaactgtgggatattgccggacaagagagattcacctcaatgacaaggttgtactaccgcgacgctagtgcctgcgttattatgttcgatgttaccaacgctacaacgtttagtaactcccagagatggaaacaagatctcgactcaaaactaactctgcccaacggtgagccagttccctgtctactgttggcaaataagtgtgacctctcaccatgggctgtcagcagagaccagatcgacagattctcaaaggagaatggctttaccggctggactgaaacttccgtgaaggaaaacaagaatatcaacgaggccatgcgtgttctcatcgaaaagatgatgcggaatagtacggaggatataatgagcttgagtacacagggtgattatataaacctacagacaaagtcatcttcatggtcttgttgttag

SEQ ID NO: 131560 - DNA, 612 bp, Artificial Sequence
  Description of Artificial Sequence: Synthetic coding sequence
atgggctctcgcgatcaccttttcaaagtgctggttgttggtgatgccgcagtcggaaagacatccctagtccagcggtactctcaggactccttttcgaagcactacaaaagtacagtgggagtcgatttcgctctgaaggttctgcaatggtccgactatgaaatcgtgcgtttgcagctgtgggacatcgccggacaggagagatttacttctatgactcgcctctattatcgagacgctagtgcttgtgtgatcatgttcgacgtgacaaacgccaccaccttcagtaattcccaaagatggaagcaagacctcgatagcaagttgacactgccaaatggcgaacccgtcccctgtttgctgctggccaacaagtgtgacctctcaccttgggccgtctccagagatcagattgacaggttttctaaagagaatgggttcaccggctggacggaaacaagcgtgaaggaaaataagaatatcaatgaggccatgagagtgcttatcgaaaaaatgatgagaaattctaccgaagacatcatgtctctaagtacacagggggactatattaacctgcaaacgaaaagctcctcgtggagctgctgctag

SEQ ID NO: 131561 - DNA, 612 bp, Artificial Sequence
  Description of Artificial Sequence: Synthetic coding sequence
atgggctcaagggatcatcttttcaaggtgttggtagtgggtgatgcagccgtaggcaaaaccagtctcgttcagcgatattcacaggattctttcagtaaacactacaagagtaccgtcggggtcgatttcgctctgaaagttctgcagtggtcagactatgaaattgtccggctgcaactgtgggacatcgccgggcaagagcggtttacttctatgacaagactgtattaccgagatgcttccgcatgtgtgatcatgttcgacgtcacaaatgccaccaccttttccaattctcagaggtggaaacaggatctagactcaaagttaacactccccaacggggagcctgtcccatgcctcctgctagccaacaagtgcgatctctcgccctgggcggtgagtagggaccagatcgatcgcttctccaaagagaacggcttcaccgggtggaccgaaacatccgtcaaggaaaataagaatattaacgaggcaatgagagtgctcattgagaagatgatgcggaatagtaccgaggatataatgtctcttagcacccaaggagactatatcaatttacagacaaaaagcagtagctggagctgctgttag

SEQ ID NO: 131562 - DNA, 396 bp, Artificial Sequence
  Description of Artificial Sequence: Synthetic coding sequence
atgacccgcctctattatcgggacgcgtcagcctgcgtgataatgtttgatgttacaaacgcaaccacattctctaattcgcaaagatggaaacaggatctggactcaaaactcaccttgccaaacggtgaacccgtcccctgtctgttgctggcaaacaaatgtgacctgagtccctgggcagtgtcacgagatcagattgaccggttctccaaggaaaatggctttactgggtggacagaaacctcagtgaaggaaaacaaaaatatcaatgaggccatgcgcgtgttaattgagaaaatgatgcgcaactctaccgaggacatcatgagcttatccacacagggcgattatataaacctgcagacgaagagttcatcctggtcatgctgctag

SEQ ID NO: 131563 - DNA, 540 bp, Artificial Sequence
  Description of Artificial Sequence: Synthetic coding sequence
atggggtcccgcgatcaccttttcaaggttctggtagtgggcgatgccgctgtcggcaagacatccttggtgcaacgctactcacaagactccttctcaaagcactacaagtctaccgtggggggacaggagcggtttacatccatgactaggctatattatcgcgatgcctctgcatgcgtcattatgttcgacgtgaccaatgccaccaccttctcaaattcacagcgatggaagcaggacctggactcaaagctaactctgcctaacggagaaccagtaccgtgcctcctgcttgctaacaagtgcgatctctccccatgggccgttagtcgcgatcagattgatcgattttctaaagaaaatggtttcacgggttggaccgaaaccagcgtgaaagaaaacaaaaatatcaacgaggctatgcgtgttctgattgagaagatgatgagaaattctaccgaagacattatgtctctgagcacccagggtgactatatcaatctccaaactaagtcatcctcctggtcttgctgttag

SEQ ID NO: 131564 - DNA, 624 bp, Artificial Sequence
  Description of Artificial Sequence: Synthetic coding sequence
atggcgaagacatacgattaccttttcaaattgttgctgattggcgacagcggggtgggaaagacttgcgtgctgttccgcttttctgaagacgcctttaactctacgttcatatcaacaatcggcattgatttcaagatcaggacaatcgagcttgatggtaagcgcattaaacttcagatttgggataccgccggtcaagagagatttaggacaataacaactgcctactacaggggagcaatgggcattatgctcgtctacgatatcaccaacgaaaagtcattcgataacatcagaaactggattagaaacatagaagagcatgccagcgcagatgttgagaaaatgatactgggtaataagtgcgatgtgaatgacaagaggcaggtgagcaaagaaaggggagagaaattagcccttgactatggcattaagttcatggaaacttccgcaaaggccaatattaatgtagaaaatgccttctttaccttggcaagagacataaaggctaagatggataagaagcttgagggcaatagcccccagggaagcaatcaaggagtgaagatcacccctgatcaacagaagagaagcagctttttccgctgcgttctgctgtag

SEQ ID NO: 131565 - DNA, 606 bp, Artificial Sequence
  Description of Artificial Sequence: Synthetic coding sequence
atgagtggtaagtccctgttacttaaggtgatactgcttggcgatggtggcgtggggaagagcagtctgatgaatagatacgtgacaaacaaatttgattcgcaggcgttccataccatcggggtggaattcctgaacagagatttggaggtggacggtagattcgtcactctccagatctgggatacagcagggcaagaaagatttaagtccttgaggactcctttttaccgtggagccgactgttgtctgcttacatttagcgtggatgatcgccagtctttcgagaacctcggaaattggcagaaggaatttatatattacgccgacgtcaaggaccccgaacacttcccattcgtcgttctggggaacaaggtggacaaagaagaccggcaggtgaccacagaagaagcacagacgtggtgcatggaaaatggtgattatccttatctggagacgagtgcaaaagacgatacgaacgttacggtggcctttgaggaggccgtcaggcaggttctggcggtggaggagcagttggaacactgtatgcttggacacactatcgatctgaacagcggatctaaagcgggatcaagttgctgctag

SEQ ID NO: 131566 - DNA, 2589 bp, Artificial Sequence
  Description of Artificial Sequence: Synthetic coding sequence
atggctcagcctggacccgcctcccagcctgacgtgtccttgcagcagagagtcgcggagctggagaagatcaatgctgaattcctacgcgcacaacagcaattagaacaggagttcaatcagaagcgtgccaaatttaaagagctttacctggcaaaagaagaagacctcaaacgacagaacgccgttctgcaggcggcccaagatgaccttggtcacctgcggacccaactgtgggaagcccaggccgaaatggagaacattaaggcaatagccacagtgagtgagaacaccaagcaagaagctattgacgaagtgaagcgccagtggcgcgaggaggtggcctctctgcaggccgtcatgaaagaaacagtaagggattatgagcaccaattccaccttcgcctggaacaggagaggacccaatgggcccagtaccgagaatcagccgagagggagattgccgacttaaggaggcggctctcagaagggcaggaagaagagaatcttgagaacgaaatgaagaaggcccaggaggatgccgagaaactgcgttctgtggttatgcctatggaaaaagagattgcggccctaaaagacaaactgacagaggcggaagataagatcaaggaattggaggcaagcaaggtgaaggagctgaatcattaccttgaagctgaaaaatcttgccggacagatcttgagatgtacgtggccgtcttaaatactcagaagtcggttctacaggaagatgcggagaaactgcggaaggagctgcacgaggtctgtcatctgttggaacaagagcgccagcagcacaatcagctcaagcacacatggcaaaaggctaacgaccagttcctggagtctcagcgactgctaatgagagatatgcagaggatggaaattgtcttgacctcagagcagctaagacaggtggaagagctcaagaaaaaggatcaagaggacgacgagcagcagcgattaaataaaagaaaggatcacaagaaagcagatgtcgaggaggagattaagattcccgtcgtgtgcgctctcactcaggaagaatccagcgcacagctctcaaacgaggaggaacatctggattccacccgcgggagcgtgcactctctcgacgcggggcttcttttgcctagtggagaccccttctcaaagtctgacaacgatatgtttaaagatggcctgaggcgagcgcagtcaaccgattctcttggtaccagtggttctctccagagcaaggctctcggctacaactataaggcaaaatccgcgggcaatctggacgaatccgatttcgggcccctggtgggcgctgacagtgtgtccgaaaattttgacacagccagcttgggttcactgcagatgccttcaggcttcatgctcactaaggatcaggagagggcaattaaagcaatgactcctgagcaggaggaaacagcgtccctgttgagttcagtgactcagggaatggagagtgcatatgtcagtccttcaggctacagacttgtgtccgagactgagtggaacttacttcagaaagaggttcataacgccgggaataagctcggtcgtaggtgcgacatgtgtagtaactatgagaagcagctacaaggaattcagatccaggaggcggagacacgggaccaggtgaagaagctgcagctgatgctgcgccaggccaatgatcagcttgaaaagacgatgaaggacaaacaggaactggaggactttatcaagcagagtagcgaagattctagtcatcagatctcagctcttgttctaagggcacaagcaagtgaaattctgctggaagaactgcagcaaggtctctcccaggcgaagagggacgtgcaggaacagatggccgtgcttatgcagtccagagagcaagtgtctgaggagttggtgcggctgcaaaaggataacgactctcttcaaggaaaacattctttgcacgtgtccctccagcaggctgaggacttcatcctccctgacactacggaggctctacgggagctcgtgcttaaatatagggaagacattataaacgtcagaacagccgccgaccacgtagaggagaaactgaaagccgaaatcttgttcctaaaggaacagatccaggccgaacagtgcctaaaggaaaacctggaggagacactgcagctcgaaattgagaattgcaaggaggaaatcgcctccataagcagtctgaaagctgagttagagagaatcaaggtggaaaaaggtcagcttgagagtacactaagagagaaatctcaacagctggaaagcttgcaggaaatcaaaatcagcctagaggaacagctgaagaaagaaacggcggcaaaggcgacagttgaacaactgatgtttgaagagaaaaataaggcacaaaggttgcagaccgaactcgatgtgtcagagcaggtccaaagagattttgtcaagctcagtcaaaccttgcaagttcagttggaacgcatccggcaggctgattccctggagcgaatcagagctattcttaacgacacaaaactcaccgacataaatcagttgcccgagacgtag

SEQ ID NO: 131567 - DNA, 2490 bp, Artificial Sequence
  Description of Artificial Sequence: Synthetic coding sequence
atggcacagccgggaccagcaagccagcctgacgtcagcttgcagcagagggtcgccgaactggagaaaattaatgctgaatttctgagggcccagcagcaattggagcaggagtttaatcagaagcgagccaaattcaaggaactataccttgcaaaagaagaagacctgaagcggcagaatgccgtgttgcaggcagctcaagacgaccttggccatctgcgcacccagctgtgggaagcccaggccgaaatggagaatataaaagccatcgccactgtcagcgagaataccaagcaggaggccatcgatgaagtgaagcggcagtggcgagaggaagtcgcctccctgcaggctgttatgaaggagactgtgagggactacgaacatcagttccacctgcgcttggaacaagagcggacacaatgggctcagtatcgagagagcgctgaaagggagattgctgacttgcgaagacggctgtcagagggccaagaagaggagaatctggaaaacgagatgaaaaaagctcaggaggacgcagagaagttgagatccgtcgttatgccaatggaaaaagaaattgctgccctgaaagacaaacttacagaggcagaagataagattaaagagttggaggcatccaaagtgaaggagctgaaccattatctcgaagcagaaaagtcttgtaggaccgacctggagatgtacgttgccgtgttgaacacgcagaaatccgtgttgcaggaggatgctgaaaagctgcgcaaggagctacacgaggtttgccacctactggaacaagagcgccagcagcacaaccagcttaagcatacatggcagaaagccaatgatcagtttctggagtcacaacggttgctgatgcgtgatatgcagcggatggaaatcgttcttacttccgagcagctgcggcaggtggaggaactgaagaagaaagatcaggaggacgacgaacagcagcggttaaacaaaaggaaggaccataagaaggccgacgtggaagaggaaataaaaattcctgtcgtttgtgctctgactcaggaagaatcctccgcgcagctgtccaacgaggaggaacacctagacagcacaaggggctctgttcactccctggacgcaggactcctcctaccatccggagaccccttttcaaaatccgataacgatatgttcaaggacggtctccgcagagcgcagagtaccgactcattaggaacctcagggagcttacagtcaaaagccctcggatacaactacaaagctaagagtgccggaaatcttgatgaatcagattttgggcctcttgtcggcgcagacagtgtgtcggagaacttcgatacagcctctcttggctctcttcagatgccgagcggcttcatgcttaccaaggaccaggagagggcaattaaagcaatgacccctgaacaggaagagaccgcgagcctgctgtcctcagtgacccaagggatggagagcgcttacgttagcccaagcgggtaccgtttagtgagcgaaactgaatggaacctgttacaaaaagaagtgcacaatgccgggaacaaactgggacgccgctgcgatatgtgctctaactacgaaaaacaactgcaggggatccagatccaagaggctgaaacgagggaccaagttaaaaaactgcaacttatgcttaggcaggccaacgaccagctggaaaagacaatgaaagataagcaggaattagaggattttatcaagcagtcctctgaggattcctcacatcagatctcagccctggtactaagagcccaggcatcagaaatattactggaggaactgcaacaagggctttcccaggcaaaaagggatgtgcaagagcagatggccgttctgatgcagtcccgcgagcaggtgtcggaagagttagttagactgcaaaaggacaacgacagcctgcaggggaagcacagcttgcacgtgagtctgcagcaagccgaagacttcattctgcctgacaccaccgaggctttgagggagttggtcctaaagtaccgggaagacattataaacgttcgaactgctgctgaccacgtggaggagaagctgaaggccgagatactgtttttgaaagagcagatccaagccgagcagtgcctaaaagaaaatttagaggaaactttgcagctggagattgaaaactgcaaggaggagattgccagtatcagcagcctgaaagcagaacttgagcgtattaaagtggaaaaaggtcaggccaccgtggaacaattgatgttcgaagagaaaaataaagcgcaacgcctacagaccgaacttgatgtaagcgaacaggtacaacgtgacttcgtgaagctcagccaaacactgcaggtacagctggaacgaattagacaggctgactccctcgagcgcatccgggccatcctgaacgatacaaagctgacagacattaatcagctacctgagacctag

SEQ ID NO: 131568 - DNA, 2490 bp, Artificial Sequence
  Description of Artificial Sequence: Synthetic coding sequence
atggcacagccaggcccggctagtcagccggacgtgagcctgcagcagcgcgttgcagaactggagaagattaatgccgagttcctccgcgctcagcaacagttagagcaagaatttaaccagaagcgggccaagtttaaagagttatatctcgctaaggaggaggatctgaagaggcagaacgccgtgttgcaggccgcgcaggatgatttaggccacttaagaacccagctttgggaagcccaggccgagatggagaacattaaagccattgctactgtgtctgaaaacaccaagcaggaagccatcgatgaggtgaaacggcaatggcgagaagaggtggctagcctccaggccgtcatgaaagagactgtgcgggactatgaacaccagttccatctcagactcgaacaggaaaggacacaatgggcccagtaccgggagtcagcggagagagagatcgcagatctacgccggaggctttcagagggacaagaagaggagaatttagagaacgaaatgaaaaaagcccaggaggatgcagagaaattgcgcagcgtagttatgccaatggagaaggaaatcgcagctctcaaagacaagttaactgaggcagaggacaagattaaagagttagaggcaagcaaggtgaaggagctcaatcactacctagaggctgaaaagagctgcagaacagatctcgaaatgtatgtagcggtacttaatacacagaagtctgtgctacaggaagatgctgagaaactgcggaaagagctccatgaggtctgccacttgctcgagcaggaacgccagcagcacaatcagctcaagcacacatggcagaaagccaatgaccaattcctcgaatctcaacgcctcctgatgcgggacatgcagcgtatggagatcgtgcttacctcagagcagctgcgccaggtggaagaactgaagaaaaaggaccaggaagacgacgaacagcagaggctaaacaaacggaaggaccacaaaaaggcggacgtggaggaggaaataaagatccctgttgtctgcgccctcacccaggaggagtccagcgctcaactctcaaatgaggaggagcacctggacagcacacgcggcagtgtgcatagtctggatgcggggctgttactgccatcaggtgatcctttctctaaaagtgacaacgatatgttcaaggacgggctcaggcgcgcccagtccactgacagcctgggaacatccggcagccttcagtccaaggccctgggatataattataaggccaaatccgcagggaacctcgacgagagtgattttggtccactcgtcggggccgactctgtgagtgagaatttcgacacagccagcttggggtcacttcaaatgccttccggatttatgttgaccaaggatcaggagcgcgcaatcaaggctatgactcccgagcaggaagaaaccgcgtccctcctgtcctcagtgacccaaggcatggagtcagcctatgttagccccagtgggtaccggctggtttcagagactgagtggaatctgctgcagaaagaggtgcataacgccggcaataagctcgggcggcgatgtgatatgtgctccaactacgaaaagcagttacagggtatacagattcaggaagcagagactcgcgaccaggttaaaaaacttcagctcatgctgagacaagccaacgaccagcttgagaaaaccatgaaggataagcaagaactggaggattttattaagcagagtagcgaggactcttcacatcagatttccgcattggtgctaagggctcaggcctccgagatcctcctggaggagctgcagcagggcctctcacaggcaaagcgggacgtacaagagcaaatggccgtgttgatgcagagcagggaacaagtgagtgaggagctcgtgaggctccaaaaagataatgactccctccaaggaaagcatagtctgcacgtttccctacagcaagcggaggacttcatactgccagatactacagaggcgctcagagagttggtgttgaagtaccgcgaagatattattaatgtgagaaccgccgccgaccacgtcgaagagaaactgaaagctgagatcttgttcctgaaagagcagatacaggcggaacagtgcctaaaagaaaacttagaagagactctgcaactcgagatcgaaaactgcaaggaagagattgcttcaatctcctcccttaaggcagagctggagcggatcaaagtggaaaaaggacaagctactgtggaacagctcatgtttgaggagaaaaataaggcgcagcggctgcagaccgaactggacgtgagcgaacaagtccagcgcgacttcgtcaaactaagccagacccttcaagttcagctggaacgcattcgccaggccgactcactggaacgtattagagctatcctgaacgatacaaagctcacggacatcaatcaactgccggaaacctag

SEQ ID NO: 131569 - DNA, 2460 bp, Artificial Sequence
  Description of Artificial Sequence: Synthetic coding sequence
atggcccaacccggccccgctagccaaccagatgaggatttaaaacgccagaacgcggtcctccaagccgcccaagacgacctgggtcacctgagaacccagttatgggaagctcaggccgagatggagaacatcaaggccattgctactgtatctgagaatactaagcaagaagccatagatgaagtgaagcgtcagtggcgtgaggaggtggcgagcctccaggcagtgatgaaagaaaccgtacgcgattacgagcatcagtttcacctgcgcctagagcaggaacgcacacaatgggcccaatatcgcgaatcagcggagagagagattgccgacctgcgaagaaggctgtcagaaggccaggaggaggagaatctggaaaacgaaatgaagaaggcgcaggaagatgccgagaaattaaggagtgtggtcatgcccatggagaaggaaatcgccgcactgaaggataagctgaccgaggctgaggacaagatcaaagagctggaggcctccaaggtcaaagagctgaaccactacctggaagccgagaaatcatgccgtacggatctggagatgtacgtggcagtcctcaacacacaaaaatcagtgctccaggaggatgccgaaaagttgcgcaaagaattacacgaggtctgccacttgcttgaacaggagcgccagcagcacaatcagttaaagcatacttggcagaaggcaaatgaccaatttctggagtctcagaggttactaatgagggacatgcagcgtatggaaattgtgctgacctcagagcagttgagacaggtcgaggagttaaagaaaaaagatcaggaggatgatgaacaacagcgcctaaacaaacggaaagatcataagaaggccgacgtcgaggaagaaataaaaatacctgtggtgtgtgccctgactcaagaggagtcttccgctcagctgagcaatgaggaggagcatttggattccacacgaggttctgtccactccctggatgcagggctccttcttccgagcggggatcccttttcgaaatctgacaatgacatgttcaaggacggactgagacgcgctcaaagcacagactccctgggcacatccggatctctgcagagcaaggctctcggctacaactacaaagcaaaaagcgctggtaatcttgatgagagcgactttggcccacttgtgggcgccgattcagtatccgagaattttgatacggcttctttaggctcgcttcagatgccaagcggatttatgctcaccaaagatcaggagcgggcaattaaggcaatgacacctgagcaggaggaaaccgccagtctgttgagttcagttacccagggaatggaatccgcctacgtgtcccccagcggttaccggctcgtgtccgagacggagtggaatctcttgcagaaggaggtccacaatgccggcaacaaacttggacgccgctgtgacatgtgttctaattacgagaaacagttgcagggtatccagatccaggaggctgaaacccgggaccaagtaaaaaaattgcaactgatgctgcggcaagccaacgaccagctcgagaagaccatgaaagataagcaagaactggaagacttcatcaagcagagctcggaagattcctcccaccagatatccgccttagtgttgagagcacaggcaagcgaaatactgctcgaggagctgcagcaaggcttgtctcaggccaaacgagatgttcaggaacaaatggctgttctgatgcagagccgggagcaggtgtcggaggagctcgtgaggctacagaaagataacgattccttgcagggaaagcattccctgcacgtgtcacttcaacaagcggaggacttcatcctcccagataccaccgaggctttgagggagctggtgctgaagtatcgcgaagatataattaatgtacggacagccgccgaccatgtcgaagaaaagttgaaagccgagatcctttttctgaaagaacaaattcaagccgagcagtgcctcaaggagaatcttgaagagacgttgcagcttgaaatcgaaaactgtaaggaagaaattgcatctatctctagcctgaaagccgaactggagcgcataaaagttgaaaaggggcaactcgaaagcaccctgagggaaaagtcccagcagctggaatccctgcaggagataaaaataagcctggaagaacagctcaagaaagagacggccgctaaggctaccgtggagcagcttatgttcgaagaaaaaaataaagctcaaagattgcagactgagctcgatgtgagcgaacaggttcaacgggattttgtaaaactgtctcagaccctgcaggtgcagctggaacgaatcaggcaagcggattcactagagcggatccgagcaattctgaatgatactaaattgaccgatattaatcagctgcccgagacttag

SEQ ID NO: 131570 - DNA, 2151 bp, Artificial Sequence
  Description of Artificial Sequence: Synthetic coding sequence
atggcacagccgggtcctgcctcacaaccggatgtttccctgcaacagcgcgtagcagagctggagaaaataaacgccgaattcctaagagcacagcagcagctagaacaggagttcaaccagaagcgggctaagttcaaggaactataccttgcaaaggaagaggacttgaaacgtcagaacgctgtgctgcaggcggcacaggatgacctgggccacttaagaacacagctgtgggaagcgcaggctgagatggagaatattaaagctatagctacggtctctgaaaatactaaacaagaagcaatcgatgaagtaaaacgccagtggcgcgaggaagtggccagtcttcaggctgttatgaaggaaacagtgcgcgactacgagcaccagtttcacttgcggctggagcaggagcgaactcagtgggcgcagtacagggaatccgccgaacgggagatcgcagatctgagaaggaggctgagcgaaggccaagaggaagaaaacctggagaatgaaatgaaaaaggcccaagaggacgccgaaaaacttagaagtgtggtcatgccaatggaaaaggaaattgcggcgctcaaggataagcttaccgaggccgaggacaagattaaggagctggaggcctccaaggtgaaagaactgaaccattatctggaagctgagaagtcgtgccgcacagacctggagatgtacgtggccgtgctgaatactcagaaatctgttctccaggaggacgcagagaagctcaggaaagagctgcatcaggaacggcagcagcacaatcagctcaaacatacatggcagaaagctaatgatcagtttctggaaagccagcgtttgctaatgcgggatatgcagagaatggaaattgtgctgacatccgagcagctccgccaggtcgaagagctcaaaaaaaaggatcaggaagatgacgagcagcagcggttgaataaacgcaaagatcataaaaaagccgatgtggaggaggaaattaagatccccgtggtctgcgcgctaacacaggaggaatccagcgcccagctgagcaatgaagaggagcacctcgatagcacccgcggtagtgttcactccctcgatgccggacttttgttgcctagcggcgacccctttagcaagtcagataacgatatgtttaaagatggactgcgccgagcccagtcaacagattccctgggtacaagcgggagcttgcaaagcaaggcactggggtacaattataaagccaaaagcgccggaaatttggacgaatcggattttggcccgctcgttggggccgatagcgtttccgaaaactttgacactgcctccctgggatcactgcagatgccttctgggttcatgttgactaaggatcaggaacgggctattaaggccatgacccctgaacaagaggaaaccgcaagcctcctcagctccgtaacccaaggtatggagagcgcctatgtttccccgagtggctacaggctggttagtgagacagagtggaatctcctgcagaaggaagtgcacaacgccgggaacaaactgggccgcaggtgcgacatgtgcagtaactatgaaaagcagctgcagggaatccagatacaggaagccgagactagagatcaggtaaaaaaacttcagctcatgctgagacaggccaacgaccagttagaaaaaacaatgaaggacaagcaagaactggaagatttcattaaacagagctctgaagattcttctcaccagatctccgcattggtgcttagagctcaggcatcagaaattctgctggaggagctgcagcaaggcctgtcacaggccaagcgagatgtgcaagaacaaatggcggtgttgatgcagtcccgcgaacaggtaagtgaggagctcgtgcgcctgcagaaggacaatgactctctgcagggtaaacactcgcttcacgtgtcacttcagcaggccgaagattttatcctccccgataccacagaggctcttagggagctagtgctgaagtaccgggaggatatcattaatgtacgcacagccgcagaccacgtcgaagaaaaactcaaagctgaaatattgttcttgaaggagcagatccaagccgagcagtgtctgaagaagaagaaatag

SEQ ID NO: 131571 - DNA, 2589 bp, Artificial Sequence
  Description of Artificial Sequence: Synthetic coding sequence
atggctcagcctggccctgcaagccaaccagacgtctccctccagcaaagagtggcagaactagagaaaatcaatgctgagttcttgcgggcgcagcaacaactagagcaggagtttaatcagaaaagggctaaattcaaagagctgtatctggcaaaggaggaggatctcaaacgacagaacgccgtgcttcaggccgcccaggacgatttagggcatcttcgtactcagctttgggaggcacaagccgagatggagaatattaaagcgatcgccacggtctcagagaacacgaagcaggaagccattgacgaggtgaagcgccaatggcgagaagaagtagccagtctgcaggctgtgatgaaggagacagtacgggactacgagcatcagttccacttgcggcttgaacaggagagaacgcagtgggcacagtacagagaatctgccgagagggaaatcgcagatctgagaagacggctcagcgagggccaggaggaagagaacttagaaaatgaaatgaagaaggcccaggaggatgccgagaagttaagaagtgtcgttatgccgatggagaaggagatcgctgccctgaaggataagctcacagaggcggaagacaaaatcaaggagctagaagctagcaaagtcaaagagctgaaccattacctggaggctgaaaaatcttgccgcaccgacttggagatgtatgtcgcagtgcttaatacccaaaaaagcgtgcttcaggaagacgccgagaagcttagaaaagaattacacgaggtttgtcacttgctggagcaagaaaggcaacaacacaatcagctcaaacatacatggcagaaggccaacgaccagtttctcgagtcccagaggttgctcatgagagacatgcaacggatggagatcgtcctgacttctgaacagctgcgccaagtggaggaattgaaaaaaaaagatcaggaggacgatgaacagcagcgcctgaataagagaaaggatcataagaaagcagacgtcgaggaggagataaagatccctgttgtctgcgctcttacgcaggaagaatcttcagctcaactaagtaacgaggaggagcatctggattcaactagaggatctgtgcactctcttgacgccggcttgctcctgcccagcggagatccgttttctaagagtgacaatgatatgttcaaggacggcctgagacgagcgcagagtacagatagtcttggcacgagtggcagcttgcagagcaaggcactcggctataactacaaagcgaagtcagcaggtaacctcgatgaatccgatttcggacccctggttggcgcagactccgtgtccgagaactttgatacggcctctttgggcagcctccaaatgccttcaggttttatgctgactaaggaccaggaacgggccattaaagccatgactcctgagcaggaagagaccgcaagccttttgtcctctgtaacccagggaatggaaagtgcatacgtcagcccgtcaggatataggcttgtctccgagaccgaatggaaccttctgcagaaggaagtgcacaatgcaggtaacaagttgggacgacgctgtgatatgtgctccaactacgaaaagcagcttcaagggatccagattcaggaagctgaaacgagagaccaggtgaagaaacttcagttgatgctccgccaagccaacgaccagttggaaaagacaatgaaggataagcaggagttggaggattttattaagcagagcagcgaagattcctcccaccagatttccgctcttgttcttcgcgcccaagcttccgaaattctgctagaagagctccagcaagggctgagtcaggcgaagagagatgtgcaggaacagatggctgtgctgatgcaaagcagggagcaagtttccgaggaactggtccggcttcagaaggataacgattcactacaaggtaagcacagcctgcatgtcagtctccagcaggccgaagattttatcttgcctgacaccaccgaggctctgcgcgaactcgtgttgaagtatcgtgaggacatcattaatgtccgaactgccgccgatcacgtcgaagagaagctcaaagctgagatactgtttctgaaggaacagatccaggcggagcagtgtctcaaagaaaacctggaggaaacacttcaactggaaattgaaaactgtaaagaagagatcgcctccatttctagcttaaaagccgaactcgagaggataaaagttgagaaagggcagctggagagcaccttaagggagaagtctcagcaattggaatctctgcaggagattaagatttcgctagaagagcagcttaaaaaggagacagccgcaaaagccaccgtggagcagctgatgtttgaggaaaaaaacaaagcgcaacggctacagactgaactcgacgtatccgagcaagtgcagagggacttcgtgaaactttcacagactcttcaagtgcagctggaacgtattcggcaggccgactcactcgaacggattcgcgcaatcctcaatgacacaaagttgaccgatatcaaccagctgcccgaaacatag

SEQ ID NO: 131572 - DNA, 1602 bp, Artificial Sequence
  Description of Artificial Sequence: Synthetic coding sequence
atggccgccgcggcccctgtggcagccgatgatgacgagcgccggcggcggccaggagccgccctggaagactccagaagccaggaaggggctaatggagaggcagagtccggagagttgtctcgtctgagggccgaacttgcaggcgctcttgccgaaatggaaacaatgaaagcagtcgcagaagtgtctgagagcactaaggccgaggccgtggccgctgtgcagcgacagtgccaggaagaggttgccagtctgcaagccatcctgaaggactcgatcagctcttatgaagctcagatcaccgccttaaagcaggagcgccaacagcagcagcaggactgtgaagagaaggagcgggaactaggtagactaaagcagctcctctcacgcgcatatccacttgattctctcgaaaaacagatggagaaggcacacgaggactctgagaaattacgcgagatcgtgttacctatggagaaagagatcgaggagctgaaggcaaaacttctcagagctgaggaattgatccaggagatacagcgccggccccgtcacgctccttccctacacggtagcacggaactcttgcccttgagtagggacccaagtccccctcttgaacccctcgaggagctcagtggcgatgggggacccgccgccgaggcatttgcacacaattgcgatgacagcgccagcattagcagtttttctcttggcggtggtgtgggttcctcctcctccttgccgcagagcaggcaaggcctgtcccctgagcaggaggagactgcttccctagtgtcaacaggtacactagtgcctgaaggaatctatctgcctcctccaggctaccagctggtgccagacacccaatgggagcagttgcagaccgagatgcaggtcctattagcgcaggtccagaacagtgagcaactcctgagaaccctgcagggcacagtgtcacaggcccaggaaagggttcaacttcagatggccgagctagtgacaacccataagtgccttcatcacgaggtgaagcgacttaatgaagagaaccaaggcctccgcgcggaacaacttccaagctctgctccccagggctcgcagcaggagcaaggcgaggaggaatctctcccgagtagcgtccctgaactgcagcagctgttatgttgtaccaggcaggaagcaagggctcgcctacaagctcaggagcacggtgctgaaagattacggatcgagatcgtgactttacgcgaggctctcgaagaggaaacagtagctcgggcctctctggagggacagctccgcgtgcagagagaggaaacagcgtcgctatgttcactaagaacagagatggagagagtccagcaggaacagagtaaggctcagctgcctgatctgctttcagagcaacgcgccaaggtgttgcgcctgcaagccgaactcgaaacgagcgagcaggtccagcgtgattttgtccggctgagccaagcactccaggtccgtctggagagaattcgtcaggccgaaacactggagcaggttcggtctattatggatgaggcgccactgaccgatgtgagggatattaaagacacatag

SEQ ID NO: 131573 - DNA, 1710 bp, Artificial Sequence
  Description of Artificial Sequence: Synthetic coding sequence
atggcagccgccgcacctgtggctgcggacgacgacgagcggaggcgtaggcccggcgccgccctggaagactctcgcagtcaggaaggcgctaacggggaggccgaatcaggagagctgtcacgcctgcgtgctgaactggcgggagcactggccgaaatggagactatgaaggccgtcgcagaagtctcggaatccacaaaagccgaagccgtcgccgcagtgcagcggcagtgtcaagaagaggtggcctcactccaggccattctcaaggactcgatcagctcctatgaggcccagattactgctctgaagcaggagaggcaacagcagcagcaggattgcgaggagaaggagcgggaattaggtcggctgaagcagctgctgtcacgggcctatccactagactccctggagaagcaaatggagaaagcccacgaggactccgaaaagctccgcgagatagtattgccaatggaaaaggaaattgaggaactgaaggctaagctcctgagagccgaagagctgattcaagagatccagaggcggccaaggcatgctccctcgctgcacgggagtacagagctgctacccctttcaagggacccctctccacccctggagccgttagaagagctctctggagacggcgggcccgccgctgaagcgtttgcccacaactgcgacgatagcgcatccattagttccttctccctgggcggaggagtggggagctcctctagtctgccccaatcccggcaaggcctctcccccgagcaggaggaaacagcttccctagtctccaccgggaccctcgtgccggaaggaatatatctcccgccaccaggttaccagctggtcccagacacccagtgggaacagctgcagacagaggggaggcagctgcagaaggatctggagagcgtgtcccgagagagagatgaactgcaggaggggctcaggcgttctaacgaggactgcgccaaacagatgcaggtgctcttagcccaggtgcagaatagcgaacagctcctgcgtaccttacagggaacagtatcacaggcccaggaaagggtgcagctgcagatggctgagctggttacaacccataagtgtctgcatcatgaggttaaaaggttgaatgaggaaaaccaggggcttcgggctgagcaactcccgagcagtgcccctcagggttcacagcaggagcaaggcgaggaggagtccttgccaagttccgtaccagaactgcagcagctgctctgctgcacccgtcaggaagcccgcgcacgcttgcaggcgcaagagcatggcgccgagagactgagaatcgaaatcgtgacactgcgcgaggctctggaagaagagacagtcgccagagctagtctcgagggacaactccgagtccaacgagaggagactgaagtgctcgaggcctccctctgctctctcaggacggagatggagcgcgtgcagcaggagcagagcaaggctcagctccccgatctgttgtctgagcagagggcgaaagttctccgactgcaagcagaactggagactagtgagcaggtccagagagattttgtccgcttatcacaggccctgcaggtgagactcgagcgtatccgtcaggccgaaactctggagcaagtgcggagcattatggatgaagctcctctgaccgacgttagagatatcaaggacacatag

SEQ ID NO: 131574 - DNA, 1497 bp, Artificial Sequence
  Description of Artificial Sequence: Synthetic coding sequence
atggccgcagcagcccccgtggcggctgacgacgatgagagacgccgccggccgggggccgactccatcagcagctatgaggcccaaatcaccgcgttgaaacaggaaaggcaacaacagcagcaggattgtgaagagaaggagagagagctggggcggctgaagcagctgttgtcccgggcttatcctctggattcgctggaaaagcagatggaaaaagcccatgaagactcggagaagctgcgagaaattgtactaccaatggaaaaggaaattgaagagcttaaggccaagctcctccgcgcagaggagctgattcaggagattcagcggaggccaagacacgctccatctttacatggatccactgagctcctgccactatctcgggatccttccccccctctggagccgcttgaagaactatctggtgatggaggacccgctgccgaagcctttgcccataactgcgatgacagtgccagcatctcctcatttagcctgggaggcggagtcggcagctcatcctctctgccccaatcgaggcaggggctgtcgccagagcaggaggaaacagcctcactggtttcaaccggtacactggtccctgaaggtatatacctgcctcctccgggctatcagctcgtgcccgatactcagtgggagcagcttcagacagagggtcgccagctgcaaaaggatctagaatctgtgagtcgagaaagggacgagttgcaggaagggctgcggcggtcaaatgaagactgcgctaagcaaatgcaggtgctcttggctcaggtccagaattctgagcagctcttaaggaccctgcaaggtacagtttcacaggcccaggagcgagtacagctgcaaatggctgagttggtgaccacccataaatgtctacatcacgaggtcaaacgtttgaacgaggagaaccaaggtctgcgcgccgagcagctaccaagctcagcacctcaaggatcacagcaggagcagggggaggaagagtctctgcccagtagcgtgcccgaactgcagcagctgttgtgctgtacccgccaagaagctagggccagactgcaggcgcaggagcacggggcagaacgactgcgcattgagattgttactctgagagaggcattggaggaggagacggtggcgcgcgcctcactggaaggacagttaagagtgcagcgcgaggaaaccgaggtattggaagcttccctgtgtagcctccgaacagagatggagcgggtccaacaggagcagagtaaagcccagctgcctgatctcctgagcgagcagcgggccaaggtgctgcgcctccaagctgaactggaaacgtccgagcaggtgcagcgcgacttcgtgcgcctgagccaagccctgcaggtacgtttggaaagaatcagacaggccgagaccctggagcaggtcagaagcatcatggacgaagcccctcttactgatgtcagagatatcaaagatacttag

SEQ ID NO: 131575 - DNA, 2085 bp, Artificial Sequence
  Description of Artificial Sequence: Synthetic coding sequence
atgactgatacggttttcagcaatagctccaaccggtggatgtacccaagtgaccggcctctgcagtccaatgacaaggaacagttgcaagctggttggagcgtgcacccaggaggacaacccgaccgacagcggaaacaggaggaactgacagacgaagagaaagaaatcatcaaccgtgtcatagcaagggccgaaaaaatggaagagatggagcaggagcgaatcggccgactggtagatagattggaaaacatgaggaaaaatgtggccggcgacggcgtgaatcggtgcattctgtgtggagagcagctagggatgctcggcagcgcgtgtgtggtctgtgaggattgtaagaaaaacgtatgcaccaaatgcggcgttgaaacaaataaccggctgcatagcgtctggctttgcaaaatttgtatcgagcaacgtgaggtgtggaagagaagtggcgcttggttttttaagggctttcctaagcaggtgctcccccagcccatgccaatcaagaaaacaaaaccgcagcagcctgtgtccgagcctgccgctcccgagcaacctgcccctgagcctaagcatcccgcaagagctcctgcccgtggagacagcgaggatcgacgcgggccaggccagaagacaggccccgatcccgcctctgctcccggaagggggaattacgggccaccagtaagacgggctagtgaggcacgcatgagctctagctcacgggattcagaatcctgggaccactccggtggcgcgggggattctagcaggtcccctgctggattgcgcagagcaaacagtgtgcaggcctcacgccccgcccccggctcagtccagtccccagcccctccccagcctggccaacccgggacaccaggcggcagtcgcccagggcccggccctgcgggcagatttccagaccagaaaccagaagtagccccctcagatcctggcaccacggccccacctcgcgaggagcgcaccggcggtgtgggcgggtaccccgctgtgggcgcacgagaagaccgaatgtcacatccatccgggccatacagccaagccagcgcggccgcccctcagcctgcggcagcccgtcaaccacccccccctgaagaggaagaggaggaggcaaactcctatgacagtgatgaggcaacgacactcggagcccttgaatttagccttctctacgatcaggataactcatcattgcagtgtacaatcatcaaagccaagggcttgaagccaatggattccaatgggctcgctgatccatatgtcaagctgcacttgcttcccggggctagcaaatcaaacaaactccggacgaaaacgttgcgaaataccagaaatccgatttggaacgagaccctggtgtaccatgggataacggacgaagatatgcagcgcaagactctccgaatctccgtgtgtgacgaagacaagtttggccacaatgaatttatcggcgagacgcggtttagcttaaagaaactgaagcctaaccaacgtaagaatttcaatatctgtctagagcgcgtcatcccaatgaagcgcgctggcaccacagggtccgcaagaggtatggccctctacgaagaagagcaggtggaaagagtgggagacatcgaggagagaggaaaaatcctggtcagcttgatgtattcaacacagcagggcggcttaatcgtgggcatcatcaggtgtgtgcaccttgccgctatggacgccaacggttattctgatcctttcgtgaagttgtggctcaagcccgatatggggaagaaggccaaacacaaaacccaaattaaaaaaaagactctgaatcccgaattcaacgaagagttcttctatgacataaaacactccgatctggctaagaaaagccttgacattagtgtctgggattacgatatagggaagagcaatgactatataggcggttgccagctcggtatttcagccaagggtgaaagactgaagcactggtatgaatgtttgaagaataaagacaaaaagattgagagatggcatcagctccagaacgaaaaccatgtcagcagcgactag

SEQ ID NO: 131576 - DNA, 2085 bp, Artificial Sequence
  Description of Artificial Sequence: Synthetic coding sequence
atgacagacaccgtgttctcaaactcaagcaaccgttggatgtacccatccgatcggcctctccagtccaatgacaaggagcagctgcaggccggctggtctgtgcacccaggcgggcagccagatcgccaaaggaagcaggaggagttgaccgatgaggagaaggagattatcaaccgagtcatcgcacgggccgaaaagatggaggaaatggagcaggagagaattggcaggctggtagacagactcgagaatatgcgcaaaaacgtggcgggcgacggagtgaataggtgcatactgtgtggggagcaactcggcatgctcggctcagcgtgcgttgtgtgcgaggactgcaaaaaaaacgtttgcacgaaatgcggtgtagaaactaataataggctgcactcagtgtggctttgcaagatctgtatcgaacagcgagaagtgtggaaacgatccggggcttggttctttaaggggttcccgaagcaggtattgccacagcccatgcctattaagaagactaagccacagcagcccgtgtcagagcctgctgcccctgagcagcccgcgcccgaacccaagcatcccgcacgcgctcctgcccggggtgactcggaggaccgacgaggcccgggccaaaaaacaggacctgacccagcctcagctcctgggaggggtaactatggcccgcccgtgaggcgggcttcagaggctagaatgtctagcagctcccgggattccgaaagctgggatcactccggaggagccggagattcgtcgcgttcaccagccggcctgaggcgcgcgaattctgtccaggcaagtagacccgcaccaggatccgtgcaatctccagctcctccacaaccgggacagccggggacccctgggggatcgaggcccggacccggccctgctggcagattccctgaccagaaaccagaggttgccccttctgatcctggaaccactgctcctccgcgcgaagagcggaccggtggcgttggtggctaccccgctgtcggggcaagggaggatcgaatgtctcacccttccggaccatatagccaggcctccgctgcagctcctcagcccgccgccgcccgccaaccgcctcctcccgaagaagaagaggaggaggccaactcttacgacagcgacgaagcaactaccttgggtgccctcgagttctcacttttgtacgatcaggataactcctcacttcagtgcactatcatcaaggcgaagggtctaaagccgatggactcaaacggattggctgatccatatgtaaaactacacctgctcccaggagcctcaaagagtaataagttgaggaccaagactttgagaaacacccggaatccaatctggaatgaaaccttggtttaccacggaatcacagacgaggatatgcagcgaaagaccctgcgaatctccgtgtgcgacgaggacaagtttggccataatgaattcattggggagacaagatttagcctgaaaaaattaaagccgaatcagaggaagaactttaatatttgcctggagcgtgtgataccgatgaaacgggccggcaccaccggatctgcccggggcatggcactgtatgaggaagagcaggtagagagggtcggagacattgaagagcgtgggaagattcttgtgtctctgatgtacagtacacaacagggaggcctgatagtggggattatacgctgtgttcatcttgcagcaatggatgcaaacggttattcagaccccttcgtaaagctgtggctgaaacccgacatgggaaagaaggctaaacacaagacgcagattaaaaagaagacccttaatccggaattcaatgaagagtttttttatgatatcaagcactctgaccttgctaagaagtcactggatatctccgtctgggactacgatatcggtaaaagcaacgattacattggcggctgccagctggggatttccgccaaaggcgaaagactcaaacactggtacgagtgcttgaagaataaggacaagaaaatagaacgctggcatcagctgcagaatgagaaccatgtgtcttccgattag

SEQ ID NO: 131577 - DNA, 2085 bp, Artificial Sequence
  Description of Artificial Sequence: Synthetic coding sequence
atgaccgatacggtcttctccaatagctcgaataggtggatgtacccctcagaccggcccctgcagagcaatgacaaggaacaattgcaagccggatggagcgttcaccctggagggcagcccgatcggcagagaaaacaagaggaactcacagatgaagaaaaggaaattataaaccgggtgattgcacgggccgagaagatggaggagatggaacaggaacgtattggacgcttggtggacagattagaaaatatgaggaaaaacgtggccggagacggagttaaccggtgtatactctgcggggaacagctgggcatgctggggagcgcttgcgtggtatgcgaagattgcaagaaaaacgtttgtaccaaatgcggcgttgagactaacaacaggctccactccgtctggctgtgcaaaatatgcattgaacaaagagaggtgtggaaaaggtccggagcctggttcttcaaggggttccctaagcaggtgctgccccagccaatgcctattaagaaaacaaagcctcagcagcctgtgtccgagcccgccgcccccgaacagccagctccagagcccaaacaccccgcacgcgcccctgcccgtggagattctgaggatcgtcggggccccggacagaaaacaggacctgacccagccagtgcgcctgggaggggaaactacggaccgcccgttcggagggcatcagaggccaggatgtcttcctcaagtagggattcggaatcatgggaccattcaggaggggcgggggacagcagtcgatctccagccggcctgcgacgcgcgaattcagtgcaggcctcccgccccgcgcccggctccgtgcaatcgcccgcccccccccagcctggacagccaggaactcccggcggctcccgccctggccctgggccagctggtagattccctgaccaaaagcctgaggtggctccctccgatccgggaactacagcccccccgagagaggaacggaccggaggtgtcggaggctaccctgctgtgggggcaagagaagaccgaatgtcacaccccagcggcccatactcccaggcctcggctgcagcacctcagccagccgctgcaaggcagccccctccccctgaggaggaagaagaagaagccaattcctatgacagtgacgaggcaaccactctcggagcattagaattctccctgctgtacgatcaggacaactcctcactgcaatgcactatcatcaaagctaaggggctgaaaccaatggactcgaacggcctcgccgacccttacgtgaagctccacctgctgcccggagcctctaaatccaacaaactgagaacaaaaacccttagaaatacgcgaaacccaatctggaacgaaaccctcgtgtaccacgggattaccgatgaagacatgcaaaggaagacgctgaggatatctgtttgtgacgaagataagttcggacacaatgaatttattggagaaacacgtttcagcctcaaaaagctgaagccaaaccagagaaagaacttcaatatctgcctcgagcgggtgataccgatgaagcgagctgggacgacaggtagtgcccggggcatggcgctgtacgaagaggagcaagtcgagagagtgggagacattgaggaacggggcaagatcctggtctccctcatgtatagtacccagcaaggtggcctaatcgtgggtatcatcaggtgcgtgcatctggcagccatggatgccaacggctactctgaccctttcgtgaaactttggctcaagcccgatatggggaagaaagcaaaacataagactcagattaagaagaaaacactcaacccggagtttaacgaggaatttttttatgacattaagcattccgacctggcgaagaagagcctggacatctccgtgtgggactacgacattgggaagagtaacgactacattgggggctgccaactggggatttccgcaaaaggggagcgactgaaacactggtacgagtgccttaaaaacaaggacaagaaaatcgagaggtggcaccagctccaaaatgagaatcatgtgagcagcgactag

SEQ ID NO: 131578 - DNA, 1938 bp, Artificial Sequence
  Description of Artificial Sequence: Synthetic coding sequence
atgactgataccgtgttcagtaattcctccaataggtggatgtaccccagcgataggcccctacagagtaagctaaaggaccggaggttagtggatcgtcttgaaaatatgaggaagaacgttgcaggagatggcgtgaaccgttgcatcctgtgtggtgagcagctcgggatgttggggtcagcttgcgtggtttgcgaagattgtaagaaaaatgtgtgtacaaagtgtggtgtggagaccaataataggctgcactcagtttggctctgtaaaatctgtatcgaacagcgggaagtctggaaaagatctggtgcctggtttttcaaggggtttccaaaacaggtcctgccccagccgatgcccatcaaaaagaccaagccacagcaaccagtgtcagaaccagcggctcccgagcagcctgcaccagagcccaagcatccggcccgagctcccgctagaggggattctgaagatcggaggggtcccgggcagaaaacaggtcccgaccctgcctcagcccctggacgcgggaactatggccccccagtgagacgcgcatccgaagctaggatgtcatcctctagcagggacagcgaatcttgggaccacagcgggggggccggagattcgtcgcgcagtcctgccggattaagaagagcaaactccgttcaggcctccagacccgctccaggttctgtccagtcacccgccccaccccagcccggccagccaggcacaccagggggcagccgcccgggacccgggcccgcgggaaggttcccagatcaaaaacccgaggttgccccgtccgaccccggcaccaccgctcctccaagggaggaacggacaggaggcgtcgggggataccccgccgtcggcgcccgggaggacagaatgagccatccatccggcccatattcccaagccagcgctgctgctccccagccagccgcagctcggcagcctcctccccccgaggaggaagaagaggaggcgaactcatacgacagtgatgaagcaaccaccctgggagctctggagttctctttgctctatgaccaagacaactcctctttgcagtgtactattatcaaagctaagggactcaaaccaatggactccaacgggcttgccgatccctacgtgaagttgcacctactccctggcgcatcaaagtccaacaaactgagaaccaaaactttgagaaacactagaaatccgatttggaacgaaaccctagtgtaccacgggattacagatgaggacatgcaaagaaagaccttaagaataagtgtgtgcgatgaggacaagtttggacacaacgagtttatcggtgagaccaggttttctctgaagaaactgaagccaaatcaacgtaagaactttaacatttgcctggagcgggtcatacctatgaagcgggcaggtacgactggcagcgcccgggggatggcgctgtatgaggaagaacaggtggaaagggtgggggatattgaagagcgcgggaaaatcctggtgtctttaatgtattcaactcagcagggcggacttattgtcggaattatcagatgcgtccatctagcggctatggacgctaatgggtattcagacccattcgttaaactctggctgaaaccagatatggggaaaaaggcgaagcataagacccaaatcaagaagaaaacgcttaaccccgaattcaacgaggagttcttttatgacataaagcactctgatttggcgaagaaaagtctggatatatccgtatgggactacgacatcggcaagtccaatgattacatcggcggctgtcagctgggcatttctgcaaaaggcgaacggctcaagcattggtacgagtgtctgaagaacaaggataagaaaatcgagagatggcatcagctgcagaatgaaaaccacgtttcttctgactag

SEQ ID NO: 131579 - DNA, 2085 bp, Artificial Sequence
  Description of Artificial Sequence: Synthetic coding sequence
atgacggataccgtgttcagcaacagcagcaatcgctggatgtacccatcggaccggccgctacagtcaaatgataaagaacagctgcaggcggggtggtcggtacaccccggaggccagccggatcgccaacgcaagcaggaggagctgaccgacgaggagaaggaaataattaaccgtgtgatcgcaagggccgaaaaaatggaggagatggagcaggagcggattgggcggcttgtggaccgccttgagaacatgcgtaagaacgtggccggtgatggagtgaatcggtgcatcctatgcggcgagcagctgggcatgcttggatccgcctgcgtggtttgcgaggattgcaaaaagaacgtgtgtacgaagtgtggagtggagactaataataggctgcattctgtttggctgtgcaagatctgcatcgaacagcgcgaagtatggaagcgatcgggcgcttggttctttaagggttttcccaagcaagtactcccgcagccaatgcccattaagaaaaccaagccgcaacagccagtgtccgaacctgctgccccagagcagcctgccccagagccaaagcacccagccagagcacccgcacgcggagacagtgaggataggaggggtcccggacagaagaccggacctgaccccgcctcagccccaggcaggggcaactatggcccccctgttagaagggcatcggaggccagaatgtccagtagttctagagatagcgaatcctgggaccattccggtggggccggagacagttcaagaagtcccgcaggcctgaggagggccaacagcgtccaggcatccaggcccgctccaggttccgtgcagtcccctgctcccccacagcccgggcagcctggtacacccggcgggagtagacccggtcctggccccgcagggcggttcccagaccagaagccagaggtagcccccagcgatcctggcaccacagctcccccgcgggaggaaagaacaggcggagtcggaggataccctgcggtgggtgctcgggaggacagaatgagccatccctccggcccctacagccaagccagcgcagctgcaccccagccagcagccgctcggcagccgcccccccccgaggaagaggaagaggaggccaatagctatgactcagacgaagctaccacactgggcgccctcgagttttcactgttgtatgaccaggacaactcctccttgcagtgcacaatcatcaaggcaaagggcttgaagccaatggacagcaacggactggctgatccttacgttaagttgcaccttcttcctggcgcctctaagtctaacaaacttcgtaccaagaccctcagaaataccaggaatcccatttggaatgaaacactggtgtaccacggcattacagatgaggatatgcagcggaaaactctgcggatatccgtgtgtgacgaggataaattcgggcataatgaatttatcggcgagacacgattttcccttaaaaaattaaaaccaaaccagcggaaaaatttcaatatctgcctggagcgcgtgatccctatgaaaagggccgggaccaccggtagtgcgcggggcatggcactatacgaagaggagcaggttgaacgcgtgggcgacattgaagagcggggcaagatcttagtaagcttaatgtacagcacccagcagggaggactgattgtggggataatacggtgtgtgcatctggccgctatggacgctaatggctacagcgatccattcgtcaagctctggctgaaaccagacatgggtaagaaggcaaaacacaagacgcagataaagaaaaagacactgaaccccgagttcaacgaggagtttttctacgacattaagcatagtgatctggccaaaaagagtttggacatttccgtttgggactacgatattggaaagagcaacgactacatcggaggctgtcagttaggcataagcgctaagggtgaacggctaaagcactggtacgaatgccttaagaacaaagacaagaagattgagagatggcaccagctgcaaaatgagaaccatgtcagtagcgactag

SEQ ID NO: 131580 - DNA, 39 bp, Artificial Sequence
  Description of Artificial Sequence: Synthetic coding sequence
atgaccgacaccgtattcagtaattccagtaaccgctag

SEQ ID NO: 131581 - DNA, 252 bp, Artificial Sequence
  Description of Artificial Sequence: Synthetic coding sequence
atgacagataccgtattcagcaacagttcgaataggtggatgtacccttccgaccgcccactgcagagcaatgataaggagcagctccaagcaggttggagtgtccaccccggcgggcagcccgaccggcaaaggaagcaggaagaactgactgatgaagaaaaggaaatcattaatagggtaatcgcccgtgcagagaaaatggaggagatggagcaggagcgaattgggcgtctggtggaccgactgtag

SEQ ID NO: 131582 - DNA, 285 bp, Artificial Sequence
  Description of Artificial Sequence: Synthetic coding sequence
atgaccgatacagtcttttctaatagctccaacaggtggatgtatccctccgaccgacctctgcaatctaatgacaaagagcaacttcaagccggctggtccgtgcaccctggcggccagcctgatcgccaacggaaacaagaggaattaacggacgaagagaaggagataatcaacagggtgatcgctcgcgccgagaagatggaggagatggagcaggaacgtatcggacggctggtggaccggctggagaacatgaggaagaatgtggctggtgacgggtag

SEQ ID NO: 131583 - DNA, 492 bp, Artificial Sequence
  Description of Artificial Sequence: Synthetic coding sequence
atgaccgatacagtgttctccaactcaagtaacaggtggatgtatcctagcgaccggccactgcagagcaatgataaggagcagctgcaagccggttggtcagtccaccccgggggacagcccgacagacagcggaaacaagaagagttgacagatgaagaaaaggagattatcaatcgggtcatcgcccgagccgagaagatggaggagatggagcaagagcgtatcggcaggctcgttgataggttggaaaatatgagaaagaacgtcgcaggcgacggtgtgaaccgttgtatcttatgcggggaacagctcggtatgcttggttccgcctgtgtggtgtgtgaggattgtaagaagaacgtgtgcactaagtgtggcgtggaaaccaataatagactgcactccgtttggttatgtaagatttgtattgaacagcgggaagtgtggaaacgctcaggtgcatggttcttcaaggggttccccaagtag

SEQ ID NO: 131584 - DNA, 384 bp, Artificial Sequence
  Description of Artificial Sequence: Synthetic coding sequence
atgaccgacactgttttctccaactcatccaaccgatggatgtacccctcagatcgcccgcttcagtctaacgacaaggagcagctgcaggctggatggtcagttcaccctggcggtcagcccgacagacagagaaaacaggaggaactcacagacgaggaaaaggaaattatcaatagggtgattgcccgggcggagaaaatggaagagatggagcaggagcggataggcagactggtggaccggctggaaaacatgcgaaaaaacgtagcaggcgatggcgtcaaccgttgcatcctttgtggcgagcagctgggtatgcttggaagtgcctgcgtcgtttgcgaggactgcaaaaagaacgtgtgtaccaagtgcgggtag

SEQ ID NO: 131585 - DNA, 315 bp, Artificial Sequence
  Description of Artificial Sequence: Synthetic coding sequence
atgactgatacagtgttcagtaactcaagtaacagatggatgtaccccagcgacagacctctgcagtccaacgacaaagagcaactgcaggcaggttggtcagtccaccctggagggcagccagaccgacagcgcaaacaggaggagctgaccgacgaggagaaggaaatcatcaaccgggtcatcgcccgggctgaaaaaatggaggagatggagcaggagcgcatcggaaggctggtagaccgtctggagaacatgcgcaagaatgttgcgggggacggcgtcaaccgttgtatactgtgtggcgaacaatag

SEQ ID NO: 131586 - DNA, 120 bp, Artificial Sequence
  Description of Artificial Sequence: Synthetic coding sequence
atgacagacacggtctttagcaattcttccaaccgctggatgtacccctcagatcggcccctgcagtcaaacgataaggagcagctccaagccgggtggtctgtgcaccccggtgggtag

SEQ ID NO: 131587 - DNA, 348 bp, Artificial Sequence
  Description of Artificial Sequence: Synthetic coding sequence
atgaccgacactgtattcagcaattcatccaacaggtggatgtaccccagcgatcggccactgcaatcgaacgacaaagaacagttgcaggcagggtggagcgttcatcctggaggccagcctgataggcagcgtaagcaagaggaactcactgatgaggagaaggagatcatcaatagggtcattgcccgcgccgaaaaaatggaggagatggaacaggagcgcatcggtaggttagtcgaccgcctggaaaacatgaggaaaaacgtggctggggacggggtgaatcggtgtatcctgtgtggcgagcagctgggtatgctgggatctgcatgtgtcgtgtgctag

SEQ ID NO: 131588 - DNA, 2073 bp, Artificial Sequence
  Description of Artificial Sequence: Synthetic coding sequence
atgacagacactgtgttctctaacagctctaaccgctggatgtatccttctgatcgcccccttcaatcaaagctgcaggcaggctggagcgtgcacccaggcggtcagcccgacagacagagaaaacaggaagagctgacagacgaagaaaaggaaatcattaaccgcgtcatcgcccgcgcagagaaaatggaagaaatggagcaggaaagaataggcaggctggtggaccggctggagaacatgagaaagaacgtggcaggcgatggggtgaacaggtgtatcctatgcggagagcaactgggcatgctcggcagtgcctgcgtagtatgtgaagattgtaagaaaaatgtgtgcactaagtgcggagtggaaacaaacaaccgactccattccgtctggctgtgtaaaatttgcatcgaacagagagaggtttggaaacgatccggagcctggttttttaagggcttcccaaagcaggtcctcccccagccgatgcccattaagaagactaaaccccagcagcctgtgtcggagcctgccgcgccagagcaacctgctccggagcccaagcatccggccagggcaccggcaagaggggattctgaggatcggcgcgggcccggccagaagactggtcctgaccccgcttctgcaccgggcagaggaaattacggacctcccgtgagaagggcaagtgaagcccggatgtcaagcagctctcgcgattcagagtcatgggaccactccggcggcgcgggcgacagtagccgttctcccgccggcctccggcgcgcaaattctgtgcaggcaagtcgcccagcccctggttctgtgcagtctccagctccgccccagcctggccagccgggtacacctggtggatcacgccccggaccagggcctgctgggcggttcccggaccaaaagccagaagttgcaccatcggaccctggtacaacggctcctccgcgagaggagagaaccggcggggtcggcggttatccggcggttggtgcaagggaggaccggatgagccatccttcagggccttatagccaggcgtccgccgctgccccacagccagccgcggcccgccagcctccccctccagaggaggaagaggaagaggcaaacagttacgactcagacgaggctactaccctgggcgctctcgagttcagcctgctctacgatcaagacaacagctctcttcaatgtactattattaaggcaaagggattaaagccaatggacagtaatgggctggctgacccatacgttaagctgcacttgctgccaggggccagtaagtccaataaacttcgaacaaagaccctgaggaacacacggaatcctatttggaacgagacactggtctatcatggaatcactgatgaagacatgcagcggaaaacattgcggattagcgtttgcgatgaggataagttcggccacaacgagttcatcggtgagacccgcttcagtctgaagaagctgaaacctaaccagaggaaaaattttaacatctgcctcgaaagagttatccccatgaagcgagcagggactaccggttcagcacgcggtatggctttatatgaagaggagcaggtcgaaagggtgggtgacatcgaagagagagggaagattctggtcagtctaatgtatagcacccagcagggtggtctgattgtgggaatcatcaggtgtgtacatttagccgcgatggatgctaacggctattccgatccctttgtcaagctgtggttgaagcccgacatgggaaagaaggctaagcacaagactcagattaagaaaaaaacactcaaccccgaattcaacgaagaatttttttacgacataaagcactcagaccttgccaaaaagagcctggacatctccgtctgggactatgacataggcaaaagcaatgactacattgggggctgccaacttggcatcagcgcgaagggggaacggctgaaacactggtacgagtgcctgaagaacaaggataagaaaattgaacgctggcatcagttacagaatgagaatcatgtgtcatcggattag

SEQ ID NO: 131589 - DNA, 378 bp, Artificial Sequence
  Description of Artificial Sequence: Synthetic coding sequence
atgactgacactgtattcagcaacagcagcaatcggtggatgtaccccagcgatcgtccactgcagtcaaatgataaagagcagttgcaagctggatggtcagtgcaccccggcggacagccggatcgacagcggaaacaagaggagttgacggatgaggaaaaagagatcatcaacagggtgatcgccagggctgagaagatggaggagatggaacaggagaggattggaagattagtagaccggctggaaaatatgcgcaagaacgtcgccggcgatggagtgaataggtgtatcctctgcggtgaacagcttggcatgcttggatcagcctgcgtggtctgtgaggattgcaaaaagaacgtttgcactaaatag

SEQ ID NO: 131590 - DNA, 546 bp, Artificial Sequence
  Description of Artificial Sequence: Synthetic coding sequence
atgacagataccgttttctctaactcttctaacaggtggatgtacccatccgatcggcctctgcagtctaacgataaagagcagctacaggcggggtggtccgtgcatcccgggggccaacctgatcggcagcgaaagcaggaggagcttaccgacgaggagaaggagatcattaatagggtgatagcacgtgccgaaaagatggaggagatggagcaagagaggatcggacggctcgtcgaccgcctggaaaacatgaggaagaacgtcgctggggacggcgttaaccgctgtattctgtgtggcgaacagcttgggatgctggggtccgcttgcgtggtctgcgaagactgtaaaaaaaacgtttgcaccaaatgcggcgtagagactaataatcggctccacagtgtctggttgtgtaagatatgcattgagcaacgggaagtctggaagagatccggtgcctggtttttcaagggttttcccaagcaggtgctcccacagccaatgccaattaaaaagaccaaaccacagcagcctgtgtag

SEQ ID NO: 131591 - DNA, 285 bp, Artificial Sequence
  Description of Artificial Sequence: Synthetic coding sequence
atgaccgatacagtgtttagtaattcctctaatagatggatgtacccgtctgaccggcctctgcagtcaaatgacaaagagcagctgcaggctggctggtcagttcaccccggcggtcagcccgatcggcagaggaaacaagaggagctaaccgatgaagagaaggagattatcaatcgggtgatagccagagccgagaaaatggaggagatggagcaggaacgcataggcaggctcgtggaccgtctagagaatatgagaaagaatgtcgcgggggacggttag

SEQ ID NO: 131592 - DNA, 363 bp, Artificial Sequence
  Description of Artificial Sequence: Synthetic coding sequence
atgacggacactgtattttccaatagcagcaatcgatggatgtatccctcagaccgccccttacagagtaacgacaaagagcaactgcaggccggatggtctgttcatcctggcggccagcccgaccggcagaggaagcaggaagagttgactgatgaggagaaagaaattatcaatagggtgatcgcgcgggccgagaagatggaggaaatggagcaggagcgaattggaagacttgtagacaggctggaaaacatgagaaaaaatgtcgcaggcgatggagtgaatcggtgcattctctgcggagaacagctcggtatgctggggtcagcttgcgtggtgtgcgaggattgcaaaaagtag

SEQ ID NO: 131593 - DNA, 405 bp, Artificial Sequence
  Description of Artificial Sequence: Synthetic coding sequence
atgaccgacacagtattcagtaacagctctaataggtggatgtatccaagtgatcgccccttgcaaagcaatgataaagagcagctgcaggccggttggagtgtccaccctggggggcaacccgatcgccaacgtaagcaggaggaactgactgatgaggagaaagaaattatcaaccgagtgattgcccgcgccgagaaaatggaagaaatggagcaggagcggatcggaagactagtggaccgccttgagaatatgagaaaaaacgttgcaggagatggtgtcaatagatgcattctttgcggagaacagctcgggatgctgggatctgcatgcgtggtgtgtgaggactgcaaaaagaatgtgtgtacaaaatgcggagtcgagaccaataatagactctag

SEQ ID NO: 131594 - DNA, 948 bp, Artificial Sequence
  Description of Artificial Sequence: Synthetic coding sequence
atggcagacaccatctttggcagtggtaacgatcagtgggtgtgtcccaatgatcgtcagctggcgttgcgtgccaaactgcagacgggctggagcgttcatacataccagaccgaaaagcaacggcggaaacaacacctgtctcctgcagaggtagaggcaattttacaggtgatccagcgagccgagagactagacgttctggaacagcagcggataggccgactcgtggagagattggagaccatgcgacgcaatgtcatgggaaacggcctgagtcaatgcttgctgtgtggcgaagtcttagggtttctggggagttcttctgttttttgtaaggattgtaggaagaaggtctgcacaaaatgcggaatcgaggcttctcccggacaaaagcggccactctggctctgcaaaatctgttcagagcagcgagaagtttggaaacgctctggcgcctggttctataaaggattgccaaaatatattctgcctctgaagacgcccggaagagcagacgacccccacttccggcctctgccaacagagcctgctgagagggagccaagaagcagcgaaacttcacgtatctatacttgggcccggggtcgggtggtttcctctgactcagactccgattccgacctctcttcttcttccctggaagacagactgccttctaccggggtgagagatcggaaaggtgacaaaccttggaaagaatccggcggcagtgtcgaggcccctaggatgggattcacccatccacccgggcatctctctggttgccagagtagcctggcctccggtgagaccggtaccgggtctgccgatccccccggcggcccgagaccaggtctcacgagacgcgccccggtgaaggatactcccggcagagccccggctgccgatgccgctccagcagggccaagctcatgcctaggatag

SEQ ID NO: 131595 - DNA, 861 bp, Artificial Sequence
  Description of Artificial Sequence: Synthetic coding sequence
atggcagatacaatttttggatctggtaatgatcagtgggtctgccccaacgacagacagttagctctcagggccaagctgcaaaccggctggagcgtgcacacatatcaaaccgaaaagcagcggcgtaaacaacatctcagtccggctgaggtggaggctatcttgcaggtgatccagagggccgagcggctggacgtgttagagcagcagcgcatcggccgactggttgagcgactcgaaacgatgagacgaaatgtcatgggcaacggcctgtctcagtgtctactgtgtggcgaggtgttggggttccttggctcatcatccgtcttctgcaaggactgtcgcaaggtctggaaacgctcaggcgcctggttttataagggtctgccaaagtatatcttgcccttgaagaccccaggaagagctgatgatcctcatttcagacccctgccgacagagcctgctgagcgcgaaccgaggtcttccgagacatctagaatatatacctgggcccgagggagggtggttagctctgattcagattcggattccgacctctcttcctccagcctcgaggaccgacttccctccacaggagtacgagacaggaaaggtgataaaccttggaaggagagtgggggcagcgtcgaagctccgcgtatgggtttcactcatccccctggtcacctgtcgggttgccaatcatcgcttgcttccggagaaaccggcactggatcggctgacccacccgggggtccacgcccaggcttgactcggcgggctccagttaaggatacaccggggagggcccccgccgcagacgcagcgccagctggcccttcgagttgtttgggctag

SEQ ID NO: 131596 - DNA, 861 bp, Artificial Sequence
  Description of Artificial Sequence: Synthetic coding sequence
atggctgatacaatctttgggtccggaaatgaccagtgggtctgtcctaatgacaggcagcttgcccttagagcgaaactccagaccggttggagcgtgcacacataccagactgaaaagcaacgacgcaaacagcatctctcacctgctgaagtggaagcaatcctgcaggttatccagagagcagaacgtctggacgtacttgagcaacagaggatcgggcgcctcgtcgagagactggaaactatgagacgcaacgtcatgggaaacggcctgtcacagtgtttgctctgtggtgaagtgttgggatttctggggtcctcctcggtgttctgtaaggactgccgtaaggtgtggaaacggtctggtgcatggttctataaaggactgcctaagtacattttgccgctcaagaccccaggcagagctgatgatccacatttcaggcccctacctaccgaacctgctgagcgtgagcctagatcttctgaaaccagcagaatctatacttgggcgcgcggacgggtggtgtccagtgattcagattccgactctgatctgagctccagctccctggaggataggctccctagcactggcgtaagagatcgcaagggcgataaaccctggaaagagtcagggggcagtgtggaggccccccgcatggggtttacccacccaccgggtcaccttagcggctgtcagtctagtttggcctctggtgagaccggtaccgggtcagcagacccacctggggggcctcggcctgggctcaccaggagggcgccggtgaaagatactcccggcagggcaccggctgctgacgccgctcctgctggacccagcagttgccttggttag

SEQ ID NO: 131597 - DNA, 2331 bp, Artificial Sequence
  Description of Artificial Sequence: Synthetic coding sequence
atgaatccagaggagcagatcgtcacttggctgatatccctgggtgtgctggagagtccaaagaaaaccatctgtgatcccgaagagtttctgaagagtagcttgaagaatggcgtggtcctctgcaaacttattaaccgcctaatgccaggctccgtggaaaagttctgtctggacccccagacagaagccgactgcatcaataacatcaacgactttctaaaggggtgcgctactctgcaggtggagatttttgaccccgacgatctctatagcggcgtcaatttttccaaggtgctctctactctgctggccgtgaacaaggcaaccgaggaccagctgagcgagcggccgtgtggcagatcctcatccctgtccgccgcgaacacatcccagaccaacccccaaggggccgtgtcttccaccgtgagcggcctgcagcgacagagcaaaaccgtggagatgactgagaacggctctcaccaactcattgtgaaagcccggttcaatttcaagcagacgaacgaggatgaactgtcggtttgcaagggcgacatcatttacgttaccagggtggaggaaggcggttggtgggagggaaccctcaacgggagaactggctggtttccaagcaattatgtgagagaaatcaaaagtagcgagagacctttgagcccgaaggccgtcaagggatttgagacagctcctttaaccaagaactattataccgtagtgttgcagaacattctcgacaccgaaaaggagtacgccaaggagctgcagagcctccttgtgacctacctccgaccattgcagtccaacaacaatttatccaccgtcgaagtgaccagcctgctgggcaattttgaggaggtgtgcacgttccaacagaccctgtgccaggcactggaggagtgtagcaagtttcctgaaaatcaacacaaggtggggggctgcttgctttcactgatgccccactttaagagcatgtacttggcctactgcgccaaccatccaagtgctgtgaatgttctgacacaacacagtgatgaactggagcaattcatggaaaaccaaggagcgtcctcccccggtatcttgatcctgactactaacctctctaaaccatttatgcggctggagaagtatgtcactttactccaggagttggagcgccatatggaagatacgcatcccgaccatcaagatatattgaaagctatcgtagccttcaagaccctaatgggacagtgccaggatcttcggaagcgaaagcagctggagctgcagatcctgtcagagccaattcaggcttgggagggagaggatattaagaatctgggcaatgttatttttatgagtcaggtgatggttcagtacggcgcgtgcgaagaaaaagaggagcgttatctgatgctgttttccaacgtcctgattatgcttagtgcctcacctaggatgagtgggttcatttatcaaggcaagataccaattgctgggactgtcgttactcgactcgatgagatcgagggcaatgattgtacgtttgaaatcaccggcaataccgtggagagaatcgttgtccattgtaacaacaaccaggatttccaggaatggttagagcaactaaataggctgatacgaggcccagcttcttgcagttctctgtcaaaaacatcgtcttctagctgtagtgcgcattctagcttcagctcgactggtcagcctcggggccctctcgagccccctcagataattaagccttggtccctatcttgtctccggcctgccccccccctccggcctagtgctgcactgggatacaaggaacggatgagctacattctgaaagagagtagcaagtcgcctaagactatgaagaagtttctgcacaagagaaagaccgagagaaaaccttccgaggaagaatacgtgattcgcaaaagtacagcagcacttgaagaggacgcccagatcctcaaagtcatcgaggcttattgtaccagcgcaaattttcaacaaggtcacggctcgagtactcgcaaagactcaatccctcaggtgctcctaccagaagaggagaagctgattattgaggaaacccggagcaatggacagaccatcatggaagaaaaaagtctggttgataccgtatatgccttgaaagatgaggtacgtgaacttaaacaggagaataagaggatgaagcaatgtctcgaagaagaactcaagtctcggagggatctcgagaaattagttcgacgacttttgaagcaaaccgacgagtgcataagaggcgagagctccagtaagactagcatcctgccgtag

SEQ ID NO: 131598 - DNA, 1869 bp, Artificial Sequence
  Description of Artificial Sequence: Synthetic coding sequence
atgaccgagaatggttctcaccagctcatcgttaaggcaagattcaatttcaaacagactaatgaagatgagttgtctgtatgtaaaggtgacattatttatgtgacaagagtcgaagagggcgggtggtgggaagggaccctgaacggccggactgggtggttcccatcaaactatgttagggagatcaaaagttccgaaagacccctctcccctaaggccgtaaagggatttgagactgcccccctgaccaagaattactacaccgtcgtactgcagaacatcctggacactgaaaaggagtatgcaaaagaactccagtcactgctcgtcacgtacttgaggcctcttcaaagtaataataatctcagcactgtcgaagtcacctcactgcttggcaacttcgaggaagtgtgtacttttcagcaaacgctttgtcaggctctggaagagtgctctaaattccccgagaatcagcacaaggtcggcggttgcctgctatccctgatgccgcactttaaaagtatgtacttggcttactgtgctaatcatccatccgccgtcaatgtgttaacacagcattccgatgagctggaacagttcatggagaatcagggtgcaagctcacctggaattctgatcctgactacaaatctgtccaagccctttatgagactggaaaagtacgtgaccttgctacaggaattagaacggcatatggaggacacccacccggaccatcaggatatcttaaaggccattgtggcattcaaaacactcatgggacagtgccaggacctcagaaagcgaaagcagctggagttgcagattttgtccgagcccattcaggcatgggagggagaagacatcaagaatctgggaaacgtgatcttcatgtcccaggtgatggtgcagtatggtgcctgtgaggaaaaggaggagcgatatcttatgctcttttccaacgtgctgattatgctgtcagcatcgcctaggatgtccggcttcatttatcagggcaagattcctatcgctggtaccgttgtcactagactggatgagatagaggggaacgactgtaccttcgagatcacaggcaatacagttgagcgcattgtggtgcattgcaacaataatcaggacttccaggaatggctcgagcagctcaacaggcttattcgaggcccggcttcatgctcttccctgtctaagaccagttctagctcatgcagcgcccacagcagcttttccagcacggggcagccacgaggtcccctggagcccccccagataattaaaccctggtcattgtcatgcctccgccccgccccaccactgagaccctccgccgccctcgggtacaaagagagaatgtcctacatactaaaggaaagtagcaagagccctaaaacaatgaagaagtttcttcacaagcggaaaactgaacgaaagccttctgaagaagagtatgtcatccgcaagagcactgcggccttggaagaggatgcccagattctgaaagtaatcgaagcttattgcacatcagccaacttccagcaggggcacggaagcagtacgcgcaaggactcaattccacaagtgctgctgcccgaggaagagaaactgatcatagaggagacacgatccaacggacagaccatcatggaggagaaatcactcgttgacacagtatacgcgctgaaagatgaggtcagggagcttaagcaggagaataagagaatgaagcagtgtttggaggaggaactgaagagcagacgtgacctggaaaaactagtgcgaaggctactcaagcagacagacgagtgcataagaggcgaatcttctagcaagacatcgattctcccttag

SEQ ID NO: 131599 - DNA, 1869 bp, Artificial Sequence
  Description of Artificial Sequence: Synthetic coding sequence
atgaccgagaacggatctcaccaactgatcgtcaaagccaggttcaatttcaaacagacgaacgaagacgagctgtctgtgtgtaaaggcgacatcatctacgtgacccgggttgaagagggagggtggtgggagggtaccctgaatgggcgtactgggtggtttcccagtaactatgtgcgcgagattaagtcatcggagaggcctctctcccctaaagcggtgaagggatttgagacagcgcccctgacaaaaaactactacaccgtggtgctgcagaatatcttagacacagagaaagagtacgccaaagagcttcagagtttacttgtgacctacctgcgaccactgcagagtaacaacaacttatccactgtggaagtgacctctctcctggggaactttgaggaggtatgcaccttccaacaaacgctgtgccaagctctcgaggaatgttctaaatttcctgagaatcagcacaaagtcggcggctgtctcctcagcctcatgccacacttcaagtctatgtatctagcgtattgtgccaatcacccctcagcagtgaacgtgctgacccaacatagtgatgagctagaacagttcatggaaaaccaaggtgcgtcttctcctggaatcctcatcctgacaaccaacttatcgaagccatttatgagactggaaaaatatgtcaccttactgcaggaactggagcgtcatatggaagatacgcatcccgaccatcaggatatactgaaagctattgtcgctttcaaaacattgatgggccaatgccaggacttgagaaagaggaagcagctggagttacagatcctcagtgaacccatccaggcctgggagggtgaagatattaagaacctcggcaacgtgatcttcatgtcccaggtcatggttcagtatggcgcttgcgaggagaaagaggaaagataccttatgctgttttccaatgtactcattatgttgagtgcatccccccggatgtctggtttcatttaccagggaaagatacccatcgctggtacagttgtgacccgactggacgagatagagggcaacgactgcacctttgaaatcacaggtaacactgtagagcggattgtggtccattgcaacaacaatcaagacttccaggagtggcttgaacagctgaatcgactgattagaggtcccgcgagctgctccagcctctcaaaaaccagcagctcaagctgcagcgcacacagtagcttcagctcaaccgggcaacctagggggcccctcgaaccacctcagattataaagccgtggagtctgtcttgcttacggcctgctccccctttgagacccagcgccgcccttggatataaggaacggatgagctatatcctcaaggagagctcgaaatcgcccaagactatgaaaaaattcttgcataaacgcaagacagaacggaaaccaagcgaggaagagtatgtgattcgtaagagcactgctgccttagaagaggatgcccagatacttaaagtgatagaagcctactgcacgagtgcaaactttcagcaggggcatgggtcaagtacaagaaaagacagcattccacaagtccttttgccagaagaggaaaaactcattattgaagaaaccagatcaaacgggcagacaattatggaggagaaaagccttgtggataccgtttacgctctcaaagacgaagtccgggagttaaaacaggagaataagagaatgaagcaatgtttggaagaggagctgaagtcaagacgagatttggaaaagctcgtgcggagactgctgaaacaaaccgacgaatgtattcgaggagagtcatcaagtaagaccagcattctcccatag

SEQ ID NO: 131600 - DNA, 1950 bp, Artificial Sequence
  Description of Artificial Sequence: Synthetic coding sequence
atgaccgagaacggtagtcaccagctgatcgtgaaggcacgatttaactttaaacagacgaatgaagatgagttgtctgtctgtaaaggtgacatcatctacgttacacgggtagaagaaggtgggtggtgggaaggcacattgaacggccgcactggctggttcccatcaaactatgtgcgcgagataaaatcgtccgacggagtgagtctccttcttccgggcctcgagtgcaatggggccatttcagcccatcataacctctgtttgccgggctctaagcgcccactgtcaccgaaagctgtgaaagggttcgagactgcacctttgacgaaaaactattatacagtagtcctgcaaaatattcttgacaccgaaaaggaatacgctaaagaactgcagagcctcttggtaacctatctgcggcctcttcagtctaataataatctgtcaacggtggaggtgacatccctgctgggcaactttgaggaggtgtgcactttccagcaaactctctgtcaggccttggaggagtgcagcaagtttcctgagaatcaacacaaagtcggggggtgtctgctttcactgatgccacacttcaagtctatgtatctggcctactgcgctaaccacccctcagctgtgaacgtgctaacgcagcactcagacgagctggagcagttcatggagaatcaaggagcaagcagtcccggaatcttgattctcaccaccaaccttagcaagccgttcatgaggctagagaagtacgtcaccttgctacaggagctggagcgccacatggaggacacccaccccgaccaccaggatattctgaaggcaatcgttgcctttaagaccctcatgggccagtgccaggacctgcggaaacgcaaacagctggagcttcaaatcctttctgagccgattcaggcatgggagggagaggacattaagaatctagggaatgtgatttttatgtctcaagtaatggtgcaatacggcgcatgcgaagaaaaagaggagcgctacttgatgctgttctccaacgtgctcatcatgctgtccgcctccccgcgcatgtctggatttatttatcagggcaaaattccgatcgccgggacggtggtgactcgcctggacgagatcgaagggaacgattgcacatttgagataaccggcaatacagtcgagcggattgtggtgcattgcaataacaaccaagatttccaggagtggctggagcagctgaaccgcctgatcaggggacccgcttcatgtagctctttgtccaaaaccagctcttctagctgttctgcacattcttcctttagtagtaccggacagcctaggggtcccctcgagcctccgcagattataaagccttggtctctctcttgcctgaggcccgcacctccactccggccatcggcagccctgggctacaaggaaaggatgagttatattctgaaggagagctccaagagtcccaaaaccatgaaaaagtttctccataaaagaaaaactgagaggaaacctagcgaagaagagtacgttatccgtaagtccaccgctgcgctggaggaggacgcacagatcctcaaggtcattgaagcttactgcacgtcggctaattttcagcaggggcatgggtcctctacacggaaggactcaattccccaggttctgctgccagaggaggagaagctgatcatagaagagacccgctcaaacggccagaccatcatggaagagaagagcctggtagatactgtctacgccttaaaggatgaagtgagggaactaaagcaagaaaacaagcgaatgaagcaatgccttgaagaggaactgaagtctcggcgggacctggagaaactggtcagaagactgttgaagcaaactgatgagtgcatccggggggagagctcaagcaaaacttccatcttgccttag

SEQ ID NO: 131601 - DNA, 1869 bp, Artificial Sequence
  Description of Artificial Sequence: Synthetic coding sequence
atgacagaaaatggctcccaccagcttattgtgaaggctcgattcaactttaaacagacgaatgaggacgaattaagcgtgtgtaagggcgacataatttacgtaactagggtagaggagggaggctggtgggaaggcaccctcaacggccggacaggctggttccccagcaattatgtcagggaaatcaagagcagcgaaaggccgctctccccgaaagcagtgaaaggatttgaaacagcacctctcaccaagaactactatacggttgtactgcagaatattctggacaccgagaaggagtacgctaaagaactgcaatcactcctggtgacgtacctccgaccactgcaatcaaacaacaacctgagtaccgtggaagttacaagcctgctggggaattttgaggaggtgtgcactttccagcagaccctgtgccaagcattggaggaatgcagcaaattccctgagaaccagcataaagtcggaggatgcctcctatcattgatgccgcacttcaaatccatgtatctggcttattgcgctaatcatccaagcgcagtcaacgtgcttactcagcattcagatgagctagagcaattcatggagaaccagggagcgtcatctccaggaatcctcatcctgaccacaaatctgagcaaaccattcatgagacttgaaaagtacgtcacattgctgcaggaactcgaacgccatatggaggacacccatccagaccaccaagatatactgaaagcaatcgtggccttcaagacactaatgggtcagtgccaagatctccgcaaacgcaagcaactggaacttcagattctttcagaaccaatccaggcctgggagggcgaagacattaaaaacctcggcaacgtcatcttcatgtctcaggttatggtgcagtacggcgcgtgcgaagagaaggaggagaggtatttgatgcttttcagcaacgttctcataatgctttctgcctccccccgtatgtccggcttcatttaccaaggaaaaattcccatagccgggactgtggtgacacgactcgatgaaatcgagggaaatgactgtacgttcgagatcaccggaaacacagtcgagagaattgtggtccattgtaataacaaccaagacttccaggagtggttggagcagcttaaccggctcataagggggccagcgtcttgctcctccctctcaaaaaccagtagtagcagctgctcggcccattctagttttagctccacaggccagcccagggggcctctcgagcctccccagatcatcaaaccttggagcctgtcttgcctacggcccgcccccccactgcggccttctgccgcgctcggatacaaggaggccttcaccttcgtctttgaagagagtagcaagagtccgaaaacgatgaaaaaatttcttcacaagcggaagaccgagcggaagccttccgaagaggaatacgtgattcggaagtccaccgccgcgctcgaggaggacgctcagatcctaaaggtcatcgaggcctattgtacatccgcaaatttccagcaagggcacgggtcaagtacccggaaagatagcataccccaggtactgctgcctgaggaagagaaactcatcattgaagagactcgatctaatgggcagacaatcatggaggaaaagagccttgtggacactgtctacgcgcttaaagatgaggtgagggaactgaaacaggaaaataaacgcatgaagcagtgcctggaggaggagctgaagtcaaggcgagacttggaaaagctagtgcggaggctactcaaacagacggatgagtgtatacggggggagagctcatccaaaacctcaatcctgccctag

SEQ ID NO: 131602 - DNA, 1896 bp, Artificial Sequence
  Description of Artificial Sequence: Synthetic coding sequence
atgttctatgcccactttgtcctgagtaagagaggcccgctggccaagatctggctggccgctcactgggataagaaactcactaaagcacacgtgttcgagtgcaacctggaatcttctgttgagtcaattatctctcccaaggttaagatggccctcagaactagtggccatctgctcctcggggtggtgaggatttaccaccgcaaggcaaagtacctgctagcggactgtaatgaagcctttattaaaatcaaaatggcatttcggcccggggtcgtagacctccctgaggagaaccgggaagcagcctacaatgccatcactttgccagaggaatttcacgactttgaccagcccctgcccgaccttgacgacatagacgtcgcacagcagttttcacttaatcagtcacgcgtggaggagataaccatgcgtgaggaagtgggaaatatttccatactgcaggagaatgacttcggtgattttggcatggacgatcgcgaaataatgcgggagggatcagcttttgaggatgacgatatgttagtgagtacaacgacctccaatcttctactggagtccgagcagtctacttcgaatctgaacgagaaaatcaaccacctggagtacgaagaccaatacaaagacgataacttcggcgagggcaatgacggcggcatacttgatgataaattgatcagcaataacgatggggggattttcgacgacccccccgccctgtctgaggctggtgtcatgcttccagagcaacccgcccatgacgacatggatgaagatgataacgtgagcatgggtggtccagactctcccgacagtgttgaccccgtcgagcccatgcctacaatgaccgaccagaccacgctggtgccaaacgaagaggaggcattcgccctggagccaattgacatcacagttaaggagacaaaagccaaaaggaaacggaagctaattgtggacagcgtcaaagagttggactccaagaccattcgtgcgcagcttagtgattacagtgacattgtaaccacattggatctcgctccacctacaaagaaactcatgatgtggaaagagactggaggggtcgagaaactcttctctctgcccgcacagcccctctggaataataggcttttaaagctgttcacgcgctgtctaacacccttggtgcctgaggacctcagaaagcggagaaaaggcggggaagccgacaatctcgacgagtttctgaaggaattcgagaacccagaggtccccagagaggaccagcagcagcagcaccagcagagagatgtaatcgacgaaccaatcatcgaagagccttcccgcctccaagagtcagtgatggaagccagccgtacaaacattgatgagagcgccatgcctccgcccccaccgcagggagtcaagaggaaggcagggcagatagatcctgaacccgttatgccacctcagcaggtagagcagatggagattccgccagtagagttacctcccgaagaaccacctaacatttgtcagctgattcccgagttggaactacttcccgaaaaggagaaggagaaggaaaaagaaaaagaagatgacgaggaggaggaggatgaggatgcatccggaggggatcaggaccaggaagaacgccgttggaacaaacggacacagcagatgctccacggcctgcagcgggctctggccaagacaggcgcagagtctatttccctactggagctctgtcgaaataccaacaggaagcaggctgctgcgaagttctatagttttctagtcctgaagaagcagcaggcaatcgagctcacacaggaagaaccttactccgacataattgccacacctgggccccgcttccacattatctag

SEQ ID NO: 131603 - DNA, 501 bp, Artificial Sequence
  Description of Artificial Sequence: Synthetic coding sequence
atggctccaaaaaaggccaaaaagagggccggcggggccaactcaaatgttttcagcatgtttgaacagacacagattcaagaattcaaggaagcatttacgatcatggaccaaaacagggacggtttcatagataaaaatgacctgcgcgacacgttcgcagctctcgggagagtgaacgtgaagaatgaggagatcgacgaaatgattaaggaagccccagggcctataaactttaccgtcttcttgacaatgttcggtgaaaagctgaagggtgccgaccccgaggagacaatcctaaacgcctttaaagtcttcgaccccgagggtaagggcgtactcaaagctgattacgtgagggagatgttaaccacccaggctgaaagattctcaaaggaggaggtagatcagatgttcgcggccttccctccggatgtcactggtaacctcgactacaagaatctcgtgcatatcatcactcatggcgaagagaaagattag

SEQ ID NO: 131604 - DNA, 909 bp, Artificial Sequence
  Description of Artificial Sequence: Synthetic coding sequence
atggtccggccagtgcggcacaaaaagccagtcaattacagtcagtttgaccacagtgactccgacgacgactttgtgtccgccacagttccgctgaataaaaagagcagaaccgctcccaaagaacttaagcaggataagcccaaacccaatctgaataatctgagaaaggaggagatccccgtgcaggagaaaacaccgaagaaacggctaccagagggtactttctctattccagcatcagcagtgccatgtactaagatggctcttgatgataagctatatcaaagagacctggaggttgccttggccctgagcgttaaagagctgcccaccgttaccaccaacgtccaaaatagtcaggacaagtctattgagaaacatggctccagtaaaattgaaaccatgaataagtctccacatatttcaaactgtagcgtggcgagtgattatttggacctggacaagatcactgttgaagatgacgtaggcggagtacagggcaagcgaaaggctgcctcgaaggccgctgcacagcagcggaagatactgctggagggttctgacggtgactccgccaatgataccgagccggactttgcacccggcgaggacagtgaagacgattcagacttctgcgaatccgaagataatgacgaggacttcagcatgagaaagagtaaagtcaaggaaattaaaaagaaagaggtgaaggtcaagtctccagtcgagaagaaggagaagaagagtaagtccaaatgcaacgcccttgccgcgtcaggcgggtcgcggagctcttctagtccactagtggtggtgtcagtcaaaagccctaaccagtccttacgcctaggcctgagccgcttggcacgggtgaaacctttgcatccaaacgctacgtctacctag

SEQ ID NO: 131605 - DNA, 1008 bp, Artificial Sequence
  Description of Artificial Sequence: Synthetic coding sequence
atggttcgccccgtgaggcacaaaaaacccgtcaattactcacagttcgaccactctgacagcgacgacgacttcgtttctgcgaccgtgccattgaataagaaaagccggacagcgcctaaggagctgaagcaggacaaacccaagcccaatcttaacaacttgcggaaggaagagatacctgtgcaagagaagacccctaaaaaacgcatggcgctggatgataagctttatcagcgggacctggaagttgcgcttgctttatctgttaaggaactgcctactgtgactacgaacgttcagaacagccaggataagtccattgagaagcacggctcctctaagatagagacaatgaataagtctcctcacatttccaattgctcagtcgcatctgattacctggacttggataagatcactgtagaggacgatgtgggcggggtacagggcaaacggaaagccgcttcaaaagcagccgcacagcagagaaaaatcctgctggagggctccgacggggactccgctaacgacacagagcctgatttcgctcccggagaggacagcgaggacgacagcgacttttgtgagtcggaggataatgatgaggacttttccatgaggaagtccaaggtgaaagagattaaaaagaaggaagtgaaagtgaaaagtcctgtggagaaaaaggagaagaagtcaaaatcaaagtgcaacgcactagtgacctcagtggactctgcccccgcagccgtaaaaagtgaatcacagtctctccctaaaaaggtttccttgtcatccgacacgactaggaagccacttgagatccgaagcccatccgccgaaagtaagaagcctaaatgggtgccacccgctgccagcggaggttcccggtcttcgtcaagtcctctggtggtagtttctgtcaagtcccctaatcagagcttgcgtttgggactctcgcggttggcccgcgtgaaaccactgcacccaaatgcaacaagtacatag

SEQ ID NO: 131606 - DNA, 702 bp, Artificial Sequence
  Description of Artificial Sequence: Synthetic coding sequence
atgaataaatcacctcatatcagcaactgtagtgtcgcctccgactatttggatctggacaaaatcacggtggaagacgacgtgggcggagttcaggggaagaggaaggccgcttctaaagccgctgcccagcaacggaaaatcctacttgaagggtctgatggtgattccgccaacgacacggagcccgacttcgctcccggagaggattcagaagacgacagcgatttctgcgaatctgaggataacgacgaggatttttccatgcggaaatctaaagtcaaagagattaaaaaaaaagaagtcaaggtgaagtcgcccgtggagaagaaggagaaaaagtcaaagagcaaatgtaacgcattagtgacaagcgtagactccgcaccggcggccgtgaaatccgaatctcagtccctcccgaagaaagtgtcattatcctccgatacaacacgcaagcctttggagatacggtccccaagtgcagaatccaaaaaacccaagtgggttcctcctggaatggcctacctgtcctcccggaccggcgcttggaagatcattacagctgcttcaggcgggtcgcggtcctcttcaagccccctggtcgtggtgtcagtgaaatccccaaatcagtctctgcgactgggtcttagcaggttggctcgggtgaagccccttcaccccaatgctacttctacttag

SEQ ID NO: 131607 - DNA, 408 bp, Artificial Sequence
  Description of Artificial Sequence: Synthetic coding sequence
atgcgaggaaagactttcagattcgagatgcaaagagacctggtatcattcccgttaagcccggccgtcagagtcaaactggtatccgctggcttccagacagcagaagagttactcgaggttaagccttccgagctaagcaaggaagtgggcatctccaaagctgaggctctggaaaccctccagataatcagacgagaatgtcttactaacaaaccccggtatgctggcacttccgaatctcacaagaagtgcacggctcttgagctgctggaacaggaacacacacagggctttatcatcactttttgctctgccctcgatgatatcttgggcggcggggtaccactcatgaagacaacagaaatctgtggtgcacccggtgtgggcaagacgcaactctggtag

SEQ ID NO: 131608 - DNA, 855 bp, Artificial Sequence
  Description of Artificial Sequence: Synthetic coding sequence
atggccgagcttgttcctttcgcggtgcccatcgaatctgacaagaccctgcttgtatgggagctctcttccggacccaccgccgaggcgctgcaccattctctgtttactgccttctcgcaatttgggcttctttatagcgtgagagtttttcctaatgcagctgtggctcacccaggattttatgccgtaataaaattctatagcgcccgcgccgcacacagggctcaaaaggcctgcgaccggaaacagctgtttcaaaagagtcccgtgaaagttagattaggcacaaggcataaggccgtgcagcaccaggctttagcacttaattccagcaagtgtcaagagctggccaactattacttcggatttaatggatgtagcaaacgcattatcaagctgcaagagctcagcgatctggaagagagggaaaatgaggattcaatggtgcctcttcccaagcagtctcttaaatttttctgcgcgttggaagtggtgttgccctcctgtgactgtcgctccccaggtatcggcctagtggaggaacctatggacaaagtcgaagaagggcccttgtccttcttaatgaaaagaaagacagcacagaagctcgccatacaaaaggcattgtccgacgcattccagaagctgctgatcgtggtactcgaatctggcaagatagcagtggagtatagaccttcagaggatattgttggggtgaggtgtgaagaggagctacatggcctgattcaggtcccttgtagtccgtggaagcagtatggccaagaagaagaagggtatctttccgatttctcacttgaggaggaggaattcagactacccgagctggattag

SEQ ID NO: 131609 - DNA, 351 bp, Artificial Sequence
  Description of Artificial Sequence: Synthetic coding sequence
atgcacttgctggtaccacccccacagcactctctgttcacggctttcagccaattcggccttctgtactccgtgcgcgtgttcccaaatgccgcagtcgcccaccccggcttttacgctgtcatcaaattttactccgcaagagcagctcaccgtgcccagaaggcctgcgacagaaagcagcttttccagaagtctccagtgaaggtcagattgggaactcggcacaaggccgtgcagcaccaggccctcgcgctgaactcttctaaatgtcaggagctggccaattactacttcggcttcaatgggtgcagcaaaaggataatcaaagatcattaccactcactctag

SEQ ID NO: 131610 - DNA, 711 bp, Artificial Sequence
  Description of Artificial Sequence: Synthetic coding sequence
atggccgaattggtaccatttgctgttcccatcgaaagcgataagactttgcttgtttgggagctcagttctgggcccacagccgaggctcttcaccattcccttttcactgccttctcgcagtttggcttgctgtatagcgtaagagtattcccaaacgccgcggtagcccatccaggcttttacgcagtgattaagttctattcagcaagagctgcacatcgcgcccagaaggcctgcgatagaaaacaattgtttcagaaatctccagttaaggtacgcctgggtactcgccataaggccgtacagcaccaggcgctcgctttaaattccagtaagtgtcaggagctcgctaattattattttggttttaacgggtgctcaaagcgcattatcaaactgcaggaactgagcgacctggaagaacgtgaaaatgaggactcgatggtgccattacctaaacagagcctcaaatttttttgcgcactcgaggtagtgctgcccagttgtgattgcagaagccctggtataggcctagtcgaggagcctatggacaaggtggaagaagggccgttgtctttcctcatgaagaggaagaccgcacagaagttagcgatccagaaggcactttcggacgccttccaaaagcttctcatcgtggtcttggggaagactgtgctcataatcctggaagtcctgcagttccaatag

SEQ ID NO: 131611 - DNA, 786 bp, Artificial Sequence
  Description of Artificial Sequence: Synthetic coding sequence
atgcatctgctggttccgccccctcaacactcccttttcactgcatttagccagttcggcctgctctacagcgtgagagtgtttcccaatgcagcagtcgcgcaccccggtttctacgccgtaattaaattctactccgcccgagcggcccaccgagcccagaaggcctgtgacaggaagcagttgttccagaagagcccagtgaaagttcgcctgggtacccggcataaagccgtgcagcaccaagccctcgctttaaatagcagtaagtgtcaagaattagctaattactactttggcttcaatggctgttctaaaagaatcattaaactgcaggagctgtccgatttggaagaaagggaaaacgaggactccatggtgcctctaccaaaacagtcgctgaagttcttttgtgcactggaggtggtgctcccaagttgtgattgtcgaagtccagggatcggactcgtggaagagcctatggacaaggtggaagagggtccgctctcttttctcatgaaaaggaagactgctcaaaagttagccattcaaaaggctctgtccgatgccttccagaagcttctgatcgtcgtattggaaagcgggaagatcgccgtcgaatacagaccctcagaagatatcgtaggagtgcgctgcgaggaagaactccacggcctgatccaggtgccatgctctccgtggaagcagtacgggcaggaggaggagggttacctgagcgacttctctttagaggaggaggagtttcggctgcctgaacttgactag

SEQ ID NO: 131612 - DNA, 393 bp, Artificial Sequence
  Description of Artificial Sequence: Synthetic coding sequence
ttcggattcaacgggtgctccaaacgcatcattaaactccaggaattatcggacttagaagaaagagagaacgaagactctatggtgccgctgcccaagcaaagtttgaaattcttctgtgctctggaagtggtactgccaagctgcgattgccgctcccccgggatcggcctcgtcgaggaaccaatggacaaggtcgaagaggaatcgggtaagatcgcagtagagtatagacctagcgaagacattgtgggcgttcggtgtgaagaggagctgcatggactgatacaggtcccatgcagcccttggaaacaatacggccaagaagaagaaggatacttgtccgacttttccctagaagaggaagaatttcgcctccccgagctggattag

SEQ ID NO: 131613 - DNA, 501 bp, Artificial Sequence
  Description of Artificial Sequence: Synthetic coding sequence
atggctgagttagtacctttcgcagtgccgatcgagtccgacaaaacccttttggtatgggagctctcctcgggccccaccgctgaggccctgcatcattcactgtttaccgccttctctcaatttgggctgttgtacagtgtcagggtgtttccaaatgctgccgtggcgcatcctggcttctacgccgtcatcaagttctattcagcccgggccgcccaccgagctcagaaagcctgtgacagaaagcagcttttccagaagtcgccggttaaggtgcgcttaggaacacgccacaaggcagtccagcaccaggccctcgcgctgaatagctctaagtgccaggagttagcaaattattacttcggatttaacggctgttccaaacgtatcataaaagtgccatgtagcccatggaagcagtatggacaggaggaagaaggatacctgagcgatttctcgctcgaagaggaagaatttcgcttaccggagctggactag

SEQ ID NO: 131614 - DNA, 642 bp, Artificial Sequence
  Description of Artificial Sequence: Synthetic coding sequence
atgcacctcttagtcccacccccacaacactccctgtttacggccttctcccagttcgggctactatactcagtgcgggtatttcccaatgcggctgtggcccaccctggcttctacgctgtgattaaattttattccgcaagggctgcccatcgcgcacaaaaagcatgcgatcggaaacagctcttccagaagtcaccagtcaaggtcagactgggcactagacacaaagccgtacagcaccaggctctcgctctcaactccagcaagtgccaagagctggctaattactacttcgggttcaatggatgttccaagcgaatcattaaactgcaagaactgtccgacctcgaagaaagggaaaacgaggattccatggtgccactgcctaagcaatctctgaagttcttttgtgccctggaggtcgtgttgccatcttgcgattgtcgcagccctgggataggcctggtggaagagcccatggacaaggtggaggaaggaccactttcatttcttatgaagcggaagactgcacagaaactggccatccagaaggcattgagcgatgcttttcaaaagctcttaatagtggtccttggcaagacagtgctgattatattggaggtgctgcagtttcagtag

SEQ ID NO: 131615 - DNA, 756 bp, Artificial Sequence
  Description of Artificial Sequence: Synthetic coding sequence
atggcggaactcgtgccctttgctgtgccaatcgagagtgataaaactcttcttgtatgggagctcagtagcggccctaccgcggaagctctacaccatagcctgttcaccgcttttagtcagtttggccttctgtatagcgtcagggtatttcctaatgccgctgttgcccaccctggattttacgcagttatcaagttctatagcgcccgcgctgctcatcgggcccagaaggcctgtgacaggaaacaattgttccaaaagagtcctgtcaaggtcagactcggtacaaggcacaaggcagtccagcaccaagcattagccttaaactctagcaaatgccaagagctcgccaattattactttgggttcaatggctgctccaagaggattataaagttgcaggagctttccgaccttgaggagagagaaaacgaagacagcatggtgcctcttcctaaacaatccctaaagttcttctgtgcccttgaggtcgtgctgccctcttgtgactgtaggtcaccaggaatcggcctggtagaagagccgatggataaagtcgaggaagagagtgggaagattgccgtggaatatcgacctagtgaggatatcgttggcgtcagatgcgaggaagaactccacggtctcatacaagttccgtgctctccatggaagcagtacggccaggaagaagaaggatacctgtcggatttcagcctggaggaagaggagttccgtcttcccgagctggactag

SEQ ID NO: 131616 - DNA, 420 bp, Artificial Sequence
  Description of Artificial Sequence: Synthetic coding sequence
atggccgaactggtgccatttgcagtccccattgagtctgataagactctcctggtttgggaactgtcttccggcccaaccgctgaggcactgcaccactccctgttcactgctttcagtcagttcggtctgctttattcagtgcgcgtcttccctaatgcagccgtggcacacccagggttctatgcggttatcaagttctattctgctagggctgcgcatcgcgcccaaaaggcatgtgatcggaagcaactgttccagaagtcccccgttaaagtgagacttgggacaaggcacaaggcagtccagcatcaggcccttgcccttaacagtagcaaatgccaggaactcgccaactactatttcggatttaatggctgttccaagcgtattattaaagatcattatcactcgctgtag

SEQ ID NO: 131617 - DNA, 432 bp, Artificial Sequence
  Description of Artificial Sequence: Synthetic coding sequence
atgcacctgctggtgcccccacctcagcactccctgttcaccgccttcagtcagttcgggctgttgtactccgtgagagtgtttcctaacgccgcagtggcacatccagggttctacgcagtgattaaattctattcggcaagggcagcccatcgagctcagaaagcatgcgatcggaaacagctttttcaaaaaagccccgtgaaggtcagactgggcactcgacacaaagcggtccagcaccaggccctagccctgaacagttctaaatgtcaggagctcgccaactattacttcgggttcaatgggtgtagtaaacggattattaaggtcccttgtagcccttggaagcaatatggacaggaggaagagggataccttagcgacttcagcctcgaggaggaggagtttagactgccggagcttgactag

SEQ ID NO: 131618 - DNA, 2733 bp, Artificial Sequence
  Description of Artificial Sequence: Synthetic coding sequence
atgcggcgctccgcagctccctctcaactgcagggtaattcattcaaaaagccaaaattcatccctccaggaagaagcaacccaggcctgaatgaggagatcacaaaactgaaccctgacataaagctgtttgagggagtagccatcaataatactttcttacctagccaaaacgatctgcggatttgcagcctcaatctgccctcagaagaatccaccagggagatcaataacagagataactgcagtggaaagtattgcttcgaggcccccactctagccacactagaccctccccatacagttcatagtgcgcctaaggaggtggctgtaagcaaagaacaagaggaaaagagcgacagtctggttaagtatttttccgtggtgtggtgcaagccgagcaaaaagaaacacaagaagtgggagggtgacgcggttctgattgtgaaggggaagtccttcattctgaaaaacctggaaggtaaagacataggacggggaataggctacaaattcaaagagttagagaaaatagaagaagggcagaccctgatgatctgcgggaaagaaattgaggtgatgggggttatttctccggacgatttcagctccgggcgctgttttcagctgggcggcggctcgaccgcaataagccattccagccaagtcgcacgaaagtgtttcagcaatcctttcaagagcgtatgtaaaccgagctccaaagaaaacaggcaaaacgatttccagaactgtaaaccgaggcatgatccctatactccaaactccctggtgatgccaaggcctgataaaaatcaccagtgggtgtttaataagaactgttttcccctggttgacgtcgtcattgacccttatctagtttaccatctgcgcccgcaccagaaagagggcattatcttcctctatgagtgcgtgatgggcatgcgcatgaatggcaggtgtggcgcaatcctggcagatgagatggggcttggaaaaaccctgcagtgcatttccttgatttggactttacagtgtcagggaccctatggtggtaaacctgtaattaagaagacacttatcgtcactcctgggtccttggtgaataattggaagaaggaattccagaaatggttaggttctgaacgaataaagatcttcacggtggatcaagatcataaagtggaggagtttatcaaatctattttttactcagtgctaatcatatcttatgagatgttattacggagcctggaccagattaaaaatatcaagttcgacctgctgatctgcgacgaaggacacagacttaaaaatagcgccatcaagacaaccacagcactcattagcttgtcctgcgaaaaaagaatcatactcacggggactccaatccagaacgacctgcaggagttcttcgccctgattgactttgttaatccagggatccttgggtccctctccagttacagaaagatttatgaggaacctattatactgtctagggagccatctgctagcgaggaagaaaaggaactcggagagagaagggccgctgagctgacatgcctgactggtctatttatattgcgaagaacacaggaaatcataaataagtacttaccgccaaagatcgaaaacgtggtgttctgccgccctggggccctgcagatcgaactgtatcgcaagttactgaattcacaggtagtgcgtttctgtctccagggcttactggagaacagtccccatctgatttgcatcggagctcttaaaaagctctgtaaccacccttgcttacttttcaactcaataaaggaaaaagagtgttcttccacgtgcgacaaaaacgaggagaagtccttgtacaaaggactcctctcagtgtttccagcagactacaaccctttacttttcacagagaaagagtcgggcaagcttcaagtgctgtccaaactcctggccgtgattcacgagctgagacccactgagaaagtggtgctggtcagcaactatacacagacactgaacattctccaagaagtctgtaagcgccacggctatgcatatactaggcttgacggtcagactcccatatctcagcgccagcagatcgttgacgggttcaattcccaacactcttctttctttatctttctcctttcttcaaaggctggcggagtcggtctgaaccttatcggaggttctcacctaatcctctacgatatcgattggaatccagcaactgatatccaggcaatgtcccgggtatggagagatgggcaaaaataccctgtccacatttacaggttgttgacgaccggcacgattgaggaaaagatttatcagcgacaaatctctaaacagggcctgtgcggggctgtggtcgacctcacaaaaacaagcgagcacattcaattttcagtggaagaactgaagaatctctttaccctgcacgagtcctccgattgtgtgactcatgatctattggactgcgagtgtacgggggaagaagtgcacacgggggactcgttagagaaatttatcgtcagcagagattgtcagctgggcccccatcaccagaagtctaatagcctgaaaccattgagtatgagccaactgaaacagtggaagcactttagtggcgaccatcttaatctcaccgatccattccttgagcgtataactgaaaatgttagtttcattttccagaacatcacaactcaggccacaggtacatag

SEQ ID NO: 131619 - DNA, 900 bp, Artificial Sequence
  Description of Artificial Sequence: Synthetic coding sequence
atggtagggaaggcgcgctcatctaactttaccctctcagagaagctggacttgttgaaactagtaaagccctatgttaaaattctcgaggagcacacgaacaagcacagtgtcattgtggaaaagaatcgttgctgggacatcatcgccgtcaattacaatgctatcggcgtcgatcggcctcctcgaacggcccagggcctgaggacactgtacaagcggttgaaagagtacgccaagcaggagcttctgcagcagaaagagacccaaagcgacttcaaatcaaatattagcgaaccaaccaagaaggttatggagatgatcccccagatttcctcattctgcctggtgcgcgaccgcaaccatatccagtctgcgaacctggatgaagaagcgcaggccgggacatccagcctgcaggttatgctggaccaccaccccgtggctatcacagtggaagtgaaacaggaggaagatattaagccccctcctccactagtgctgaacagtcaacagagtgataccctggaacagcgggaagaacacgagctggtgcatgtgatggagagaagtctgagtccctccttgtcttcggtggatatgcgaatgacttccagcccttcgagtattccccggagggacgacttctttaggcatgaaagcggagaacattttaggtctcttctaggatacgaccctcaaattcttcaaatgctcaaagaagagcaccagatcatcctggagaaccaaaaaaatttcggactctatgtacaggaaaagagggacggtctgaaacggcgacagcagttagaagaagagctgctgagagcaaagattgaagtggagaaattaaaggccatcagactgagacacgatctcccggaatacaactctctgtag

SEQ ID NO: 131620 - DNA, 378 bp, Artificial Sequence
  Description of Artificial Sequence: Synthetic coding sequence
atgaggaggtctgccgctccgtctcagctccagggaaattcattcaagaagcctaagttcatccctcccgggagatctaatcccggcttaaatgaggaaataacgaagctcaacccagacataaagttgtttgagggcgtcgcaattaataatacattcctccccagtcagaatgatctgcgcatttgtagcctgaacctacctagtgaagaaagcacccgggaaatcaataatcgggacaactgctctggcaagtactgtttcgaagcgcctactctggcaaccctcgaccctccccataccgtacattctgcacccaaggaggtcgctgttagtaaagagcaggaagaaaaatccgattccctggttaagtattag

SEQ ID NO: 131621 - DNA, 354 bp, Artificial Sequence
  Description of Artificial Sequence: Synthetic coding sequence
atgagaagaagcgccgctccttctcagctccaggggaactcttttaagaagcccaaattcatcccccctgggcggtcgaatcccggtcttaatgaggaaatcactaaactgaacccggatatcaaattgttcgagggggtagcgatcaacaacacatttctcccctcgcagaatgaccttcggatctgcagcttgaatctgccctctgaagagtccacccgcgaaataaacaacagggacaattgctcaggcaaatattgtttcgaggctccaacgctcgcaacactggatcccccccatacagtacagacttggatgagaaggcatcgcctggtgccagtgcattatcgttag

SEQ ID NO: 131622 - DNA, 477 bp, Artificial Sequence
  Description of Artificial Sequence: Synthetic coding sequence
atgttggatcatcatcccgtggctattacggtggaggtgaaacaggaggaagacattaagcccccacccccactcgtcctgaacagtcagcagtctgacacacttgagcaaagggaggaacatgaattagtccacgtgatggagcgcagccttagtcctagcttgagttctgttgatatgaggatgacatcaagtcccagctcgatccctcgccgggatgatttcttccggcacgagtctggcgagcattttcgcagtctactaggttacgaccctcagattcttcagatgttgaaggaagagcaccagatcatactggaaaatcagaaaaacttcgggctctatgtgcaagagaagagagacggcctcaagaggcgccagcagctcgaggaagagctattgagagcaaagattgaagtcgaaaaactgaaggcaattcggctcagacatgatctgccagagtataacagcctgtag

SEQ ID NO: 131623 - DNA, 1749 bp, Artificial Sequence
  Description of Artificial Sequence: Synthetic coding sequence
atgggactcggcaaaactctacaatgtatctcactgatctggaccctgcagtgccagggcccctacgggggaaagccagtgatcaagaaaaccctaatcgtaactccgggatcccttgtgaacaactggaaaaaggagtttcagaagtggctgggctcagagaggatcaagatttttacagtcgaccaggaccacaaggtggaggagtttattaagtcaatattctattctgttctcattatttcttacgagatgctgctccggtctctcgatcagattaaaaatattaagtttgatctactcatctgtgatgaaggccataggctcaaaaatagtgccatcaagaccacgaccgcactcatctccctctcttgtgaaaagagaattattctgacgggcaccccaatacagaacgatttacaggaatttttcgccctgatcgacttcgtcaatccggggatacttggaagtctcagcagttatcggaagatctacgaagagcctattatcctgtcccgagagccgtccgcttcagaagaggaaaaggaactaggcgaacgtgagcagctgaacttgctggccagtttggattccctactacggcgcacgcaggagatcataaataaatatctgccccctaagatcgagaacgtggtcttctgccgacccggcgccctgcagattgaactgtaccgcaaactgctcaattcccaggtcgtacggttttgcttgcagggtctccttgagaactcgccccatctcatctgcatcggtgcattgaagaagctctgtaaccacccgtgtttgctgtttaacagcataaaagagaaagagtgcagttctacatgcgacaaaaacgaggagaagagcttgtacaagggcttattgtccgtttttcccgccgactacaacccactgctctttaccgagaaggaatctggcaagcttcaggtgctctccaaactcctggctgtgatccatgagctgcgacctacagagaaggtggtcttagtttcaaattacacgcagacactgaatatactgcaggaggtgtgcaagcgccatggttacgcttacacgaggctcgacggacagacccccatctcacaacgccagcagatcgtcgacgggttcaattcccagcacagcagcttcttcatttttctgctgtcatccaaggccgggggagttggtctgaatttgatagggggatctcatctcattctttatgatattgactggaacccagccacagatatacaggcaatgagtcgcgtgtggcgcgatggccagaagtatcccgttcacatctatcgcctgctgaccactggcaccatcgaggagaagatctatcagaggcagatctctaagcaggggttgtgtggggccgttgtggatttgacaaaaacaagcgaacacatacagttctcagtcgaggagctcaagaacttgtttaccctccacgaatcaagtgattgcgtgacacatgacctgctggattgcgaatgcactggggaggaagtgcacactggcgattccctggagaaatttattgtgagccgagattgtcagcttggccctcatcaccagaagagcaactccttaaagcctctgtcaatgtcccagctgaaacagtggaaacatttctctggggaccacctcaacctgacagatccttttttggaaaggattacagagaatgtctccttcattttccagaatatcaccacgcaggccactggcacatag

SEQ ID NO: 131624 - DNA, 1290 bp, Artificial Sequence
  Description of Artificial Sequence: Synthetic coding sequence
atggccgcaatgcttaagtgtgtgatgtccgggagccaagtaaaagtgttcggcaaggccgtgcaagccctgtcccggatttcagacgagttttggctcgaccccagcaagaagggcctcgccctccgctgtgtgaattcaagtcgctctgcatatgggtgcgttttgttttcaccagttttcttccagcattatcagtggtccgctctcgtgaaaatgagtgaaaatgaactggatactacactgcacttgaagtgcaagttaggcatgaaatcgattttgcccatattcagatgcctgaactcactagagaggaacatcgagaagtgtaggatctttaccaggtcggataagtgcaaggtcgttattcaatttttctataggcatggcatcaaaaggactcacaacatttgtttccaggaaagccagccactgcaggtgatctttgacaaaaacgtgtgcacgaatacactgatgatacagcccagattacttgccgatgccatcgtgctctttacaagctctcaggaggaagtgacactggccgtgactccactcaatttttgccttaagagcagtaacgaggaatccatggatctctctaacgccgtccactccgagatgttcgtgggctctgacgagttcgacttttttcagattggcatggacactgaaattaccttctgttttaaggagctgaaggggatcttaaccttcagtgaagccactcacgcccccatcagcatttattttgatttccctgggaagcccctggctctgtctattgatgatatgctcgtggaggccaacttcatcttagccactctggccgatgagcagagccgggcaagcagtccacagtccctgtgcttaagccagaaaaggaagagatcagacctaatagagaagaaggccggaaaaaatgtgaccgggcaggccctggaatgtatcagcaagaaggctgcaccgaggcggttgtaccccaaggagacactcactaacattagcgcccttgagaattgcggcagcccggctatgaaacgcgtcgacggagacgtttcagaagtgtccgagtcctccgtatccaatactgaggaagtgcccggctccttgtgtttgcgcaaattctcttgcatgttcttcggcgcagtgtcctctgaccagcaggaacattttaaccatcctttcgatagcctggcaagggcaagcgattcggaggaggatatgaacaatgtgtgctgtagaaaggaatttaacgggtctgatgccaagtacttttgcattatttag

SEQ ID NO: 131625 - DNA, 1038 bp, Artificial Sequence
  Description of Artificial Sequence: Synthetic coding sequence
atgagtgaaaatgagttagatacgaccctgcatctgaaatgtaaattgggaatgaagtccatactgccaattttccggtgcctgaacagtttggaacgaaatatcgaaaagtgtagaatcttcactcggtcagacaaatgcaaagtggtgattcaatttttttacagacatggcattaagagaacccataacatctgtttccaggaaagtcagccattgcaagtcatttttgacaagaacgtctgtacaaataccctgatgatccagcctcggctgctggcagatgcaattgtgttgttcactagttcccaggaggaggtgacactggccgtaaccccattaaacttctgcctgaagagctctaacgaggaatctatggatctatctaatgcagtgcactctgaaatgtttgtaggtagtgacgagttcgacttttttcaaattggaatggatactgaaatcacattctgttttaaagagctcaaaggtattctgaccttctctgaagctacccatgcccccatctccatttattttgatttccctgggaaacctttggccctatccatcgatgacatgctagttgaggcaaacttcattctcgccacattggcggatgagcaatcaagggcctcgtccccgcagagcctgtgcctctctcagaaacggaaacgcagtgacctgatagagaaaaaagctgggaaaaacgtgactggccaggctctggagtgtatatcaaagaaggcggctccccgccgtttatatccaaaggaaacactaacgaatatttcagctctagaaaactgtggcagccctgccatgaaacgcgtggatggcgatgtgtcagaggtcagcgagtcctctgtgagtaacacagaggaagttcccggaagtttgtgtctccgtaagtttagttgtatgttcttcggcgcagtgtcttctgaccagcaggagcatttcaatcacccctttgatagcctagcccgagcctccgacagcgaggaggatatgaataatgggtctttttcaatattctag

SEQ ID NO: 131626 - DNA, 1038 bp, Artificial Sequence
  Description of Artificial Sequence: Synthetic coding sequence
atgagcgagaatgagctcgatacgaccctccatttgaaatgcaagctgggcatgaagtctattctgccaatcttccgttgcctgaattctttggagcgtaatatcgagaagtgtcgtatttttactcgtagcgacaagtgcaaagtggtgattcagttcttttatagacacggaatcaagcgcacccacaacatttgctttcaagaatcccagccgctacaggtcatattcgacaagaacgtgtgcactaacactttgatgattcagccccgccttctggctgacgctatagttctctttacctcctcccaggaggaagtgaccctggccgttacacctctgaatttttgcctaaaatcatctaatgaggaatcgatggacctatcaaacgctgtacactccgagatgttcgtcgggagtgacgaattcgatttcttccagatcggaatggatacggaaattacattctgctttaaagaactcaaaggaatcctcaccttcagcgaggcaactcacgcccccatctccatatacttcgactttcctggcaagccactcgccttatccattgacgacatgctggtggaggcaaattttatcctggccacgctggccgatgaacagagtcgggccagtagcccccagagcctttgcctttcccagaaacggaagaggtcagatctgatcgaaaagaaggctggcaaaaatgttaccggccaggcacttgagtgtatcagcaagaaagctgccccacgacggctgtacccaaaggagaccttaacgaacatctccgcattggaaaactgtggatctccagccatgaagagggtagacggggatgtcagtgaggtgtcggagagcagtgtgagcaacactgaagaagtgcctggcagcttatgtctacgaaaattctcctgtatgtttttcggcgctgtgtcctctgatcagcaggagcatttcaaccatccatttgatagtctagcccgcgcttctgacagcgaggaggacatgaataatgggtctttcagcattttctag

SEQ ID NO: 131627 - DNA, 1449 bp, Artificial Sequence
  Description of Artificial Sequence: Synthetic coding sequence
atggggtgcgtgcagtgcaaggacaaagaagcgactaagctaacggaggagcgcgacgggtctctgaaccaatcgtccggatataggtatgggacagaccctactcctcagcactaccctagcttcggcgtaacgtccatcccaaattacaacaatttccatgcggctggcgggcaaggtctgacggtgttcggtggggtgaactcttcaagccataccggaactttgagaaccagaggtggtacgggcgtgacgctgttcgtcgctttatacgattacgaggctagaactgaagatgatctgtcttttcacaagggggagaaattccagattctgaattccagtgaaggagactggtgggaggcgaggtctctcacaaccggcgagaccggctacataccctctaattatgtggccccagttgactcgatccaagcagaagaatggtacttcggaaagctgggacggaaagacgccgaaagacagctgttatcgtttggcaacccccggggaactttcctgatacgcgagagtgaaactacaaaaggggcctattctctgagtatccgcgactgggacgacatgaaaggcgaccacgtgaagcattataaaattcggaagctggacaacgggggctattatataaccacccgggcccagttcgagacactccagcagttggttcaacattactctgggacttggaacggtaataccaaggtcgccattaagaccctcaaacccggcacgatgagtcctgaatcttttctggaggaagcccaaatcatgaaaaaactgaaacacgataaactcgtccagttgtatgctgtggtgtctgaagagccgatctacatcgtgacggagtacatgaacaagggcagtctgctggacttcctaaaggacggagagggtcgcgccctgaaattgccgaacctggtggatatggcagctcaagtcgcagccggcatggcatacattgaacgaatgaattatattcaccgcgaccttcgttcggctaatattctcgtgggaaacggccttatctgtaagatagctgatttcggcctggccagactgattgaagacaatgagtacacagccagacaaggcgccaaattccccattaagtggactgccccggaggccgccctgtacggccgctttactattaagagtgatgtctggtcttttggtattctgctgactgaacttgtgactaaggggcgcgttccatacccaggaatgaataacagagaggtgctggagcaggtggaaagggggtatagaatgccctgtccgcaggactgccccatcagtctgcatgagcttatgatacactgttggaagaaggatcccgaggagaggccaactttcgaatatctgcagtcattcctcgaggattattttaccgctactgagcctcagtatcaacctggcgagaacctgtag

SEQ ID NO: 131628 - DNA, 1410 bp, Artificial Sequence
  Description of Artificial Sequence: Synthetic coding sequence
atggaggattccacaagcccaaaacaagaaaaggagaaccaagaggagctcggggagacaagaaggccgtgggagggtaagacagctgcgagcccccagtattctgaacccgaaagctcagaacccctcgaggcaaagcagggccctgagacaggaagacagagtcgatctagtcgaccttggtccccccagagcagagctaagacgcccctgggaggacccgccgggccagagactagctcgccagcacctgtcagtccccgggaaccatcgtcgagcccgtccccactagcccccgcccgacaagacctcgctgcaccaccccagagcgatcgcacaacttccgtgatccccgaggcgggtacgccctacccagaccccctggagcaatcttccgacaaacgcgagagtacgccacatcacacttcacagagcgaggggaatacgtttcagcagtcccagcagccgaagccccacctgtgcggccgcagagatgtgtcttacaacaatgcaaagcagaaggaattaaggtttgacgtgttccaagaagaagattcaaattccgattatgatttgcagcagccggctccgggcgggagcgaggtggccccttctatgctagagatcacaattcaaaacgctaaggcatatctgttaaagacctcctccaatagtgggttcaacctgtatgatcatcttagtaacatgctgaccaaaatcctcaacgaacgccccgaaaatgccgttgacatctttgaaaatatttcccaggatgtgaagatggcccacttctcaaagaagttcgacgcgttacagaacgagaacgaactcttgcccacatacgagattgccgaaaagcagaaggccttgttcctgcagggccatctcgagggcgtggaccaggaattggaggacgagattgggcggtgtaattggttcaactcaattcagaaaaatgaggaggaggaagaagaggaagatgaggagaaggacgactccgattatatcgagcaggaagtaggtctgcctctcctaaccccaatctcagaggatcttgagatccagaacatcccaccttggacaacccggctcagctctaatttaatcccccagtacgcaattgccgtgttgcagagtaacctgtggccgggtgcctatgccttttctaacgggaagaagtttgagaatttctacatagggtggggccataaatacagtcccgataactacacccctcctgtgccccccccagtgtatcaggaatatccttccggccctgagataactgaaatggacgatccctcagtagaggaggagcaggcctttcgggctgctcaggaggcagtactgctagccgctgagaacgaagagagtgaggaggacgaggatgaggaagacgattacgattag

SEQ ID NO: 131629 - DNA, 1803 bp, Artificial Sequence
  Description of Artificial Sequence: Synthetic coding sequence
atggaggacagcacctctccaaagcaggagaaggagaatcaggaggagctgggcgaaaccagacggccctgggaaggaaaaacggctgcttcgccgcaatattcagagcccgagtcttctgagcctctggaggccaagcaagggcctgagaccgggcgccagtcacggtcatctaggccatggtcccctcagagccgcgcaaaaaccccattaggggggcctgcgggcccagagacgtccagtccagccccagtttcaccacgggaaccgtcctctagcccctccccactggccccagccaggcaggacctggcagccccaccacagtcagacaggactacttccgttatccctgaggccggtacaccctatccagaccccctggagcagtcgagcgataaacgggaaagtacacctcaccacacctcccagagcgaggggaatactttccagcaatctcaacaaccgaaaccacacctctgtgggaggagggacgtcagctacaacaacgcgaaacagaaagagctgaggttcgacgtcttccaggaggaggactccaacagtgactatgatctgcagcagcccgcccccggcggctctgaagttgcccctagcatgctcgaaattacaatccagaatgcgaaagcctacctcctcaagacgtctagcaattctggcttcaatctgtacgatcatctttctaatatgttgaccaagatcctgaatgagaggcctgagaacgccgtcgatatcttcgagaatatctctcaggatgttaagatggcccacttcagtaagaaatttgacgccctgcagaacgaaaacgagttacttcctacttacgaaatcgctgagaaacaaaaagccctgttcctccaagggcatctcgagggcgtggaccaagaattagaggacgagatcgccgagaatgcattgcccaatgttatggagtcggcgttttatttcgagcaggctggtgtgggactgggcaccgatgaaacctacaggattttcttggccctcaaacagctcaccgatactcaccctattcagcgttgcagattctggggaaaaatcctgggactcgaaatgaattatattgtggccgaagtggaatttcgcgaaggggaggatgaggaagaggtggaagaagaggatgtggcagaagagcgggacaacggcgaaagcgaggcccatgaggatgaggaggatgagcttcctaagtccttctataaagccccacaggcaattcccaaagaggagagccgaacgggtgcaaacaagtacgtgtacttcgtgtgcaacgaacccggtaggccttgggtaaagctcccaccagtgatccccgcgcagatcgttatagctcgtaaaattaagaaattcttcaccggacgccttgatgctccaattatttcctatcctccattccctggtaacgagagtaactatctcagagcccagatcgccagaatctcggccgggacacacgtttccccactagggttttaccagttcggagaggaagagggtgaggaagaagaggaagctgagggcgggagaaactcttttgaagagaacccagacttcgaaggaattcaggtgatcgatctcgtggagtcgctgagcaactgggtccaccacgtacaacacatcctctcccaacgctttaggatctacccaccaggacagcatggctacccacagatctcatttcacaacatgctactgcagagctttaacccaaccttcggcctggaacacatgccaagccctatggccaagagtctcaagatatctacatag

SEQ ID NO: 131630 - DNA, 1536 bp, Artificial Sequence
  Description of Artificial Sequence: Synthetic coding sequence
atgctcgagatcacaatccaaaatgccaaggcatatctgctcaaaacaagctccaattcgggattcaacctgtacgatcatctgagcaacatgcttacaaaaattttaaatgagagacccgagaatgccgttgatattttcgaaaatattagccaagacgtgaagatggcccatttttccaagaagttcgatgctctgcagaatgagaatgaactccttcctacgtacgagatcgccgagaaacagaaagcgctcttcctgcaagggcacctggaaggcgtcgaccaggagctcgaagacgaaattgccgaaaacgctctcccaaacgtgatggaaagtgccttctattttgagcaggcgggggtgggattaggaacagacgagacttatcgaatcttcctcgccctgaaacagctcaccgatacacacccaatccagagatgtaggttctggggaaagatacttggactcgaaatgaactatattgtcgcggaggttgaattccgagaaggcgaggacgaggaagaagttgaagaagaagatgtcgccgaagagagagacaacggggagtcagaagcacacgaagacgaagaagacgagctgcctaaatccttctataaggcccctcaggctatcccaaaggaagaaagtagaaccggagccaataaatacgtctactttgtgtgtaatgaacctgggcgcccctgggtaaaactgccaccggtaattccagcccagatcgtgattgctcggaagatcaagaaatttttcacgggtcgcctggatgctccgatcatctcctaccctccgttccccggcaacgagtccaactatctgcgtgctcagatcgctagaatcagcgccggcacccacgttagtcccctgggtttctatcagttcggcgaggaggagggtgaggaagaagaagaggcagaggggggacggaactcattcgaggagaacccggattttgaggggattcaggttatcgatctggtagagagccttagcaactgggttcatcacgtccagcacattctgtcgcaagggcgatgcaattggttcaactcaatacagaaaaatgaggaggaggaggaagaggaagatgaagagaaggacgattctgattatattgagcaagaggttggcctcccgctgctcactcccattagcgaggatctcgagatccaaaacattccgccatggaccacaaggctcagctcaaatctaattccccaatacgccattgcggttctgcaatctaacttgtggccaggagcctatgcatttagtaatgggaaaaagtttgaaaacttttatatcgggtgggggcataaatattcaccagataattacacgccgcccgtaccccctcccgtataccaggagtacccctcaggtcccgaaatcaccgaaatggacgaccccagcgtggaagaggagcaggcttttagagctgcccaagaagcggtgctgctggctgccgagaatgaggagagtgaggaggacgaggatgaagaggatgattatgattag

SEQ ID NO: 131631 - DNA, 531 bp, Artificial Sequence
  Description of Artificial Sequence: Synthetic coding sequence
atgctggtaaagagggactatagatacgatagagtgctgttttggggaaggatattaggcctagtcgctgattactacatcgctcaagggctgtcggaagaccagttagcacctcgcaagacactctactccttgaactgcactgaatggagcctgctccctccagcaaccgaagagatggtcgcacagtcctctgtggtgaaagggcgattcatgggagatccaagctacgaatatgagcacactgagctacaaaaggtcaatgaaggcgagaaagtgttcgaggaggaaatcgtggtccaaataaaagaagagacacgactcgtgtctgtcattgaccagatcgataaggccgtggccattatccctcggggtgccctgttcaagacacccttcggccctacacacgtgaaccggacttttgaaggatactataactggtataaaacgcccgctcctcacccaacgtgcgacggcaaccagggtgttcgcgctcgtggtagaagcccctcactggggaggtttctctag

SEQ ID NO: 131632 - DNA, 831 bp, Artificial Sequence
  Description of Artificial Sequence: Synthetic coding sequence
atggacgcagattccctgcttctatcgctggagctggcaagtggatctggccagggactaagccccgatcgaagagcgtccctactgacctccctgatgctggtgaagcgggactacaggtacgatagagtattgttctgggggcgaatcctcggtctcgtcgccgattactatatcgcccaggggctgagtgaggaccagctcgccccaaggaagacactctattccctcaattgcactgagtggtctctcctcccgccagccacagaggaaatggtggcgcaatcatcagtggtcaaagggcgctttatgggagacccaagctacgagtacgagcacacagagttgcagaaagtgaacgagggtgagaaggtctttgaagaggagatagtcgtgcagattaaggaagaaacacgtttagtaagcgtgattgaccagatagataaggcagttgcgattatacccaggggtgccctcttcaaaactccgtttggacccacacatgtaaaccgtaccttcgaagggctatcgttgagcgaagccaaaaagctcagctcctattttcatttccgcgagcccgttgaattaaagaataagactctgctcgaaaaggccgatctggacccctctttggacttcatggactccctggaacacgatataccaaagggctcatggtcaatccagatggagcggggtaacgcgctggttgtactgcgctcccttctgtggcccggactgaccttttatcacgcccctagaaccaaaaattacggctatgtctacgttggtacaggagaaaagaatatggatctcccctttatgctgtag

SEQ ID NO: 131633 - DNA, 921 bp, Artificial Sequence
  Description of Artificial Sequence: Synthetic coding sequence
atggacgctgattctctgctgctctccctagaactagcctcaggaagcgggcagggactgtcccccgatcgaagggcttcactgctgaccagtctcatgctggtgaaacgcgactatagatacgatagggtgctgttctggggccgcattttgggtttagtggccgactattatatagctcaggggctatcggaagatcaactggcacctcgaaaaacgctatattctctgaactgtactgagtggtcactgctcccgcctgctaccgaagaaatggtggctcaaagctctgtcgtgaaagggcgcttcatgggcgatccatcatatgagtatgagcataccgagctccagaaggtgaatgaaggcgagaaagtctttgaggaagagattgtgattgacaaggctgtagcgataataccgcgcggcgcgctgtttaaaacgccttttgggcccacccatgtaaaccgcacatttgaaggcctaagcctgtctgaggcgaaaaagctctcttcctacttccactttcgcgagccggtggaacttaagaacaaaacattgctcgagaaagccgacttggacccgagcctggacttcatggattcattggaacacgacatccccaaggggtcagaggcagtggtccagggtgattttacgtggttactctccaggtgtggctttggttggccttgctcttgggacagctgcagcgtatccatgcgtgtgcttgagcaccctgatggcgagggccagtgtcccgggggagctgcgcaacccgcccttgctggtccgcacctgctgccctgctccccccaccaggagttatggctgcggcttaggggccattggcgggaagaacacgggttggcattgcacgccatcgagtgggaacctgcatggatgtttcttaaccgggtttag

SEQ ID NO: 131634 - DNA, 402 bp, Artificial Sequence
  Description of Artificial Sequence: Synthetic coding sequence
tgattgaattgtactgaatggtccttgctccctccagcaacggaagagatggtggcgcaaagctccgtggtaaaaggcagatttatgggtgatcctagttacgaatacgagcacacagagctccaaaaggttaatgaaggcgaaaaagttttcgaagaggagatagtggtgcagatcaaagaagagacacgactcgtgagcgttatagatcaaatagacaaagccgtcgctattatcccaaggggggctctgttcaaaacccccttcggtccaacccacgtaaaccggacttttgagggctactacaactggtacaaaacacccgccccccacccaacatgtgatggaaaccagggggtgagggcaagggggaggtctccctctctggggagatttctgtag

SEQ ID NO: 131635 - DNA, 1086 bp, Artificial Sequence
  Description of Artificial Sequence: Synthetic coding sequence
atgtgggttcttaccccagccgccttcgccgggaaactcctgtcagtcttcagacagcctttgagcagcctgtggcggtcacttgtgcccctcttctgttggctccgagctacgttttggttgctcgccactaaacgcaggaagcagcagttagtgctgcggggcccggacgaaactaaagaggaggaggaggatccaccactgccaacaacacccacgtcagtcaattatcatttcacacggcaatgcaactataaatgtggtttttgttttcatactgccaaaacatcgtttgtgctgccgctcgaagaggccaaacggggactgttgctgttaaaggaagccgggatggagaagatcaacttctctggcggggagccattcttacaggatagaggggagtacctcgggaaattagttcgtttctgcaaggttgagctccggctacccagtgtgtctatcgtgtctaatggatccctcattcgcgagcgctggttccaaaattatggtgaatacctcgacatcctggcgatctcatgcgatagttttgatgaggaggtgaacgtgctgattggcagaggccaaggcaaaaagaaccatgtggagaatctgcaaaagttgagaagatggtgtcgggactacagggtcgccttcaagattaatagcgtgataaaccgcttcaatgtggaggaagatatgaccgaacagatcaaggctttaaacccggttagatggaaagtatttcaatgtctgctcatcgaaggggagaattgcggagaagatgccctgcgcgaggccgagcggtttgtgatcggtgacgaggagttcgagcgcttcctggaacggcacaaggaggtctcctgtctcgtgcctgaaagtaatcagaaaatgaaagacagctatctgattcttgacgagtatatgcggtttcttaactgcaggaagggaaggaaggatccatcaaagagtatattggacgtgggagttgaggaagccatcaagttcagcggcttcgacgagaagatgttcctgaagcgcggcggtaaatatatttggagtaaagccgatctcaagctcgactggtag

SEQ ID NO: 131636 - DNA, 765 bp, Artificial Sequence
  Description of Artificial Sequence: Synthetic coding sequence
atgctgcattcttctcattatcctgggatggagaaaatcaatttcagcggcggcgagcccttcctgcaggaccggggggagtacctggggaagctggtgaggttctgcaaagttgaactgcgcttacccagtgttagcattgtcagcaatggaagcttgatccgtgagcggtggttccagaattatggagagtacttggacatactggcaatctcctgcgatagcttcgacgaagaggtcaacgtcctgatcggcaggggccaggggaagaaaaatcacgtggagaatctgcaaaagttacggaggtggtgtcgagactaccgggtcgcatttaagattaacagcgtcatcaatcggttcaatgtggaagaagacatgactgaacagataaaagctctgaatcccgtacgttggaaagtgttccagtgtctgttaatagaaggcgagaactgtggtgaggatgcactgcgagaagcagaacgttttgtaatcggcgacgaggagttcgagaggtttctcgagcgccacaaagaggtctcctgtctagttcccgagtccaaccagaaaatgaaagactcataccttatcctggatgagtatatgagattcctgaattgccggaaggggcggaaggacccctctaagagcattttagacgtgggagttgaggaagctattaagtttagtgggttcgacgagaagatgttcctaaagcgcggggggaagtatatttggtcaaaagctgatctcaagctcgactggtag

SEQ ID NO: 131637 - DNA, 1674 bp, Artificial Sequence
  Description of Artificial Sequence: Synthetic coding sequence
atgtataagcgaaacggacttatggcctctgtactcgtgacctccgcgactccacagggtagctctagctctgatagcctagagggccagtcctgcgattacgcctctaagagctacgatgctgtcgtctttgatgtgctcaaagtgacccccgaggagttcgcctcgcagatcacccttatggacattccagtgtttaaggcgatccagccggaggagctggcttcgtgcgggtggagtaaaaaagagaagcatagcctcgcccccaatgtggttgcctttacccgacgattcaatcaggtgagtttctgggttgtccgcgaaatactaacagcccagaccctgaagatacgagctgaaattttaagccactttgtaaaaattgcaaaaaagttactagagctgaataatctgcattctctcatgtccgtggtctcagcactgcagtctgcccctatcttccggctgacaaaaacatgggccttgctaaaccgtaaggacaaaacaactttcgagaagctggattatctgatgagcaaagaggataactataagcggacgagggagtatataagatctctgaagatggtaccctcaattccttatctgggcatctacctgcttgatctgatatatattgattcggcttatcccgccagcggaagcatcatggagaacgaacagcggagtaaccagatgaacaacattctgcggattattgccgatctacaggtcagctgttcgtatgaccacctgaccaccctgccgcacgttcagaagtacctgaaaagcgtgaggtacattgaagagctccagaagttcgtggaggatgataactataagctctctcttaggatcgagccaggatcttcctcaccacgcctcgtctccagtaaggaggacctagcagggccatcagccggttccgggagcgcccggttctcccggcgccctacctgtccggacacttccgtcgctgggtcattgcccacccctcccgttccccgccacaggaaatcgcattctcttggaaataacatgatgtgtcaactgtccgtagttgaatccaagagcgcaacattccccagtgaaaaggccaggcacttgctagacgactccgtgctggaaagccgtagccctaggcgcggcctggcactaacctcgagcagtgccgtgaccaacggcctgagcctggggagtagtgagagctctgaattttccgaggagatgtcgagcgggctggagtctcctactggaccgtgcatttgctctctgggtaattctgcagccgtgcccacaatggaaggacctctcaggagaaaaacactgcttaaagagggacggaagcctgccctgtctagctggactcgctactgggtgatcctgtcaggcagtacattattgtattatggtgccaagtccctgagaggtaccgacaggaaacactacaaaagcacccccgggaagaaggtttccatcgtgggctggatggtacagctgccggacgacccagaacacccagacatcttccagcttaacaaccccgacaaaggtaatgtgtacaaattccagactgggtctcgcttccatgctattctgtggcataaacacctggatgatgcttgcaagtctaacaggccacaagtcccagccaacttaatgagcttcgagtag

SEQ ID NO: 131638 - DNA, 522 bp, Artificial Sequence
  Description of Artificial Sequence: Synthetic coding sequence
atgtacaaacgcaatggcctgatggcttccgtgctggtgacaagcgcaactccccaaggctccagctcttcagattccctggaagggcagtcgtgcgactatgcctccaaatcttacgacgcagtggtgtttgatgtccttaaggtgacaccagaggaattcgctagtcaaattaccctgatggacatccccgtgtttaaggcgattcagcccgaggaactggcttcttgtgggtggtccaaaaaagagaagcacagcctcgctcccaacgtcgtagccttcacaaggcgcttcaatcagaagctcttagaactgaacaatcttcatagcctgatgagtgttgtgtcagccctgcagagcgcacctatctttcgattgaccaaaacctgggcactgcttaaccgtaaagataaaacaactttcgagaagttagactatttaatgtctaaggaggataattataagaggacacgagagtacatccgatctcttaagatggtgccgagcatcccgtacctctag

SEQ ID NO: 131639 - DNA, 1590 bp, Artificial Sequence
  Description of Artificial Sequence: Synthetic coding sequence
atgtataagaggaacggattgatggcctctgtcctcgtgacctccgcaacaccccagggatccagcagcagcgattcactggaggggcaatcttgtgactacgcttctaaaagttatgatgcagtggtttttgatgttttgaaggtgactcccgaagagtttgcttcccagatcactctcatggacatccctgtttttaaagcaattcagcctgaggagctagcctcctgcggctggtccaagaaggagaagcattcccttgccccgaatgtggtagcgtttaccagaaggtttaatcaggtgtctttttgggtggtgcgggaaatactgactgcacagacacttaagatccgtgctgaaattctctctcacttcgtcaagattgcaaaaaagttactcgagttgaataaccttcacagtctgatgtcggtggtatccgcactccaatctgcgcccatctttcgacttacaaagacatgggccttattgaaccgaaaagataaaactaccttcgaaaagctggattacctgatgtctaaggaggacaactacaaacgcacacgggaatacatacgttccctaaagatggtaccatccatcccatacctgggtatttatttgttagacctaatttacatcgacagtgcctatccggctagcggctcaattatggagaatgagcaaaggtcgaatcagatgaacaatatcctgaggattatagctgacctccaagtgtcatgtagctacgaccacttgacaacacttccacacgtacagaagtatcttaaatctgtcaggtacattgaggagctgcagaagttcgtcgaggacgacaactataagctcagcttgcggatagagccagggagctcctctccccgcctggtaagcagtaaagaagatctggctggcccctccgcgggctctggatctgctcgtttttcacggcggcccacatgccccgacaccagtgtcgctggcagcttgcctacccctcctgtgccacggcataggaagagccactctttaggcaacaaccgcggcagactatacgccactcttggcccaaattggcgagttcctgtgcgcaatagcccacggacacggtcctgtgtgtattcccccactggcccctgcatttgctctttagggaacagtgctgcagtcccaacgatggaagggcctctgcgcagaaagactctccttaaagaggggcggaaaccagctctgtcgtcctggacaagatactgggttatcctgtctggttctacattgctctattacggagctaagagtcttagggggaccgacagaaagcacgtgtcaatagtcgggtggatggtccagcttcccgatgacccagagcaccctgatatattccagctgaataaccccgataagggaaacgtttacaaatttcagaccggtagtagattccacgccattctctggcataagcatctggatgatgcctgcaaatcaaaccgcccacaggaggcaggcgccgcacccggacctaccggaactgacagccacgaagtggaccaccttgagggaggagccggaaaggaggccggaccctgtgcttag

SEQ ID NO: 131640 - DNA, 918 bp, Artificial Sequence
  Description of Artificial Sequence: Synthetic coding sequence
atgtataagagaaatggactgatggcttcagtcctggtgactagtgctacaccacaagggtccagctccagcgatagcctggaggggcagtcttgcgactatgcgtccaagagctatgacgccgtcgtatttgatgtgctcaaggtgaccccggaagaatttgcatcacaaataacactgatggatattcccgtattcaaagctatccagcccgaggagctggcttcttgcggctggtccaagaaggaaaaacattccctcgcgcccaacgtggttgcctttactagaagattcaaccaggtcagtttttgggttgtcagagagatccttacggcgcaaaccttgaagatcagagctgaaattttatcacattttgtaaaaattgcaaagaagttactggagttgaataatctccacagtctgatgagcgtcgtttctgccctgcagtcagcaccaattttccgcctgaccaaaacctgggcgttgctcaaccgcaaagataagactacctttgaaaaattggactacctcatgtctaaggaagataattataagagaaccagagagtacatcagaagcttaaagatggtacctagtataccatacctgggaatctacctactagacctcatatatatcgatagtgcttatcccgcctcaggctctataatggagaacgagcagaggagcaaccagatgaacaacatcttacgcattatagctgatttgcaggtgtcatgttcttatgaccatcttactaccctgcctcatgtgcagaagtacctgaagagcgttcgctacatcgaggaactgcagaaatttgtggaagacgacaattacaagttgagtctgaggatcgaaccaggatcctcaagcccccggcttgtctcatctaaggaggatctggccgctatgtag

SEQ ID NO: 131641 - DNA, 642 bp, Artificial Sequence
  Description of Artificial Sequence: Synthetic coding sequence
atgtacaagaggaatggattaatggcctctgtcctggtgacgtcagcaacgccccaagggtcttcatcctccgatagcctcgaaggacagtcgtgcgattatgcttctaaatcttatgatgctgtcgtgttcgatgtactcaaagtgactccggaggaatttgcatcccagattactttgatggacatccctgtctttaaagcgattcaacctgaggagctggcatcttgcgggtggagcaagaaggaaaagcatagcttggccccaaacgtggtagccttcacacgtaggttcaatcaagtttctttctgggtggtacgggagatcttaacggcccaaacgctgaagatccgcgccgagatcttaagtcacttcgtgaagatcgctaagaaactactcgaactcaataatcttcatagtcttatgagtgtcgtttccgccctgcagagtgcccccatatttcgactaactaaaacctgggccctactaaataggaaggacaagaccacttttgaaaaattggactatctgatgtccaaagaagataactataaaagaactcgtgagtacattcgctccttaaagatggttcccagcataccctaccttgggaggagtttgaactggctgatcttcttttag

SEQ ID NO: 131642 - DNA, 327 bp, Artificial Sequence
  Description of Artificial Sequence: Synthetic coding sequence
atgtacaaaaggaacggcctgatggctagcgtgctcgtgactagcgctaccccacaagggagttctagcagcgattctctggagggccaatcatgtgattacgcatccaaaagctacgatgccgtggtttttgatgtcctgaaagtcacacctgaggagttcgcttcgcagattacacttatggatatccccgtctttaaggccatccaacctgaaaaggggtggcctgcacggatggaagacagtctgcagaagagcactgtttccagccgaccccacgacaccctgcagtttcgcaagactcttcctgtggggcctggcacctag

SEQ ID NO: 131643 - DNA, 1155 bp, Artificial Sequence
  Description of Artificial Sequence: Synthetic coding sequence
atgtataagcgtaatggattgatggccagtgttctggtgacttccgccacaccacaggggagttcgtccagtgactccctggaggggcagtcttgcgactacgcatctaagtcttatgacgcagtagtctttgacgtattgaaggtaactccagaggagttcgctagccagattacactgatggatatacctgtgttcaaagctattcagccagaggaactagcctcttgtgggtggtcgaagaaggagaagcattccctggcacccaacgtggtggcatttacgaggaggtttaatcaagtgtctttttgggtagtccgtgagatcctgactgcacagaccctgaaaattagagcggagattctgtcacactttgtcaaaatcgcaaagaaactccttgagctgaataatcttcattcgctcatgtccgttgttagtgccctccagtcagctcccatctttcggttgacaaagacatgggccttgttgaaccgcaaagacaaaaccaccttcgagaagctggactacctgatgtccaaagaagataactataaacggacaagagagtacatccgaagtttaaagatggtaccatccattccctatctaggaatctacctgctcgatctgatctacatagactctgcgtatcccgccagcgggtctatcatggagaatgagcaaaggtccaatcagatgaataatatactcagaattatcgccgatcttcaggtgtcttgtagttatgaccacctgacgactctgccccacgttcagaagtacctcaaaagtgtcaggtacatagaagagttgcaaaagtttgttgaggatgataattacaaactgtccctccgcatagagcccggaagttcttccccccgtttggtctcaagcaaggaggaccttgcagtgtctcacctgagctcgttgtcccatcagggtcaggcagaagaggcgcggctgaagccaacatctggacaacatcctgcctggatgtggccatcttccagcagggttcccgctgcccctcctgcttctgccgcccccagatctccgtggccacgtaacctgcggaacgaccagggtcagcctggcgctgtggccctgacctgcaacccttccactctgggctctagatccagaagaatcacatag

SEQ ID NO: 131644 - DNA, 1614 bp, Artificial Sequence
  Description of Artificial Sequence: Synthetic coding sequence
atgtataaacgcaacggattgatggcctctgtgctggtgacctcagccactcctcagggctcaagcagttctgattcgctcgaaggacaatcttgtgattatgctagcaaaagttatgacgccgtggtgttcgatgttcttaaagtaacgcctgaggagtttgcaagtcaaattactctgatggacattcccgtgttcaaggctattcaacccgaagaacttgccagttgcggttggagcaagaaagagaaacacagtctcgcaccaaatgtggtagctttcactcgcaggttcaatcaggtatcgttctgggtggtacgagaaatactcaccgcccaaactttgaaaattagagcagaaatcctatcccacttcgtgaagattgccaagaagctgcttgagctgaataaccttcactcgctgatgagcgttgtaagtgccctgcagagcgcccccatattcagactgaccaaaacctgggcgctccttaaccgcaaagataagactacgtttgagaaactggactatcttatgagtaaggaggacaattataagagaactagggagtacatcagatcccttaagatggtgccttccatcccctacctagggatttatttactggatttgatttacatcgactctgcatatccagcctctggcagcataatggaaaacgaacagagatcaaaccaaatgaacaatatcctgcggatcattgccgacctccaggtaagctgctcatatgaccacctcaccacgttgcctcacgtccagaaatacctgaagagtgtacgctacattgaagaacttcagaaattcgtggaggatgataattataaactgtccctgcgcatcgaaccagggagctcatctcctcggctggtctccagtaaagaggatctggccggcccatctgcaggctccggtagtgcacgcttttcccgccgtcccacctgccccgatactagcgttgccggatctctccccacgcctccggtaccccgtcatcgcaaatcccacagcttgggcaataatcgcgggcgcttatatgctactctcggccctaattggagagtaccagtccgcaattccccaaggaccaggagctgtgtttacagccctacaggaccctgtatctgttccttagggaatagcgctgcagtcccaaccatggagggtcccctgagaagaaagactctgctcaaggagggaagaaaacccgcactatcgtcctggacgcgctactgggtgatactcagcggaagcacactgctgtactacggagctaaaagtctgcgaggcacggatcgcaaacactacaagtctaccccgggcaagaaggtgagcattgtcggatggatggtacagcttcctgacgaccccgagcatccggatatattccagttgaacaacccggataaaggaaacgtctacaagttccaaacaggctcacgattccatgccatcctctggcataagcatttggacgatgcttgcaagtccaatcggccgcaggaggctggtgctgccccaggcccaacaggaaccgactcccacgaagtagaccacctggaggggggcgccggaaaggaggccggaccatgtgcttag

SEQ ID NO: 131645 - DNA, 462 bp, Artificial Sequence
  Description of Artificial Sequence: Synthetic coding sequence
tagaatagccctcgaactcgctcttgtgtgtacagccctacagggccctgcatatgttctcttggcaatagcgcagcggtgcccacgatggagggccccctgcggcgtaaaaccctgctgaaggaagggcggaaacccgccctaagtagctggacacggtattgggtaatcctgagcgggtctaccctgctctactatggggcaaaaagcctgcggggtaccgacaggaaacactacaaatccacccccggaaagaaagttagcattgtgggctggatggtgcagctccctgatgatcctgaacacccagatattttccagctgaacaatccggataaaggtaatgtatacaagtttcagacagggtctaggttccacgcgattctgtggcataaacatctggatgatgcctgcaagagcaacagaccacaagtgccagccaatctgatgtcgtttgagtag

SEQ ID NO: 131646 - DNA, 6252 bp, Artificial Sequence
  Description of Artificial Sequence: Synthetic coding sequence
atgttctccaaaaagccgcatggtgatgttaaaaagtccacgcagaaagtactggatacaaagaaggacgcgcttacccgactgaaacacctgcgtatagtgattgaaaatgctgagtccatagatctcaaacagttcttcgaccagcatttttcccatatttactacgttttcttcgagaactttgtcaccatagaggcctccttaaagcaaaaggggcataagtctcaacgggaagagctagacgcaattctgttcatattcgagaaaatcctccaattgctgccagaacgaatccaccaaagatggcaattccattctatcggcctgatcctcaagaagctgctgcatacaggcaacagtttgaagatccgtcgcgaaggagtgcgcctatttctgctgtggctccaagccttgcagaataattgttccaaagaacagctgtggatgttttcttgcttgatcccgggcttctccgcccctcagtctgagcacggccctcggaccctggacaaccttattaaccctcctctgaaccttcaggaaacgcaagtaacaatcgaagagattaccccgttagttccgcctcagagtggcgacaagggacaggaagacctgacaagctactttctcgaagccctactgaagtatattgtcatccaggtgaaaagcctcgaatggaaaaataaagaaaatcaggaacgagggttctcatttttattttcccacttcaagaaatattacctgccctacatattccccaatatctgcaaagagaactctctgtaccatccgatcctggacattccccagatgcgacccaagccccattatgtcgtaatcaagaaagacgctgagaccaatgaggcaatttactgcaccaaagaaccctttattaaggcacgagtgattgtcataagatggctggttagcttctggctcgagcctaagccacacaccgggccccacatccctggcatggagggtgaagtactgccaaagaacatacagcgagcggcagcctcacttgtcagtcgcgaggaaagcaagaatgataacgcagacaaaaccgaccgtaccacggagcctgaacaaagccattctaatacctcaaccctaacggagagggaaccttcttcatcaagcctctgtagcattgacgaggagcaccttacagatatcgagatcgtccgacgggttttctcttccaaaagaagcaacgtgaatttcgtgaccgaaatcttcagacaggcctttctgctcccaatctgcgaggccgcggcaatgcgcaaagtagtgaaagtttaccaggagtggatccaacaggaagaaaaacccctgttcatgcaggagcccgaggaaattgtgatcaccagttccgaccttccatgtatcgagaatgttacagatcacgatatctccatggaagaaggtgagaaaagagaggaggagaacggtacaaacactgccgatcacgtgcgaaatagcagttgggccaaaaacggatcctaccagggcgcactacacaatgcgagtgaggaggctacagagcagaacatcagggccggaactcaggcagttttgcaagtgttcatcattaatagctccaatatcttcctgttagagcccgccaacgaaattaagaacctgttggatgagcacaccgatatgtgtaaaaggattctgaacatttacaggtacatggtggttcaggtctcaatggataagaaaacctgggagcagatgctcctggtgctgctgagggtgaccgaatcagtcctcaaaatgccgtcccaggcctttctgcagtttcaagggaaaaagaacatgactctggcggggcggcttgctgggccattgtttcagacactaatcgtggcgtggatcaaagctaaccttaatgtgtacatatcaagagagctgtgggatgacttgctcagtgtgctgagttcacttacatactgggaagaattggccacagagtggagccttacaatggagactttgacgaaagtgctggcccgaaacctgtatagcctcgacttaagcgatctcccattggataaactgtcagaacagaaacaaaaaaagcacaagggcaaaggcgtgggccacgaatttcagaaggtgtccgtggacaaatcattctcacggggttggtctcgcgatcaacctggacaggcccccatgcgccagagaagcgccacaactaccggaagccctggaaccgagaaggccagatctatagtccgccagaaaacggtagcaatgcgaagccggagcataggagagtgcgccctgcccagcgcgtacatccgatccgctaagagcgctccagtgctgattcacaccagtaaaccgttcctgcccgatatcgtcctgactccattgtcagacgagctgtctgacatcgacgatgctcaaattctgccacggtcaaccagagtgagacacttcagccaaagcgaagaaaccggtaatgaagtgttcggggcactgaatgaggagcagcctttaccccggagcagtagtacgtccgacatcctggagccattcactgttgaacgagcaaaagtcaacaaggaggatatgagtcagaagctgccaccactgaattctgacatcgggggaagttcagctaacgtgcctgacctcatggatgagttcatcgcggagcgcctgcgtagtggaaacgcctccacaatgactcggcggggctcttctccaggatccttagagattccaaaggacctccccgacatcttaaacaagcagaaccagatgaggccaatcgatgacccgggcgtcccctctgagtggaccagtccagcctcagccggaagtagtgatctgatttcatccgactcacactcggactccttcagtgcttttcagtacgatggccgaaaattcgacaactttggctttggtacagacaccggagtgacctcctcagctgatgtcgacagcggttccggccatcaccagagcgcagaagagcaagaggtggccagtctaactaccctgcatatcgactctgaaacgtccagtctcaaccagcaggcatttagtgcagaagttgccactataaccgggtctgaaagcgcctctccggtgcatagtcctctcggctctcggagccaaacacccagtcccagtacactgaatattgatcacatggagcagaaagatctgcaattggacgagaaactgcatcattctgtcttgcagacacctgatgatttggagatttcagagttcccttctgagtgctgttctgtgatggccgggggcacattaacaggttggcacgctgacgtggccaccgtgatgtggaggcggatgctaggcatcctgggagacgtgaactcaataatggaccctgagattcatgctcaggtgtttgattatctttgcgaattgtggcagaatttagccaaaataagggacaacctgggaataagcactgataacttgacatcaccctcacctcctgtcctgataccacctttacgcattctgactccgtggctatttaaagctacaatgttgacagataagtataaacagggtaagctgcatgcctataaacttatatgtaataccatgaagcgccggcaggacgtttcccccaatagggacttcttgacacacttctataatattatgcactgcggtctcctgcacatcgatcaggacatagtcaacacaatcatcaagcactgctcacctcagttcttctctctcgggctgccaggagctactatgctgatcatggacttcatcgtggccgccgggagggtcgcatcttcagcctttcttaacgctcctagggtagaagcacaggtgctgctcgggtccctggtgtgcttccccaacttatactgcgagctgccctccctgcacccaaacatccctgacgtcgcggtgtcacaatttaccgatgtgaaggagctcataataaaaacggtcctttccagtgctcgggatgaaccaagcggtccggctcgttgcgttgccctatgttcccttggaatttggatctgtgaagagctagttcacgagtcccatcacccccagatcaaggaagcgcttaatgtgatttgtgtctccctaaaattcaccaataagaccgtcgcccatgtcgcgtgtaacatgctgcatatgcttgtgcattacgtgcctaggctccagatttaccagcctgattccccgctgaaaatcatccagattctgattgccaccattacgcacctccttccctccacggaggcttcctcatacgagatggacaagagacttgtagtgtcactgctgttgtgtttgttagactggattatggcactgcccctcaaaaccttgctgcagccttttcacgccactggggcagagtcagacaaaaccgagaaaagcgtgttaaactgcatctacaaagtgctgcacggatgtgtgtatggagcacagtgctttagcaatccccggtatttccccatgtccctgagtgaccttgcgagtgtggactacgatccattcatgcatcttgagtccttgaaagagccagaacccctgcactcgcccgatagtgagagatcaagcaagttacagccagttaccgaggtcaaaacgcagatgcaacatggcctaatttcaatagcagcccgtaccgtaatcacgcatctcgtgaaccatctaggacactacccaatgagtggtggacctgccatgttgacgagccaggtttgcgagaaccacgataatcattactctgagtctactgagctgagcccagagctgtttgagtctcccaacatacaattttttgtgcttaacaatactaccctggtaagctgtatacagatcaggagcgaagagaacatgcccggaggtggtttgtccgccgggcttgcaagtgctaactcgaacgtgcgcattatagtcagggacctgtccggtaagtactcatgggactccgctatcctgtacggacctccaccggttagtggacttagcgagcctacttcatttatgctgtctctgtctcatcaggagaagccagaagaaccccctaccagcaatgaatgcctggaggacatcacagtaaaagacggccttagcctgcaattcaagaggtttagggaaacggttcctacctgggacacaattagagatgaggaggatgtcctcgatgagctacttcagtatctgggtgttacatcccccgaatgtctccaacgcaccggaatctcgcttaacatccctgctccccagcccgtgtgtatcagtgagaaacaagagaatgatgttattaacgcaatcctaaaacagcacaccgaagagaaggaatttgtggaaaaacacttcaatgatctgaatatgaaggctgttgagcaggacgaaccaatcccacagaagccacagtccgcattttattactgtcgtctgctactttctattctgggcatgaacagctgggacaagcgtaggagttttcacttactcaaaaaaaacgaaaagctgttacgcgagctccgcaacctcgattccaggcagtgcagggagactcataaaatagccgttttctatgttgcagaaggtcaggaggataaacacagtatcctcactaacactggggggtcacaggcttacgaagatttcgttgccgggctcggttgggaggtgaacctgacaaaccattgtggattcatgggggggctgcagaagaacaagagcactgggctcaccaccccgtactttgcgacatccacagtcgaggttatttttcacgtatctacgcgcatgcccagcgacagcgatgactccctgacaaagaagctccggcatttaggtaacgacgaagtccacatcgtgtggtcagagcataccagagattataggagaggcattattccaacagagttcggagacgtgctgattgtaatctatcctatgaagaatcatatgttcagcatccaaatcatgaaaaaacctgaggtgcctttcttcggaccactgtttgacggggcgatcgtgaacggcaaggtcctccctatcatggtccgggctacagcgatcaacgccagcagagcactgaaatccttgatcccactgtatcagaacttctatgaagaaagagcccgatacttgcagaccatagtccaacaccatttggagcccacaacgtttgaggattttgctgctcaggtcttcagtcctgctccttaccatcacttaccttccgatgccgaccactag

SEQ ID NO: 131647 - DNA, 6252 bp, Artificial Sequence
  Description of Artificial Sequence: Synthetic coding sequence
atgttctcaaaaaagccacacggcgatgtgaaaaagtctactcagaaggtgttggacaccaaaaaagatgcccttacccgactgaagcaccttcggattgtgattgagaacgctgagtccatagacctcaagcagttttttgatcagcattttagtcacatctactacgtcttctttgaaaatttcgtgacaattgaagcttctctgaagcagaagggacataaaagtcaaagagaagagttagatgccatacttttcatctttgaaaagatcttgcagcttttgccagaacgtatccaccagagatggcagttccattctatcggcctgattctgaagaagcttttacataccgggaactcactcaagatccggagggagggtgtacggctgttccttctgtggctgcaggctttacagaacaactgctccaaggagcagctctggatgttttcttgcttgatccctgggttcagcgccccccagagtgaacacggacccagaacccttgacaacctgatcaatcctcccctgaatctgcaagagacgcaagtcaccattgaagagattacccctcttgttccacctcagtccggagacaagggacaggaggacctgactagctatttcctcgaagctctcctgaaatacattgtgattcaggtgaagtctctggagtggaagaacaaggagaatcaggagcgagggtttagcttcttgtttagccacttcaagaagtactatttgccttacatctttcccaatatctgcaaggagaattcactatatcacccgattcttgatatcccccagatgcgccctaaaccacactatgtggttattaagaaagacgccgaaaccaacgaagctatatattgtaccaaggaacctttcatcaaagcacgcgttatcgtcatcagatggcttgtgagtttttggctggagcccaaaccacacactggcccccacatccctggcatggagggcgaagttttacccaagaacatccaacgagccgctgcatcactggtttcacgagaggaatccaagaatgacaatgccgataagacagacagaacaacagagcccgaacagtcccacagtaacaccagtaccctcaccgagagggagcctagtagtagcagcctttgtagcattgacgaggagcacctgacagatatcgagatcgttagaagggtgtttagttcgaagcggtctaatgtcaacttcgtgacagaaatctttaggcaggctttcctcttgccgatttgtgaggccgctgctatgcggaaagtcgtcaaggtataccaagagtggattcagcaggaggaaaagccactgttcatgcaggaaccagaggagatcgtgattacttcatcagaccttccctgtattgagaatgtgacagatcacgatatctcaatggaagaaggagagaagcgcgaagaggaaaacggaaccaataccgccgatcatgtacggaatagttcatgggcgaaaaatggatcctatcaaggcgctctgcataacgctagcgaggaggctacagaacaaaatatccgcgcgggcacccaggctgtgctacaggtatttattattaacagttctaacattttcttgctcgagccagccaacgaaatcaagaacttactggatgaacacactgatatgtgcaagaggattctgaacatttaccggtacatggtggtacaagtctcgatggataagaaaacgtgggagcaaatgttacttgtgctgctgcgcgtaaccgaatctgttctgaaaatgccatcccaggcgtttctacagttccaggggaagaagaacatgaccttggcggggcgattagctggtccgctgttccagacattaatcgtggcttggattaaagcgaatcttaatgtgtacatttcacgggagttatgggacgatttgcttagtgtcttaagtagcctgacttactgggaagagctagccactgagtggtcactcaccatggaaaccttaaccaaagtgctggcaagaaatctgtattcccttgacctgtccgacttgccactcgataagctcagcgaacaaaaacagaagaaacataaaggcaaaggggtggggcatgagttccaaaaagtgagcgtagataagagtttctcgagggggtggtccagagatcagcccggtcaggcccctatgagacaacggtcggctaccaccaccggcagtcccggaaccgagaaagcacggagtatagtccggcaaaaaactgtagatattgatgacgcacaaatcttaccaaggtcaactcgggtaaggcatttctcgcagtctgaggaaacaggcaacgaggtcttcggcgcactcaacgaggagcagcctctgcctcggtcctcatccacttcagacatccttgagccattcacggtggagcgggcaaaggtcaacaaggaggatatgtcacagaagttgcctccactgaactcagacattggcggctcttcagctaacgtcccggatctcatggacgaattcattgccgagaggctgcgcagcggcaacgccagtacaatgacccgacgggggtccagtcctggcagcctcgaaatccccaaagacctgcccgatattcttaacaagcaaaaccagatgaggccaatcgacgacccaggcgtgccgtcggaatggacctcgcctgccagcgccggcagtagtgatctcatcagtagcgacagccacagcgacagcttttccgctttccagtacgatggcaggaagttcgataactttggtttcggcacagataccggtgtaacctcatctgccgacgtggacagcgggagcggccaccaccagtcggcggaggaacaggaagtagcaagtttaacaaccctccatatcgattccgagaccagctcactgaaccaacaggctttcagcgccgaggtggccacgattaccggctcagagagcgcctctccagtccattctcctttggggagcagatcacagacacctagcccttccaccttgaatattgaccacatggaacagaaggatctgcaacttgacgagaagttacaccactcagtgctgcagaccccagatgatttagagatctccgaattcccatccgagtgttgttctgtcatggcggggggcacgctgacaggttggcacgcagacgttgcgaccgttatgtggcggaggatgcttgggatcctgggcgatgttaacagtatcatggatccagaaattcacgcccaagttttcgattacctgtgcgaattgtggcagaatctcgcaaagatcagggacaatctggggattagtacggataacctgacatctccctccccccccgtcctcattcctcctcttagaattttaactccttggttgttcaaagccacaatgttgacggataaatataaacagggcaagctccacgcctataaactgatctgtaatactatgaagcgtcgccaggacgtaagtcccaatcgcgattttctgacccatttctacaatattatgcactgtggattattgcatatcgatcaggacattgtgaataccataatcaagcactgcagcccccagttcttctcacttggcctcccaggggctaccatgctgatcatggattttattgtggctgccgggcgcgtggcctccagcgcattcctgaacgccccaagagtggaggcacaggtgctcttaggatccctcgtctgtttcccgaacctgtattgtgagttaccaagtctccaccctaatattccagacgtggcggtgagccaatttacagatgtgaaggaacttatcatcaaaacggtactaagctccgcgagagatgagccatctggcccagcacggtgtgtggccctttgctccctcgggatttggatctgcgaggagttagtccatgagtcccaccacccccagatcaaagaagccctgaatgttatatgcgtcagcctcaagttcacaaacaaaacagtggcacatgtggcctgcaacatgcttcacatgctcgtccactacgtccctcggctgcaaatctatcaacctgattcacctctgaagatcatacagatcctgatcgccacaattacccatcttttgccgagcacagaggcctcttcctacgagatggataaacgactggttgtctctctgttgctgtgcctgctagattggattatggcccttcctctgaagacactattgcagcctttccatgctactggcgccgagtctgacaagaccgaaaagagcgtgctgaactgcatttacaaggtactgcatggatgcgtgtacggcgcccaatgcttttccaacccacgttatttcccaatgtctctctcagacttggcttctgttgactatgatccgttcatgcatctggaaagcctgaaggagcctgagccactccactccccagactccgaacgatcctcgaaactgcagccagtgactgaggttaagactcagatgcagcacggacttatctcaatcgccgctcgaacagttattacgcatctcgtcaaccatctgggccattatcccatgtccggcggcccggccatgctaacttcacaggtgtgtgaaaatcatgacaaccactactcggaaagcactgaattatcgcctgagctgttcgagtcaccaaacatccagttcttcgttcttaacaacacaacactggtgtcatgtattcagatcaggtctgaggagaacatgcctggaggcgggctgtccgctgggctggcgtcagctaatagcaacgtgcgcattatcgttagggatttgtccgggaagtactcctgggactcggctattttgtatggcccaccaccggtaagcggtctgagtgaacctacctcttttatgctgtctctgtcacaccaagaaaagcccgaggaaccccccaccagtaatgaatgccttgaggatattaccgtgaaggacggtctaagcttgcaattcaaaaggttccgggagacagtaccaacctgggacactatccgcgacgaggaggacgtgttggatgaactactgcagtacctcggtgtaacgtcaccagaatgcttacaacggacagggatctccctgaacatccctgcccctcaaccggtctgtatttccgaaaagcaggagaacgatgttattaatgcgatcctgaagcagcacacagaggagaaagaattcgttgagaagcactttaatgaccttaacatgaaggccgttgaacaagatgagcctataccacaaaagccccagtccgccttctattattgtagactcctactgtcaattcttgggatgaactcctgggacaagagacgatcctttcacctgctgaaaaaaaatgaaaagctgctacgggaactgaggaacctggattcaaggcagtgtcgggagacccataagattgcagtcttctatgtcgccgagggacaagaagacaagcattccatcctcacgaacactgggggatcccaggcatacgaagacttcgtggcaggcttaggctgggaggttaatctgacaaaccattgtggattcatggggggactgcagaagaataaatctacaggactgaccaccccatattttgcgaccagcacagtggaggtcatttttcacgtgtcaaccagaatgccttccgatagtgatgacagcctcacaaaaaaactccggcatctaggcaatgatgaagtgcatatcgtctggagcgagcacacaagggactataggcggggcatcattcctaccgaattcggtgatgtactgattgtaatttatccaatgaaaaaccacatgttttctattcagattatgaaaaaacccgaggtccctttcttcgggccactctttgacggagcaatagtgaacggtaaagtgttgcccatcatggtgagggctacagcgataaatgcttccagagccctcaaaagtctcattccactgtaccagaacttttacgaagaacgcgcgcgctatcttcagacaatcgtacagcaccacctggagcccacaactttcgaagatttcgccgcccaggtttttagtccagcaccttaccaccatctgcccagcgatgcagggtcataccccgagatacttccctccgaaacccccacagccacccaagtggatggggcagatttagcaagcccgatgagtcctcgtacttctaagtcacgcatgtccatgaaacttcgacgcagtagtggctcagctaacaagagttag

SEQ ID NO: 131648 - DNA, 6222 bp, Artificial Sequence
  Description of Artificial Sequence: Synthetic coding sequence
atgttttccaagaaaccccacggcgatgtaaagaagtctacccagaaggtgttggatacgaagaaggacgcactcacgcggcttaaacaccttcgcatagttatcgagaatgcggaatctattgatttgaaacaattcttcgatcagcacttttcccatatttactatgtgttctttgagaatttcgtgacaattgaggcctccctgaagcagaagggtcacaagtcacagagggaagaacttgacgccatcctgtttatctttgaaaagatcctgcagctcctgcctgagcggatacaccaacgatggcagtttcacagtattggcttgattctcaagaagctgctgcatactggaaacagcctgaaaatccggcgggaaggagtgcggctctttctgctttggttacaggctctgcagaacaattgtagtaaagaacagttatggatgttttcctgtctcatcccaggtttcagtgccccccagagcgaacacggcccgaggaccttggacaacctgatcaatccccctttaaacctgcaggagacgcaagtgaccattgaagagattacccccctcgtgcctccacagtctggcgacaagggtcaggaagaccttacctcttattttctagaagcactgttaaaatacattgtcatacaggtgaagtccctggagtggaaaaacaaggaaaatcaggaaagagggttctcttttctcttctctcactttaagaagtactatctaccatacatcttccctaatatttgtaaagaaaacagcctgtaccaccctatactcgatatcccccagatgcgcccaaagcctcactatgtggtcatcaagaaggatgccgagaccaacgaggccatatactgcacaaaggaaccttttatcaaggccagagtgattgtgatcagatggttggtttcattctggcttgaaccaaagcctcacacaggcccgcacatccccggaatggaaggtgaggtcctccccaagaacattcagagggctgcagcctccctggttagcagggaagaaagcaagaacgacaatgccgacaaaacggaccggactacagagccagagcagtcacactctaataccagcaccctgacagagagagagccatcctcttccagtctgtgcagtattgatgaggaacatctgaccgacatcgagatcgtgagacgtgtttttagttctaagagatctaatgtcaacttcgttactgaaatctttcgtcaagcattcctcctccctatttgtgaagccgccgctatgcggaaagtcgttaaagtgtaccaagaatggattcagcaggaagaaaagccgctatttatgcaagagcccgaagagatagtgattacgagctccgatttaccatgcatcgagaacgtcacagaccacgacatcagtatggaggaaggcgagaaaagagaggaggagaatgggaccaatacagcggaccacgtgagaaacagcagctgggctaagaacggcagctatcagggggctcttcataacgcgtcagaagaagcaaccgagcaaaacatccgagccgggactcaggcagtgttacaggtttttattattaactcatcgaatatctttctgcttgagcccgccaatgaaattaaaaatctgctggacgagcacactgacatgtgcaagcggattttgaacatttaccgctacatggtagtgcaggtgagcatggacaaaaaaacctgggagcaaatgctgttagtcctgctgcgcgtgacggaatccgtgctgaagatgccctcccaggctttcctgcagtttcaaggcaagaaaaacatgacactggccgggagactcgctggaccactgttccagaccttgatcgtcgcttggattaaggctaatctcaacgtctatatttctcgggagctctgggatgacctgttatcagtcctgtcctccttaacatattgggaagagctggcgaccgaatggagccttacgatggagacactgactaaagtgctggcacgcaatctgtactctctagacctgtcagatctgcccctcgacaagttatccgagcagaagcagaaaaagcacaaaggaaagggagttggccacgagttccagaaggtgagcgtggacaaatctttctcccggggctggtctcgtgatcagccaggccaagcacctatgcgccagcgaagcgctacaacaacaggcagccccggaacagaaaaagcacgatccattgtccgacagaagactgtggacattgatgacgcccagatactcccccggtctactcgcgttaggcactttagccaatctgaagagaccggtaacgaggtgtttggagcgctcaacgaggagcaacctctgcccaggtcttcgtccacgtctgacatcctggaaccctttaccgtggagcgcgccaaggtcaataaggaagatatgagccagaagctgccccccctgaacagcgacatagggggatcttctgctaacgttccagatctaatggatgagttcatcgccgagcggctgagaagtggcaacgccagtactatgacccggaggggctctagcccaggatccctggagattcccaaggacctccccgacatcttaaataaacaaaaccagatgaggcctattgacgacccaggcgtgcccagcgagtggacgtcgccagcgtctgctggatcttcagacttaatttccagcgacagccactctgattccttctctgcattccagtacgacggacgaaaatttgataacttcggctttgggacagacacaggcgtcaccagctctgcagacgttgactctggctccggccatcaccagtccgctgaggagcaagaggtggccagccttactacccttcacattgatagtgaaactagttccctgaatcaacaagccttctcagccgaagtggctactattacagggtctgagagtgcaagccccgtgcactcgcccctcggctccagatcccagactccatctcccagtacacttaatatcgaccatatggagcagaaagacctgcagctggacgagaaattgcaccattctgtactgcaaaccccagacgacctggagatatcagaatttccttctgagtgttgcagcgtgatggcagggggaaccctcacaggctggcatgcagatgtggcaaccgtgatgtggcggaggatgcttggcattttaggagatgtgaatagcataatggaccccgaaatccatgcccaggtcttcgattacttatgtgaactttggcagaacctggccaagatccgggataaccttgggatttcgactgataaccttaccagtcccagtccccccgtactcataccgccactaagaattctgaccccttggttgtttaaggcaactatgctcaccgacaaatataaacaaggcaaacttcacgcatacaaactgatctgcaacaccatgaagcgccgacaagacgtatcacctaacagggactttctcacccacttttacaacattatgcactgtgggttgctgcacatagaccaggacattgtaaacaccattatcaagcattgctccccccagttcttttccctgggtttgcctggcgccaccatgttgatcatggatttcatcgttgcggccggccgcgtggcctcatcagcgtttctcaacgcaccccgcgtggaagcccaagtgctgttaggctctctggtatgcttcccaaatctgtactgcgagttgccttccttacaccccaacattccagatgttgcagtgtctcagtttactgatgtgaaagaactcatcattaaaacagttctgagcagtgccagagatgaaccatcgggccccgctcggtgcgtggcactgtgttccctgggtatttggatctgcgaagaactggtccacgagtcgcaccacccacaaatcaaggaagctctgaacgtgatttgcgtgtccttgaagtttactaataaaactgtggctcatgtggcctgcaacatgctgcatatgttggtccattatgtgcctagactccagatttaccagcccgactcacccttgaagattatccagattttgattgcaacaattacccatctgctgccaagcaccgaagcctcctcctacgagatggataaacggctggttgtctctctgctgctgtgcctgctggattggatcatggccctccctctgaaaacactcctccaaccctttcacgcgacaggcgctgaatcagacaagacagagaagtcagtcctcaactgcatctacaaggtactccatggctgcgtgtacggagcacagtgttttagcaacccaagatacttcccgatgtcattgtccgaccttgcttcggtagattacgaccccttcatgcaccttgaatccctcaaggagcctgagcccctgcatagtcctgacagcgagcggtctagtaaactccagcctgtgactgaagtcaagacccaaatgcagcatgggttgatatctatagcggctcggaccgttatcacccatcttgtgaaccacttagggcattacccaatgagcggcggccccgccatgttgacctcccaggtatgtgaaaaccatgacaaccattatagcgagtcaacagagctatctcctgagttgttcgagtcacccaacatccagttcttcgtgctgaataacacaactcttgtgtcctgcattcagatccggagtgaggaaaatatgccgggtgggggtctgagcgccggcctagcttccgcaaattctaatgtgagaatcatagttcgagacctgtcgggcaagtattcttgggactccgcaatcctttatggaccaccacccgtctcggggctaagcgagcctacctcattcatgctttcccttagccaccaagaaaagccggaagagccccctacatcaaacgaatgtctcgaagacattaccgtgaaagatggacttagtctccaatttaagaggttccgggagacggtgccaacatgggatactattagagatgaggaggatgtgctcgatgaactgcttcaatatttgggcgtgacatcacccgagtgcctccagcgtactgggatctctctgaacattcctgcccctcagccagtctgcattagtgagaagcaggagaatgacgtgataaacgccatcctgaagcagcacactgaggagaaggagtttgtggaaaagcattttaacgatctgaacatgaaggcagttgagcaggatgagcccatcccccagaagcctcagtcagccttttactattgtcgtttactgctctcaatcctgggaatgaactcgtgggacaagagaaggtcgttccatctgctcaagaagaatgaaaagctgctgagggagctccgcaacctggactccaggcaatgccgggaaactcacaaaatcgcggtgttctacgtcgctgaaggccaggaggataagcattccatactcacgaataccggtggctctcaggcgtacgaggactttgtcgctggtttgggttgggaagtcaatctgaccaaccattgcggcttcatgggaggccttcagaagaataagtctacaggtttgactacaccatactttgcaacatcaaccgtggaggtgatattccatgtttctacacgaatgccctctgattctgatgacagcctgacgaagaaactgagacacctgggcaacgatgaagtgcatatcgtctggagtgagcatacacgcgattataggcgagggatcatcccaaccgagttcggagacgtactgattgtgatatatccaatgaagaatcatatgttctccattcaaattatgaagaagcctgaagtcccattctttgggccgcttttcgatggggctatcgttaatggcaaggtgctgcctattatggtgcgggccactgcgatcaacgccagccgggcactgaagagcttgattccactctaccagaacttttatgaagagagagcccgctacctccaaaccatcgttcagcaccacctcgagcccactacctttgaagatttcgcagctcaggtgttttctcctgcgccctaccaccatcttccgagcgacgctgaagagaggaatgcggtgattgttctgttcctgcctaaacccccactggagaatataggccatcttaaggcaccaacacagcgcttctaccccgttaaactgcctcagcagcgccgatag

SEQ ID NO: 131649 - DNA, 6150 bp, Artificial Sequence
  Description of Artificial Sequence: Synthetic coding sequence
atgttttcgaagaagccccacggggatgtgaagaaaagcactcagaaggtgctggacaccaagaaggatgccctcacccggctaaagcacctgcgcatcgtgatcgaaaatgcggaaagtattgaccttaagcagttctttgaccaacacttctcgcatatttactatgtgttcttcgaaaacttcgtcacaatcgaggcgagcctgaaacagaagggccacaagtcacagagggaagaattagatgctatccttttcatctttgaaaaaatattgcagctgctgcctgagcgaattcatcagcggtggcaatttcactccattggactgattctgaagaaactcctgcacaccgggaatagcctgaagatcagaagagagggcgtaagactgtttttactctggctgcaggcccttcaaaataactgctccaaagagcagctttggatgtttagttgccttatccccggtttttccgcgccacaatcagagcatggcccgaggaccctggataatctgatcaatccaccactgaaccttcaggagacacaggtaacaatcgaagagatcacacctctcgttcctccacagtcaggggataagggccaagaggatctaacgagctattttcttgaggccctcctgaagtatatcgttatacaggtcaagagtctcgaatggaaaaataaagaaaatcaagagaggggtttttctttcctgttctcccactttaagaagtactacctgccttacatatttcctaacatctgtaaagagaactctttatatcaccctatcctggacataccacagatgcgacctaaaccacactacgtggtaatcaaaaaggacgcagagacaaacgaagctatctactgtaccaaggagcctttcattaaggcccgggtcattgtaatccggtggctcgtgtctttctggctggagcccaagccccacactggacctcatataccagggatggaaggtgaggttttaccaaagaatatccagcgcgccgcagcctcccttgttagcagagaagaatcaaagaacgacaatgctgataagaccgaccgtactaccgagccagaacagagtcacagcaataccagcacattgacagaacgcgaaccctcttcttcatccttgtgtagtatcgatgaggaacatctcacagacattgagatcgtacggcgggtgttttccagcaaaaggagcaatgtgaactttgtgaccgagatcttccggcaggcatttctgctccccatctgtgaggctgccgcaatgagaaaggttgtgaaggtctaccaagagtggatacagcaggaggagaagccgctcttcatgcaggagccagaggagatcgttatcacatcttcagatttgccttgcattgaaaatgtgactgaccatgacatctccatggaagaaggagaaaagagagaggaggagaacgggacaaacacggccgatcatgtgcgcaactcgagctgggcaaaaaatggctcgtaccagggcgcattgcacaatgctagtgaggaggcaactgaacaaaatatccgggccggtacccaagctgtcctccaggtgttcatcattaattcttctaacatttttctactagagcccgctaacgagatcaaaaatctgctggacgagcatactgatatgtgcaaacgaatccttaacatctaccggtacatggtggtgcaggtgtcaatggacaagaagacatgggagcagatgctcctggtactgctaagggtcacggagtcagtgctgaagatgccaagccaggcttttctgcagttccagggtaagaagaatatgaccctggctgggcggttggctggtcctttgttccagactctcattgtagcgtggatcaaagccaatcttaatgtctacataagccgcgagctgtgggatgacttgctttccgtgctgagctcactaacgtactgggaagaactggctacggagtggtccctgacaatggagactctgaccaaagtcctggcgcggaacttgtattccctggatctcagtgatctgcccctggataaattaagcgaacaaaaacaaaagaagcacaagggaaagggtgtgggacacgagtttcagaaggttagtgtggataagagcttcagcaggggttggtcaagggaccagccaggacaggctcctatgaggcagcggagcgctacaacaacgggtagcccgggtacagagaaagcacgatctatagttcgccaaaagaccgtggatattgacgatgcacagattctgccccggtccacccgagtgcggcacttctctcagtcagaagagactggcaacgaggtgttcggcgctctaaacgaagagcagcccctaccacggtctagtagcacttccgatattctggagcctttcacggtcgaacgcgccaaagaggccgaacagaatgccactagaggctctacagaggggagcgttcagagctgtaacggcctattttggaaggaaagctgtagcgacattggcggctcttccgcaaacgtgccagacctgatggatgagtttattgccgaaagactgagatctgggaatgccagcaccatgacaagacgaggaagttcacccggatccctggagataccgaaggacctgcctgatatcctaaataaacagaaccagatgcgccctattgatgaccctggggtgcctagtgaatggactagtccggcttccgctggctccagcgaccttatttcttccgatagccatagtgactctttcagcgcctttcaatatgacgggcgaaagttcgacaatttcggttttgggactgatactggcgtgacctcctcagcagatgtggatagcgggagtggccatcatcagtcagccgaggagcaggaagtcgcctcacttactaccctccacatagatagtgagacttcatcactgaaccaacaagcattttctgccgaggtggcaactatcactgggtctgagagtgcttcacccgttcactcacccctgggcagcagatcacagaccccttctccctccaccctgaacattgatcacatggaacagaaggatctgcagctggatgaaaaacttcatcacagcgtacttcagacccctgatgacctggaaatctctgaattcccatccgagtgctgctcagtgatggcaggcggtactctgacgggttggcatgcagacgttgccactgtgatgtggcggcgcatgttgggcatcctcggtgatgtcaatagcatcatggatcctgaaattcatgcccaggtctttgattatctctgcgaactgtggcagaacctggcaaagattcgggataatctaggcatcagcaccgataatcttacttcaccctcacctcctgtcttgatccccccactgagaatcctcaccccttggttatttaaagcgaccatgctcactgacaaatacaagcagggaaagctacatgcttacaagttgatatgtaataccatgaaaagacgacaagatgtgagccctaatagggattttttaacccatttctacaatattatgcactgtgggctgcttcacatcgaccaggacatagtgaacacaatcattaagcattgctctccccagttcttctccctgggtctgccaggcgccactatgttgatcatggactttatagtcgctgcaggccgtgttgccagtagtgctttcttgaacgcaccaagggtagaagcccaggtgctgttaggatctctcgtatgctttcctaacctgtactgcgagctgccctccctgcatcctaatatcccggacgtcgcggtgagtcaatttaccgacgtgaaggagctcataattaagaccgtgctgagttcagcccgcgacgagccctcaggacccgcccggtgcgtggccctctgttcactcggcatttggatttgcgaggagctagtgcacgagtctcaccacccacagattaaagaagccctgaatgttatctgtgtttctctgaagtttacaaataagacagtggcgcatgtcgcctgtaatatgcttcacatgctcgtgcactacgttccaagactacagatctatcaacccgattcacccttgaagattatccagattctgatcgctactattactcatctcctgccctcgacggaagctagcagctatgaaatggataaacggttggtggtgtctctgctcttgtgtctccttgattggataatggccctgccactaaaaaccttactccagccctttcatgccactggagccgagtctgacaaaacggaaaagtcagtattgaactgtatctataaggttcttcatggttgcgtctacggcgcccagtgcttcagcaatccccgctacttccctatgtccttaagtgacctggcatctgtcgattatgacccctttatgcacctggaatcccttaaggagccagagccccttcattcccccgacagcgaacggtcctccaaactacagcctgttacagaagtcaagacccaaatgcaacacgggctgatatccatcgccgcaaggactgtcattacccatctagttaaccatttgggtcattatcctatgagcggaggccctgccatgctgaccagccaagtgtgtgaaaaccatgataaccactattccgagagtaccgagttgtcccctgaactgttcgaatctcccaacatccagttctttgtcttgaacaacactacactggtgagttgcattcagatcagaagtgaggagaatatgccaggtggcggcctgagcgccggccttgcctctgcgaattcaaacgttcgaatcattgtgcgtgacttgtcagggaagtactcctgggatagcgcaattctctatggtccaccccccgtgagcggactgagcgagccgacgtcattcatgctaagcctttctcaccaggagaagcctgaggaaccaccaacgtcaaacgagtgcttagaagacataaccgttaaggatggactgtcgttgcagtttaagaggttcagggagactgttccaacctgggataccatacgcgatgaggaagatgttctggatgaacttcttcaatatctaggagtgacaagtccagaatgtttacagagaactggaatatcactcaatattcctgctccacagcccgtatgcatctcagagaagcaggagaatgatgtgatcaatgccatcttgaagcagcacacggaggagaaggaattcgtggaaaagcacttcaatgatttgaatatgaaggcggttgagcaggacgaaccgattccgcaaaagccccaatccgcattctactattgtaggttgttgctcagcatccttgggatgaatagctgggacaagagaagaagcttccacctacttaaaaaaaacgaaaaactgctgagagagctgagaaacctggactcaagacagtgtcgggaaacccacaagattgccgtattttacgtggctgaaggccaggaggataagcactcgattctcaccaacacgggcggtagccaggcctacgaggatttcgtcgcagggctgggttgggaggtaaatttgacgaaccactgtggcttcatgggcggccttcagaaaaacaaatcaactgggctgaccaccccctatttcgccacttcaaccgtggaggtgattttccacgtcagcacccgaatgccttccgacagcgatgactctcttacaaagaagctacgccacctgggtaatgacgaggtacatattgtttggagcgagcatacgagggattaccgccggggcatcatccccaccgagttcggtgatgtcctcatcgtgatctatccaatgaagaaccatatgtttagtatccagatcatgaagaaacccgaggtgcctttcttcggtcccctcttcgacggggccatagtgaatgggaaagtgctgcctattatggtgcgagctactgcgatcaacgcttcccgggccctgaagtctttgattcccctctaccaaaatttttacgaggaacgtgcccggtacctccagacgatcgtacaacatcacctcgagccaacaacatttgaagattttgccgcccaggtattctcccccgctccttaccaccaccttccgagcgacgctgaccactag

SEQ ID NO: 131650 - DNA, 6111 bp, Artificial Sequence
  Description of Artificial Sequence: Synthetic coding sequence
atgttcagcaaaaagccccatggcgacgttaagaagagtacccagaaggtgctggatacaaagaaggatgctctgactaggctgaaacatctgcggatcgtgattgagaatgcagagagcattgatttaaaacaattcttcgaccagcacttctcacacatctactacgtattctttgaaaactttgtcaccatagaggcaagcctcaagcaaaaagggcacaaatctcaaagagaggaacttgatgccatcctcttcatattcgaaaagatacttcaactgctacctgagcggatccatcagcgatggcagtttcacagtataggacttatcctgaaaaaactcctgcacacaggcaattctcttaagatccggcgggagggggttaggttattccttctatggctgcaagccctacagaacaattgctctaaagagcagctctggatgttcagttgcctcatcccaggcttttcagctccgcaatctgaacacggaccaaggacactcgataatctgataaacccacctcttaatctgcaggaaacgcaggtgacaattgaggagatcactccactggtgccccctcagagcggcgataaagggcaggaggacctgacctcatactttctggaggccctgctgaaatacatcgtcattcaggtgaagtctctggagtggaaaaacaaggaaaatcaagagagggggttctccttcctttttagtcatttcaagaagtactacctcccctacatcttcccgaacatctgtaaagagaactctctgtaccatcccatcctggatatcccgcagatgagaccgaaaccacattatgtggttatcaagaaggatgctgaaacaaacgaggcgatttactgtacaaaggagccctttattaaggcgagagtgatcgtgatcaggtggctggtctctttctggttagagcctaaacctcacacgggcccccatatccccggcatggagggggaagttctgcctaaaaacatccaacgcgccgctgcctcattggtctcgcgcgaggaatctaagaacgacaacgccgataagactgatcgaactaccgaacccgagcaatcacacagcaatacctccaccctgacggaacgcgaaccgagtagcagtagcctctgcagtatcgacgaggaacacctcactgatatcgagatagtgaggagagtgttctctagtaagcgcagcaacgtcaacttcgtgaccgagatcttccgacaggcattcctgttgcctatctgcgaagccgccgccatgcgcaaggttgtcaaggtgtaccaagagtggatccagcaggaagaaaaacctctgttcatgcaggaacccgaggagattgtgattacaagcagcgatctgccctgtattgagaacgtcacggaccatgacatcagtatggaagaaggcgagaaacgtgaagaggagaatggtactaataccgctgatcatgtgcgtaactctagctgggctaagaacggtagctatcaaggcgctttgcacaacgcctcggaggaggccacagaacagaatattcgggcaggaactcaagctgttctccaggtcttcattatcaatagtagcaatatctttctccttgagcccgctaacgagatcaagaacctgcttgatgaacatacagatatgtgtaaacgcatccttaacatttataggtatatggtggttcaggtgagcatggacaagaaaacttgggagcaaatgctcctcgtgctgctaagagtgacagagagtgtcctcaagatgcctagccaggcctttctgcagttccagggcaaaaaaaacatgacgctggccggtcgactcgcaggaccacttttccagacactgatcgtcgcctggattaaggccaacttgaacgtgtatatcagtcgagaactctgggatgacctcctttctgttctcagctctctcacctattgggaagagctagcaacagagtggtccctcacgatggaaaccctgactaaggtcctggcgcgcaacctgtatagccttgacctgtcagatctgccactggataaattgagtgagcagaagcagaagaaacataaaggaaagggggtgggccacgaattccagaaggtgtccgtggacaagagttttagtaggggatggtctagggaccagcctggccaggctccaatgagacagcgatccgccactaccaccggctcaccaggtacagagaaagcaagatcaattgtgcgccaaaaaacagtcgacattgatgatgcccaaatcctgccacgaagcaccagagtgagacattttagtcagtccgaagaaactgggaatgaagtgtttggagctttaaatgaggaacagcccctgccaaggagctccagcacaagcgatattctggagccattcacggtggaacgggcaaaggtgaacaaagaggatatgagtcagaaattgccccctctgaacagtgacattggaggcagttctgcgaatgtgcctgacctcatggatgagtttatcgccgagcgcctcagaagcggcaatgcatccacgatgactcgtagaggttcaagcccaggctccctggagatacccaaagatcttccagacatcttgaataaacagaaccagatgcggccaatcgatgatccaggggtgccttccgagtggacatccccggcatcagccgggtcatccgacctcatctcgagcgattcacactctgattccttctccgcgtttcaatacgacggcagaaagttcgacaatttcggtttcggaaccgatactggcgtgaccagttcagctgacgttgactctgggtccggtcatcatcagtctgccgaagagcaagaagtggccagccttacaacactgcacatcgacagcgagaccagttccctcaatcagcaggcgttctctgccgaagtagctacaatcaccggatccgaatccgcctcccccgttcactcacccttaggtagtcgatcccaaaccccatctccatccactctcaatatcgaccacatggagcagaaggaccttcagctcgacgagaagctgcaccatagcgtattgcaaacacctgatgatctggaaataagcgagttcccatctgagtgttgtagtgtgatggccgggggaactctcacaggatggcatgccgatgtcgcaaccgtaatgtggcgaagaatgctgggtattctgggggatgtaaacagcattatggatccagaaatccacgcccaagtcttcgactacctctgcgaactgtggcagaacctcgcgaagatccgcgacaatctcgggatctctactgacaatctcacttcaccctcacccccggtattaataccccctctgcgtattcttaccccttggctgtttaaagcgacaatgctcaccgataagtataagcaggggaagctccatgcatacaaactcatctgcaatacaatgaagcggaggcaagatgttagccccaatagggacttcctcacgcacttctataatatcatgcactgcgggttgctgcatatcgatcaagacatagtcaacaccataatcaaacattgttcaccacaattcttctccctcggcttgccaggagctactatgctgatcatggatttcatcgtcgcagctggacgcgtggcatcctcagcatttttgaatgctccgagagtcgaggctcaggtcctgctagggagtctggtttgcttccctaatctctattgcgagctgccctccctgcaccccaacatcccagacgtcgccgtttcccagtttaccgacgtgaaggaactcattatcaagaccgtgctgtcaagtgctagagacgaacccagcggaccggctagatgtgtggccctgtgttcactgggaatttggatctgtgaagagctcgtacacgaatcccatcacccgcaaatcaaagaggctctcaatgtcatctgcgtttcactcaaattcacaaacaaaacagttgcccatgttgcttgtaatatgctccacatgcttgttcactacgttcccaggctgcagatctaccagcccgacagtcccctcaagattatccagattctcatcgccacgatcacccatctcttaccatcgactgaggcgtccagttacgaaatggacaaaaggttagttgtttccctactactctgccttctcgactggatcatggccttaccactcaagacgctacttcagccattccatgcaactggagcagaaagcgataaaacagagaagtcggtgctcaattgtatctataaggtgctacacggttgtgtctacggagcccagtgctttagcaaccccaggtactttcctatgtctctttcggacctggcatctgtggattatgatcccttcatgcacctcgaatcccttaaggagccagagcccctgcacagtcccgattcggaacgatcatcgaaactccaaccggttactgaggtgaaaacgcagatgcagcatggcctgataagcatcgccgcccggacagtgatcactcacttggtcaaccatctcggccactatccaatgagtggagggcccgctatgctgacaagccaggtctgcgaaaaccacgataaccattactccgaatcaaccgaattgtcacccgagcttttcgagtcccccaacatacagttctttgtcctaaacaacacaacactggtctcttgtatccagatccgttccgaggagaacatgcccggcggtggcctatctgccggcctcgcttcagcaaatagcaatgtgcgcatcattgtgcgggacctctccggaaagtactcctgggactccgcaatcctgtacggtcctccgccagtgtccgggcttagtgagcccactagttttatgctgagtctctcccaccaggagaaaccggaagagcctccgacatctaacgaatgcctggaggacattaccgtgaaggacggcttgagcctgcagttcaagcggtttcgcgagaccgtcccaacctgggataccatccgcgacgaggaggacgttcttgatgaactgttgcaatacttaggggtgacctcacctgaatgtctgcaaagaaccggaatttccttaaacattcccgctccacagccagtgtgtatttccgagaaacaggagaatgatgttattaacgccatattaaagcagcatactgaagagaaagaatttgtcgagaaacacttcaatgacctcaacatgaaggccgtggaacaggacgagcccattccccagaagccccagtcagccttctattattgccgactcctgctgagtatcctggggatgaacagctgggataagaggcggagcttccacctacttaagaagaacgaaaagctgctgcgggaactaaggaacctcgacagccggcaatgtcgagagacccataaaattgcagtattttatgtcgccgagggccaggaggataagcacagcatcctcactaatacagggggatcgcaggcctacgaggatttcgtggccggtctggggtgggaagtgaacctaactaaccactgcggcttcatgggcggactacagaagaacaaaagcacaggcctaaccaccccttatttcgctaccagcaccgtcgaggtgatattccatgtgagcacgaggatgccctcagattctgacgattccctgaccaaaaagctgcgccatctgggcaatgacgaggtacacattgtgtggagtgagcatacaagggattatcgccgcggcatcataccgactgaatttggggacgtgttgatcgtcatttatccaatgaagaaccatatgttcagtatacaaatcatgaagaaacccgaagtacccttctttgggccgttgtttgacggggccattgtcaacgggaaggtccttcctatcatggtgagagccacagcgattaatgctagccgggccctcaagagcctcatccctctgtaccagaacttttatgaggaaagggcccgctacttacagacaatcgtgcagcaccacctggaaccaaccaccttcgaagatttcgcagcccaggtgttttccccggccccatatcaccatctgccgtcagatgctgatcactag

SEQ ID NO: 131651 - DNA, 6252 bp, Artificial Sequence
  Description of Artificial Sequence: Synthetic coding sequence
atgttttccaagaaacctcatggcgacgttaagaagtccacccagaaagtcctggacaccaaaaaagatgccctgacacgcctgaagcacctgagaatcgtgattgagaatgctgagagcatagacctgaaacagtttttcgaccagcacttctctcatatttattatgtgtttttcgaaaactttgtcaccattgaggcaagcctcaagcagaaggggcataaaagtcagcgggaggaacttgatgcgatactgtttatctttgaaaagatcctgcagcttctgcccgagagaatccatcagagatggcagtttcattccatcggattgattctcaagaaactgcttcacaccggaaactccctgaagattaggagggagggcgtccggctttttcttctgtggctccaagccctgcagaataactgttctaaagaacagctgtggatgttctcctgcttgatccctggtttctctgcgccacagagtgaacacgggcccaggaccctggacaatctcattaatccacccctgaacctgcaggaaactcaggtgacaatcgaagaaatcactccactcgtgccccctcaaagcggcgataagggacaggaggacctgacatcatacttccttgaagcccttctgaagtacatcgttattcaggttaagtctttggaatggaagaataaggagaaccaggagcgtggattctctttcctgttctcacatttcaagaagtactacttgccctacatttttccgaacatttgcaaggagaactccctgtaccacccgatactggatatacctcagatgaggcctaagccacattatgtagtgataaagaaagacgcagaaaccaacgaggctatatattgcacgaaggaacccttcattaaggccagggtcattgtgattcgctggctggtctcattttggctggagccaaaaccgcacacagggccccacatacccggaatggagggcgaagtcttaccgaagaatatccaacgcgcagccgcttccctggttagccgagaggagtccaaaaacgataacgctgacaagacagatcgcactactgagccagagcagagccactccaacacgagcacacttacagaaagggaaccatcatctagcagtctgtgttcaattgatgaggaacatctgaccgatatagaaatagtcaggagagtgttcagttctaagcgcagcaacgtgaacttcgtgacggagatctttaggcaggcattcttattgccaatctgcgaggccgctgctatgcgcaaagttgtgaaggtttatcaggagtggattcagcaagaggaaaagcccctgttcatgcaggagccggaagaaattgtgatcacatcttctgacctcccatgcatcgaaaacgtcacagatcatgacatatcaatggaagagggagagaagagagaggaggaaaacggtacaaacacggccgaccatgttcggaattcttcctgggcaaaaaacggctcctatcagggagccctacataatgccagcgaggaagctaccgagcagaacattagggccggcacccaagccgtgcttcaggtcttcatcataaatagctctaatatctttctgctggagcctgccaatgaaattaaaaatctccttgacgagcataccgacatgtgcaagagaatcctgaatatttaccggtatatggtcgtgcaggtctctatggataagaagacctgggaacaaatgctcctggtgctgttgagagtgactgagagcgtgctgaaaatgccttctcaagccttcctgcagtttcaaggcaagaagaacatgaccctggctgggcgattagccgggcctttatttcagacgctcattgtggcctggatcaaggccaacctgaatgtgtacatttctagggaactttgggacgatctgctctctgtgttatctagtctgacgtattgggaggaactggccacggagtggtctctgactatggaaactcttactaaggtgcttgcccgcaacctctactcactggacctaagtgacctgcccttggacaaactgtcggagcaaaagcaaaagaagcataagggtaaaggtgtcggtcacgaatttcaaaaggtgagcgtggataagtccttttcaaggggctggtcccgggatcaacctggccaggctccaatgcgccagcggagtgcaaccacaacggggagtccagggaccgagaaagctcgttcaattgtgcggcagaagaccgttgcaatgcgttcaagaagtattggagaatgtgccctgcctagtgcctacatccgatccgcaaagagcgccccagtcctgattcacacctccaagccctttctaccagatatagtgctcacaccactttctgacgagctgtccgatatcgacgacgctcagattctaccccgcagtaccagggtgcgtcactttagccagtccgaggaaacaggcaatgaggtattcggcgctctgaacgaggaacagccacttccacgctcaagcagcacttccgatatcctagaaccctttacggtggaacgggcaaaggtcaacaaggaggatatgagtcagaagctgccacccctgaattctgatatcggtgggtcatctgcaaacgtgcccgacctgatggacgaatttatcgcggagcgcctccgctccggcaacgcctccactatgacccgccggggcagtagccccggctctctcgaaatccccaaggatttaccagatatactgaataaacagaaccagatgcgccctatagatgaccccggagtgccgtcagagtggacgagtcccgcatccgcgggatcgtcagatctcatctccagtgactcgcatagcgattctttctccgcgttccagtatgacggtcgcaagttcgataattttggtttcggaactgacacaggagttacctctagcgccgatgttgacagtggatccggtcatcaccagagtgccgaggagcaagaggtggctagcctcacaacgctccatattgatagtgaaacttcttccctgaatcagcaggcgttctccgctgaagttgccacaattacagggtcagaatcagcttccccagtacactcgccactcggcagccggtcacagacaccaagcccctctactctgaatattgaccacatggaacaaaaagatctgcagttggacgaaaaactccaccacagcgtgctgcagaccccggacgatttagaaatatctgaatttccttctgaatgttgtagtgtcatggccgggggaaccctaacagggtggcacgccgacgttgctaccgtaatgtggagacgaatgctggggattttgggtgacgtaaatagcatcatggatccagagatccacgctcaggtgtttgattacctctgtgagctgtggcagaatctggctaaaattagggacaacctaggcattagcacagataatttgactagtccctccccccccgtcctcatacctccccttcgaattttgaccccttggttgtttaaggctaccatgctcaccgacaagtataaacaggggaaactgcatgcgtataagctcatctgcaataccatgaaacggagacaagatgtttcgcccaatcgggactttctgacacacttttataatattatgcactgtggactcctgcatattgatcaagacatcgtgaatacgattattaagcattgcagcccacagttcttctctttgggtctcccaggagcaacgatgctaatcatggactttattgttgctgcaggacgagttgcttctagcgccttcctgaatgcgccccgcgttgaagcccaggtactcctcggatctctggtgtgcttccccaacctgtattgcgagttgccctccctccaccctaacattcctgatgttgccgtctcacagtttacggacgttaaggaattgataattaagacagtcctgagctcagccagagacgagcccagcggaccagcccggtgtgtcgcactttgcagccttggcatctggatttgtgaagagctggtgcacgaatcccatcatccgcagattaaggaagccctcaacgtgatttgcgtgtctctgaaattcaccaataaaactgtggcacacgtggcctgtaatatgctgcacatgctggtgcattatgtgccccgcttacagatctatcagcctgactctcccctaaagatcatccagattctcatagcaaccattacccacctgttgccatccaccgaagcatcctcatatgagatggacaagaggctcgttgtttctcttctgctctgcctactggactggatcatggcccttccattgaaaaccctccttcagccctttcatgccaccggggccgagagtgataaaaccgagaaaagtgtcctgaattgcatttataaggttctgcacggctgtgtgtacggagcgcagtgtttctctaacccgaggtacttccctatgagtctcagtgacttagcctcagtggactatgaccctttcatgcacctggaatcactgaaggagcctgagcccttgcattcccccgacagcgagaggtcctctaaactgcagcccgtcaccgaagtcaagacacaaatgcagcatggcttgatctcaatagccgctcgtaccgtgatcacccatctggttaaccacctcggccactatccaatgtctggtggtccagccatgctgacaagccaggtatgcgagaaccacgataaccactactcagagtccacggagttatccccggaacttttcgagagccctaatattcagttttttgtacttaacaacaccacacttgtgtcctgtattcagattcgtagcgaggaaaatatgccaggtggtggactgagcgctgggctggcatctgccaattcgaacgtaaggatcatagttcgggacctgagcggcaagtacagctgggactctgctatcttatacggaccgcccccggtgtccggtctaagtgagcccacctcattcatgctcagcctcagtcaccaggaaaaacctgaggagccaccaactagcaacgaatgcctagaggatatcactgtgaaagatggtctctcacttcagttcaagcggttcagagagactgttccaacctgggataccattcgtgacgaggaggacgtgttggatgaactgctccagtatctcggggtgacatccccagaatgcttacagagaaccgggatctcgcttaatatcccggctccacaaccggtgtgtatatctgagaaacaggaaaatgacgtcatcaacgctatcctcaagcaacatactgaggaaaaggaattcgtggaaaagcactttaatgacttaaatatgaaagccgtcgagcaggacgaacctatccctcaaaaaccccagagcgccttctactactgcagactgcttctgtccatcctcggtatgaattcatgggacaagcggcgctctttccatctactgaagaagaacgagaagttgctgagggaacttagaaatctggactcccgccagtgtcgagaaacccacaaaatagcagtgttctacgtcgcggagggccaagaggacaaacactctatcctgaccaacaccggcggttcacaggcctacgaggacttcgtggccggcttagggtgggaggtaaatttgacaaaccattgtggctttatgggggggcttcagaagaataaaagtactggcctgacaacaccatactttgccacttcaactgtcgaagtcatatttcacgtttctacgcgcatgcccagtgatagcgatgacagcctcaccaagaaactgagacacctcggaaatgacgaagtacacatcgtctggtcagagcatacaagagattaccggaggggcatcattccaacagagttcggcgacgtcctgatcgttatctatcccatgaagaaccacatgtttagtattcaaatcatgaagaagcccgaagtcccattttttggcccgctgtttgacggagccatcgtgaacggcaaagtcctgcccataatggtgcgcgcaaccgccattaatgcatccagggctctcaaaagtttaattcccctttatcagaacttttacgaagagagagcacgttacttgcagactatagtacagcaccaccttgaacctacaacattcgaggacttcgcagcacaggtgtttagcccggccccctatcaccacctgccttcggacgccgatcattag

SEQ ID NO: 131652 - DNA, 2169 bp, Artificial Sequence
  Description of Artificial Sequence: Synthetic coding sequence
cagatactgattgccacgattacacacctgctaccatccacagaagcctccagctacgagatggataaaaggctggtcgtgtctctacttctgtgcctcctggactggattatggccctgcccctgaaaactcttctgcaacctttccatgccaccggagccgaaagcgacaagaccgaaaagtctgtgcttaactgcatttataaggttcttcacgggtgtgtttatggcgcacaatgtttttcaaacccgagatatttccccatgtctttgtcggatcttgcgagcgtggactatgacccctttatgcatttagaaagtctgaaagagcccgagccgttgcacagccctgacagtgagcggtcaagcaagctgcagcccgtgaccgaagttaagacgcagatgcagcatggcttgatctctatcgctgctcggactgtcatcacacatctggtgaatcacctcggtcactacccaatgtcaggaggcccggcaatgctgacctcccaagtctgcgaaaaccatgataaccattactcagaatccaccgaactcagtcctgaattattcgagtcccccaacatccagttctttgttcttaataataccaccttagtaagctgtattcagatccgctcagaggaaaatatgcccggcgggggcctctccgccggacttgcatccgcaaatagtaatgtgcgaattatcgttcgagacctctcgggcaagtactcatgggattctgctatcctgtacgggccgcctccggtttctggcctttcagagcccacgtcctttatgttgtccttgtcacaccaggagaaaccagaagagcccccgaccagtaacgagtgcctcgaggacattacggtcaaggatggcctttcgctgcaattcaagcggtttagagagacggtcccgacgtgggataccatcagggatgaagaggatgttctggacgagcttttgcaatacttgggcgtcaccagtcctgaatgtctccagcgcactgggatcagtcttaacatacctgcaccacagccggtgtgcataagtgagaaacaggaaaatgatgtgatcaacgcaatcctgaagcagcacacagaagagaaagagtttgtggagaaacattttaacgacctgaatatgaaagccgtggagcaggatgagcccatcccacagaaaccacagagcgccttttattattgcagactcttgctctccatcctggggatgaatagctgggacaaaagacgctcctttcatctactgaaaaaaaatgaaaaactgctgagagaacttcgcaatctcgacagccgccaatgccgggagacgcacaagatcgctgtgttttatgtcgccgaaggccaggaggataagcacagtattctgacaaacaccggcggctcccaggcgtatgaagacttcgtagccggtttagggtgggaagttaacctgactaatcactgtggctttatgggcggcctgcagaagaataaatctacgggtctgacgaccccctattttgcaacgtctactgtggaggtcatatttcatgttagcaccagaatgcccagcgatagcgatgactccctgaccaagaagctgcggcatcttggcaatgacgaagtccacatcgtgtggtcagagcacacccgagactatcggagggggataattcctacagaattcggtgacgtgctgatcgttatctatccgatgaagaatcacatgttcagcatccagattatgaaaaaacctgaggtacctttcttcggccctctctttgacggtgcgatcgtcaatgggaaagtgctgccgataatggtccgagctaccgcgataaacgcctcaagggctcttaaaagcttgattcccctctatcagaacttctacgaagagagggcccggtacctccagactatagtgcaacaccacctggagcccactacattcgaagattttgctgcccaggtttttagcccggccccctatcatcacctgccctctgatgccgtcgggtcttacccagagatattaccaagcgagacacccaccgccacacaagtagacggggccgacctggcaagccctatgagccccaggactagtaaatcccggatgtccatgaagcttcgccggagttcgggaagcgccaataagtcctag

SEQ ID NO: 131653 - DNA, 2709 bp, Artificial Sequence
  Description of Artificial Sequence: Synthetic coding sequence
atggtgcagcgaatgtgggcagaagcagccgggcccgcagggggtgccgaacccctgttcccaggcagccggcgatccagatctgtctgggatgccgtgaggcttgaagttggcgtgcccgatagctgtcccgtagtcttacatagtttcacgcagctggacccagacctgccaaggccagaaagtagtacccaggagattggcgaggaactcattaatggggtcatctactctatctccctccgaaaagttcaactgcatcacggggggaataagggacagcggtggctcggatatgagaatgagtcggccctgaacctgtatgagacgtgtaaggtgcgtaccgtaaaagccggtaccttggagaagctggtagagcacctggtgccagcattccaagggtctgacctgtcttacgtaaccatctttctatgcacttaccgcgccttcacgacaacgcagcaggtgttagatctcttgtttaaaagatatggatgcattcttccctacagcgatgaagatggtggcccccaggaccagctcaagaatgcgatctcctccatcttgggtacatggcttgaccagtacagcgaggatttctgccagccccccgactttccttgcttgaaacagcttgtggcatacgttcagcttaatatgccagggagtgaccttgagcgcagagctcacctgctgctggctcagttggaacactccgaacctatcgaggcggagcctgaagcactgagtccagtccctgcgctaaaaccgacaccagaactggaactcgccctgacccccgcacgagcccccagccctgttccagccccggccccggagcctgaaccagctcccacccctgcccctggcagcgagttggaagttgcccccgccccagcccctgagctccagcaagcccctgagcccgcagtgggcctggagtcagcccctgcccctgccttggaactagaacccgcccccgaacaagatccggcacccagccagacactggaactggaacctgccccggctccagtcccatccttgcaacccagctggccaagcccagtggtcgccgaaaatggcctgagtgaggagaagccacatttgctagtcttccccccagatctggtcgctgagcaatttactctgatggacgccgagttgtttaaaaaagtggtcccctaccactgcctcgggagcatctggtcacaaagggacaaaaaagggaaggagcacttggcacccactatacgcgctaccgtgacccagtttaatagtgtagccaattgcgtgatcactacctgcttgggtaatcggagtactaaagcccctgaccgagccagggttgttgaacattggatcgaagtggcaagagagtgcagaatcctaaagaatttctcatcactgtatgcaattctgagcgccctgcaatccaatagtatccaccgcctcaaaaagacatgggaagatgtttcgagagattctttccgtatctttcagaaacttagcgagatcttcagtgatgagaataactatagtctgtcccgcgagctgcttatcaaggagggcaccagcaaattcgctacactggaaatgaaccccaagagggcccagaaacgccctaaggaaacggggattattcagggaacggtgccttacttgggaacattcttaacagatctcgtgatgcttgataccgcaatgaaggactatctgtatggcagactgataaatttcgaaaaaaggcgtaaagaatttgaggtcattgctcaaataaagctgttgcagtcagcctgtaacaattatagtattgcccctgacgaacagttcggggcgtggttcagagcggtggagcggctgagcgagaccgaatcgtataatctgagctgcgagctggagcctccctccgaatctgcatctaacacacttcgcacaaagaaaaacactgctatcgtcaagcgctggtctgatcgacaggctcctagcactgaactgtctacctctggatcatctcactcgaagtcctgtgatcagctacggtgtggcccttatctgagctccggagatattgcggacgctctgagcgtccactcagctgggtcgtcttctagtgatgtcgaggagatcaatataagcttcgtgccagaaagtcctgacggccaggaaaagaagttttgggagagtgcatcacagtccagcccagagaccagcggaatatcaagcgcgtccagttccactagcagcagttctgccagcactacccctgttgccgctacacggacccacaagaggtctgtatctgggctctgcaattcctcttccgcgctccctttgtacaaccagcaggttggtgattgctgcatcatccgggtttccctggatgtggataatggcaatatgtataaaagcatcctggtgacgtcccaggacaaggctcccgccgttattagaaaagcaatggacaaacataacctcgaggaagaggagcctgaagactatgagctgcttcagatcctgagcgatgatcggaagctaaagatccccgaaaacgccaatgttttctacgcaatgaacagcaccgccaactatgatttcgtcctgaagaagcggaccttcacaaagggtgttaaagtcaagcacggagcctcttcaacgttgccacggatgaaacagaaagggctaaaaattgctaaggggatattctag

SEQ ID NO: 131654 - DNA, 2745 bp, Artificial Sequence
  Description of Artificial Sequence: Synthetic coding sequence
atggttcagagaatgtgggcagaggcagcaggtccagccggaggcgccgagcctctgtttcctgggagcaggcggtccagatccgtctgggatgcagtccggttagaggttggcgtacccgatagttgcccagtggtgctgcatagtttcactcagctggatcccgaccttccgcggccagagtcttccactcaggagatcggtgaagagctcatcaatggggtcatctatagcatatcattaagaaaagtgcagcttcaccacggagggaacaaggggcagcgctggttagggtacgaaaacgagagtgcactgaatttatatgaaacctgcaaggttcgcacagtgaaagcaggcaccctggaaaaactggtggaacatcttgttccagccttccagggttctgacctaagttatgtaactatcttcttatgcacctacagggccttcacaaccacgcagcaggtgttggacctccttttcaagagatacggccgctgtgacgccttgacagccagcagcagatacggctgcatcctgccttattctgatgaagacggcggcccccaagatcaactgaaaaatgctataagctcaattctgggtacctggctggatcagtatagtgaggacttttgccagcctcccgatttcccttgtttgaagcaactggtggcatatgtgcagctcaacatgcctggtagcgacctagagcgccgggctcacttattgctcgcccagctggagcactctgagccaatcgaggccgagcccgaagcgctatcccctgtgcccgcactcaaacctactccagagcttgaactggccctcacacctgcccgcgctccatcaccggtgcccgcgcccgctcccgaacccgagcctgccccaactcctgctccagggagcgaactggaggtcgcccccgcgccagctccagaacttcaacaggcccccgagccagccgtgggactggagtccgctcctgcgcccgccctcgaactagagcccgcccccgaacaggaccctgccccatcccaaaccttagagctggagcctgcccccgcaccggtgccatctctccagcccagttggccttcccccgtggtggccgagaatggtctgagtgaagagaaaccacatttgctagtttttccacccgatctcgtggccgagcagttcaccctgatggacgcggaactgttcaagaaggtggtcccctaccattgtctgggctcaatatggagccagcgagataagaaaggcaaagaacacctcgcgccaaccattagagccactgtgacacagtttaactctgtggccaattgtgtgatcaccacatgtctggggaacaggagcacgaaggctccagaccgggctcgggtcgtcgagcattggatagaggtcgcccgtgagtgcagaatcctcaagaacttttcttccctgtatgctatcttgagtgccttgcagtccaattcaatccacaggctgaagaagacctgggaagacgtgagccgagattccttcagaattttccagaaactgtccgaaattttcagcgacgaaaataattacagcttatcccgtgagttgctgatcaaagagggcacgtcaaaattcgcgacgctcgagatgaaccctaagcgggcacagaagagacccaaggaaacagggattattcaggggacagtgccctacctggggacatttctgactgatctggtgatgctcgatacagccatgaaagactacttatacgggcggttaataaactttgagaagaggcgcaaggaattcgaggttatcgcacagatcaaacttctacagtcagcgtgcaacaattactcaatcgcccccgatgagcagttcggagcctggtttcgtgccgttgagcgcctatctgaaacagagagctacaatttatcttgcgagctagaacccccatcagagagtgcttcaaataccctcagaaccaaaaagaatacagcgatagtaaaacggtggtccgaccggcaagccccctccaccgagctctctacgtccgggtccagtcactctaaatcctgcgaccagctgaggtgtgggccttatctgtcctccggcgatattgcggacgcgttgtcagtgcactctgccggcagttcgagctccgacgtggaagagattaatatcagcttcgtgccagagagccccgatggacaggaaaaaaaattctgggaaagtgctagtcagtcctctcctgagacttcagggatttcctcagcctcctctagtacttcatcgtcatctgccagcactaccccggttgcagccaccagaactcataagaggtcagtgtccggcctttgcaattcttcaagcgctctccctctttataatcaacaggtcggcgactgctgcataataagagtgtctctggacgttgacaatgggaacatgtacaagagtattttggtcactagccaggacaaagccccggcagtgatacggaaggcaatggataaacacaatctggaggaggaagagcccgaagattatgagctcctgcaaatcttatccgatgataggaagctgaaaattcctgagaacgcaaacgtgttttacgccatgaattcgacagccaactatgactttgtcctgaagaagcgaacgttcacaaaaggcgtcaaagtgaagcacggcgcctcttccactctgcctagaatgaaacagaagggactgaaaattgccaaggggatattctag

SEQ ID NO: 131655 - DNA, 1341 bp, Artificial Sequence
  Description of Artificial Sequence: Synthetic coding sequence
atgccgggaagtgaccttgagcgccgcgcccatctgctgttagcccagctggagcactcagagcccatcgaggcggaaccagaagccctgtcaccagtgcctgccctcaagcccacccctgagctcgaattagctctgacacctgctagggctcccagcccagtgccagcaccagctccagagccagagccagcccccacacctgcccctggcagcgaattagaggttgcccccgctcctgccccagaacttcagcaagcccccgagcctgctgtaggactggagtctgcgccggcaccagccttagaattagaacctgctccagagcaagatcctgcaccctctcaaactctggagctggaaccagcccctgcccctgtgcctagcttgcagcccagctggccaagtccagtggtggccgagaatggccttagtgaggaaaaaccgcacctcctcgtcttcccacctgatctggtcgccgaacagttcactctgatggacgctgaatgccgtattttgaagaacttcagctcgctctacgctattttgtcagctctgcaatccaattctatccatcggttgaaaaagacatgggaggacgtctccagggattcatttaggatattccagaagttgagcgagatcttttcagacgagaataactacagcctctcgagggagctgcttatcaaagagggcacatccaaattcgccacactggagatgaaccccaagagggctcagaaaaggcctaaagagacagggattattcagggaacagtgccctatctgggcacgttcttaacagaccttgttatgctggacacggcgatgaaagattatctgtatgggcggctaattaactttgaaaagcggcggaaggagtttgaggttatcgcacaaatcaagctgctccaaagtgcctgcaacaattactcgatagctccagatgagcagtttggagcctggtttagagcggtggaaagacttagcgagaccgagtcttacaacctgtcttgtgagctggagccaccatcagagagcgcgtctaacacgctgaggacgaaaaagaacactgccattgtgaagaggtggagcgatcggcaggccccttccacggagttgtcgacctctggttcaagccattcgaaatcttgtgaccagctgaggtgcggcccatacctgtcatccggcgatattgctgacgccctgagcgtccattcggctgggtctagctctagtgacgtggaggagataaacatctcttttgtgcctgaatcccccgatggccaggagaagaagttctgggagagtgcgtctcaatccagccccgagacctag

SEQ ID NO: 131656 - DNA, 2658 bp, Artificial Sequence
  Description of Artificial Sequence: Synthetic coding sequence
atgtgcctgtggggtcacagtaccgcaccagctcataccctgtccagtccaccacttttgttttgttccctgccatgtgccctgcacctgcaacctggcacaggccacccacccgggcaagttccaaggaaaagttctacccaggagattggagaggaactcatcaatggcgtcatctattctattagcctcaggaaggttcagctccaccatggcggcaacaagggccaaagatggcttgggtacgaaaacgagagtgctttaaatctgtacgaaacctgtaaggtgcgaactgtgaaggccggaaccctcgaaaagctggtcgaacatctggtgccagcgtttcagggaagcgatttgagttatgtcacaatcttcctctgcacctatcgcgccttcaccacaacccagcaagtgcttgatctgcttttcaaaaggtacggatgtatcctgccctacagtgatgaagacggcggcccacaggatcaacttaagaatgccatctcttcaatcctgggaacctggctggaccagtattcagaagacttctgccagccaccagattttccttgccttaagcagcttgtcgcttatgtgcagttgaacatgccgggctcagacctggagcgacgggcacatctacttttggctcaattggaacactctgaaccaatagaagccgaacctgaagccctgtcccctgtgcctgccctgaagccaacccctgagcttgaactggccctgactcctgcacgtgccccttctcccgtgccagctcccgcccctgagcctgaacctgcccctactccagcccctggatccgaactggaagtggctcccgctcccgctccagagttacagcaggcgcctgagcctgctgtaggtctcgagtccgcaccagctccagcgctggagctggaaccggcccccgagcaagaccctgcccctagccagaccctggagctcgagccagcacccgcgcccgttcccagcctccagcctagttggccctctcccgttgtcgctgaaaatggattgagtgaggagaagccacacctcctggtgttccccccagacctggtcgccgagcagtttacacttatggacgccgaactgttcaagaaggtggttccatatcactgccttggctcgatttggagccaacgtgacaagaaagggaaagagcatctggctccaacaatcagggcgacagttacacagtttaacagtgtcgctaactgcgtcataactacatgcttggggaaccgtagtaccaaggcacccgatcgcgctcgggtcgtagagcactggattgaagttgccagagagtgccgcattctgaagaatttctcttcactgtatgccatcctgagcgccctccagtctaactccatccataggttaaagaagacctgggaagatgtatccagggactctttccggatcttccaaaaactttctgaaatcttctccgatgagaataattactccttatcccgggagctcctgatcaaggagggtacaagtaaatttgcaactctcgagatgaatccaaaaagggctcagaaaaggccaaaggaaacaggcattattcaaggcactgtgccttacttgggtacatttctgactgatctggtcatgcttgacaccgcaatgaaggactacctctatggacgtctcatcaacttcgagaagcgtcgcaaagagttcgaagtcatcgcccagattaagctcctgcagtctgcgtgcaataactactccattgcgcccgacgagcagttcggcgcttggtttcgtgcagtggaacgactctcagagaccgagtcatataacttgtcatgtgaattagagccgccgtcagagtccgcctctaatactttaaggactaaaaagaataccgcaatagtgaagaggtggtccgacagacaggctccttctaccgaactcagcacctccggaagcagccactcaaagtcctgtgatcaactgagatgtggaccgtatcttagcagtggcgacattgcagacgctttgtctgtccacagtgcgggttcctctagtagcgatgtggaagagataaacatctccttcgtccccgagtcacctgatgggcaggaaaagaagttctgggaaagcgcgtcccagtcaagtcccgagacaagcggcatctcttcagccagttcgagcacaagctcctcctcggcgagtactaccccggttgcggctacaaggacccataaaaggtccgtgtcagggctttgcaattcttcttcagcactgccactgtacaaccagcaagttggtgattgctgtattatccgcgtctccttagatgtcgataacggtaatatgtacaaatcaattttggtcacatctcaagacaaggcaccagcggtcattcgaaaggcaatggacaaacacaatctcgaggaagaggagcctgaagactacgagctcttgcagattcttagcgatgaccggaagctcaaaatcccagaaaatgcgaatgtgttttatgctatgaattccactgccaactacgacttcgttctgaagaagcggacctttacaaaaggcgttaaagtaaaacatggagcctcttctacgctcccccgcatgaaacagaagggactgaaaatcgcgaaagggatcttctag

SEQ ID NO: 131657 - DNA, 2742 bp, Artificial Sequence
  Description of Artificial Sequence: Synthetic coding sequence
atggcccgggaagctggacaggtctgtgcccgaccagctgtacctagggggcggaagggtagtgtcttttttgcttgtgtgagcgtagtgaccgccaggcggcgcgcagtggccagacgtgcggcactgcagtctcctacaccctggttggctcccttacccgctcccgcaaccactgagtcaagtacacaggaaattggcgaggaattaattaatggcgtgatctactccatctctctgaggaaagtgcaacttcaccacggtggaaacaaggggcaacgttggctcggctacgagaacgaatctgccctcaatttatacgagacatgcaaagtgagaacagtgaaagcaggcaccctggaaaagctggtggaacatttagttccagccttccaaggcagcgatctttcctacgtgactattttcctatgtacttacagggcctttaccactactcaacaggtacttgacctgctatttaaacgctacggcaggtgtgatgcgctcaccgcctcttcgcgatatggctgcatccttccatacagtgacgaagacggaggccctcaagatcagctgaaaaatgcaatctcaagtatcttgggcacatggttggatcagtactctgaggacttctgccagccccctgactttccgtgtctaaaacaactcgtcgcatatgttcaactgaatatgccagggtcagacctggagcgcagagcccacttgctcctcgcccagctggaacatagtgaacctattgaagcagaacctgaggctctttctcctgtgcctgctctgaagcccacaccagagctggaattagcattaactcccgcgagggccccttctccagtgcctgccccagccccagagccagagccagccccaacgcccgccccgggttccgaattagaggtggccccggcccctgctcctgagctgcagcaagccccagaaccagccgtgggcctcgagtctgcacccgcccccgctttggaattggagcccgcaccagagcaggaccccgccccctcccaaaccctggagctcgagcctgcccctgctccagtcccaagtcttcagccctcttggccctcaccagtggtggctgaaaacgggttgtccgaggaaaagccgcatctgctggtcttccctccagatttggttgcggagcagtttactctaatggatgccgagctgttcaagaaggtggtgccttatcattgtctcggctctatttggtcccagagggataagaaagggaaggaacacttagcacccactattcgggccactgtgacacagtttaacagcgtcgctaattgtgtgatcactacgtgccttggcaaccggtccactaaggcccctgatcgggctcgcgtcgtcgagcactggattgaagtcgctagggagtgcaggattctaaaaaatttctcctcgctgtatgccattctatctgctcttcagagcaattccatccatcggctaaagaagacgtgggaggacgtttctcgagactcattccgtatcttccaaaaactcagcgaaatattctccgacgagaacaattactctctgtctagggagcttctcatcaaggagggaacaagcaaattcgccaccctagagatgaatcctaagagagcgcaaaagcgcccgaaggaaacagggatcatccaagggacagtgccatacctcggcacctttctgaccgatctggtcatgttggacactgctatgaaagactatctgtatggccggctcatcaattttgagaaacgccgcaaggagttcgaggtgatagcacagatcaaacttctccagtccgcttgtaacaactactccatcgccccagatgaacagtttggcgcatggtttagagctgtagagcgactctcggaaaccgaatcctacaacctgtcctgcgaacttgaacccccatccgagtctgcctccaacactctgcggactaaaaagaacactgccattgttaaaaggtggagtgataggcaggcaccgagcaccgaactgtccactagtggttcgagccatagcaagtcctgcgaccagttacggtgcggaccttacctgagtagcggcgatatcgccgatgcattgagcgtacattcagcaggtagctctagtagcgacgtggaagaaataaacatttcctttgtgccggagagcccggacggccaggaaaaaaagttctgggaaagtgcaagccagagcagccccgagacttcaggtatatccagcgcctcttcgtctacatcctcgtcgagcgccagcacgaccccagtggccgctaccaggacacacaagcgctcagttagcgggttgtgtaatagtagctccgcccttcccctgtataatcagcaggtgggtgattgttgcatcatccgagtatcgctcgatgtggacaatgggaacatgtacaagtccatactggtcacatcgcaggacaaggcaccagccgttattcgtaaagctatggacaaacacaatctggaagaagaagaacccgaggattacgagctactccagatcctgtccgatgatcgcaaacttaagatccccgaaaacgccaacgtgttctacgcaatgaacagcaccgctaactatgacttcgttcttaaaaaacgcacattcacaaagggggtgaaggtcaagcacggcgcgagttcgactctgccccgcatgaagcagaaggggctaaaaatagccaagggaatcttctag

SEQ ID NO: 131658 - DNA, 2580 bp, Artificial Sequence
  Description of Artificial Sequence: Synthetic coding sequence
atgatggtggactgccagtcatcaacacaggagattggggaggagctgatcaacggggttatatacagcatcagcctgagaaaagtgcagctgcaccacggcgggaataaaggccagcgatggctggggtatgagaatgaatccgctctaaacttgtacgagacatgcaaggtaagaaccgtgaaggcaggtactctcgagaaactcgtggaacacctcgtgcccgctttccaagggtctgacttgagttacgtgaccattttcctttgtacctaccgcgccttcacgacgacccagcaggtccttgacctgctattcaaacgttacggccgttgcgacgctctgacggcatctagtcgatatggatgtatactgccatacagtgatgaggacggtggacctcaggatcagctgaaaaacgctatttcttcgattctcggtacatggctggaccagtactctgaagacttttgccagccccctgactttccctgcctcaagcagctggtggcttacgtgcagcttaatatgccaggctctgacctggagcgcagggcccacctgttgcttgctcagctggagcacagtgagcccatcgaagcggagcccgaggctctctcccccgtccctgcgctcaagccaaccccggaacttgaactggccctgaccccggcaagagctccatcaccagttccggccccagcacccgagcctgagcctgctcctacgcccgcccctggaagtgagctcgaggtggctccagccccagcacctgagttacaacaagctccagagcccgcagtcggactcgaaagcgctcccgcccccgccctagagctggagccagctcctgaacaagatccagccccaagtcagaccttagaactggagccagcccccgctccggtgccctcgcttcaacccagctggcccagccccgtggtagccgaaaacggacttagcgaggagaaaccgcatctgctagtgttcccccccgatctcgtagctgagcagtttaccctgatggatgctgaactctttaagaaagtagtgccctatcactgcttaggttcaatatggtcccagagggacaaaaagggcaaggaacacctggccccaaccatccgggccactgtgacacaattcaactctgtcgctaattgcgtaattacgacttgtctgggaaatcgatccacaaaggccccagaccgtgcccgcgtggtggagcactggatcgaagtcgcacgggaatgtcgaatccttaaaaacttcagcagcctgtatgctatcctcagtgccttacagtctaacagcatccacagactgaaaaagacatgggaagatgtgtcccgggacagcttccgcatattccagaaattgtctgagatcttcagcgatgaaaacaactacagtctgagtagagaactgctgatcaaggaaggtaccagtaaatttgctacccttgaaatgaatcctaaaagagcccaaaagcggcccaaggaaaccgggatcatccagggaaccgtcccatacctgggcaccttcctgactgacctcgtcatgttagacaccgcgatgaaggactatctctatggccgccttattaactttgaaaagcggcgcaaggaatttgaagtaatcgcacagattaagctgttgcagtccgcctgtaacaattatagtattgcgccagatgagcagttcggtgcttggtttcgcgcggttgagaggctctcagaaaccgagtcttataacctgagctgcgaactcgaacctccatcggaatccgcatctaatacactgaggactaaaaaaaatacagcgatcgtgaaaagatggtcagacaggcaagctccctctacagagcttagtacaagcgggtccagtcattcaaagtcctgtgaccaactgagatgcggcccctatctgtccagcggcgacatcgcggatgccctgagcgtgcattccgctggttcatccagctcagatgttgaagagataaatatttcattcgtgcctgaaagtcctgacgggcaggaaaagaaattctgggaaagcgctagccaatcaagtccggagacctccggtattagttccgcatcgagtagcacatcctcgagtagtgcatcaacgactccggtggctgccacacgtacacacaaacgttccgtctcagggctgtgtaactcctcctcagccttaccactgtacaatcagcaagtgggggactgctgtatcattagggtttcgctggatgtggataatggcaatatgtacaagtcaattttggtgacatcccaagataaggctccagccgtaatccggaaggctatggataagcacaatctggaggaagaagaacctgaagactatgaactgcttcagatactttctgacgatcgtaaactcaagatcccagagaatgctaacgtgttctatgctatgaatagcactgccaattacgactttgttctaaagaagcgaacgttcaccaaaggagttaaagtgaagcacggagcctcctctacactaccacgcatgaagcaaaaagggctcaaaatcgccaaaggaatcttctag

SEQ ID NO: 131659 - DNA, 930 bp, Artificial Sequence
  Description of Artificial Sequence: Synthetic coding sequence
gtggttgcagagaatgggctctctgaggagaaaccgcacttacttgtcttccctcctgatctggtcgcggaacaattcaccctgatggacgccgagtgccgaattctcaaaaactttagtagtctttatgccatacttagcgccttgcaatctaactctatccatcgtctgaaaaaaacttgggaagatgtgagtagggatagcttcaggatctttcagaagttatccgagattttctctgatgagaacaactactctctgtcccgcgagttgttaattaaagagggcacatccaaattcgctacactggagatgaaccctaaaagggcccaaaaaaggcccaaagagactggcatcatccaggggaccgtgccttatctgggtacatttcttaccgacttagtcatgctggacacagctatgaaagactatctgtatggacggttgattaatttcgagaaaagaaggaaggaattcgaggtgatagcacagatcaagctgctccaatccgcctgtaacaattattccattgccccagatgagcagttcggagcatggttcagagccgtcgagcgcctgagcgaaaccgagagctacaatctgtcctgtgagctagagccgccctctgaaagcgcatcaaatacgctgaggacgaagaaaaatacagccatcgtgaagcgctggtccgacaggcaggcaccgtccaccgaacttagcaccagtggttcttcccacagcaagtcttgtgaccagctccggtgtggaccctacctcagtagtggggatatagcagacgccctgtctgtccattcagctggaagctcctcctcggatgtggaggagattaacattagctttgtgcctgagagtcctgacggtcaagagaagaagttctgggagagcgcctcgcagtcatcccccgagacttag

SEQ ID NO: 131660 - DNA, 2958 bp, Artificial Sequence
  Description of Artificial Sequence: Synthetic coding sequence
atgcaccgacgcagactggccctcggcctgggattttgtctcctcgccggcacttctcttagtgtgttgtgggtgtacttagaaaactggctgccagtttcttacgttccctactatttgccttgccccgaaatactgccaatgatgatggctctgtcatgcttatgccatcagcaacatgaagccgccctacaggagggagaggccacaccggcgagaggaatggtgacagttccatcagcacaggctgctggggctcaggcccatacggccgcagatactcacactcttgtgggagctcaccgtctgagggggaatttgcagcccagagcatctgccgcacacttaccagcgactgagcctgatcactgggggcacggcgtatgtcgaggtgagtcatcgacacaggagattggagaggagctgatcaatggtgtgatttacagcatctcactaaggaaggtccagctgcaccacggcgggaacaaaggtcaacgctggctgggttatgagaacgaaagtgcactcaatctgtatgagacctgcaaggtccggactgtgaaagccggcactctggaaaagctagttgaacatcttgtgccagcctttcagggctccgacttgtcctacgttacgattttcttatgcacatacagggccttcacaaccacccagcaggtgttagatctcttatttaagcggtacggccgatgcgacgcactcactgctagttcaaggtacggttgtatccttccttattcagacgaggacggtggaccccaggatcagctcaagaatgcaatttcttcgattctgggaacatggctcgatcaatatagcgaggatttctgccaaccaccggactttccatgtctcaagcagctggtggcctatgtccagcttaatatgcctggcagcgacctagagaggagggcccacttgctgctggcacagctcgagcattctgagccaattgaagcagaaccagaggccttgagccctgtacctgctttgaaacccacccccgaactggaactggctctgactccagctcgggctcccagccctgtgcctgcaccagccccagagccggagccagccccaactcccgccccaggctctgaactggaggttgcacctgctcctgccccagaactgcagcaagcgcccgagcctgcagtcggcctggagtctgctccagccccggccctggaactcgagcctgcacccgaacaggatccagccccctctcagaccctcgaactggaacccgccccggctccggtcccctcactacaaccatcttggcctagcccagtggtagctgagaatggactatccgaagaaaagccccatctgctggtttttcccccggatcttgtggcagagcagtttacattgatggacgccgagttattcaaaaaagtggtcccctaccattgcctagggagcatatggtcccaacgggacaagaaaggcaaggagcatttggcccccactatccgcgcaacagtgacccagtttaacagcgtggcaaattgcgtcattaccacttgtctcggaaatagatccacaaaggcaccggatcgggcacgggttgtggagcactggattgaagtggcccgagagtgtcgaattttgaaaaacttttcctcactctatgcaattctgagtgctttgcagtctaactctattcacaggctgaagaagacttgggaggacgtgagcagggatagcttccggatctttcagaagcttagcgaaatattctcagatgaaaataattacagtctctctcgggaactgctcatcaaggagggaaccagcaaatttgccacccttgaaatgaaccctaagagagcccaaaagcgacccaaggagaccgggattatacagggaactgtgccatacctgggtaccttcctcacagacctggtcatgttggacaccgctatgaaggactatttgtatgggaggctaatcaactttgagaagaggcgcaaagagtttgaggtgatcgctcaaatcaagctcttgcagtccgcctgtaacaattactctatcgcccctgacgagcagtttggggcctggtttcgggctgtcgagcgactgtctgaaacagagtcgtataacctgtcctgcgagcttgagccaccttccgagagcgctagtaatacgttaagaactaagaagaacacggccattgttaaacgctggtcagacagacaggcaccatctacggagctgtccacttcaggttcgagtcattcaaagagctgcgaccagctgcggtgtggcccatacctgagctcaggtgatatcgcagacgccctgtcagtgcacagcgcagggtcttcatctagtgacgtggaggagatcaacatctctttcgtgcccgagtcacccgatgggcaggagaagaagttctgggagagcgctagtcagtccagcccagagaccagtggaatctcatccgcctcaagctcgaccagctccagctcagcctcaactactcctgtcgccgccacccggactcataagcggtctgtaagcggcctctgtaactcgagctcagcactgccactgtacaaccagcaagtaggcgattgctgtatcatccgagtgagcctggacgtggacaatgggaatatgtataagagcatcttggtgacctctcaggacaaggctccagctgtgatccggaaggcaatggacaaacacaacctggaggaagaggaacctgaggattatgaacttttgcagatcctcagcgacgatcgaaagttgaagattcccgagaatgccaacgttttttatgcgatgaatagtacggctaactatgacttcgttctcaaaaagcgaacatttaccaaaggcgtgaaagtgaagcatggggcctctagtactctcccccgcatgaaacagaaagggctcaagattgcaaagggaatcttctag

SEQ ID NO: 131661 - DNA, 2412 bp, Artificial Sequence
  Description of Artificial Sequence: Synthetic coding sequence
atggaggtgaaacctgtgggggaacctacccaggaggtatcaaagtttaaactgagcaccaaagtggaatcaacaggccactggctagtggaagaccatgtccgcatctgggaggtgttgaagacagaagaatccagcattcaggactggggggaagaagtcgaggagggtgccgtttatcatgttaccctcaagagagtgcagatccaacaagccgcgaataaaggcgcaaggtggctcggagttgagggtgaccagctgccccctgggcatacagtgagccagtacgagacctgtaaaatcagaacaatcaaagcgggaacactcgaaaagttggtggaaaacctcttgaccgcctttggcgataatgacttcacgtacatctccatcttcctgtcaacataccgaggcttcgcctcgaccaaagaggtcctggagctcctgcttgacaggtatgggaacctgacaagtccaaactgtgaggaagatggtagccaaagctcttccgagtctaagatggtaattcgaaacgccattgcgtctattctgcgcgcctggctcgaccagtgcgctgaagacttcagagagccaccccatttcccttgtctgcagaagttgctcgactatctgacacgaatgatgccgggttccgacccggaacggagggcgcagaacttactggagcaattccagaagcaagaagtggaaaccgacaacgggctgccgaatactatctccttctccctcgaagaggaagaggagttggaaggcggcgagagcgctgaattcacttgctttagcgaggatctagtcgctgaacagttgacatatatggatgctcagctcttcaagaaggtcgttcctcatcattgtctgggctgtatctggagtcgcagagacaagaaagagaataagcacctggccccaactatacgagctaccatcagtcagttcaataccctcaccaaatgtgtggtgagcacaatcctcggaggtaaggaactgaaaacacagcagagagccaagatcatcgaaaaatggatcaatatcgcgcatgaatgtcggctactcaagaatttttcatcccttagagctattgtgagtgcccttcaatcgaactcaatctatagactgaagaagacctgggccgcagtcccacgggaccgcatgctgatgtttgaggagttgtctgacatattctccgatcacaataaccacctaactagcagagagctgctcatgaaggaaggtacttccaagttcgccaacctcgactcgtctgtcaaggagaaccaaaaacggacacagcgacggcttcagctgcagaaggacatgggcgttatgcaagggaccgttccgtacctggggacctttctcactgatttgactatgctggacaccgccctccaggactacatcgaggggggcctgattaatttcgagaaacggaggcgcgaatttgaggtaattgcccagataaagctgctgcagtctgcatgtaatagttattgtatgacccccgaccagaaatttatccagtggttccagcgccagcagcttctcactgaagaggaatcctatgccctgtcttgtgaaatcgaggccgctgccgacgccagtacgacgtccccgaagccgcggaaatcaatggttaaacgcctctcgttgctgttcttgggcagtgacatgattactagccccacaccaacaaaggaacagcccaaaagcaccgcttccggctctagcggggaatcaatggactcggtgtctgtgtcctcatgtgagagtaatcattcagaggccgaagaaggctctattacacccatggatacccccgacgagcctcagaaaaagctcagcgagtccagttcctcttgttccagcattcacagtatggacactaatagttcaggcatgtcatctctgatcaaccccctgtcctccccaccttcatgcaataataatcctaaaatacataagaggagtgtatccgttacttccatcacaagtactgtcctccctcctgtatataaccagcagaatgaagatacatgtataattcgtatttcagtggaggacaacaacggtaatatgtacaagagcatcatgctgacatctcaggacaaaaccccagcggtgatccagagggctatgcttaagcacaacctcgattctgatcctgcggaagaatacgaactggttcaagtcatctccgaagacaaagagctcgtgatcccagactcagcaaatgtattttatgctatgaattctcaggtgaattttgattttatcctccggaaaaagaactccatggaggaacaggtcaaattgagatcgagaacctctttgaccctgccccgcactgctaagcggggctgttggagcaaccgccatagtaagattaccttgtag

SEQ ID NO: 131662 - DNA, 2307 bp, Artificial Sequence
  Description of Artificial Sequence: Synthetic coding sequence
atgaaactgttatggcaggccaaaatgtcctcaatccaagattggggtgaagaggtggaggagggtgcagtctaccatgtgaccctgaaaagggtccagatccagcaagcagccaacaagggtgctcgttggttaggagtggaaggagaccagctcccccccggtcacactgtgagccagtatgagacttgtaagatcaggaccatcaaggccggcactctcgagaagctcgtggagaaccttctgacggctttcggagataatgatttcacctatatctctatcttcctaagcacgtatcgaggctttgcatcgaccaaagaagttctggagctgcttctcgatcggtatggcaacctgaccagcccgaattgcgaggaggacggcagtcaaagctccagtgagtcaaagatggtaatccgaaacgccattgcctcaattctgagagcatggctggatcagtgcgctgaagactttcgggagccccctcactttccatgcttacaaaagctgctggattatctaacccgtatgatgcctgggagcgaccctgagcgccgtgcccagaacctcctcgagcagtttcagaaacaggaagtggagaccgacaacggattgccaaatacgatcagtttcagtcttgaggaagaggaggagctggagggaggagaatcggctgagtttacgtgttttagtgaggacttggttgctgaacaactgacgtatatggatgcacagctgtttaaaaaggttgtgccacatcactgtctcgggtgcatttggagccggagagataagaaagagaataagcatcttgccccaaccattagggccacgatcagtcagttcaataccttgaccaaatgtgtggtcagtacgatcctaggggggaaggaacttaaaacccagcagcgggcaaaaatcattgagaagtggatcaatattgcccatgagtgtaggctcctcaaaaatttttcgagtcttagggccatcgtatccgccctgcagtcaaactcgatttacagactgaaaaagacatgggccgcagttcctcgagacaggatgctaatgttcgaggaactatctgacatctttagtgatcacaacaatcacctgacatctagagagttactgatgaaggaggggacttctaagtttgctaatttggattcaagtgttaaagagaatcagaaaagaacccaacgacggttgcagctccagaaggacatgggcgtgatgcagggcaccgtaccttacttagggacattcttaactgaccttacaatgctggacaccgctttgcaggactatatcgaaggaggtttaattaattttgaaaagcgcaggagagagttcgaagttatcgcacaaatcaagctgctgcagagtgcctgtaactcatactgcatgactcctgaccagaaatttatacagtggtttcagagacagcagctgctgacggaggaggagtcttacgccttgagctgcgagatagaggcagccgccgacgcttcaactactagtcctaagccacgtaaaagcatggtcaaaaggctgtctttattgttcctggggtcagatatgatcacttcgcccaccccaaccaaggaacagcccaagtctacggcctccggtagctcaggtgaaagcatggattctgtgagcgtgagcagctgcgaatctaaccactctgaggctgaagagggcagtatcactccaatggacacaccagacgaaccccagaaaaagctgagcgagtcatctagtagttgttcctctatacatagtatggatacaaactccagtgggatgtccagcctgattaacccgctctcttcacccccatcttgtaataacaaccccaaaatccacaagaggagcgtgtccgttacatcaatcaccagcactgtccttccccccgtgtacaatcagcagaacgaagacacctgcattatccggatttcggttgaggataataatggaaatatgtacaagagcatcatgctgacctctcaggacaaaactcccgcagtcatccaaagggcgatgctgaagcacaatttagactccgacccagccgaggagtacgaacttgtccaggtgatctctgaagataaagagctggtaatccctgactctgccaacgttttttatgcaatgaactcccaggtgaactttgatttcatcctacggaaaaagaactccatggaggaacaagttaagctgagatcaagaacctcactgacacttccccgaacggctaagcgaggctgctggtctaacaggcatagcaagatcacactgtag

SEQ ID NO: 131663 - DNA, 2412 bp, Artificial Sequence
  Description of Artificial Sequence: Synthetic coding sequence
atggaagtgaagccggtgggcgagcccacgcaggaggtctctaaattcaaattgtccaccaaggtcgaatcaactggccattggttggtggaggatcatgttcgcatttgggaggtgctgaaaacagaggaatcatcaatccaggactggggcgaggaggtcgaggagggtgcagtgtaccacgtgactttgaaacgagtgcagatccagcaggccgccaataagggcgccagatggcttggggtagaaggtgatcagctcccaccagggcacactgtttcacaatacgagacatgcaagatccggaccattaaagccggaactctagaaaaactggtggagaatctcctcaccgcctttggcgacaatgacttcacatacatctccattttcctgagcacatacagaggctttgcttccaccaaagaagtattagaactgctcctcgatcgatacgggaatctgacaagtcctaattgcgaagaggatggaagtcagtcatctagcgaaagcaaaatggtcatacggaatgccatcgccagtatattaagagcgtggctggatcagtgcgccgaggactttcgcgaacctccacatttcccatgcctgcagaaactcctcgattacctgacaaggatgatgccaggttctgaccctgagagacgtgcacagaatctactggagcaattccagaaacaggaagttgaaacagacaatggccttcccaacaccatatctttttcactagaagaggaggaggaactcgaaggtggggaatctgctgagttcacatgcttttctgaggatcttgtagctgaacagctgacatacatggacgcccaattattcaagaaagtggttccacaccattgcctcgggtgtatctggagtaggagagataaaaaagagaacaaacatttagctcccacaatccgggctactatttctcagtttaacaccttgactaagtgcgtcgtgagcacgatacttgggggcaaggagttaaaaacacagcagcgagccaaaatcattgagaaatggattaatatcgcccacgagtgtcggctgctcaagaatttcagctccttaagggctattgtctcagctttgcagagcaactctatatacaggctgaagaaaacgtgggccgccgtgccccgggaccgcatgctgatgtttgaggaactctctgatatcttttctgaccataacaaccacttgacttctcgagaacttctgatgaaggaaggtaccagcaaattcgccaacctcgacagcagcgtcaaagaaaatcagaagcgcacccagcgccgcttacagttacagaaggacatgggcgttatgcaggggaccgtcccttatctagggacattccttaccgacctaacgatgctggatacagctttacaagattacatcgaggggggcttgattaacttcgaaaaaaggcgtcgcgagttcgaggtaattgcgcagataaaacttcttcagagcgcctgtaactcttattgcatgactccagatcaaaagtttatccaatggttccagagacagcagcttctcacagaggaggagtcatacgctctgtcatgtgaaatcgaggccgccgcggatgccagcacgacttcgcccaaacccaggaagtcaatggtcaagaggctgtcattactttttcttggctctgacatgatcaccagtcctacaccaactaaagagcaaccaaaatcaaccgcatcgggttcctcgggcgagagcatggactccgtgagcgtcagttcttgcgaaagtaatcactctgaagctgaagagggtagcatcacaccaatggacacccccgacgaaccccagaagaagctatcagaatcatcaagttcctgcagtagcattcattcgatggataccaatagcagcggcatgagttccctgatcaaccccctcagttccccgccgtcatgcaacaacaatccgaaaatccataagaggtccgtttcagtgacatctataaccagtactgtgttgccccctgtttacaatcagcagaatgaggatacctgtattattcgaatctcagtggaagacaataacggtaacatgtacaaaagtattatgctgacaagccaggataagaccccagccgtaatccagcgcgcaatgttgaagcacaatctggattcagatcccgctgaggagtatgaactagtccaggtgatctctgaagacaaggagctcgtgattcccgatagtgctaatgttttctatgcgatgaatagccaggtcaattttgattttatattacgaaaaaagaatagcatggaagagcaagtgaagctgaggtcacgcacgagtctgactctgccccggacggccaagcgaggctgttggtccaaccgccacagtaagatcactctgtag

SEQ ID NO: 131664 - DNA, 2301 bp, Artificial Sequence
  Description of Artificial Sequence: Synthetic coding sequence
atggaagtgaagcctgttggagagccgactcaggaggtgtcgaagtttaagctgtctacgaaggtggaaagtacggggcattggttggttgaagatcacgttcggatttgggaggttctcaagacagaggaagtcgagggcgaccaattgccacccggacataccgtgtctcagtacgaaacctgtaagattaggaccataaaggcgggcaccttggagaaactggtggagaacctactcaccgctttcggggacaatgactttacttacatcagcatctttcttagtacatacagagggttcgcttcaacaaaggaggtactggaactcctgctcgataggtatgggaatctgacgtctccaaattgtgaggaggacggctcgcagtcatcatccgagagtaaaatggtgatccgcaatgccatcgcatcaatcctaagagcgtggctagaccagtgtgcggaggattttagagagccgccccacttcccttgcttacagaaacttctcgattatctgacgagaatgatgcctggctcggatccagagcggagagctcagaatctgttagagcagtttcagaagcaggaggttgagactgataatggcctgcctaacacaattagttttagtctcgaggaagaagaggagttagagggaggagaatcagcagagtttacatgtttcagtgaagacttggtggctgaacagctgacatacatggatgcacagctatttaagaaggtcgtgccccaccattgcctcggatgcatttggtctcggcgcgacaagaaggaaaataaacaccttgcccctactatccgcgctacgatttcccaattcaacacgttgacaaagtgcgtcgtcagcactatccttggtgggaaagagctcaagacccagcaacgggctaaaattattgagaagtggattaatatcgctcatgagtgcaggttgcttaagaacttctcttcactgagggctattgtgagcgcactgcagagtaactcaatctacaggttgaagaaaacatgggctgctgtgccacgagatagaatgctgatgtttgaagagctgagtgacatcttctctgatcataataaccatctgacctcaagggagttgctgatgaaagaggggaccagcaaatttgcaaacctagattcttctgttaaagagaatcagaaaagaacccagcgtaggctgcagctgcagaaagacatgggagtcatgcagggtacagtaccgtacctgggcacattcctaactgacctgactatgctggacacagccctgcaagattatatcgagggcggcttgattaacttcgagaagcgtcggagagaattcgaggtgattgcccagatcaagctgttgcagtctgcctgcaactcttattgtatgacccctgatcaaaaattcatacaatggtttcagaggcaacaacttttgactgaggaggaatcttacgccctgagctgcgaaattgaggccgctgccgatgcctccaccacaagccccaaaccccgcaagtcaatggttaaacggttatcgctgctttttttggggtctgacatgattacttctccgactcctactaaggagcagcccaagagcactgcatccggatcatctggcgaatcaatggacagcgtgagcgtgagttcatgcgaaagcaatcatagtgaagcggaggagggaagtatcactcccatggacactccggatgaacctcagaagaagctgtccgagtcgtctagcagttgctcctcaattcatagtatggacactaatagtagcggtatgtcctctcttatcaaccccctgtccagccctccgtcatgcaataacaaccctaagatacacaagcggagcgtaagcgtgacctcaataactagtacggtgttgcccccggtgtataaccagcagaatgaggacacttgcattattcggattagcgtggaagataataatggcaatatgtacaagtctataatgctgacatctcaagacaaaaccccagccgtaattcaacgagctatgctgaaacataacctagacagcgacccagccgaagagtacgaactggtgcaggtgatctccgaggacaaagaactggtaattccagattctgcaaacgttttctatgcgatgaatagccaagtgaattttgacttcatccttaggaaaaaaaattccatggaggagcaagtcaagctccgcagccgaactagtctgacattgcccaggacagctaaacgcggctgttggagcaatcgccactcaaaaattactctgtag

SEQ ID NO: 131665 - DNA, 2220 bp, Artificial Sequence
  Description of Artificial Sequence: Synthetic coding sequence
atgaagttgctgtggcaggccaaaatgagtagcattcaagactggggcgaggaagtcgaggaaggagccgtgtaccatgtaactctgaagagagtccagattcaacaggccgcaaataagggagctcgatggctcggtgttgagggcgatcagcttccaccgggacatacagtctctcaatatgagacatgtaaaatacgcactattaaagcgggcaccctggaaaagctcgtcgagaatctgcttaccgccttcggggacaatgactttacctacataagtatcttcctgtccacctacagggggtttgcctccaccaaggaggtgctggaactgctgctcgaccggtacggaaacttgacgagcccgaattgtgaggaagacggcagccagtcctcgtccgagagcaagatggtgattaggaatgccatagcatctattctacgcgcttggctggaccagtgcgctgaagactttagagaacctccgcacttcccctgcttgcagaaattgctagattacctgaccaggatgatgcctggatctgaccctgagagaagggcccagaatctgttggaacagttccagaaacaggaagtggagactgataacggtctgcccaacacaataagttttagcttggaggaggaggaggaactggaggggggggaaagtgcggagtttacctgcttctccgaagacctggttgcagagcaactgacttatatggacgctcagctgtttaagaaggttgtcccccatcactgtctgggctgcatttggagccggcgtgacaagaaagagaacaaacatctggcccccaccatacgcgctactatctcacagtttaataccctgacaaagtgtgttgtcagcactattttaggaggaaaggagctgaaaacccagcagagagcgaagattatcgagaaatggattaatatcgcacatgagtgccggctgctcaaaaatttcagctcacttcgcgctatagtatccgcgctgcagtctaactctatttaccgcctgaaaaagacctgggcggcggttcccagagacagaatgctgatgtttgaagagttaagcgatatattcagcgatcacaacaatcacctcacatcacgcgagttgctaatgaaagaagggactagcaagttcgctaacctggattcatccgtgaaggagaatcagaagagaacgcagcgccgtctccagcttcaaaaggatatgggaggactcattaacttcgaaaagcgacgcagggagttcgaggtaatagcccagataaagctgctgcagtccgcttgtaatagttactgtatgaccccagaccagaaattcatccagtggttccagcgccagcagcttctgactgaagaggaaagctacgccttaagctgcgaaattgaagctgctgccgatgcctctacgacttcaccaaaacctcggaagagtatggttaagcggctgagcctcctgttcctcggatccgacatgataacatcacccacccctaccaaagaacaacccaagagcactgcttctgggtcctcgggggaaagtatggactccgtgtccgtgagtagctgcgaatcgaatcactccgaggcagaagagggttccattacaccgatggatacccccgatgagcctcagaagaaattgtctgagtccagtagcagctgttcaagcatccacagtatggatacgaattcctccgggatgtcaagtctgattaatcccctctcgtcaccccctagctgcaataacaatcctaagattcataagcggagtgtaagcgtgacgagcatcacgtcgactgttcttcctcctgtgtacaatcagcaaaacgaagatacctgtattatacgcatcagtgttgaagataataacggaaatatgtacaaatccattatgctaacgtctcaggacaaaacaccggcagtaatacagcgggcgatgctgaaacacaatcttgattccgacccagctgaggaatatgagctggtgcaggtgatcagcgaagataaggaacttgtgatacctgactccgctaacgttttctacgccatgaatagtcaggtcaacttcgatttcatcctacgcaaaaaaaattcaatggaggaacaggtgaaactgagaagcagaacctcactaactttgccccggaccgctaagcggggatgctggtcaaatcggcattccaagatcaccctgtag

SEQ ID NO: 131666 - DNA, 1173 bp, Artificial Sequence
  Description of Artificial Sequence: Synthetic coding sequence
atgggtagcttcaaagatcggggcgatggactacccaacaccatctcctttagcttggaggaagaagaagaactggaaggcggagaaagcgccgagttcacctgcttctccgaggatttagtcgccgaacaacttacctatatggacgcgcagctctttaagaaggtggtgccacaccactgtttaggatgcatctggagcaggcgggacaagaaagagaataaacacctggcacccactatccgggctactatttctcagtttaatactttaactaagtgcgttgtgtctaccatcctgggaggaaaagagttgaagactcagcagagagcaaaaatcatcgaaaaatggattaacatcgcacatgagtgccgcctgctgaagaacttctcgagtctcagggccattgtgagtgctctgcagtcgaatagcatatataggcttaaaaagacatgggccgccgtgcccagggatcgcatgctgatgtttgaggagctcagtgacatatttagcgaccacaacaaccacctcacatcaagggaacttctgatgaaggagggaaccagcaaatttgccaatctggactcttccgtgaaggagaatcagaagcgcacacaacggcggctccagttacagaaagatatgggtgtaatgcaaggaactgtgccatacctgggcaccttcctgactgacctaaccatgttagacaccgctttacaggattacattgagggcggcctgataaactttgaaaagaggagaagggagttcgaggtaatcgcccaaatcaaattgctgcagtcagcctgtaactcctactgcatgacacctgatcagaaattcattcaatggtttcagcgacaacagttgttgaccgaggaagagtcctacgctctcagctgcgaaattgaggcagctgctgacgccagcacaacaagccctaagcctagaaaatccatggtcaagaggctgtctctgctattccttggatccgacatgatcacttctcctacacctacgaaggaacaaccaaaatccactgcatcaggcagctctggcgaatccatggactcagtgtctgtgagcagctgcgaatctaatcactctgaagcagaggaaggctcgatcacccctatggacacaccggacgagcctcagaagaaggccctctag

SEQ ID NO: 131667 - DNA, 1422 bp, Artificial Sequence
  Description of Artificial Sequence: Synthetic coding sequence
atgcggaaattgttaaccaacctacccgcagccgctgtcctcagcgcccaggtatactccgccgtactacaggggctgtgggaagagaacgtgtgcggcactccagggcggacaagagtctgtactgccctgctgtacggccaggtttgcccgtttcaggacagcactgacgggctccgaactatcactagtatcctatttaattggccaccagaaaatacgtctgtctactaccaaccacctcagcggtctagcttccggattaaactagcgttccggaatctcagttggcctggtttgggtctcgaagaccaccaggagattgtgctgggtcaattagttcttccagaaccaaacgaggctaaacctgacgatccggccccgcggccaggtcagcacgccctgaccatgcccgctctggagcctgccccgccgctgttagccgatctggggcctgcactggaacccgagtctccagccgccttaggcccccctggatacctgcattcggcccctgggcccgcccccgcccccggggagggccctccgcctgggactgtgctagaacctcagagcgctccagagtcatcatgtccttgccggggcagcgtgaagaaccagccatccgaggagctcccggatatgaccacttttccccccaggttgctggctgaacaactaacactgatggacgctgagctgtttaaaaaggtggtgctgcacgagtgccttgggtgcatctggggccagggacacttaaaaggaaatgaacacatggcgccaacagtccgggccactatcgctcatttcaaccggttgacgaactgtattaccacctcctgcctgggagatcactccatgagagctcgggaccgggccagagtcgtcgagcattggatcaaagtggctagagagtgcctcagtctgaacaactttagcagcgtgcatgtgatcgtctccgccctttgtagcaacccaattgggcaactgcataagacctgggctggcgtttctagtaaatctatgaaagagctgaaagagttatgcaagaaggataccgccgtcaagagggacctattgattaaggctggcagttttaaggtcgccactcaggagcgaaacccacagcgggttcaaatgaggctccgtcgacagaaaaaaggcgtcgtaccattcctgggcgacttcttaactgagttgcaacgcctagattccgccatccccgacgatctggacgggaacacaaacaagagatccaaagaagttagggtgttgcaagagatgcagctgcttcaggtggccgcaatgaattaccgcctccggccccttgagaaatttgttacctacttcacccggatggagcagctcagcgacaaagaaagctataaactgagctgccagctggaaccggagaatccttag

SEQ ID NO: 131668 - DNA, 1743 bp, Artificial Sequence
  Description of Artificial Sequence: Synthetic coding sequence
atgcgcaagctgctgaccaatttgcccgccgccgccgtgcttagcgctcaagtctattccgctgtcctgcaagggctctgggaggagaatgtgtgcggcacgcctgggcgaacccgggtgtgcaccgcgttgttatatggccaagtatgcccctttcaggactccacggatggactcagaaccataaccagcatcctgttcaattggcccccagagaacacttcagtctattatcagccaccccagcgctcgagtttcagaatcaaactggccttccgcaacctatcctggcctgggctaggactcgaggatcatcaggagatcgtactaggacagctcgttttgcccgaaccgaatgaggccaaacctgacgatcccgcaccaagaccaggtcaacacgccctgacaatgcctgcacttgagcccgcccctcccctgctggcagacctgggacccgctctggagccagaaagtcctgccgctttgggccctcccggctatctccactctgctcccggtcccgcgcccgcccccggcgagggtccaccgccagggactgtactggagccccagagcgcgcccgagagcagttgtccctgccgtggctccgttaaaaaccaaccttcagaagaacttccagacatgacaacatttcccccgaggctgctggcagaacagttaactctgatggatgcagagttgttcaagaaagttgtccttcatgaatgcttgggctgtatctggggccaggggcacctaaaaggaaacgaacacatggcgccgacagtgagagccactattgcacactttaaccggctgacgaactgcattacaacgtcatgtctcggtgatcacagcatgcgcgccagggacagagccagagtggtcgagcattggatcaaggtcgcgagggaatgtctctctctgaataactttagctcagtccacgttattgtatcagccttgtgttcaaatcccataggccagttgcacaaaacctgggcaggtgtttcctcaaagtcaatgaaagaacttaaggaactgtgtaaaaaagacacggctgtgaagcgcgatctgctgatcaaggcgggcagcttcaaagtggcgactcaggagcgcaacccacagcgggttcagatgagactccgaagacagaagaagggcgttgtaccattcctgggcgatttcttaacagaactgcagcgattggatagtgccatccccgatgacctcgacggaaacacaaacaaacgttccaaggaagtacgggtactccaggaaatgcaacttttgcaggtggccgccatgaactatcgcttacgaccactggagaagttcgtcacctactttacaaggatggagcagttatcggacaaggagcgctggggattcacaatgatgtcaaggatcgtctctaatagttggccccaggccatccacccaccacagccccccaaagtcctcacactacagttgcaggccgtcttgcctgcaggggcccgcaagcctgtcggctggcagcacccagccgttgccggtaatccacccgggtgctggcccgaacataggctctgcacgatcccccaccctgatagaaggcatcagggaacaacctctaggcgcttagctgcccagctccacttggcgctggatccacaccaccagctcctgctattggcccggattagaccttgggatttctgcgaaagtggtggacggcccttttatgtctacttcctgtag

SEQ ID NO: 131669 - DNA, 1968 bp, Artificial Sequence
  Description of Artificial Sequence: Synthetic coding sequence
atgaccgagtgctttcttcctcccacatcgagtccgtccgaacatcgccgcgtcgagcatggtagcggcctgactcgcactccatcctctgaagaaatctcccccaccaaatttcctggtctgtatagaaccggagagcctagtcctcctcacgacattctgcatgaaccccctgacgtggtatctgatgatgagaaggaccatgggaaaaaaaaagggaaattcaagaagaaggaaaaacggacagagggttatgctgcgtttcaggaggatagtagcggagacgaagccgagtctccatctaaaatgaaaagatccaaaggtattcacgtgtttaagaagccgtccttctcgaaaaaaaaagagaaggatttcaaaatcaaagaaaagcccaaagaggaaaagcataaagaggagaaacataaggaggagaaacataaagaaaaaaaatccaaggacctaactgctgccgacgtggtgaaacagtggaaagaaaagaagaagaaaaaaaagcctattcaggaaccagaagtgccacagatcgatgtccccaacttgaaacctatcttcgggattcccctcgcagacgctgtggagcgtacaatgatgtacgatggaatacgactgccagcagtcttccgggagtgtattgactacgtggagaaatacgggatgaaatgcgaaggcatctaccgggtgtcggggataaaatccaaagtggacgagcttaaggccgcatacgaccgtgaagagtctaccaacctggaggattacgaaccaaacacagtggctagcctgctgaaacagtacctccgggacctgcctgaaaatctgctcaccaaggagcttatgccgcgcttcgaggaagcatgtggaagaacgactgaaactgagaaagtacaggaattccaacgattactgaaagaactgcctgaatgtaattacttgctgatctcttggctgattgtgcacatggaccacgttatcgccaaggagctggagacaaaaatgaatatccagaacatctcaattgtgctgtctccaactgttcagatctcgaatcgggtgttatatgtgttctttacccatgttcaggagctgtttgggaacgttgtgttgaagcaagtcatgaagcccctaagatggtccaacatggctacaatgcccacattaccagagacacaggctggcataaaggaagagatacggagacaggaatttctactcaattgcctacaccgggatttgcaaggaggcatcaaggatctgagtaaagaggagagactgtgggaagtccaaagaatactcacagcactgaagagaaaactaagggaggccaaaagacaggaatgcgagaccaagatagcccaggagatcgcctctctgagcaaagaggatgtgagtaaagaagaaatgaatgaaaatgaggaggtaatcaacatactgctggcacaagaaaacgagattctgacagagcaagaggagttgctcgctatggaacagtttcttcggaggcagattgcatccgagaaggaagagattgagcggcttagagccgagatagctgagattcagtctagacagcagcatgggaggtcggaaacggaagagtattctagtgagtctgagtctgagagtgaggacgaggaggaactgcagataattctggaggatcttcagcgccagaatgaggagctagaaatcaagaataatcatttgaatcaagcaatccacgaggagcgcgaagctattattgaattgcgagtgcagctgcgactgctgcagatgcagcgtgccaaagccgaacaacaagcgcaagaagacgaggagcctgagtggaggggtggggccgtgcagccccccagagacggagtattggagccgaaggccgccaaggaacaacctaaagccggtaaagaaccagcaaagccatcaccatctcgcgaccgcaaggaaacctctatttag

SEQ ID NO: 131670 - DNA, 1968 bp, Artificial Sequence
  Description of Artificial Sequence: Synthetic coding sequence
atgacagagtgcttccttccacccacttcttcacccagtgagcatcgtcgcgtagaacacgggagtggcttaacccgaactccatcatctgaggaaattagcccaactaagttccctggactttaccgaactggagagccatcccccccgcatgacatcttacacgaaccgcccgacgtggtctctgacgacgagaaagaccacggcaaaaagaagggtaagttcaagaagaaagagaagcggacagagggatacgcagcattccaggaggacagcagtggagatgaagccgaaagtcctagcaagatgaaaaggtccaaagggatccacgtctttaagaagccctcatttagcaagaagaaagaaaaagacttcaaaatcaaagaaaagcccaaggaggaaaaacataaggaggagaaacataaggaggagaaacacaaggagaagaaaagcaaggaccttacagccgcagacgttgtgaagcagtggaaggaaaaaaagaagaaaaagaagcctatccaagagcccgaggtaccccagatagacgttcccaatctgaagccaatcttcggcattcctcttgcggacgctgtggagcggaccatgatgtatgatggaatccgcttacctgccgtatttagagaatgtattgactatgtggagaagtatgggatgaaatgcgaagggatttaccgggtgagcggcataaagtcgaaagtggatgagcttaaggcagcctatgatcgagaagagtctacaaatctggaagattatgagccaaacaccgtcgcctcacttctcaaacagtacctccgagatcttccggaaaatttattgacaaaggagctaatgccccgcttcgaagaagcctgtggacggacaacagaaaccgaaaaagttcaggaattccagagactgctgaaagaactgccagagtgcaattatttgctgataagctggctgattgtacacatggatcacgttattgccaaggaactagagacaaagatgaatatacagaatatctcaattgtgctgtctccaactgtgcagatctccaaccgtgtcttatacgtgttcttcactcatgtccaggagctgttcggcaacgtggtgttgaaacaggtgatgaaacctctgcgatggtccaacatggccacaatgccgacactccccgagacccaagccgggatcaaagaggaaattagacggcaagagttcctgcttaattgtctacatcgggacttgcaaggaggcatcaaggacttgagcaaagaggaaagactctgggaggtgcagcgcatcctaaccgctctgaaaaggaaacttcgggaagcgaagcggcaggaatgcgagactaaaattgcacaggaaatagcgtcgctgtctaaggaggacgtgtctaaggaggaaatgaacgaaaacgaagaggtcatcaacattttgctggctcaggagaatgaaatactgactgagcaggaggaactgctggccatggaacagttcttaaggcggcagattgcctctgagaaggaggagattgaacggctgagggccgaaattgctgaaatccagagccgacagcagcatggtcgttccgagaccgaagaatatagtagtgagtccgaatcagaatccgaggatgaggaggagcttcagataatcctggaagatctccagcgtcagaacgaggaactcgagataaagaataaccacctcaaccaggctatccacgaggaacgagaggcaattatcgaactgagagtccagctcaggcttctccaaatgcagcgcgctaaggccgagcagcaggcccaggaggacgaagagccggagtggcggggcggagctgtccagccccctcgcgacggcgtgctggagccaaaagctgccaaagagcagccaaaggcggggaaggagcccgccaagccatcacctagtcgcgaccggaaggaaacctccatttag

SEQ ID NO: 131671 - DNA, 1044 bp, Artificial Sequence
  Description of Artificial Sequence: Synthetic coding sequence
atgacggagtgcttcctgccccccaccagctctccttcagagcaccgacgggttgagcacggcagtggcctcacccgcaccccttcatccgaagagatcagcccaacaaaattccctgggctgtaccgaactggtgagccttcaccacctcacgatatcctgcacgaacctccagatgttgtgtcagatgacgagaaagatcatggaaaaaagaaaggaaagtttaagaagaaagagaaaaggaccgaaggctacgcggcgttccaagaggactcatccggcgacgaggctgaaagcccctctaagatgaagcggagcaagggcatacatgtgttcaaaaagccttcgttcagcaaaaagaaggagaaggacttcaaaatcaaagaaaagcctaaggaggagaaacacaaagaagagaaacacaaggaagaaaaacacaaggaaaaaaaatctaaggaccttactgccgcggacgtggttaagcagtggaaagaaaagaagaaaaaaaaaaaaccaatccaagagcccgaagttccccaaattgacgtgccaaaccttaaaccaattttcggtatcccgcttgcagacgcagtggagaggaccatgatgtatgacggtatccggctgccagcagtctttagagaatgcatagattatgtggagaagtacgggatgaaatgcgaggggatttaccgcgtctcaggcatcaagtccaaggtagacgagctgaaggccgcttatgaccgggaggaaagcacaaatttggaggactacgagcctaatactgtggcttcacttctgaagcagtaccttcgagatttgcctgagaatctcttaactaaggagctgatgcccagatttgaggaggcgtgtggaaggacaactgaaacggagaaggtgcagagctcaggggaggaggccgcccggagctgtcagttcctcactgccgggaccagcaagggacttcttactggcctagttaagggttcccaccttggtctcgtgcatcctcagcgcatgctgtttaagcctgaaatcttttag

SEQ ID NO: 131672 - DNA, 1980 bp, Artificial Sequence
  Description of Artificial Sequence: Synthetic coding sequence
atggaagccgccgcagccgccgctgctgcagctgccgccgcagccgcagccggcggaggctgtggaagcggaccacccccactcttgctttcagagggagagcaacagtgctattctgagctgttcgcacgttgtgctggcgctgctgggggcggtccgggcagcggtccacctgaagctgcccgagtcgctccgggcacagcgacagctgctgccggtccggtcgctgatctcttcagggcttcccaattaccagctgagaccctgcaccagataaccgagctctgtggcgcaaaaagggtggggtatttcggcccaacacaattttacattgccctgaagctgattgcggcggcacaaagcggtctgcctgtgcgaatcgagtcaataaaatgtgaacttccactgcctcggttcatgatgtctaaaaatgacggagaaatcagattcggcaacccagctgagctacacggtaccaaggtccagatcccgtacttaacaactgaaaagaatagcttcaaacgaatggacgacgaggacaagcaagagacccagtctcctaccatgtctcctttggcctcacccccttccagccccccccactaccagagagttccattgtcccacggatatagtaaacttagatctagcgcggagcagatgcacccggcgccttacgaggctagacagcccctcgtgcaacctgaggggagtagttctggcggcccgggtacaaagcctctgcggcatcaggcctctctgatcagaagctttagcgtagagagagagctccaggataactctagctatcccgacgaaccttggaggattaccgaggagcaacgggagtactacgtaaaccaattcagaagcctgcagcctgacccctcttctttcattagcggctcagttgcgaaaaacttctttacgaagagcaagctgagtatcccagaactgtcctacatctgggagctcagtgacgccgattgtgatggggccttgacccttccggagttctgtgctgcttttcacctgatcgtggccagaaagaatggataccctctcccagagggtctgcctcctactttgcagcccgaataccttcaagccgccttcccaaagcccaaatgggactgccagttgttcgactcgtatagtgagtccctgccggctaaccaacagcctagagacttaaaccgaatggagaagaccagcgtcaaagatatggccgatttgcccgtgcctaatcaggatgtaactagtgacgacaaacaggctctgaagtcaaccattaatgaggctctgcctaaagacgtcagcgaagatccggcaacacccaaggactccaactcattaaaagcacggcctaggagtcgctcatactcctcgactagcatcgaggaagctatgaagcggggggaggacccccccacccctccacctcggcctcaaaagacccactctagagcctcaagccttgacctgaataaagtgtttcagccttccgtcccggccactaaatcaggcttactgcctcctcctccagctctacctccacgtccctgtccctcccagagcgaacaggtgtcggaggcggaactgttaccgcagcttagccgcgccccctctcaggcagccgagtcctcccctgcaaaaaaagacgtgctttacagccagccaccctctaagcctattcggaggaagttcagacccgaaaatcaagctacggaaaaccaggagccctcgaccgctgcatccggcccagcctccgcagcgaccatgaagcctcatccaacagtccaaaaacaatcatccaaacagaagaaagccattcaaacggccatcaggaagaataaggaagctaatgccgttttagcacgccttaactccgaacttcagcaacagcttaaagaggttcaccaggagagaatcgctctggagaatcagttggaacagctacgccccgttactgttctctag

SEQ ID NO: 131673 - DNA, 1983 bp, Artificial Sequence
  Description of Artificial Sequence: Synthetic coding sequence
atggaagctgcagcagcagcagctgccgctgcggccgccgctgctgccgccgggggcgggtgcggttcaggtcccccacccctgttattgagtgagggagaacaacagtgctactccgagctgtttgctaggtgtgccggcgcagctggaggaggccctgggtccggtcctccggaagccgcccgagtggccccaggcacagccaccgcagcggcgggacccgtcgccgacttatttagggccagtcagttaccagctgagacattgcatcaaattacggaactgtgtggcgcaaaaagagtcgggtattttggccctacccagttttacatcgctctcaaacttatcgctgcagcccagtctggactccctgtcaggatcgagagtattaagtgcgaacttcctctccctaggtttatgatgtccaagaatgacggcgagattcggtttggtaatcccgctgagttgcacggcaccaaagtgcaaattccttatctgacaaccgagaaaaattctttcaagcgcatggatgatgaggataaacagcaagaaacccagtctcccacaatgtcacctctggccagtccaccctcatcgccacctcattaccagagagttccactgtcccacgggtacagcaagctgcgcagcagcgccgaacaaatgcaccctgccccatacgaggctcgccagcctttagtccagcctgaaggctcatcctctggagggccaggcacaaaaccactgcgccatcaggcctccctgatccgcagttttagtgtggagagggaacttcaggataactcctcctacccagacgaaccatggagaatcaccgaggagcagcgggaatactacgtaaatcagttcagaagccttcagcccgacccttctagctttatttcaggatcagtggccaaaaactttttcaccaagtctaaactctccattcccgagctctcatacatatgggagctgtccgacgcagactgtgacggcgcactgacgctgcccgagttctgcgctgcttttcatctgatcgtagccaggaaaaatggttatcctctgccggaaggcctgcctcccaccctacagcctgagtacctccaggccgccttcccgaagccgaagtgggattgtcagttgtttgattcctactctgaatcactgccagctaaccaacagccccgggacctgaatcgaatggagaagaccagtgtgaaggacatggcagacctgcctgttccaaatcaggatgtcacatccgacgataagcaggccttgaagagtacaatcaatgaagccttgccaaaagacgtcagcgaggaccctgctacccctaaggactcgaactcactgaaggctagacccagaagccgctcatactcctccactagcatcgaagaagctatgaagcgcggcgaagaccccccaactcccccgcccagaccacaaaagacccattctcgtgcgagcagcttggacttgaataaagtgtttcagccatcggttccggcgactaaaagtggtctgcttccacccccacctgccttgccccctcgcccatgtccgagccagtcggaacaggtaagtgaagcagagctgcttccacagctgtctagagcgccatcacaggctgccgaaagcagcccagcaaaaaaggatgtgctctacagtcaaccacctagcaagccaattcgtagaaagtttaggcctgagaaccaggcaacagaaaaccaggagccttctacggcagcttctggtcccgcaagcgcagctacaatgaaaccccaccccacagttcagaagcagagttctaagcaaaagaaagcaattcagaccgcaattcgcaagaacaaggaggctaacgccgtacttgcgcgacttaacagcgagttgcagcagcaactgaaggaagtgcatcaggagcgcatcgctttggagaaccaactagaacagctgcggcctgtcactgtgctttag

SEQ ID NO: 131674 - DNA, 1824 bp, Artificial Sequence
  Description of Artificial Sequence: Synthetic coding sequence
atggaagctgccgctgccgccgcggccgctgcagccgccgctgccgccgctggtggcgggtgcgggtcgggtcctccccctctcctgttaagtgaaggagagcagcagtgttacagcgagctgtttgcccggtgtgccggtgctgccggaggcggaccagggtcgggccccccggaagccgcacgcgtggcgcctggaaccgccacagcggccgccggacccgtagccgacctgttccgggcctcccagttgccagctgaaaccttacatcagatcacagagttgtgtggggctaaacgagtcggctattttggaccaacgcaattctacatcgcgctgaagctcatcgccgccgcccagtctggcctgccagtcagaatcgagagcataaaatgtgagctgcctctccctcgttttatgatgtctaaaaacgacggggagatcagattcggaaatccagctgaactacatggtacgaaagttcagattccttatctgaccacagagaaaaacagctttaagaggatggatgatgaggataagcagcaagagactcagagccccacgatgagccccttggcaagtccaccctcatctccacctcactaccagagggtccccctctctcatgggtatagcaaacttagaagttcagctgaacagatgcatccagccccttacgaagcccggcaacccttggttcaacctgagggttcctccagcggtggccctggaactaaaccactgcggcatcaggccagcctgatcagaagcttttctgttgaacgagagctgcaggacaactccagctaccctgatgaaccctggcgcattacagaggagcagcgcgagtattacgtaaatcaattcaggtccctgcagccagaccctagcagtttcattagcgggagcgtggcaaagaactttttcactaagtctaagctgagcattcctgagctctcttacatctgggagctgagtgatgcagactgtgatggagcccttactttaccagaattttgcgctgcttttcacctcatcgttgcccgaaagaatggatatccactccccgagggactccccccaaccctacagcccgaatatttgcaggccgcctttccaaagcctaaatgggattgtcagctgtttgatagctactctgaatcattgcccgcgaaccagcagcctcgcgatttaaaccgcatggagaagaccagcgtaaaggacatggcagatcttccggtgccgaatcaggatgttaccagcgatgacaagcaagctcttaagtcgactataaacgaagccttaccgaaggacgtctcagaggacccagctactcccaaggactccaattccctcaaagcacgacctcgctcgcgttcatactcttcaacttctatagaagaagctatgaagcggggggaagacccacctactccccctccaaggccgcagaaaacccattctcgagctagttccctcgacctaaataaggtcttccaacctagtgtccctgctacaaaatcagggctacttcctccaccccccgccctgcccccgcggccatgtccgtctcagtcagaacaggtcagtgaggccgagctgctgccacaattgagtcgggcaccctcacaagccgcagagtcttcaccggctaaaaaggacgtcttgtactcccagccgcctagtaagcctattaggagaaaatttcgcccggtgtgcggcatccaacccctgattagtattgagctgcgagccttcaggacaagtcgacacctgttcaatgtgtccctggtgcattggcaggcgttgtctatagcttag

SEQ ID NO: 131675 - DNA, 1380 bp, Artificial Sequence
  Description of Artificial Sequence: Synthetic coding sequence
atgatgagcaagaatgatggcgagatccgtttcgggaacccggctgagctccatggcacgaaggtacagatcccatacctcaccactgagaaaaactcttttaagagaatggatgatgaagataaacaggagacccagagcccaactatgagccccctggcctcaccacctagctcgcctcctcactaccagagggttcccctgtcacacggctactccaagttgagaagcagcgcggagcagatgcaccccgccccatatgaggcacgccagccactagtgcagcctgagggaagtagctcaggtgggccagggaccaagccgcttagacatcaggcctctctgatccgcagtttttctgtagaacgtgagctgcaggacaacagctcctaccccgatgaaccatggcggataaccgaggagcagcgcgaatattacgtgaaccagttcaggtcgctccaaccagacccctcatccttcatctctggctctgtggccaagaacttcttcacgaagagtaagttaagcatcccggagctgagctacatttgggagttgtcggatgccgactgtgatggggccctgacacttccagagttttgtgccgcattccacctgatcgtagccagaaagaatggctacccattgccagaagggctgcccccaacccttcagccggaatatctccaggccgctttcccaaagcctaagtgggattgccagctgttcgactcttacagcgagagcctgccggcaaaccaacagccccgtgatctgaatcggatggagaagacatccgttaaggatatggccgacctacccgtgcctaaccaggatgtgacttctgatgacaaacaggcactgaagagtactatcaacgaggctctcccaaaagacgttagcgaggacccagctacgaaatccggactgctccccccccctcctgctctacctcccagaccatgcccttctcagagtgagcaggtgagcgaggcagagctgctaccccaattgtctcgggcaccatcccaggccgctgaatcctcacccgccaagaaggacgtgttatactcacaacctcccagcaagccaattcgacggaaatttaggccagagaaccaggctacagagaatcaagaaccatccacagcagcaagcggtccagcttcagccgctacaatgaagccacacccaaccgtgcagaagcagtcgtcaaagcagaaaaaggcaatccagaccgccatcagaaagaacaaggaggcaaatgcggtcctggcaaggctgaattcagaactgcagcaacagctgaaagaagttcaccaagaacgcatcgcgctagaaaaccagctggaacagctccgtcctgtaaccgttctgtag

SEQ ID NO: 131676 - DNA, 1863 bp, Artificial Sequence
  Description of Artificial Sequence: Synthetic coding sequence
atggcagctgctactgcggaccctggagccggaaatccccagccaggtgattccagtggcggtggcgctggcgggggtttgccctcccccggcgagcaggagttaagcaggaggcttcagcgtttgtacccagctgtaaaccagcaggagacccccctgcccaggagctggtcaccaaaagacaagtacaactatatagggttgagccagggcaacttacgcgtgcactataaggggcacgggaaaaatcacaaagacgctgccagcgtccgtgccactcatccaatccccgccgcatgcggtatctattatttcgaggtcaagattgtatccaaggggagggacggatatatggggatcggcctgagtgcccagggcgtcaacatgaatcggctgccgggctgggataaacattcatatggctaccacggagacgacggccattcattttgttctagcgggactggccagccctacggccccactttcacaactggtgacgtcattggctgttgcgtgaacctcataaacggcacatgtttctacactaagaatggccactccctgggcattgcatttaccgatttgccagccaatctttatccgaccgtgggcctccagactcctggcgaaatcgtggacgccaatttcgggcagcaacctttcctcttcgacatcgaggactacatgcgggaatggagagctaaagtccagggaactgtccactgttttcctatatctgcgcggctaggcgaatggcaggctgtgctccagaatatggtgtcctcctatctggtccatcacggatactgcgcaacagccactgcctttgcccggatgaccgaaacacctatacaggaagagcaggccagcatcaaaaatcgacagaaaatccagaaacttgtgttggagggacgagttggagaggccattgaaaccacccaacggttttaccctggcctgttagagcacaacccaaatctgctcttcatgctgaaatgcaggcagttcgtggagatggtgaacgggaccgatagcgaagtccggtctttatcttcaaggtctcctaaatcccaagattcctaccccggtagcccaagtctgtctccaaggcacggccctagctcatcccatatgcacaacaccggagcagattcacccagttgttccaatggggtcgcatctactaagagcaaacagaatcacagcaagtaccccgctccctccagcagctctagctccagcagctctagttcatcctccagcccgtcctcagtgaactacagcgagtccaattctacggactcgaccaagagtcagcaccacagctctacttctaaccaggagacatctgacagcgaaatggaaatggaggcggagcattaccctaatggagtcttgggctctatgagcacccgaatcgtgaatggagcatacaaacatgaagacctgcagactgacgagagtagcatggatgaccgccacccacgccggcagctttgtggcgggaaccaggcagccactgaaagaatcatcttgttcggacgggaactgcaggccctgagtgaacagcttgggcgtgaatatggaaagaatttagctcacacagagatgctgcaggatgcattctctctacttgcttatagtgatccctggtcttgcccagtggggcagcagttggatccaatccagagagagccagtatgtgctgccctgaacagtgctattctcgagtctcagaacctccctaagcagccccccctgatgctggccctggggcaggcctccgagtgcctcaggctgatggcaagagctgggttagggagctgttcatttgcgcgtgttgacgactacctacactag

SEQ ID NO: 131677 - DNA, 1602 bp, Artificial Sequence
  Description of Artificial Sequence: Synthetic coding sequence
atgggcatagggctctcggcccagggcgtcaatatgaatcggttacccggttgggataaacattcctatggttatcacggcgacgacgggcacagcttttgttcgtccggaaccggacaaccctatggaccaacctttacaaccggtgatgtgatcggttgttgtgtaaatttaattaatggcacctgcttctacaccaaaaacggtcactctctggggattgcgtttaccgacctccctgctaacctgtatcccactgtcggcctgcagacccctggggaaattgtggacgctaatttcggccaacagccttttctcttcgatattgaggactacatgagagagtggcgtgctaaagtccaagggaccgtgcattgcttcccgattagtgcccggctaggggaatggcaggctgttctccagaacatggtcagttcatatctggttcaccatggatactgcgccaccgctacagcatttgcaagaatgactgagacacccatacaggaggaacaagcctcgattaagaacagacaaaaaattcagaaactggtgttagaaggccgtgttggcgaagctatagagaccactcagagattctatcccggcctgctggagcacaatcctaacctccttttcatgctaaaatgcagacagttcgttgaaatggtcaacggtactgattctgaggtgagatccctatcctccagaagccctaagagtcaggactcgtatcccggctccccctctctcagtccgagacacgggccttccagcagtcacatgcacaatactggagcagattccccaagttgctcaaacggggtcgccagcaccaagtccaagcaaaatcattccaagtatcccgctcctagttcttcatcgtcgtcaagtagctctagtagctcttcaagtcctagctcagtaaactactccgagagtaattcaacggactccactaaatctcagcaccacagttcaacatctaatcaagagacttccaatccttggctgcagcttgagcgtcggccaaatcaggcagcacccaccaccccacccggcccaacacccacatccactccaccccactctgactcagagatggaaatggaagcggagcactaccccaatggagtgcttggctccatgtcaactagaatcgttaatggggcctacaaacatgaggacttacaaaccgacgagagcagtatggacgaccggcacccaagacgccagctttgcggaggaaatcaagctgccaccgagagaatcatcctgtttggccgagaacttcaggcgctctcagagcagctcgggcgcgaatacggaaagaacttggctcatacggagatgctgcaggatgccttctcattactcgcttactcagatccatggagctgtccagtgggccagcagctagacccaatccagcgggagcccgtgtgcgccgccctcaactctgctattctcgagagtcagaacctccccaagcagcctccactgatgctggctctcggccaggcctccgaatgcctgcggctaatggctagagccggattgggcagctgctcattcgctagggtggatgactatctccactag

SEQ ID NO: 131678 - DNA, 540 bp, Artificial Sequence
  Description of Artificial Sequence: Synthetic coding sequence
atgggatgggacaagcactcctacggttatcatggggacgatggccattctttttgcagcagtgggaccggacagccatacggccccacctttacaactggagacgtcattggttgctgtgtgaatttgatcaatgggacgtgtttttataccaagaacggtcattcactgggaattgccttcacggatttgcctgccaacttgtatcctactgtggggctgcaaaccccaggcgaaatcgtagacgcgaacttcggccagcaacctttcctgtttgatatcgaagattatatgcgcgagtggcgggccaaagtgcaaggcaccgtgcattgcttcccaatcagtgcccgcctcggagaatggcaggccgtgctgcagaacatggtgagttcctaccttgttcaccatgggtactgtgccactgccacagccttcgcaaggatgacagagacacccatccaggaggaacaggcatctatcaaaaatcgccaaagtaaggtttactctacctttcccttcccgttcctcacctgcccttag

SEQ ID NO: 131679 - DNA, 1785 bp, Artificial Sequence
  Description of Artificial Sequence: Synthetic coding sequence
atggctgccgcaactgcagaccctggggccggcaatccgcagcccggcgattcaagtggagggggggccggcggtggattgccgtcccctggggagcaggaactgtctcgccggctgcagaggttatacccggcagttaatcagcaggaaacccctctgccacggtcctggtcacccaaagacaaatacaattacattggacttagccagggtaacctgcgtgttcattacaagggacacggaaagaatcataaagacgctgcctccgtacgagcaacccaccccatccctgcggcatgcggcatctattactttgaggttaagatagttagcaaaggcagagacggctatatgggcattgggctctccgctcaaggggtcaatatgaataggctacccggtatcgccttcaccgacttaccggccaatctttaccccacagtgggattacaaactcctggagagattgtggatgcgaacttcggccagcagccctttctgttcgacatcgaagactatatgagggaatggcgggcaaaggtccagggaactgttcattgtttcccgattagtgccaggttgggagagtggcaagccgtgcttcagaacatggtgtcttcatatctagtgcatcatggttactgcgcaaccgccaccgcatttgccagaatgaccgagacaccaatacaggaggaacaggcctctattaagaatcggcaaaaaatccagaagctggttctggaaggccgggtcggagaggctatagaaaccacacaaagattttatcccggattattggaacacaacccaaacctgctgttcatgttaaagtgcaggcagtttgtagagatggtgaacgggaccgattcggaggtacggtctcttagctcaaggtcccccaaatcacaggactcgtatcccggatctccctccctgagtcctaggcacggcccttcttcatctcacatgcataacactggcgcagattctccttcctgtagcaatggagtggcctcaaccaaaagcaaacagaaccatagcaagtatcccgcaccgtccagctccagctcatcttcctcttcttcttcgtcgtcatccccgagctccgtgaattattccgagtctaattcaacagacagcaccaaaagccagcatcatagcagcacttcaaatcaggaaacctcgaatccctggcttcagctcgagcggaggccaaaccaggctgcaccaacaaccccaccaggtccgactcctacctctacaccaccacattccgattctgagatggagatggaagccgagcactatcccaacggcgtgctcggttccatgtcgacgagaatcgtgaacggcgcctataagcacgaggacctacagacagacgagagtagtatggatgacagacatccacgtcggcaattgtgtggcggtaatcaggctgctacagagcggattatcttgttcgggcgcgaactccaggccctgagcgaacagctgggtcgagagtacgggaaaaatcttgcccacacagaaatgctgcaggacgcattcagcttactcgcctacagtgacccatggagttgcccagtcggacaacagttggatccaatccagcgggagcctgtctgtgccgctctgaactcagctatactcgagtcccagaacctaccaaaacaacccccactgatgttggctctgggtcaggccagtgaatgtcttagattgatggcccgcgcaggattgggatcttgtagtttcgctcgagtagatgattatctccattag

SEQ ID NO: 131680 - DNA, 1176 bp, Artificial Sequence
  Description of Artificial Sequence: Synthetic coding sequence
atgcgcgaatggcgggctaaagtgcagggaacagtccattgcttccctatttctgcccgattaggggaatggcaggctgtgctgcagaacatggtttcctcttacctcgtccaccatggatactgtgctacggccactgccttcgctcgtatgactgaaacacctattcaggaggagcaggcctccatcaaaaaccgacagaagatccaaaagctcgtgttggagggacgcgtgggagaggccatcgaaacaacacagcgtttttatcccgggctgctggaacataaccctaatcttctgtttatgctgaaatgccggcaatttgttgagatggtgaatgggaccgattcggaagttcgcagcttatcaagccggtccccgaaaagccaggacagctatcctggatctccatccttgtccccccgtcacggcccctctagctcccacatgcataacactggcgcagacagtccttcatgttctaacggggtggcatccacaaaatccaaacagaaccatagcaaatatcctgcaccatctagctctagctcctcttcctccagctcctcttctagttccccctcgagtgtgaattattcagaatcaaactccaccgattccacaaagtcacagcaccactcatctacgtccaatcaagagactagcgacagcgagatggagatggaggcagagcactaccccaacggcgttttgggctccatgagcactcggattgtgaacggcgcctacaagcatgaggacctgcagaccgatgagtcaagtatggacgaccgccaccctcggcggcaactgtgtggggggaatcaagctgccacggagcgaattattctctttggaagggagttgcaggccctgagtgaacaactcggccgcgagtacggcaagaaccttgcacataccgagatgctgcaggacgcgttctctctactggcctatagcgatccatggagctgtcctgtggggcaacaattggacccaattcagcgagagcccgtgtgcgcagctctcaactccgccatattggagagccagaacttgccaaagcagcccccactcatgctcgctttgggtcaagcgagcgagtgcctgcgactcatggctcgggctgggctgggatcctgttcattcgccagggtagacgactacttacactag

SEQ ID NO: 131681 - DNA, 3267 bp, Artificial Sequence
  Description of Artificial Sequence: Synthetic coding sequence
atggccttacatttccagtctctggcggaactcgaagtgttgtgtacacacctgtacattggcactgatttgacacagaggatcgaggccgagaaggccctgctggagttaatcgactccccagaatgtctgtctaaatgccagttgctgctcgaacagggcaccacctcatacgctcagttgttggcagccacatgtctctcgaagttggtgagccgcgtgagtccgctgcctgtagagcagcgtatggatattcgaaactacattttgaactatgttgcctcccagcccaagttggctccgtttgtgattcaggcccttattcaggtcattgcaaagataaccaaactgggctggttcgaggttcagaaagatcaatttgtcttccgtgagatcatcgccgacgtcaaaaagttcctccaaggcacagtggaacattgtatcattggggtgattatcctcagcgagctcacccaagagatgaacctcgtagactactcgcgccccagcgctaagcacaggaagattgccactagctttcgagatacctcccttaaggacgttctcgtgctggcgtgtagcctgctgaaggaggtattcgctaaacctctaaacctccaggaccagtgccaacaaaacctcgtgatgcaggttttgaagctcgtcttgaattgcctgaactttgacttcatagggagctctgccgacgaatcagcagacgacctttgtacagtccagatcccaactacatggagaacaatcttcctggagccagaaacactggatctttttttcaacctttaccacagtctacccccgctccttagccagcttgcgctgtcgtgcctggtgcagttcgcttccacccggcgctctttattcaactcgcccgagagggccaagtaccttggaaacctgattaagggcgtgaaaagaatcttggaaaacccccaggggctgtccgacccaggcaactaccacgagttttgccggttcctcgcccgactgaagacaaactatcagctcggcgagctggtcatggtgaaggaatacccagaagtcatccggcttatagccaatttcacaatcacttcactgcagcactgggagttcgccccgaattcagtgcactatctgctgacactgtggcagcgcatggtggcatccgttcctttcgtaaaatcaaccgaaccccatctgctagacacttatgctccagaaatcacaaaggccttcatcaccagtcggttagattccgtcgccattgtcgtgcgggatcacctcgacgatcccctcgacgacaccgcaactgtgttccagcagcttgaacagctgtgcacggtgtcccgctgtgagtatgagaaaacatgtgctctgttggtccagttgtttgatcagaacgctcagaactaccagaaattgcttcacccctactcaggggtcacagtcgatattacgatacaggagggccgtctagcctggcttgtgtacctggtgggaaccgtagttggcggacgcctgacctacacgtcaacggatgagcatgacgcaatggatggcgaactgtcttgcagggttttccagctgatcagcctgatggataccggcttgccgagatgctgtaacgagaaaattgagctggccatcctctggttcttggatcagtttcgtaagacatatgttggcgaccagttacaaaggacttccaaggtgtatgcaagaatgagtgaagtgctgggaatcaccgacgataatcatgttcttgagactttcatgacgaaaatcgtcaccaatctaaagtactggggccggtatgagccagtcatctcgcgcaccctccagtttctgaatgacctttcagtaggttatattttgctaaagaaactagtgaaaatagacgcagtgaagtttatgctaaagaaccacacatctgaacactttccatttctgggtattagtgacaatcacagcctgagcgatttcagatgcagaacgaccttttacactgcgctaacacgactgctgatggtggacctcggggaggatgaagatgagtttgaaaatttcatgctgccccttactgttgcctttgagaccgtccttcagatctttaataataattttaaacaagaagacgtaaaacgcatgctgatcgggctggcacgggatttgagaggaatcgcctttgctttgaatacaaaaacaagttacaccatgctgttcgactggatgtatcctacgtacctgcctttattacagaacgccgttgaaagatggtacggagagccgacttgtacaacccctatcttgaaactcatggctgaactcatgcagaataggagtcaaaggctgaattttgacgtgagctcaccaaatgggatcctgctgtttcgggaagcctccaagatggtatgcacttatggcaaccaaattctttcccttggtagcctaagtaaagaccagatataccctatgaagttaaaagggatttctatctgttatagtgcactcaagagcgctctgtgtgggaattatgtgtcctttggggtgttcaaactctacggggataaccacttcgataacgtgttgcaggcctttgtgaagatgctcctctccgtgagtcacagcgatctgctgcagtaccgcaagctctcacagagctactacccacttctggaatgtcttacacaggaccacatgtccttcataataaacttagagccccctgttcttatgtacgtactcacttctatcagcgagggtctgacgaccctggacaccgtggtgtcttcgtcctgctgcacttcactcgattacatcgtgacctacctgttcaagcatatagccaaggagggaaagaaaccactgcgctgcagagaagcaacccaggccggacagcggcttctgcacttcatgcaacagaatcctgatgtccttcaacaaatgatgtccgtactcatgaacactatcgtgttcgaggactgtaggaatcagtggagcgtgagcagacccctcttagggctaattcttctcaatgagaaatacttttccgaactacgggcatctctgattaatagccagccactaccaaaacaagaggttctcgcccagtgttttaggaatctgatggagggagtagaacagaacctgagcgtgaagaaccgggaccgctttacgcagaaccttagcgtctttcgccgggacgtcgcggaagcactccggagcgatgggaacaccgaaccttgcagcctggatatgatgtcatag

SEQ ID NO: 131682 - DNA, 1557 bp, Artificial Sequence
  Description of Artificial Sequence: Synthetic coding sequence
gtgtacgcacggatgagtgaagtcttgggaatcacagacgataaccatgtacttgagactttcatgacaaagatcgttaccaatctgaaatattggggtcgctatgagcctgtgataagtcgcaccctgcaatttttgaacgatttatcagtaggatatatactgcttaaaaagctggtgaaaatcgacgccgtgaaattcatgctgaaaaatcatacgtccgagcatttcccttttctgggaatcagcgataatcatagccttagcgatttccgctgtagaactacattttacacagctctgacccgcctcctcatggtagatctcggggaggacgaggatgagttcgaaaactttatgcttcccctgactgttgctttcgagactgtcctgcagattttcaataacaactttaagcaggaggatgtgaaacggatgttaatcggacttgccagggaccttcggggtatcgcttttgcactaaatacaaaaacctcctataccatgttgtttgattggatgtaccccacgtatctccccctgctgcagaacgccgttgaaaggtggtacggcgagccgacttgcacaactcccatactgaagttgatggcagagttaatgcagaataggagccagcggttgaacttcgacgtatcttcacctaacgggatactgctgtttcgtgaggcaagcaagatggtctgcacttacggcaaccagatcctatctttggggtccctcagcaaggaccagatttacccaatgaaacttaagggcatctcgatctgctactcagccctcaaaagcgcgctatgtgggaattatgtttccttcggcgtgttcaagctctatggggataatcattttgacaatgtgctgcaggctttcgtaaaaatgttactcagtgtgtcgcactccgatctcctgcagtataggaagctcagccagtcttactacccgttgcttgaatgtctgactcaggaccacatgtcgtttattattaatctcgagcctcccgtgttgatgtacgttctcacaagcattagcgaagggctaacgactcttgacactgtggtgagctcaagttgctgcacctcccttgactacattgtgacatacctattcaaacatatcgcaaaagagggcaaaaagccacttaggtgccgagaggcaacccaagctggtcagcgtctgctccattttatgcaacagaaccccgatgtactgcagcaaatgatgagtgtgttgatgaatacaattgttttcgaggattgcaggaaccagtggtcagtgtcaaggcccttactgggactaattcttctcaatgagaaatacttttcagaactacgcgctagtctcattaacagtcagcctctaccaaaacaagaggtgctcgctcagtgcttccgcaacttgatggagggtgttgagcagaatctgtcggtgaaaaatagggatcggttcacacagaatctcagtgtgtttagacgggatgtagccgaggctctgaggtcagacggtaacaccgagccttgcagcctggatatgatgtcctag

SEQ ID NO: 131683 - DNA, 1419 bp, Artificial Sequence
  Description of Artificial Sequence: Synthetic coding sequence
atggacatacggaactacatcctgaattacgtcgcttctcagccaaagcttgccccgttcgtgatccaagcactgatacaagttatcgcaaagatcaccaagctcggttggtttgaggtccaaaaagatcagtttgttttcagagagattattgcagacgtaaagaagttcctccaggtagactactcgcgcccttctgccaagcacagaaaaatagcaacttcgttcagagacacatctctcaaggatgtgctggtcctggcctgcagcctgctcaaagaggtcttcgcaaagccgctcaatttgcaagatcagtgccagcaaaacctcgtcatgcaggtactcaagttagtcctgaactgtctaaacttcgactttatcggctcttcagccgatgagtccgccgacgacttatgtacggtgcaaatccccaccacttggaggacaatctttctcgaacccgagacattggacctgttctttaacctctatcattccctgcctccattgctaagtcagcttgctctctcttgtctggtgcagtttgcaagcactcgcaggtctctgtttaactcgcccgagcgggctaagtatctcggcaacctcattaaaggtgtgaaacgcatcttggagaacccacagggtctgagcgaccctggaaactatcacgaattttgtcggttcctcgccaggctcaaaacaaactatcagctcggagaactggtcatggtgaaggagtaccccgaggtgatacgactgatcgcaaattttacaattaccagcttacagcattgggaatttgccccgaattccgtgcattaccttctcacactttggcaacgtatggtcgcctccgtcccctttgttaaatcaacagagccccacctcttggatacctacgccccagaaatcaccaaggcatttattacgtccagactggactcagtggccatcgtagtgcgggatcatctggacgaccccctggacgatactgccacagtgtttcagcagctggaacagctttgtacagttagcaggtgcgagtacgaaaaaacatgcgcactcctggtgcagctgttcgatcagaacgcgcaaaactatcaaaagctgctacacccctattctggagtgacggtggatataacaatccaagaaggaagactggcatggctggtttacctggtaggcacggtcgtggggggaagactgacctacacgagtacagatgaacacgacgcaatggatggcgaactgtcctgccgagtgtttcagttgatttccctgatggatacaggcctcccgcgctgctgtaacgagaagatagagctggccatcctctggtttcttgatcagtttcgtaaaacctatgttggagaccagctacagcggacatcaaagaagacctttatctacttgtag

SEQ ID NO: 131684 - DNA, 9675 bp, Artificial Sequence
  Description of Artificial Sequence: Synthetic coding sequence
atgcgcaggagcaaagcagatgtggagagatatatcgcctcagtgcagggatccacaccatcccctagacaaaagagcatgaagggattctactttgcaaagttatattacgaggcaaaggagtacgacctggctaaaaagtatatttgcacgtacatcaacgtacaagagcgcgatcctaaagcccaccggttcctcggcttactgtacgaattggaggagaacaccgataaggctgtggagtgctacagaagaagtgtggagttgaatccgactcagaaggatctcgtactgaagattgcagagctgctttgcaaaaacgacgtcactgatgggagagcaaaatactggttagaaagggctgctaagctgttcccggggtcccccgcgatctacaagctgaaagaacagctcctggattgcgaaggcgaagacggatggaataaactgtttgacctgatccagtccgagttgtatgtgagacctgacgacgtgcacgtgaatatacgtcttgttgaagtttatcgatcaacaaaaagacttaaggatgccgtggcacactgccacgaagcggagcgcaatatcgccctgaggtcctccttggaatggaattcttgcgtggttcagaccttgaaggagtacctcgagtctctccagtgtctggagtctgataagtctgattggcgcgccaccaataccgatctgctgctggcctacgctaacctgatgctgttaactctctccacacgcgacgtgcaggagtcaagggagctcttgcagtctttcgactctgcccttcagtcggtgaagagtcttggcgggaacgatgagctcagcgcaaccttcctagagatgaaaggccatttctatatgcacgcgggctccctgctgcttaagatgggtcagcacagttccaacgtacagtggagggcactgagcgaactggctgccctctgctacctaatcgcctttcaggttcctcggcctaaaatcaaactcatcaaaggggaagctggtcaaaacctgctcgagatgatggcttgcgaccgtctgagtcagtcagggcacatgttgctcaacctgagcaggggcaagcaagactttttaaaagaaatagttgagacatttgcgaacaagtccggccagagcgccctgtatgacgccttgttctcgtcacaatcaccaaaagacactagcttcctcggttccgatgacatcgggaatatcgacgtgcgcgagcctgagctggaggacctgacaagatacgacgtgggggcgatccgagcacataatggctctctccagcatctgacttggctaggcctccagtggaattccttgcccgcgctgccaggcatcaggaaatggctcaagcagctgtttcatcacctgccccacgaaacctcacgcttagagaccaatgctcctgagagtatctgtatcctagatctggaggtctttttgctgggggttgtatacacctcacatctgcagctaaaggagaagtgcaatagccatcactcttcttatcaacctctatgtctgcctcttcctgtctgcaagcagctatgcacggaacggcagaagagttggtgggatgctgtatgcacactgatacatcgcaaggcagtcccagggaatgttgctaaattgcgcctattggtgcaacacgagattaacactctcagagctcaagaaaaacacggattgcagccggcgctcttagtgcattgggcagaatgcctacagaaaacaggaagtggcctgaattctttttacgaccaaagggaatacattggtcggtctgtgcattactggaagaaagtgctgcctttgttaaaaatcatcaaaaaaaagaactccatccccgagcccatcgatccactgtttaagcatttccatagtgtcgacatccaggcctccgaaattgtggaatatgaagaagacgcacatatcactttcgcaattctggacgccgtgaacgggaacatagaagatgcagtgactgcttttgaatccatcaaatctgtcgtaagctactggaacctcgctcttattttccataggaaggccgaggatattgagaacgatgcactctcaccagaggagcaagaagagtgcaagaattatctgagaaagacaagggactacctgatcaagattatcgacgactccgatagcaatctgagcgttgtgaaaaagttgccagtccctctggaatcagttaaggagatgttaaattccgttatgcaagaactggaagattacagcgaaggcggaccattgtacaagaacggatcactccggaacgcagattctgagatcaagcactcgaccccgtcccccacacgttattctctttccccatccaaatcctataagtactcccccaagacccctccaaggtgggctgaggatcagaacagcctattgaaaatgatctgtcagcaggtcgaagcaatcaagaaggagatgcaggagcttaagctcaatagcagcaacagtgcatcgccacacagatggccgactgagaattacggtcccgacagcgtccctgatgggtatcaaggttcccagacgtttcacggagctccactgacagtggccactaccgggcccagcgtatattattctcagagccccgcctacaactcacagtacctcctgcgacctgctgccaacgtaactcccactaaggggcctgtgtacggcatgaaccggttacccccgcagcagcatatttatgcttacccacaacagatgcacaccccaccagtgcaatcctctagcgcatgcatgttcagccaagagatgtacggaccacctgctctgaggtttgaatcacccgccaccgggattttaagtccccggggtgatgattacttcaactataacgtccaacagacaagtactaacccccctctacccgaaccggggtactttactaaaccccctattgccgcgcatgctagccggagtgcggagtctaaaactattgaatttggtaagacaaactttgttcagccaatgccgggggagggacttcgcccaagtctgccaacacaggctcacaccacacagcccacccctttcaaattcaacagtaacttcaaatctaatgacggcgattttactttctcctcccctcaggtggtgacacagccacccccagccgcctactcaaactctgaaagccttctgggactgctgacgtctgacaaacctctccagggtgacggctattctggcgcgaagcccatacccggagggcagactatcggcccccgcaacactttcaactttgggtcgaagaacgtatcaggaatctcgtttactgagaacatgggttcttctcagcagaaaaacagtgggtttagacgttctgacgacatgtttacctttcatggcccgggtaagagcgtcttcggaacccctactctagagacggccaacaagaatcacgaaacggacggagggtcagctcacggagacgacgatgacgacggaccacactttgagcccgtggtgcccctccctgataagattgaggtcaaaacaggtgaagaagacgaagaggagttcttctgtaacagggcaaaactcttcaggtttgatgttgaaagcaaagaatggaaggaaagaggcatcgggaacgtaaaaatcctacggcacaagaccagcgggaaaattcgtctgctgatgagacgagaacaggttcttaaaatctgtgctaaccattatatcagcccagacatgaaattaaccccaaacgccgggagtgatcgttccttcgtttggcacgccctcgattacgccgacgagttgcctaagcccgagcagcttgccatcaggttcaaaaccccggaggaggctgcgctgtttaagtgtaaattcgaggaagcacagtctattctgaaggcacccgggaccaacgtcgccatggcgtccaatcaagccgtccgcatagtaaaggagcccacgtcccacgacaataaagatatttgcaagtcggacgctgggaatctgaactttgaattccaggtggcaaagaaggagggttcctggtggcactgtaattcatgtagtttaaagaacgcaagtactgcaaaaaaatgtgtgtcctgtcagaacttgaatcctagcaacaaagagctcgttggaccgccgcttgctgagactgtctttacccccaaaaccagcccagagaacgtgcaagaccgcttcgcactggtcacaccgaaaaaggaggggcattgggactgttccatttgccttgtccggaatgaaccaacagtctccagatgcatcgcatgccagaacacaaagtccgctaataagtccggcagctctttcgtgcaccaggcgagtttcaaatttggacaaggcgatttgccgaagccaataaattcagatttcagatcagtattctctacaaaagagggacagtgggattgcagtgcctgtttggtgcaaaacgaaggatcaagcacaaaatgcgccgcatgtcagaacccgagaaagcagtccctaccagctacctccatacctaccccggcttccttcaaattcgggacttccgaaacaagtaagacccttaaaagtgggttcgaggacatgtttgctaagaaggaaggtcagtgggattgttcgagttgtctggtgcgcaacgaggccaatgcaactcggtgtgttgcctgtcagaatccggacaaaccaagtccatccacgtctgtgccagccccagcctcattcaagttcggaactagcgaaacctccaaggctcccaaaagcggctttgaggggatgttcactaagaaggaaggacagtgggactgctcagtgtgcctcgttcgtaatgaggcttcggccaccaagtgtatcgcatgccagaaccccggaaaacagaaccagacaacttccgcagtctctacacccgcctcttccgaaacttcaaaggcacccaagtctggtttcgagggtatgttcacaaaaaaggaaggtcagtgggactgctcggtgtgtctcgtgagaaacgaggcctctgccaccaagtgcatagcgtgtcaaaatcccggcaagcagaatcagactacctctgctgtctctactcctgcctcatctgaaaccagcaaagcgccaaaatccggcttcgaaggtatgttcactaaaaaggagggacaatgggattgctcagtctgcctagttcgaaatgaagcttctgcaactaaatgcatcgcatgccagtgccccagtaagcaaaatcaaactaccgcaatttctacccctgcatctagcgagatctcaaaggcccccaaatcggggttcgaggggatgtttattcggaaagggcagtgggattgttccgtttgttgtgttcagaatgaatcatccagtctcaaatgtgtcgcgtgcgacgcttctaaaccaacacacaagcctatcgctgaggccccgagcgcattcacactaggatccgagatgaaattgcatgatagctcaggcagccaagtcggaacaggattcaagtctaacttctccgaaaaagcctcgaaattcggtaatacggagcagggttttaagttcggccacgtcgaccaggagaattccccttccttcatgttccaaggttcctccaatactgaattcaaaagcacgaaggagggtttttccattcctgtgagcgccgatggatttaaatttgggatttcagagccaggaaatcaagagaagaagagtgagaaacccttggagaacggcacaggctttcaggcgcaggatatcagtggccagaaaaacggccgcggggtaatattcgggcagacctccagcacttttaccttcgctgatcttgccaaatcgacgtcaggtgaggggttccagttcgggaagaaagatccaaatttcaagggtttcagtggggccggcgagaaactcttcagtagccagtacggcaagatggctaataaagcaaatacgtccggggacttcgagaaggacgatgacgcatacaaaactgaagattccgatgacatccatttcgagccagtcgtgcagatgccagagaaagttgagcttgtgactggagaggaggatgagaaggtgctgtattctcagcgggtcaagctgttccgcttcgacgcagaggtatctcaatggaaagagcgcgggctaggaaatctaaagattttgaagaatgaggtcaatggaaaattaaggatgttaatgcgaagagagcaggttctaaaggtctgtgctaatcactggattaccacgactatgaacttgaaacccttgtccggcagcgacagagcctggatgtggctggccagtgacttctcagatggcgacgccaaactggagcaattggcagccaaattcaagacccccgagctcgccgaggaattcaagcagaagttcgaagagtgccaacgtctcctcctagatattccgctgcagacgccgcataagctagttgacactgggagggccgcaaagttaatccagagggccgaggaaatgaagagtggccttaaagacttcaagacatttttgacaaacgaccagaccaaagtaactgaggaggaaaataagggatccggcactggggcggccggagcctctgacactacaataaagccgaatcccgagaatactggccccactctagaatgggataactacgatctgcgagaagatgccctagatgacagcgtttcctcctcatcagtgcatgccagtcccctcgcttccagccctgtccggaagaacctgttccggttcggagagtccacgaccggctttaatttctctttcaaaagtgccctgtctccaagtaaatcccccgccaagttgaaccagagtggcacaagcgtcggcactgacgaagagagcgacgtaactcaggaggaagagcgagatggtcagtattttgagccagtcgtccccctacctgacctggtggaggttagctctggagaggaaaacgagcaggtcgtgtttagtcatagggccaaactgtacagatacgacaaagacgtcggacagtggaaagaacggggtatcggcgacattaagatcctgcagaactatgacaacaagcaggtcaggatagttatgaggagggatcaagtgttgaaactgtgcgcgaaccaccggatcacacctgatatgaccctgcaaaatatgaagggaacagagcgagtttggctctggaccgcctgtgacttcgccgatggagaacggaaggtcgagcatcttgccgtacgcttcaaactgcaggatgtagctgattcctttaagaagatcttcgatgaggcgaagaccgcgcaagagaaggatagtctcatcacacctcatgtgagccgatcttcgactccccgggagtcgccatgcggaaagattgccgtagcggtcctagaggagacaacccgggagcgtaccgacgttattcaaggcgacgacgtcgccgacgccaccagtgaggtggaggtgagttccacatcagagaccaccccaaaagcagtggtttctccacctaagttcgtgttcggtagcgagtctgtgaaatccatctttagctctgagaagtctaagccttttgcctttggaaatagctctgctacgggttcactgttcggcttctcttttaacgcgcccttgaagtcaaataactcggagacttccagcgtagcccagagcggtagtgaaagcaaagtggagcccaagaagtgcgagttgtctaaaaatagtgatatcgaacagtcaagcgactctaaagtgaaaaacctattcgcatcttttcccacagaggagtcatcaatcaattataccttcaaaacccccgaaaaggccaaagaaaagaaaaagcccgaagattcgcccagcgatgacgacgttctgatcgtgtacgaactcacacctacagccgaacagaaagctctcgccaccaagctgaagttgccccctaccttcttctgctacaaaaaccggcccgactacgtctccgaggaagaggaggatgatgaggactttgaaacagccgtgaaaaagcttaatgggaagctctatctggacgggtcagagaaatgcagaccactggaggaaaatactgcggacaacgagaaagaatgtatcatcgtttgggagaagaaacctacagtcgaggaaaaagcgaaagccgatacactgaagctaccccccacgtttttttgtggcgtgtgctccgacacggacgaggacaacggcaacggggaagatttccagagcgagctgcagaaggtgcaggaagctcagaagagtcaaactgaagaaattactagtaccaccgactctgtttatacaggtgggaccgaggtgatggtgccctccttttgcaaatcggaagagccagactccatcactaaatccatctcaagcccgtctgtctcatccgagaccatggacaaacctgtcgacttatctactcgaaaggagattgacaccgatagtacttcacagggggagagcaagattgttagcttcggctttggaagttctaccgggctatcctttgccgatctggcttcgtcaaatagcggggatttcgccttcgggtcaaaggataagaattttcagtgggctaacacaggagccgccgtttttggcactcagtcagtcgggacacagtccgctgggaaagtgggtgaggatgaagacggatccgacgaagaagtcgtgcacaacgaagacatccactttgaaccgattgtatccctgcctgaggtcgaggtcaaatccggcgaagaagatgaagaaatcctcttcaaggagcgggccaagctttataggtgggatcgcgacgtttctcaatggaaagaacggggtgtgggagacatcaagattctttggcacactatgaaaaattactaccggatcctgatgcgtcgcgaccaagtgttcaaagtctgtgcaaaccacgtgatcactaagaccatggagctgaaacctctgaacgtctctaataacgcccttgtgtggacagcctcagactatgcagacggggaggccaaggtggagcagctcgctgtgcggttcaagactaaagaggtggcggactgtttcaaaaagaccttcgaggaatgccagcagaacttgatgaagttgcaaaaaggtcatgtgtctcttgcagctgaactgagcaaggagacaaacccggtggtttttttcgatgtttgtgctgatggagagcctctgggacgcataaccatggagctgttcagtaacattgtgccacgaaccgcagagaatttccgggctctatgtacaggagaaaaaggtttcggttttaaaaattccatctttcaccgcgtcattccagactttgtttgccagggtggtgatatcacaaagcacgacgggaccggaggccaatcgatctacggagacaaattcgaggacgagaattttgacgtcaagcatacgggacctgggcttctatctatggctaaccaggggcagaacacaaataatagccagtttgtcattaccctgaaaaaggccgaacatctggacttcaagcacgtcgtgtttggattcgtgaaggacgggatggatacagtcaaaaagatcgaaagtttcgggagtccaaagggttcggtgtgtagaaggatcactatcactgaatgcggacagatctag

SEQ ID NO: 131685 - DNA, 1500 bp, Artificial Sequence
  Description of Artificial Sequence: Synthetic coding sequence
atggccgatctagccaatgaggagaaacctgcaatcgctccacccgttttcgttttccagaaagataaggggcaaaagcggagcgcgggcggatcctcaccagagggaggagaggatagcgaccgtgaggacggcaactattgtccacccgtgaaacgcgaacggacctcatccctaacgcagttcccacccagccaatcagaagagagatcgagcggattcagactgaaaccacccactctgattcacggacaagctccctccgccggattaccctctcagaagcctaaggaacagcagcgcagcgtgctgcggcctgcagtccttcaggctccccagccaaaagctctgagtcaaacagtccccagctcgggcaccaatggggtgagcctgccagccgattgcactggtgccgtgccggccgcgtctcccgataccgcagcttggcgaagcccttcagaggctgctgatgaagtctgtgcactcgaagaaaaggaaccgcagaaaaatgaatcatccaacgccagcgaagaagaagcctgcgagaaaaaggacccggccactcagcaggcttttgtcttcggtcagaatctgagagatcgtgtgaagctgatcaatgaatccgtggatgaagccgatatggaaaatgcagggcaccctagcgccgacacgcctactgcaaccaattattttttacagtacatcagcagcagtctcgagaactctacaaatagcgccgatgcttcttcgaataagtttgtgttcgggcagaacatgtcagaaagagtgttgagccccccaaagctgaatgaggtctcaagcgacgctaaccgggagaacgccgccgccgaatctggctcggaaagctcctctcaggaagccaccccagagaaggaaagcctggccgaatccgcagccgcttacaccaaggcaactgcgagaaaatgtctgcttgaaaaggtcgaagtcattacaggtgaggaagcggagtccaatgtcctgcaaatgcagtgcaagctcttcgtgttcgataaaacttcacagtcttgggtagagagggggcggggccttctgaggctgaacgatatggcttctactgatgacggcacacttcagtctagattagtgatgagaactcaggggagcttaaggctaatattgaacacgaaactctgggcacagatgcaaattgataaagccagcgagaaatctattcgtattaccgctatggacactgaagatcaaggcgtgaaagttttcttgatttccgcaagctcaaaagatacaggacagttatatgccgccctgcaccaccggatactggctctaagatctagggtggaacaggaacaggaggctaagatgcccgcacctgagcctggtgcagccccttccaacgaggaggatgacagtgatgacgatgatgtcttagccccatctggtgcgactgccgcaggcgcaggtgacgaaggggatggccagacaacaggctctacctag

SEQ ID NO: 131686 - DNA, 1194 bp, Artificial Sequence
  Description of Artificial Sequence: Synthetic coding sequence
gctgacgtcaccaaagcagagaaacctgctatagcccccccggtattcgtgttccagaaggacaaaggacagaaacgatcggctggcgggtcaagtcccgaaggcggtgaagattctgatcgggaggatgggaattactgccctccggtgaaacgcgagagaacttcctctctgacccagtttccaccttcacaatcggaggaaagatcgtccggctttcggctgaaacctccgacactgattcacggacaggctccctccgcaggtctgcctagtcagaagcccaaagaacaacagcgcagcgttcttcgcccagctgtgcttcaggccccacagcctaaagctctgagccagactgtgccttcctcaggaacgaacggagtgtcactgcccgccgactgtactggcgctgttccagctgctagtccagatacggctgcatggcgctctccctcggaagctgccgacgaggtgtgtgccttggaagagaaagagcctcaaaaaaacgaaagctccaatgcctctgaagaagaggcttgcgagaagaaggatcccgcaacacagcaagctttcgtatttggacaaaatctgagggaccgggtgaagcttatcaacgaaagcgtggacgaagcagatatggagaacgccggacacccttccgctgacacaccaaccgctaccaattactttctccagtatataagctcctcgcttgagaactctaccaatagcgccgacgccagctccaacaaatttgtatttggacaaaatatgtcagaaagagttttgtcccccccgaagcttaacgaagtgtccagcgacgcgaatagagaaaacgccgccgcagagtccggaagtgagtcctccagccaggaggccacacccgaaaaggaatccctcgccgagtcagctgcagcctataccaaggccactgcgagaaagtgccttttggagaaggtggaggttatcacaggtgaggaggcggaaagcaatgtcctgcagatgcagtgcaagctgttcgtgtttgacaagacatctcagtcttggtggctcttacggcatccacacccaagccaccccgccgtcggtccctgtctatgtggtgagcaacccgctctgtgtccctgtccaggcttgccaaactaccgtccaggcacccctgctcagctgggcggtttgttggtgagggtgtag

SEQ ID NO: 131687 - DNA, 1704 bp, Artificial Sequence
  Description of Artificial Sequence: Synthetic coding sequence
atggccgacctggctaatgaagaaaagcccgcgatcgctcccccagttttcgttttccagaaggataagggtcagaagagcccagccgagcagaagaatttgtccgactcaggggaagaaccccggggagaggctgaagctccacaccacggcacaggccatcccgaatctgccggagagcatgcgctcgagcccccagctccagccggcgcatctgccagtacaccaccccctcctgccccagaggcacaactgcccccattcccaagggagcttgctggtcggagcgccgggggatcttctccagaaggcggggaagacagcgatcgggaggacggcaattactgtcccccagtgaagcgcgaaagaacttcgtccctcacacagttcccgccttcacagagcgaggaaagatcctccggatttaggttgaagccccctacacttattcacggacaggccccaagcgcaggcttgccgagccaaaaaccaaaggagcagcagcgctccgtcttgagaccagccgtgcttcaggctcctcagccgaaggccctgtcacagacggtgccttcatctggtacaaatggtgtatctttaccagccgattgtaccggtgctgtccccgccgcctcgcccgacacagcagcatggcgctcgccctccgaggccgccgatgaagtctgcgccttggaggagaaagagccacaaaaaaacgagtcttctaacgcttccgaagaagaggcatgtgaaaagaaggatcccgccactcaacaggcctttgtcttcggacaaaatctgagggatcgcgtcaagctgatcaacgaatccgtagatgaagcagatatggagaatgccggacacccgagtgcagacacccccaccgctactaactattttcttcagtacatttcgtcaagcctggaaaacagcacaaactccgctgatgcatcttcaaacaagtttgtgttcgggcagaacatgagcgaacgagtgctttcccccccaaagctgaacgaggtctcctccgacgctaatcgcgagaatgccgctgcagagtctggaagcgaatccagttcacaggaagccacgcctgagaaagaaagtcttgccgaatctgcagcagcgtatacaaaggcgacagcacgaaagtgtttgctggagaaagtggaggtgataacaggggaagaggctgagagcaatgtgctgcagatgcagtgtaaattgttcgtgttcgacaagacttcgcagtcttgggtggaacgcggacggggcctgctgagactgaatgacatggcttccacggacgacggtacactacagagccggttagtgatgcgcacccaggggagtctgcggctcattttgaatacaaagctgtgggcacaaatgcagattgacaaggccagcgaaaaatcgatccggatcactgccatggacaccgaggatcagggggtcaaagtgtttctcatcagtgcgtcatctaaggacaccggtcaactgtacgctgccctacatcatcggatcctggctctgcgcagcagggtggaacaggagcaggaagcgaagatgccagcccctgagccaggggccgcacccagcaacgaggaggatgattctgatgacgacgacgtcctcgcgccaagtggcgccactgcagccggggccggcgacgaaggcgacggccagacaacaggaagcacatag

SEQ ID NO: 131688 - DNA, 1689 bp, Artificial Sequence
  Description of Artificial Sequence: Synthetic coding sequence
atggcagatcttgcgaacgaagagaaaccagcaattgccccacctgtctttgtttttcagaaggacaaaggacagaaatctcctgcggagcagaaaaatctcagtgactctggagaggaaccccgaggcgaagcagaagcgcctcatcacggcactggacaccccgaaagcgcaggcgagcacgccctggagccaccagcccctgccggagcctccgcatctaccccccccccacccgctcccgaagcccagcttcccccctttccccgagagttggctggacgttccgcgggggggtcatcacccgaaggtggagaagatagcgacagggaagacggaaactactgcccccctgtgaaaagagagagaacatcctcactgacccagtttccccccagtcagtccgaggagaggtcgtccggattccgactgaaaccgcctacacttatccacggtcaggcaccttcagcaggcctgcccagccagaagcccaaggagcagcagcggtcagtgcttcggccagccgtattacaggcccctcagccgaaggccctctcacagactgttccgtcctccggcacgaacggggtgagtttgcctgccgactgcacaggggcagtacctgccgcaagtccagacacggccgcatggcggtccccttccgaggcagccgacgaggagaaagagcctcagaaaaacgagagttccaacgcctctgaggaagaagcttgcgaaaagaaggacccagccacccagcaagcatttgtgttcgggcaaaatttgcgggaccgagtgaagctaatcaatgaatctgttgatgaggccgatatggaaaacgctggccaccctagcgccgatacacccacggctactaactatttcctgcagtacattagtagcagtttagagaactctaccaattccgccgacgcttcatcaaataaatttgtttttgggcaaaacatgagcgaaagggtgttgtctccaccgaagctgaatgaggtaagttctgatgccaatagggaaaacgctgctgctgagtctggtagcgagtcttcctcacaggaagctacacccgagaaagagtccctggcagagtccgctgctgcctacacaaaagctaccgcccggaaatgtctacttgaaaaggtggaggtgatcactggtgaggaggcggaatcgaacgtcctacagatgcaatgcaagcttttcgtcttcgacaagacctcccagagctgggtggaaagagggaggggcttgctgaggctcaatgacatggcatctactgacgacggaacgctccaatccaggcttgttatgcgaactcagggatctctgcgccttatcttgaataccaagctgtgggcccagatgcaaatagataaagcttccgagaaatccatccgcataacagcaatggataccgaagatcagggcgtaaaagtgtttttgatatctgctagctcaaaagacactgggcagctatacgctgccttgcaccacagaattctcgcccttcgatctagagtggagcaggagcaggaagccaaaatgccagcgccagagcccggcgctgccccatcgaacgaagaggacgactcggatgacgacgatgtccttgccccatccggcgcaaccgctgccggggccggcgacgagggcgatggccaaactacgggcagcacatag

SEQ ID NO: 131689 - DNA, 1320 bp, Artificial Sequence
  Description of Artificial Sequence: Synthetic coding sequence
atggccgacctggccaatgaggaggaacggagcagtgggtttaggctgaagcccccaacccttatacatggtcaagccccctctgctggactgccgagccagaagccgaaggagcagcagaggtccgtccttaggcctgccgttctgcaggcaccccagccaaaagccctgtcacaaactgtgcctagcagcggcacaaacggggtgagcctgccagctgactgtaccggtgcggtgccagcagcgtccccggacaccgcagcttggcgctccccgagcgaagctgctgatgaagtgtgtgcccttgaggagaaagaaccacagaaaaatgagtccagcaatgcgtctgaagaggaagcatgcgaaaaaaaggatccagccacccagcaggcttttgttttcgggcagaacctgagggatcgggtgaagctcatcaacgagagcgtggatgaagctgacatggagaacgctggtcaccctagcgcagatactccgactgccacaaattattttctgcaatacatttcatcgagcctggagaacagcaccaactcagccgatgccagcagcaataaatttgttttcggccagaatatgtccgaacgtgtactaagtccacccaagctaaatgaagtcagttccgacgcaaatcgtgagaacgcggctgctgagagcggctcagagagcagctcacaggaggctactccggagaaggagagcttagccgagagtgccgccgcctacaccaaggcaaccgctaggaagtgcttgctggagaaggtcgaggtgattaccggagaggaagcagagagcaacgtgttgcagatgcagtgtaagctgtttgtctttgacaagacgtctcagtcttgggtggaacgaggacgcggattgctcagactgaatgacatggcaagcactgatgatggaacgttacagagtcgcctggtcatgaggacacagggcagcctgaggctgatcctcaacacgaagctatgggcgcagatgcagatcgacaaagcgtctgaaaaatcaatcagaatcacggccatggatactgaggaccaaggcgtcaaagttttcctgatctctgccagcagcaaggatacaggccaattgtatgcagccctgcaccacaggattttagctttacggtcaagggttgagcaggaacaagaagcaaaaatgccagcaccggagcctggagccgcccctagcaacgaagaagacgatagcgacgacgatgacgtcctggccccatctggagccactgcggcgggagcgggcgatgagggggatggccaaaccactggatccacttag

SEQ ID NO: 131690 - DNA, 2190 bp, Artificial Sequence
  Description of Artificial Sequence: Synthetic coding sequence
atgtcaggacagcctcccccaccccccccccagcagcagcagcagcagcagcaactgtccccgccaccgccggcagccctagcaccggtgtcaggcgttgtgttgccagctcctcccgccgtgtcagccggaagcagcccagcgggttctccagggggcggagctgggggagaaggactgggcgccgccgctgctgctttgctgctgcatcctccccctcccccaccaccagcaaccgctgctccacctcccccgccacctcctccacccccacctgcatcggcggccgctccagccagtggccctccagccccaccgggtcttgctgcaggccctgggcccgccggcggagctcctactccagccttggtggcaggaagttccgctgcagccccatttcctcatggggatagcgcgctgaacgaacaggaaaaagagctgcaaagacgcctcaaaaggctgtacccagcagttgacgaacaggaaacacccctcccgcggtcttggtcaccaaaagacaaattttcttatatcggcttgagccagaataatctcagggttcattataagggtcatggaaaaacaccaaaagatgctgctagcgtgcgcgcgacccaccccattcccgctgcatgtggcatctattatttcgaggtgaaaatagtctctaaaggccgcgatggctatatggggatcgggctgtccgcacaaggggtcaacatgaaccgcctccctggctgggataagcattcctacggctatcacggagatgatgggcattctttttgctcatccggaaccgggcaaccttacgggcccacatttacaaccggagacgtgatcggctgttgtgtgaacctcatcaataatacctgcttctacaccaaaaacggtcatagcctcggcatcgcatttactgatctgcctccaaacttgtaccccactgttggtctgcaaaccccgggagaggtcgttgacgccaacttcggccaacaccctttcgtgttcgacatcgaagattatatgcgggaatggcgaaccaagatccaagcccagatcgaccgctttcccatcggcgatcgggagggggaatggcaaactatgatccagaagatggtgagtagctacctcgtacatcacgggtactgcgcaaccgccgaagccttcgccagatcaacggatcagacggtcctggaagagctggcctcaatcaagaaccgacagcggattcagaaactggtcttggccggcagaatgggcgaggctatcgaaacaacgcaacagctctacccatctctcctcgagcggaatcccaacctgttgtttacacttaaggtcaggcagtttattgagatggtgaacgggaccgactctgaagtgcgatgcctgggcggaaggtctcccaaatcacaggattcttacccagtctccccgagacctttcagttctcctagcatgagcccttcacacggtatgaacatccataatttagcctctgggaagggtagtacagcacacttcagtggttttgaatcctgttctaatggagtcataagtaacaaggcccaccagagttattgccactcgaataaacaccagtccagtaatcttaatgtgcccgaacttaattcaatcaacatgagcaggagtcaacaggttaataatttcacctctaacgatgtggacatggagacggatcactattccaatggtgtaggagagacttccagcaatggttttctcaatggatcttcgaagcacgatcacgaaatggaggattgtgatacagaaatggaggtagattcttcgcagctaagacgccaactgtgcggaggaagccaggcggctatcgaacggatgattcatttcggaagagagctacaggcaatgagcgaacagctgcgccgagattgtggcaaaaatacagcaaacaaaaaaatgctcaaggacgcgttctctctcctggcctactccgacccctggaattcacccgtcggaaaccagctcgacccaatacagagagagccggtgtgctcagccctgaatagcgctatactggaaacccataaccttcctaaacagccaccactcgcactggccatggggcaggccacgcagtgtctgggcttgatggcaaggtctggaatcggcagctgtgcgtttgccaccgttgaagactacctccattag

SEQ ID NO: 131691 - DNA, 1176 bp, Artificial Sequence
  Description of Artificial Sequence: Synthetic coding sequence
atgtcagggcaaccgccacctcctcctccccagcagcagcagcaacagcagcagctgagcccacccccgcctgcagcactggccccggtgtccggagttgtgctccctgcgccccctgccgtgtccgccggctcttcgccggccggaagcccgggcggaggagcagggggagagggactgggcgcagccgcggcggcactgcttttgcacccacccccgcccccaccgccggcaactgctgcaccacctccacctccacctccaccccccccacccgcttccgcggccgctcccgcatctgggccaccggcgccccccgggctcgccgccggccctggtcccgctggaggcgccccaactccagctctggtggctggcagctccgccgctgctcccttcccgcacggggattccgccctgaacgagcaagagaaagagttacagaggcgtctcaagcgactttatcccgcagtggacgaacaggaaaccccactgcctcggtcttggagccctaaggacaaattcagttacattggtctctcacagaacaacttgagggtgcactacaagggccacggaaagacccctaaggacgccgcttcagtccgtgctactcaccctatacctgctgcctgcggaatctactatttcgaagttaagatagttagtaaaggtcgggacggctacatggggattggactcagtgctcagggcgtgaatatgaatcggttgcctggttgggacaaacattcttatggatatcacggagacgatggacatagtttttgctcctccggcactggtcagccttacggccctactttcaccaccggggacgtgattggatgttgtgtgaacctgatcaataatacttgtttctacaccaaaaatggccacagtttagggattgcctttaccgacttacccccactcgattaccctgtgtcaccccgcccgtttagctcaccatctatgtctccatcacatggcatgaacattcacaatctcgcatccggtaaaggatcgacagctcattttagtgggtttgaaagttgtagtaacggggtgatatctaataaggctcaccagagctattgtcattcaaacaagcaccaatccagcaatgagtgtacacggaccaagcagtacaaatatgttaaaatcaccgcctcttag

SEQ ID NO: 131692 - DNA, 1503 bp, Artificial Sequence
  Description of Artificial Sequence: Synthetic coding sequence
atgggcattggattatccgcccaaggggtgaatatgaacaggctgcccggctgggacaagcattcttatggctatcatggggacgatggccatagtttctgctcatcaggcacaggccaaccttacggccccactttcaccacaggagatgtaatcggatgctgcgtgaatctgataaataacacctgcttctataccaagaacgggcactccttggggatagccttcacagatttgcccccaaatttataccctacagtcggtctgcagacaccaggggaagttgtggacgcaaatttcggacagcacccctttgttttcgatatagaagactatatgcgtgagtggaggacgaaaatccaagcacagattgacaggttcccaataggcgacagagagggggaatggcagactatgattcagaagatggtgtcaagttatctggttcaccatggatattgcgcgaccgccgaagcatttgcaagatccacggaccaaaccgtgctggaagagctcgcctctattaaaaaccgacaaaggatacagaagttggtgttggccggtcgcatgggagaagcgattgagacaacgcagcagctgtacccttcactgttagagcgcaaccccaacctgctgttcactctcaaagtaagacagttcattgaaatggtgaatggtactgactcagaagtgagatgtctcggtggtagatcaccgaaatcacaggactcctatcctgtctcacctaggccattcagcagccctagtatgtcccctagtcacgggatgaacatacataacctggcctccgggaaaggctcaacagcccacttctctggttttgagtcatgttctaatggagtcatatctaataaggcacatcaatcatactgccacagtaataagcaccagtcttcaaaccttaacgtgccagaactgaactctattaacatgagcaggtcccaacaggtgaacaacttcaccagcaacgacgtcgacatggagactgatcactactccaacggggtgggagagacctctagcaacggattccttaacggaagcagcaagcacgaccacgagatggaagactgtgatacggaaatggaagtagacagctcacaattacgaaggcaactctgtgggggtagtcaggccgccattgaacgcatgatccacttcggacgggagttgcaggctatgtcagaacaactgaggcgggactgtgggaagaataccgccaataagaagatgttaaaggacgctttttccttgctcgcgtatagtgacccctggaattcgcccgtcgggaatcaactggatcctatacaaagagagcccgtttgctcggccctgaacagcgccatcctcgagacgcacaacctccctaaacagcctccacttgcgctagctatgggccaagctacccaatgcttgggattgatggctcgcagcgggatcggatcatgtgcattcgcgactgtagaggattaccttcactag

SEQ ID NO: 131693 - DNA, 387 bp, Artificial Sequence
  Description of Artificial Sequence: Synthetic coding sequence
atgttcgacgtaacttcccgggtgacttacaaaaacgttcccaactggcatagagatttagtccgagtatgcgagaacattcctatagttctgtgcggtaataaagtggatataaaggaccgaaaagtgaaagctaaatcaatagtattccataggaagaagaacttacagtactatgatatctctgccaagagcaattacaacttcgaaaagcctttcctttggttagcgaggaagctgattggggatcccaaccttgagttcgttgccatgcccgctttagcaccccccgaagtagtcatggacccggctcttgccgctcagtacgaacacgaccttgaggttgctcagactaccgccttgccggatgaggacgacgacttgtag

SEQ ID NO: 131694 - DNA, 702 bp, Artificial Sequence
  Description of Artificial Sequence: Synthetic coding sequence
atggccgctcagggggagcctcaggtacagtttaaactagtcttggtaggggacggtggaaccggtaagacaaccttcgtaaagagacaccttactggggagttcgagaaaaagtacgtggctaccttaggcgtcgaagtgcaccctctagtcttccacacaaataggggcccaattaaatttaatgtgtgggatacagctggccaggagaagtttggcgggctacgggacggttactacatccaggagatgggtattcatcatgtagcccatgctgggttggagctgatgagcagtgctcaatgtgcgattattatgttcgacgttactagtcgcgtgacatacaagaatgtcccaaactggcacagggatctcgttcgcgtctgtgaaaacatccccatcgtgctatgtgggaataaggtggatataaaagatagaaaggtgaaagcaaaatccattgtgttccaccgcaagaagaatctccagtattatgatatttcagccaagtcaaactataactttgaaaaacctttcctgtggctggctcgcaaactcatcggggaccccaatctcgagttcgtcgcaatgcccgcccttgctcccccggaggtggtaatggatcccgccctggccgcacaatatgagcatgacctggaagtcgctcagaccaccgctctgcccgacgaggacgatgatctttag

SEQ ID NO: 131695 - DNA, 651 bp, Artificial Sequence
  Description of Artificial Sequence: Synthetic coding sequence
atggccgcccagggggagccgcaggttcaatttaagctcgttctggttggcgatggcggtacgggcaagacgacctttgtaaagcgccacttgacgggagagtttgaaaagaagtatgtggctacacttggggtggaggtgcatcccctcgtgtttcataccaacaggggcccaattaaatttaacgtttgggacacggccggacaggagaagttcggaggccttagggatggatactacattcaggcccaatgcgccatcatcatgttcgatgtgacgagtcgagtaacttataagaacgtgccgaactggcacagagacctcgtgcgtgtatgcgaaaacatccctatcgtgctgtgtggcaataaggtggacatcaaagaccgcaaagtgaaggccaaaagtatagtcttccacagaaagaagaacctgcagtattacgatatttccgccaaaagcaactacaacttcgagaagccatttctttggctggcccgaaagttgataggcgaccccaacttggagtttgtggcgatgccggctttagcacccccggaggtcgtgatggacccagccttagccgcgcagtacgaacacgatctcgaggtggcacagactacagctctccctgacgaggacgacgacctctag

SEQ ID NO: 131696 - DNA, 705 bp, Artificial Sequence
  Description of Artificial Sequence: Synthetic coding sequence
cggagacgtagactgcgcctcaggcgcctgaattgtgcctcagccatcttcccggcctctgtggggcgcgcccggaggagattttggaagctggtacttgtgggcgacggcggaacagggaagaccacgtttgttaagagacacttgacaggggagtttgagaagaaatacgttgccacactgggagtggaagttcaccccctcgtgtttcacaccaatcgcggccctatcaagttcaatgtttgggacacagctggccaggaaaaattcggcgggctgcgcgatggttactatattcaggcacaatgtgcaatcataatgttcgacgtgacctccagggtgacttataagaacgtccccaattggcaccgcgatttggtcagggtgtgtgaaaatatccctatcgttttatgcggcaataaggtagacatcaaagatcgaaaagtgaaagcaaagtctatcgtgttccaccgaaagaaaaaccttcagtactacgacatctcagctaaaagcaattacaattttgagaaaccctttctgtggctggctaggaagttaatcggagacccgaacctagagtttgttgccatgcccgccctcgctccaccagaagtggtcatggatccagctttggcagcacagtacgaacacgatctcgaagtcgcccaaacaactgccctgcccgatgaggatgacgacttgtag

SEQ ID NO: 131697 - DNA, 387 bp, Artificial Sequence
  Description of Artificial Sequence: Synthetic coding sequence
atgtttgacgtgacgagtagagttacttacaagaatgttccaaattggcacagggatttagtgcgagtttgcgagaacattccaattgttctttgtggcaataaggtggatatcaaggacaggaaagtaaaagctaaaagcatcgtttttcaccggaaaaagaatctacagtactatgacattagtgccaagagcaactataactttgaaaaacccttcctgtggctcgcccggaagctgataggcgaccccaatctcgagtttgtcgccatgccagccttagcccctccagaggttgttatggatcccgcgttggcggctcagtacgaacacgaccttgaggtcgcccaaaccaccgccctgccagacgaggacgacgacctatag

SEQ ID NO: 131698 - DNA, 651 bp, Artificial Sequence
  Description of Artificial Sequence: Synthetic coding sequence
atggcagctcagggagagccgcaagtgcaattcaaactggtactcgttggggacggaggaacaggaaaaaccacattcgttaagaggcacctcaccggcgagttcgagaagaaatacgtggccaccctgggagtggaagtgcatcccctcgtgtttcatactaatagagggcctatcaagtttaatgtgtgggacaccgcagggcaggagaagttcggaggtctgcgcgacggttactacatccaagctcaatgcgccattataatgtttgacgtgacaagccgcgtgacctacaagaatgtgcctaactggcaccgagacctcgtcagggtgtgcgagaacattccgattgtcctctgcggcaacaaggttgatattaaggaccggaaagtgaaggctaaatcaatagtttttcaccgcaagaaaaatctgcagtactatgacatcagcgcgaagtccaattacaactttgaaaaaccgtttctatggctggcccgaaaacttattggcgaccccaacttggaatttgtcgccatgccagcattggcacccccggaagtggtcatggatcccgcactcgccgcccagtacgagcacgatctcgaagtggcccagactacggctcttcccgacgaagacgacgatctgtag

SEQ ID NO: 131699 - DNA, 5271 bp, Artificial Sequence
  Description of Artificial Sequence: Synthetic coding sequence
atgcggcgatccaaggcctacggcgaacgatacttggctagcgttcagggctccgctcccagtcctggcaagaagctgcgggggttctacttcgccaaactgtactacgaggccaaagaatatgacctggccaagaagtatgtctgtacatatttatctgtccaggagagggacccaagggctcatcgcttcctcggtcttctgtacgaactcgaggaaaacaccgagaaagccgtcgaatgctaccgtaggtctctggaattgaatccacctcagaaggatctcgtgttgaaaatcgctgagctgctttgcaagaacgatgtgaccgatggcagagccaaatactgggttgagcgcgccgccaagttgttccccggctcaccagcgatttacaagttaaaggaacaccttttggattgcgagggtgaggacggatggaataagctcttcgactggatacagtccgaactatatgtccgcccagacgatgttcacatgaatatccgcctagtggagctatatcggtcaaacaaaagactgaaagacgctgttgcgaggtgtcatgaggctgagagaaatatcgccctccgctcatctctggaatggaactcctgcgttgtacaaacactcaaggagtatttagaatcactgcaatgtttggaatcggataaaagtgactggcgggccaccaacaccgatctgctactcgcttacgctaacctgatgttgctcactctgagtacccgcgacgtccaggaaagcagagaactgctggaatcttttgattctgcgcttcagagtgcaaagagcagcctgggtgggaatgacgaattaagcgccacctttctggaaatgaaaggacacttttatatgcatgcaggcagcctgctgcttaaaatgggccaacacgggaacaatgttcaatggcaggcactgagcgagctggccgcactctgctacgtgatcgccttccaggtcccaaggccaaaaattaagctcattaagggcgaagctggtcagaacctgctggagatgatggcctgcgaccggctctctcagtccgggcacatgctcttaaatcttagccggggtaaacaggacttcctgaaggaggtcgtggagacttttgcgaacaaatctggccagagcgtcctttataacgccctgttcagctcacagagctcgaaggatacctccttcttgggttcagacgatatcggaaatatagatgtgcaggagcccgagctggaggatctggcacggtacgacgtaggggccattcaggcccataacggtagtttgcagcacctaacatggttgggcttgcagtggaactctctgccggccctcccaggcattcggaagtggttgaagcagttgttccaccatctgcctcaagaaacttcaagattggagaccaatgcccctgagtctatctgtatcctcgatctcgaggtatttttgctgggggtggtttacacatctcacctccaactcaaggagaaatgtaacagtcatcattcttcctaccagcctctgtgcctgcccttacctgtctgcaaaagattatgcaccgagcggcagaaatcatggtgggatgcagtttgtacactcattcatagaaaggccgtgcctggaaacagcgcggaactacgattggtggtccagcatgagatcaataccctcagagcccaagagaaacacgggctgcagccagcactccttgtgcactgggccaagtgtttgcagaaaatgggacgaggcttgaactcctcctatgaccagcaggagtatatcggtcgcagcgtgcattattggaagaaggtgctacccctgctcaagataatcaagaaaaactcaatccccgagcccatcgaccccctgttcaagcactttcatagcgtggatatacaggcaagcgagatcgttgaatacgaggaggacgctcatattacattcgctatccttgatgcagtacacggaaatatcgaagacgctgtaactgcatttgagtcgattaaatcagtcgtgtcgtactggaacctagccctgatctttcaccggaaggctgaagacattgaaaatgacgccgtatttcccgaggagcaggaagaatgcaaaaactatctgcgcaagacccgcgactacctaataaagattatcgacgactctgatagcaacctctcagtagtgaagaaattgcctgtccccctagaatctgtgaaagagatgctcaagtcagtaatgcaagagctggaggattactccgaaggcgggccgctgtacaagaacggatctctgaggaacgccgactctgagatcaagcatagtacccccagtcccacaaaatattccctcagtccgtcaaagagttacaagtatagcccaaaaacacctcccagatgggctgaggaccagaacagcctgaggaagatgatttgtcaggaggtaaaagcgataacaaagttgaatagctctaagtctgcttcccgacaccgatggccaacagaaaactacggaccggattcggtgcctgatggctaccaaggttctcaaactttccacggcgcccccctcactgtggcaaccaccgggcctagtgtgtactattcacagagccctgcttacaatagtcagtaccttttgcgccccgctgccaacgtcaccccaaccaaagggagctctaacacggagtttaagtccacgaaggaagggttttccatagctgtatcagccgatgggtttaagttcggcatctccgaacctgggaaccaggagaagaaaagcgagaaaccgctggagaatgacacaggattccaggcccaggacatcagtgggcagaagaatgggagaggcgtaatttttggccagacatccagtacctttacattcgcggacgtagccaaatcaacgagcggcgaaggatttcaatttgggaaaaaggatcccaatttcaaaggcttttccggcgccggcgagaagctgttcagctcacagtgtggtaaaatggccaacaaggccaatacttccggcgacttcgaaaaagatgatgacgcatgcaaaaccgaggactctgacgacattcattttgagcctgtggtccaaatgcccgaaaaagtcgaactagttacaggtgaagagggggaaaaggtgctttattctcagggtgttaagctgttcagattcgacgccgagatctctcaatggaaggagcgtggtctgggaaatttaaagattctaaaaaatgaggtcaatggcaagcccagaatgctaatgcgcagggaccaagtgctgaaagtgtgtgctaaccactggatcacaactacgatgaatctgaagccactgtcagggtccgatcgcgcttggatgtggcttgctagtgacttcagtgacggtgacgccaagcttgaacgcctggccgctcagttcaaaactcctgagctcgccgaggaattcaaacagaaattcgaagaatgtcaaagactactgcttgacatccccctgcaaaccccacacaaactggtagataccgggcgtgctgcgaaactcatacagcgggccgaggagatgaagtccggcctgaaggatttcaagaccttcctcacaaatgatcagactaaggtgacggaggaggagaataaaggctcaggtactggagctgcaggagcttcagacaccactattaagcctaaccccgagaataccggtccaactctggaatgggacaactacgacctgcgggaggatgctctagatgataacgtatcttcctcttcagtgcacgactcccccttggcatcctcgccagtacgcaaaaacatcttcaggttcgacgagagcactacaggatttaactttagctttaaaagcgctctcagcctgtctaaaagtcctgctaagttgaaccaatcaggcacctccgttgggacagatgaagagagtgacgtgacccaggaggaggagcgggatgggcagtacttcgagccagtcgttcctctcccagacctggtggaagtaagctctggcgaggagaatgagcaggttgtcttctcccatcgcgcggagctgtatcgatatgacaaagacgtcggccagtggaaggagcggggtataggggatatcaaaatccttcagaattacgacaataaacaagtccgaatcgtgatgagacgtgatcaggtgctcaaactgtgcgccaatcaccgcatcaccccagacatgtctctccaaaatatgaaaggaacagaaagagtgtgggtctggaccgcctgcgacttcgccgatggggaaagaaaggttgaacacttagcagttagatttaagctacaggatgtcgccgattcattcaagaaaattttcgacgaggcgaaaacagctcaagaaaaagattccttgatcactccgcatgtgagtagaagctctaccccacgcgaaagcccatgtggaaagattgcagtggctgtgctggaggagactactcgcgagcgcaccgatgtgattcagggggacgatgtggccgatgctgcttccgaggttgaggtaagttctacctccgagaccacaaccaaggcagtggtgtctccacccaaattcgtctttggctctgaatccgtcaagagaatttttagctccgaaaagtctaatccatttgcgttcgggaatagtagcgctacgggctcccttttcggcttttccttcaacgctcccctgaaatcgaatgattcagaaaccagcagcgtagcacagagcggctcagagtcaaaagtcgagccaaagaagtgcgagctcagcaagaattccgacatagaacagtctagcgacagtaaggtgaagaatctgagtgccagctttcccatggaggaatcatccatcaattacacattcaagaccccagaaaaggaaccccctctttggcacgccgaatttacgaaggaggagctagtgcagaagttatccagtacaacaaaatcagcggaccaactcaatggcctgctaagagaaactgaagccacctcagccgtgttgatggaacaaattaagctgctaaaaagtgaaattcgtcgattggaacgtaatcaggaggagagcgcagccaacgtggagcacctaaagaatgtactcctgcagttcatctttctgaaaccaggctctgagagggaatcactgctgccggtgatcaacactatgctgcaactcagtccagaggagaagggcaaacttgcggccgtcgcccagggactccaggaaaccagcatcccaaagaagaagtag

SEQ ID NO: 131700 - DNA, 5247 bp, Artificial Sequence
  Description of Artificial Sequence: Synthetic coding sequence
atgaacgtcatgggttttaataccgatagactggcttggaccaggaataagctacgaggattttatttcgctaaactctactacgaggccaaggagtatgaccttgccaagaagtacgtctgcacatacttgtcggtccaggagcgcgaccctcgggcacataggttccttggcctcctctatgaactggaggagaataccgagaaggccgtcgagtgttacagaagatcgctggagctgaacccgccccagaaagacctggtcctgaagatcgcagaactgctgtgcaagaacgatgtgactgatggaagggccaagtattgggtggaacgggctgccaagctgttcccgggtagccccgcaatttacaagcttaaggagcacctgctcgattgtgagggtgaggatggctggaacaagctctttgactggatccagagtgaactatacgtcagacccgacgatgtacacatgaacatcaggctggtggagctgtacaggtcaaataagcgactgaaggacgcggtggcacggtgccacgaggccgaacggaacattgcactccgctcctcactggagtggaacagctgcgtggtgcagaccttaaaggagtacttagagtctttgcagtgtttggagagtgacaagagcgattggcgcgccactaacaccgatcttctccttgcgtacgcaaatctgatgctactgacactgtctacgagagacgtccaggaaagtagagaactgctggaaagcttcgactcagctctacagagcgccaaatctagccttggaggcaacgacgagctgtccgcaacttttttggaaatgaaaggtcatttctacatgcatgccggctccctcctgctgaaaatgggtcaacatggcaataatgtgcaatggcaggccttgagcgagttggcagccctgtgttatgtcatcgcttttcaagtccccagaccaaaaattaagttaatcaagggagaagctggccagaatttactggagatgatggcatgtgatcggctgagtcaatccggacacatgctgttgaacctgtcccgaggcaaacaggattttctcaaggaggttgttgagacgtttgctaacaaaagcggacaaagcgtcctttacaatgccctgttcagctcacagagttctaaagacacaagtttcctggggagcgacgatataggtaacatcgatgtccaggagccagagctggaagatctcgcccgttacgacgtcggggccatccaggctcataacgggtctctgcagcacctcacctggcttggcctgcagtggaattctctgccagctttgcctggtatcaggaagtggttaaaacagctcttccaccatctacctcaggagacttcaaggcttgagaccaacgcccctgagtctatttgtattctcgacctcgaggttttcctcctgggcgtggtttatacttctcatctgcagcttaaggagaaatgcaacagtcatcactcttcctatcaaccactgtgtcttcctctgcccgtttgtaagcgcctgtgcactgagagacagaaatcatggtgggatgctgtctgcactctcattcatcgcaaagcagtgccagggaactcagcagaactgcggcttgttgtgcagcatgagattaataccctcagagcccaggagaaacatgggcttcagcctgccctcttagtgcattgggccaagtgtcttcaaaaaatgggccgaggcctgaatagctcatatgaccagcaagaatacataggccggtccgtgcactactggaagaaggtcttgcccctgctgaagattataaaaaaaaattctattccagaaccaatagatccgctgtttaagcacttccacagcgttgacatccaggcatccgaaattgtggagtacgaggaggatgcacatattacatttgcaatcctggacgccgtgcacggcaatattgaggatgcagtaactgcattcgaatccatcaagtcagttgtgtcgtactggaacctggctctcatcttccacaggaaggccgaggacattgagaatgacgccgtttttccagaggagcaggaagagtgcaagaattacctgaggaaaacacgggactacttgatcaagatcattgacgactccgactccaatctgagcgttgtgaagaagcttcctgtacctcttgagtccgtgaaagaaatgttgaagtccgtaatgcaggagttagaggactactcagaaggaggtccgctgtacaaaaatggctctctccgcaacgcagactccgagatcaaacactccacaccttcacctactaagtatagcctgtctccatccaaatcttacaagtactcccctaagaccccccctcgttgggctgaggatcagaattctttgagaaagatgatttgtcaagaggtgaaagcaattacgaagctgaattcaagcaagtcagcctccaggcaccggtggcctactgaaaattacggacccgactctgttccagatggatatcaggggtctcaaacttttcacggtgccccactgactgtggctactactggaccttccgtttactattctcagtccccggcttataattctcaatacctcctacgcccagccgccaacgtgaccccgaccaaaggtagctccaacaccgaattcaaatcaaccaaagaagggttctcaatcgcagtgtcagccgatggtttcaagttcggtatctctgaaccgggaaaccaggagaaaaagtctgagaaacccctcgagaacgataccgggtttcaggcccaggacattagtggacagaagaatgggagaggcgtcatcttcggccaaacctcaagtacttttacttttgccgacgtggctaagtccactagtggggaaggatttcaatttgggaagaaggaccctaattttaaggggttctcaggggcaggggagaaactctttagctcacagtgtggaaaaatggccaataaggccaacacctcaggggatttcgaaaaggacgacgatgcatgcaagacagaagatagcgacgatattcactttgagccagtcgtacagatgccggaaaaagtcgaattagtcaccggggaggagggggagaaagtgttatattcacagggtgttaaactcttccgctttgatgcagagatctctcagtggaaggaaaggggacttggaaacctgaagattctaaaaaatgaagtgaacggtaaaccccgtatgctcatgagacgtgaccaggttctgaaggtctgcgctaaccattggatcacaaccactatgaatctgaagcccttgagcggcagcgatagggcatggatgtggctcgcatcagacttctcggacggggatgccaaattagagcgcctggccgcccagtttaagactccagaattggccgaagagttcaagcagaagttcgaggaatgccaaaggctgctattagacatcccgctgcaaacacctcataagcttgtggatactgggcgggcagctaagctcattcaaagagctgaagaaatgaaaagtggtctcaaggacttcaagacctttctgaccaacgatcagacgaaggttacagaggaggagaataaggggtctggaaccggcgctgccggtgcctctgacacaactatcaaacctaatccggaaaacactggtcccaccctggaatgggataactatgatctccgcgaggacgccctcgatgataatgtttctagctcgtccgtgcacgactcacctctcgcatccagccccgtgcgcaagaacatattcagattcgatgagagcaccacggggttcaacttctccttcaaatcggcactctcactctcgaaatcccctgctaagctgaaccagagtgggactagcgtgggcaccgatgaggaatcagatgtgacgcaagaggaggagcgagacggtcagtactttgaaccagtggtaccacttccggatttggtagaggtttccagcggagaagagaatgagcaagtggtctttagccaccgcgccgagctctatcgatacgataaggacgtcggccagtggaaggaacgtggcattggcgatataaagattttgcaaaattacgacaacaaacaagtgaggattgttatgaggcgcgatcaggtcctgaaactgtgtgctaaccacaggataactcccgatatgtccctccaaaacatgaaaggtacagagagggtgtgggtgtggactgcatgcgatttcgcagatggagagaggaaggttgaacacttggcagtgcggttcaaactgcaggacgtggcggactctttcaagaagatatttgacgaggccaaaaccgcacaggagaaggattcactgatcacccctcatgtatcccgttcaagcaccccccgtgaatctccgtgcggcaaaatagctgtggcagtcctcgaggagactactcgcgagcggaccgacgtgattcagggcgacgacgtggcggatgctgcctcagaagtggaggtcagcagcacaagcgagaccactacaaaggccgtcgtatcccctcctaaatttgtcttcggatctgagtccgtgaaacgtatcttttcatctgagaagagcaatccgtttgcctttggcaactcatccgcaaccggaagcctgttcggattttcgttcaatgcacccctgaaatccaacgactccgaaacctcttcagttgctcagtcagggtccgagtcaaaggtggagccgaagaagtgtgaactgtcaaaaaattctgatatagaacagagcagtgattcaaaggtgaaaaatctttccgcttctttccctatggaagaaagctctatcaactataccttcaaaacccccgagaaggagcctcctttatggcacgccgagtttacgaaggaggagttggtgcagaaactctccagcactacaaagagtgcagaccagctgaacggactactgcgggagactgaggcaacaagtgccgtgctcatggagcagattaaactgctcaaaagcgaaataagacgcctcgaaaggaaccaggaagaaagcgctgccaatgtggagcatctgaagaatgtcttgctgcagtttatctttctgaagcctggaagcgaaagggagtctcttttgcctgtgatcaatactatgctgcaattaagtccagaggagaagggaaagttggctgcagtggcacaaggcctacaggaaacctcaatcccaaagaagaagtag

SEQ ID NO: 131701 - DNA, 1935 bp, Artificial Sequence
  Description of Artificial Sequence: Synthetic coding sequence
atgctgatgagaagagatcaagtactcaaagtgtgtgccaaccactggatcactacgacaatgaacctgaaacccctttccgggagtgatcgggcctggatgtggctggcttcagatttcagcgacggagatgcgaaacttgagcggctcgcagcccagttcaagaccccggaacttgcagaggagttcaagcaaaaattcgaagagtgccagcgccttctgctggatatccctttgcaaacacctcataagctggtggacacgggtcgggccgctaagcttattcagcgggccgaagaaatgaagtccggtctgaaggatttcaagacctttttgacaaacgatcagacgaaggtgacagaagaggagaacaagggctccggtaccggggccgccggggcatctgacacaacgattaagcccaatcctgagaatactggtccgaccttagagtgggacaattatgatttgagagaggacgcccttgacgacaacgtgtccagttcgtctgtccacgacagccccttagcttcaagcccggtccggaagaacatattccgatttgacgagagcacaacgggcttcaattttagcttcaaaagcgcactgtcccttagcaagagccccgcgaaactcaaccaaagtggaacaagcgtggggactgatgaggaatctgatgtcacacaggaggaggagagggatgggcaatacttcgagcctgttgtgccattgccagatctggtggaagtcagcagcggagaggagaacgaacaggtggtgttctcccatcgcgccgaactttatcggtatgataaagacgtcggtcagtggaaggagcgcgggattggggatatcaagatcctccagaactatgataacaagcaggtgcggatcgtaatgcggcgggaccaggtcctcaaactgtgtgctaatcacagaattacccccgatatgagcctgcaaaatatgaagggcaccgagcgggtgtgggtatggactgcctgtgattttgccgatggggagagaaaggtcgagcacctcgccgtgcggtttaaactacaggatgtagcagactcttttaagaagatttttgatgaagcgaaaaccgctcaggaaaaggactcactcattacaccccatgtttcacggagctctacccccagagagtccccttgtggaaaaattgctgttgctgtgctcgaggaaaccacaagagaaaggacagacgtgattcagggcgacgacgtagctgacgccgcttccgaggttgaggtttcatcgaccagtgagacgacaacaaaagccgtggtgtccccacccaagttcgtatttggatcagagtctgtgaagaggatttttagcagcgaaaaatcgaaccccttcgcttttggtaactcaagtgcaactggcagtctgttcggattctctttcaatgctccattgaagtcaaacgactcagagacaagctctgtggcccagtccgggtctgaatctaaggtggaaccgaaaaaatgcgagttgtccaaaaactcagacatagagcagtcatccgattccaaagttaaaaatctctccgcaagctttccgatggaggaatcctccattaactatactttcaaaacaccagaaaaagaaccccctctgtggcatgccgaatttacgaaggaagaactagtgcagaaactctcctctactacaaagtctgccgaccagctgaacggccttctaagggaaaccgaggccacatcagcagtgctgatggagcagatcaagctcctgaaatcagagatacggcggttggaacggaatcaagaggagtccgcagccaatgttgagcaccttaaaaatgtactcctgcaatttatttttctcaagccagggagtgaaagggaacctagctcgtgctacaaatatgatgtcgccgcccagccatag

SEQ ID NO: 131702 - DNA, 5247 bp, Artificial Sequence
  Description of Artificial Sequence: Synthetic coding sequence
atgaatgtgatgggctttaacaccgacagactcgcctggacacgaaataagttgaggggcttttactttgcgaaactttattatgaagcaaaagagtatgacctggccaagaaatatgtgtgcacttatctttccgtccaggagagggacccccgcgcccaccggttccttggactcttatacgaattggaggagaatactgagaaggccgtggaatgttacaggagaagtctggaattaaatcccccgcaaaaggacttggtgctgaagattgcagaattactgtgtaagaatgatgtgaccgatggaagagccaagtactgggtggagagagcggcgaagctgttccccggctcccccgcgatttataagctgaaggagcatctcctggattgcgagggggaggatggatggaacaaacttttcgattggatacagagcgagttgtacgtgaggcccgacgatgtgcacatgaacattaggcttgtggagctctaccgatcaaataaaaggctgaaagatgcagtcgcaagatgccatgaggctgagcgcaacatcgccctgcgatcttctcttgaatggaactcttgtgtggtgcagactctgaaggagtacctcgagagcctgcagtgcctcgaatccgacaaaagcgattggcgcgccacgaacacagatctgcttttggcatacgccaatttgatgctgctgacacttagtacccgagacgtgcaggaatcacgcgagcttcttgaaagcttcgactccgcgctgcagagcgctaaatcctcgctgggaggtaatgatgagctgtccgccacttttctcgaaatgaagggacatttctatatgcatgctggtagcctcctccttaaaatgggtcaacatgggaataatgtgcagtggcaagccctttcggagttagctgccctgtgctacgtgatcgcctttcaagtgcccagacccaaaattaagctgattaagggagaagcaggacagaaccttctggaaatgatggcctgtgaccggctttcacagtcgggacatatgctactcaatttaagccgcggcaagcaggacttcctaaaggaggtcgtggaaacttttgcaaacaaatccggtcagagcgtgctttataacgcattattctcttctcaatcctctaaagacacttcattcctggggtcagatgatatcggtaacatcgacgtccaagaacccgagttggaggatctcgctcggtacgacgttggcgcaatccaggcacacaatggaagcctgcaacatctgacgtggcttggtttgcagtggaacagtctgccggctctcccaggcattcggaagtggctgaaacagctttttcatcacctaccccaggagacaagcagactggagacgaacgcccccgagtctatatgcatcctggatctggaagttttcttgcttggcgtggtttacacctctcatctacagctgaaagaaaagtgcaacagccaccactcttcttaccagccactgtgcctacccctgccagtgtgtaaacggttgtgtacagagcgacagaagtcctggtgggacgccgtgtgtacactgattcaccggaaagctgtccctggcaattccgccgaactacgcctagtcgtgcagcacgaaatcaacaccctgagagcgcaggagaagcacggactccagcctgctctgctggtgcattgggccaaatgtctgcaaaaaatgggtcggggcttgaactcatcttatgatcagcaagaatacattggaaggtcggtgcactactggaaaaaagtgctgccgttacttaagattataaaaaaaaattcgattccagaacctatagaccccctgttcaaacatttccattctgtggacattcaggcttctgaaatcgtcgaatatgaggaagatgctcatattacctttgcaattttggatgccgtgcacggtaatattgaagacgcagtaaccgcatttgaaagtatcaaatccgtcgtctcttattggaacctggctctgattttccacaggaaggctgaggacatcgagaacgacgccgtgtttcctgaggaacaggaggaatgcaaaaactacctacgcaaaacccgggactacctcattaaaattatcgacgattcggacagcaacctgtctgtggtaaagaaactcccagtccctttggaaagcgtgaaggagatgctgaagagtgtgatgcaggagctagaggactattcagaagggggtccgctatataagaatggctcattgagaaacgctgactcagaaatcaaacattccacaccttctccaaccaagtattcattgagcccctccaaaagctataaatactccccaaagacccctccaagatgggccgaggaccaaaattccttgcgtaagatgatatgccaggaagtgaaagcaatcaccaaactgaacagttcaaaatcagcatccagacatcggtggcccaccgagaactacggccccgattcggtccctgacggctatcagggcagccagaccttccacggagctccactcaccgtggcgacaacgggtcctagcgtgtattactcacaatccccggcctacaactcccaatacctcctgcgtcccgccgcaaacgtcactccaaccaaggggtcttcaaacaccgagttcaagtctacaaaggagggttttagcatagcagtgtctgctgacggtttcaaattcggaatcagtgagccgggaaatcaggagaagaagagtgaaaaaccacttgagaacgacacaggctttcaggcgcaagacatcagcggccaaaaaaatggccgcggggttatttttgggcaaacctcaagtactttcacattcgcggatgtggccaagtccacttctggggaggggttccaattcggaaaaaaggaccccaactttaaggggttttccggcgccggggaaaagctctttagctcccagtgcggtaaaatggccaataaggcaaatacatcgggagacttcgagaaggatgacgatgcatgtaagaccgaggactctgatgacatccatttcgagccggttgtgcagatgcccgagaaagtggaactggtgaccggcgaagaaggcgagaaggtcttgtactctcagggtgtgaaactgtttagatttgacgcagagatcagtcagtggaaggaacggggcctcgggaacctgaaaattctgaagaatgaggttaacggcaaaccacgcatgttaatgagacgggatcaagtattaaaggtctgcgcgaaccactggattaccactacaatgaatctcaagccactgtccgggagtgatcgggcttggatgtggttggctagcgacttctcagacggtgacgccaagcttgaacgcctcgccgcacaatttaaaacaccagaattagcggaggagttcaagcagaaattcgaggagtgccagagactgctactggacatccccctgcagacccctcacaagttggtggatactggtcgtgcagcgaagttaattcaacgcgccgaggagatgaagagcggcctaaaggatttcaagaccttccttaccaacgaccagacaaaagtgaccgaagaagagaacaaaggcagtgggaccggtgcagctggcgcttcagacaccaccatcaagccaaaccccgagaacactgggccaaccctggagtgggataactacgacctgagggaggatgcgctggatgacaacgtgagcagcagctctgtgcacgactcacctctggccagtagccccgtcaggaaaaatatttttcggttcgacgaatcaactactggctttaattttagttttaagtctgcactgtctcttagtaagagccctgcaaaactgaaccagtcaggtacctctgtcggcaccgacgaagagagtgatgtcacacaggaagaggagcgggacggtcagtacttcgaacctgtagtccccctgccggatttagtcgaggtttcgagtggggaagaaaacgagcaggtggtgttttcacatcgggcagagctataccggtacgacaaagatgtcggccagtggaaagagcgcggcatcggtgatattaaaattctgcaaaattatgataacaagcaagtgaggattgtgatgaggcgcgaccaagtgctgaaactgtgtgccaaccataggatcactccagacatgtcactccaaaatatgaagggtactgagcgcgtgtgggtttggacagcctgtgatttcgccgacggtgagcgtaaggttgaacacctggctgtccgcttcaaacttcaggatgtcgccgacagcttcaagaaaattttcgacgaggccaagactgcacaagagaaggactccttgatcacacctcacgtcagtagaagcagcactcctagggaaagtccttgcggcaagattgccgttgccgtcttggaggagaccactagggagcgaacggacgtgatccagggggatgacgttgcagatgccgcatccgaggttgaggtcagtagcacctccgagaccacaacaaaagctgtcgtgagcccgcctaaatttgtgtttggttccgagtcagtcaagcgaatcttctcatcagagaagtctaatccctttgcatttggtaattcttccgcaactgggagtctcttcgggttctctttcaacgccccacttaagtcaaacgattctgagacatcctccgtcgcacagtctggctccgagtccaaagtcgagccaaagaagtgcgaactgagcaaaaacagtgacattgagcagtcctctgattccaaggtaaagaacttgtctgcatcttttccgatggaagaaagctctatcaattataccttcaaaacaccagagaaagagcctcccttgtggcacgctgaatttaccaaggaggagcttgttcaaaaactgtccagcactacaaagagcgccgaccaactgaatggtttgctcagagagactgaagctacttctgcggtcctcatggagcaaatcaaactcctgaaaagtgaaattaggaggctggagaggaatcaagaggaaagcgcagccaacgtggaacaccttaagaacgtcctcctgcagttcatttttttgaagccgggctcagaacgggagagcctgttaccagtcattaatactatgctccagctgtctcctgaggaaaagggaaagcttgctgcagtggcgcagggccttcaggagactagtatccccaagaagaagtag

SEQ ID NO: 131703 - DNA, 3042 bp, Artificial Sequence
  Description of Artificial Sequence: Synthetic coding sequence
atgctgaagtcggttatgcaagagctggaggactacagtgaggggggacctctgtacaagaatggatcccttagaaacgccgattccgagatcaagcattcgaccccatccccgaccaagtactcactatcaccatccaaatcttacaaatattctcccaagaccccccccaggtgggctgaagatcagaactcattgcggaagatgatttgtcaggaggtgaaggccattaccaagttgaacagcagcaagtcagcatcccgccacaggtggccaacagagaactatggccccgatagtgtgcccgatggctatcagggaagccagacatttcatggagctcctctcaccgtagcaaccactgggccctccgtttactactctcagtcccccgcttacaatagtcagtacctgttaagacctgcagcaaacgtgacccccaccaaggggtccagtaataccgagtttaaatcaacgaaagaggggttttccatcgcagtttctgctgacggcttcaagtttggcatatccgagccaggaaaccaggagaagaaaagcgaaaagcccctggaaaacgacaccgggtttcaggctcaagatatatccgggcagaagaatgggaggggagtgattttcggacagaccagttccacttttacattcgctgacgttgccaaatccacctctggcgagggcttccaatttggaaagaaagaccccaattttaaaggcttctctggagcgggcgagaagttattttcatctcagtgtggtaagatggcaaacaaagccaacacctctggagactttgagaaagatgatgacgcctgcaaaactgaggactcagacgacatacattttgagcccgtggtgcagatgccggaaaaggtggaactggtcaccggggaagaaggcgagaaggtgctctactcgcagggggttaagctctttcggtttgacgctgaaatctcccaatggaaagaacgcggtctgggtaacctcaaaattctgaaaaatgaggtgaatggcaaaccgcgtatgctcatgagacgcgaccaggtgttaaaggtgtgtgcaaaccattggatcactaccacaatgaatttaaagcccctgagtgggagcgatagggcctggatgtggctcgccagcgacttctctgatggcgacgctaaacttgaacgtctggccgcccagttcaagacaccagaacttgcagaggagttcaagcagaagtttgaagagtgccagcgactcttgctggacatcccccttcaaactccacacaagttggtggatacaggcagggccgcgaagctcatacagcgcgccgaggaaatgaagtcaggactcaaggactttaagaccttcctgaccaatgatcaaactaaagtcaccgaagaggagaataaaggctctggaacaggcgctgcaggcgccagtgacaccacgattaaaccgaacccggagaatacgggaccaacactagaatgggacaattatgacctacgcgaggacgctcttgatgacaacgtgagcagctcatccgtgcatgacagtcctctggcttccagtcctgttagaaaaaatatctttcgttttgatgagagcaccacgggctttaatttctctttcaagagcgcactatcattatcaaaaagcccggcgaaattgaaccagtcaggcacctctgtggggaccgatgaggagtcagatgtgacacaagaggaagaacgcgacggtcaatactttgaacccgtggtgcccctcccagacctagtcgaggtttcgtccggagaggagaatgagcaggtcgtattttcacatatggccgagctctacaggtatgataaggatgtcgggcagtggaaagaacgcggcatcggagatattaaaatactgcagaactacgataacaaacaggttaggattgtgatgcgtcgcgaccaagtcctaaagctgtgtgctaaccatcgcatcaccccagacatgtcacttcaaaatatgaaaggtacagagcgagtgtgggtgtggactgcttgtgactttgccgatggcgagagaaaggttgaacatctggcagtgaggtttaagctccaagatgtagcagatagtttcaaaaaaattttcgatgaggctaaaaccgcacaggaaaaggactcactgatcacaccccatgtgagccggtctagtactccacgtgaatccccctgcggaaaaatagccgtggccgtgctggaagaaactaccagagaacgtacggacgtcatccaaggggacgatgttgctgacgctgccagtgaggtggaggtgtcctccacctctgagactaccactaaagcagttgtgtccccgcctaagttcgtgtttgggtcagagtctgtcaagcggattttctcctccgagaagagcaatcccttcgcattcggtaattcctccgcgaccggcagcctgttcggcttcagtttcaatgcccccttgaaatcaaatgattctgagacctcttctgtagcccagagcggttccgagagcaaggtggaacctaagaagtgtgagttgagcaagaattccgatatagagcaatcatcggattctaaggtgaagaatttatctgcgtcttttccaatggaggagtcttctattaactacacctttaagactccagagaaagagccccccctgtggcacgccgagttcactaaagaggagctagtacaaaaattgagctctaccaccaaaagcgcagaccagctcaatggcctattgcgtgagacagaagcaacctctgccgtgctaatggagcaaataaagctgctgaagtcagagattcgaagactggagcgaaaccaggaggaaagcgccgctaacgtagagcacttgaaaaacgtcctcttacagttcatctttctaaagcctggtagtgagcgtgaatccttattacccgtgataaacacgatgttacaattaagccctgaggaaaaaggcaagctggctgctgtggcccaggggctgcaggaaacatcgatccccaagaagaaatag

SEQ ID NO: 131704 - DNA, 5271 bp, Artificial Sequence
  Description of Artificial Sequence: Synthetic coding sequence
atgcgtcgctcaaaagcctacggcgagcggtacctggcatcagtccaaggcagtgcaccaagcccggggaaaaagctgagaggcttctattttgccaaactgtattatgaggcgaaggagtacgacctcgctaagaagtacgtttgcacatacttgtcggtgcaggaacgcgacccccgcgctcaccgctttctgggactgctgtatgagctagaggaaaacacagagaaggctgtcgagtgttaccggcgatcattagaacttaacccgccccagaaagacctcgtcctgaaaattgccgaactgttgtgcaagaatgatgtcacagatggacgtgccaagtactgggtggagcgggcagctaagctgtttcctggatccccagccatttacaagttgaaggagcaccttctggattgcgaaggcgaggatggatggaataaactcttcgattggatacagtcagaactgtatgttcggcctgacgatgttcacatgaacataagactggtagagctttataggtccaacaagcgtctcaaggatgccgtggcaaggtgccatgaggctgagcgcaacatagctctgagaagcagtctcgaatggaattcttgcgtcgtccagacattaaaggagtacttagagagccttcagtgcctcgagtccgacaaaagcgattggcgcgctaccaacacagacctgttgctcgcctacgccaacctcatgcttcttaccctgtctactcgcgacgttcaggagagcagagagctcctggagtcattcgatagtgcactgcagagcgcaaagtcttcacttggagggaacgatgaactgtccgctaccttcctcgaaatgaagggccacttttatatgcatgcaggctctcttctgttaaagatgggacagcacggcaataacgtgcagtggcaggcactgtccgagctggccgcgctctgctatgtgattgcgtttcaggttccccgcccaaagataaagctgatcaaaggagaagcaggccaaaatttgttagagatgatggcttgcgaccggttaagccagagcgggcacatgttactgaacctgagtaggggaaaacaggacttccttaaagaagtggtcgagaccttcgcaaacaagagcggccagtcagttctgtacaatgcattgttttccagccaatccagtaaggacactagttttctggggagcgacgacatcggaaatattgatgtgcaggaaccagaactagaagatctcgcccgttacgatgtaggagcaattcaggctcacaacgggtcactgcaacatctaacatggctcgggctccaatggaattcactgcccgcactgcctggcattcgcaaatggttaaaacagctcttccatcatctcccccaggagacctcccgcctagagacaaacgctcctgaatctatatgtatcttggatctcgaggtattccttctgggcgtggtctatacttcccatcttcagctgaaagagaaatgcaattcccaccattcaagctaccagccgctgtgcctgccattgcctgtgtgtaagcgtctttgcaccgagagacagaaaagctggtgggatgccgtttgcacactcattcacagaaaggcagtgcccggcaattcagctgagcttcggctggtggtacagcacgagatcaataccttacgtgcccaggaaaaacatggccttcagcctgctttactggtgcactgggctaaatgcctacaaaaaatgggaaggggccttaactcttcgtacgaccaacaggagtacatcggcagaagcgtccattactggaaaaaggtgctgccactgctcaaaatcattaagaagaattccatacccgaacctattgaccccctctttaagcactttcattcagtcgatatccaggcctctgagatagtcgagtatgaggaggatgctcatataacgttcgctatcctggatgcagtgcatggtaatattgaagatgccgtcaccgccttcgaatcgatcaagtccgttgtgagctactggaatctcgccctcatctttcatcgcaaagccgaagatatagagaacgacgccgtcttccccgaagagcaggaagagtgtaagaactatctccgtaagacccgggactatctgatcaaaattattgatgattccgactccaatttgagcgtggtcaaaaaactcccagtccctctggaatctgtgaaggagatgctcaaatcagtcatgcaagagttggaagattactctgaaggcggccctctgtataagaacggaagcctgcgtaacgcagactctgaaataaagcatagcacaccgagtcccacgaaatatagcctgagcccttctaaatcttacaagtacagtcccaagaccccccccagatgggctgaagatcagaactccctgcgaaaaatgatttgccaggaagtgaaggctatcaccaaactaaattcttcaaaaagcgccagcaggcatagatggccgacggagaactatggaccagattccgtccccgatggctaccaaggatcccagacattccacggtgcccctctgaccgttgctactacgggcccaagcgtgtactattctcagagccccgcatacaatagccagtacctcctgaggccagcagccaatgtcacacccaccaagggctccagcaataccgagtttaagagcaccaaggaaggcttcagcatcgccgtgtcggcggacgggttcaagttcggtatctccgagcctggtaaccaagaaaaaaaatcggagaagccgctggaaaacgatacgggctttcaggctcaagatatctccggacagaaaaacggtaggggcgtaatctttgggcagacaagctcaacgttcacctttgccgatgtcgccaaatcgacttccggagagggcttccagtttggcaagaaggatcctaactttaagggattttcaggcgccggagaaaagctgttctctagccaatgcggaaaaatggcaaataaagcaaacacctccggcgacttcgagaaggacgacgatgcatgcaaaaccgaggattcagacgatattcacttcgagccagtggtgcagatgccagagaaggttgaactggtgactggcgaagaaggggagaaagtgctgtacagccagggggtgaagttgtttagatttgacgctgagattagccaatggaaagaaagagggctcggcaacttgaaaatcctcaagaacgaagtgaacggcaaaccacgaatgctcatgagacgggaccaggttctcaaagtgtgcgctaatcattggataacgaccaccatgaacctcaaaccattgtccggatctgatagagcctggatgtggctggcatccgacttttcagacggcgatgccaaactcgaaagactagcagcccagtttaagaccccagagctggctgaggaattcaagcagaaatttgaggagtgtcagcgccttctgctcgatattcctctgcagacacctcataagctcgtggacaccggaagggccgcaaagctgatccagcgcgccgaggaaatgaaatccggactcaaagacttcaagacttttttgactaacgatcaaacaaaagtcactgaagaagaaaacaaagggagtggcaccggcgctgcaggcgcctcggatactacaatcaagcctaatcccgagaacactggaccaacccttgaatgggataactacgacctgcgggaagacgcactcgatgacaacgtttcttcctctagcgtgcatgatagtcccttggcctcatcccctgtccgcaagaatatttttagatttgacgaatccacaacaggatttaatttctcattcaaatccgcactctcgctgtcgaaatcaccagctaagttgaaccagagcggcacctccgtcggaaccgacgaggagagtgatgtgactcaggaagaggaacgagatgggcagtactttgaacctgtggttcccttaccagatctggtggaagtgtcctcaggggaagaaaatgaacaagtagtcttttcacatatggcagaactgtaccggtatgacaaggatgtgggacagtggaaggaaaggggcatcggcgacataaagatattgcaaaactatgacaacaagcaggtgaggatcgttatgcgcagagaccaggtgctaaaactttgcgccaatcacaggatcacaccggacatgagtctgcaaaacatgaagggtaccgagagggtatgggtgtggactgcctgcgacttcgctgatggcgaacgtaaggtggagcacctggcagtgcgattcaagcttcaggatgtggccgacagcttcaaaaagatctttgatgaggccaaaactgcccaggaaaaagactccctgattacacctcatgtgtctcggtcaagtacgccacgcgagtcaccatgtggaaaaattgccgttgcagtcttggaagaaactaccagagaaaggactgacgtaatccaaggggacgacgtagccgacgcagcgtcggaggtggaagtctcctcaactagtgagaccactacgaaagctgttgtttccccccccaaattcgtgttcggtagcgagtctgtgaaaagaattttttcctctgaaaaaagtaatccgtttgcgttcggaaattcaagtgccacaggatctctgttcggcttttcctttaatgcccctctaaaaagtaatgactccgagacctccagcgtggcacaatccggcagtgagagcaaggtcgagcccaagaagtgtgaactgagcaaaaacagcgacatagagcaaagctccgacagtaaggtgaaaaatctgagtgcctcgttccccatggaggaatcatccattaattataccttcaagactcccgaaaaggagcctcctctgtggcatgctgagtttacaaaggaagaactggttcagaaactgagcagtactaccaaaagcgctgaccaacttaacggactgctgcgagaaactgaggccacaagtgccgtgttaatggagcagataaagctactgaaatctgaaatacgccggctggagcggaatcaggaggaatctgctgccaacgtggaacatttgaaaaatgttctcctgcaattcatttttctcaagccggggtctgagcgggagtcccttttgccagttatcaatactatgctgcaactctctcccgaagaaaaaggcaaactggcggccgtggcacagggtctgcaagagacaagtatcccaaaaaaaaagtag

SEQ ID NO: 131705 - DNA, 5247 bp, Artificial Sequence
  Description of Artificial Sequence: Synthetic coding sequence
atgaatgtgatgggatttaatacagaccgcctcgcatggacacgtaacaagctgaggggcttttattttgctaaactgtactacgaggccaaggagtacgacctcgccaaaaaatacgtttgcacatacctgtcagtgcaggagcgtgacccaagagcacatcgctttcttggactgctttacgaactggaagagaatactgaaaaggctgtggagtgctatcgacggagccttgagttgaaccctccccagaaagatcttgtcctgaagatcgctgagctcctgtgtaagaatgacgtcacagatgggcgggcaaaatactgggtggagagagccgcgaagcttttcccagggagtcctgctatttacaaacttaaggagcacctgctggattgtgagggggaggacggatggaacaaactctttgattggattcaatctgaactctatgtaagacccgatgacgtacacatgaacatcaggcttgtggaattatatagaagtaacaaaaggcttaaagatgccgtggctcgatgccatgaagccgaacgaaatatcgctctgaggagctccctcgaatggaacagctgcgtggtgcagacgctgaaggagtatctggaatcactacagtgcctggaaagcgacaagagtgattggcgggccaccaacacagatttgcttttggcgtatgccaatcttatgctcctgactctctccaccagagacgtccaagagtcccgggagttgctcgaaagcttcgactccgcgctgcaatctgccaaatcatctttgggcgggaatgacgagctctcagctactttcttggaaatgaaaggacatttttatatgcatgccgggtccctgttattgaagatgggccaacacggaaataacgtgcaatggcaggccctgtccgagttagctgctctttgctacgttatagctttccaagttccgagaccaaagattaaactgattaagggagaggcagggcaaaacctactggagatgatggcctgcgatcggcttagtcagtcaggacacatgttactcaatctttcacgcgggaagcaagatttccttaaagaggttgttgagacattcgccaacaaatccgggcagagtgtcctttacaatgcacttttcagttctcagtcatctaaggataccagcttcctggggtccgacgacatcggcaacattgacgtccaggagccagagttagaggaccttgcacgctatgacgtaggcgccatacaagcgcacaatggatccctgcagcacctgacctggctagggcttcagtggaactccctgcccgctcttccggggataagaaagtggttaaagcagcttttccatcacctgccacaggagacctctcggttggaaactaacgccccagagagtatttgtatcctggaccttgaggtatttctgctgggcgtggtgtacacctctcacctgcagttgaaagaaaagtgcaattcccatcattcctcctaccagccactgtgcctgcctctgcctgtgtgcaaaagactctgcacagaaagacagaagtcttggtgggacgccgtttgcacgctgatccacaggaaagcagtccccgggaactcagccgaactccggctggtcgtccagcatgagatcaatacgttgagagcccaggaaaaacacgggctgcagcccgctcttctcgtgcactgggccaagtgtttacaaaaaatgggtaggggccttaacagctcctatgatcagcaagagtatataggccgctctgttcactactggaaaaaagtgttgccactcttgaagatcataaagaagaactccatccccgagcctatcgaccctctgttcaaacacttccattctgtcgacattcaagcctccgaaatcgttgaatatgaagaggacgcacatattacatttgccatcctggatgctgtgcatggcaacattgaagatgccgtcactgcgtttgagagcatcaaaagtgtggtgagttactggaacttggcacttattttccacaggaaggctgaggacatcgagaatgacgctgtgttccccgaagagcaggaagagtgtaaaaattatctgcggaagacacgcgattatttgatcaagattatagacgacagcgattccaatctgagtgtcgttaagaagctgcccgtgcccctggaatccgttaaggaaatgctgaagtcagtcatgcaggaactggaagattatagtgaggggggcccactatataaaaacgggtcactgaggaatgctgactctgagatcaaacacagtactcccagcccgaccaagtacagcctgagcccatccaaaagttacaaatattctccaaaaacccctccgcgctgggcagaagaccagaatagtctccgaaagatgatctgtcaggaagtgaaggcaattaccaaactcaacagcagcaagagcgcatctcgacaccgatggcccaccgagaactacggcccagatagcgtccctgatggctaccaggggtcacagaccttccacggtgccccacttaccgtggccacaacgggcccaagcgtttactactcccagagccctgcatacaattctcaatatctcctgaggccagctgccaatgtgacacctaccaaaggtagctccaataccgaattcaagtcaactaaggaggggttctctattgcagtctcagccgacggctttaagttcggaataagcgagccgggcaatcaggagaagaagtctgagaaacccctcgaaaacgacaccggattccaggcccaggatatcagtggccagaaaaacggccggggtgtcattttcggccaaacctcgtccacatttacgtttgcagacgttgccaaaagcacttccggagagggttttcagttcggaaaaaaggaccccaactttaagggcttctcgggggccggggagaagctctttagcagccagtgtggcaagatggcaaacaaagctaatacaagcggcgacttcgaaaaggacgacgatgcttgtaagacggaagacagtgatgatatacatttcgaacccgtcgtccagatgcctgaaaaagttgaactggtaaccggcgaagaaggggaaaaagtgctgtacagccagggggtgaaactatttaggtttgacgctgagatttcacagtggaaggagcgcggccttggaaatttaaaaatcctgaaaaatgaagtgaacggtaagccccgtatgctcatgcgcagagatcaggtgctcaaggtatgcgctaatcactggatcaccactaccatgaacctgaagcctctaagcggatctgacagggcctggatgtggctggcttctgatttctccgacggcgacgccaagctggaacgccttgccgcgcagttcaaaaccccagaactggccgaggagtttaaacagaaattcgaagaatgccagcgccttctgctcgacattcctctccagacaccccacaaactcgtggataccggaagagcagcgaagctaattcagcgcgcagaagagatgaaatccgggctcaaggatttcaagacatttcttaccaacgaccagacaaaagtcactgaggaggagaataaagggtcaggcacaggcgccgccggagcttccgacacaactatcaaacccaaccctgagaacactggtcctaccctggagtgggacaattatgacctgagggaggacgccctagatgacaacgtaagttcgtctagcgtgcatgactccccacttgccagctcccccgtgcggaaaaacatttttaggttcgacgaaagcaccacaggcttcaacttctcattcaagtctgcactgagcctgtcaaagtcgcctgcaaagttgaaccagtctggcacaagtgtgggaacagacgaggagtctgacgtgacccaggaggaggagcgcgacggacaatattttgagccagtggtgccattacctgatctggtcgaagtgtcatcaggtgaggagaatgagcaggtggtgttcagccacatggccgagctttataggtacgataaagacgttggtcaatggaaagaaagaggcatcggcgatataaaaatattgcaaaactacgataataaacaagtgcgtatcgtgatgagacgggaccaggttctgaaactgtgcgcaaaccacagaatcactccagacatgtccttgcagaatatgaaagggaccgagcgggtgtgggtgtggacggcctgtgatttcgcagatggagaacgcaaagtggaacacctggctgtccgctttaaattgcaggatgtggcagactcttttaaaaaaatcttcgacgaagccaaaacggcccaggagaaagattccctcataacaccccacgtgagtcggtcctccacacccagggagagcccttgtggtaagatcgcggtggccgtccttgaagaaactacccgggagcggacagacgttatccagggcgacgatgtcgccgacgctgcctcggaagtcgaggtgtcaagtacttctgagactacaaccaaggccgtcgtgtcaccccctaaatttgtgtttgggtccgagtccgttaaacgtattttttcctccgaaaaatcaaacccttttgctttcgggaattcttcggccacgggctctctttttggcttctccttcaacgcacctctcaagtcaaatgattctgaaacctcttcagtggctcagagcggaagtgaatcgaaagtagaacccaaaaaatgtgagctgtccaagaacagcgatatcgagcagagctcggatagtaaggttaaaaatttgagcgccagctttcctatggaagagagtagtataaattatacattcaagacaccagagaaagagcctccactgtggcacgctgaattcactaaagaggagttagtacagaagctgagctcgacaacgaaatccgccgaccagctgaacggtctcctgcgagagactgaggctacgtctgctgttctcatggaacagatcaagctgcttaaaagtgagatccggagacttgagcgcaaccaggaagagagtgccgcgaatgtcgaacacctcaagaatgtcttattacagtttatctttttaaagccagggtccgagcgcgaatctttgctgcctgtcatcaacacaatgctgcagctgagccctgaggaaaagggcaaactcgctgcagtggcccaagggctgcaagaaactagtatccctaagaagaaatag

SEQ ID NO: 131706 - DNA, 1935 bp, Artificial Sequence
  Description of Artificial Sequence: Synthetic coding sequence
atgctgatgagaagagaccaggtgctcaaggtctgcgctaaccattggattacgactacaatgaatctcaaacctttgagcggtagcgaccgcgcttggatgtggctcgcgtccgacttttcagacggcgatgccaagttagaaaggcttgcagcccagttcaaaactcccgaactcgcagaagagttcaagcaaaaattcgaggaatgtcagcgcctgttgctggacatcccgttgcaaactcctcataaattagtggatacagggagggcggccaagctcatccagagagcagaggagatgaagtctggcctcaaggatttcaaaacattcttaaccaatgatcagacaaaggtgaccgaggaagagaacaagggctcaggcacaggagccgctggcgcatctgacacaactatcaaacctaaccccgagaacactggtccaaccctggaatgggacaactatgatcttcgcgaagatgcacttgacgacaatgtatcctctagctctgtacatgactccccccttgctagctcacccgtgcggaagaatatttttcggtttgacgagagcaccacaggcttcaatttctccttcaagagtgctttgagtctttctaaatctccagccaagctgaatcagtctgggacatctgtggggacagacgaagagtctgatgtgacccaggaagaagagcgcgatggccagtattttgaacccgtggttcccctgcccgatttggttgaagtcagctccggcgaagaaaacgagcaagtggtcttcagccacatggctgaactttaccgatatgacaaggacgtgggccaatggaaggaaagaggaattggtgacatcaaaatcttgcagaattacgataataaacaggtgaggatagtgatgcgccgagaccaggttctaaagctgtgcgcgaatcacaggatcacaccggatatgagccttcagaatatgaagggcacagagcgcgtgtgggtctggacagcatgtgacttcgctgacggagagcggaaagtagagcatctcgccgttcgctttaaactgcaagacgtggctgacagctttaagaagatcttcgatgaagcaaagactgctcaggagaaagactcacttatcacaccccatgtcagtcggagctctacaccacgtgagtcgccatgcggcaagattgccgtggcagtcttagaggaaacaacaagagagcgtactgacgtaattcaaggtgatgacgttgcagatgcggcctccgaggtggaggtatcatccacctctgaaacaacaaccaaagctgtggtttcacctccaaagtttgtttttggctctgagtccgtaaaacggatcttttcttccgaaaagtccaacccatttgcatttggcaatagctctgcaactgggagtctgttcggtttttcctttaatgccccactcaaatccaatgattcggagacgtcaagtgttgcacagagcggatcagagagcaaggtagagccgaaaaagtgcgaactgagcaagaacagcgacatagaacagtctagtgattcaaaagtgaagaatctgtcggcttcattccctatggaagagtcctctatcaattacaccttcaagacccccgaaaaggagccaccactgtggcatgccgaattcacaaaggaggagctagtccagaaactgagttccaccactaagtcagccgatcagcttaatggactgctgagagagactgaggccactagtgccgtattgatggagcagatcaaattgctcaaaagcgagattcggcgcctcgaacggaatcaggaggagtccgctgctaacgtggagcatctgaagaatgtgctgctgcagtttatcttccttaagcccgggtcggagcgcgagcccagcagttgctacaaatacgacgtagctgcacagccatag

SEQ ID NO: 131707 - DNA, 5301 bp, Artificial Sequence
  Description of Artificial Sequence: Synthetic coding sequence
atgtcttgtagcaaagcttacggagagagatatgtggcctctgtccagggctcggcaccatccccccgaaagaaatcaacacggggcttctatttcgctaagctttactacgaagccaaggagtatgacctggctaagaaatacatttgtacgtacataaacgtgagagagatggacccccgcgcccaccgctttctcggcctcttatacgagctggaagagaacactgagaaggctgttgaatgctaccggaggtccgtagagctgaaccctactcaaaaggacctggttctgaaaattgccgaactgctatgtaagaatgacgtgaccgatggacgcgccgaatactgggtggagcgcgccgccaagctgttcccggggagtccagctatctacaaattgaaggaacagcttttggattgcgagggggaggatggctggaataaactgttcgatctcattcagagcgagctatatgtacggcccgacgacgtacatgtgaatatcaggctcgtcgagctctacaggtcgacgaaacgactgaaggatgcagtagctcgctgtcacgaagctgagcgaaatatcgcgctgaggagttcactggaatggaactcctgtgtagttcaaaccctaaaggaatacctggagagtttgcagtgcctcgagtcggacaaatcagattggagagcgacaaatactgacctgcttttagcctatgccaacctgatgcttctaacgctgtcgactagagacgttcaggagtcacgggagttattagaatccttcgactctgcgcttcagtccgctaaatctagcctgggaggcaacgacgagttgtccgccacatttctggagatgaagggacacttttacatgcacgctggatctctcctgttgaaaatgggacagcacggaaataacgtgcagtggagagctctctcagaactcgccgcgctctgctatctgatagcttttcaggtgcctaggcccaagataaagctgattaagggagaggcgggacaaaacctgctcgagatgatggcctgcgaccgactgtcccagtctggtcacatgttactaaacctcagtcggggcaagcaggattttctaaaggtggtggtagagaccttcgccaacaagagcgggcagtcggctctgtatgacgcactgttctcttcccagagtcctaaagatacatcattcctcggatcagatgatatcggaaatattgacgtgcaggaaccagagctagaagatcttgccagatacgacgtaggagctattagggcacacaacggtagtctgcaacatctgacatggcttggcttacagtggaatagcctgcccgcactgccgggaataaggaagtggctcaagcagctgtttcaccacttaccccaggagacaagtaggctcgagacgaatgctcctgaatccatttgcatcctcgacctggaggtgttcctgctcggggtggtttacacttcccatctccagcttaaggaaaaatgcaacagtcatcattcgtcgtatcaacccctgtgcttgccgctgcccgtctgcaagcagctttgtaccgaaagacagaagtcctggtgggatgccgtgtgcactcttatccatcgaaaggcagtcccagggaactctgctaagctgcggctcctggtccagcacgagattaacaccctccgggcccaggaaaagcatggactgcagccggcattgctggtgcactgggcaaaatgtctgcagaagatgggaagtggattaaacagcttctatgatcagcgggaatacattggccggtctgtgcattattggaagaaggtgctccccctgctaaagattatcaaaaaaaaaaattcaatccctgaaccaatagatccactgttcaaacactttcactccgtcgacattcaagcctctgaaatcgtcgagtatgaagaagatgcacacgtgacgtttgctatcctcgatgccgttaacggcaatatcgaagacgccatgaccgcctttgaaagcataaagtccgttgttagctattggaatttggctctgatttttcataggaaagcagaggatatcgcaaacgacgcccttagccccgaagagcaggaggagtgcaaaaattatctcaggaaaactagggggtatctcattaaaatcctggacgattctgacagcaacctctccgttgtgaaaaagctgcccgtgccgttagagtcagtcaaagaaatgcttaagtcagtcatgcaggaactggagaactatagtgaaggagggcccttatacaagaacgggtccctgcgcaacgccgactctgagataaaacactctacaccaagccctaccaaatacagtttgagcccgagcaaaagttacaaatattcccccaaaaccccccctaggtgggcggaggaccagaacagcttacttaagatgatcaggcaggaagtgaaggccattaaggaagaaatgcaggagttgaaactgaattctagcaaatccgcatcacaccaccgctggccgaccgagaactatgggccggattcagtcccagatggataccagggttcccagaccttccacggcgcgccactcactgtggcgactacagggccatccgtctactatagccagtccccggcatacaacagccaatatctgcttaggccagccgccaatgtgacccccacaaaaggtagttccaacaccgaattcaagtcaacgaaagaggggttttcaatcccggtttcagctgatggttttaagtttggaatttccgaacccgggaatcaagaaaaaaagagcgaaaaaccgctggaaaacgatacaggcttgcaggcccaggatattagcgggcgcaagaaaggccgaggtgtcattttcggccagacctcctctacatttacgttcgccgatgtagctaaaagcacctcgggagaagggtttcagttcggcaaaaaagacctgaacttcaaggggttctcaggggcgggggaaaagctgttttcgtcacagtatggcaaaatggctaataaggctaataccagcggagatttcgaaaaagatgacgacgcctataagaccgaagacagcgatgatatccactttgagccggtggtccagatgcctgagaaggtggaactggtgactggcgaggagggggagaaagtactgtacagtcagggtgtaaagcttttcagatttgacgcggaagtatctcaatggaaggagagagggctgggaaatctgaagatcctaaaaaatgaggtcaatgggaaggtgaggatgttgatgcagcgggagcaggtgttaaaggtgtgcgctaatcattggatcactaccaccatgaacttgaaacctctgtctggatccgatcgcgcctggatgtggagcgccagcgacttctcagacggagatgccaagctggagcgattggccgccaagttcaagaccccagaactagcagaggaatttaagcagaaatttgaggaatgccagcggcttctgctggacatccccttacaaactccacacaaactggtggatacaggacgtgcggcaaaactgattcagcgagcagaggagatgaaaagtggacttaaagatttcaagacattcttaactaacgatcagaccaaagtcgctgaagaagaaaataaagggtctgggaccggtgctgccggggcatccgataccacaatcaaacccaatgcagagaacacggggccgaccctggaatgggacaactatgacttgagagaagatgcactggatgattccgtcagttcgtccagtgtgcacgcatccccgctggctagctctcctgtgcgcaagaacctgttccactttgacgagtctaccaccggttctaactttagctttaaatctgctctcagcttgtcgaagtccccagccaagctaaaccagtccggaaccagtgtgggaactgacgaggaatcggacgtgacacaggaagaggaacgggacggacagtattttgagcccgtggtgccactcccagacctcgtggaggtcagctctggagaggagaatgaacaggtcgtctttagccatcgagcggagttttaccgctacgataaagatgtgggacagtggaaagagcgaggaatcggcgacattaagatcctgcaaaattacgataataagcatgtacggatcttgatgaggagagatcaggtgctgaagctgtgtgccaaccaccggattacaccagatatgtctctgcagaatatgaaaggcacagaacgcgtctgggtgtggaccgcctgcgactttgccgacggcgagagaaaagtcgagcacctggctgtaaggttcaagctccaagatgtggcggactctttcaaaaagatttttgacgaagccaaaaccgcccaagagaaggattccctgattacaccccacgtaagtcgttcgtcgacgcctagggaatctccctgcggtaagattgctgtggctgtgctggaggaaactacccgagagcggactgacgtcatccagggcgatgatgtagccgatgctgcctccgaggtcgaggtctcgagcaccagtgaaaccactacaaaggctgttgtgtctccaccgaaattcgtgtttgggtcagaatctgttaaaagaatcttcagtagtgagaaatcaaagccatttgcgtttggcaactcctccgctacaggaagcctgtttgggttctccttcaacgcccccctcaagagtaacaattccgaaacaagtagtgtggctcaatctggcagcgaaagtaaggtggagccgaagaagtgtgagctgagcaagaatagtgacatcgagcaaagctccgacagtaaagttaagaatctcagtgcttcttttcctaccgaagagtcctctattaactatacctttaagactccagagaaagagcccccgctgtggtacgccgagtttaccaaggaagagctcgtacaaaaactaagcagcacaaccaagagtgccgaccatctgaacggactccttcgcgaaattgaggctacaaatgccgtgctgatggaacagatcaaactgctaaaaagtgagattcggcgcctggagaggaaccaggagcaggaggttagcgccgctaacgtcgaacatttaaaaaacgtccttctccagtttatttttttaaagcctgggtccgagagggagagactgttacctgtgattaacactatgctgcaacttagcctggaagagaaaggcaagctggctgccgtggctcaggctgagcggggtttcgtgcttaattcaacattttag

SEQ ID NO: 131708 - DNA, 471 bp, Artificial Sequence
  Description of Artificial Sequence: Synthetic coding sequence
atggaccctagggcacaccggtttctagggttactttacgagctggaagagaacaccgagaaggccgtagaatgttaccggaggtctgtcgaactgaacccaactcagaaggacttggtcctgaagatcgccgagctgctgtgtaagaacgatgtgaccgatgggcgggcagaatactgggtagaacgggcagcgaagctcttcccaggttctcccgcaatctacaagctgaaggaacagttacttgattgcgaaggcgaggacggctggaacaagctttttgacctgatccagtctgaattgtacgtccgacccgatgatgtccacgtgaatatccggcttgtggagctttacaggagtaccaagagattaaaagatgcggttgcacggtgccatgaagcagagcggaacatagctcttagatccagtttagagtggaactcttgtgttgtgcagacgctgaaattctag

SEQ ID NO: 131709 - DNA, 3378 bp, Artificial Sequence
  Description of Artificial Sequence: Synthetic coding sequence
atgctcctcacactgtctacaagggatgtacaagaatctagagagttgctggagagctttgactctgcccttcagtccgccaaatcttcactgggaggcaatgatgaacttagtgccacctttctggaaatgaaaggacatttctatatgcacgctggttcactcctcttgaaaatgggacaacacggaaacaacgtccagtggcgagccctgtcagagctggcggctctgtgctacctgatagcatttcaggtgccacgcccaaaaatcaagctcatcaaaggggaggccggccagaatttactggaaatgatggcgtgtgatcgactgagccagtctggccatatgctgctaaatctttcccgggggaaacaggattttttgaaggtggtggtggagaccttcgcaaataagagcggccagtcagccctgtacgacgcactctttagcagccagtctcctaaggacacgtccttcttgggtagcgatgacatcgggaatattgacgtccaggagccagagctggaggacctggcgcgttatgacgtaggagcaattagagcccacaatggatcccttcagcacctcacatggctgggccttcagtggaatagtttgccagcgttgcccggcatacgtaagtggttaaaacagctgtttcatcacctgccacaggagacatcaagactggagactaacgcccccgagtcaatctgcatcttggacttggaggtgtttctcctgggggtcgtgtacacaagccacctgcagctcaaagaaaagtgtaattcacaccacagttcttaccagcctctgtgcctgccactcccagtctgtaaacaactttgtaccgagagacaaaaaagttggtgggacgccgtatgtacactgatccaccgtaaggctgtacccgggaacagtgctaaactgaggctgctggtgcagcatgagattaacacccttagagcacaggaaaagcacggcttacagcccgctctgctggtccattgggccaaatgtttgcagaagatggggtcaggtctaaattctttctatgaccagcgcgaatatatcggccgctccgtccattactggaagaaagtcctgccattgcttaaaattatcaaaaagaagaactcaatccccgagccgattgatcccttgttcaagcacttccatagcgttgatattcaggcaagtgagatcgtggagtatgaggaggatgcccacgttacctttgccattctagacgcagtgaatggcaatattgaagatgccatgaccgctttcgagagtataaaaagtgtggtctcatactggaatctggcccttatatttcacaggaaagctgaagatatagccaacgatgccctgagccccgaagaacaggaggagtgcaaaaactatttgcggaagacccgaggctacctcattaagatactggatgactccgactcgaatctgagcgtcgtcaagaagctgcccgtgcccttagagtccgtgaaagagatgttgaaatctgtgatgcaggaactcgagaactacagtgaaggtgggccactgtataaaaatgggtccctgcgcaacgccgacagtgaaatcaaacacagtacaccctctccaaccaaatacagtctctctccttccaaatcatataaatatagccccaaaactccccctaggtgggctgaagaccagaatagcctgctgaagatgatccgacaggaggttaaggcaatcaaggaagagatgcaggaattaaaactgaatagttccaagtccgcttcgcaccacagatggcccaccgaaaactacggacctgactccgtgcctgatggataccagggaagccaaacattccacggcgctccactgactgtggccaccacaggaccaagcgtgtactatagccagtcgcccgcatacaactcgcagtacctcctgcgaccggccgccaacgttacccctaccaaagggtcatccaacactgaatttaaatccaccaaggaaggcttttccatccccgtcagcgccgatgggtttaagtttggcatttcggagccgggtaatcaagaaaagaagagtgagaagcctctcgagaacgacacggggctgcaggcccaggacatctctggcaggaaaaaggggcggggggtgatcttcggacagacctcctcaacgttcacttttgcggacgttgcaaaatccactagtggtgagggtttccaatttggtaagaaggacctaaattttaagggatttagcggtgccggagagaaactgttctcatcgcagtacgggaagatggcaaataaggccaacaccagcggagacttcgaaaaagatgatgacgcgtataaaactgaggactccgatgatatccatttcgagcccgtggtccagatgcctgaaaaggtggagctcgttactggcgaagaaggcgaaaaggtgttgtactctcagggagtcaaactgtttaggtttgacgcggaagtatcgcaatggaaggaaaggggcctggggaacctgaaaatcttgaaaaacgaggttaacggcaaagtccgcatgctgatgcagagagagcaggtacttaaggtgtgcgccaaccactggattacaacaaccatgaatctaaaaccacttagcggatctgaccgtgcatggatgtggagtgcgtcagatttttctgatggggatgctaagttagaacgccttgcggctaagtttaagacccccgaattagcagaagagttcaagcaaaagtttgaggagtgtcagaggctgctactagatatcccccttcagaccccgcataagctagtggataccgggcgagccgccaagttgatccagagggccgaggagatgaagtctggttcagagagcaaagtggaacctaaaaagtgcgagctgtccaaaaactctgacattgaacagagcagtgacagcaaggtgaaaaacctgtcggcctccttccctacagaagagtcaagtattaactacacgttcaagactccggaaaaggaaccaccactctggtatgccgagtttacaaaggaagaactggtacagaagctgtcctccacaacaaaatccgcagatcatctgaatggccttctgcgggagattgaggcaacaaatgccgtgctaatggagcagattaagttgcttaaaagcgagatcagacggctggagaggaatcaagagcaggaagtgagcgccgcaaatgtagagcatttaaagaatgtcctgcttcagtttatatttttaaaaccaggctctgagcgtgagcgtctactccccgtgatcaatacgatgcttcagctcagtctagaagagaagggaaagcttgctgctgtcgcacaaggagaggaatag

SEQ ID NO: 131710 - DNA, 423 bp, Artificial Sequence
  Description of Artificial Sequence: Synthetic coding sequence
acagaggagagtagcataaactatacctttaaaactcctgaaaaagaaccccctctgtggtacgctgagttcaccaaagaagaactggtacagaagctttcatccactactaagtcggccgaccatctgaacggcctcctgcgcgaaatcgaggccaccaacgctgttttgatggaacagataaagctgctgaagtctgagatcaggaggctcgagaggaatcaggaacaggaggtctccgctgctaacgtcgagcacttaaaaaatgtactgttacagtttatattcttgaagcccggctccgagagggagcgcctgctgccagtcattaacactatgttgcagctgagcctggaggaaaagggcaaacttgctgccgtggctcaaggtttgcaggaaaccagcatccctaagaagaagtag

SEQ ID NO: 131711 - DNA, 5277 bp, Artificial Sequence
  Description of Artificial Sequence: Synthetic coding sequence
atgagctgctctaaggcctatggggaacgttacgtggcttccgtgcagggatctgctccctctcctaggaaaaaatctacgcgtggtttctacttcgccaaattgtactacgaagctaaggagtatgacctggccaagaagtacatctgcacatacataaacgtgcgtgagatggacccacgggctcataggttcctcggcctgctttacgaacttgaggagaacaccgagaaggccgtcgaatgctaccgacgtagcgtcgagctgaaccccacacagaaagacttggtgttgaagattgccgagcttttgtgtaagaatgacgtgaccgacggtcgcgcggagtattgggtggagagggcagcgaagctcttccctggaagtcctgctatctacaaactaaaagagcagttactggactgtgagggagaagatggttggaacaagctgtttgacctgattcagtctgaactttatgtgaggccagacgatgtacacgtcaacattcgcctcgtggaactgtaccgatctacaaagagactcaaggatgcagtagcacgatgtcatgaagccgaacgaaacatcgcacttcgctcctctcttgaatggaacagctgcgtggtgcagaccttgaaagaatacctggagtccctgcagtgtcttgagagcgacaaatccgactggagggccactaataccgatttactgctcgcttacgccaacctgatgctcctcacactcagtacccgcgatgtgcaggagtccagagagctcttggagtccttcgattctgctttacagtcagcaaaatcctccttgggtggcaacgatgagctgtcagcaacgttccttgagatgaagggacacttctacatgcacgccggctcactcctgctaaagatggggcagcatgggaataatgtgcagtggcgagccctaagcgaactggcagctttgtgttatctcatcgctttccaggttccccggccaaagattaaattgatcaaaggcgaggccggccagaatctcctggaaatgatggcctgtgatcgtctgtctcagagcggtcacatgctgctcaatctctcaagaggcaaacaggacttcttgaaagtggttgttgaaacttttgccaacaaatcagggcagtccgctctgtatgacgccctgtttagcagtcagtctccaaaagatactagtttccttgggtcagacgatattggtaatatcgatgtacaggagcctgagctggaggacctcgctcggtacgacgtcggcgccatccgagcacacaacgggtctcttcagcatctgacttggctcgggctccagtggaactccctgcctgccctgcctggtatccggaagtggctgaaacaattgtttcaccatcttccccaggaaacctccagactggagaccaacgcaccagagtctatatgtattctggacttagaagtgtttttgctaggggtcgtgtacacaagtcatctgcagctgaaggaaaaatgtaactcccaccactccagttatcaaccactctgtctgccactcccagtgtgtaagcagctatgcactgagagacagaagagctggtgggacgccgtgtgcactctcattcatcgcaaggccgtgcctggcaacagcgcgaaactgcgtctacttgtgcagcacgaaataaacaccctcagggcccaggagaaacacgggctgcagcctgccctgctggtccactgggccaagtgcctgcagaaaatggggagcggactgaactcgttctatgatcagagagaatacatcggccggagcgtgcactactggaagaaggtgctacccctcctgaagataattaaaaaaaagaatagcattcctgagccaatcgaccctcttttcaaacacttccatagcgtggatattcaagcgagcgaaatagttgaatatgaagaggatgcccatgtgacatttgcaatccttgacgccgtgaatggaaacatagaagatgcaatgaccgcattcgagtcaatcaagtccgtcgtgtcatattggaacctggcgcttattttccaccggaaggctgaagacatcgcaaatgacgctctcagcccagaggagcaggaagagtgtaaaaactacttacggaagacccgaggctacctcatcaagatactggatgactctgacagtaacctctccgtagttaagaagctcccagtgcccctcgaatccgtgaaagagatgcttaagagcgttatgcaggagctcgaaaactactctgagggcggtcccctgtacaagaatggctcactgcggaacgcagacagtgaaattaagcattctaccccgtccccaaccaagtactccctcagcccctccaaatcatacaagtacagtccaaagactcccccacgatgggctgaagatcagaactctctcctgaagatgatccgccaggaggtcaaagccatcaaggaggagatgcaggagctgaaactgaactcgagcaagtcagccagtcatcaccggtggccaactgagaactacggcccagactccgttccggatggataccaggggtcccaaaccttccacggcgccccacttacagtcgctaccactgggccctcagtctattactcacaatctccagcttacaattctcaatatcttctccgacctgccgccaacgtaactcccaccaaggggtcatcaaatactgaattcaaatctaccaaagaaggctttagtattcctgtcagcgcagatgggttcaagttcggaatttcggaaccagggaatcaagaaaagaagagtgaaaagccacttgagaacgacaccgggctccaagcccaggacatcagtggcaggaaaaaagggagaggagtgatattcggacagacctcctctacttttacctttgctgatgtggctaagtccaccagtggtgagggatttcagttcggcaagaaagacctgaattttaaagggttcagtggggcaggcgaaaaactcttttcatcgcagtacggcaaaatggccaataaagccaacactagtggagacttcgaaaaggacgatgatgcatacaagacagaagactcagacgacatacacttcgagcccgttgtgcaaatgcccgagaaggtcgagctcgtgaccggcgaagagggagaaaaagttctatacagtcaaggcgtgaagcttttccggtttgacgctgaggtgtcccagtggaaagaaagagggctgggaaaccttaagattctcaagaatgaagtgaacggcaaggtaaggatgctcatgcagcgagagcaggtgttaaaggtgtgtgccaaccattggatcacaactacaatgaatctgaaacctctctccggtagtgatcgcgcatggatgtggtccgcatccgatttctccgacggagatgcaaagctggagaggcttgcggccaagttcaagacaccagaacttgccgaggaattcaaacagaaatttgaagagtgccaacgtctcctgctcgacatcccactgcaaactccccacaaactcgtggatactgggcgagctgcaaagctgatacagcgagcagaggaaatgaaaagtggtttgaaggacttcaaaacattcctgacgaatgatcagaccaaagtggccgaggaagagaacaaaggaagtggcaccggagctgctggcgcatccgacaccaccataaaacctaacgcggagaatacgggaccaacattagagtgggacaattatgatctgcgcgaagacgccctggacgacagcgtgtcatctagctccgtccacgccagcccattggcttcttcgcctgtccgtaaaaacctattccacttcgacgagagcaccaccgggtccaatttttcattcaaatccgcgctgtccctgtctaaatcgcccgccaagctgaatcagtccgggacatctgtcggcacagacgaagaatcagacgtgacacaggaagaggagcgtgacggccagtacttcgaaccagtggttcccctcccagatctcgtagaagtgagttccggcgaagagaatgaacaagttgtcttttcccaccgcgccgagttttaccgatatgataaagatgtcggacagtggaaggagagagggattggtgacattaaaattcttcagaactatgacaataagcatgttagaattttaatgcggcgcgatcaggttttgaagctgtgtgccaatcacaggataactcctgacatgtctctgcagaatatgaaaggcaccgaacgagtgtgggtttggaccgcgtgcgactttgcagacggagagcgcaaggttgaacacctggcagtgcgcttcaagctgcaggacgtagcagattcctttaagaagatcttcgacgaagccaagactgcccaggagaaagacagtttgataactccgcacgtcagcagaagctctacaccgagagaatccccttgcggaaaaattgccgtggccgttctggaggaaacaacaagagagcggacagatgtaatccagggcgacgatgtcgctgatgcggctagtgaggtggaggtcagttctacctcagaaacaactactaaagccgtggtttcaccgcccaaatttgtgttcggcagcgagagcgtgaaaaggatattttcaagtgaaaagagcaaaccttttgctttcggtaactcgagtgcaaccggctcactctttggcttctcatttaatgcccccctgaaatcaaacaacagtgagacaagctctgttgcccagagtggaagcgaatctaaagtggaaccaaaaaaatgtgaactttcgaaaaattccgatattgagcaatcctctgattctaaggttaagaacttgtctgcatcttttccaactgaagaatctagcattaattacacatttaagacacctgagaaggaaccccctttatggtatgctgaattcacgaaggaggaattagtccagaaactgtcaagcaccacaaagtctgctgatcatttaaatggcctgttgcgtgaaattgaagctacgaacgcagtgcttatggaacagattaaactgctcaagagtgagatccgtcgcctggagcggaaccaggaacaagaggtgtctgccgccaacgttgagcacttgaagaacgtgctgctgcagttcatcttcctgaaaccgggctcagagagagaaagactcctccctgtaatcaacacaatgctccaactcagcttggaggagaagggtaaactagcagcagtggctcagggtgaggagtag

SEQ ID NO: 131712 - DNA, 5301 bp, Artificial Sequence
  Description of Artificial Sequence: Synthetic coding sequence
atgagttgctctaaagcgtacggcgagcggtatgtggcatctgtccaaggctccgcaccttctccgagaaagaaaagcacccggggattttattttgccaaactttattacgaggccaaagagtatgatctcgccaaaaagtacatatgcacttacattaatgtgagagaaatggatcccagagcacaccggtttctggggttgctttacgaacttgaggaaaacactgaaaaagcagtcgagtgctaccggaggtcagtggaactgaaccctactcagaaagacctggttcttaagatcgctgaactattgtgtaagaatgatgtgaccgacggacgggcgaaatattgggtggaacgtgccgcaaaactgttcccaggatccccagccatctacaagttaaaagagcagctgctggattgtgaaggcgaggacggctggaataaactgttcgatttaattcagtccgagttgtacgttcgcccagatgacgtccatgtgaatattcgcctcgttgagctgtatcgctcgacaaagagattgaaagacgccgtggctcgctgccatgaggccgagcgaaacattgctctgcgatcgagcttagagtggaattcttgtgtagtgcagacattgaaggaatacttagagtcgctacagtgcttagaaagcgataagtccgactggagggccactaatactgacctgctgttagcatacgccaatttgatgctcctgactctgtctacccgagacgtccaagagtcacgcgaattgttagaatcgttcgacagtgctctccagagcgctaagtcttctctcggcggaaacgacgaactgtctgctacgtttttggagatgaaaggccacttctatatgcatgccggttcccttctcctgaaaatgggacagcatggaaataatgtccaatggagggctctgtcagagttagccgctctgtgttacctgatcgcattccaggtgccccgacccaaaatcaaactcatcaagggagaagccgggcagaatctgttggagatgatggcatgcgacaggctgagtcaaagtggccacatgcttctaaacctgagtcggggaaagcaggattttcttaaggtggtggttgaaacctttgccaacaaatccggtcagagcgctctgtatgatgcgcttttctcgtctcagtcaccaaaggataccagctttctgggttctgatgacataggcaatattgatgtgcaggaaccggaactggaggacttggcacgctatgatgtaggggcaatccgtgctcacaatgggtccttacagcaccttacgtggttaggcttacaatggaactccctgcccgcgttacccggaatccgaaaatggttgaagcagctcttccaccatctgccccaggagactagtaggctcgaaactaatgcaccagagagcatatgtatcctcgacctggaggtcttcttactgggggtggtgtacacaagccacctgcaactgaaagagaagtgtaactcccatcattcaagctatcagccattgtgcctgcctctgcccgtgtgtaagcagttatgcacagaacgccaaaaatcatggtgggacgccgtctgtaccctgatccaccgaaaggctgtgccgggcaattcggcgaagctgaggctgctcgtacagcacgagatcaacaccctgagagcccaggaaaaacacggcctccagcccgcactgctggtccattgggcgaagtgcttgcagaagatgggcagcggattgaacagcttctacgatcagagagagtatatcggaaggtctgtgcactattggaagaaggtgctgccactcttgaagatcattaagaaaaaaaatagtatccccgaacccatcgaccctctatttaaacacttccactcggtggatatccaagcgtcggaaatcgtggaatatgaagaggatgctcatgtcacttttgccatcctagacgccgtcaacggcaatatcgaagacgccatgacggcatttgagtcaatcaagtctgtggtgtcatactggaacctcgccctgatatttcatcgtaaagccgaggatatcgccaatgacgctctcagcccagaggaacaggaggagtgcaaaaattaccttcgaaaaactcgaggctaccttattaaaattcttgacgattctgatagtaatttgtctgtggtcaagaaactaccagtgcctttagaatctgtgaaggagatgttgaagtcggtgatgcaggagctggagaattattcggagggggacccattatacaagaacggcagcttaagaaacgccgactctgaaattaagcacagcactccctccccaactaagtattcactcagcccttcaaaatcgtataaatacagtcccaagactccccccaggtgggccgaagaccaaaactctctactcaaaatgattaggcaggaggttaaagccatcaaggaagaaatgcaggagttgaaattgaattcaagcaagtccgcatctcaccacaggtggcctacagagaactacggaccagacagtgttccggatgggtatcaaggaagccagacattccacggcgcccccctaacagtggccacaacggggccatcagtgtattattcgcaaagccctgcctataattcacaatatctgctgagacccgcagccaatgtgaccccgacgaaaggctcgtcaaacaccgagttcaagtctactaaggagggtttctccatccccgtgagtgcggatggattcaaatttggtataagcgaacctggcaaccaggaaaaggagtcggaaaaacctcttgaaaacgacacagggtttcaggcgcaggatatatccgggcagaaaaatggcagaggtgttatctttggacaaacatcctctacgttcactttcgcggacgtggcaaagtctaccagtggagaggggtttcaatttggcaaaaaagatcccaacttcaagggcttttctggcgctggcgagaaactatttagcagtcagtgtggcaaaatggctaataaggctaatacctctggggattttgaaaaagacgatgacgcctataaaactgaagattctgacgatatacatttcgaacctgtagtacaaatgcccgagaaagttgagctggttatcggggaggagggagaaaaagtgttatacagccagggagtgaaactgtttagatttgacgcagaagtgaggcagtggaaggagcgcggcctgggcaacttaaagatccttaaaaatgaagtgaatggcaagcctcgcatgttgatgcggcgagaacaagtcctgaaagtctgcgcaaatcactggatcaccactacgatgaacctcaagcctctctcgggatcagatcgggcctggatgtggagcgcctccgacttctccgatggtgacgctaaactagaacggttggccgctaagtttaagacgccagagctcgccgaggagtttaaacaaaagtttgaagaatgtcagcagctcctcctggatattcctctgcagacaccacataaactggtggacactggccgcgcagccaaattgattcaacgcgcagaagagatgaaatccggcttaaaggatttcaagacattcctgacgaacgatcaaaccaaggttactgaagaagaaaacaagggatctggcacaggggcagccggagccagcgataccactattaagcccaatcccgaaaataccgggcctacactggaatgggacaactgtgatctccgagaagatgctctcgatgattccgtttctagtagctcagtgcatgccagccccctagcctcaagcccagtcagaaaaaacctgttccactttggggagtcaacaactggctctaatttcagcttcaaaagcgcgctcagtccttcgaagtcccctgctaaactcaatcagtcaggaaccagcgtggggacagacgaggaaagcgatgttactcaagaggaagagcgtgatgggcagtactttgaacccgtggtccccctgcccgacttggttgaagtttcgagcggagaggaaaatgagaaagtggtgttctctcaccgggccgagctgtaccgatatgataaagatgtcggccagtggaaagagcggggtataggcgacatcaagatactgcagaactacgataacaaacaggtacgcatcgttatgaggcgcgatcaggtcctgaagctgtgtgctaaccatacgattactcccgacatgtcccttcagaatatgaaaggaacagaaagagtttgggtttggaccgcgtgtgatttcgccgatggtgagagaaaagtggagcacttagccgtgcggttcaaactgcaggacgtcgccgacagcttcaagaaaatctttgatgaggccaagaccgcccaggaaaaagactcgctgatcacaccgcatgtgtctaggtcctctactcccagggagtcaccatgtggaaagatcgccgtcgctgttctggaggagactactcgtgaaagaacagatgtgatccagggcgatgacgtggctgatgcagcttctgaggttgaagtgtcgagcacatctgagaccaccacaaaagctgtcgtctcgccaccaaaattcgtttttgggtcagagagtgtcaaacgtatcttttccagtgagaaatccaaacccttcgcctttggcaactcatctgccaccggctcgctttttgggttttcgttcaacgcgagtctgaagagcaacaattcagaaacctcctcggtggcccagagtggaagtgagtccaaagttgagcctaaaaagtgcgagctcagcaagaatagtgatatcgagcagtccagcgatagtaaggttaagaatctttccgcttctttcccaatggaggagtcgagcatcaactatacctttaagaccccagagaaggaacctcccttatggcatgcagaattcactaaagaggagctcgtccagaagttatcctccacaaccaagtcagctgatcacctgaatggcttgctgcgagaagccgaggctacctctgcagtgcttatggagcagataaagctcctgaagtctgaaattcgccgactcgaacgtaaccaggaacaggaagagagcgcagccaatgtggaacatctgaagaacgttctgttgcagttcatttttctgaagccagggtcagaacgtgagcggctgctgcctgtcataaacaccatgttacaactgagcccggaagaaaaaggtaaattagccgcggttgcacaggcagagaggggattcgtactgaatagcacgttttag

SEQ ID NO: 131713 - DNA, 3378 bp, Artificial Sequence
  Description of Artificial Sequence: Synthetic coding sequence
atgttactcactctaagtacccgggatgtacaggagagtcgggagttgctcgagtcttttgactccgctctccaatcagccaaatcttctcttggaggaaatgatgagctgtcagctaccttcttggaaatgaaggggcacttctacatgcacgctggttccctcctacttaagatgggccagcacggaaacaatgttcagtggagggctctgagcgaactcgccgccctgtgttatcttattgccttccaggtacccagacccaaaattaagctgatcaagggggaggcggggcagaatctgctcgaaatgatggcctgcgacagactgtcccaatcgggccacatgctcttgaatctgtctagagggaagcaggatttccttaaagtggttgtcgagacgttcgctaacaaatcagggcagagtgccctttacgatgctctctttagcagtcaatcacctaaggatacatctttcttgggctccgatgatatcggcaatatagacgtgcaggagcccgagctggaagacctcgcgcgctacgatgtcggagcaattcgggcacacaacggctctctacagcacctaacatggttgggtttacagtggaattccttaccagcccttcctgggattaggaagtggctgaagcagctcttccatcatttgcctcaggaaacctcccgtcttgaaaccaacgctccggagtccatttgtatcctcgacctagaggtgtttcttctgggagtcgtctacacttcccacttgcagctgaaggaaaagtgtaattcacaccattctagctaccaacctctgtgcctcccgttgcccgtctgtaaacagttatgcaccgagagacagaagtcatggtgggacgcagtatgcacgttgattcacagaaaggccgtgccaggaaactctgctaagctcagattgttagtgcagcacgagataaacaccctccgggctcaggagaaacacggactccagcctgccctgctggtgcattgggcaaaatgtttacagaagatgggttccggacttaacagtttttatgatcagagagaatatattggccgctcggttcattactggaaaaaggtgctacccctgctgaagatcatcaagaagaagaacagcatcccggagcccattgatcctctgttcaaacattttcattcggtagatatccaagcgtccgaaattgttgagtacgaagaagatgcacacgtgacctttgcaatcctggacgcagtgaatggaaacatcgaggatgccatgactgcatttgagtccattaaatctgtggtctcctactggaatctggctctgatttttcaccgaaaagccgaagacattgcgaatgatgctttgtcgcccgaagagcaggaggagtgcaagaactatttgaggaagaccagaggctacctcattaaaatactcgatgactcagacagtaatttgtccgtggtgaaaaaacttcctgtgccgctagaaagcgtgaaggaaatgctcaagtcggtgatgcaggaactcgagaactattccgagggcgatcctctttacaagaatgggagcctacggaatgctgacagcgagattaagcacagcacaccttcccccactaagtactccctttctcccagcaaaagctataagtatagccctaaaaccccaccgagatgggctgaagaccaaaactctcttcttaaaatgattagacaagaggtgaaagcaataaaggaagaaatgcaagagttaaagctgaacagtagtaagagcgcctcgcatcatcgctggccaacagagaattatggtcctgattccgtccccgacggttatcaaggatcacagaccttccacggggccccactaacagtggccactacgggtcccagtgtctattactcacagtcacctgcctataatagccaatatttgctgaggccagccgccaatgtgacccctaccaagggcagcagtaacacagaattcaaaagcaccaaagaggggttctctatccccgtttcagctgatggctttaaattcggcatttctgaaccaggtaatcaggagaaggaaagcgagaagcccctagaaaatgatacagggttccaggcccaggatatctccggacagaaaaatggccggggggtgatttttgggcaaacttcctcaacgttcaccttcgcagatgtagccaagagtacctccggcgagggattccagttcggaaagaaggacccgaattttaagggtttctctggggcaggagaaaaactattctcttcccagtgcggaaagatggccaataaggccaataccagcggcgacttcgagaaagacgacgacgcatacaagactgaggatagtgacgatattcactttgagccagtggttcaaatgccagagaaagtggagctggtgatcggagaggagggggaaaaggtgctgtactcacaaggggttaagctgttccgtttcgacgccgaggtaaggcagtggaaagagagaggtctaggcaacctgaaaattctgaagaacgaagtcaatggtaagccacgcatgctgatgcgacgggaacaggtgctgaaggtttgtgcaaaccattggatcaccacaactatgaatctgaaacccttgtccgggagtgatcgagcgtggatgtggtcagcttccgattttagcgacggggacgctaagctggagagactggcggcaaagttcaaaactcctgaactcgcagaggagtttaaacagaagtttgaagagtgtcagcaactcctgctggacataccattacagactccacacaaactcgtggatacagggagggccgctaaactgattcagagagccgaggagatgaaatctgggtctgaatccaaggttgagcccaagaaatgcgaactctctaagaatagtgacatcgaacagtccagcgattccaaagtgaagaacctttcagcttcttttccaatggaagagtccagtatcaactacaccttcaaaactccagaaaaggaacccccactctggcacgcagaatttactaaagaggagctggtgcagaagcttagttccacaaccaaaagtgcagatcatctcaatgggctgcttagagaggccgaggccaccagcgccgtgctgatggaacaaatcaaacttctgaaaagcgagattaggagactggagagaaatcaggaacaagaggaaagtgctgccaacgttgaacaccttaaaaacgtgttgctgcagttcatttttttgaaacccggctctgagagagagcgcctcctacccgtgatcaacactatgctgcaattgagccccgaggagaaaggaaagttagctgccgtggctcagggagaggaatag

SEQ ID NO: 131714 - DNA, 471 bp, Artificial Sequence
  Description of Artificial Sequence: Synthetic coding sequence
atggacccccgggcacataggttcctcggcctcctgtacgagctggaggaaaatacagagaaggcagtcgaatgctacagacggtccgtcgagttgaaccctacccagaaggatctcgttcttaagatcgctgagctcttgtgcaagaacgacgtgacagacggaagagccaaatattgggtggaacgggcggcaaaactgttccccggcagtcccgccatctataaactgaaagaacagctgctggattgtgaaggagaagatggctggaataaactgttcgacctcatccaaagcgagctgtatgttagaccagacgacgtgcatgtgaacatcaggctggttgaattgtacagatcaaccaagagactgaaagacgcagtcgcccggtgccacgaagctgaacgcaacattgccctgcgttcttcactcgagtggaacagttgtgtcgtgcaaacccttaagttttag

SEQ ID NO: 131715 - DNA, 5277 bp, Artificial Sequence
  Description of Artificial Sequence: Synthetic coding sequence
atgagctgtagcaaagcttatggggagaggtatgtcgccagcgtgcaaggaagcgcaccatcgccacgcaagaaaagtacgaggggcttttatttcgcaaaattgtattatgaggccaaagagtatgatctagccaaaaaatacatctgtacatacatcaacgtcagagagatggacccacgtgcccaccggttcctgggtctgctgtacgaactggaagagaacactgaaaaggctgtggagtgttacagacggtctgtcgaactcaaccccactcaaaaggacctggtgctaaagatcgcagagctgctttgcaaaaacgacgttacagacggacgggccaaatattgggtggaaagagcggccaaactgttccccgggtcaccagcaatatacaaactgaaggaacagcttctggattgtgagggtgaggacggatggaacaaactgtttgatctgatccagtcagaattgtatgtccgtcctgacgacgtccatgtgaatatccgactggtagaactgtaccggtcaactaagaggttgaaagacgctgtcgcaaggtgccacgaggctgaacgcaatatcgctttgaggtcttccctggaatggaactcatgtgttgtccagactctgaaggaatacttagaatctctgcagtgcctcgagagtgataagtccgactggagggcaacgaacacagacctgcttctcgcatatgccaacctgatgcttctgacactctcaacacgggacgtacaggagtccagagaattgctggaaagcttcgacagcgctctccaatcagccaagagctcactgggtggcaacgacgagctgtccgccacctttctcgaaatgaagggacacttctacatgcacgcaggctccctgctattgaagatggggcaacacggtaacaacgtacaatggcgcgccctgagcgagctggcggctttgtgctatctgattgcctttcaggttcctagacccaaaatcaagcttattaaaggggaagcagggcaaaacctgttggagatgatggcctgtgaccgcttaagtcagtctggacacatgcttttaaacttatctcgagggaaacaggacttccttaaagtggtggttgaaaccttcgctaacaaatcgggccagtccgccttgtacgacgcactgttcagctcccagagtccaaaggatacgtcatttctgggaagtgacgatattggcaacatcgacgttcaggagcccgagctggaagatctcgctcggtacgacgtcggcgctataagggcccacaacggatctctgcagcacctaacatggctggggctgcaatggaattctctcccagctcttcccggtatccgcaagtggttgaaacagcttttccatcacctgccccaggaaacatccaggctggaaactaatgctcccgagtctatctgtattctggatctcgaggtgttcctgctcggggtggtctatacctcacacctccaacttaaggagaaatgtaactcccaccacagttcataccagccactatgtcttccccttcccgtgtgcaagcaattatgtacggagcgccagaagtcctggtgggacgcagtctgcacactcatacacagaaaagccgttccaggcaattcagccaagttacgccttctagtacaacacgaaatcaatacactgcgggctcaagagaagcatggtctccagccagctcttctcgtacattgggccaagtgtctccaaaaaatggggagcggccttaacagcttctatgaccagagagagtacatcggcagaagtgttcactattggaagaaagtcctcccgctgctgaaaattatcaagaaaaagaatagtatcccggaaccaatcgatcctctgtttaagcactttcactccgtggacattcaggcgtctgagatcgtcgagtatgaggaagacgcccacgtgacttttgctatcttggatgcggtcaacggcaatattgaagacgccatgactgccttcgaaagcattaagtcagtcgtttcttactggaatttggcgctgatatttcatcgcaaggcggaggacattgctaatgacgccctctccccagaggaacaggaggaatgcaaaaattacctgcgaaaaactcgcggctaccttatcaaaatactggatgactcagactcaaatttgtctgtggtgaagaagcttcccgtccctttagagagtgtcaaggagatgctgaaaagtgttatgcaagagctcgaaaattattcagagggagatccgctgtataaaaacgggtcacttcgcaacgccgacagcgaaatcaaacattcaaccccttcccctaccaaatacagtctctcaccaagcaaaagctacaagtatagccctaagaccccccctaggtgggccgaggaccagaactcattgctcaagatgattaggcaagaggtcaaagccattaaagaggaaatgcaggaactgaagctgaattctagtaagtcagcgtcgcaccacagatggcctactgaaaactacggccctgattctgtgcccgatggctatcaaggcagtcaaaccttccacggggccccactgacagtggcgactaccggtccctctgtgtattactctcagagccccgcgtacaatagtcagtacctgctgcgacccgctgctaatgtgactcccactaagggctcttctaatacagagttcaaatctacaaaagaggggttttcgattcctgtgagtgccgatgggtttaagttcgggattagtgagccaggaaatcaggaaaaagaatccgagaagccactggagaacgacacaggtttccaggcccaggacatatcaggtcagaagaacgggaggggagtcatcttcggtcaaacctcaagcaccttcaccttcgcagacgtcgcgaaatctactagtggcgagggatttcaattcggaaaaaaggatcctaactttaaggggttttctggcgctggcgaaaagctgttttcgtctcaatgcggcaaaatggccaataaagccaacacctctggcgatttcgaaaaggacgacgacgcctataagacagaggattccgacgatattcactttgagcccgtggtccagatgcctgaaaaggtcgagctagtcattggggaagaaggtgagaaggtgctgtatagccagggcgttaagctttttcgtttcgatgcagaagtgagacagtggaaggagcgcgggctggggaatctcaagatcttgaaaaacgaagtgaatgggaagccccgtatgctcatgcgcagggagcaagtgctaaaggtctgtgccaaccattggataaccactactatgaacttgaagccactcagcgggtccgaccgggcatggatgtggtccgcctcagatttctctgacggagacgctaagcttgagcggctcgctgcaaaattcaagacccccgagctagccgaggagttcaaacagaaatttgaggaatgccagcagctgttacttgacattcccctgcagacccctcataaactagttgacaccggacgcgcagcaaagcttatccagcgggcagaggagatgaagtctggactgaaggactttaaaacttttctgactaatgatcaaactaaagtgacggaggaggaaaataaaggatcaggtactggggcggctggggcctccgataccacaattaagcccaatcccgagaataccggcccaacacttgagtgggacaactgtgacctgagggaagacgcactggatgactccgtatcttcttcatcagtccatgcctctcctctggcctcgtcccccgtcagaaagaacctttttcatttcggggagtccacaaccggatcaaatttttcctttaagagtgctctctccccttcaaagagtccggccaagctaaaccagtccggcacctctgtggggaccgatgaagagtccgatgtgacacaggaggaggaaagagacggccagtacttcgaacctgtggtgccgctccccgatctcgtggaggtcagcagcggtgaagaaaacgagaaggtcgtgttctcgcacagagcagaactgtacagatacgacaaagatgttgggcagtggaaggaacgcgggataggagatattaaaatcctgcagaactatgacaataaacaagttagaatcgtcatgcgacgggaccaggtgctgaaactgtgcgcaaaccatactattacgccggacatgtccctgcagaatatgaaaggcactgaacgtgtctgggtgtggacagcctgcgactttgcggatggggagaggaaggtggagcacctggcggtgagattcaagcttcaagacgtcgccgacagcttcaaaaagatcttcgacgaggccaaaaccgcccaggagaaggacagcctaattactcctcatgtctcacgatctagcacacccagggagagcccctgtgggaaaatagctgtggcagtcctggaggagactacccgcgaaagaacagatgttattcaaggggacgacgtcgccgatgctgcctcggaggttgaagtgtcttccactagcgagacgactacaaaggccgtagtgagcccccctaaattcgtgttcggatccgaaagcgtaaagcgcatcttctcctctgaaaaaagcaaaccctttgcctttgggaactccagcgccacaggctcactgttcgggttcagcttcaacgcctcactgaagtccaacaatagcgaaacgtcttcggtggctcaatccggcagtgagtctaaagtggagcctaagaaatgtgaactgagtaagaatagtgatattgagcagagttccgactcgaaggttaagaacctgagcgcctcattccctatggaggagagttcgatcaattatacatttaaaacccctgagaaggaaccgcccttatggcacgctgaattcacaaaagaagaactcgtgcagaaactgagcagcacaaccaaatccgcggatcacctgaacggacttctacgcgaagccgaggcaacgtcagccgttttaatggagcaaatcaaattactgaaatccgagattcgaaggctggagaggaaccaggaacaggaagagtccgccgctaatgtggaacacctcaagaatgtgttgctccagttcatttttttgaagccaggtagtgaaagggagaggctcctgccagttatcaatactatgctgcaacttagtcccgaggagaaaggcaaactggcggctgtcgcccagggcgaagagtag

SEQ ID NO: 131716 - DNA, 5298 bp, Artificial Sequence
  Description of Artificial Sequence: Synthetic coding sequence
atgcgacgcagcaaggccgatgttgagcggtatgttgcgtccgtgctgggcctgactccgtccccccgtcagaagtcaatgaaaggtttctacttcgctaagctgtattacgaagcgaaagagtatgacctggctaaaaagtatatctgtacctatatcaatgtgcaggagagggaccccaaagcccatcggttcctgggactgctgtacgagctcgaggagaacacagaaaaagccgtggaatgctaccgtcggagcgtggagctgaacccaactcagaaggacctcgttctgaaaattgctgagctgctgtgtaaaaatgacgtgactgacggtcgcgcaaagtattgggtggaacgcgccgccaaactgtttcccggatcgccagccatatataagctgaaagagcaactgttggactgcgaaggtgaggacggttggaataaactgttcgaccttatacaaagcgaattgtacgtgagacctgacgacgtacacgtgaacatcagactggtggaactgtaccgttctactaaaagactgaaagacgcagtggctcactgccacgaagctgagaggaatatcgccctccgctcctctctcgagtggaattcatgtgtggtgcagactttgaaagagtacctggaaagcttgcagtgtctggaatcagataagtctgactggcaggcgacaaataccgacctgttgctagcttacgcaaatcttatgctgctcacgctgtcgacaagggatgtccaggaaaaccgtgagcttctggaatcttttgattcagcgttgcagagcgccaagagctctctggggggcaacgacgagctcagcgcaacgttcctggagatgaagggccatttctatatgtatgccgggagcctacttttgaaaatgggacagcacggaaataatgttcagtggcgagcactgtccgagctcgcagccctgtgctaccttatcgctttccaggtgcctcgacccaagatcaaattaagagaggggaaagcaggccagaaccttctagagatgatggcttgcgatcggctctctcagtccggacacatgctgttgtcactgtccagggggaaacaggatttcctcaaagaagtggttgaaacctttgctaacaaaataggtcagtccgcgttgtacgatgctttattttcctcgcagtcaccaaaggataccagctttctgggatctgacgacatcggcaagatcgacgtgcaggaacccgagctcgaggacttggctagatacgacgtgggggccatcagagcccataatggttctctgcagcacctcacctggctcggcttacagtggaactcgctgcccgctcttcctggaatacggaagtggcttaagcagttgttccacaggctcccacacgagaccagcagactcgaaacaaacgcacctgagagcatatgcatcctggacctcgaagtgtttctgcttggcgtggtgtacacctcccatctgcagctgaaagaaaaatgcaactcacatcatagctcctaccagcccctgtgcctgccattcccggtctgcaagcaactttgcactgaaaggcagaagtcatggtgggatgccgtgtgcaccctcatccatcggaaagctgtgcccggcaatttggccaaactgagactgctagttcaacatgagattaataccttgagagcccaagaaaaacacggattacagccggcactgctggtgcactgggccaaatatctgcagaagacaggctcggggctgaactccttctacgggcaactcgagtacatcggacgctccgttcactactggaagaaggtcttacctctccttaaaatcatcaagaagaactccatccccgagccaattgacccgttgtttaaacatttccacagcgtggacattcaagcctctgagatcgtggaatatgaggaagacgcccatatcaccttcgccatgctggatgcagtgaacggtaatattgaagacgcagttactgcgtttgagtctataaaatctgtggtctcttattggaatctggcactgatctttcatcggaaggctgaggatattgagaacgatgccctctcccctgaagagcaggaggaatgccgaaattacctgactaaaacacgggactacctcatcaagattattgatgatggcgacagcaatctgagtgtggtcaagaagctgcccgtgcctctggaatcagtgaaacagatgctcaacagcgtcatgcaggagctggaggactattcggaggggggacctctgtataaaaacggctcgttgcgcaatgcagacagcgagattaagcactccacacccagccccacaaagtattccctctccccgagtaaatcttacaagtattcaccagagactccccctagatggactgaggatcgtaactctctcctgaacatgatctgccagcaagtcgaagctatcaagaaggagatgcaagagctaaagttgaactctagcaagagcgcgagccgccacagatggccgacagaaaattatggacctgactccgtacccgacggctatcaaggtagtcagacatttcatggcgctccgttaactgttgccactacaggtccgtctgtttattattctcagtctcccgcttataacagtcagtaccttctgagacctgcagcaaatgtcactccaacgaagggctcttctaataccgagtttaagagcactaaagagggattcagcatacccgtgtcagcagatggattcaagttcggaataagtgagccgggaaaccaggaaaaaaaaagagagaaaccactggaaaatgacactggatttcaagcacaggatatctctgggcggaaaaagggtcgcggcgtcatcttcggccagacatccagcacctttacatttgctgacgtagccaaatccacatccggcgaggggtttcagtttggcaaaaaggatctgaacttcaaaggatttagcggggctggggaaaaactgttttccagccggtacggcaaaatggctaacaaggcaaacacaagcggggattttgaaaaagacgacgacgcgtacaaaactgaggactccgacgatattcactttgagcccgtggtacagatgccggagaaggtggagttagtaacaggtgaagagggtgagaaagtgctctattcccagggagtgaagctgtttcgattcgacgcagaggttaggcagtggaaagagcgcggcctggggaacctgaaaatcctcaaaaacgaagtaaatggaaagctccggatgctcatgcgaagagaacaagttctaaaagtctgtgctaatcattggatcacgaccaccatgaacctcaagccactgtccggaagtgatagggcttggatgtggagcgccagcgatttcagcgacggcgacgctaagctggagcggctcgccgctaaatttaagacgccggagttggctgaggagttcaagcagaagtttgaggagtgccaacgcttactcctggacatcccactgcagacccctcacaaactcgtcgacaccggaagggcggcaaagctcatccagcgggctgaggagatgaaaagtgggctgaaggacttcaaaacatttttaaccaatgaccagaccaaggtgactgaggaggagaacaaggggtcgggaactggggctgctggcgcttccgacactacaattaagccaaatgctgagaacaccgggcccaccctggagtgggacaattacgacctgcgcgaggacgcactggatgactctgtctcctcaagctcagtgcatgcatcccctttggcatcatctccagtgagaaaaaacctcttccgtttcgatgagagtactaccggtagcaacttttctttcaaaagtgccctgagtttgtctaagtcaccagctaagttgaaccagtctggaacctctgttggcaccgatgaggaaagcgttgtgactcaggaggaggagcgggatggccaatattttgaacccgtggttcctctcccagatctcgtggaggtgtcttccggcgaggagaacgagcaggtggtcttcagccatcgcgctgaaatctatagatacgacaaggatgtcggtcagtggaaagaacggggcatcggtgatattaagatattgcaaaactacgataacaagcaggttcgaattgtgatgaggcgcgaccaggtcctgaagttgtgcgcaaatcatcgcataactccagacatgagtttgcaaaacatgaaaggcactgagagagtgtgggtctggacagcctgcgacttcgccgatggagaaaggaaggtggagcacttagccgtgagatttaagctgcaggacgtcgctgacagcttcaagaaaatcttcgacgaggccaagacagcacaggagaaagactccctgattaccccacatgtgtccaggagctctacaccgagggagtccccgtgcggcaagatcgccgtagcaattttggaagaaacaacgagagaaaggactgacgttatccaaggcgacgatgttgccgacgctgccagcgaagtggaagtgagtagcacctcggagactacaactaaagccgtggtcagccctcccaaattcgttttcgtgtccgagtccgttaaaagaatcttttcctctgagaagtccaagccttttgtgttcggaaactcgtccgctaccgggagtttatttggttttagcttcaatgcccccctcaaatcaaataatagtgagaccagctccgtcgcccaatccggaagcgagtctaaggtagagccgaagaaatgtgaactaagtaaaaactccgacatcgagcagagctcggacagtaaggtcaagaacctgtccgcgtccttcccgacagaggagtccagcatcaactacactttcaagaccccagaaaaggagcccccgctgtggcacgccgaattcacgaaggaagagctggtgcagaagctgagaagtacaaccaaatctgcagaccacctgaacgggctactgcgcgaaatcgaggcaactaatgccgtgcttatggaacagatcaagttactcaagtccgagatccgccgcttggagaggaaccaggagcgggagaaatccgcggctaatctagaatacctgaaaaatgtgcttctccagtttattttcttgaagccaggctccgagcgagagaggctactccccgtgatcaatactatgttgcagctttcaccggaggaaaagggaaagttggcagctgttgctcaggacgaagaagagaatgcaagtagatcctctgggtag

SEQ ID NO: 131717 - DNA, 2715 bp, Artificial Sequence
  Description of Artificial Sequence: Synthetic coding sequence
atgcgccggagcaaggctgacgtcgaacgctacgtggcgtctgtactgggattaaccccgagtccgaggcagaagtctatgaaaggattttactttgccaagctctactatgaggccaaagaatatgacctggcaaagaagtatatttgtacctatattaacgtgcaggagagggacccgaaggcccaccgtttcctgggcctgctctatgagctggaggagaacacggagaaagcagtggaatgctaccgtagatcggtggaactgaacccaacacagaaggaccttgttctgaaaatcgccgagcttttatgcaaaaatgatgtaaccgatggccgggccaagtattgggtcgagcgcgccgctaagctttttcccggtagtccagctatctacaagctcaaggaacaactgctggattgcgagggggaggatggctggaataagctattcgatctcatacagtccgaactatacgtccgacccgacgacgttcacgtcaatatccgcttggtggaactttaccgcagtacgaagagactgaaagacgccgtggcccattgccatgaagcagagcggaatattgccctgcggtcgagcctcgagtggaacagttgtgtcgtgcagaccctgaaagagtaccttgagtcactgcagtgtcttgaatcagataagtccgattggcaagcaaccaatacagacttactgctcgcctatgcgaatctcatgcttctgacactctcaaccagggacgtgcaggaaaaccgcgagttgcttgagtcattcgatagcgcattacaaagcgccaaaagctctttaggcggcaatgatgaattgtccgctaccttcttggaaatgaagggacacttctatatgtacgctggatctttgctgttgaagatgggccagcacggcaataatgtgcagtggagggcattgtctgaactggccgccctatgctatctaatagctttccaggtacctcgaccaaagatcaaattgagggaggggaaggctggacagaaccttctggaaatgatggcttgtgatcggctctcacagagcgggcatatgctgctcagtctaagccgaggtaagcaagatttcctgaaggaggtcgttgagacttttgccaacaagattgggcaaagtgccctgtatgatgccctcttcagttcacagtctcctaaggatacctccttccttggtagcgatgatatcggaaagatagatgtccaggagcctgaactggaggacctggctaggtatgatgtgggggcaattcgcgcacacaatggctccttgcaacacctgacttggctgggactgcaatggaatagtctaccagctttacccggcatcagaaaatggctgaaacagctctttcaccgacttccccacgagaccagcagactcgaaaccaacgcacctgagtcgatctgtattttagacctagaagtcttcttgctgggggttgtgtacactagtcacttacaattaaaggagaaatgcaattcccatcattcgtcttaccaacccctgtgtcttccatttcccgtttgcaagcagttgtgtacagagagacaaaaatcctggtgggatgccgtgtgtacactgatccaccgcaaggcagttcccgggaatttagctaagttgagattgctggtccagcacgagatcaacaccctgcgggcccaggaaaagcatggattacagccggccctgttagtccattgggcgaaatacctccaaaaaacaggttctgggctcaattcattctacgggcagctcgaatatattggccgcagcgtccattattggaaaaaggtcttaccactccttaagatcatcaagaaaaattctatcccggaacctatcgaccccctatttaagcacttccacagtgtggatattcaagcctccgagatcgtggaatacgaggaagacgcccacatcactttcgccatgttggatgctgtgaatggcaacatagaggacgctgtgacagcatttgaaagcatcaagagcgtggttagttactggaacttggcccttatttttcatagaaaagcggaagacatcgagaacgatgctctatccccagaagaacaggaagaatgccggaactacctgacaaaaactcgtgactatctaattaaaatcattgatgatggtgattcgaacctgtctgtggtcaaaaaattgcctgtgccgcttgagtccgtgaaacagatgttaaattctgtgatgcaggagctggaggactactcagaaggcggacctctttacaagaatggatcactgcggaacgccgacagcgagattaaacatagcaccccctctccaacgaagtactccctgagcccaagcaagtcatataaatacagccccgagaccccgccccgttggactgaggacaggaattccctgcttaatatgatctgtcagcaggtggaagccatcaaaaaagagatgcaggagctcaagttgaacagcagtaaaagtgcatcccggcacaggtggcctaccgagaactacggaccggattcagtgccggatgggtaccaaggatctcagacatttcatggagcacccctcaccgaagccgctcatcggcacttcactatcgagaaacacggggactcaaagtggatcatttaccggtttactaagcaactctgcggaactgagagagctagggcgaagatttcatag

SEQ ID NO: 131718 - DNA, 459 bp, Artificial Sequence
  Description of Artificial Sequence: Synthetic coding sequence
atgtggtctggcacgtctccaaggtgctgggtgtccccacgcagactggaccgctacatttgcacctatattaatgtgcaggagagagaccctaaagcccacagattcttggggctgctctatgaacttgaggagaacacagaaaaggctgtggaatgttacagaagatccgttgaactaaacccaacacagaaggatttagtcctgaaaatagccgagttgttgtgtaagaacgatgtgacagatgggcgggctaagtactgggtcgaacgcgcagccaagctgtttcccggctcccccgccatctataaactcaaggagcagctgctggattgtgaaggcgaagacggatggaataaactattcgatctcattcagtccgagctatacgtgcgccccgatgacgtgcatgtcaacataaggctcgtcgagctgtaccgatctaccaagcggctgtag

SEQ ID NO: 131719 - DNA, 2715 bp, Artificial Sequence
  Description of Artificial Sequence: Synthetic coding sequence
atgcgaaggagtaaggccgacgttgagcgatacgtagctagtgtgctggggctgaccccatccccccgccagaaaagtatgaaggggttttactttgctaaactatattacgaagcgaaagaatacgatctagctaaaaaatatatttgcacctatattaacgtccaagagcgagaccccaaagcacatcggttcctgggcctgctctacgagctcgaggagaacactgagaaagccgtagaatgttacaggcgtagcgtggagctcaacccaactcagaaagatctggtgcttaagatagctgagttactctgtaagaacgatgtgaccgacggccgggctaagtattgggtggagcgggcagcgaagctgttccccggatcaccagccatctataagctgaaggagcagttgctcgactgcgaaggcgaagacggttggaacaaactctttgacctgattcagagcgagttatacgttaggcccgatgacgtgcatgtcaacatccggcttgtagaactgtacagaagcacaaagcggttaaaggatgccgtcgcccactgtcacgaggcggaaaggaatattgcactgaggagcagcctagagtggaatagctgcgtggtccaaacactcaaagagtatctggagtctctacaatgtttggagtcggataaatcagactggcaagcgactaacacagatctcctgctcgcgtacgctaacctgatgttgttgaccttgtccacacgggacgtgcaagagaaccgggagcttctagaatcttttgattcagctctacaaagcgccaaatcatcacttggcgggaatgatgagcttagcgctacgttcctggagatgaagggccatttctatatgtacgccggcagtctgttgctcaagatggggcaacacggaaataacgtacagtggagggccctctctgagctggcagcactttgctatcttatcgcatttcaggtgcctaggcccaaaataaagttaagggagggaaaagccggtcagaatttgctagaaatgatggcatgcgaccgcctctcccaaagtggacacatgctgctcagcctcagcaggggcaaacaagattttttgaaagaggtggtggaaaccttcgctaataagattggacagtctgccctttatgacgccctatttagctctcagtctccaaaggatacttcattcctcggctctgacgatattgggaaaatcgacgtgcaggagcccgagctggaggatctagctcggtacgatgtgggcgccatacgcgcccataatggctcccttcagcatttgacttggctcggccttcagtggaatagcctgcccgcactacctgggatacggaagtggttgaagcagctctttcaccgactccctcatgagacatccagactggagaccaatgcaccagagtcaatctgtattctcgatctagaggtgttcttactgggagtggtgtacacctctcacttgcagctgaaggagaaatgtaatagccatcattcctcctaccagcctctgtgtttgcccttccctgtctgcaagcagctctgcacagaacgccagaagtcctggtgggatgccgtctgtacactcatccaccggaaggcagtccctgggaatctcgccaagctgagactgctcgtgcagcacgaaatcaataccctgcgggcccaagagaagcatgggctgcagccagcacttctggtccactgggcaaagtatttacagaagacaggatctggcctcaattccttctacgggcagcttgaatatatcgggcgatcagtccattattggaaaaaagtcctgcccctgctcaaaatcatcaagaagaattctatccctgagccaattgaccccctgtttaagcacttccattccgttgatatccaggcatcagagatcgttgaatacgaagaagacgcacacattactttcgctatgcttgatgcagtgaatggaaacattgaagatgctgtcacggcattcgagtctattaagtccgtcgtgtcttactggaacttagcactcatttttcaccgaaaggccgaggacatagaaaacgatgctctgagccccgaagaacaggaagaatgtagaaattacttaaccaagacccgggattatctgattaaaatcattgacgacggcgactccaacttgagtgtcgtaaaaaaattacccgttcccctagaatctgtaaagcagatgctcaactcagtcatgcaggaactcgaggattatagtgagggtggcccactctacaagaacggatccctgagaaatgctgacagtgagataaagcattcaacccccagcccaaccaagtacagcctttcacctagtaaaagctacaagtactctccagaaaccccccctcgctggaccgaggacaggaactccctactaaacatgatttgccaacaggttgaggccataaaaaaagaaatgcaggagttgaaacttaatagctctaagagcgcctcccgccacagatggccgacggagaactacgggcctgactctgtgcccgacggataccaagggtcccaaacttttcatggggctcccttgacggaggcggcccataggcacttcaccatcgagaaacacggggattcaaagtggattatctaccgtttcacaaaacagctgtgtggcaccgaaagggctagagccaaaatcagctag

SEQ ID NO: 131720 - DNA, 5298 bp, Artificial Sequence
  Description of Artificial Sequence: Synthetic coding sequence
atgaggcgctcgaaggcggatgtggaaaggtacgtggcatcagtgttgggtctaacaccatcgccacggcagaagagcatgaaaggattttatttcgctaagctatattatgaagcgaaggagtatgatttggccaaaaaatacatatgcacttatatcaacgtccaggagagggaccccaaggcacaccgattcctaggtctgttatacgaactggaggaaaatactgagaaggccgtggaatgttatcgaaggagcgtggagctgaatcccactcaaaaggatctggtcctcaagatcgccgaacttctttgcaaaaatgatgttaccgacggccgggctaagtattgggtggagcgggccgccaaactgtttcctggctcacccgccatatataagctgaaggaacagctgctggactgtgagggggaagatggatggaacaaacttttcgaccttatccagtcagagctgtacgtgagacccgacgacgtgcatgtcaatatcagactagtcgaactgtatagaagcacaaaacgtttgaaggatgctgtggcgcattgtcatgaggctgagcggaacattgcactgaggagtagcctggagtggaattcctgtgttgtgcagacactcaaggagtatctcgagagcctccagtgtcttgagagtgataaatccgactggcaggctactaatacagatctgttactcgcttacgccaacctgatgctgcttaccctgtccactcgtgatgttcaagaaaaccgcgaactgttggaatcattcgacagtgctctccagtctgctaaatcgtctctggggggcaatgacgagctatccgctacctttttggagatgaagggacacttctacatgtatgccgggagcctgttgcttaagatggggcagcacgggaacaacgtccaatggcgggccctgtctgaactggccgccctgtgttacctgattgcatttcaggtccccaggcccaaaattaagctgcgcgagggcaaagccggccaaaatctgcttgaaatgatggcctgcgacaggctgagccagagcggccacatgctgctgagcctaagccgcggcaagcaggactttctgaaggaagtggtcgagacttttgcaaacaagatcggacagagcgcgctatacgacgccttgtttagctcgcaaagccctaaggatacctctttccttggatctgacgatatcggcaaaattgacgtccaggagcctgaactggaggacttagcgaggtacgatgtcggggcaatccgggcgcacaacggcagtctccagcacctcacgtggctgggcctacagtggaatagtctgcctgcattacctggtatacggaaatggcttaagcagctgtttcaccgcctccctcatgaaacctccaggcttgaaactaacgccccagaatctatctgtatattggatcttgaagtgttcctgctgggtgtcgtttacaccagtcaccttcagttgaaggagaagtgcaactctcaccactcctcctaccagcctctttgcttgccattccctgtctgtaaacagctgtgcaccgaacgtcagaaaagctggtgggatgccgtgtgtactctgatacacagaaaagccgtaccagggaacctcgctaagctccgacttctcgttcagcacgagatcaatacacttcgcgcccaggagaaacacgggctgcagccggccttgctcgtgcattgggccaagtatcttcagaaaacagggtctggcctaaactccttttacggacagctggagtacatcggtagatctgtgcactactggaagaaggtgctcccattgctcaagattatcaaaaaaaattccatcccagaaccaattgatccattgttcaagcactttcactccgtcgacatccaggccagcgaaatcgttgagtatgaagaagacgcccacatcacatttgccatgctcgacgccgtaaatgggaacatcgaggacgcagttaccgcatttgagagcatcaaatccgtagtgtcttactggaacttggctttaatcttccataggaaggctgaggatattgagaacgatgctttgtctccggaggagcaggaggaatgtcggaactacctcacgaaaactagagactacctaatcaagatcatcgatgacggagactccaatctgagtgttgttaagaaactgcctgttcccctggagagcgtgaaacagatgctaaatagcgttatgcaagaactggaagactattcggaaggcgggcctctgtataaaaatgggtctctgcgcaacgcggattctgagataaagcatagtaccccctctcctactaagtattctttgtcccccagcaaaagctacaagtacagccctgagacaccccctaggtggaccgaagaccgaaattccctgctgaacatgatctgtcaacaggtggaggcaattaagaaagaaatgcaggagttaaaactaaactcttcgaaatcggcttcacgccaccgctggcccacagagaactacggcccagactccgtgcctgacggataccagggaagccagacatttcacggcgccccactaaccgtggccaccactgggccttcagtttattattcccagagccctgcatacaattcccagtacctactgcgccccgcggcaaatgtgacgcccacaaagggctcctctaacacagaattcaagagcaccaaagaaggcttttccatccccgtttccgcagacgggtttaaatttggcatatctgaacctgggaaccaagaaaagaaaagggaaaagcctctggagaatgacacgggcttccaggctcaggacatctccggacgaaaaaaggggaggggagtgatattcggtcaaaccagctcaacttttacttttgcagacgtggcaaagagcacaagtggcgaggggtttcagttcggcaagaaagatcttaactttaagggtttctccggggccggtgaaaagctcttttcatcacggtatggcaagatggcgaacaaggccaacacatccggggatttcgaaaaggacgatgatgcctacaaaactgaagactctgacgacatccatttcgagcccgtggtccagatgccagagaaggttgagttggtcacaggggaagagggcgaaaaagtactctactcgcagggggttaagcttttccgtttcgatgctgaagtaagacaatggaaggagaggggcctcggcaatctgaagattctgaagaatgaggttaacggtaaactgcggatgctcatgcgcagggaacaagtgcttaaagtgtgtgcgaatcactggatcaccactactatgaacctcaaacctctgagtggctctgatagagcctggatgtggagcgcttccgatttttccgacggtgacgcaaagcttgagcggctggccgctaagttcaagacaccggagctggctgaggagttcaagcagaaatttgaggaatgccagcgactccttctcgatatccccttacaaactcctcacaaactcgtggatactggccgagcggccaagttaatccaacgcgctgaagaaatgaagagcgggcttaaagacttcaagacgtttcttacaaacgatcagaccaaagtaactgaagaagagaacaaaggatcaggaactggggctgccggcgcgtccgatacgactatcaagcctaatgcggaaaacactggcccgaccctggagtgggataattatgatttgcgcgaggacgccctggatgattcagtgtcatctagcagcgtgcacgcctcccctctggcaagctcccccgtgaggaagaatcttttcaggtttgacgagagcaccaccggatcgaacttcagtttcaaatctgcgttaagcctctccaaatctcctgcgaaactcaatcagtctggcacttctgtaggcaccgatgaggagagcgtcgttacacaggaggaagagcgtgacggacagtactttgagcctgtagtgcctctccctgaccttgtggaagtcagttccggtgaggaaaatgaacaagtcgtgttttctcacagggcagaaatttatcgctacgacaaggacgtaggacaatggaaggaacgagggatcggagatattaagatattacagaattatgacaataagcaggtgaggatcgtgatgcgccgggatcaggtgttgaaactgtgcgctaaccatcgaatcactcccgacatgagcctccaaaatatgaaggggactgagagagtttgggtctggaccgcatgtgactttgctgatggagagcggaaggtcgagcatctggcggtgagattcaaactgcaggacgtggctgattcgtttaaaaaaatcttcgatgaggccaagaccgcgcaagaaaaagactccttgattactcctcacgtctcccggtcgtcaacccctcgggaaagcccttgcgggaaaatagctgtggccatactggaagagaccaccagagaacggactgacgtaattcagggcgacgacgtggcggatgccgctagtgaagtggaggtttcctcaacatcggagaccacaactaaggctgtcgtctctcccccaaagttcgtcttcgtgagcgaatctgtcaaaaggatctttagctccgaaaagagcaaaccttttgtgtttggcaactccagtgccaccggctccttgtttgggttctctttcaacgcccctctaaagtccaataattccgagacctcttccgtggctcaatcgggatccgaatcaaaagttgagccaaagaaatgcgaactgagtaagaactctgacatcgaacagagctctgatagtaaggtgaagaatttatcagcctcatttccaaccgaagagtccagcataaactacacattcaaaactcctgagaaggaacctccgctgtggcacgctgagtttacaaaggaggaactggtgcaaaagttgcgttccacgaccaagtcggcagaccatttaaatggacttctgcgcgaaatcgaggccaccaatgcagtcctcatggagcagataaagcttctcaaatccgagatccgccgcctcgaacgtaatcaggaaagggaaaagtctgcagccaacctagagtatttgaagaatgtactgctccagtttatatttctgaaacccgggtccgaaagagagcgacttctgccagttatcaatacgatgctccagctgagccctgaagagaaggggaaactcgccgcggtggcgcaagacgaagaggagaatgcgagcagaagctcaggttag

SEQ ID NO: 131721 - DNA, 2715 bp, Artificial Sequence
  Description of Artificial Sequence: Synthetic coding sequence
atgaggcgttcaaaggcagacgtggagcgatatgtcgctagcgtgctcgggttgacaccctctccacggcaaaagagcatgaaaggtttctactttgcaaagctgtactacgaagccaaggaatatgacttggcaaagaagtatatttgtacatatatcaatgtccaagagcgggatccaaaggcacataggttcctgggccttttgtacgaattggaggagaacaccgaaaaagctgtcgagtgctatcggaggtctgtagaacttaacccaacccagaaggatctggtactgaagatcgcagagttgctttgtaagaacgatgtcacggacggaagggcaaaatactgggtggaacgagctgcgaagcttttccccgggtccccagcaatctacaagctgaaagagcagctcctcgactgtgaaggggaggatggatggaacaaactgttcgacctgatccagtcagagctctacgtaaggccggacgatgtgcacgtgaatatccgactcgttgaactctacagatccaccaagcgattgaaggatgcagtagcacattgtcatgaagccgaacggaacatagcactcaggtcttcattagagtggaatagctgcgtggtgcagacactgaaggagtatctagagtcactgcaatgtctcgagtctgataaaagtgattggcaggctacaaacaccgacctgctacttgcctatgccaacctcatgctcttgactcttagtactagagacgtgcaggaaaaccgagaacttctggaaagcttcgactccgcccttcagtctgcgaaatcgtctcttggaggcaacgatgaactgtccgccacatttttagaaatgaagggtcacttctacatgtatgcaggtagcctgcttctgaaaatggggcagcacggtaacaacgttcagtggagggccctcagtgagctagctgcactctgctacctcattgcctttcaagtgcctaggcccaagatcaagctcagagaaggcaaggccggccagaatctgctcgagatgatggcctgtgaccggctttcgcaatctgggcacatgctcttgtctctcagtaggggcaagcaggatttcctcaaggaagttgttgagactttcgcaaacaagattggtcagtctgccctttacgacgcacttttcagtagtcagagcccgaaggacacttcttttcttggatctgacgatatcggtaagattgacgtgcaagagccagagctggaggacctcgctcgttatgacgtgggggccattcgggcccacaacggcagcctgcagcatcttacctggctggggctgcagtggaactcactccctgcgttgcccggtataaggaagtggctaaaacagctgttccaccgtttgccacacgagacctctcgccttgagaccaacgcccctgagagcatctgcattctagatctggaagtgtttcttctgggagttgtctacacaagtcaccttcagctgaaggagaaatgtaactcacaccattcatcatatcagcctctctgtctcccctttccagtctgcaagcagctgtgcaccgaacgccagaagtcttggtgggatgccgtctgcacactgattcacaggaaggcagttccaggaaatctcgcaaaactgcgcctgctcgtacagcatgagattaataccctgcgcgcccaggagaaacacggactccagcctgctctgctcgtccactgggccaaatatctgcaaaagaccggctctggcctgaactctttctatggccagctggaatatataggcaggtccgtgcactactggaagaaagtgcttccactattgaagatcatcaaaaagaatagcataccagagcccatagatccgttgtttaagcattttcacagcgtggatatacaggcttccgagattgtcgagtatgaagaggacgctcacattacatttgccatgctcgacgcagtgaacggtaatatcgaggacgccgttaccgccttcgagtctattaaatcggtggtgagttactggaatttggctctcatcttccatcggaaagcagaggatatcgaaaatgacgctctgtcgccggaagaacaggaggagtgtaggaattatttgactaaaacgagagattaccttattaaaatcattgacgacggcgactcaaatctgtccgtcgtgaagaaattgcccgtccctctcgagtctgtgaaacagatgctcaactctgtgatgcaggaactggaggactactctgaggggggtcctttgtataaaaacgggtccttgagaaacgccgacagcgaaatcaagcacagcactccctcaccaaccaaatactccctgtccccatccaaatcctataaatatagtcccgagactcctccaaggtggactgaagaccgcaactccctactgaatatgatatgccagcaagtcgaggcaatcaaaaaagaaatgcaggagctgaaactgaactctagtaagtcagcctctagacacagatggccaaccgagaactacggccccgactctgtaccggatggatatcagggaagccagacttttcacggggcgccactcacagaggccgctcaccgccacttcaccattgaaaaacacggagactcaaaatggattatttaccggttcacgaagcaactgtgcggcaccgaaagagcgcgcgcgaaaattagctag

SEQ ID NO: 131722 - DNA, 5298 bp, Artificial Sequence
  Description of Artificial Sequence: Synthetic coding sequence
atgcgcaggtccaaagcagacgttgagcgatacgtggcttccgtgctgggcctcacaccttcacctagacagaagagcatgaagggattctactttgctaagctgtactacgaagccaaggaatacgatcttgccaagaagtacatatgtacctatataaacgttcaagaaagagaccccaaagcgcaccgcttcctaggcttgctctacgagttagaggaaaacactgagaaagccgtcgagtgctatagacgctccgtcgaactgaacccaacacagaaggaccttgttctcaagatcgctgagctcctgtgtaagaatgacgtgacggacgggagggcaaagtactgggtcgagagggcggccaaactgttccccggctctcctgccatctacaaattaaaagagcaattgctcgactgtgagggcgaagatggttggaacaagctttttgatctgattcagtctgaattatacgttcgcccagacgatgtacatgttaatatccggcttgttgaactataccggtccaccaagcggctgaaggatgctgtggctcactgccacgaggctgaacggaacatcgccctgcgatcttccctggaatggaactcttgtgttgtccagacactgaaggaataccttgagagcctccagtgcctcgagtctgacaagtccgactggagagcgacaaatactgacctgctgctggcatatgccaatctgatgcttctcacactttctacacgcgatgtacaagaaaatcgggagctcctcgagtcctttgacagcgcccttcagagtgctaagagctccctgggcggaaacgatgagctgtcggcaaccttccttgagatgaaggggcatttttacatgtatgccggatctctcctgctcaaaatgggtcagcacggtaacaacgttcaatggagggccctctctgaactggctgccttatgttatttgattgcctttcaggttccccgccccaaaatcaagctgcgtgaggggaaggcaggccaaaacctcctcgagatgatggcatgcgacaggctcagccagtccggccatatgctgctgtctctcagtcgggggaagcaggactttttgaaagaggtggtcgagacgtttgcaaacaagattggccaatcagctctctacgacgcgctgttctcgtctcagagcccgaaagatacttctttcctgggcagcgacgacataggaaagatcgatgtgcaggagcctgaactcgaagacctggcacgttacgatgtgggagctatcagggctcataacggatctttgcagcacctgacctggctgggcctgcagtggaactccttacctgccttgcctggtataaggaagtggttaaagcagctgttccaccgccttccgcatgagacctctcgcctggagacgaacgcccccgaatcgatctgcattctggacctggaggtgtttcttttgggggttgtgtatacgtctcaccttcagctcaaggagaagtgcaacagccatcactcctcctaccagccgctgtgcctgccctttccggtgtgcaagcagctgtgtacggagcgccaaaagagctggtgggacgcggtttgtactttaatccacaggaaagcggtcccgggcaaccttgcaaagctgcggcttctggtgcagcatgagatcaatacacttagagcccaggagaagcacggactccagccggctctactcgttcactgggctaagtatcttcagaagacaggatcaggccttaactctttttacggacagctggagtacataggacggtcagtacattattggaaaaaagtgctgccccttctgaagatcatcaagaagaattccattcctgaaccgattgatcctctcttcaagcattttcactctgtggacatccaagcatctgagatcgtagagtacgaggaagatgcacatattactttcgccatccttgacgccgtgaatgggaacatcgaggacgccgtgaccgccttcgagtcaatcaaatccgtagtgagctactggaaccttgccttgatcttccatcgaaaagcggaagatattgagaacgatgcactttctccagaggagcaggaggaatgccggaattatttgacgaagactcgggactatctcatcaagatcattgacgacggcgattctaatctctctgtggtcaaaaagttaccggttcccctcgagtccgttaagcagatgctgaactctgtaatgcaggaactggaggactatagtgaaggaggccctctgtacaagaacggttctctgagaaatgccgactcagagattaaacactcaacaccaagccctaccaaatactccctctccccctccaagagctacaaatactcaccggagacccccccacgttggacagaagatcgaaactcccttctcaacatgatatgtcagcaggtggaagcgattaagaaagagatgcaggagctgaagcttaacagctcgaaatcagccagccggcatcgatggcccacagaaaactacggcccagattcagtgccagacggataccaaggcagccaaactttccacggtgctccacttactgtggctaccacagggccttccgtctactatagccaatcacccgcttataactcacaatacctcctacgtcccgctgctaacgtgacaccaacaaaaggcagctccaacaccgagtttaaatctaccaaggaaggtttctcaattcccgtttctgctgacggctttaaatttggtatctcggagccaggcaaccaggagaagaagcgggagaagcccctggagaacgacacggggcttcaggcccaggatatccgggggcgcaaaaagggacggggggtgattttcggccagactagctcaacatttacatttgccgatgtcgctaaatccacaagcggagagggctttcagttcggcaagaaggatctgaactttaaaggtttctccggggcaggtgaaaaactcttttccagcaggtatggaaaaatggcaaacaaggcgaacacttctggagacttcgaaaaggacgatgatgcttacaagaccgaagatagtgatgacatacacttcgaacctgttgtccagatgcctgagaaggtggagctcgtgactggcgaagagggcgagaaggtgttgtattctcagggggtcaagctctttcgcttcgacgccgaggtgcgtcaatggaaggagcgggggcttggtaatttgaaaatccttaagaatgaggtgaatggcaaactccgcatgcttatgcggcgggagcaagtcctcaaggtgtgtgcaaatcactggattaccactacaatgaacctgaaacctctcagcggaagcgatcgtgcatggatgtggtccgcctccgacttttcagacggggatgcgaaacttgagcgtctggccgctaagttcaagacacccgagctcgctgaagagttcaagcagaaattcgaggagtgccagagactattgctggatataccattacagactccgcacaagctggtggatactgggagagctgccaagctgattcagcgcgccgaggagatgaagtctgggcttaaagacttcaaaacattcctgactaacgaccagacaaaggtgactgaagaggaaaataagggcagtggaacaggtgtagctggagcttctgacacaacgataaagccaaatgcggagaataccggaccgactttggaatgggacaactacgatttaagggaggatgcccttgacgacagtgtgagcagctctagtgtgcatgccagtcctctggcatcctccccagtccggaagaatctattccgtttcgatgagagcacaaccggatccaactttagctttaaaagtgctttatccctctccaagtctcccgccaagctgaaccaatcaggcacttctgtcggcacggatgaagaatcagtcgtaacacaagaggaggagcgagatggccaatacttcgaacctgtcgtacctctgccggatctggtggaggtgtcctctggcgaggagaacgagcaagtcgtattcagccaccgggctgagatctatcgatatgacaaggatgtcggccaatggaaagagagaggcatcggtgacatcaaaattcttcagaactatgataacaaacaggtgagaatcgtaatgagaagggatcaagtgctgaaactctgcgccaatcaccggatcacacccgatatgtctctccagaacatgaagggcactgaaagagtgtgggtatggacagcatgcgatttcgccgacggggagcggaaagttgagcacttagcagtacgatttaaacttcaggatgtggcagacagttttaaaaaaattttcgatgaggctaagactgctcaggagaaagactcattaataacaccacacgtgagtagatcatccacacctcgagagagcccttgcgggaagatcgctgtggcagtgctggaggagataactcgcgagcgtaccgacgtcattcagggtgatgatgttgccgatgccgcatctgaggtggaggtgagttcaacctccgagacaacgaccaaggccgtcgtgagtccgcctaaattcgtgtttgtctcagagtcagttaagcggatcttctcatcagaaaaatccaagccctttgcctttggcaactcctcagctaccggctcattgttcggcttctcatttaatgcccccctgaaatcaaataacagtgaaacatcatccgtggcccagtcaggctctgagtcaaaggtagagcctaaaaaatgtgagctgtccaaaaacagcgatatcgagcagtcttcggactcaaaggttaagaacctttcggccagtttccccaccgaggagagctccatcaattacaccttcaagacccctgaaaaggagcccccattgtggcacgccgagtttaccaaggaagagctggtgcagaagttgcgctccacaacaaaatccgcggaccacctgaatggtctgctccgcgagattgaggccactaacgcggtcctgatggaacagattaagctgctgaagagcgaaatccggagactagaaagaaaccaggagagggaaaagtccgcggcaaatctggagtacctgaagaacgtactgcttcaattcatcttcctgaagccggggtcggagcgggagagactcctcccggtaataaacactatgctgcaattaagccctgaagagaagggcaagctggccgctgtcgcccaggatgaggaagaaaatccttcgaggtcatctggatag

SEQ ID NO: 131723 - DNA, 1407 bp, Artificial Sequence
  Description of Artificial Sequence: Synthetic coding sequence
atggggactgctacgcccgatggcagagaggatcaggagaggctctgggtctccgtcgaagatgcccaaatgcacaccgtgactatatggctgacagtacgccctgacatgactgtagcatcgctcaaggacatggtgtttcttgattacggttttccccctgtgttgcaacagtgggtcattggtcaaaggttggcacgcgaccaggaaacactgcactcacacggcgtaaggcagaatggggactcggcctacctgtatctgctgagtgccaggaacacatcccttaacccccaggaactgcagcgagagaggcagctccgcatgctggaggacttaggatttaaggatcttacattgcaaccgcggggtcctcttgagcccggtccgcctaagcccggggttcctcaggagccaggaagggggcagccagacgctgtccctgagccacctccagtgggatggcaatgcccgggctgcacattcattaacaaacctacaaggccagggtgtgagatgtgctgcagggctcggccagaggcatatcaggtgcccgcctcgtatcaacctgacgaagaagaacgagcccgcctcgccggagaggaagaggcacttagacaataccagcagcggaaacagcaacagcaggagggcaattaccttcagcatgttcaactggaccagcggagcttagttttaaataccgagcctgccgagtgccctgtttgttattctgtcctcgcgccaggggaggctgtcgtgcttcgtgaatgcctgcatacgttttgccgtgaatgccttcagggcacaattcgcaacagccaggaagccgaggtatcgtgcccgtttatagacaatacttactcatgctcaggaaagttgctcgagagagagatcaaagccttactgacccccgaagattaccaacgtttcctcgacttaggaatctctatagctgaaaatcggagcgctttttcctatcattgcaagacacccgactgcaagggatggtgcttcttcgaagacgatgttaatgaatttacttgtccagtttgttttcacgtgaactgtcttttatgtaaagctatccatgagcaaatgaattgcaaggaataccaggaggatctcgctttgcgcgcacagaatgacgtagcggccagacaaacaaccgagatgctgaaggtgatgctccagcagggtgaggccatgcgctgccctcagtgccagatagtcgtgcagaagaaggacggctgcgactggatccgctgcactgtctgccacaccgagatctgctgggtgactaaggggcctagatggggacctggcggcccaggcgatactagtggggggtgccggtgcagagttaatggcatcccttgtcacccatcctgtcagaactgccactag

SEQ ID NO: 131724 - DNA, 1533 bp, Artificial Sequence
  Description of Artificial Sequence: Synthetic coding sequence
atggatgaaaaaacgaaaaaggccgaagagatggcactctcactgaccagggcagtagccggcggcgacgagcaggtcgcaatgaagtgtgcgatatggcttgccgaacagagagtcccactgagcgtgcagctgaagcccgaggtgagccccacacaggatattcgattgtgggtgtccgtagaagacgctcaaatgcacactgttaccatctggcttacggtgaggcccgatatgaccgtcgctagcttaaaggacatggttttcctggattacggattccctccagtactgcaacagtgggtgatcggtcagcgcttggcaagagatcaagagactctccacagccatggggtgagacagaacggcgactccgcttatttataccttctgtccgcacggaatactagtctgaatcctcaggaacttcagcgtgagcgtcagctcagaatgctcgaagaccttggatttaaggacctcaccctgcagccgagggggcccctggagccgggtcctcctaagccgggggtccctcaggagcctggaagagggcagcccgatgctgttcccgagcctcccccggtggggtggcaatgtccagggtgtacctttattaacaagccaactcgccccggttgtgagatgtgctgtcgggctcgtccggaagcctaccaggtgcccgcaagctaccagcctgatgaagaagagcgggcacggttggcgggcgaggaagaggcgctgcggcagtatcagcagcgtaaacagcagcagcaggagggcaactatctccagcacgtacagctggatcagagatccctcgttctcaatacagaacctgcggaatgcccggtttgttactcagtgctggcgcctggcgaagccgtggttcttagggaatgcttacacacattttgtagggagtgtctccaaggaacaattcggaacagtcaggaagctgaagtcagctgcccattcattgacaacacctactcatgcagtggtaagctgctggagcgggaaataaaggccctcctcacacccgaggattaccagagatttctggatcttggcatatcaatcgcagagaacaggagcgctttcagttaccactgcaagaccccagattgtaaggggtggtgcttttttgaggacgacgttaacgaatttacttgcccggtgtgttttcatgtcaactgtctgctctgtaaggcaatccacgaacagatgaattgtaaagaatatcaagaggacttggccctgagggcccaaaacgatgtggctgcccggcagaccacagagatgctaaaagtgatgctacagcagggagaagcaatgagatgtccacagtgccagattgtggtgcagaagaaggacgggtgtgactggatcaggtgcaccgtgtgtcatactgagatttgctgggtgaccaaggggccgagatgggggcctggtggacccggggacacatcaggaggctgcagatgtagagtgaatggcattccgtgccatcccagctgtcagaactgtcattag

SEQ ID NO: 131725 - DNA, 1011 bp, Artificial Sequence
  Description of Artificial Sequence: Synthetic coding sequence
atggacgaaaaaacaaagaaggcggaggaaatggccctgtcactgactcgagcagtggctggcggggatgagcaggtggccatgaagtgcgccatatggctcgctgaacaaagagtgccactcagtgttcagttgaagcctgaggtgtctcccacccaagatatccgcctttgggtgtccgtggaagacgctcagatgcatacggtcaccatctggttgaccgtcaggcccgacatgaccgtcgcttcgctgaaggatatggtcttcttagattatggcttcccgcccgtccttcagcagtgggtcatcgggcaacggctcgcacgggatcaggagactcttcattcccatggagttaggcagaacggtgattcagcttatctgtacttgctttccgctaggaacacctctctgaacccccaagaactacaacgggagagacagcttaggatgctcgaggatctgggattcaaagatctgacgctgcagccccggggccctctcgagcccggtccgcccaaacccggcgtgcctcaagaacctggaaggggccagcccgacgcagtcccggaacctccacctgtagggtggcaatgtcccggctgtacattcattaacaagcctaccagacccggctgtgaaatgtgttgtcgggctagacccgaggcttaccaggtccccgcttcttatcaacctgatgaggaggaacgagcaagactggccggggaggaagaggctctccgtcagtaccagcagcgcaagcagcagcagcaggagggaaattaccttcagcacgtccagttagaccagaggtcactggtgctgaatactgaacctgccgaatgtcccgtgtgttattcagtcctcgccccgggcgaggctgtggtccttcggtccgcctgtagggcaccatcagccaccgctagacgaaggcggagcccagctccctcactcacaacccccacgcgggcaagggctagctgctggaggggaagaagccgaaggtcctag

SEQ ID NO: 131726 - DNA, 792 bp, Artificial Sequence
  Description of Artificial Sequence: Synthetic coding sequence
atggatgagaagaccaaaaaggccgaagagatggccttgagcctgacacgggcagtggctgggggggatgaacaggtcgcaatgaagtgcgctatctggcttgcagagcaacgggtgcccctctctgtgcagctcaaaccagaagtctcacccacccaggatataaggtccaggggggagaagaccgaagaggtgggagaggtccgcgaagtgccggatcatggcggcccccgggtgctacctagagtggactcgaagtcgagtgttgaaccactggaaggacctaattggctttgggtgtcggtggaggacgctcagatgcacacagtcacaatatggcttacagtgagaccagacatgaccgttgcttctctcaaggacatggtgtttctggactacggcttccctcctgtgctccagcagtgggtgattggacagagactcgcccgggaccaggagaccctccatagccatggtgtaaggcaaaatggggactcagcctatctctatttgctcagcgccaggaacacttctctcaatccacaagaattgcaaagggaacggcagttgcggatgctggaggacctgggattcaaggacctaaccttgcagccaaggggtcccctagaaccaggaccacccaagcctggtgtgccccaggagccagggagagggcagcccgatgccgttccagagcccccacccgtaggctggcagtgtccgggctgtaccttcattaataagccaactaggccaggatgcgaaatgtgctgtagagctcgccccgagtag

SEQ ID NO: 131727 - DNA, 819 bp, Artificial Sequence
  Description of Artificial Sequence: Synthetic coding sequence
atggacgagaagacaaagaaggccgaagagatggccctgagccttactagggctgttgctggtggggatgagcaggtcgccatgaagtgtgcaatctggctcgccgagcagcgggtgcctcttagtgtgcagcttaagcccgaagtgagccccacacaggatatcaggctctgggttagtgtagaggacgcacagatgcatactgtgacgatctggctgaccgtgcgacccgacatgacagttgcatcgcttaaggacatggtcttcctcgattatgggtttccacccgtgctacaacaatgggtaatcgggcagcgtctcgcacgcgaccaggaaaccttgcattctcacggggtcagacaaaatggagacagtgcttatctttacctgctgtcggcaaggaatacaagccttaatcctcaagagctgcagcgggaaagacagcttcggatgttagaggatctcgggtttaaggatctcacactgcagccaaggggacctctggagccaggaccccccaaaccaggcgtgcctcaggaaccggggcgtggccaacctgacgcagttccagagccgcccccagtaggctggcagtgtccaggatgcacttttatcaacaaacccacacggccagggtgcgagatgtgctgtagggcccgccccgaggcttaccaagttcccgcctcatatcagcccgatgaggaggaaagagcacgccttgctggagaagaagaggcactgcgacagtatcagcagggcgttcccgccgggcatcatcctcaacagcctgggggcggcggcctcctccccctgcactag

SEQ ID NO: 131728 - DNA, 354 bp, Artificial Sequence
  Description of Artificial Sequence: Synthetic coding sequence
atggacgagaaaaccaaaaaggccgaagagatggctctcagtctgaccagggctgtcgcggggggagatgagcaggttgccatgaaatgcgcgatttggttggccgagcaaagggtcccattgagcgttcagctcaagccggaggtgagtcctacacaagatatcagattgtgggtcagcgtcgaagatgcccagatgcataccgtgaccatctggctgacggtgcgcccagacatgacagtcgcatcactcaaggacatggtttttcttgactacgggtttccacccgtcctccagcaatgggtgatcgggcaacgtttagctcgtgaccaagaaaccctgcattcacattag

SEQ ID NO: 131729 - DNA, 768 bp, Artificial Sequence
  Description of Artificial Sequence: Synthetic coding sequence
tgagaaatggcactgagcttgacgagagctgtggccggaggggatgaacaggtggccatgaaatgtgctatttggctggcagaacagcgggtccccctgtctgtccaactgaaaccagaggtatctcctactcaggatatcaggtcccgcggcgaaaagaccgaagaagtgggcgaggtgcgggaggtgcccgaccatgggggacctagggtgctgccaagagtggattctaaatccagtgtggagcctctcgaaggtccaaattggctttgggtcagcgtcgaggacgctcaaatgcatacagtcacaatctggcttaccgtccgaccagacatgaccgtcgcttccctgaaggacatggtgtttctcgactacggtttccctcctgtgctgcagcagtgggtgatcgggcaaagacttgcccgcgatcaggaaaccctgcatagtcacggagttaggcagaacggtgattcagcctatttgtacttattgagcgctagaaataccagcctgaaccctcaagagctgcagcgcgaacgtcagctgcgaatgctcgaagacttaggcttcaaggatctcaccctgcaaccccggggccccttggaacctggtcctccgaaacccggagtcccacaggaacctggtcgcgggcaaccagacgccgtccccgagccacccccagtgggctggcagtgtcctggatgcacattcatcaacaaacccactagaccgggctgtgagatgtgttgtagagccagacctgaatag

SEQ ID NO: 131730 - DNA, 819 bp, Artificial Sequence
  Description of Artificial Sequence: Synthetic coding sequence
atggatgaaaagacaaaaaaagccgaggagatggctctcagcctgacaagggctgttgcaggcggcgatgagcaggtcgccatgaagtgtgctatttggctggccgaacagagagtccccctctctgtgcaattaaagccggaagtcagcccaacccaggacatacgcctctgggtgtcagtcgaggacgcacaaatgcacactgttactatctggttaactgtgcggcccgacatgactgtggcatctcttaaggacatggtcttcctggactatggttttccccccgtgctgcaacagtgggtcatcggtcagagattggcgcgcgaccaggagaccctgcactcccatggcgttcggcagaatggtgactcagcttacctgtatctcctctcagccaggaatacctccctgaatccccaggaactgcagagggagcgtcagctccgaatgttggaggacctggggttcaaggacctgacactgcaaccacgcggcccgttggaacccggcccacccaaacctggggtgccacaagaacccggaagggggcagccggatgccgtacccgagccgccccctgttgggtggcagtgcccaggctgcacttttatcaataagccgacgcggccggggtgtgagatgtgttgccgcgcaagacctgaagcataccaggtgcctgcttcttatcagccagacgaagaagaaagagcccggctggctggggaggaagaggccttgagacagtatcagcagggggtccctgctggccatcacccacaacagccaggcggcgggggcctgctgcctctgcattag

SEQ ID NO: 131731 - DNA, 4830 bp, Artificial Sequence
  Description of Artificial Sequence: Synthetic coding sequence
atgaacagccctgtagatcccggggcccgccaggccctgcgaaaaaaaccccccgagcggacaccagaggacttgaacactatctatagctacctgcatggaatggaaatactgtccaatcttcgcgagcaccaactccgtctcatgagcgcaagggctcgctacgagcgatacagcggaaatcaggtgctgttctgctctgagaccattgccaggtgctggtacattctcctgagtggaagtgtactcgtcaagggttccatggtgctgccgccgtgtagcttcggaaagcagtttggcggtaaacggggctgtgattgccttgttctagagccatcagagatgattgtcgtagaaaacgccaaagacaatgaagactccatccttcagcgcgagattccagctcggcaaagcagacggaggttccggaagattaactacaagggtgagaggcagaccatcaccgacgacgtggaggtcaactcctacttgtctcttccagcggatctcacgaagatgcacctgacagagaacccacatccgcaggtgactcacgtgtcctcaagtcagagtggatgcagtattgcttccgactcagggagctcttctcttagcgacatttaccaggctacagaatcagaggtgggtgacgttgatctgacccgactgccggagggacccgtagactccgaggacgacgaggaagaggacgaggagattgacaggaccgacccgctgcagggccgcgacctagtgcgcgagtgtcttgaaaaggagccagctgataaaacagacgacgacatcgagcagctgctcgagtttatgcaccaactgcctgcctttgccaacatgactatgtcagtaagacgggaactgtgctccgttatgatttttgaagttgtcgaacaagccggagcaataatcctcgaagacggccaggagcttgattcttggtacgtaatcttgaacggtaccgtcgagatttcccatccagatggcaaggtggagaatctgtttatgggaaactcctttggcatcacgcccaccctcgacaaacaatatatgcatgggatcgtgcggacgaaggtggacgactgtcagtttgtgtgtatcgcccagcaggactactggcggatattaaatcatgtggagaaaaacacccacaaggtagaggaggagggagaaatagtgatggtgcacgaacacagggagctggatcggagcggaactagaaaaggccatattgtcataaaggcaacacccgagcgactgattatgcatctcattgaggagcactccatagttgatccaacatatattgaagacttcttactgacttaccggacgttcctcgaatcaccacttgacgtgggaatcaagctgctggaatggttcaagattgacagtcttagagacaaagttactagaatcgttttactatgggtcaataatcattttaatgacttcgagggagaccctgccatgaccaggtttctggaagagtttgaaaagaatctcgaggataccaagatgaatggccatctgcggctactcaatatcgcatgtgctgcgaaggcaaaatggagacaagtcgtcttgcagaaagcctcacgagagtctccattgcagttttctctaaacggtgggtctgagaaggggttcggaatctttgtggagggcgtagaacccgggagcaaagctgcagattctggcctgaagagaggagaccagattatggaggtgaacggtcagaacttcgagaacatcacgttcatgaaagccgtggagatcctgcgcaacaatacacacctggccctgaccgtaaaaactaacatctttgtcttcaaggaactgctgtttcgcaccgaacaagagaaatcgggagtcccccacatccctaagatagctgagaaaaagagtaatcgccattccatccagcacgtccctggcgacatcgagcaaacaagccaagaaaagggttccaaaaaggtgaaagcaaacacagtatctggaggccgaaacaagattaggaaaattctggataagactcgcttcagtattttgccacccaaactcttcagcgacggggggttgtcacagtcccaagacgactctattgtcggaacgagacattgtcgccatagcttggcgatcatgcctattccagggacactctcttcaagctcaccggacctgctccagcccaccacttccatgttagatttctcaaacccgtcagacatacccgatcaggtcatccgtgttttcaaggtagatcagcagtcctgctacatcatcataagcaaagatactaccgcaaaggaagtcgtgtttcacgcggtccacgagttcggcttgactggtgcctctgacacctattcgctatgcgaggtgtccgtcacacccgaaggcgtgataaagcagcgtagacttccagatcagttttcaaaattagccgacaggatccagttgaatggtcgttactacttgaagaacaatatggagacagaaacgctgtgttcagacgaggatgcccaggaactcgttaaggagtcccaattgtccatgcttcaactttccacaatcgaagtcgccacacaactgtctatgcgcgatttcgacttgttcaggaacatcgagccaactgaatacatagatgatctgtttaagttgaacagcaaaacaggaaacactcatctcaagcggttcgaggacatagttaatcaagagacattttgggtggcaagtgagattctgaccgaggctaatcaactcaaaagaatgaagattataaaacattttatcaaaattgctttgcattgtcgtgagtgcaaaaactttaacagtatgttcgctatcatttccggcttaaacctcgcaagcgtcgcaaggctcaggggaacttgggaaaagcttccatccaagtacgagaaacacctgcaggatttgcaggacatttttgatccctcaagaaacatggctaagtaccgcaacattctttcaagtcaaagcatgcagcctccaatcattccattatttcccgtggtgaaaaaggacatgacattcctgcacgagggcaacgacagcaaggtggatggattagtgaacttcgaaaagttgcggatgatatccaaagaaatcaggcaggtcgtgaggatgacatccgccaacatggacccggccatgatgttcaggcagagaaaaaaaagatggcgctccctaggttctctttcccaggggtcaactaacagcaacatgctcgatgtgcaaggaggagcacacaaaaagagagcgaggaggagttcactcctaaatgccaagaagctttatgaggacgctcaaatggctcggaaggttaagcaatacctgtccagtctggacgtggaaaccgatgaagagaagttccaaatgatgtccttgcagtgggagccagcctacgggactctcacgaaaaacctaagtgagaagcggagcgccaagtcttcagagatgagccctgttccaatgcgaagcgcaggccagacaaccaaggcccacctgcatcaaccccaccgcgtttcacaagtgttgcaggtgcctgcagtgaatttgcacccaattagaaaaaagggccagacaaaggaccctgctctcaacacatcactgccccaaaaggtgctaggtactactgaggagatcagcggcaagaaacataccgaggacaccattagcgttgcttcgagtttacactcgtctcctcccgcctctccacaggggtcaccacataaaggatatactctgatcccatcagcaaaaagcgacaatctgtctgactcatcccacagtgaaatatcctcccggtctagtatcgtttcaaattgttccgtcgattctatgagtgctgctctccaagacgaacgctgctcttctcaggccctggccgtcccagaatctactggggccctcgagaagaccgagcacgcctctggtattggggaccattcgcagcacggccctggctggaccctcctgaaacccagtctgatcaaatgtctggccgtctcaagtagcgtcagtaacgaagagatttcccaagagcatattattatcgaggcagctgacagcgggcgaggcagctggacatcctgctcgagcagtagccacgacaatttccagtccctgccaaatcccaaatcatgggactttctgaatagctaccgccacacacacttggatgacccaattgctgaggtcgagcctaccgatagcgagccctattcctgcagcaagagttgcagccgaacatgcggccagtgtaagggatctttggagaggaaaagctggacctcatctagttccctctctgacacatacgagcctaattacggcacagtgaagcagcgcgtgctggagagcaccccagccgagtctagcgaaggccttgaccccaaggatgctacagacccagtgtataagaccgtgaccagttctaccgagaaaggcctgatcgtttactgtgttacatctccgaaaaaggacgaccggtacagggagccgccaccaacacccccagggtatctggggatctcgctcgccgatctgaaggagggaccacacactcacttaaagccccccgactacagcgtcgcggtgcagcggtccaagatgatgcataatagcctaagccggctgccccccgccagcctgagctctaacctggtggcctgcgttcccagcaagatagtgacacagccccaaaggcataacctgcagccctttcaccccaagctaggagacgtgactgacgcagacagcgaggccgatgagaatgagcaggtctcagcggtgtag

SEQ ID NO: 131732 - DNA, 4530 bp, Artificial Sequence
  Description of Artificial Sequence: Synthetic coding sequence
atgaactcaccagtggatcctggagctagacaggctctgagaaaaaagcccccagaacggactcctgaggacctgaacaccatatatagttatctccatgggatggaaatactgagcaacttgcgtgaacatcagctgagacttatgtccgctagagcccgctacgaaagatatagcggaaaccaggtgctgttctgtagcgagaccattgcccggtgctggtatattctgctgagcggatctgtgttagtcaaggggagtatggttctccccccatgcagtttcggtaaacagtttggaggaaaacgtggctgtgactgtctggtgctggaaccctccgagatgatcgtggttgaaaatgccaaagacaacgaggactcaatcctccaacgcgaaattccagcaagacagagcaggagacgttttaggaagatcaattacaagggagaacgccaaacgattacagacgatgtcgaagtgaactcatacctgagtctgcccgcagacctgacgaagatgcatttaactgagaacccgcacccgcaggtgactcacgtgtctagctctcagagtggatgttctattgcgtcagactcaggctcatcatccctgagtgatatctatcaggcaactgaatccgaggtgggtgacgtggatctgacacgactgccagaaggacccgtcgattcggaggacgacgaggaggaagatgaggaaattgacagaactgacccactacagggtcgggacctcgttcgcgagtgcctagagaaagagccagcggataagaccgatgacgacattgagcaattactcgaattcatgcaccagctaccagcgtttgctaatatgaccatgtctgtgagaagagagctgtgcagcgttatgatcttcgaggtcgtggagcaggcgggtgcaatcatccttgaagacgggcaggagctcgactcatggtatgttatcctgaacggcaccgtcgaaatatcccacccagacgggaaagtcgagaatctcttcatgggtaattctttcggcataactcccacgctggataagcagtatatgcacgggatcgttcgcaccaaagtggacgactgtcagtttgtttgtatcgctcaacaggactactggaggatccttaaccatgtcgagaagaatactcataaagtggaggaagaaggcgagatagtgatggtacatgaacatcgggaactcgaccggtcaggcactagaaaggggcacatcgtgatcaaggcgacccctgagcggttaattatgcacttaattgaggagcactctatcgtggacccaacttatatcgaggactttttgctcacataccgaacattcctcgaatcacctctggatgtcggaataaaactgctcgaatggtttaagatcgactcccttcgcgataaagttaccaggatcgttctgctgtgggtgaacaatcacttcaacgacttcgaaggtgaccctgccatgactcggttcctggaggagttcgaaaagaatctagaagacactaaaatgaatgggcatctgcggctgcttaatatcgcctgcgcagcgaaggcaaagtggaggcaggtcgtgcttcagaaagcctcccgggaatccccattacaatttagtctgaatggcgggtctgagaaaggcttcgggatcttcgttgagggtgttgagcccggctccaaagctgccgactctggcctgaaacgcggcgaccagattatggaggtgaatgggcagaacttcgaaaacattacatttatgaaagcagtggagatcctgaggaacaacacccacctcgcactgaccgtgaaaactaatatcttcgtgttcaaggaactgttgtttcgcactgagcaggaaaagtctggggtcccacacatcccaaagatagcagaaaagaaaagcaatcgccattcgatacaacacgtgccgggagacatcgagcagacttcccaggaaaaaggcagcaaaaaagtgaaagccaacactgtgtccggaggcaggaacaagatcaggaaaattctcgacaaaactcggttctccatcctccccccgaaactgttctcagacggtggattgagccaaagccaggatgacagcatcgtggggacacgacactgccgacactctctggccatcatgcctataccaggcaccctgtcctcttcttcgccggaccttcttcagccaaccacctctatgctggacttcagtaatccctccgctgtgggattttattacatacccgaccaggtgataagggttttcaaggtggaccagcagtcttgttacattattatcagcaaggatactacagccaaagaagtggtcttccatgccgtgcacgaatttggcctgaccggagcctcggatacatactccctctgtgaggtctccgtgactccggaaggcgtcataaagcagagacgtcttcctgaccaattttctaagctggccgaccggatccagttgaacggaagatactacctgaagaacaatatggagaccgagactctgtgctcagacgaggacgcacaagaattagttaaggaatctcagctgtcgatgttacagctgtccacaatcgaggtcgccactcaactatcgatgagagacttcgacctctttcgcaacatagagccaaccgaatacatagatgatttattcaagcttaacagcaagacagggaacacacaccttaagagatttgaagatattgttaaccaagagaccttttgggtggctagtgagatactaaccgaagccaaccaattaaaaaggatgaagataatcaagcactttatcaaaatcgccttgcactgtagagagtgcaagaacttcaatagcatgtttgccatcattagtgggttaaatctcgccagcgtggcccggctccgtggcacttgggagaaattgccctccaagtatgaaaagcatttacaggacctccaagacatctttgatcccagccgcaacatggcaaaatatcgcaatatcttgagtagtcagagcatgcaaccccccatcattccgctctttccagtggtgaaaaaagacatgacctttctgcacgagggcaatgactcgaaggtggatggcttagtgaatttcgagaagttacgtatgatttcaaaagagatccggcaggtagtgcggatgaccagtgccaacatggaccctgccatgatgttccgccagagaaagaagagatggcggtcacttgggtccctgtcccagggatccaccaattccaatatgctcgatgtccagggcggcgcgcacaagaaacgagctcgcaggtcatctctcctcaatgctaagaagctctacgaagacgctcaaatggccaggaaggtcaaacagtatctctccagtcttgatgtggagacagacgaggagaaattccagatgatgagcttgcaatgggaacctgcctatggaaccctcactaagaatctatccgaaaaacgcagtgctaagtccagcgagatgtctcctgtcccaatgcgatcagctggtcagacaacaaaggctcacttgcaccagccccacagggtgtcacaagtccttcaggtccccgcggttaacctgcatccaattagaaaaaagggccagactaaggacccggccttgaacacatccctccctcagaaggttttgggaaccacggaagagatctcaggaaagaaacacaccgaagatacaatctctgtggccagttccctacattccagcccacctgcatctcctcagggctcgcctcacaaaggctatacactcatcccgagcgcaaaaagcgacaacctgtccgatagttcccattcagagatcagctctcgtagctcaattgtatccaactgcagtgtggattcaatgtctgctgccctgcaggacgagcggtgcagttcacaggctcttgccgtgcccgaatcaaccggagccttggagaagacggaacacgcatctgggatcggagatcatagccagcacgggcctggctggaccctactgaagccaagcttaattaaatgtctcgcggtgtccagcagtgtgtccaatgaagaaatctcccaggagcatatcattatcgaggctgccgactctgggcgaggatcttggaccagctgttcttcctctagccacgacaattttcaatctctgcccaatccaaagtcctgggatttcttgaactcttatcgacacacacacctcgatgatccgattgctgaggtggaacctacagactccgagccttattcttgttcaaaatcttgctctcgtacctgtggacagtgcaaaggcagcctggaacgaaagtcatggactagttcatcctccctatcggacacctacgagcccaactacggcacagtcaagcagagggtgctggaatcaaccccagccgaatccagcgaaggtctcgatcctaaggatgctaccgacccagtgtacaagactgttaccagctcgacggagaaaggtctcatcgaaaatgagcaagtgtcagccgtttag

SEQ ID NO: 131733 - DNA, 4530 bp, Artificial Sequence
  Description of Artificial Sequence: Synthetic coding sequence
atgaattcgccagtcgaccctggagcccgccaagctcttcgcaagaagccacctgaacggacacctgaagacctgaatacaatctacagctacctccacgggatggagatcctgtccaatttgcgagaacaccagctcaggctcatgtccgcaagggcgcggtacgagcgctattcggggaaccaggtgctgttttgctccgagacaatcgcccgatgttggtacatcttactgtccggttcagttctggtaaaaggctcaatggtgctgccaccatgctcatttgggaaacagtttggaggcaaaagggggtgtgactgtttggtgctggagcctagcgaaatgatagttgtcgagaacgcgaaggacaatgaggactcaattttgcagagggaaattcccgctcgtcagagcagacgtcggttcagaaaaataaattataagggcgagcgacaaacaattactgatgacgtggaggtgaatagttatctttccctgccagctgacctgacgaaaatgcatctcacagagaaccctcatccgcaagttacacatgtgtcaagtagccaaagtggctgctccatagcttccgactcaggctcatcatccctgagcgacatttatcaggccactgaaagcgaggtcggagatgttgatcttacccggttaccagagggaccagtcgattctgaagacgatgaggaggaagacgaggagatcgatcggactgaccctctccagggcagggacctggtgcgggagtgcctcgagaaagaacccgccgacaaaactgacgatgacattgagcagcttttggaatttatgcaccagctccccgcgttcgcaaacatgaccatgagcgtaagacgggagctgtgcagcgtcatgattttcgaagtcgttgaacaggccggggccattattttagaggacggtcaggagttagactcttggtacgtcatcttgaatgggaccgtcgaaatctcccatccagacgggaaagtggagaatctctttatgggaaattcattcgggattacccccaccctggataagcaatacatgcatggcatcgtgaggaccaaggtagacgactgtcaatttgtctgtatcgcgcagcaggattactggaggatcttgaaccacgtggagaagaatacccacaaagtggaggaagaaggtgagatcgtaatggtgcacgaacaccgcgaactcgaccgtagcgggacacggaagggacacatcgtaattaaagccaccccggaacggctgatcatgcacctgattgaagaacactccatcgtggacccaacctatatcgaggactttctgttgacttaccggacttttctcgagtcgccactagatgtagggataaagctgcttgaatggttcaagattgactctctgcgggacaaggttacccggatcgttctgctgtgggtaaataatcattttaatgacttcgagggcgaccctgccatgacccggttccttgaggagttcgagaagaatctcgaggacacaaagatgaatgggcatctacgattactgaatatcgcctgcgccgcaaaagccaagtggaggcaggtcgtcctccaaaaagcctcaagggagagccccctccagtttagcctcaatggcggatcggagaagggctttggcattttcgttgaaggcgtcgagccaggaagcaaagccgcggacagtgggcttaagagaggggaccagattatggaggttaatggacaaaacttcgagaatattacctttatgaaggctgtggagatccttcgaaataacactcatctagcgctcacagtaaagactaatattttcgtctttaaggaattgctgttccggacagagcaggagaagagcggcgtccctcacattcctaaaatagctgaaaaaaagtctaacaggcatagtattcagcatgtccctggggatatcgaacagaccagtcaggagaaaggaagcaaaaaggtcaaagcaaatacagtgagtggcggtaggaacaaaatccggaaaattctagacaagacgcggtttagtattctgcccccaaaactctttagcgatggggggctgtcacagagccaggatgattcaatagttgggactagacactgcaggcattcgctcgccataatgcccatcccaggcaccctgtcttcttcctcccccgacctgttacaacctacgaccagtatgcttgacttctctaatccctctgctaaggggttcaagaacattcccgaccaagtcatccgcgtgtttaaggtggaccagcagtcttgctacatcatcatttctaaggatactaccgcaaaggaagttgttttccatgctgtccatgaattcggtctgaccggagctagcgacacgtacagcctttgtgaggtcagtgtcacgccggagggtgttattaaacagcggaggttgccggatcaattttcgaaactagctgaccgcatccagctgaacgggcgctattatctcaagaacaacatggagaccgagacattatgttctgacgaggacgctcaggagctggtcaaggaaagccagctgtcaatgctgcagctttctactatagaggttgctacacaacttagcatgagagacttcgacctgtttcgcaatattgagccaaccgagtacattgacgatctctttaaactgaactctaagactggcaatacccacctgaagcgattcgaggacatcgtgaatcaggaaaccttttgggtggcctcggagatcctgaccgaggcaaatcagctgaaaagaatgaaaattataaagcactttatcaaaatagccctccactgccgcgagtgcaagaacttcaactccatgttcgccatcatctcagggttgaacctggccagcgtggcccgcctgcggggcacatgggagaagttgcccagtaaatacgagaagcacttacaggatttgcaagacattttcgacccgagcaggaacatggccaaatatcgtaatatcttgtcctcccagtctatgcagcctccgataataccactgtttccagttgtgaaaaaagatatgacttttctccacgagggtaacgactctaaagtggatgggctcgtcaactttgaaaaactccggatgatttccaaagagattcgccaggtggtacgcatgacaagcgctaacatggatcccgctatgatgttccgccaaaggaagaagcgttggcggtcgctcgggtcactgtcccagggcagtacaaactctaacatgttagatgtccagggaggcgcacataaaaagagagcacggcgctcctctctgctgaatgcgaagaaactgtatgaggacgcccagatggctcgaaaggtaaagcagtacctctcatccctcgacgtggaaactgacgaggagaagtttcagatgatgagcctccagtgggaacctgcttacggaactcttacaaaaaacctatcagaaaagaggagcgccaagagcagtgaaatgtcgcccgtccccatgagatccgccgggcagactacgaaggctcatcttcatcagccacaccgggtgagccaggttctccaggtgcccgctgtcaatcttcaccccatacgcaaaaaaggccagaccaaggaccccgcccttaatacgtcgctgcctcagaaggtgctgggaacaaccgaggaaatttctggaaagaaacacacagaagacacaatttcagtggcaagttctcttcactcctcaccccccgcttctcctcaaggctctccccataaaggctataccctgatcccttccgctaaatctgataatctcagcgacagtagccactccgaaatcagcagtcgctcatctatagtgtcgaactgttccgttgactctatgtccgccgctttacaagacgagcggtgtagtagccaggctttggcggtgccagagtccacaggcgcccttgagaagactgagcacgccagtgggattggtgatcactcgcaacacggtcccggctggaccctgctgaagccaagcctgatcaagtgtctggcagtgtcgtcgtcagtgtcgaatgaagaaatcagccaggagcacatcatcatcgaggctgccgatagcgggaggggatcttggacttcttgctccagcagctctcatgacaactttcagagccttcctaacccaaaatcttgggattttctgaatagctacaggcatacccatctggatgacccaattgcagaggtagagcccactgacagcgagccgtactcctgcagcaagagttgctccaggacctgtggccagtgtaaggggtcactcgagagaaagagctggacaagctcctcttccctctccgatacatacgaaccaaattacggaactgttaagcagagagttttggagagcacccctgcagagagctctgaaggactggaccccaaagatgcaacggaccctgtgtataaaactgtgacatcttcaactgaaaaaggcctgataggcaagaagcagacaagctacttttag

SEQ ID NO: 131734 - DNA, 4515 bp, Artificial Sequence
  Description of Artificial Sequence: Synthetic coding sequence
atgaactctcctgttgatcccggagctcgccaggccctgagaaagaagccgccagaaagaaccccagaggacctcaacaccatctattcatacctccatgggatggaaatccttagtaatttacgggagcaccagctgcggttgatgtcagccagggctagatatgagcgctactctggcaaccaggtcctattttgtagtgaaacaattgcccgatgttggtacattctgttatctggcagtgtgctggtaaagggcagtatggtgctccctccatgctcctttggaaagcaatttgggggcaagcgcggatgtgactgccttgtcctggagccatcagaaatgattgtagtggaaaacgccaaggacaacgaagattctatactgcagcgagagatcccagccaggcaaagcaggaggcgcttccgcaagatcaattacaagggcgaacgacagaccattacagatgatgtggaagtcaacagttatctgtccctgcccgcagacttgaccaaaatgcacctgaccgagaacccccatcctcaggtaacccacgtttccagttcacagtccggatgcagtatcgcatccgattctggatcatcctccttgtccgacatctatcaggccacggaatctgaggtgggcgacgtcgatctgactagacttcccgagggcccggtagattctgaagacgatgaagaggaggatgaggagatagatcggacagatcccctgcagggccgggatctggtaagggaatgcctggaaaaagaacctgctgacaagactgacgacgacatagagcagttattagaattcatgcaccagctcccggcttttgccaatatgacaatgtctgtgcgtagggagttgtgctccgtcatgattttcgaagtggtagaacaagccggcgccatcatcttggaagatgggcaggagctggacagctggtatgtgattcttaacggcacagttgaaatctcacatcctgatggaaaggtggagaatctctttatggggaattcctttggaatcacgcccactttggataagcagtacatgcacggcatcgtcaggacaaaggtggacgactgccagtttgtgtgcattgcccaacaggattactggcgtatactgaaccatgtggaaaagaacacacacaaagtggaggaggaaggtgaaatagtcatggtgcacgagcacagagaattggatagatctggaactagaaagggccatattgtgatcaaggccacccccgagagacttataatgcatctgatcgaggagcacagcatagttgatcctacatatatagaagacttcctcttgacctaccgcaccttcttagaatctcccctcgacgtaggaattaagctccttgagtggtttaagatagacagtctccgtgacaaggtgaccaggattgtgctgctgtgggtcaataaccactttaatgatttcgaaggcgatccagctatgacgagattcctggaagaatttgagaagaaccttgaggataccaagatgaacggacatctgaggctgctcaatatcgcctgcgccgctaaggctaaatggcgccaagttgtgctgcaaaaggcgtctcgggagagtcccctccagttcagcttgaacggtggttccgaaaaaggctttgggatcttcgtggaaggcgtcgaacccgggtctaaagctgcagactcgggactgaagcgcggagatcagattatggaggtgaacggccagaacttcgaaaatataacctttatgaaagccgttgagatcctgcgcaataacactcatcttgcattgacagtcaagactaatatcttcgtcttcaaggagctcctgtttaggacggaacaggagaaaagcggagtccctcatattcctaaaatcgccgagaaaaagtccaaccggcattctatccagcacgtaccaggtgacatagagcagactagtcaggagaaaggatccaagaaggttaaagccaataccgtcagtggaggacgtaataaaattaggaagattctggacaagaccagattcagtatcctgccccccaagctgttttcagacgggggcctgtcacagtcccaagacgatagcattgttgggacgagacactgcaggcactcactggccattatgcccatacccggaaccctgtcctcttcttcaccggaccttttgcagccaaccacatcaatgttggacttttccaacccttctgacataccagaccaggtgattagggtgttcaaagtcgaccagcagagctgctatatcattatctccaaggataccaccgcgaaggaggtggtgtttcatgcagtgcacgagttcggacttactggcgccagcgatacctattctctatgcgaagtaagcgtgactccagaaggggtgatcaagcagaggcggctgccagaccagttttccaaattggcggacaggatccagttgaatggacgctactatctgaaaaacaacatggaaaccgagacattatgctctgatgaggatgctcaggagttggtgaaagaatctcaacttagcatgttgcaactgtccacgatcgaggttgccacacagctgagcatgagggattttgatcttttccgcaatatcgaacccactgaatatatcgacgatctatttaaactgaatagcaagacgggaaatactcacttaaaaaggttcgaggatattgtgaatcaggagacattctgggtcgcctctgagattctcactgaagcaaaccagttgaaacggatgaagatcattaagcattttataaaaattgcactccactgcagggagtgcaaaaactttaactcgatgttcgccattatctccggcctcaacctggccagcgtggcccgtctgcgtggaacttgggaaaagttaccttcaaagtatgagaaacatctgcaggatctacaggatatctttgacccgagtaggaatatggccaaatatcggaacattctgagcagccagagtatgcagccaccaattatacccctttttcccgtggtaaagaaggacatgacgtttctgcatgaaggtaatgactctaaggtggacgggctggtcaacttcgaaaagctgaggatgatctccaaggagattcgtcaagtcgtgcggatgacctcagccaacatggaccctgccatgatgttccgtcaaagaaaaaagcggtggcgctcccttgggtccctgtctcagggctcgaccaattcgaacatgctcgacgtgcagggtggggcgcataagaaaagagcacggcgttcaagcctgttgaatgcgaagaaactgtatgaagacgcccagatggcccggaaagtgaagcagtaccttagctcgctggatgtcgagactgacgaggagaagtttcagatgatgagcttgcagtgggagcccgcctacggcacactgaccaagaaccttagtgagaagcgaagtgccaaatctagcgagatgtctccagtccctatgaggtccgccggccagacaactaaagcccacttgcatcaacctcatcgagtaagtcaggtgctgcaggttcctgccgtgaatctgcacccaatccgtaagaagggacaaacaaaagatccagctctgaatacaagtttacctcagaaggtcctgggaaccaccgaagagatatccggaaaaaagcacactgaagacacgatctctgtggcatcctcacttcacagctcacctcctgccagccctcagggttcgcctcataaaggctacactctcataccatcggccaagagcgataacctctcagacagctcccattccgagatttcctctcggtcttccatagtgagcaactgttcagttgattctatgtctgccgctctccaggacgagaggtgctcatcccaagcactcgccgtgccagagtctaccggggcattggaaaagactgagcatgccagtggaatcggagaccattctcagcacggacctggctggacattactcaagccttccctaattaagtgtctagcagtgtccagcagtgtgtccaatgaggaaatttctcaggaacacattattatcgaagcagccgactcaggaaggggttcttggactagctgctcaagctcgtcacacgataattttcagtcactaccaaaccccaaatcttgggactttctgaactcatacaggcatacacatctcgatgacccaatcgcagaggtggaacctaccgatagcgagccctattcttgctcgaagtcgtgctcccgaacatgcgggcagtgtaaagggtcactcgagcgtaagtcatggacctctagttcttctctcagcgacacatacgagcccaactacggcacagtgaaacagcgagtgctggagtctacacccgccgaaagttctgaaggcttggacccaaaggacgctaccgaccccgtctataagacggttaccagcagcacagagaaggggctcatcgagaatgaacaggtgtccgcggtatag

SEQ ID NO: 131735 - DNA, 4806 bp, Artificial Sequence
  Description of Artificial Sequence: Synthetic coding sequence
atgaatagccccgtcgaccccggcgctcgtcaggctctgcggaagaaaccaccagagagaacgccggaagatctgaacaccatttactcctatctgcatggcatggaaatcttatctaacctgagggaacaccagctcaggttgatgagcgccagggcccgctatgagagatactctggcaaccaggttctgttctgctcagaaacaatcgcccgatgctggtatatcttactgtctgggtctgtgttggtgaaagggagcatggttctgcccccatgcagcttcgggaagcagttcggcggtaaacgcggatgcgactgcttggttctggagccctccgaaatgatcgtcgtggaaaacgcaaaggataatgaggactctattctgcagcgggagatccctgcccgacagtcacgccgacggttcagaaagatcaactacaaaggtgagcgacaaaccatcacggatgacgttgaagtgaattcctatctgtcactgcccgccgatctgacaaaaatgcaccttactgaaaacccacatccccaggtgactcatgtgtctagctcacaaagcggatgttccatcgcttccgactcgggaagttcatccctgtctgatatataccaggcaacggaaagcgaagttggcgatgtcgatttaacccgccttccagagggccccgtggattctgaagacgatgaggaggaggacgaagagatagatcggacagacccacttcagggtagagatcttgtgagagagtgtctggagaaggagcctgcggataaaacagacgatgacattgagcagttgcttgaattcatgcatcaacttcccgccttcgccaacatgacaatgtctgtgagaagagaattgtgctcggtgatgatttttgaggtggttgaacaagccggcgccatcatacttgaagatggacaggaactggactcatggtacgtgatcctgaacggaaccgtggagattagtcacccagatggaaaagtcgagaatttgttcatgggaaattctttcgggattacccccaccttagataagcagtacatgcacgggatcgtgaggaccaaagtggatgactgccagttcgtgtgtatagcccagcaggactactggcgcattcttaaccacgtagaaaaaaacacccacaaggttgaagaggaaggagagatcgtgatggtgcacgagcaccgggaactggacaggtctggcactcgaaaagggcatatagtaattaaagccacacctgagagacttattatgcatctgattgaggaacacagcattgtggaccctacatacatcgaagattttctacttacgtacagaacctttttagaatcccccctggacgtggggatcaaactgctggaatggttcaaaatagatagccttagggacaaagttacacgtatcgtgctcctatgggtgaataatcacttcaacgacttcgagggcgatcccgcaatgacaagattcctggaagagttcgagaagaatcttgaggacactaaaatgaacgggcatctgagattactgaatatcgcttgtgctgctaaggcgaaatggcgacaggtggtccttcagaaagcctcacgggaaagcccgctgcagttcagcctcaatggaggatctgaaaaggggtttggcatattcgtagagggggttgaacctggttccaaggccgccgactcggggctgaaacggggcgaccagatcatggaggtgaacgggcaaaactttgagaacatcacattcatgaaggctgtggagatactgcgcaacaacacgcatctggccttgactgttaaaactaatatcttcgtgttcaaagagctcctctttcgtactgaacaggaaaaaagcggcgtaccccatatcccaaagattgctgaaaaaaagagcaatcgccatagtatccagcacgtgccaggcgacatcgagcaaaccagccaggaaaaagggagcaagaaggtgaaggcaaacaccgttagcggcggtcgcaacaagatccggaagatactggacaaaactcggttctcgatactgccaccaaagctgttctccgatggaggcctcagccagtctcaggacgattcaatcgttggcactaggcactgcagacactcccttgccattatgccaattccaggcaccctgtcgtcctcctctcccgacctcctgcagcccaccacatcaatgctggatttttcgaatccctctgatattcccgaccaggtgataagggtgtttaaagtggatcaacagtcttgctacattataatttccaaagacaccaccgcaaaagaggtagtctttcatgccgtgcacgagtttgggctgacgggcgccagcgacacctactcactgtgcgaggtgtcagtgacacctgagggcgttatcaagcagagacgcctgcccgatcagttctcgaagctagcagataggatccagctgaatggacggtactatcttaaaaataatatggaaactgaaacattgtgtagcgacgaggatgctcaggaattagtgaaggaatcccagctgagcatgcttcagctttccactatcgaagtcgcaacccagctgtcaatgagagattttgacttattccgaaatatcgagcccaccgagtatattgatgacctcttcaagttgaattcaaaaacagggaacacccatctgaagcgtttcgaggacatcgtcaaccaggaaaccttttgggtcgcaagtgaaattctcaccgaagctaaccagctgaaacgaatgaagattattaaacatttcatcaagatcgccctacactgccgggaatgcaagaacttcaatagcatgttcgccattatctcagggctgaatcttgccagcgtcgccaggcttcggggcacatgggagaaactgccaagtaaatacgaaaaacatttacaggacctccaggatatattcgacccctctcgaaatatggccaaatacagaaacattctgagttcacagagcatgcaaccccccatcattccccttttcccagtggtgaaaaaagacatgacctttctacacgagggaaacgacagcaaagtggacggacttgtgaacttcgagaagcttcggatgatctcaaaagagataagacaggtagtgcgcatgacctcagcgaatatggatccggccatgatgtttcgccagaggtctctgagccagggctccactaactccaacatgctggatgtgcagggtggcgcccataagaagagagcacgacgcagctcactgttaaacgccaagaagctgtatgaggatgcacaaatggcaagaaaagtcaagcagtatctcagcagtctcgacgtggaaacggatgaagagaagttccagatgatgagcctacagtgggagcccgcctacggaactcttactaaaaatctgtcagagaaaagatctgctaaatctagcgaaatgtccccggtccccatgagaagcgcaggccagaccacgaaggcccatctgcaccagccccacagagtgtcacaggtcctccaggtgcccgccgtaaatctccacccaatcaggaagaaagggcagacaaaagacccggccctcaacacttcactgccacagaaagttctgggaaccactgaggagatctccggtaagaaacatacagaagatacaatatccgtggcttcttcactccattcttcaccgcccgcatcaccacagggttccccccataaggggtacacactgattcccagtgctaaatccgacaacctgtctgatagctcccatagcgaaatttcctccaggagttcgatcgtttcaaactgtagcgtcgatagcatgtccgcagcgctgcaggacgagcggtgtagtagccaagccctggccgttcctgaaagcacgggcgccctagagaagaccgagcatgcatccggaattggtgaccatagccagcacggccccggctggaccctcctgaagccctcactgatcaagtgcctcgcagtctcaagcagtgtttcaaatgaagagattagtcaggaacacattatcatagaggccgccgattctggcagaggtagctggacttcttgcagctctagttcgcatgacaatttccagtcgctgccaaatcccaaaagttgggatttcctaaatagctaccgacacacccatctcgacgacccaattgcggaggtggaacctaccgattccgagccctattcctgttctaagagctgttccaggacttgcggccagtgcaaaggttctttggagcggaagtcatggacctctagttcctccttatcagacacctatgaaccgaactatgggacagtaaaacagcgggtgctggaaagtactcctgccgagtcctcagaaggcctggacccgaaggacgctaccgatcctgtgtacaaaactgtaacaagctctaccgagaagggactgatcgtgtactgcgttacaagccctaagaaagatgatcggtatagagagcccccacccacccccccaggctacctggggatctctttggccgatctaaaggaagggcctcacacccatttaaagcctccggactactccgtagccgtgcagcgcagtaagatgatgcataatagcctcagccgcctgcccccggccagtctttctagcaatctcgtcgcttgcgtgccatctaagatcgtgacacagccccaaagacacaacctccagccgttccatccgaagcttggcgatgttaccgacgccgactctgaagcagacgagaatgagcaggtcagtgccgtgtag

SEQ ID NO: 131736 - DNA, 3615 bp, Artificial Sequence
  Description of Artificial Sequence: Synthetic coding sequence
atgaactctcctgtggatcccggtgcaagacaggcactgcggaaaaagcccccagagcgtaccccagaagatctgaacaccatctatagctatctgcatggcatggagatcctgtctaaccttagggagcaccaacttcgcctgatgtcggcacgagccagatatgaacggtactccggtaatcaagttctcttctgtagtgagaccattgctcggtgctggtatattttactcagtgggagcgttttagtgaaagggagcatggttctgccgccgtgttcctttgggaagcaattcggcgggaaacgcggttgtgattgcttggtgttggaaccttcagaaatgatagtcgtcgagaatgccaaagataacgaagactctatcttacagcgtgaaatcccagcccgacagtccaggagaaggttcagaaaaatcaattataaaggagaaaggcagaccatcactgatgatgtcgaagtaaattcctatttgagcctgccggctgatctcacaaagatgcacctgaccgaaaacccccacccacaggttactcatgtatcttcaagccagtctggctgttctattgcatcagacagcggctcttcaagcctttccgacatctatcaggcaactgagagtgaggtgggagatgtggatttgaccaggcttccggaaggccccgtggatagcgaagacgatgaagaggaagatgaagaaattgacaggaccgatcctctacagggaagagacctggtgcgggagtgtcttgagaaggaacctgccgataagacagatgatgatattgaacagttattggaattcatgcatcagcttccagccttcgccaatatgacaatgagcgtgaggcgggagctgtgcagcgtgatgatctttgaggtcgtcgagcaagctggcgccattatcctggaagacggacaagagctggactcgtggtacgtgatcctcaatggtacagtagaaataagtcacccggatggaaaagtggagaatttgttcatgggcaactcctttggcatcacgcccacattggataagcaatacatgcacgggatcgtacgcaccaaggtagacgactgtcagttcgtatgtatcgcccaacaggattattggcggattttgaatcacgttgaaaagaacactcataaagtggaggaggaaggcgaaatagtgatggtccacgaacaccgcgagctagatcggagcggtactaggaaggggcacatcgtcattaaggccacccccgaaaggttaatcatgcatctgatcgaggagcactccattgtagatcctacttatattgaagatttcctgctgacttacagaaccttcttagaatcccctttagacgtgggaataaagcttcttgaatggttcaagatagacagtttgagagacaaagttacccgcatagtgctgctttgggttaacaatcactttaacgatttcgagggagatcctgccatgactaggttcctcgaagagtttgagaagaacttggaggacaccaagatgaatggacatctcagacttctgaacatcgcatgcgcagccaaagctaaatggcgacaggtcgtcctacagaaagcttcccgcgagtcaccactccagttctctttgaatggtggttcggaaaaaggttttgggatttttgtcgagggcgtcgagccaggtagcaaagccgccgatagtggattgaagagaggggaccaaatcatggaggtaaatggacaaaacttcgagaatattaccttcatgaaagcagtggagatcctcaggaataatactcaccttgccctgaccgtgaaaactaacatcttcgtgttcaaagaactcctattccggacagagcaggaaaaatccggtgtgccacatattcccaaaatcgccgagaaaaagagtaacagacactcgatacaacacgttccaggtgacatagagcagacaagtcaagaaaaaggaagcaagaaggtgaaggcaaacactgtgagcggggggagaaacaagatccgtaagatccttgataagactaggttctctatactccctcccaagctgtttagcgatgggggtctctcccagtctcaggatgatagtattgtggggacacgtcactgtcgtcactctttagctattatgcccatccctgggacacttagttccagcagccccgatttgcttcagccaaccacatccatgctagacttctcgaatccctctgatatacctgaccaagttattcgcgtgttcaaagtggaccagcagtcttgctacattattatctcaaaagatactaccgcgaaagaggttgtgttccacgctgtacacgagtttggtctcactggtgcctccgacacatacagcttatgtgaagtttccgtgacacctgaaggagttataaagcaacggcgactccctgatcagttcagtaagttggcggaccgaatccagctaaacggtaggtactatcttaaaaacaatatggagactgagacgctgtgctctgatgaggacgctcaggagctggtgaaagaaagtcaactgagcatgctgcagctgtccacaatcgaggtggctacgcagcttagtatgagagattttgaccttttccggaatattgaacctactgaatacattgacgatctgttcaagcttaactcgaaaacaggaaacacgcatctaaaaagatttgaggacatcgtcaaccaagagactttctgggtggctagcgaaatactaacggaggccaatcagttgaaacggatgaaaattatcaaacactttattaaaatagcgctgcattgccgcgagtgtaaaaatttcaacagcatgttcgccatcataagcggactgaacttggcctcagtggcaaggctgagagggacttgggagaagctgccctccaaatatgagaaacacctgcaggacctacaggatattttcgacccttccagaaacatggctaaatatagaaatatcctgagttctcagtccatgcagccacccattatccccctttttccggtcgtcaaaaaggatatgacctttctgcacgaaggcaatgactccaaagtggacggccttgtcaattttgaaaaactccggatgatcagtaaagagattcgacaggtcgttagaatgactagcgcaaacatggaccccgccatgatgtttcgacagcggagtctgagccagggcagcaccaattctaatatgctggacgtccagggcggtgcccacaagaagcgcgctcgccgatcaagcttgttaaacgccaagaaactttacgaggatgcccagatggccaggaaggtcaaacaatacctctcatctcttgacgttgaaactgatgaagagaagtttcagatgatgtctcttcagtgggagcccgcctatggcacactgacaaagaacctgtctgagaaacgatccgctaagtcatccgagatgtcccctgttcccatgcggtccgctggacagacaactaaggcccatctgcatcagcctcacagagtttcacaagtactccaggtgcctgctgttaatcttcaccccatcaggaaaaaaggacagaccaaagatcccgcactgatgtag

SEQ ID NO: 131737 - DNA, 4176 bp, Artificial Sequence
  Description of Artificial Sequence: Synthetic coding sequence
atgaactcacctgtggatcctggcgccaggcaagctctgcggaaaaagccacctgaacggactccagaggatctgaatacaatttactcttatctgcatgggatggagattctcagcaatctgagggaacaccagttgaggctgatgtccgccagggcccgatatgagcgctactcaggcaaccaggtgttattctgctctgaaacaatcgctcgctgctggtatatcttgctgtccggctcagttctcgttaaagggtctatggtgctgcccccctgtagctttgggaaacagttcggcgggaaacgtggctgtgactgcttggtgctcgagccctccgagatgatagtcgttgaaaacgccaaagacaacgaagacagcatcctgcagagggagattcccgctcgccaaagccgacgtagattcagaaagataaactataagggggagcggcagacgatcactgatgacgtggaggtaaattcctacctgtcgctgcccgccgacctcactaagatgcaccttacagaaaacccccacccgcaggtcactcatgtaagcagcagccaaagtggctgttcaattgccagtgactctggatcatcgtccctgtcagacatctaccaggcaactgaatcggaggtgggtgatgtggaccttacccggctgcctgaggggcccgtggacagtgaggacgacgaggaggaggacgaggaaatagaccggactgaccctctgcaggggcgcgacctggtgagggagtgcttggagaaagagcccgccgataaaacagacgacgatattgaacagctattggagttcatgcatcaactccccgctttcgccaacatgactatgtctgtgcgaagagagctgtgtagcgtgatgatttttgaggtggtcgagcaggcaggcgctatcatcctggaggacggacaggaactggattcctggtacgtgattctgaatggcacagtcgagatctctcaccctgacggcaaagtggagaacctctttatgggtaattctttcgggattacaccgacgcttgacaaacagtacatgcacggcattgtgcggaccaaagtggatgattgccagtttgtctgtatcgcccaacaggactactggcgaattttgaatcatgtggagaagaacactcacaaggtggaggaggagggggagatcgtgatggtccatgaacacagggaattggacagaagcggtaccaggaagggccatatagtgataaaggctacccctgaacgtctgatcatgcacctaatcgaggaacacagcatcgtagaccccacttacatcgaagacttcctcctcacctataggacattcctagagagcccgcttgatgtgggaatcaagctgctggagtggtttaagattgattcactgcgagacaaagtgacaaggattgtactgttgtgggtgaataaccacttcaacgacttcgagggtgaccctgctatgacaaggttcctggaagagttcgaaaagaaccttgaggacactaaaatgaacggacatcttcggttactcaacattgcctgcgctgctaaagcgaaatggcggcaggtcgtattgcagaaggccagccgagaatcacccctccagttctcactgaacggcggttctgagaagggcttcggaattttcgtcgaaggagtggagcccggctcaaaagctgcagacagtggccttaagcggggggatcaaattatggaagtcaatggtcagaacttcgaaaatatcactttcatgaaggctgttgagatcttgcgaaacaacacacacttagcactgaccgtcaaaaccaacatctttgttttcaaagaactcctgtttcgtacagagcaggaaaagtctggagtaccgcacatcccaaaaattgcagagaagaagtctaaccgccactcgattcagcatgtgcctggggacatcgagcagactagccaagagaaaggcagcaaaaaggtaaaagccaatactgtcagtggcggacgcaacaagataagaaagatcttggacaaaactcgcttctccattttgccccctaagttgtttagcgacgggggcctgtctcagagtcaggatgactcaatcgtcggcactcggcactgccggcattccctggctatcatgcccatcccaggtactttaagctcctcatccccagatttattgcagccaacaacctcgatgttggacttctctaacccgagtgatatacctgaccaggtgatacgcgtgtttaaggtggaccagcaatcctgttatatcatcatcagtaaagacaccacagccaaagaagtcgtgttccacgccgttcacgagttcggcctgaccggtgctagcgatacatatagcctgtgcgaagtgagcgtcactccagagggcgtcattaaacagcgccgactaccagaccaattctctaaactcgccgataggatccagctcaatggaaggtattacctgaaaaataacatggagacggagacgttgtgttcagatgaggatgcgcaggaattagtgaaagaatctcaactctctatgctccagctgtccacgatcgaggtagcaacacagctttctatgagagactttgatctttttagaaacatagagccaacggagtatattgatgatctcttcaaactgaacagcaaaacgggaaatacccatctgaagcggttcgaggacatcgtgaatcaagagactttctgggtcgcaagcgaaatcctcacggaagctaaccagctaaaaaggatgaaaattatcaagcactttataaaaatcgcactacattgccgagagtgcaaaaattttaactccatgttcgcaataatctcaggcctaaatctggcttccgtggctcggttgagagggacctgggagaaattacctagcaagtacgaaaagcacctccaggacttgcaggatatatttgatccaagcagaaacatggcgaaataccggaacattctgtcttctcagagtatgcagcccccaatcattccccttttcccagtggtgaagaaggacatgacattcctacatgagggaaatgactccaaagtggacggattagtcaatttcgagaaacttcggatgataagtaaggaaatcagacaggttgtgagaatgacaagcgctaacatggatcccgccatgatgtttcggcagagaagcttatcccaggggtccaccaattccaacatgcttgacgttcaaggtggcgcacataaaaaacgagctcgcaggagctctctccttaatgctaagaaactttatgaagatgctcagatggctagaaaggttaagcagtacttgtcttccttggatgtcgaaaccgacgaagagaaatttcagatgatgtcattgcaatgggagcccgcttatggcactctaaccaagaacttatcagaaaagcgaagtgccaaatctagcgagatgtcaccggtgcccatgaggtccgccggtcaaaccactaaagcccatcttcaccagcctcatcgggtgtctcaagtactgcaggtgccggctgtgaatctgcatccaatacggaagaaaggccagacgaaggaccccgctctgaatacttccctccctcagaaggtcctgggaactacggaagaaatctcaggaaagaagcatactgaggatacaatatcggtagctagttccctgcactcatctcctcctgcgagtcctcagggatccccacacaaggtcgggagtattatcagtgaccactccagcaagattagtggacagagttgtcccggcatcggaggtgcttacctgcagaaaaagattctacagatcacgcggagtacggctaaacggaccgactccactgagaaagcaaccgaggaaaacagagaccgtacaagttgcgaaaacaccactcgaaaacggatgacatcaccgtttcgtaggctgcgggaaagaatgctctccagggaaagactggtcaactctcagaaggaggacacagatcataaccaggctacagaaagttgcgagaaggttaaggacgtggggtctaatatcaaagatgagaagggcagtgccattttcaatagtaattctcaaggcaactctaacactttgaattgcttctatacaagattcaagtctaagagaaggaagaccttatag

SEQ ID NO: 131738 - DNA, 2484 bp, Artificial Sequence
  Description of Artificial Sequence: Synthetic coding sequence
atgaatagccccgtggaccccggagccaggcaagcgctacgcaaaaagccccccgagcgcaccccggaggacttgaacacaatctattcctatcttcacggtatggagattttgtcaaacctgcgcgagcaccagctgcggctaatgtctgcgcgggccagatatgagaggtactccggcaaccaggtccttttctgtagcgaaactatcgcaagatgctggtatatcttgctgagtggctccgtgttggtcaaaggttcaatggtgctgcccccttgctcctttggtaagcagttcggcgggaaacggggctgtgactgcctagtacttgaaccatctgagatgatcgtggtcgaaaacgctaaggataacgaagactcaattctgcagagggagattcccgccaggcagtctcgccgccgtttcagaaagatcaactacaaaggggagagacaaactatcaccgacgatgtcgaagtaaacagttatctctctctgcctgccgacctcacaaagatgcacctcaccgagaacccccatcctcaagtcacacatgtctcttcgagccaatcagggtgctccatcgcgagcgactccggatcaagcagtctgtctgatatttaccaggccaccgaatccgaagtgggagatgtggatctgacccggcttccagaagggccagttgacagcgaggatgatgaagaagaagatgaggagattgaccgcactgatccattgcaaggaagagacctcgtacgggagtgcctggagaaggaacctgctgacaaaacagatgacgatattgagcagctgttagaattcatgcaccagctcccagcttttgcgaatatgacaatgtctgtgcggagggagctctgtagcgtgatgatttttgaagtggtggagcaagccggcgccatcatcctggaagacggccaagagcttgactcctggtatgtgatcctgaatggtacagtggaaatttcacatccagacggtaaagttgagaatttgttcatggggaattctttcggcataactcctactctcgataagcaatatatgcacgggatagtgcgtaccaaggtggatgactgccagttcgtgtgtatagcccagcaggattattggaggattttgaatcacgttgagaagaatacccataaagtggaggaggagggcgaaattgtgatggtccatgaacatagggaactggaccggagtgggactcgaaagggacatatcgttatcaaggctacccctgagcggctgattatgcacttgatcgaagagcacagtatcgttgaccctacttacattgaagacttcctgcttacatatcgtacctttttagagtctcctcttgatgtaggtatcaagctcctggagtggtttaagatagattccctgcgtgacaaggttacaaggattgtactgttatgggttaataaccattttaacgatttcgaaggagacccagccatgacccgcttcctggaggaattcgaaaagaatctggaagacaccaagatgaacggacatctaagactgctcaatattgcatgtgccgctaaagccaagtggaggcaagtcgtgctccagaaagctagccgcgagagccctctgcagtttagcctaaatggaggtagtgaaaagggcttcggcatcttcgtagaaggagtggagccaggctctaaggcggccgactcaggcttgaagcggggggatcaaattatggaggttaatggacaaaactttgaaaatattacctttatgaaggctgtcgagatactgagaaacaacactcacctggcgctgacagtgaaaaccaatatctttgttttcaaggaactgctctttcggactgagcaggaaaagagcggagtgcctcacattccaaaaattgccgaaaaaaaatccaatcggcactccatacagcatgtgccaggggacatcgagcagacatcacaggagaaggggagtaaaaaggtcaaagccaatacggtttccgggggtcgcaacaaaatccgcaaaatactggataagacgcggttttccatactcccccccaaattgttttctgacggtgggctgtctcagagccaggatgattcaatcgtcggtactcggcattgtcgccactctcttgctatcatgccaattcccggtaccctgtcgagcagctcaccagacctgctccaaccaaccacctccatgctggattttagcaacccctccgacataccagatcaggtgattcgcgtcttcaaagtggaccagcagtcctgctatatcattatcagcaaggacaccacagccaaggaggtggtttttcacgccgttcatgagttcggcctgaccggtgcatcagatacctattcgttatgcgaggtgagcgtgacccctgagggagtgataaagcaacggcgcctcccagaccaattttctaaactcgccgatcgtattcagctgaatggaaggtag

SEQ ID NO: 131739 - DNA, 1551 bp, Artificial Sequence
  Description of Artificial Sequence: Synthetic coding sequence
atggccgataatttgtccgacactctgaagaagctgaagatcacggccgttgacaagaccgaggactccctagagggctgtctcgattgtttactgcaggccttggcgcagaacaacactgaaacctcagaaaaaatccaggccagcggtattctgcaactttttgcgtccctgctcactccccagtcttcttgcaaagcaaaggtcgccaatattatagccgaagtcgccaagaatgagttcatgaggatcccctgcgtggacgctggccttatttccccccttgttcaactgcttaactccaaggatcaagaggtgttgctgcaaacaggaagagccctgggcaacatttgctatgactcacagtcctcaaaggaacaatttgcttccacgaatatcgccgaagagcttgttaagctttttaaaaaacaaatcgagcacgataagagagaaatgatttttgaggtcctcgccccactggcagaaaacgatgccattaagttacagttggttgaggcaggtctggtggaatgcctccttgagatcgtgcagcagaaagtcgatagcgacaaggaggacgatattacggagttgaaaaccggctctgatctgatggtacttctgctgctgggagacgagtcaatgcagaagctgttcgaaggggggaaaggcagcgtgttccagagggtcttaagctggattccatctaacaaccaccaactccagctggccggggccctcgcaattgccaattttgcacgcaacgacgctaactgcatacacatggtagacaatggtatcgtggagaagctgatggacctcctggaccggcatgtggaagacgggaacgtgacagtccagcatgcagcattgtctgcccttaggaacctggctatccccgtgatcaataaggccaaaatgctctccgcaggcgtgactgaggccgtcctcaaatttttgaaatctgaaatgcctcctgttcagtttaagttactgggtactctcagaatgcttatcgacgcccaggccgaggccgcggagcagctggggaaaaatgtcaagctcgttgagaggctggtggaatggtgtgaggctaaggaccatgctggggtcatgggagagtccaaccggctgttgagcgcgttgatcagacactcaaagagcaaggatgttatcaagactatcgtgcagagcgggggcatcaaacatctcgttaccatggccacctccgaacacgtgattatgcaaaatgaagctctggtggccttggccctcattgccgctctcgaactgggaaccgcagagaaagacctggagtctgccaagttggtacaaatacttcatcggttgctcgccgacgaacgatcggctccagagatcaagtacaactctatggtgctgatttgtgccttaatggggtcagaatgcctccacaaggaggtgcaggacctggcattcttggacgtcgtttccaagctgaggtctcacgagaataagtcagtcgctcagcaggctagtctgacggagcagcggctgactgtcgagagctag

SEQ ID NO: 131740 - DNA, 1827 bp, Artificial Sequence
  Description of Artificial Sequence: Synthetic coding sequence
atggccgataatctgagcgatacgctgaagaaactcaaaataactgccgtagataaaaccgaggactcattagaaggttgcttagattgtctcctgcaggctctcgcacaaaataatacagaaactagtgaaaaaatccaggcttccggcatactgcagctctttgcctcccttctgaccccacagagctcctgcaaggcaaaggttgccaatattatcgcggaggtcgccaagaacgagtttatgcgcataccgtgtgttgacgctgggttgatttctcccttggtgcagctgcttaacagcaaagatcaagaggtgctgctgcagaccggaagggcgctcggcaacatttgttatgactctcatgagggaagatcggccgtagaccaagctgggggcgctcagatcgtcatagatcacctaaggtctctgtgtagcattactgatccggcaaatgagaaactgctaacagtcttttgcggaatgctcatgaactactccaatgaaaatgatagtcttcaggctcaacttatcaacatgggcgtaatcccgactttggtcaagcttctcggaatccactgccagaatgccgccctaacagagatgtgcctggtggcctttgggaatctagccgaattggaatcgtcaaaagagcagttcgcatcaaccaacatcgcagaggaactcgttaagttatttaaaaagcagatcgagcacgataagagggagatgattttcgaagtccttgccccattagccgaaaatgacgctatcaaattacagttggttgaagctggtctggtcgaatgcctcttagagatagttcaacagaaggtggactcagataaagaggacgatattacagaattgaaaactggcagtgacctgatggtcctgcttctgctgggcgacgaaagcatgcaaaagctgttcgagggcggaaagggctcagtctttcagagggtcctgagctggatcccctcgaacaaccaccagcttcaacttgctggagccttggctatcgccaatttcgcgcggaacgacgcaaactgtatccatatggttgataacgggatcgtcgagaagctcatggacctcctcgatagacatgtagaggatgggaatgtgacggtccagcacgccgcccttagtgcccttcgaaatctcgccattccagtgataaacaaagccaagatgctgagcgcaggggttacagaggctgtcctgaagttcctcaagtcagaaatgcccccagtgcagtttaaactgctggggactctaaggatgctgattgacgctcaggcggaagcagcagagcaactgggcaaaaatgtgaagctggtggagaggctggtggagtggtgcgaagccaaggatcacgccggggtgatgggcgaaagcaatcgactgctctctgcactaattcgacattcaaagtcaaaggacgttatcaagactatcgtccagagtggcggtatcaaacatctcgtgacaatggctacttcagagcatgtgattatgcaaaatgaggcactcgtggctctggccttgatagccgccctagaacttggtacagcagaaaaggacttggagtccgctaagttggtacagattctccacagacttttggccgacgaacgcagtgccccggagatcaaatacaattcaatggtgcttatttgcgccctgatggggtcagagtgccttcacaaggaggttcaggaccttgccttccttgatgtcgtcagtaagctgaggagtcacgaaaacaagtctgtggcccagcaggcctcgttaacagagcagcgcttaacagtcgagagctag

SEQ ID NO: 131741 - DNA, 1680 bp, Artificial Sequence
  Description of Artificial Sequence: Synthetic coding sequence
atggccgataacctctccgatacactaaaaaagctgaagattactgccgtggataaaacggaagattcactggagggatgcctggattgcctgctgcaggccctggcccagaacaacaccgaaactagcgaaaagattcaagctagcggaatcctccagcttttcgcctctctgctgaccccacagagtagctgcaaggcgaaggtcgctaatattatcgcggaggtggccaaaaacgaattcatgaggattccctgtgtggacgctggcttgatttctcccctggtgcagctgttgaactctaaagaccaggaggtgttactgcagactggtcgcgctctagggaatatctgctatgacagccacagcctccaggcacagcttatcaacatgggagtgattccaacattagtgaaactgctgggcattcactgtcagaacgctgctttgaccgaaatgtgtctagtggctttcggtaaccttgccgagctggagtcctccaaggagcagtttgcctctactaacatcgccgaggagctggtgaaactgtttaagaagcagattgagcatgataagcgggagatgattttcgaggtgctggctccccttgccgaaaacgacgccatcaaactgcaattggttgaggcgggcctggtggaatgtttgctggagattgttcagcagaaagtggatagtgacaaggaggatgacatcactgagttgaagaccggctccgatttgatggtcttgcttttactgggcgatgagtccatgcagaagttatttgaaggcggcaaaggatccgtgttccagcgcgtgctgtcatggattcccagcaataaccaccagcttcagctggcaggcgctctcgccatagcaaacttcgccaggaatgacgctaattgcattcatatggtggacaatggaattgtcgagaagctgatggacctcctagatcgccatgtggaagatgggaacgtgactgtccagcacgctgctctgtcagcactgcgtaacctggctattcccgttatcaacaaggccaaaatgctcagcgcaggcgtgactgaggccgtgttaaaatttctgaagtccgaaatgccgcctgtgcagtttaagctgctgggtaccttgagaatgctgatcgatgcacaggccgaggcagccgagcagttggggaagaatgtgaagctcgtggaacgtctcgtggagtggtgtgaagccaaggatcacgcaggggtaatgggtgaaagcaatcgactactcagtgctcttatacggcactccaaatccaaggatgtgattaagaccatagtgcagtctggtgggattaagcatctggtcaccatggctactagtgagcatgtcattatgcaaaacgaagccctggttgcgttggctctgatcgctgctctggaattgggcacggccgagaaagaccttgagagcgctaagctggtccagatactgcacaggctcctggcggacgaacgctccgcaccagagataaaatacaacagcatggtgcttatctgtgcactcatgggcagcgagtgcttgcataaggaggtacaggatctggcctttctggacgtcgtaagtaagctgcgcagtcatgagaacaaaagcgtggcccagcaggcctcactaaccgaacaaagattgaccgtggagtcatag

SEQ ID NO: 131742 - DNA, 1677 bp, Artificial Sequence
  Description of Artificial Sequence: Synthetic coding sequence
atggacaatctctcagatacccttaagaagctcaaaatcaccgctgtggacaagaccgaagatagcctggaggggtgcttggattgcttacttcaggccctggctcaaaacaatacggagacatcagagaagatacaggcaagcggcatcttgcagctgttcgcttctttgctaacgccccaatcttcctgtaaggctaaggtcgcaaatatcatcgctgaggtggctaagaacgaatttatgagaattccttgcgtcgacgcgggactgataagcccccttgtgcagctccttaactcgaaagaccaggaagttcttctccaaactggaagagcactgggtaacatctgttacgattcacattctcttcaggctcagctcatcaatatgggagtgattcccaccctggtcaaacttcttgggatacactgtcagaacgccgcacttactgagatgtgtttggtggccttcggtaatctcgccgagttggaaagctcaaaggagcagtttgcgagtacaaatatcgcggaggaactggttaagctctttaaaaagcagatcgagcatgataagagggagatgatatttgaggtgctggcccctctcgcggagaacgatgctatcaagctgcagctggtggaagctggcctggtggaatgcctgttggagatagtccagcaaaaggtcgattcagataaggaagatgatatcaccgaacttaagactggtagtgatctgatggtgctgcttctccttggggacgagtccatgcagaaactgttcgagggcggaaagggatccgtgttccagagagtcctatcatggattccaagtaacaaccatcagctccaactggccggcgcactcgctattgccaattttgcccggaacgatgctaattgcatccacatggtggacaatggaatagtggaaaagctgatggaccttctggaccgacacgtggaggacggcaacgtaactgtacagcacgccgcactttcggcactgaggaaccttgccattccagtcataaataaagccaaaatgctgtctgccggtgtgactgaggcggttttgaagtttctcaagtcagaaatgccgcctgtacagtttaagctgctgggtaccctccggatgctgatagacgcccaggcagaagctgccgagcagctgggtaagaatgtcaaattagtcgagcgcttagtggaatggtgcgaggccaaggatcacgccggcgtgatgggagaatccaataggctcttgagcgcgctgattcggcacagtaaaagtaaagacgttattaaaacaatcgtccagtctggtgggattaagcacctcgttacaatggccacgagcgaacacgtgattatgcagaacgaggctcttgtggcactcgcccttatcgctgcgttggaacttggaacagcggaaaaagatctggagtctgccaaacttgttcagattctgcaccgactccttgctgatgagcggagcgccccagaaataaaatataactccatggttctcatctgtgcactcatggggagtgaatgtcttcacaaggaggtgcaggatctggcctttcttgatgtggtcagtaaactgcgatcccacgagaacaaatccgtggcccaacaggcatcccttaccgagcagcggctgacggtggagtcgtag

SEQ ID NO: 131743 - DNA, 1824 bp, Artificial Sequence
  Description of Artificial Sequence: Synthetic coding sequence
atggacaatctttcagacacattgaagaaacttaagattaccgcagtagataaaaccgaagattcactggaaggatgcctggattgtctgttacaggctttggcacagaacaataccgaaacgtctgagaaaattcaagctagcggcatactccaattgttcgcctccttactcaccccccagagtagctgtaaagctaaggtcgcaaatattatcgccgaagtcgctaagaatgaatttatgcgaattccctgcgttgacgcaggcctgatctcccccctcgtgcagctgctgaactcgaaagatcaggaggtgctactccagaccgggcgagctttggggaacatctgttatgacagtcacgagggtcggtctgccgtcgaccaggccggcggtgctcagattgtcatcgaccatcttcggagtctctgtagtattactgatccagccaacgagaaactcctaaccgtgttttgcggcatgttgatgaactatagtaacgaaaacgacagcctccaggctcagctcatcaatatgggcgtcatcccaactttagttaagcttcttggcattcattgtcagaacgccgccctgactgagatgtgcttggtggcctttggcaatctggccgaattggaaagttctaaggagcagttcgcttcaaccaatattgctgaggagctggtgaagctgttcaaaaaacagatcgagcatgacaaaagggagatgatctttgaagttctggcgcctcttgccgaaaacgacgccattaaattgcagttagttgaggcaggcttggtggagtgcctccttgagattgtccagcagaaagtggatagcgataaggaggacgacattacggaactcaaaacaggttctgacctgatggttctgctcctgctgggagacgagagcatgcaaaagctcttcgaaggtggtaaggggtccgtgttccagcgagtgctcagctggatcccatccaataatcaccaactgcagctagccggagcccttgcgattgctaattttgctcgcaatgacgctaactgtatccatatggtggacaacgggatcgttgagaaactgatggatcttttggataggcatgttgaggatgggaatgtgaccgtgcaacacgccgcactctctgcactaaggaacttggccattcctgtgatcaataaggcaaagatgctctccgcaggcgttactgaggccgttctaaagtttttgaaatccgagatgccgccagtccagttcaagttgctaggcactcttcggatgctcattgatgcccaggcggaagcggcagagcagctgggcaagaacgttaaactggttgaacggctggtcgagtggtgtgaggccaaagatcatgcgggagttatgggcgagagcaaccgcttgctctccgcgctgatacgtcactccaagtccaaggacgtcatcaagactatagtgcagtccggcggtatcaagcacttggtaaccatggctacgagcgaacacgtgattatgcagaacgaagcgctggtggctcttgctctgatcgccgccctcgaactagggaccgctgagaaggaccttgagtctgctaaactggtacagattctccatcgtctcctggccgatgagagatccgcacctgaaattaagtacaacagtatggtgcttatctgcgccttgatgggatcagaatgcctgcacaaagaagtccaggatctagcttttctggacgtggtgtcgaaactaaggtcccacgaaaataagtcagtggctcagcaggcatctctgacggaacagcgtttgaccgtggaatcttag

SEQ ID NO: 131744 - DNA, 1824 bp, Artificial Sequence
  Description of Artificial Sequence: Synthetic coding sequence
atggcggataatttatcagataccctgaagaagctgaaaatcacagccgtggacaagactgaggacagtctggagggctgtctggactgtcttctgcaggccctcgcccagaacaacaccgagacttccgagaaaattcaggccagcggaattctgcaactgtttgcctctctcttgactccacagtcttcctgtaaagccaaagtggctaacattatcgcggaagtggccaaaaacgagtttatgcgcatcccctgcgttgatgccgggctgatctcacccctagtgcagctgctgaactcaaaagaccaggaagtccttttgcagactggccgggcactgggcaacatatgctatgattcccatgaggggcggtccgccgttgatcaggctgggggggcacagatcgtcatcgaccacctcaggtcactctgttccataactgatccggcaaatgagaaactactgacagtgttttgcggaatgctgatgaactatagtaatgagaatgacagtttacaagcacagctcataaatatgggagtcattcccacactggtgaagttgctcggaattcattgccaaaacgcagctctgaccgaaatgtgtctggttgcctttggaaatcttgccgagctagaatcctccaaagaacaattcgccagcactaatatcgcagaggaactagtcaagctatttaagaaacagattgagcatgacaagcgggagatgatattcgaggtgctggcaccattggcagagaatgatgccataaagcttcagttggtagaggcggggttggtggaatgcctgctggaaatcgtacagcaaaaggtcgactctgacaaggaagacgacatcaccgagctaaaaactggcagtgatttgatggtgctgctgctcctcggcgacgagagtatgcagaagcttttcgagggaggtaaggggtcagtgttccaaagagtattatcatggatcccgagtaataaccaccagctgcaactggcaggcgcgcttgccattgctaacttcgcccgcaacgatgcgaactgtatacatatggtagacaacgggatcgtggagaagttgatggatttgctggatcggcatgtggaggatggtaatgtgacagtccagcatgctgctctgtctgcccttcgaaacctcgccatcccagttattaacaaggcaaaaatgctctcggccggtgtgactgaagctgttctgaagttcttaaagtccgaaatgccacctgtccagtttaaactgctcggaacgctgaggatgctgattgacgctcaggaagccgccgaacagctgggcaagaacgttaagctggtagagagactggtggagtggtgcgaggccaaagatcacgccggcgttatgggagagtctaatagactcttgtctgctctcatcagacacagtaaatccaaggatgtcatcaagaccatcgtgcagagcggagggattaagcatctggtcacgatggctacatcagagcacgtgattatgcagaatgaagcactagtggctctagctctcatcgccgcgctggaactggggacagccgagaaggatctcgaatccgccaagctggtgcaaatcttgcaccgactgctggccgacgagcgctctgctcctgagatcaaatacaacagtatggtgctgatctgtgctctgatggggtcagaatgtctgcataaagaagttcaggacctagccttcctggacgtggtatctaagctgaggagccatgagaacaaaagcgttgctcagcaggctagtctgaccgagcagcgcctgacagttgagtcttag

SEQ ID NO: 131745 - DNA, 555 bp, Artificial Sequence
  Description of Artificial Sequence: Synthetic coding sequence
atgagggaatacaaacttgtcgtcctcggctccggcggcgtcggcaaatctgcgcttactgtgcagttcgtgcagggcattttcgtcgagaagtatgatcccaccattgaagacagctaccgcaagcaggtagaggtggacgcccagcagtgtatgcttgaaatccttgatactgccgggactgaacagtttacagctatgcgagatctgtatatgaagaacggccagggcttcgctttggtatactctattaccgctcagtctaccttcaatgacttacaagatctcagggagcagattctgcgggtaaaagataccgacgacgtgcccatgatcttggtaggcaacaaatgtgatttggaggatgagcgggttgtggggaaagaacagggtcagaacctcgctcgccaatggaataattgtgcctttcttgagagttctgcgaagtctaagatcaatgtaaacgaaattttttacgacttggttaggcagataaatagaaagacccctgttccaggcaaggcccgcaaaaaatcatcatgtcaattgctttag

SEQ ID NO: 131746 - DNA, 555 bp, Artificial Sequence
  Description of Artificial Sequence: Synthetic coding sequence
atgagggagtataaacttgtggttctcggatccgggggcgtgggtaaatctgcattaactgtacagtttgtccaagggatcttcgtggagaagtatgatcccacaattgaggattcttaccgaaaacaggtggaggtggatgcccagcagtgtatgctggagattcttgacaccgcgggtacagaacaatttactgcaatgcgggacttgtacatgaaaaatggccagggcttcgctctcgtgtactcaatcacagcccagagcaccttcaatgatctgcaggacctccgcgagcagatcctccgcgtcaaggataccgacgacgtgcccatgatccttgtcgggaacaaatgtgaccttgaagacgaacgtgtagtcgggaaagagcagggccagaacctggcaaggcaatggaacaattgcgcttttctcgaatcttcagcaaaaagtaagatcaatgttaatgagatattctacgatctggtgcgtcagattaatagaaagacaccagtccccggtaaagcccgtaaaaagagttcctgtcaactactgtag

SEQ ID NO: 131747 - DNA, 357 bp, Artificial Sequence
  Description of Artificial Sequence: Synthetic coding sequence
atgcgagacctatatatgaagaacggtcagggcttcgctttggtatattctatcactgcacagagcactttcaatgatttgcaggatctacgcgagcagatcctgcgggtgaaagacacggacgacgtaccaatgatactcgtgggcaataagtgtgacctggaggacgagcgcgtcgtgggaaaagagcagggacagaacctggctcgtcagtggaacaattgcgccttcctagagtcctccgccaagagcaagattaatgttaatgaaatattctacgacctggtgaggcagatcaaccgcaaaacgcccgtacctggcaaggcccgcaagaagtcctcctgccaactcctctag

SEQ ID NO: 131748 - DNA, 555 bp, Artificial Sequence
  Description of Artificial Sequence: Synthetic coding sequence
atgagggagtacaaattagttgtcctggggagtgggggtgtcggaaaatccgccttgactgttcagtttgtccaagggatctttgtagaaaagtacgacccaacaattgaagattcttaccgcaagcaagtggaggtggacgcacagcagtgcatgctggagatcctggacaccgccggcacagaacagtttaccgctatgagggatttgtacatgaagaacggacaggggttcgccctggtatacagtatcactgcgcagagcactttcaacgacctgcaggatctgcgggagcagatcctacgcgtgaaagacacagatgatgtcccaatgattttagtggggaacaaatgcgatctggaagacgagcgtgtcgtgggtaaagagcagggccagaatctcgcacgccagtggaacaattgtgcgttcttagagtccagtgctaagtctaagatcaacgtcaacgaaattttttacgatctcgtgcgccaaataaatagaaagacccctgtgcctgggaaggcacgtaagaaatcttcttgtcaactactctag

SEQ ID NO: 131749 - DNA, 99 bp, Artificial Sequence
  Description of Artificial Sequence: Synthetic coding sequence
atgagagaatataagttagtggtcttaggaagcggcggggtgggcaaatccgccctgaccgtgcagttcgtgcaggggatctttgttgagaagtactag

SEQ ID NO: 131750 - DNA, 429 bp, Artificial Sequence
  Description of Artificial Sequence: Synthetic coding sequence
atgcgcgaatataaactggttgtcttggggtccggcggagtggggaagagcgccctcgaacagttcaccgcaatgcgggacctttacatgaaaaacgggcagggcttcgcactcgtgtatagtatcacagcacagagtacgtttaacgatctgcaggatctgagagaacaaatcctgagggttaaagacactgacgacgtgcccatgattctggtgggcaataaatgcgatttagaagacgaacgggtcgtgggcaaggagcagggtcagaatctggctcgtcagtggaacaactgcgcgtttctcgagtctagcgcaaaaagcaagatcaacgtgaacgagatattctatgatcttgtccgccagatcaaccggaaaactccagtcccaggcaaggctcgtaaaaaatcttcttgccagctgttgtag

SEQ ID NO: 131751 - DNA, 384 bp, Artificial Sequence
  Description of Artificial Sequence: Synthetic coding sequence
atgagagagtataagctggttgtgctagggagtggaggtgtcggtaaatcagccctgacagtccagttcgttcagggcatttttgtcgaaaagtacgaccccactatcgaagactcttaccggaagcaggtcgaagtagatgcacagcaatgcatgctggaaattctggacaccgctggaactgagcagtttacggctatgagagacctgtacatgaagaacgggcaagggttcgctctggtgtattccatcaccgcacaaagcacttttaacgaccttcaagatttgcgagaacagatcctgagagtgaaggatactgacgacgtgccaatgattttagtgggtaacaaatgcgacctggaagacgagcgtgtggtaggatag

SEQ ID NO: 131752 - DNA, 429 bp, Artificial Sequence
  Description of Artificial Sequence: Synthetic coding sequence
atgagggaatacaagctcgtggtactgggtagcgggggggtcggcaaaagtgcactgaccgttcaatttgtgcagggcatcttcgtagagaaatacgaccccacaatagaggacagttatcgcaagcaggttgaggtagatgcccagcagtgtatgctggaaatattagataccgccggcaccgaacaattcactgctatgcgcgatctgtacatgaaaaacggccagggcttcgctttggtgtattccatcacggctcagtcaacctttaacgatctgcaggacttgcgcgagcaaattcttcgcgtgaaagacacagacgacgtacccatgatcctcgtgggcaacaaatgtgatttagaagacgaacgggtggtgggcaaggagcagggccagaacctagataacggcacaaccgtccacagttag

SEQ ID NO: 131753 - DNA, 147 bp, Artificial Sequence
  Description of Artificial Sequence: Synthetic coding sequence
atgagagagtacaagctggtcgtgctgggcagtggtggagtagggaaatctgccttgacagtccagttcgtgcagggcatctttgtcgagaagtacgaccccaccatagaggatagctatagaaaacaggtggaagtcgatgcttag

SEQ ID NO: 131754 - DNA, 36 bp, Artificial Sequence
  Description of Artificial Sequence: Synthetic coding sequence
atgcgggagtacaagttagtggtgttagggagttag

SEQ ID NO: 131755 - DNA, 264 bp, Artificial Sequence
  Description of Artificial Sequence: Synthetic coding sequence
atgagggagtataagctggtggtattaggcagtggtggggtgggtaagtcagctttgacagttcagttcgtacagggcatcttcgtcgaaaagtacgaccccactattgaggacagttaccggaaacaggtcgaagtcgatgcccaacagtgtatgctagaaatactggataccgccggaactgagcagtttaccgcaatgcgtgacctctatatgaagaatggccagggattcgcgttagtatactcaattacagcacagtag

SEQ ID NO: 131756 - DNA, 555 bp, Artificial Sequence
  Description of Artificial Sequence: Synthetic coding sequence
atgcgagaatataaactcgtggtcctcggctcaggcggagtgggcaaaagcgccctgacggtccaatttgtgcaaggcatttttgtggagaaatacgatcccaccatcgaggactcgtacaggaaacaagttgaggtggacgctcagcaatgcatgctagaaatactggacaccgccgggactgagcagtttacggctatgagggacttgtatatgaagaacggacagggctttgctcttgtgtattcaatcacagcacagagtacctttaacgatctgcaagatctaagagagcagatactgcgggtgaaggacacagatgatgtgcctatgattctggtgggtaataagtgtgatctcgaggatgagcgcgttgtcggaaaagaacaaggccagaaccttgcaagacagtggaataactgcgcttttttagaaagttctgccaaaagtaagatcaacgtgaatgaaattttttatgacttggtccgacagattaatcggaaaacccccgtgccaggcaaggcaagaaaaaagtccagctgtcagctcctgtag

SEQ ID NO: 131757 - DNA, 306 bp, Artificial Sequence
  Description of Artificial Sequence: Synthetic coding sequence
atgcgggagtacaaactcgttgtgctgggatctggcggagtgggcaagagtgccctaaccgtccaatttgtccaagggatctttgtcgagaaatatgaccccacaatcgaggactcataccgcaagcaggtcgaagtggacgcccaacagtgcatgttggagatcctcgacacagcaggaacagagcagttcaccgctatgagagatctgtacatgaaaaatgggcagggcttcgccctggtgtattccataaccgcccaatcaacttttaatgacctgcaggacctgagagaacagattctgtag

SEQ ID NO: 131758 - DNA, 162 bp, Artificial Sequence
  Description of Artificial Sequence: Synthetic coding sequence
atgcgagaatacaagttggtagtgcttggttcgggcggagtggggaagtctgcattaaccgtgcagttcgtgcaggggatcttcgttgagaaatatgacccaacaattgaggatagctatcgcaaacaagtggaggtggacgcccagcaatgtatgctgtag

SEQ ID NO: 131759 - DNA, 429 bp, Artificial Sequence
  Description of Artificial Sequence: Synthetic coding sequence
atgagggaatacaaattggtcgtgttaggaagtggcggagtgggaaagagtgccctcgaacagttcacggcgatgcgcgacttgtacatgaaaaacgggcagggctttgcattggtgtactcgatcacagcgcaaagcaccttcaacgatttgcaggacctccgggagcagatcctgcgggttaaagatactgatgatgttccgatgatcttggtcggcaacaagtgtgaccttgaagacgagagggttgtcggaaaagaacagggccagaatctggctagacagtggaataattgcgcctttttagaatcttctgcaaagtctaagatcaatgttaacgagatcttttacgatctcgttaggcaaatcaaccgcaaaacccccgtacctggaaaggcgagaaagaagtctagttgtcaactgctatag

SEQ ID NO: 131760 - DNA, 498 bp, Artificial Sequence
  Description of Artificial Sequence: Synthetic coding sequence
atgcgggagtacaagctggtggtcctgggtagcggtggtgtgggcaagtctgcactgaccgtgcaatttgtgcagggaatttttgtcgaaaagtatgatcctactattgaagatagctaccgtaaagagcaatttaccgcaatgagggacctgtatatgaaaaacggacagggatttgccctcgtttactccatcaccgcccagtccacattcaacgatctgcaagacctccgcgagcagatactaagggtgaaggacaccgacgatgtaccgatgatcctggtgggcaacaagtgcgacctggaagacgagcgagttgtgggcaaagaacaaggacagaatctcgcgaggcaatggaataattgcgccttcctcgaatcctcagctaagagcaaaatcaacgtaaatgagatcttttatgatttggtgcgacagatcaatagaaagacccccgtgcctggaaaagcacgcaagaagtcgagctgtcaactcctgtag

SEQ ID NO: 131761 - DNA, 420 bp, Artificial Sequence
  Description of Artificial Sequence: Synthetic coding sequence
atgcgagagtacaagctggttgtgctggggagtggaggggtgggcaaaagcgctcttaccgtccagttcgtccaggggatttttgtcgagaagtacgatccaaccatcgaggactcatatcgcaagcaggtggaggtggatgcacagcagtgcatgttggaaatacttgatacggctggaacagagcagtttaccgcgatgcgggacctttacatgaagaacggtcaggggttcgctctcgtctacagcatcacagcgcagagcacttttaatgacttgcaggacctccgagaacagattctcagggtgaaggataccgacgacgtgcccatgattttggttggcaacaagtgcgacttggaggacgagagggtcgtaggtaaggagcagggacagaacttagcccgacagtggaattag

SEQ ID NO: 131762 - DNA, 282 bp, Artificial Sequence
  Description of Artificial Sequence: Synthetic coding sequence
atgcgtgaatacaaactggtggtgctcggctcaggtggtgtcggcaagagcgccttgaccgtacaattcgtacagggaatcttcgtggagaaatatgatccaactatcgaagacagctaccggaagcaagtggaagtggatgcccaacagtgcatgctggagatcctggatactgccggaactgagcaattcaccgcaatgcgcgatttgtacatgaaaaacggccaaggatttgcactggtgtacagtatcaccgcacagtccacatttaacgatttatag

SEQ ID NO: 131763 - DNA, 36 bp, Artificial Sequence
  Description of Artificial Sequence: Synthetic coding sequence
atgagggagtacaaactggtggtgctgggcagctag

SEQ ID NO: 131764 - DNA, 297 bp, Artificial Sequence
  Description of Artificial Sequence: Synthetic coding sequence
atgagagaatataagctagttgttctcggaagcggtggcgtgggaaaatctgccttaaccgtccagttcgtgcagggaatcttcgtcgagaagtacgaccccaccattgaggactcgtatagaaaacaggtggaggtcgacgctcagcagtgtatgcttgagatcctggatactgcagggactgaacaatttaccgctatgcgggatctgtacatgaaaaacggacagggtttcgctcttgtgtattcgattaccgcccagtctaccttcaatgatctccaagacttaagggaatag

SEQ ID NO: 131765 - DNA, 414 bp, Artificial Sequence
  Description of Artificial Sequence: Synthetic coding sequence
atgagggagtataaactcgttgtacttggcagcggaggcgttggaaagtcggccctgacagtgcagttcgttcagggtattttcgtcgaaaaatacgacccaacaattgaagactcctaccgcaaacaggtagaggtggacgcacagcaatgtatgctggagattcttgataccgctggaacagttcccatgatccttgtaggaaataagtgtgatctggaggacgagagagttgtgggcaaggaacaggggcagaacttagcccggcaatggaacaattgcgccttcctcgaatccagtgccaagtctaagataaacgtgaacgagatattttatgacctggtccggcagataaatcggaagacccccgtccctgggaaagccagaaaaaagagctcttgtcagctcctttag

SEQ ID NO: 131766 - DNA, 357 bp, Artificial Sequence
  Description of Artificial Sequence: Synthetic coding sequence
atgcgagacttgtacatgaaaaacggtcagggcttcgccctggtctatagcattacagctcagtcaacctttaacgatctccaggacctcagagagcagatcctgcgggtgaaggatacagatgacgtaccaatgattttggtcggcaacaagtgtgatctggaggacgaacgcgtcgtgggaaaagagcaaggacaaaacctagcgaggcaatggaataattgcgccttcctggaatcctctgctaagagcaagattaacgttaatgaaattttctacgacctggtgcgccagattaaccgcaaaaccccggtgccagggaaagctaggaaaaaaagtagctgccaattgctttag

SEQ ID NO: 131767 - DNA, 369 bp, Artificial Sequence
  Description of Artificial Sequence: Synthetic coding sequence
atgcgagaatataagttggtggtgctcggctctggaggagtaggcaagtccgcattaacggtccaattcgtgcagggtatatttgttgaaaagtatgatccaactattgaggatagctacagaaagcaggtagaagttgacgctcagcagtgtatgttggaaattctggatactgcaggaaccgagcagttcaccgccatgagagacctttacatgaagaacggtcagggatttgctcttgtgtactctataacggcccagtctactttcaacgacctccaggacctgagagaacagattctcagagttaaggacacggatgatgtgcccatgatcctggttggcaataagtgcgacctggaggactag

SEQ ID NO: 131768 - DNA, 258 bp, Artificial Sequence
  Description of Artificial Sequence: Synthetic coding sequence
atgagagaatacaagcttgtcgtacttggcagtgggggtgtgggaaagagtgccttaacagtccagtttgtgcagggtattttcgtggagaagtacgaccccaccattgaggattcctaccggaagcaagtagaggtggacgcacaacagtgtatgctggagatccttgataccgcgggcaccgagcagttcactgccatgagggacctttacatgaagaacggccaaggcttcgccctcgtgtacagcatcacatag

SEQ ID NO: 131769 - DNA, 552 bp, Artificial Sequence
  Description of Artificial Sequence: Synthetic coding sequence
atgagagagtataaagttgttgtgcttggcagcgggggcgtggggaagtcagcactgaccgttcaattcgtgactggaacctttattgagaagtatgatcccacaattgaagatttttataggaaggaaattgaggtggatagctctcccagtgtgctggaaatcctcgacacggctggcacagaacagttcgcttccatgagggacctgtacattaaaaacggacagggtttcatcctcgtttacagcctcgtcaatcagcagtccttccaagacattaagcccatgagggaccagatcatcagggtaaagagatacgagaaggtgcccgtaattcttgtgggtaacaaggtcgacctggaaagcgaacgcgaggtatcttcctccgagggaagagccctagctgaagagtggggctgtccatttatggagacatctgccaagtccaagactatggtcgatgaactgtttgctgagatcgtccggcagatgaattacgcagcccagcctgacaaggatgacccttgttgcagcgcgtgcaacattcagtag

SEQ ID NO: 131770 - DNA, 1671 bp, Artificial Sequence
  Description of Artificial Sequence: Synthetic coding sequence
atgaatgagggagccccgggagactccgacctggagactgaggccagagtaccctggtcaattatggggcattgtcttcggacaggccaggcacggatgtccgcgacaccaactccagctggggagggggcaaggcgagacgaactgttcggcattttacagatactccaccagtgtattttaagctccggcgacgcatttgttctgactggagtttgttgctcctggcggcagaacgggaaaccaccttacagccaaaaggaggacaaagaggtgcagacaggctacatgaatgcccaaatcgaaatcatcccctgcaagatctgcggagataaaagcagcggaatccactacggcgtgataacctgcgagggctgcaaagggtttttccgtaggtcccagcagagtaacgccacctattcatgtccacggcagaagaattgtttgatcgatcgtacttcgcgcaaccgttgtcagcattgcagattgcagaaatgtctggcggtgggaatgagccgcgatgctgtgaaattcggacgtatgagcaagaagcaacgggattcactttacgctgaggtgcagaaacatcgaatgcagcaacagcagagggaccaccagcagcaaccaggcgaggctgaacctctcacccccacctataacatttccgccaacggccttactgagcttcatgacgatctgtccaattacatcgacggtcacactccggaaggctccaaagccgactctgcggtgtcctccttctacttggacattcaacctagtcctgaccagtctggcctggatattaacgggattaaacccgaacctatttgtgattatacgccagcatctgggtttttcccttattgttcgttcaccaacggcgagacctctcccaccgtgagcatggcagaactggaacaccttgcgcagaacatttccaagtcacacttggaaacttgtcagtacctccgagaggagctgcagcagatcacttggcaaacctttctgcaggaagaaatcgaaaattatcagaataaacagcgtgaggtgatgtggcagctgtgcgccatcaaaatcacggaagcaattcaatacgtggtagagtttgccaagaggattgatggcttcatggaactctgtcagaacgaccagatagtcctgctcaaggccggtagccttgaggtggtcttcatccgcatgtgtagggccttcgattcgcaaaataacaccgtgtactttgacggcaagtacgccagccctgatgtcttcaagagtctcgggtgtgaagacttcatttctttcgtcttcgagttcggcaagtctctatgtagtatgcacctgacagaagacgaaatcgctctgttttctgctttcgtactaatgagcgcagaccgcagctggctccaggaaaaggtaaaaattgagaaactgcaacagaagatccaactagctctgcagcacgtgcttcagaaaaatcatagggaggacgggatattaacaaaactgatctgcaaggtctccaccttgcgggctttgtgtggacgccataccgagaagctgatggccttcaaagccatttatcctgatattgttcgcttacactttcctcctttgtacaaagagctgttcacctcggaattcgagcctgccatgcagatcgatggatag

SEQ ID NO: 131771 - DNA, 1647 bp, Artificial Sequence
  Description of Artificial Sequence: Synthetic coding sequence
atgaatgagggtgcacctggtgacagcgatctggagacagaggccagagtcccatggtccataatggggcactgtttgcgcacagggcaagcacggatgtctgcaacacccacgcccgcaggcgagggagcccggtcttccagcacttgtagcagcctgagcaggttattttggagccagttggagcacattaattgggatggagcaacagccaagaattttattaacctgcgcgagttttttagcttcctgctacccgctttgaggaaagctcagatagaaattatcccctgtaagatctgtggcgataaatcctctggtatccattatggcgtgatcacctgcgaaggatgcaagggcttttttagacgatcccagcagagcaatgccacttactcttgccctagacaaaagaactgcttgatcgatcgcactagtcggaaccggtgccagcattgtcgcctgcaaaagtgcctagccgtgggaatgtcacgagacgccgtgaagtttggacggatgagtaagaaacagcgcgacagcctctacgctgaggtacaaaaacatagaatgcagcaacagcagagggaccaccagcagcaaccaggcgaggcggaacctctgacccctacctacaacatttcagcaaatgggctcactgaactccacgatgacctcagcaactatatcgatggccacaccccagagggctccaaggccgattcggccgtgtcttccttttacctggacattcagccgtctccagatcagtccggactcgacatcaatggtataaagcctgagccaatttgcgactatacacctgccagtggcttcttcccttactgttcctttactaatggcgagacttcccctacggtttccatggcggaactggagcaccttgcccagaacatttcaaagtcacaccttgagacctgtcagtaccttcgcgaagagttacagcaaattacatggcagacctttttgcaggaagagatcgaaaactaccagaataaacaaagggaagtcatgtggcagctttgcgccattaaaattactgaagccattcaatacgtggtcgagttcgccaagcggattgacggttttatggaactctgccagaacgatcagatagtgctccttaaagcaggttccttggaagtcgtcttcatccgaatgtgtagagccttcgactcccagaataatactgtgtatttcgatggcaaatacgcgtcaccagatgtgtttaagtcccttggttgtgaggatttcatttctttcgtttttgaattcggcaagtctctgtgctcgatgcacttaacggaggacgagattgccctgttcagtgcgtttgtcttgatgtcagccgatcgctcctggctccaggagaaggtgaagatcgaaaagctgcagcagaaaattcagctggcgctgcagcacgtcctgcagaaaaatcaccgtgaagacgggattctcactaagctcatttgtaaagtcagcacactgagggctctgtgcgggaggcataccgaaaaactgatggccttcaaagctatctatccagatatcgtcagacttcactttccgcccctttacaaggaactctttacctcggagttcgagccagcgatgcagatcgatgggtag

SEQ ID NO: 131772 - DNA, 1572 bp, Artificial Sequence
  Description of Artificial Sequence: Synthetic coding sequence
atggaatctgccccggccgcaccagatccagctgcctctgaacccggttccagcggcgccgatgctgctgccggtagtcgcgaaacgcctctgaatcaggaaagcgcccgaaagagcgagccaccagcacccgtcaggcggcagtcctattctagtacatctagaggcatctccgtgacaaagaagacccatacctcccagatagagatcatcccctgtaagatttgcggagataagtctagcggaatccactacggtgttatcacttgtgagggatgcaaggggttcttccggcgtagccagcagtctaacgcaacctatagctgccctcggcagaagaattgtttgatagatcgtacatcaaggaaccggtgtcagcactgtcgcttacagaagtgcctagccgtaggcatgagccgcgatgcggttaagttcggaagaatgagtaagaagcagcgcgacagtctgtacgccgaggtacagaagcatcggatgcagcaacagcaacgggaccaccagcagcagccgggcgaagctgagcccttgactcccacttacaatatatccgcaaatggtctaaccgaacttcacgatgatctcagcaattatatagatggtcacacccccgagggtagcaaggcagacagcgctgtgtcctctttctacctggacattcaacctagccctgatcaatcaggactggatatcaacggaatcaaacccgagcctatttgtgattatacacccgcctccggcttctttccttattgctcgttcacaaacggcgagacgtcccctaccgtgtcaatggctgaacttgaacatttggcccaaaatatcagtaaatcacacctggagacctgccaatatctgcgggaggaacttcaacagattacttggcaaactttcttacaagaggaaattgaaaactaccagaacaagcagcgggaagtaatgtggcagctgtgcgcgatcaagatcacagaggctatccagtatgtcgttgagtttgctaaacggattgacggattcatggagctgtgtcagaatgaccagatcgttctccttaaagccgggtcactggaggtggtctttattcggatgtgtcgggccttcgactcccagaacaacacagtctacttcgacgggaagtacgccagccccgatgtgtttaagtcacttggatgtgaggactttatctcattcgtgtttgagttcgggaagagcctttgctctatgcacctgactgaagatgaaatagctcttttttcagcttttgtactcatgtccgcggatagaagctggttgcaggagaaggttaagatcgaaaagctgcagcagaaaattcagctagccctgcagcatgtgttgcagaaaaatcaccgcgaggacgggatcttgaccaaactcatctgtaaggttagcactttacgcgcattgtgcgggaggcacaccgaaaaactaatggctttcaaagctatataccctgatattgtgagactacattttcctccactgtataaggagctgttcacaagtgagtttgagcctgcaatgcagattgacggttag

SEQ ID NO: 131773 - DNA, 1407 bp, Artificial Sequence
  Description of Artificial Sequence: Synthetic coding sequence
atgatgtatttcgttatcgccgcaatgaaggctcagatagagattattccatgcaagatctgcggcgataaatcatctggcatccactacggggtcattacttgtgagggttgcaagggctttttcaggcggtcccagcagtccaacgccacatatagctgtccccgccaaaaaaactgtcttattgacagaactagccgcaacagatgtcagcattgccgtctgcagaagtgtctggccgtgggcatgtctagggacgcagtcaaatttggaaggatgtctaagaaacaaagggactccctgtacgcagaggtacagaagcacagaatgcagcagcagcagagagaccatcagcagcagccgggcgaggccgaacccttaacaccaacctacaatattagtgccaatgggttaactgaactgcatgacgacctctccaattatatcgatggccatactccggagggctcaaaagctgattccgctgtttcctctttctacctggacatccagccttcccccgatcaaagcgggctcgatatcaacggcatcaagccagagcccatttgtgactacacaccagcatcagggtttttcccctactgttcatttacgaacggagagacgagcccaacggtcagtatggcggaactcgaacacctcgctcagaatatctccaagtcccatttagaaacatgtcagtatctgagagaagagctccaacagatcacatggcaaacttttctgcaggaagaaattgagaactatcagaacaagcagcgggaagtcatgtggcagctttgcgccattaaaatcacagaagccatacagtacgtggtggaattcgccaagcgaatcgacgggttcatggaactctgccagaacgatcagatagtcctccttaaggccgggagtctcgaagtggtgttcatccgcatgtgccgggcattcgacagtcagaataataccgtgtattttgacggaaagtacgccagccctgatgtctttaagagcttaggatgtgaggacttcatatcatttgtgtttgaattcggcaaatccctgtgtagtatgcatctgaccgaggacgagatagcgctgttctcagccttcgtgctgatgagtgctgaccgttcttggcttcaggagaaagtgaaaattgaaaaactgcagcaaaaaatccaactagcacttcagcatgtgctgcaaaaaaatcaccgagaggatggcatcttgacaaagctgatctgtaaagtgtctactctaagggccttatgcggccgacacacagagaaacttatggctttcaaggccatctatccagatattgttcgcctgcactttcccccactttataaagaactattcacttcagaatttgaacccgccatgcagatcgacggatag

SEQ ID NO: 131774 - DNA, 1557 bp, Artificial Sequence
  Description of Artificial Sequence: Synthetic coding sequence
atggatagggcccctcagcgacagcaccgcgcctccagggagcttctggcagccaaaaaaacccacacgtcccagatcgaggtaatcccttgcaaaatttgcggagataagagcagtggcatccactatggcgtgatcacatgcgagggatgtaagggcttttttcggagaagtcagagatgtaacgcagcatactcttgtacaaggcagcagaactgtcctattgatcgcacttcccggaaccggtgtcagcattgtcgcctacagaaatgccttgcgctgggaatgtctcgggatgccgtgaagtttggaagaatgagtaaaaaacagcgagatagcctccatgccgaggttcagaaacaactgcaacagagacagcagcaacaacaagagcccgtggtgaaaacgcctcctgctggcgcccaaggtgcggacactctgacctacactttaggcttgccggatggacagctaccactgggctcttcgccagacctgccagaggcaagcgcatgcccccccgggcttctaaaagccagtggatcaggcccctcctacagcaataatttggctaaggctggcctaaacggcgccagttgccacttagaatactcccctgagagagggaaggccgagggtagggagtctttctattccactggctcccagcttacaccagatcggtgcggcctccggttcgaggagcacagacatcccggacttggggagttgggtcaaggacccgattcctacgggagcccgagcttcaggtccacccccgaagctccttacgcaagtttgacggaaatcgagcacctggtacaatctgtatgtaagagctatcgtgagacctgtcaactgaggctcgaggaccttcttcgtcagagaagtaatatcttttcaagagaggaggtgacgggctaccagcggaaaagcatgtgggaaatgtgggaacgctgcgctcatcacctcactgaagctatccaatacgtggtggagttcgccaagcggttgtctggcttcatggagctgtgccagaacgatcagattgtcctccttaaggctggtgcaatggaggtggtgcttgtcagaatgtgtagagcctacaacgcagacaaccggacagtgtttttcgaaggaaaatatggcggaatggaattgttccgagcattgggctgctccgagctgatttcaagcatattcgatttctcccatagtctgagcgctctgcacttcagtgaggacgaaatagcattgtacactgccttagttctcatcaacgcccacagacctggcctgcaggaaaagcgcaaggtcgaacagctgcagtacaacctggaattagccttccaccatcacctgtgtaagacgcacagacagagtatattagccaagctgcctcccaagggcaagctcaggtcactgtgctctcaacacgtagagagactgcagatcttccagcatctgcatccaatcgtagtgcaggcggccttccctccattatataaggaactgttctccacggagactgagtcacccgtcggactttccaaatag

SEQ ID NO: 131775 - DNA, 1494 bp, Artificial Sequence
  Description of Artificial Sequence: Synthetic coding sequence
atgcggacacagattgaagtgatcccttgtaaaatctgcggggataagagcagcggtatacattacggcgtgattacgtgtgaagggtgcaaggggttcttcagacgttcccaaaggtgtaatgccgcgtacagctgtacccgccagcagaactgtcctatcgatcggaccagcagaaaccggtgccaacactgtagattacagaagtgcctcgctttgggtatgagtcgtgacgccgtgaagttcggtagaatgtctaaaaagcagcgcgatagtctccacgccgaagtccagaagcagctgcagcagcggcagcaacaacagcaggaacccgtggtgaagacccccccggctggagcccagggggcagacactcttacatatacactggggctgccagatggacagctgcctttaggcagctcccctgacctcccggaggcctccgcctgtccccctggattgcttaaggcttctggttctggtccatcctacagcaacaacctagccaaggctggactgaatggagcaagctgccatttggaatacagtccagagagggggaaggccgaagggagagaaagcttttatagtactgggagccagcttacgccggataggtgtggcctgcgctttgaagaacaccgccaccctggtctaggggagttgggacaaggtcccgacagctacggtagcccttccttcagaagcaccccagaggcaccatatgcttctttgacagaaattgagcacctagttcaatccgtctgtaaatcctaccgggagacatgtcagttgaggctagaagacctattgagacagcgtagcaatatattctctagggaagaagtcactggttaccaacggaagagcatgtgggaaatgtgggaaagatgcgcccatcacttgacagaggctattcaatatgttgtcgagtttgcaaaaaggctgtctggcttcatggaactttgccaaaatgaccaaattgtgcttcttaaggcaggtgcaatggaggttgtcttagtgagaatgtgcagagcatataacgccgataatcgcaccgttttcttcgagggcaaatatggcgggatggaactttttcgggcactcggctgctctgagctaatttcctccatatttgacttttcccacagtctgtccgcgctacatttcagtgaggacgagatcgctctgtataccgccctggtactgatcaatgcccaccgcccgggcctgcaagaaaagcgcaaggtcgagcagctgcagtataatctggaactggcctttcaccaccacttatgtaaaactcatagacagtctattctcgccaagttgccccccaaagggaaactgaggtctttgtgctcacagcacgtggagcggctgcaaattttccagcacctgcaccctatcgtggttcaggccgcctttcccccattgtacaaagagctgttctctacggaaaccgagagtccagtcgggttgtctaaatag

SEQ ID NO: 131776 - DNA, 1719 bp, Artificial Sequence
  Description of Artificial Sequence: Synthetic coding sequence
atgtggggcacaggcccctcggccgggaaagaccggatgtctgggcgcccatggccccacccctggtccaagagtggaacaccctctgaacaggatcgtcgcgcaacaggcctcgtctcgtgtgaacacggaggcgggaagtttgagggacagtcccatcaggctccaggcccccctggcggaggacgtaccggctgcctcgagcttttagccgccaagaaaacgcacacatcacagattgaagtgatcccctgcaaaatttgcggtgacaagtcatccgggatccactatggcgtaattacctgcgagggttgcaaaggtttctttcggcgttctcagaggtgcaacgccgcgtattcttgcacacggcagcagaactgccccattgacagaacatcgaggaacaggtgccaacattgtagacttcagaaatgtctagcgctgggaatgtcacgcgatgcagtgaaatttgggaggatgtccaagaaacagcgggacagcctgcatgccgaggtgcagaagcagctgcagcagagacagcagcagcagcaggagcctgtcgtaaagacacccccagccggcgcccaaggggccgatactctgacatacacactgggtctcccagacggacagctgccactaggttccagtcccgacctcccagaggccagcgcttgccctcccgggctgctgaaggctagcggaagtggacccagctacagcaacaacctggcgaaggcgggcctaaatggcgctagttgccatcttgagtactcaccggaacgggggaaggcggagggacgtgagtccttctactctaccggatcacagctcacccctgaccggtgcggacttcggtttgaagaacataggcaccccgggctgggtgagcttggacaaggcccagacagttatgggagcccttctttccgctctacacctgaggctccatatgccagtttgaccgagattgagcatttagttcagtccgtctgtaagtcttatcgcgagacctgtcagctccgcctggaggacttgctgcgccagcgttcgaacatcttctcgagggaggaggtcacgggataccagcgaaaaagcatgtgggagatgtgggagcggtgcgcccatcatctgaccgaggcaatccagtacgtagttgagttcgccaaaaggctaagtggctttatggaactgtgccaaaacgatcaaatagtattgcttaaggcaggagctatggaagtggtgctcgtgcgcatgtgcagagcctataacgcagataaccggacggtgttttttgaagggaaatacggcggcatggaacttttcagagccctgggttgttcggagcttatttcaagcatctttgacttctcccactcgctgagcgccttgcacttttcagaagacgaaatcgctttgtataccgccctggtcctgatcaatgcccacagaccaggactccaggaaaagaggaaggtagagcagctacagtataacctggaactagcgtttcatcaccacctatgtaaaacgcacaggcagtctatcctggcaaagttaccacccaaagggaagttacgaagcctgtgctctcagcacgttgagaggctgcagattttccaacacctgcatccgatcgtggttcaggccgcatttccccccctctacaaggagcttttttcgacggagacagaatcgcccgtgggcctgagtaagtag

SEQ ID NO: 131777 - DNA, 2835 bp, Artificial Sequence
  Description of Artificial Sequence: Synthetic coding sequence
atgctggactccttctcacaagagtccacgctccctttcagagaagccagaaaacgaacgagcttccaacccgtccaagtgtggcggaacttcaccgcctctcagactactgagagccctgcttgtagcggcgcctctctgggtgaaatgaccgcttggaccatgggggctagaggactggacaagaggggtagctttttcaagctgattgacactatcgcctccgaaattggagagctaaaacaggagatggtgcgcacggatgtgaacctggagaacgggctggagccggcagagacccatagtatggtaaggcacaaggacggcggatactccgaggaagaggacgttaagacttgtgctagggactccgggtatgactcattatccaacaggttgtctattttggatcgtctattgcatacacacccaatctggcttcagctgagcctgtccgaggaggaggccgccgaggtactgcaggcccaacccccaggcatctttttagtgcacaagtcaacgaagatgcaaaagaaagtgctctccttacgactgccctgtgaattcggggcgccgctgaaggagttcgcaatcaaggagagcacatacaccttttccctggaaggatccggaatttctttcgccgatctgttcagactgatcgccttctattgtatctctagagatgtgttacccttcaccttgaaacttccttacgcaatcagcacagccaaaagcgaggcacagctggaggaattggcccagatgggcctgaatttctggtctagtcctgctgacagcaaaccaccaaacctgccccctccccaccggccactttcaagcgacggcgtctgcccggctagtttaaggcaattgtgtctcattaacggtgtacactccatcaaaacaaggacgccttccgagctggagtgtagccagacgaacggtgctctgtgctttatcaatccgcttttcctgaaggttcattcacaagacctgtcgggcgggcttaagagacctagtacaagaacccccaacgccaacggcaccgagcggactaggtctcctcctccacgccctccacccccagccattaactccctgcacacttcccctcgcctggcccgcaccgagacccagacctctatgcctgaaacagtgaatcacaacaaacatggaaacgtagctctgcccgggacaaaaccaacccccatccccccccctcggctaaaaaaacaggcatccttccttgaagccgaggggggcgccaaaaccttgtcaggcggccgacctggggccgggcccgaactggagctcgggacagccgggtctccaggcggcgccccccctgaggcagctcctggtgactgcacacgagctccaccaccttcctctgagagtagaccaccatgtcatggtggccgccaacgtctctccgacatgtctatctcgacatcctctagcgactcccttgagttcgaccgatccatgcccctttttggttatgaggcagacacaaattcgagcttagaggactacgagggcgagtcagatcaggaaactatggcccctcccataaagtcaaagaagaagcgctccagcagcttcgtcctaccaaaactcgttaaatctcaactacagaaggtgtctggcgtgttttcctcattcatgactcccgagaaacgaatggtccggagaatagccgagctgagccgggacaaatgcacctacttcggttgcctcgtgcaggactatgtgtcattcctccaggagaacaaagagtgccatgtctcatcaacagatatgctgcaaacgattagacagttcatgacccaagtcaagaattatttatctcagtccagtgaattagatccccccatcgaatccttgatccccgaggaccagatagacgtggtcctggagaaagcaatgcataagtgcattctgaagccgttgaaaggtcacgtcgaagctatgctgaaagacttccatatggccgatgggtcgtggaaacagctcaaggagaacctgcagctggtgaggcagcggaatcctcaggagctgggcgtgttcgcacctacccccgatttcgtggacgtcgagaagatcaaggtgaagtttatgactatgcagaagatgtattcaccggagaagaaagtaatgctcctgctgagagtgtgtaagctgatttacacggttatggagaataactctggtagaatgtacggggcagacgactttctgccagtgctgacctacgtaatcgctcagtgtgacatgttggaattggatactgagattgaatacatgatggaactgctagatcccagcctattgcacggagagggcggctattaccttactagcgcctatggcgctttgtccctgattaaaaacttccaagaagagcaagcggctcggctcctgtcaagtgagaccagggacactctccggcaatggcataaaaggagaacaacaaacaggactattccctcagtggatgacttccagaactatctccgggttgcttttcaggaggtcaattccggatgtaccggcaaaacacttctggtgagaccttacattacaaccgaggacgtctgtcaaatatgtgctgagaagttcaaggtgggagaccccgaggaatatagtctctttctatttgtggatgagacttggcagcagctcgcagaagatacctatccccagaagatcaaggccgaattacacagccgacctcaaccccatatctttcactttgtatacaagagaatcaaaaacgatccttatggtatcatctttcagaacggagaggaagacctcaccacatcttag

SEQ ID NO: 131778 - DNA, 1389 bp, Artificial Sequence
  Description of Artificial Sequence: Synthetic coding sequence
atgacagcttggacgatgggcgctagaggccttgacaaacggggatctttcttcaagctgatcgataccatcgcctcagaaattggggagttgaagcaagagatggtgcgtacagatgtgaacctcgaaaacggactagaacccgccgagacacactctatggtccgccacaaagacggtggctattcagaggaggaggatgtgaaaacgtgtgcgcgggattctggatacgactcgctctcaaaccggctatctatactagaccggctcctccacacacacccaatttggttacagcttagtcttagcgaggaagaagccgcggaagtgttacaggcccaaccaccaggcatattcctcgtacataaaagcactaagatgcagaagaaagtgctgagcctccgcctcccctgtgaattcggggctccccttaaagagttcgccatcaaggagtccacctacaacgtggttctcgaaaaagccatgcacaagtgtatactgaaaccactgaaggggcacgtcgaggccatgcttaaggattttcatatggcagacggatcatggaagcagctgaaggagaatcttcagttggtgcggcaacggaatcctcaggaattgggggttttcgcaccgacgcctgatttcgtcgacgtggaaaaaatcaaggtgaaatttatgaccatgcagaaaatgtacagtcccgaaaaaaaggtgatgctccttctacgagtgtgtaagctgatctacaccgtcatggagaataattccgggaggatgtatggggccgacgattttcttccagtcttgacttatgtaatagcacagtgcgacatgttggaactggatacagaaatcgagtatatgatggagctgttagacccatcccttttacacggcgagggcgggtactatcttacctccgcatacggagctcttagcttaattaagaacttccaagaggagcaagcggcgcgtctgctttcatccgagacaagggacacactgagacagtggcataagagaaggacaacaaacagaacaatcccctccgtggacgacttccagaactacctgcgggtggcgttccaggaagtgaactctggatgcaccggaaaaactctgttggtcaggccctatattactacagaagacgtgtgccagatttgcgccgagaagtttaaggtgggggatccggaagaatactctttgttcctatttgtggatgaaacctggcaacaacttgccgaagacacatacccccagaagataaaagccgaactgcatagtcgaccacagccacacatctttcactttgtgtataagcgcattaagaacgacccgtacgggattatttttcagaacggagaggaggacctgaccacttcgtag

SEQ ID NO: 131779 - DNA, 717 bp, Artificial Sequence
  Description of Artificial Sequence: Synthetic coding sequence
atgtcatccggttattcctcactcgaggaggatgccgaggacttcttcttcaccgctagaaccagtttctttcgccgcgcgccccagggaaaacctaggagtggtcaacaggatgtcgagaaggagaaagagacgcatagttatctgtctaaagaagaaatcaaagagaaagtccacaaatacaacttggcagtgacagataagctgaagatgaccctgaattcaaatgggatctataccgggtttattaaagtgcagatggagctgtgtaaaccaccccagacttctcccaattcaggcaaactgtctccgtcctccaacgggtgcatgaacacgctccacattagcagcactaacactgtgggcgaggtgatcgaggccctcctgaaaaaattcctagtgaccgagtcacctgctaaatttgctctgtacaagcgctgtcatcgtgaagaccaagtttacgcctgcaaactatcagaccgtgaacatcctttatacttgcgcctggttgctggccctcggactgatacactcagttttgtactgcgtgaacacgagattggtgagtgggaagctttttctctgcctgagctgcagaactttctacgtatcctggacaaggaggaagatgagcagcttcagaacctcaaaagaagatatacggcatacagacagaagctcgaggaggcactgagagaagtgtggaagccagactag

SEQ ID NO: 131780 - DNA, 507 bp, Artificial Sequence
  Description of Artificial Sequence: Synthetic coding sequence
atgaccctgaactcaaatggaatctacaccggctttatcaaagtgcagatggagctgtgtaagccgccccaaaccagcccaaattctggcaaattatctccttctagtaatgggtgcatgaacaccctgcacatctcaagcacaaacaccgtgggggaggtaatcgaggctctcctaaagaaattccttgtcactgagagtcccgccaaatttgccctttacaagcgttgtcacagagaggatcaagtttatgcttgcaaactctccgaccgcgaacatcccctgtacttgcgcttagtagccggaccccgtaccgacaccctctctttcgttcttcgggagcacgagataggggagtgggaggcctttagcctcccagagttacagaatttcctcaggatccttgacaaggaagaagatgagcagttgcagaaccttaagcgtcgatacacagcttatagacagaagttggaagaggcgcttcgcgaagtgtggaagccagattag

SEQ ID NO: 131781 - DNA, 717 bp, Artificial Sequence
  Description of Artificial Sequence: Synthetic coding sequence
atgagtagtggctatagctcgctagaggaagacgccgaggactttttctttaccgccaggacctcatttttccgtagggctcctcagggtaaacctaggtccggacagcaggatgtcgagaaagagaaggagacccattcctatctgtctaaggaggaaataaaggagaaagttcacaaatacaacctggccgttaccgataaactcaagatgactttgaacagcaacggcatttacaccggattcattaaagtgcagatggagctgtgcaaacccccacagacttcccccaatagcgggaagctctctccctccagtaacggttgcatgaacacgcttcatatcagctccaccaacacagttggggaagttatcgaggctcttctcaaaaaatttttagtgactgaaagccctgcaaaattcgcgctctacaaaaggtgccatagggaggaccaggtttacgcctgtaagctcagtgatcgcgagcaccccctctacctgcgactcgtcgcgggccccagaaccgatactcttagctttgtcttgagagagcacgaaataggagagtgggaggctttcagcctccctgaactgcagaactttttacggatactcgataaggaggaggacgagcagctgcagaatcttaagcggaggtacactgcctatagacagaaactggaagaagcccttcgtgaagtctggaaaccggattag

SEQ ID NO: 131782 - DNA, 1014 bp, Artificial Sequence
  Description of Artificial Sequence: Synthetic coding sequence
atgactatgatggcgcaccagtacccctcatggatctttatcaacgagaaaactttcatcacaagggagcaattaaactctcttctgaaaacgtacaacatcttttatgagaaccagaagaacttacacatcctatacggagaaacagaggatggaaagctgatcgtggaaggaatgctggacattttctggggggtgaaacggcccattcaactaaaaatccaggatgaaaaaccattcagctcattcaccagcatgaagtcctctgatgtgttttctagcaaaggcatgacgcgctggggcgagttcgacgatctatataggatctccgagctcgacaggacgcagatccccatgtccgagaagcggaattcccaggaggattacctgtcctaccacagtaacacactcaaacctcacgcaaaggatgaacctgattctcccgtactgtaccgcaccatgtccgaagccgctttggtgcgcaagcggatgaaacccctgatgatggataggaaggaacgccagaagaaccgcgcgagtattaacggacatttttataatcatgaaacttcaattttcatcccagcttttgagtccgaaaccaaagtgcgggtgaactcgaacatgcgtactgaggaagtgattaaacaactgctgcagaagtttaagatcgagaattcccctcaggactttgctttacacattatattcgccacgggggagcagaggagactgaaaaagacagacatccccctcctgcagcgtctgcttcaaggtccctctgagaaaaatgccaggatattcctcatggacaaagacgctgaggagattagcagcgacgttgcacagtacattaacttccacttttctctgctggaatctatcttacagagacttaatgaggaagaaaaacgcgaaattcagaggattgtgaccaaatttaacaaagaaaaagccattattctaaagtgtctccaaaataaactggtgattaaaactgagacaaccgtgtag

SEQ ID NO: 131783 - DNA, 978 bp, Artificial Sequence
  Description of Artificial Sequence: Synthetic coding sequence
atgttgtgggaggagaccggtgctgcccccgcgcccgcgcgggcatctgacctcccctatcggattcattttctttcttcgggcttaatcctggtaacacgacagctgacagaagacgggaaactgattgtggaggggatgctggatattttttggggcgtgaaaaggcccattcagctgaaaatccaagacgagaaacccttttcaagctttaccagcatgaagtctagtgatgtattttccagtaagggcatgacgcggtggggagagtttgacgatctttatcggatctccgagttggatcgaactcagatccccatgtctgagaagaggaatagtcaagaggactatctatcttaccatagcaataccttgaaacctcatgccaaagacgagcccgattcacctgtgctctacagaaccatgtcagaggcagcgctcgtgcgaaaacgtatgaagccactaatgatggatcggaaggagagacagaaaaatagagcttcaatcaacggccacttctacaatcacgaaacatcaatcttcatcccagccttcgaaagtgagaccaaagtgagggtgaattcaaacatgcgtacagaggaggtgattaaacagctgcttcagaaatttaagatcgagaattccccccaggattttgccctgcatatcatttttgctacaggagagcaaaggcggctgaagaaaacggatattcccctgctgcagcgactacttcagggcccgagcgagaagaacgccaggatctttctgatggataaggacgccgaagaaatatcgtcagacgtggcacagtatatcaactttcatttctccctcctggaatctatccttcagcgactgaatgaggaagaaaaacgagaaattcagagaatcgtgacgaagttcaacaaagagaaggccatcattttgaagtgcctacaaaacaagttagttatcaaaacagagacaaccgtttag

SEQ ID NO: 131784 - DNA, 1110 bp, Artificial Sequence
  Description of Artificial Sequence: Synthetic coding sequence
atgctgtgggaggagaccggcgccgctcctgcccctgcacgcgcatctgaccttccatatcgcatttcttccgaccacctgaagaaagaggaaaagatgaccatgatggctcaccagtacccttcctggatttttatcaatgaaaaaactttcataaccagggagcaacttaacagcttgttgaaaacatacaacatcttctacgaaaatcagaagaatcttcatatcttgtacggtgagactgaagacgggaagctaatcgtggagggaatgctcgacatattttggggcgtaaagcgacctattcagttgaagatccaggatgaaaagcctttttcatcatttactagcatgaaatcctctgacgtttttagtagtaaaggaatgacaagatggggagaattcgacgacctctacagaatcagcgagcttgatcggacacaaatacctatgtccgaaaagcggaactcacaggaagactatctatcctatcacagcaatacactgaaacctcacgccaaagacgagcccgactctcctgtgctatacagaacaatgtcggaggccgctttggtgcgcaaacggatgaaaccactgatgatggaccgtaaggagaggcagaaaaaccgcgcaagtatcaatggccatttttataaccacgagaccagtatttttatcccggcattcgaatctgagacaaaagtgcgagtcaatagcaacatgagaacagaggaggtgataaagcagttactccagaagttcaaaattgagaattctccccaagatttcgcattgcacataatctttgcgaccggagaacagcggagactcaagaaaaccgatattcctctgctccagagactgctgcagggcccttctgaaaaaaatgctcgtatatttttaatggacaaagacgctgaagagatctcctctgacgtcgctcagtatatcaattttcacttctccttgttggagagcattctgcagcggctcaatgaggaggagaaacgagagatccaacgaattgtcaccaagttcaacaaagaaaaagcaattatcttaaaatgtcttcagaacaagctggtgataaagacagagactacagtctag

SEQ ID NO: 131785 - DNA, 912 bp, Artificial Sequence
  Description of Artificial Sequence: Synthetic coding sequence
atgacgatgatggctcatcagtaccctagctggattttcattaacgagaagaccttcatcacgcgcgagcagttgaatagcctcctcaaaacctataatatcttttacgagaatcagaagaatcttcacatattgtatggtgaaacagaggacggcaagttaatagtggagggaatgttggacattttttggggcgttaaacggcccatccagctcaagattcaagacgagaagcctttctccagcttcaccagtatgaaaagctccgacgtctttagtagtaagggaatgacaagatggggtgagttcgacgacttatacagaattagtgaactggaccgcacacaaattccaatgtccgagaaacgtaactcgcaggaggactacctttcctaccactcaaatacactgaagccccacgcaaaagacgaacccgactcacctgtgctttaccggaccatgagcgaggctgcactcgtgcgaaaaaggatgaagcccctgatgatggaccgcaaggaacggcagaagaacagggcttctattaatggtcatttttataaccacgagattgagaactccccgcaggacttcgccctgcatatcattttcgcaaccggcgaacagcgcaggttaaagaagaccgacatcccgctgttgcaacgtctcctgcagggcccctcagaaaagaatgccagaatttttctgatggacaaggacgccgaggaaattagctctgatgtcgcccaatatatcaattttcacttctctttgctggaaagcattcttcaaaggctcaacgaagaggaaaagcgtgaaattcaaaggatcgtgacgaagttcaacaaagaaaaggccatcatcctgaagtgcctgcagaataaattagtgattaagaccgagacaacggtttag

SEQ ID NO: 131786 - DNA, 3141 bp, Artificial Sequence
  Description of Artificial Sequence: Synthetic coding sequence
atgttgtcccgcacactaagttacaagtatcgcgatctggattcaactttctcctccctcggtgcaagtgatgacccagctgagctttcaactcaactaagcgcaccaggggtgttgaaagtgtttggagatagtgtctgtaccggaacgcactacaagagtgttctggccactggcacttcgagcgcaagagagctggtgaaggaggctctggagcggtacgcccttgacccccgccaggccggccagtacgtgctctgcgacgtcgtagggcaggctggggacgctggtcagaggtggcaagccaggtgcttccgcgtgtttggtgattccgaaaagcccctgctcatccaggaactgtggaagcccagagagggattgtcccggcgattcgagctacgaaagcgcagtgacgtcgaagaactggccgcgaaagaagtcgacacaattacagccggcattaatgcccaggccaggagactccagcgctctcgggccaaaggtacaccaactcccgccctcggagatgcgcgaagttccccaccaccacgcctgcgccgaacagttagtgaaacgtcgctcagccccgtgaatgccctgcccgccgcagctcaagggcctgaggagccgggaccagacgccatgaggtattccctgtatcagtccccgcatctgttactgctgcagggatactcgcagcagcacccaggcgtttgtgcgcagcctggccccgcccatggcgggcctgcggacccatcaaaacccagcatttccttatccgccccagacatacttcccctgcattgtacaattcgtcgacagccgttacccgattctggccaggcagccggcagattagtgttagagcccatacccggggcccacatttcagtgaatttcagcgaggtggggcatcgtaccgtggtgctacatcatggcgacttactctcactgggactctactatctgctcctctttaaggaccccgctcaggcccagcccctccctgctcgggccctggcaaggctccgcgccgtcccacagtcctgccggttgtgcggtgctgctctgggggcccgcggagccgccagtcccacgcaggccgcactgcccagacgtcagcagctgctgcttgagttcgaaccccacctagaagacaccctgttgcagcggattatgacgctgatcgagccagggggtgatgatcataaattaactcccgcttttctgctgtgcctgtgtatccagcattctgctacccattttcagcctggcactttcgggcagctgctgctcaagattgcgagactcatcagagaaacagtgtgggagaagaccaaagaactggccgaaaaacaagcacaattacaggaaccgatttcactggcctcctgcgccatggcagacctggtccctgatctgcagccaatcctgttttggatgtccaatagcattgagctcctgtatttcatccagcaaaagtgccccctgtatatgcagagtatggaggaacagctggacatcaccggctccaaggagtcactgttttcatgcaccctgacagcatccgaggaggctatggcggtgctggaggaagtggtgctgtacgcatttcagcagtgtgtctactatgttagcaaatctctctatatttgcctgccagcactgcttgagtgtccgccatttcagactgagaggagagaaagctggagcagtgcgcctgagttacccgaggaattacggagagtcgtgtccgtctatcaggctgcactggaccttcttcggcaactccaggtgcaccccgaggtcgccagccagatgctggcgtatctgttctttttttctgggactttacttttgaaccagttgctggatcgcggcccctccctgtcctgctttcactggccaagaggcgtgcaggcctgcgcgcgcctccagcagctgctggagtggatgcggtccgctggcttcggcgcagccggcgaacacttctttcagaagctctcatgtaccctgaatctgctggctacaccgagagcgcaactgattcagatgagctggactgcgctacgagcagccttccccgcattgtcacctgcacaactccatcgacttctaactcactatcaactcgccagtgccatgggtccaatgagcacttgggagccgggagcccaggacagcccagaggcctttcgttcggaagatgtgttagagagctacgaaaatccacctcctattgtgctgccatctgacgggttccaggttgacctggaagcgaactgtctcgacgattctatctaccagcatctcctgtacgtgaggcactttctctggggcctgcgctctagagcatcacccgggagccccggccggccgggctccggcgcttcacagcccgtgtgccctgaaggcatgcatcacgttgttttagatggacacctagaggcccccagttgccctctggctccacgggaccccggcccagccgcacgggaagtcgcaccagagaggacactgcccctccggggtgcgccatgggcccaggccccacccggcaggcagccatctcgggggggaagccaggccggcccccctcatacagatagcagttgtctgctgactccccctagcacccctctcggacccgaacctggcgatcctgattggcctgagagcggcggtccgtgcggaaaggcactacctgagagacaacgaaatggcttgtccggtctgcgaggggctgctccagaaggagattcggcagctctggccgaggaaagccctcccgctccttcttcaagatcgtcttcaactgaggatttttgttatgtttttacagtggagcttgagcgaggcccgtcggggctgggtatgggcctgatcgatgggatgcacactcacttgggagcaccaggcttgtatattcagacccttctgcccgggtctccggctgccgctgatggacgcctgtctctaggagataggatattggaagttaatggcagcagcttacttggtctgggctacctgcgggcagtagacctgatcagacacggtggcaaaaaaatgcgcttcctggtcgcgaagagcgacgttgagaccgctaaaaaaatccactttagaacacctccattgtag

SEQ ID NO: 131787 - DNA, 3228 bp, Artificial Sequence
  Description of Artificial Sequence: Synthetic coding sequence
atgttttacgggacccactttataatgtcaccccccacaaaatctaaattaaagcgacaaagccaactgctctcttcaatgttatccaggacattgagctataaatatagggacctggactccacattctcctccctcggtgcttccgacgacccggccgaactgagcacacaactgtctgctccaggagtactgaaggtgttcggcgattccgtgtgtactggcacacattacaagagtgtgctcgccaccggtactagttctgccagagagttagtcaaagaagcacttgaaagatatgccctggatcctagacaggctgggcagtatgtcctctgtgatgtggtgggacaggccggggacgcaggccaacggtggcaggcaagatgctttagagtattcggagacagcgaaaaacctcttttgatccaggagctgtggaagccacgtgaaggtctgtctcgcagattcgagctaagaaagagaagtgatgtggaagagcttgctgcaaaggaagtggacactatcaccgctgggatcaatgcccaggcccgcaggctccagagaagccgggccaagggtacccctaccccggccctgggggatgcaagatcgagtccacctcctcgtcttagacgaaccgtgagcgagacatctctgagcccggttaacgctctgccggctgccgcccagggaccagaggagccgggcccggatgcaatgaggtactccctgtaccaatccccacatctgctgttactccagggatattctcagcaacatgattccctcgtgtatgttctcaaccgcgatcggcacactgtgggacagcggacaccaagctcaaaaccgtccatttcccttagcgcccctgacatactcccactccactgtacaatccgacgccagcctctgcctgacagcggccaagccgccggaagacttgtgctggagcccataccaggtgcacacattagcgtaaacttttctgaagtgggacaccggacagtggtcctgcaccatggtgatcttctttcactgggcctctattacctcctgctctttaaggatccagcccaggcccagccactgcctgcccgggcacttgcgaggctgagagcagtgccacagagctgccgcctctgcggagccgcactcggggccagaggcgccgcctcacctacacaagcagctttgccaagacgtcaacagttactgctggaattcgagcctcaccttgaggatactctgctccagagaatcatgaccctgatcgagcctggtggtgatgatcataagctgaccccggcttttctgctgtgcctttgtatacagcatagcgcaacacattttcagcctggaacattcggacaacttcttctgaagatcgccagactaatccgagaaacagtctgggagaagaccaaagagctagcagaaaagcaagcacagctgcaggaaccaatttccctggcatcctgtgccatggcagaccttgtgccggatctgcagcccatcctgttttggatgtctaattccatcgaattgctatacttcatccagcaaaaatgccctctctacatgcaatctatggaggaacaactcgacatcaccggatctaaagaatcgctgttttcatgtacacttactgcaagcgaagaagccatggccgtgcttgaagaagttgtcctctatgcctttcagcaatgcgtgtattatgtcagtaagtccctgtacatttgcctgcccgcacttctcgaatgcccaccatttcaaaccgagcggcgcgagtcatggagttccgcccctgaattgcccgaagagctgagaagagtcgttagtgtctatcaggccgctctcgacctgctcaggcagcttcaggtgcatccagaggttgcatctcagatgctggcctatctattctttttcagcggaacactgttgcttaaccagctgcttgatagaggaccaagcttgtcctgcttccattggccacgaggggtgcaggcttgtgcgagattgcagcagttgctggaatggatgaggtctgccggcttcggcgccgccggcgagcacttctttcaaaaactgtcatgtactctgaacctactggctacaccccgggcacagctgatacagatgagctggactgcactcagggcagcgttcccagcactcagccccgcgcagttgcatagactcttgacacactatcagctagcctccgctatgggtccaatgtcgacttgggagccaggtgcgcaagacagccccgaggcctttagaagcgaggatgtgctcgaaagctacgagaatccccctcccatcgtgttaccctccgacggctttcaggtggaccttgaagccaactgccttgacgatagcatttaccaacacctgctgtatgtgcggcattttctatggggcctgagatccagggcttctcccggtagtccaggcagacccggaagcggcgcaagccagccggtttgcccagagggcatgcaccatgtggtgttggacggacatctcgaggcaccttcttgtccactggccccaagagatccagggcctgccgctagggaggtcgcacccgaacggacactgcctctgcggggggcaccatgggcccaagccccacccggccggcagcccagccgcggtggaagtcaggccggccccccccatactgactcttcctgccttctgacaccaccctcaacaccattaggcccagaaccaggggaccccgactggccagaatcaggtggcccttgtggaaaagccctccccgaacgccagcgcaatgggctgagtggattaaggggcgccgccccagagggcgatagcgcggcgctggccgaagagtctccgcctgccccaagttctaggtcttcttcaacagaagacttttgctatgtgttcacagtcgaacttgaaagaggtccttctggccttggaatgggacttatcgacgggatgcacacccacctgggagccccaggtctctatatccagacactgctcccaggctcaccagcggccgctgatggccggctgagtttaggtgatcgtatcctggaggtcaatggatcctccctattggggctcgggtaccttcgggccgtcgaccttattcgccacggcggcaaaaagatgcggttcctggtagccaaatccgacgtggagacagccaaaaagatccatttccggaccccgccactgtag

SEQ ID NO: 131788 - DNA, 405 bp, Artificial Sequence
  Description of Artificial Sequence: Synthetic coding sequence
atgttttatggaactcattttatcatgtctccaccaacgaagagcaagttaaagcgccaaagtcagcttttgtcctcaatgttaagcagaacattgtcctacaaatacagagacctagattcgaccttctctagtctaggggctagcgacgatcccgcggagctctctacacagttgtccgcccctggagtgctaaaagtctttggggatagcgtttgtaccggcactcactataagagcgtgctggccaccggcacctcctctgcacgagaactggtgaaggaggccctggagcgctatgcacttgacccccgccaagcaggccagtatgtgctgtgcgacgtggtaggacaggcaggagacgccggccagagatggcaggcgagatgttttagggtgttctag

SEQ ID NO: 131789 - DNA, 1629 bp, Artificial Sequence
  Description of Artificial Sequence: Synthetic coding sequence
atgttttacggcactcatttcattatgtccccccccacgaaatctaagcttaagagacagtcccagctgctgagcagcatgttgtcccgaaccctgagttacaagtatcgagatctggactcaactttcagctctttaggggcctcagacgatccagctgaactgtcaacccagctgagcgctccaggagttctcaaggtgttcggcgactccgtgtgtactggcacacattacaaaagcgtgctggccactgggacatcgagcgccagggagttggtcaaggaggctctggagaggtatgcactggacccaaggcaggccgggcagtacgtgctgtgtgatgtcgtagggcaggccggagacgcgggacagcggtggcaggcacgatgctttagagttttcggggatagcgagaagcccctcctgatacaggagctctggaagccccgggaaggactatctcggcgatttgaactgcgaaagcggagcgatgtggaagagcttgcagctaaggaagtggataccatcaccgctgggattaatgctcaggccaggaggctgcaacggtcccgggctaaaggtacacccacccccgccctcggagatgctaggtcatctcctccgccaagactgcgaagaacagtaagcgaaacatctttgtccccggtgaacgcgctccctgctgcagcccaggggcccgaagaacccgggcccgatgccatgaggtacagcctgtaccagtctccccatctgctgctcctgcaggggtatagtcaacagcacgattcactggtgtacgtgctgaaccgcgatagacatactgtcggacaacgcaccccatcttctaaaccctctatctctctatctgcacccgacattctacctctccattgtactatcaggcggcagccgctcccagattcagggcaggccgcagggcgcctcgtgctggaacccatccctggggcccacatttctgttaacttcagcgaagtaggccatagaactgtggtcctacaccacggtgatctgctgtcgttggggctttactatcttttgctttttaaagatccagcccaggcacagcctctcccggccagagccttggcccgactccgtgcggtcccacagtcctgtagactctgcggcgccgccctgggcgcccgtggagcagcatctcccacacaggcagccctgcccaggagacaacagctgctgcttgagtttgagccacacttggaggacacattgctacaacggatcatgaccctgatcgaaccaggtggcgacgaccacaaacttaccccagcatttctgctgtgtctctgcatccagcacagtgcaacccatttccagcccgggacattcggacaattgctgctcaagattgctcgacttattcgggaaactgtctgggaaaagaccaaggagttagcggagaaacaggcacaactcttggagggcattgctgttttgctccatgcggatggccagcggggcgggcatggtggagctgggggcgggggtgcagttcgcttgcctgccgtgcgactactttgcctacaagtgcctgtgcatctgccaccaggtaccccaggcgttccagctatccccgacggcgccccctag

SEQ ID NO: 131790 - DNA, 2508 bp, Artificial Sequence
  Description of Artificial Sequence: Synthetic coding sequence
atgcgatatagtctgtatcagtcaccccacctgctgctgctgcaagggtacagccagcagcatgacagcctcgtgtatgtgttgaaccgagacaggcacacggtgggacagcggactccctcctccaaaccaagcattagcctgtccgcccccgatatcctgcctcttcattgcacaatcagacggcaaccactgcctgactcaggacaggctgctggcagactggtccttgagcctattcccggtgctcacatctcagtgaatttttcagaggtcgggcacaggactgtggtgctccaccacggcgatttgttatctctgggcctgtactacctgctcctgttcaaggaccccgcccaggcacagccacttcccgcgcgggctctggcccggctgagggccgtgccacagagttgcaggttgtgtggtgccgctttaggagcacggggcgccgctagtccgactcaggccgcgctgccacggcgacaacagttactcttagagttcgaaccacacctcgaagacactctattgcagcgtatcatgaccctgatagaacctggcggggacgaccacaagctaacaccggcattccttctgtgtctctgtatacaacacagtgccacacatttccagccaggaacgtttggacagctactgctgaagatcgctcgtcttattagggagaccgtgtgggagaaaaccaaggagctggcggagaagcaggctcagctccaggagccaatcagcctcgcctcctgtgccatggctgacctggtgccagacctccagcctatcctcttctggatgtcaaactccattgagcttctttattttattcaacagaagtgccctctatatatgcagagtatggaggaacaactggatattactggatctaaggagagtttatttagctgtaccttgactgcttctgaagaagccatggccgtcctggaggaggttgtcctgtacgcctttcagcaatgtgtttactatgtgagcaagtctctgtacatttgccttcctgccttactagagtgccctccctttcagaccgagcgcagggagtcctggtcatcggcacctgagttgcccgaagaactcagacgagttgtgtccgtctaccaggcagccctggatcttctgcggcagctacaagtgcacccagaggtcgcctcccagatgttggcctatttgttctttttttccgggactttactattaaaccaacttctggacagagggccgagtctttcgtgctttcattggcccaggggagtccaggcctgcgcgcgcttgcagcaactcttagaatggatgagaagtgccggatttggggctgccggtgaacacttcttccagaagctgagttgcaccttgaacctgttggcaactccccgagcacaattaatccagatgagctggactgccctgcgggctgcatttcccgcactgtctcctgcccagttgcatcggctgctgacacactaccaactggctagtgccatgggtccgatgagcacatgggagccgggagcccaagacagcccggaggcatttcggtctgaggacgtcctggaatcatacgagaacccgccgccaattgttcttccttcagatggattccaggtggatctggaggcaaactgcttggacgatagtatttatcagcacttgctgtacgtgcggcacttcctctggggactccggtcacgagcttccccaggatctcctggacggccggggagcggagcctctcaacccgtttgtccggaaggaatgcatcacgttgtgctcgatgggcatctagaggcacctagttgccctttagcaccccgagatccaggccccgccgcccgagaggttgcacccgagaggaccctccccctcaggggggctccgtgggctcaggccccccctggtcggcagccgtcaaggggaggaagccaggcagggccaccccataccgacagttcttgcttgctcacaccccccagcaccccgctagggcctgaaccaggagacccagactggcccgaatctggcggaccatgcggcaaagcgttgccagagcgtcagagaaacggattgtcggggctgcgcggcgcggcccccgaaggagactcggcagccctagccgaggagagccccccagcccctagttcacgatcttcttccacggaagatttttgttatgtctttaccgtggaacttgaaagaggcccctctggtctgggaatgggccttattgatggcatgcatactcacttgggcgcaccaggcctgtatatccagacccttctgccgggttcgcccgccgccgccgatgggagactctcattaggagatagaattctcgaggtgaacggttcatctctgttgggactcggatacctgagagccgtggatctcatccggcatggaggtaaaaaaatgcggtttctcgtggcgaaatctgacgtggagacggctaaaaagatccattttcggaccccacctctgtag

SEQ ID NO: 131791 - DNA, 2085 bp, Artificial Sequence
  Description of Artificial Sequence: Synthetic coding sequence
atgtgctccactggaacaggcactcgctgggccagcggcccaccaccggcctcaccagcctcagctagtcagcctccaacctcctgcctctatacagctcccagcgccggtaacaggtcacgaacggccgcgcggcctcgaggcgggtggttagaacctatacctggggctcacatttccgtcaacttttccgaagtgggacataggacggttgttctgcaccatggagatctcttgtcccttggcctctactaccttctcctgttcaaggaccccgctcaggcccagccactgcccgcccgtgcattggcccggctccgcgcagtgccacagtcttgcagactatgcggggccgctttaggcgcacgtggtgccgcatcccctactcaggccgctctgccgcggcggcagcagctcttattagagttcgaaccccacctcgaagacaccctccttcagcggatcatgacgctcatcgagccaggcggggatgaccataagttgactcccgcctttctcctgtgtctgtgtatccagcatagtgccacccattttcagcccggtacctttgggcagcttcttttgaaaatcgcccgattgattagggagactgtctgggagaagaccaaggaactggctgagaagcaggcacaacttcaagagcctatctcacttgcctcttgcgcaatggctgacctggttccagacctccagcctattctgttctggatgtctaattcaatcgagctcctttacttcattcagcagaagtgtcctctctacatgcagtccatggaggaacagctggatatcacggggagcaaagaaagcctgttcagctgcacactgacagcttccgaggaagccatggccgtactagaagaggttgtgctgtacgcgttccagcagtgcgtctactacgtgtctaagagcctctatatttgcctccctgcactgctggaatgcccgcccttccagactgaacggcgggagagctggtcgagtgcccccgaactgccagaggaactgcggcgtgtagtatctgtataccaggctgccttggacctgctgcggcagctccaggttcacccggaggtggcctcccagatgttggcctacctgttctttttttctggtactctcctgcttaatcagctgctggatcgcggtccctcactctcttgttttcactggcccagaggagtgcaagcttgcgctcgactccaacagctgctggaatggatgcgatcagctggttttggtgccgccggggagcattttttccagaaactttcatgcaccttaaatcttttagccacaccccgcgctcagcttatccagatgtcatggacagccctgagggcggccttccctgccctgtcacctgcgcagctgcacagactgctgacccactatcagttggctagcgccatggggcccatgtccacttgggagccgggcgctcaggactcgcctgaggccttcaggtctgaagatgttctggaaagctatgagaacccaccacctatagtcctgcccagtgacggatttcaggtagacctcgaggctaattgcttagacgactccatctaccaacacctcctgtatgtgagacacttcctatggggtctcagaagtcgggcctcccccggcagcccaggccggccgggctccggcgcaagccagcctgtctgtcccgagggcatgcatcatgtggtactggatggtcacttggaagccccgtcctgccctttagctcccagggatcccgggccggccgcgcgcgaggtcgctcccgagcggactctaccgttacgaggggctccatgggcacaggctccgccagggagacagccaccagggctctatatccagacacttttgccgggatctcctgccgctgccgacgggcgactgtccttgggggaccggatcctggaggtcaacggtagctcgctgttaggattaggctatctgcgagcggtggacctgatccgccatggcggaaaaaaaatgagattcctcgtggctaagtccgatgtggaaactgcaaagaaaattcattttcgtactccacctctgtag

SEQ ID NO: 131792 - DNA, 369 bp, Artificial Sequence
  Description of Artificial Sequence: Synthetic coding sequence
atgaagttggccgccatgatcaagaaaatgtgtccaagcgattccgaactcagcattccggccaagaattgttaccgtatggtgatcttaggtagcagcaaagtgggaaaaactgctattgtgtccaggttcttgaccggcaggtttgaggacgcatacacacctacaatcgaggacttccatcgaaaattctattcgatccgcggagaggtgtaccagttggatatactggatacctctggcaaccacccatttccggctatgagacgtctgtctatcctgacagatccccgccaccaagtactgccacaggagcagaatcagggagagaggggacgggcacctggccaccttcgacagcaggggtag

SEQ ID NO: 131793 - DNA, 2394 bp, Artificial Sequence
  Description of Artificial Sequence: Synthetic coding sequence
atggggacactgggaaaggctagggaggccccgcggaagcctagtcacggatgccgagccgcctcgaaagccaggctggaggccaagcccgccaatagccccttcccatcccacccctcactagctcatatcacccaattccgaatgatggtttcactgggtcatctcgcaaagggcgcaagcttggatgatctcattgacagctgtattcaatccttcgacgctgatgggaatctttgtcgcagcaatcagcttttgcaggtgatgctaaccatgcatcggatcgtgatttcgtccgccgagctactccagaaggtgatcaccttgtacaaggatgccctagctaagaattcccccggcctctgtttaaagatctgctacttcgtgcgatactggattactgaattctgggtaatgtttaagatggacgcctccctgaccgatacaatggaggagtttcaagagcttgtcaaggctaagggcgaggagctgcactgccgtttgattgacaccacacagataaatgcccgcgactggtctcgcaaattgacccagcgcataaagagcaacacgtcaaagaaaaggaaggtgtctctactattcgaccatctggaacccgaggagctatcagagcacctgacctatcttgagtttaaatcgtttcggcgcataagtttcagtgattaccagaattacttggtaaactcttgcgtgaaggagaaccccaccatggagcggtcgattgctctttgtaatgggatctcacagtgggttcagttgatggtactgagtcgccccacgccccagcttagggctgaagtcttcattaaatttatacaggtggcgcagaaactgcatcagttgcagaacttcaatactttaatggctgtgatcggaggattatgtcattcctcaatcagtcgtctgaaggaaacaagtagccacgtcccacacgagatcaataaagtcttgggcgagatgaccgagctactgtcttcttcacgaaactacgacaactacaggagggcatacggagaatgcacggacttcaagatacctatcttgggtgttcatctgaaggacctgatttccctttacgaagctatgcccgattatctcgaagacggcaaggtgaatgtgcacaaacttctggccctatacaaccacatttccgagctagttcaattacaggaggtagccccccctctggaggcaaacaaggacctggtgcacttactgacccttagcctggacctttactatactgaggacgagatctacgagttgtcctacgcacgagagccgagaaatcacagagccccacctcttaccccaagcaaaccccccgtggtggtggactgggcctccggagtgagccccaagcccgatcccaagactatctccaagcacgtccagaggatggtcgacagcgtttttaagaattacgaccacgaccaagacgggtacatttctcaggaggaattcgagaaaatcgccgctagtttccccttttccttttgcgtcatggataaggacagagaaggcctcatctctagagacgaaatcactgcatactttatgcgggcatcatcgatttatagcaaactcggcctcggtttcccgcataatttccaggaaactacataccttaaaccgaccttttgcgacaactgcgctggattcctctggggggtgatcaaacagggatataggtgcaaagactgcggaatgaattgccacaagcagtgtaaggatctcgtcgtgtttgagtgtaagaaacgggccaagaacccagttgcccccaccgagaataatacatccgtgggcccagtttccaatctttgttccctaggagctaaggatttactccacgcgcctgaggaagggcctttcaccttccccaatggagaagccgtcgagcatggagaggagagtaaggacaggaccattatgctcatgggcgtgagctcccagaaaatctcactaaggctcaagcgcgcggttgcacacaaggccacacaaaccgagagccagccttggatcggaagcgagggacccagtggccctttcgttcttagctcgcccaggaagacggcgcaagatactctgtatgtccttccaagcccaacctccccatgcccaagcccagttttggtccgcaaacgcgcctttgtgaaatgggagaacaaagactctctgatcaagtcaaaggaggagctacgccatctccggctgccgacataccaggagctggagcaggagattaacacactcaaagcagacaacgatgcgttaaagatccagcttaagtacgcccagaagaagatagagtctctgcagctggagaagagcaaccatgttctcgcacaaatggagcagggagattgttcatag

SEQ ID NO: 131794 - DNA, 1794 bp, Artificial Sequence
  Description of Artificial Sequence: Synthetic coding sequence
atgggcacactgggcaaagccagggaggcccctagaaagccaagccatggttgccgagccgcctccaaggcccgtctggaggcgaagccggcaaattctccttttccgtcccatcccagcctcgcacacattactcagttccgaatgatggtcagtctcggacacctggctaaaggagccagcctggacgacctcatagacagctgtattcaatcctttgatgctgatggcaacctgtgtcgttccaaccaactgttacaggttatgctcactatgcaccgcatagtgatcagctcagccgagctgttgcagaaagttattactctataccccgatgcattagccaaaaacagtcctggtctatgcctgaagatttgctactttgtgagatactggataacggaattttgggtgatgttcaaaatggatgcgtccctgacagacacaatggaggagtttcaggaactcgtcaaagcgaaaggtgaggaactgcactgtcgcctcattgacaccactcagattaatgccagagattggagtagaaaactcacacagagaataaaaagcaatactagtaaaaaaagaaaggtgtccctcctctttgatcacctcgaacctgaagagctgagcgaacacctcacatacctggagtttaaatccttcaggaggatttcattttctgactaccagaactacctggttaatagttgcgtgaaggagaatcccactatggagcgctcaattgcactctgcaatgggataagccagtgggtgcagctgatggttctgagtcgacccacaccccagctccgtgctgaagtttttatcaaattcattcaagtggctcagaagttgcatcagttgcagaatttcaacaccttgatggcagttatcggcggcctgtgccactctagcatttccaggctcaaagagacttccagccatgttccccacgagatcaacaaggtgctcggagagatgactgagctcctgagttcatcacgaaattatgacaactaccggagagcttatggcgagtgcactgattttaaaatcccaatactcggcgtccacctcaaggatctgattagcctgtatgaagccatgcctgactatttggaagatggcaaagtcaatgttcacaaactcctggctttgtacaaccacatctccgaactggttcagttgcaggaggtggcccccccacttgaggccaacaaagacctcgtgcacctgctgactctttcattggacctgtactacaccgaggacgaaatatacgagctctcctacgcaagagaaccccgcaatcacagggctcctagtgtgtttaaaaattacgaccacgatcaagacggatatatttcccaggaggaattcgaaaaaattgccgcaagcttcccattctccttctgtgtgatggacaaagatagggaaggcttgatcagcagagacgagatcaccgcctactttatgcgcgcatcatctatttacagtaagctgggacttggcttcccccacaacttccaggagactacttacctgaagcccacgttctgtgacaactgtgcaggatttctgtggggcgtcattaagcagggttaccggtgtaaagactgcggaatgaattgtcataaacagtgcaaggacctggttgtgtttgaatgtaagaagagagcaaagaatccggtagcccccactgaaaataatacatccgtggggcccgtgtctaacctgtgctcccttggcgccaaagatctattgcatggaaacaaatattctgaatcacgctag

SEQ ID NO: 131795 - DNA, 1641 bp, Artificial Sequence
  Description of Artificial Sequence: Synthetic coding sequence
atggggacattgggcaaagcacgagaggctcctcgcaagccatctcacgggtgtagggctgccagtaaggcccggctggaggcaaagccggctaattctccatttccgagccacccaagcttggcgcacattacacagttcaggatgatggtttcattaggccacctggcgaaaggggcatctctggacgacttgattgacagctgtatacagtccttcgacgcagatggaaacctctgtcggagtaatcaactcctccaagtgatgctgaccatgcatcgcattgtaataagctctgctgaacttctccagaaagtcataactctgtacccagacgcgctggcaaaaaatagcccggggctgtgcctcaagatctgctacttcgtgcggtactggatcaccgagttttgggtcatgttcaagatggatgcaagtctgactgacactatggaggaattccaggaactcgtgaaagccaagggagaagaactgcattgtcgcctaatcgatactacacagatcaacgctcgcgattggtcacggaaactgactcagaggattaagagcaacactagtaaaaagaggaaagtttcactcttgtttgaccatctggagccagaagagctgtcagagcacctgacctaccttgagtttaagagctttcgccgtatctccttttcagactaccagaattaccttgtgaactcctgcgtgaaggaaaaccccacgatggagagatccatcgccttgtgcaacggcatatctcagtgggtacagctcatggttttatcccgcccaacgccacagttgagagccgaagtgtttattaagtttatccaagtggcccagaagctccaccaactgcaaaattttaataccctgatggccgtcatcggcggtctgtgccactccagtataagtaggcttaaggagacgtctagtcacgttccccacgagattaacaaggttttaggggaaatgacagagttactgtccagctccagaaattatgataactatcggagagcctatggggaatgtacagacttcaaaattcctattctgggagttcatctgaaagatctgatttctttatacgaggcaatgccagattacctggaggatggtaaggtgaatgtgcacaagctgctagctctgtataaccatattagcgaactggtgcaactccaggaggtggcgccgccactagaagctaacaaagacctggtgcacttgctgacattgtctctggacctgtattatacggaggatgagatatatgagctgtcatatgcgagggaaccaagaaatcacagagcacctagcgtttttaagaattatgatcacgaccaggacggctacatctcacaggaagaattcgagaaaatcgcggcatcattccctttctctttttgtgtcatggataaagaccgagagggcttgatctcaagggacgaaattacggcttacttcatgcgggcttcttccatctacagcaagctagggctgggtttcccacataactttcaggagacaacgtatctcaaaccaacgttttgtgacaattgtgctggattcctgtggggcgtgatcaagcaagggtacaggtgcaagggaaataagtattcagagtcgcggtag

SEQ ID NO: 131796 - DNA, 2289 bp, Artificial Sequence
  Description of Artificial Sequence: Synthetic coding sequence
atgggcacgttaggcaaagctcgggaagctcccagaaaacccagtcatgggtgccgcgccgcaagcaaggcccggcttgaggccaaaccagctaatagcccttttccatctcaccctagtttagcccatatcacgcaattccgtatgatggtgtctctgggtcacctggcaaagggggcctctctcgacgacctgatagattcctgtattcagtccttcgacgccgacggtaacctgtgccgaagtaatcaattactacaggtgatgcttacgatgcatagaattgtgataagctccgctgagctgctccagaaggttattacgctatacaaggatgcactggccaagaactcaccaggtctgtgcctgaagatttgctactttgtgcgttactggattaccgagttctgggtaatgtttaagatggacgcctctttaaccgacactatggaggagttccaggaactggtgaaagccaagggagaggagctgcattgccgattgatagacacaacacagattaatgcccgcgattggtcccgcaagctgacccaacgaatcaaatctaacacctccaaaaagcgcaaagtctctctcctcttcgatcatttggaacccgaagagctgtcggagcatctgacctatctggaatttaaatccttccgtagaatctccttctccgactaccagaactaccttgtcaactcttgtgtcaaggaaaaccccactatggaacgatcgatcgctctctgtaatggtattagccagtgggtccagttgatggttctttcccggcccactccccagttaagagccgaagtgtttatcaaattcattcaagtggcccagaaactgcatcaattgcagaatttcaataccttgatggcagttatcgggggcctgtgccactcaagtatttccagattaaaggagacctcctcacacgtaccccatgaaattaacaaggtgctgggagaaatgacggagctgttatcctcatcccggaattacgacaattatcggcgggcatacggcgagtgtacagactttaaaattccaatcttaggtgtgcatttgaaggacctaatctccctgtacgaggctatgccagattatcttgaggatggtaaggtcaatgtccataaactgctggcattgtataaccatatttcagagctggtacagctgcaggaagtggctcccccattggaagctaataaggatcttgtgcacctactgacactgtcccttgacctgtactatacggaagacgagatttatgagctttcttacgcgagagaaccaaggaatcacagggcaccgtccgtcttcaagaactacgatcacgatcaggatggttatatctctcaggaggagtttgagaagatcgcggcctctttcccattcagcttctgcgtgatggacaaagacagggaaggtcttatttcccgggatgagatcaccgcctactttatgcgtgccagttctatctacagcaaactgggacttggattcccccataatttccaggagactacatacttgaagccaacattctgcgacaattgcgctgggtttctgtggggcgtgataaagcagggatatcggtgcaaggattgtgggatgaattgccataaacagtgcaaggatctagtggtgttcgagtgcaagaagagagcaaaaaatcccgttgcccccacggagaacaacacttctgtgggccccgtgtccaatctttgtagtttaggagccaaggacttactgcacgccccagaagagggacccttcacatttccaaatggtgaagccgttgaacacggcgaggagtctaaggaccggaccattatgctgatgggggtctcaagccaaaagatttctctcaggttgaaacgagcagtagcacacaaagcaacccagactgaaagccagccttggatcggatccgagggcccttctggcccgttcgttctgagcagccccagaaagactgcccaggacacgctttacgtgcttcccagcccaacatccccatgtccttcccccgtgctagtgcggaaacgtgcatttgtcaaatgggagaacaaagacagtcttataaaatctaaggaagaactccgacacctgcggttgccaacctaccaggaattggaacaggagatcaacacacttaaggcagacaacgatgccctaaaaattcaactcaaatacgcgcagaagaagatcgagtcacttcagctggaaaaatccaatcatgttctggcccagatggagcagggggactgctcgtag

SEQ ID NO: 131797 - DNA, 2250 bp, Artificial Sequence
  Description of Artificial Sequence: Synthetic coding sequence
atgatggtgtcgctcggtcacctggccaagggcgccagcctggatgatctgattgattcctgtatccagagctttgacgcagacggtaatctgtgccggagtaatcagctcttgcaagtaatgctgactatgcaccggatcgtcatctcatctgcggagcttctccagaaggttattactctttataaagacgcactcgcaaagaattctccaggattgtgcctcaaaatctgttattttgtgagatattggatcaccgagttttgggtgatgttcaagatggatgcgagtctcaccgacacgatggaggaatttcaggagctcgtgaaggcaaaaggggaggaactacattgccgcctgatcgatacgactcagattaatgccagagactggtctagaaagctcacacaacgcattaaatctaacactagtaagaagcggaaggtctctctcctctttgatcatctggagccagaagaactctctgagcacctcacctaccttgaatttaaatcgttcagaagaataagcttcagcgactatcagaactatctcgtcaatagctgtgtgaaggagaatccaaccatggagcgcagcatcgctctttgtaatggaatcagccagtgggtgcagctgatggtcctgagcaggcccacccctcagctaagggccgaagtgttcataaaattcatccaagtcgctcagaaattgcatcagttacagaatttcaatactttgatggcggtgatcgggggtctatgccactcaagcatttcaaggctcaaagaaaccagcagccatgtgcctcatgaaattaataaggtattgggtgagatgacggagctgctgagctcctctcgaaactacgataactaccgacgcgcctatggagagtgtactgacttcaagatacccatcctgggcgtccatctcaaggatcttatttcactctatgaggcaatgcccgattacctagaagacggtaaagtcaacgtacacaaactgctcgccctctataatcacatatctgaactggttcagctgcaggaggtggcaccaccgcttgaggccaacaaggatttggtccatctgctcacgctgagcctggatctgtattacacggaggatgaaatctacgaactgtcgtacgcgcgcgaaccaaggaatcaccgagccccacctctaacccctagcaagcctccagtcgtggtggactgggcttctggggtgtccccaaagcctgaccccaagacgatcagcaagcacgtgcagagaatggtcgatagcgtgttcaaaaactatgaccacgaccaggacggctacatctcccaagaagagtttgaaaagatagccgcttccttccccttttccttttgcgtcatggataaggacagggaaggcctgatctctagggatgaaatcaccgcgtatttcatgagagcttccagcatctatagtaagctaggtctcggatttccacacaactttcaagaaaccacctacttgaagcctaccttctgtgacaactgtgccggtttcctctggggagtgatcaaacagggatatagatgcaaagactgcgggatgaattgccacaaacagtgtaaagaccttgtggttttcgagtgcaagaagcgcgccaagaatccggttgcgccaactgaaaacaacacgtcagtgggtccggtttccaacttatgctccttaggcgcaaaagatctgcttcacgcccccgaggaaggcccctttacttttccaaatggggaggcagtcgagcacggtgaggagagcaaagatagaacgattatgctgatgggcgtttcaagccagaaaatctccctacggctgaagcgcgcagttgcccataaggccactcagacagaaagtcaaccatggatcggctcagagggcccttcaggaccattcgtcctgtccagtccgaggaaaacagcgcaagacaccctgtatgttttgccgtcacccacctccccctgtcccagcccagtcctcgtgcgaaagagagcgttcgttaaatgggagaataaagatagccttataaagtcaaaggaggaattaaggcacctgagacttcccacatatcaggagctggagcaggagattaatacgctgaaagccgataacgacgccctgaagatccagctcaaatatgcccaaaagaagattgaaagcctccagttagagaaatccaaccatgtccttgctcaaatggaacagggtgactgcagttag

SEQ ID NO: 131798 - DNA, 1446 bp, Artificial Sequence
  Description of Artificial Sequence: Synthetic coding sequence
atgggaaccctgggcaaggcccgggaggctccccgcaagccgtcacatgggtgccgcgctgcatccaaagcccgcctggaggccaagcccgccaacagtccatttcctagccatccaagcttagcccatataactcagttccggatgatggtgtctcttggtcacctggccaagggtgctagtctggacgatctgattgattcctgcatccagagctttgacgcggacgggaatttgtgcagaagcaaccagctcctccaggtgatgctgacgatgcaccgaatcgtaataagctctgctgagcttctacaaaaggtgatcactctatatcccgatgccttggcaaaaaactcaccgggactatgcctgaaaatttgttacttcgtcaggtactggattaccgaattttgggtcatgttcaagatggacgcttccttgaccgataccatggaagaatttcaggagctcgtcaaggccaaaggggaagagctgcactgcaggttgatcgacacaactcaaataaacgctagggactggagccgcaaacttacccaacggataaagtctaatacctctaagaaacgaaaggtgtcactgctttttgaccatttagaacccgaagagctctctgagcatcttacatatctcgagttcaaaagcttcagaaggatctcatttagcgattatcagaattatctggtgaattcatgtgttaaagagaatccaaccatggaacgatccattgcattgtgcaacggtatttctcagtgggtgcagttgatggtgctatcccgcccaactccacagctgcgagctgaggtctttatcaagttcattcaagttgcacagaagctccatcagcttcagaactttaatacgctaatggctgtgatcggcggactgtgccacagctctatcagcaggctgaaggagacctcctcccatgtgccacacgagatcaacaaagtgttaggggagatgaccgaactgctgagcagcagccgtaattatgacaattatcgacgcgcttatggtgagtgtactgattttaaaatccccatcctcggagtgcatctgaaggacctaatctctttatacgaggcgatgcctgactatctggaggatggaaaagttaacgtccacaaactgctcgctctttacaatcacataagcgaacttgttcagctccaggaagtcgccccccccctagaggccaacaaagacttagtccacctcctgaccttgtcgttagacctctattacacagaagacgagatctacgaactgtcctacgccagggaaccccggaaccatcgggccccttccgtgtttaaaaattatgatcacgatcaggacggctacattagccaggaggagttcgaaaagattgccgcatcttttccctttagcttctgcgtcatggacaaggaccggtctggcgcttag

SEQ ID NO: 131799 - DNA, 1641 bp, Artificial Sequence
  Description of Artificial Sequence: Synthetic coding sequence
atgggcactctcgggaaagcaagggaagccccaaggaaaccaagtcacggatgtcgtgctgcatccaaggcacgtctcgaggccaaacccgccaatagccccttccccagccatcccagcctggctcacataacacagtttcggatgatggtaagtctgggccacctcgcgaaaggagcgtccctggatgacctgatagatagctgcattcagtcctttgatgctgacggtaacctctgtcgttccaaccagctactccaggtgatgttaactatgcatcgaatcgtcatttctagcgccgagctgttgcagaaggtcatcacgctgtataaggacgctctggccaaaaatagcccaggactctgcttgaaaatttgttacttcgtcaggtactggatcacagaattttgggtaatgtttaaaatggacgccagtctaaccgataccatggaggaatttcaggaactcgtgaaagccaaaggcgaggagctacactgcaggctgattgacactacccagataaatgctcgggactggtcgcgtaagctcacccagcgcatcaaaagtaatacaagtaaaaaacggaaggtgtcattactctttgaccacttggaaccagaggaattatctgagcatttgacgtacctcgaattcaagagcttccggcgtatcagcttttccgattatcaaaactatctggtgaatagttgcgtgaaagagaatcccactatggaacgctctatcgccttatgtaacggaatctcccagtgggtacaactgatggtgctgagccgcccaactccacagctgcgagccgaggtgtttatcaaattcatacaagtggcacagaagctccaccaactgcagaattttaacacccttatggcagtcattggtggcctgtgccatagctccatcagccggttgaaagagacatcatcccacgtgcctcatgagatcaacaaggtactcggagagatgactgaactgctctcttcatccaggaactatgataattataggagagcttacggcgagtgtactgacttcaaaatccccatccttggagtgcacctcaaggacctaattagcctgtatgaggctatgcccgattaccttgaagacggcaaggtgaacgtgcataagctgctggccctttacaatcacatctcagagctggttcaactacaagaggtagccccccccctcgaggccaacaaggatctggttcatctccttactctcagtttggatctatactacaccgaagatgagatttacgagctgtcttatgcaagagaacctcgcaatcaccgtgctcccagtgtgttcaaaaactacgatcatgatcaggatggctacatttcgcaggaagaattcgagaaaatcgcggcttccttcccattcagtttctgcgtgatggataaagatagagagggtctgatttcccgtgacgagattactgcgtattttatgagagctagttccatatatagtaaactgggcctgggtttcccacataattttcaggagactacctacctgaaacccactttctgtgacaattgtgccggcttcctgtggggagttatcaaacaagggtatcgatgtaagggcaataaatattctgaaagcagatag

SEQ ID NO: 131800 - DNA, 1794 bp, Artificial Sequence
  Description of Artificial Sequence: Synthetic coding sequence
atgggaactctggggaaggctcgggaggctccgagaaagccatcgcacggctgcagggctgcctctaaggctaggctcgaggcgaagccagcaaactcaccatttccatcgcatcccagccttgcgcacattacccagtttcgcatgatggtctccctggggcatcttgccaaaggggcatccctggacgatctgatcgactcgtgcatacaatctttcgacgctgatggcaatctttgcagaagcaatcagttgctgcaggtaatgctgaccatgcaccgcattgtgattagctcagcagaactgctccaaaaggtaatcaccctctacaaagacgccctggccaaaaacagtcccggactctgtctcaagatttgttattttgtcagatattggatcaccgagttttgggtgatgttcaaaatggacgcttccctgactgatacaatggaggaatttcaggagttggtgaaggctaaaggtgaggagctgcattgcaggctcatcgatacgacccaaattaatgcccgcgactggtctcgcaaattgactcagcgcatcaaaagcaacaccagtaaaaaacgtaaggtaagtcttctatttgaccatctggaacccgaggagctttctgagcatttgacctaccttgagtttaaaagcttcaggcgtataagcttctcagactatcagaattatctggtaaattcatgtgtcaaggaaaatcctaccatggagcgttcaattgcattgtgcaacggcattagtcagtgggtgcagctcatggtcctgtcccggccaacacctcaactacgtgcagaggtgttcattaaattcatccaggtcgcgcaaaagctccaccagctgcagaactttaataccttaatggccgtaatcggcggcctctgtcactctagcattagcagattgaaggagacatccagccatgtaccccacgagatcaataaagtgctgggggaaatgacagagctcctgtcatctagtagaaattatgataattatcggcgcgcctatggcgagtgtaccgatttcaaaattcccatcttaggcgttcatcttaaagatctgatcagcctctatgaggccatgcctgattatctggaggacggcaaggtgaatgtgcacaaacttcttgcgctgtacaaccatatttccgaattggtccaattacaggaagtagctcctccactcgaagccaacaaggatctagtccatctgcttacactgagtttggatctgtactacaccgaggacgagatttatgaactgtcctatgcccgcgaaccgagaaatcatagggcaccatcggtcttcaaaaactatgaccatgaccaagatggctatataagccaggaggagttcgagaaaatcgccgcaagttttcccttttcgttctgcgttatggacaaggacagagaaggattaatttccagagacgagattacggcttacttcatgcgggcgtcatctatttattctaaactaggactgggcttccctcacaacttccaggaaactacataccttaagccgactttctgcgataattgcgctggattcttgtggggagtcatcaagcagggctaccgctgtaaagactgtggaatgaactgtcacaagcagtgtaaggacctggtggtatttgagtgcaaaaaaagggctaagaaccctgttgctccaaccgagaacaatacctccgtgggccctgtcagcaacctgtgcagcctgggggctaaagatttactccatggtaacaagtacagtgaaagccggtag

SEQ ID NO: 131801 - DNA, 1830 bp, Artificial Sequence
  Description of Artificial Sequence: Synthetic coding sequence
atggccggcactctcgacctggacaaaggctgtactgtggaggagttgttgcgaggctgtatcgaggccttcgatgactcagggaaagtacgggacccccagctcgtccgtatgttcctgatgatgcatccctggtatataccaagcagtcaactggcagccaagctcctccatatttatcagcagagcaggaaggacaatagtaactccctacaggtaaagacctgccacctggtgaggtactggattagtgcttttcccgccgagttcgacctaaacccggaactcgccgaacaaattaaggagctgaaggccttgcttgatcaggagggaaaccgtcggcactctagcctgatcgatatcgacagcgtgcctacctacaaatggaaaaggcaagtcacccagaggaatcctgtgggccagaaaaagagaaaaatgtccttgctattcgaccatctagaacctatggagctagccgagcacctgacttacctggaatataggtctttctgcaagatactctttcaggattaccactccttcgtgacgcacggttgtactgtggataacccggtgttagaacgcttcatatctctgtttaattcagtgtctcaatgggtacagttgatgatcttaagtaagccgaccgcgccccagcgcgcactggtaattactcactttgtgcatgtggcggaaaagttgctacagcttcagaactttaacactctgatggccgtggttgggggcttaagccactcgagcattagccgcctgaaggaaacacacagccacgtgagccccgagactattaagttatgggagggtctcaccgagcttgttactgccaccggcaactacggcaattaccggcgtaggctggctgcatgcgtcgggttccggtttccaatcttgggcgtacacctcaaggatctggtggcgctgcaactggctctgcccgattggctagacccagcccgtacaagactgaacggggctaaaatgaagcagctgttcagcatcctggaagagctggcaatggtcacgtcgctgagacccccagtgcaggcaaatcctgatttattatccctgctaaccgtgagtttggatcagtatcagaccgaagatgagttgtatcagctaagccttcagcgagagccaagaagcaagagctcccccacgtcccctacaagctgtactcccccacctagacccccagtactggaggagtggaccagcgccgctaagcccaagctggatcaagccctcgtggttgagcatatagaaaaaatggtagagagtgtttttagaaatttcgacgtggatggggacggacacatttcgcaggaggagtttcagatcatccgggggaacttcccatacctgtcagcattcggcgatcttgatcaaaatcaagacggctgtatctcgcgcgaagagatggtttcctactttttgagatcatccagtgtgctgggaggtagaatgggattcgtgcacaattttcaggagtcaaacagcctgagacctgttgcatgtcgacactgtaaggcgctgatcctgggcatttacaagcagggcctcaagtgtagagcctgcggagtgaattgccataaacagtgcaaggataggctcagcgttgagtgccgcaggcgcgcacaaagcgtctcattggaaggctcagcaccgagcccttccccaatgcactcccatcaccacagggcctttagtttctcattgccccgccctgggcggaggggatcacgtcctcctgagattcgcgaggaagaagttcagacagtggaagacggagtgttcgacattcacctgtag

SEQ ID NO: 131802 - DNA, 1833 bp, Artificial Sequence
  Description of Artificial Sequence: Synthetic coding sequence
atggccggcactctcgacctggataaaggctgtactgttgaagaacttttgcggggctgcattgaggctttcgatgatagcggaaaagtgagggatccccaactcgtgcgtatgttcctaatgatgcatccttggtacatccccagcagtcagctggcagctaagctactgcacatttatcaacagtcccgcaaggataacagcaattcccttcaagtgaaaacatgccatctggtgcgctattggatctccgccttcccagccgaattcgatctgaatcccgaactggccgagcaaataaaagagcttaaggccttgctagaccaggaggggaaccgccggcactcgtctctgattgatattgatagtgtccccacctacaagtggaagcgacaagtgacccagaggaatccggtcggacagaaaaaaagaaagatgtcgctgttgtttgatcacctcgaaccaatggaactcgccgaacatctgacatacctggagtaccggtccttttgtaaaatcttatttcaagactatcactcctttgttacgcacggctgtacagtggacaaccctgtcctggagcgcttcatttcactgttcaatagcgtttctcaatgggtgcagctgatgattctcagcaaaccaacagcaccccagcgtgccctcgtgatcactcatttcgtgcacgttgccgagaagttgcttcagcttcaaaactttaacaccctgatggcagtcgtaggcggcctgtcccactcctccatcagcaggctcaaggaaacccatagtcatgtgtctcccgaaaccattaaactctgggaggggcttacagagcttgttacagcaaccggcaactatggaaactatcggcgccgactcgcagcctgtgttgggtttcgctttcccatactgggtgtgcatctgaaggatcttgtggccttgcaacttgcacttccagattggctggaccccgcaagaacccggctgaatggcgccaagatgaagcaactgttctccatcctggaagaactcgctatggtgacgtctctgagacctcccgtccaggccaatccagacctgctctccctcctaactgtgagcctcgatcaataccagaccgaagatgagctctatcagctgtctcttcagcgggaacctcggtctaagagctctccaacatcgccgaccagctgcaccccaccccccaggccccccgtgctggaagaatggacatcggctgcaaaaccaaagctggaccaagccctggtggtcgaacatatcgaaaaaatggtggaatccgtatttcggaattttgacgtggatggggacgggcatatttcccaggaagagtttcagattatcaggggcaatttcccctatttaagcgcttttggggacctggatcagaatcaagacggctgcatatcccgagaggagatggtctcttacttcctccggtcttcgtctgtccttggagggagaatgggctttgtccacaactttcaggagtccaattcactcagacctgttgcttgcaggcactgcaaggctctcatcctcggcatatacaaacagggactgaagtgtcgtgcttgcggagttaactgccataagcagtgcaaagaccggctgtcagtcgagtgtaggcgcagagcccagtctgtgagtttggaggggagcgcccccagtccttctcccatgcactcacaccatcacagagcttttagtttttccttgccacgtccgggtcgacgcgggagtcgcccacccgcagaaatacgggaagaggaggtgcagacagtcgaagatggtgtgttcgatattcacctctag

SEQ ID NO: 131803 - DNA, 1830 bp, Artificial Sequence
  Description of Artificial Sequence: Synthetic coding sequence
atggccggtactctggaccttgataagggatgtaccgtggaggagctgctgcgaggatgtattgaggcatttgacgactccgggaaggttcgcgacccacagttagtccgcatgtttctgatgatgcacccatggtatatccctagtagtcagttagccgcgaaactgctccatatatatcaacagagccgaaaagacaattccaactccttgcaagttaaaacatgtcatctggtgaggtactggatttcagcttttccagccgagtttgacctgaaccctgagctcgcagagcaaatcaaggaattaaaggctctcctggaccaggaggggaacaggcggcatagttctcttattgatatcgacagtgtacccacttacaaatggaagcggcaggtgacacaacgcaatcccgtcggacagaaaaaaagaaagatgtcgctgcttttcgatcatttggagccaatggagctcgctgaacatttaacctacctcgaataccgctctttttgcaaaattctgtttcaagactatcattcctttgtgacacacggatgcaccgtggacaatcccgtactggagcgctttatctcgttattcaatagtgtgtcccagtgggtccagctgatgattctcagcaaaccaacagctccccagagagccctcgtaatcactcattttgttcacgttgcggaaaagctcctgcagctgcagaattttaacactctgatggctgtcgtggggggattaagccattctagcatatcgcgtctgaaggagacccactcccacgtgagtcccgaaaccatcaaactctgggagggactgaccgaattggtgacagctactggcaactatggaaattaccgaagacgcctagcggcatgcgtgggctttcgctttccgattctgggggttcacctcaaggacttggttgctctgcagcttgcactccccgattggttagatcccgccaggactagactcaacggcgcgaagatgaaacaactgttctccattctggaggagttagctatggtcacaagccttagacctccagtccaggcgaaccccgacttattaagcttgctcaccgtctcgctggaccagtatcagacggaggatgagctgtaccagctctccctccagagggaaccccggagcaagagttctcctacatcacctacctcctgcacccccccacccaggccacccgtgctggaggaatggacatctgcagcaaaacctaagctcgatcaggccctggttgtggagcacattgaaaaaatggtcgagtccgtgtttcgaaattttgacgtcgatggggacggtcacatctcgcaggaagaattccagatcattcggggaaattttccctatctctcggcctttggggatctagatcagaatcaggatggatgtatcagccgggaggaaatggtaagctacttcctgcgctcatcctccgtgcttggcggtcgcatggggttcgtccacaatttccaggagtctaactcacttcgacctgtggcgtgtagacattgcaaggccctgatcctggggatctacaagcaaggcctcaagtgtagagcttgtggtgtcaattgtcataaacagtgcaaagataggctgtccgttgaatgccgaagacgggcacagtccgtttctctggagggttctgcgcctagcccaagccctatgcattctcatcaccaccgggcgtttagcttctcccttcctagacccgggcggagaggcagcaggcctcccgaaatccgagaggaggaggtccagacagtggaagatggagtgttcgacatccatctctag

SEQ ID NO: 131804 - DNA, 1830 bp, Artificial Sequence
  Description of Artificial Sequence: Synthetic coding sequence
atggctggcacgctggacctggataagggttgcaccgtggaggagctcctgagagggtgcattgaagcgtttgatgacagcggaaaggtgagggatcctcagttggtgcgcatgtttctgatgatgcacccctggtacataccatcctcacaacttgctgctaagttgctccatatttatcagcagtcccggaaggataattccaactctcttcaggttaagacctgtcacctggttcgatattggatatccgccttccctgcggaatttgacttgaatcccgagttagctgaacagatcaaggagctgaaagcccttctggaccaggaggggaacagacggcactcgtctcttattgacattgactccgtcccaacttataaatggaaacgtcaggtgacccagaggaaccctgtgggccagaagaaaaggaagatgtccctactatttgatcacctggaacctatggaactggcagaacaccttacctatctggagtataggagcttctgcaaaatactgtttcaggactatcactcattcgtcacacatggctgcaccgtggacaacccagtgctggagcgctttatcagcctgttcaactctgttagtcaatgggtgcagctgatgatcctttctaaacctactgcacctcagagagctcttgtgataactcacttcgtgcatgtggccgaaaagctgcttcagctgcagaattttaacaccctcatggcagtcgtgggaggactctcacattctagcatttcaaggctgaaggaaacgcactcccacgtaagccccgagacgattaagctgtgggaggggctgactgaactggtcaccgctaccggaaattacggaaactatcgtcgccgccttgccgcctgcgtgggtttccgttttccaattctaggggtgcaccttaaagatctggtcgccctgcagcttgcactgcccgactggctggatccagctcgaactcggttgaatggggcaaagatgaaacagctcttctctatacttgaggagctcgccatggtgacatcgctgcgaccgcccgtgcaagccaaccccgatctgctaagcctgctaaccgtgtccctagaccagtaccagacagaagacgagctgtatcaactaagtctacagagagaaccccgcagcaaatctagccctacaagccccacctcctgcacccctccccccagacccccggtgctggaagagtggacttcagccgccaagcccaaactggaccaggccctcgtggtggaacacatcgaaaaaatggtggaatccgtctttagaaacttcgacgtggatggtgatggccacatcagccaagaagagtttcagattatccgcggcaacttcccttacctgagcgcttttggagatttagaccagaatcaggatgggtgcatcagtcgcgaggaaatggtgagctatttcctcagaagttctagcgttctgggaggacgtatgggcttcgtccacaacttccaggaaagtaacagcctgcgacccgtggcatgccgtcattgcaaagccctcattctgggcatctataaacagggccttaaatgccgcgcctgcggagttaactgccataagcagtgtaaagatcgcctgtccgtcgagtgccggaggcgagcccagtccgtgagtctggagggcagtgccccatcacccagccctatgcactcacaccatcatcgtgctttctccttttcactaccccgtccaggaaggcgggggagccgccctccagagattcgggaagaagaggtgcagaccgtagaggacggcgtgtttgatatccacctgtag

SEQ ID NO: 131805 - DNA, 432 bp, Artificial Sequence
  Description of Artificial Sequence: Synthetic coding sequence
atggctgggaccttggacctcgataagggatgtacagtggaagaactcctgagaggctgtattgaggcattcgatgactcggggaaggttagagatcctcagctggtgcggatgttcctcatgatgcacccctggtacattccgtcaagccaactcgccgccaaacttctgcatatctaccaacagtctaggaaggataactcaaacagtctccaggttaaaacatgtcatctggtgcgctactggattagcgcctttcccgccgagtttgacctgaacccagaactagcagaacagattaaggaactcaaagcgctgcttgatcaggaggggaacaggcgccactcaagcctaatcgacattgacagcgtgtgcgtaggcgagcacagaggccttggcggccatagcgtctcttacacgatctgcgcctag

SEQ ID NO: 131806 - DNA, 1731 bp, Artificial Sequence
  Description of Artificial Sequence: Synthetic coding sequence
atgaaccgcaaggattcaaaaagaaagagccaccaggaatgtaccggcaagatagggggtcgcgggcgaccaagacaggttcgcaggcataagacctgtccgtcacctagggagatatctaaagttatggctagcatgaatctgggcttactctctgagggcggatgtagcgaagacgagctgctggaaaaatgtatccagtcttttgattcagccgggtctctgtgccacgaagaccacatgctcaacatggtcctcgctatgcattcttgggtgcttccatcggctgacctggccgcgaggctgctcacttcctaccagaaagcaacaggcgacacccaggagcttagacggcttcaaatatgccacctcgtgagatactggctgatgcggcacccagaagtcatgcaccaggaccctcagttagaggaggtgatcgggcgcttttgggcaacggttgctcgcgaaggtaacagtgcgcagcgcaggctgggcgattcatctgatctccttagtcccggggggccaggaccacccctacccatgtctagccccggcttggggaagaagcggaaagtctccctgctttttgatcacttggagaccggcgagttagcacagcacctaacgtatctggaattccgatcctttcaggccatcaccgcacttttggaactaacagaattgttggcttcacataacaactatgcacgttaccggcgcacgtgggcaggatgtgccggtttcagattaccagtgttgggcgtgcacttaaaagacctggtcagcctgcacgaggcacagccagatcgcttgcctgatgggcgcctccacctccctaagctgaataacctctacctacgtcttcaggaactggttgcccttcagggccagcaccccccatgctccgcaaacgaggacctattgcacctgctgactctgtctttggacctattctataccgaggacgagatttatgaactgtcctatgctcgcgagccccggtgcccaaagagtcttccaccctccccatttaatgcccctctggtcgtagaatgggcccccggtgtgacccctaagccagacagggttacactggggcgccatgtcgaacaactcgtggagtcagtgtttaagaactacgatccggaaggcaggggcacaataagccaagaggatttcgaacgtctgagcggaaattttccatttgcctgccatggcttacacccgccgccacgacagggtcggggctccttcagtcgcgaggaacttaccggctacttgctcagggcctccgcaatttgctccaagctcggcctggcatttttacatactttccacgaggtcacatttaggaaacctacattttgcgatagttgtagtggatttctgtggggggtcacaaagcaaggctatagatgcagagaatgcggactgtgctgtcacaagcattgccgggaccaagtgaaggtggaatgtaaaaaacgtccaggggccaaaggcgatgctggccccccaggagctcccgtgccctccacccccgcaccccatgctagttgcggtagtgaggagaaccactcatatacacttagtcttgaaccagaaacaggctgccaacttcgccatgcctggacacaaacagaatctccccacccctcttgggagacagacaccgttccctgcccagtcatggatccgccaagcaccgcgagcagcaaacttgacagctag

SEQ ID NO: 131807 - DNA, 1854 bp, Artificial Sequence
  Description of Artificial Sequence: Synthetic coding sequence
atgaatcgcaaggacagcaaacggaagtcccaccaggaatgtacaggcaagatcggtggccgcggccggccccggcaggtgcggagacataaaacatgcccgtcaccccgcgaaatctccaaggttatggcatcaatgaatctggggctgttatctgagggaggctgttctgaggatgaactcctcgaaaaatgcatccagtcctttgatagcgccggaagtctttgccacgaggatcatatgctgaatatggtgctcgccatgcactcatgggtactgccctctgctgatctcgcagcacgccttctcactagctatcagaaagcgacaggggatacacaggagctcagacgtctccagatctgccatcttgtgaggtactggctgatgcggcaccccgaggttatgcatcaggaccctcagttggaagaggtgatcggacgcttttgggccacagtggcacgggaaggcaactcagcccagcgtaggctgggggacagttctgatctcctcagtcctggcggtcccggccccccactcccgatgtcatctcctggacttggcaagaagaggaaggtatctttgctcttcgaccatctggaaactggtgagttggctcagcacctcacttaccttgagtttcgatctttccaggccattacccctcaggatctccgctcctatgttctgcagggatctgtaagagggtgtccggccctggagggatctgtgggattgtcaaatagcgtatccagatgggtgcaagtcatggtgctatcaaggccaggacccctgcagcgcgcgcaggtcttggacaagtttatccacgttgcacagcgtcttcaccaactgcagaattttaatacccttatggcagtgactggaggactgtgtcactccgcgataagtcgcctgaaggactcccacgctcacctttcccccgattcaactaaagctcttcttgagctcaccgagctcttggcctcccataataattatgcacgttatcgacgcacttgggctggctgcgccggctttcgccttcccgttctgggggttcacctgaaggacctggtctccttacacgaggcacagcctgaccgcctgcccgatggaaggcttcatctgcctaagctgaataacctatatttaaggctgcaggagctcgtggccctgcaggggcaacacccgccctgttctgccaacgaggacctgctgcacctgctgacactgtccctggatctcttctataccgaagatgaaatttacgagctctcctatgcacgcgaaccccgatgtcctaagtccctgcccccaagcccttttaacgcaccattggtggtggagtgggccccgggagtaacccccaagccagatagagtgaccctaggtaggcatgtggaacagctggtggaaagtgtctttaagaactatgaccccgaagggagaggcaccatatcacaagaggacttcgaacgcttatctggaaattttccattcgcctgccacggcttgcacccacctcccaggcaggggagaggttctttctctcgtgaagaactgactggctatttgctccgagctagcgccatttgctctaagctgggcctggcatttttacacacttttcatgaagtgacttttcggaaacctacattttgcgacagctgtagcggatttctgtggggcgtcaccaagcaggggtatagatgtaggggagagtggggcgtgtctgagtgggagggctccctaggaccccaggcaggaagaatggatgacacagaccgtaccccagctgccgcctttccgcagtctgccggatgtgtggcaacaaataccgccgagactaggtag

SEQ ID NO: 131808 - DNA, 1455 bp, Artificial Sequence
  Description of Artificial Sequence: Synthetic coding sequence
atgaaccgaaaagatagcaaacggaagtctcatcaggagtgtactggtaagatcggcggtcgcgggcgtccccggcaggtgcgacggcataaaacttgtccaagcccccgtgagatctccaaagtgatggcgagtatgaacttaggactcctgtctgaagggggctgttctgaggatgagctgctcgagaaatgcatacagtccttcgacagcgctgggtctctttgtcacgaggaccacatgctgaacatggtcctggcaatgcactcttgggttttaccgagtgctgacttagccgctcgcctacttaccagttaccaaaaagcaacaggggatacccaagagttgagaaggcttcagatctgtcacctagtcaggtactggttgatgaggcacccagaagtcatgcatcaagatccacaactggaagaagtgattggcaggttctgggcgacagtcgcccgcgaggggaacagtgcccagcgtagactgggcgattcttctgatctcctgtcccctggtgggccagggccccccctacccatgagctctcctgggctgggtaaaaaacgcaaggtctcattgctgtttgaccacctagaaacaggggaactcgctcagcacctcacttatttagaatttcgctctttccaggccatcactctaagtctggacctgttttatacagaagacgaaatctacgaattatcttacgcccgagaaccaagatgtccaaagtctttgcctccgtcaccatttaatgcaccgctggtcgtggagtgggctcctggagtgacaccaaaaccagatcgagttacgctggggcggcatgttgaacagctagtggagagtgtctttaagaactacgatcccgagggcaggggcaccatctcccaggaagactttgagcgcctgtctggcaactttccctttgcctgccacgggcttcatccccccccaaggcaaggtaggggctccttctctcgggaggaattaaccggatatctacttcgtgcatccgccatatgctccaaactgggactggcattcctccacaccttccacgaggttacctttcggaaacctacattctgtgatagctgcagtgggttcttgtggggtgtcacaaaacagggctaccgctgcagggagtgtggcctttgctgccataaacactgtcgggatcaagtgaaggttgagtgcaagaaacgcccaggtgcaaagggggatgccgggccacctggcgctcctgttccctcaactcctgcccctcacgcctcatgcggcagcgaggaaaaccactcttacacgctttccctcgagcctgaaacgggatgtcagctccggcacgcctggacgcagaccgagagtccccatccttcttgggagacagacactgtgccttgccctgtaatggatccacccagtacagccagctcaaagctcgatagctag

SEQ ID NO: 131809 - DNA, 1746 bp, Artificial Sequence
  Description of Artificial Sequence: Synthetic coding sequence
atgaacaggaaagattcaaaacggaagagccaccaagaatgtactggtaagataggaggacgcgggaggccacggcaggtgaggcgtcataagacgtgcccctctcctagggagatttccaaagtaatggcatcaatgaacctcggtttgctatcagaggggggatgttctgaagacgagctgttagagaaatgtatccaaagttttgatagtgctggctccctctgtcacgaggatcacatgctcaatatggttctggcgatgcatagctgggtcttaccctctgcagacttagctgctaggctccttaccagctaccagaaagctacaggcgacacacaggaactcaggcggctgcagatttgccaccttgttcgatactggctgatgaggcatcctgaagttatgcaccaggatccccaactggaagaggtcatcggccgtttctgggcgacagtggccagagaggggaactctgcccagcgacgcctgggggattcatcagatttattatcccccggcggcccaggcccaccactccccatgtccagtccaggcctggggaagaaaaggaaagtttctctgctgtttgaccacctagagacaggggagctggcacagcacttgacatacctcgaattccggtctttccaggccatcaccccacaggatttacgcagttacgtactccagggaagcgttaggggctgccccgccctcgaaggctctgtgggattgtctaattcggtcagccgctgggtgcaggtaatggtgctgtcaagacctggtccactgcagcgggcccaggtgttggataaatttatccacgtggcccaacgcctgcatcagctacagaacttcaataccctgatggcagtgaccggaggactctgccacagtgctatctcacggctgaaagatagtcacgcccacctctctcctgacagcacgaaactgagtctcgacctgttttatacagaggatgagatttacgagctgagctatgctcgcgagcctcggtgccctaagagccttcctcccagcccgttcaacgccccattggtcgtggaatgggcgccaggagttacccctaagccagatcgtgtgacacttgggcggcatgtcgagcagttggtggaaagcgtgttcaagaattatgaccctgagggtcggggaaccattagtcaggaggactttgaaagattgtcgggcaatttcccatttgcctgccacggcttacatcccccacctagacagggcagaggctcattttccagggaggaacttaccgggtacctcttacgcgccagcgcaatttgctccaagttgggcttagccttccttcacacctttcacgaggttactttccgcaagcctacattctgtgactcttgttccggcttcttgtggggcgttacaaagcaaggctaccggtgtcgggaatgtgggctctgctgccataagcactgtagagaccaggtcaaagttgaatgtaaaaaaagacccggcgcgaagggggacgccggaccacctggagcacccgtgccaagtacaccggcccctcatgcctcatgtggcagtgaagagaatcatagttacacactcagcttagaaccagagacgggctgccaattaaggcatgcttggacccaaactgaatctccccacccaagctgggaaaccgatacagtcccctgccccgtaatggacccgcccagtactgcctcctctaagcttgattcctag

SEQ ID NO: 131810 - DNA, 2022 bp, Artificial Sequence
  Description of Artificial Sequence: Synthetic coding sequence
atgaataggaaggacagtaagaggaagtctcaccaggagtgcaccgggaaaataggtggaagggggagacccaggcaggtgcgcagacacaaaacatgtcctagtccacgcgagatatccaaggtgatggcgtccatgaacctgggccttctcagcgagggcgggtgctccgaagatgagcttttggaaaaatgcatccaaagctttgattccgccggttctctatgtcacgaagatcacatgttaaatatggtgctggctatgcactcatgggtgctcccgtccgccgaccttgccgcccgcttgctgacttcgtaccagaaagccaccggcgacacacaggagttgcggcggctgcagatttgccacctggttaggtactggctcatgaggcatcctgaggttatgcaccaagacccacagttggaagaagtgatcggtcgcttttgggccactgttgcacgggaaggcaattccgctcagagaagacttggcgattcttcagatctgttgtctcccggcggaccagggccacctctacctatgtcaagccctggattaggaaaaaagagaaaggtctcactgctttttgatcatctcgaaacaggcgagctagcacagcatctgacttatctcgaattcaggtcgtttcaggctatcaccccacaggatttacgtagttatgttctgcaaggttcggtgagagggtgtcccgcccttgaagggtccgtggggctgagcaattctgtgagccgctgggtacaggtgatggtgctctctcggccaggcccccttcagcgcgctcaggtgttggataaattcattcacgtcgctcaacgtctccatcagctccagaattttaacactctcatggctgtgacaggagggctatgtcatagcgccatatcccgccttaaggattcccatgcccacttgtctcccgacagtaccaaggccctcctcgaactaaccgagctgctcgcctcgcacaacaattacgcacggtatagaaggacttgggccggctgcgctggcttcagactgcccgtgttaggcgtccatctaaaggacctcgtttcactccacgaggctcagcctgatcggctgccagacggaagactgcatttgcccaaactgaacaatctctacctgaggctgcaggaactggttgcactgcaagggcagcatccgccctgcagcgccaacgaggacctgctccaccttctaacattgtccctggacctgttctacaccgaagacgagatctatgagctcagttacgcccgtgagccaaggtgccccaagtctttgccaccgtctcctttcaatgcccctttggttgtggagtgggccccaggtgtgacccccaagccggatcgggtcaccctcggcagacacgttgaacagctggtggaatccgtcttcaagaactacgatcctgaagggagggggaccatttctcaggaagactttgagagattatccggtaacttcccatttgcctgccacggcctgcaccccccacctcggcaaggccgtgggagcttctcgcgcgaagagcttactggttatctactgcgcgccagtgcaatctgcagcaaattggggctcgctttcctgcatacattccacgaggtgacctttagaaagcccactttctgcgactcgtgctccggattcctgtggggcgtcaccaaacagggatatcgctgtcgcgagtgcggactctgctgccataagcactgtcgggatcaggtgaaagttgagtgcaagaagcgacctggtgcaaagggggatgcggggccccctggagccccggtgcctagcactcccgccccacacgcttcctgcggcagcgaagaaaaccatagctatactcttagtctggaaccggagaccgggtgccaactgaggcatgcgtggacacaaacagaatccccacacccctcctgggagaccgacactgttccctgtcctgttatggacccgcccagcacggcaagcagcaaattggactcctag

SEQ ID NO: 131811 - DNA, 1980 bp, Artificial Sequence
  Description of Artificial Sequence: Synthetic coding sequence
atgaacaggaaggacagcaagcgtaaatcccaccaggaatgcaccggaaaaatcgggggacggggacggcctagacaagtgagaagacacaagacatgcccctctccacgggagatttcgaaagttatggcatcaatgaacctcggcttgctctccgagggaggctgtagcgaagacgagttactggagaaatgtattcagagtttcgattccgccggatccctgtgccatgaagaccacatgctaaacatggtgctggctatgcattcttgggtacttccttctgcagatttagccgctcgcctgctcacctcttatcagaaagcaaccggggatactcaggaattgaggcgcttacagatctgtcatttggtgcgctattggctgatgcggcacccagaagtcatgcaccaggatccacagctggaagaggtgatcggacggttttgggccacagtcgcgagagaaggtaatagtgctcagcggcggttgggcgactcttccgacctgcctggactcggaaaaaagcgtaaggtgtctttactttttgatcacctcgagaccggtgagctggcgcagcacctaacctatctggagtttcgcagctttcaggctatcacacctcaggatctacggtcgtatgtactgcagggttctgtacggggttgtcccgcactggaaggtagcgtgggtctttccaactctgtgagtcgctgggtgcaggtcatggttctcagtcggcccggccccctccagcgggcacaagtgctggataagtttatccatgtggcccagcgcctccaccaactacagaattttaacacattgatggccgtcactggcggactgtgtcatagcgctatcagtcggctgaaagactcccatgctcaccttagccctgatagtactaaggcccttcttgagctgactgaactattggccagccataacaattacgcccgctaccgaagaacttgggcgggttgtgctggatttcggttgccagtgctgggcgtgcatctgaaagacctcgtgtctttacatgaagctcagcctgatcggcttcccgacggcaggctccatctgcccaagctcaacaatctctatttgcgcttgcaggaactggtagctttgcagggccaacatccgccctgtagcgctaatgaggatctcctacatctgttgacactgtcactggacctcttctacaccgaggacgagatctatgaacttagctacgctcgggagcccagatgcccaaagtctctgcccccttctccattcaacgctcctttagtggtggaatgggcgcccggggtcacacccaaacctgacagagtgacgttgggcaggcacgtggaacagcttgtggagtctgtatttaagaattacgatcctgaggggagggggacgatctctcaagaggatttcgagagactgagtgggaatttccccttcgcttgccatggccttcaccctccccccagacaaggccgtggttcttttagtagggaggagctgacaggctatcttttgcgggcctccgcaatctgctccaagcttggtttggccttcttgcatacattccacgaagtaacatttaggaagcctaccttttgtgatagttgctccggatttctgtggggggtgaccaagcagggctaccgttgcagggagtgtggactctgttgccacaaacactgccgagatcaagtaaaggtcgagtgcaagaaacgcccaggtgctaaaggcgacgctgggccacccggggcaccagtccccagcacacctgctcctcatgcttcttgcggctcagaagaaaatcactcctacaccctttcgttggagccagaaacagggtgtcagcttagacacgcctggacgcagacggagtccccacacccgtcatgggagacagacacagtcccttgccctgtgatggacccaccgtctacagcctcgtcaaaattggatagttag

SEQ ID NO: 131812 - DNA, 1815 bp, Artificial Sequence
  Description of Artificial Sequence: Synthetic coding sequence
atgaatcgcaaggattccaagagaaagtcccaccaggaatgcactgggaagatcgggggccgagggagaccaagacaggtgaggaggcataaaacctgcccaagtccccgggaaattagcaaggtgatggcttctatgaatctggggctgctgtctgaaggcggctgttccgaggacgaactactggagaagtgtattcagtctttcgatagcgccgggtccttgtgccatgaagaccatatgttaaatatggtactggcaatgcactcctgggtcctccccagtgccgacctggcagctcggctgctcacgtcatatcagaaagcaacaggggatacccaggagctgcgacgactccagatctgccacttggtgagatactggctcatgaggcacccagaagtcatgcatcaggaccctcaacttgaagaagtgatcggccgattttgggccactgtcgcccgtgaggggaatagcgcacagcgaaggctgggcgattcctcagatctgctgtccccaggtggccctgggccgccactgcccatgtcaagccctggcctgggtaaaaagaggaaggtctcgctcctgttcgatcacctggagacgggagagctggcccagcatttgacttatctggagttccggagctttcaagcgataacaccccaagacctgagaagttatgtgctccagggttcggttagaggttgtcccgcattagagggttcagtaggcctgtctaacagcgtgtctcggtgggtgcaggtcatggtgttgagcagaccgggtccactccagagagcacaggtgctggacaagtttatccacgtggcccagcggcttcatcagctgcagaactttaatactctcatggccgttacaggagggctgtgccattcggccattagcagactgaaagattcccatgctcatttatcacccgattccacaaaagaactcgtcgcattgcagggccagcacccaccatgttcagcgaacgaggacctgctgcatctgctaacacttagtttggatctgttttatacggaagatgagatctacgaactctcctatgcaagagaaccacgatgcccaaaatctttgcctccttccccttttaacgctcctctggtggtcgaatgggctcccggggtgaccccgaaacccgaccgggtgacgctcggtagacatgtcgagcaactcgtcgaaagcgtttttaaaaattatgaccccgaaggccgggggaccatatcccaggaagacttcgagagacttagtggcaattttccattcgcctgccacggactgcaccctcctcctcgtcaaggccggggaagcttctcaagagaagaactaactggctatctgctccgtgccagcgcaatatgcagtaaattagggctcgccttcctgcatacattccacgaggtgacgttcaggaaaccaaccttctgtgactcatgctccgggtttctctggggggtgacaaagcaaggataccgctgtcgggaatgcggcctctgctgccacaaacattgcagagaccaggtcaaagttgagtgcaaaaaaagacccggagccaaaggagatgctggtccacctggcgcacccgttccatctacccctgccccccacgcctcctgcggaagcgaagaaaaccactcatacaccctttccctcgaacccgaaactggctgtcagctgcggcatgcatggacccagacagagagcccacatccttcttgggaaacagacaccgtcccctgccccgtgatggatccccccagcaccgccagtagcaaactcgactcctag

SEQ ID NO: 131813 - DNA, 1857 bp, Artificial Sequence
  Description of Artificial Sequence: Synthetic coding sequence
atgaagaaagacgtcagaatactgctggtgggagagccccgagtgggaaaaactagccttataatgagcctagtgtccgaggagttcccagaagaggtgccccctcgcgccgaggaaattacaattcctgccgacgttaccccagaacgggtgcccacccacatcgtggactatagtgaggcagagcagagtgatgagcaattacaccaggaaatttcccaggccaacgtaatatgcattgtctatgctgtaaataataaacattctatagacaaggtgacttctagatggatacctcttattaatgaaaggacagacaaggacagcagacttccgctgatcctggtagggaataagagtgacttagtcgaatattcttcaatggaaaccatacttccaattatgaaccagtacactgagattgagacttgtgtggaatgttctgctaagaacttaaagaacatctcggaactgttttactacgctcaaaaggcagtgctccaccctacaggccctctttattgtcccgaggagaaggagatgaagcccgcatgtatcaaagccctaacacgaatcttcaaaatttccgaccaggacaatgacggcaccttgaacgacgcggaacttaactttttccagagaatctgttttaataccccgctggcccctcaagcattggaggacgttaagaacgtggtgaggaaacatatctctgacggtgtggctgacagcggtctaactctgaaggggttcctgttcctgcatacactgtttatccaacgaggacgacacgaaacaacatggacggtgttacgacggttcggatacgatgatgatttggatctgacccccgagtatttattcccccttttgaaaatcccgcccgactgtacgactgaacttaaccaccacgcttatctgttcctacagagtacatttgacaaacatgacctcgatagagattgcgccttatcccccgacgaattgaaagatctctttaaggtctttccgtatattccttggggaccggacgtgaacaacacagtgtgcacaaacgagagggggtggattacctatcaagggtttctctcacagtggacacttaccacctatctggatgtgcagcgttgtctggagtaccttggctacctaggctactctatccttacagaacaggagagccaagccagtgctgtgactgtgacccgcgacaaaaaaattgacctccagaagaagcaaacccaaaggaatgttttccgatgtaatgtgattggtgtgaagaactgtggtaagagtggcgtgctgcaggctctccttggccgcaacctgatgcggcaaaagaagattagggaggatcacaagtcttattacgccatcaacaccgtgtacgtttacgggcaggaaaaatacttattattgcatgatatttctgagagcgaatttcttacagaagccgagatcatttgtgatgtagtgtgtctggtctatgacgtttccaacccaaaaagctttgaatactgtgctagaatcttcaaacagcattttatggactcgaggattccgtgtttaatcgtagctgcaaaatccgatttgcatgaagtgaaacaggagtacagcatatcccccaccgacttctgcagaaagcataagatgccacccccccaggccttcacctgtaacaccgcggacgccccctccaaggacatcttcgtaaagctcacgacaatggcaatgtatccacatgttacccaggccgatctgaagtcttccacattctggttaagagcctctttcggtgctactgtatttgctgtactaggctttgccatgtacaaagcgcttctcaagcagagatag

SEQ ID NO: 131814 - DNA, 1980 bp, Artificial Sequence
  Description of Artificial Sequence: Synthetic coding sequence
atgaaaaaagacgttcgaatacttctcgtgggcgagcctcgggttggaaagactagcttgatcatgagcctggtatccgaggagttcccagaagaagtgccgccccgcgcagaagaaatcacaatccccgcagatgtaacccctgagcgggttccgactcacattgtggattacagcgaggcagagcagtccgatgagcaactgcaccaggagatttcacaggccaatgtcatttgtatagtctatgctgtcaacaataaacattctatagataaggtcacatcacgttggattcctcttataaatgaaaggacggacaaggatagccggcttcctctaattctggtgggcaacaagtcagacctggtagaatattccagcatggaaacaatcttaccgatcatgaaccagtacaccgaaatcgagacgtgtgtggaatgctctgccaaaaacttaaaaaatatctcagagttgttctactacgcgcagaaggccgttctgcatccaacgggtcctctttactgtcctgaggaaaaagagatgaaaccagcttgtattaaggctctgaccagaatcttcaaaatctctgaccaggacaatgatggtaccttgaacgatgcagagcttaatttttttcagcgcatttgttttaacacacccttggcccctcaggccctagaggatgtcaagaatgtggtgcgtaagcacatatctgatggcgtggccgatagtgggctcaccctgaagggtttcctgttcctacataccctcttcattcaacgtggacggcatgagactacttggactgtgctgcggcggtttgggtatgacgacgacctcgacttaacgccggaatatttgtttcccctgctgaaaatcccacccgattgcacaaccgaactgaatcaccacgcctatctatttctgcaaagcaccttcgacaaacatgacttggaccgggattgtgccctttcccctgacgagctgaaggacctgttcaaagtgtttccatacatcccctggggccctgacgtgaataacactgtatgtactaatgagaggggctggataacttaccagggttttctgtctcagtggactctcaccacgtatctcgacgttcagagatgtttggagtacctagggtacctgggatatagcatactaacagaacaggaatcgcaggcttccgccgtaactgtgacgcgcgataaaaagatcgatctgcaaaaaaagcaaacccaacgcaacgtgttcagatgtaatgtgatcggcgtgaaaaattgtgggaagagtggggttttacaggcgctgctcggtagaaatctgatgcgccagaagaaaatcagggaggaccacaagtcctattacgccattaataccgtctatgtgtatggtcaggaaaagtatttactcctacacgacatttcggaatcagagttcctcaccgaggccgagatcatctgcgacgttgtctgcttagtgtacgacgttagcaacccaaagagcttcgaatactgtgcccgcatcttcaagcagcactttatggattccagaattccgtgccttattgtggctgctaaatcggacctgcatgaagtaaagcaggagtactctatatcccccaccgacttttgtcgcaagcacaagatgccccctcctcaggcttttacctgcaacaccgctgacgccccttcaaaggacatcttcgtgaagcttaccactatggcgatgtaccctcatgcacgactcaggtgcatgtgcacatgtaaccgctgtacattttgcatttgtcagaactttctaaatagcgacttactccagtccgtcaagaacaagatcttcaccgccgtactgaatagacacgtgacccaggctgatctgaaaagttcaacattctggctgagggcctcctttggtgcaactgtcttcgccgttttggggtttgccatgtacaaggctttattgaagcaacgatag

SEQ ID NO: 131815 - DNA, 2076 bp, Artificial Sequence
  Description of Artificial Sequence: Synthetic coding sequence
atgaagaaagatgtccgtatcctgctggtcggggaaccacgagtggggaagacttcactcatcatgtctctcgtgtccgaggagttccccgaagaagtcccacctcgtgccgaggagattacgatccccgccgatgtgacaccagagcgcgttccgacccatatcgttgactattctgaggcagagcagtccgatgagcaactgcatcaggagatcagccaggccaatgtgatttgcatcgtctatgcagtgaacaacaagcacagtattgataaagttacttctcgatggattcctcttatcaacgaaagaacagacaaagactcccgacttccactgatactcgttggtaacaaaagtgatctggtggagtattcaagtatggaaaccatcctgcccatcatgaaccagtatacagaaatcgagacttgcgtggaatgctcagcgaagaacctaaagaatattagcgagctcttctactacgcgcagaaggctgtcctccatccaactggtccattatattgcccagaggaaaaagaaatgaagcctgcttgtatcaaggccctgacccggatcttcaagattagtgatcaggataacgacggtacgctgaatgacgccgagctgaacttcttccaacgtatttgctttaacactccactggctccccaggcgctggaagatgtgaagaatgtggtaagaaagcacatttctgatggagtggctgactcaggacttacgctgaaaggttttctctttttacacaccctgtttatacagcgcggacgacatgagacgacctggacggtactcagacgattcggttatgacgatgatctggacctgacacctgagtacctcttcccgctgctcaagatcccccctgattgcacaactgagctgaaccatcacgcttacctgtttctgcagtcgacgtttgacaagcacgacctggaccgggattgtgccttgtctcccgacgagctgaaggacctgttcaaagtctttccctacattccgtggggccccgacgttaataatacagtgtgtaccaacgagagaggttggattacctatcaaggcttcctgagccagtggacgctgacgacatatctggatgtgcagaggtgcctcgaatacctggggtacctcggatacagtatccttacagaacaagagtcccaagccagcgccgttacggtaacacgtgacaagaaaatcgatctgcagaagaagcagacccaacggaacgtctttcgttgtaacgtgattggcgtcaagaactgtgggaagagcggggtcttgcaggctctactgggcagaaacctcatgagacagaagaaaattcgggaggaccataagagttactacgcaatcaatacggtttacgtctatggccaggagaagtatctgctgctccatgatattagcgagagtgagttcctgacagaggcggaaatcatttgtgacgtggtttgccttgtgtatgacgtgagcaatccgaaatctttcgaatattgtgcacgaatttttaagcaacactttatggactctagaattccatgtctcatagtggccgcgaagtcggacttacatgaggtcaagcaggagtattcaatatcacctacagatttctgtagaaaacacaagatgccgcccccacaggcgtttacctgtaatacagctgatgcgccatctaaggatatcttcgtcaagctcaccaccatggccatgtacccagaagatcattaccgagaccgactttcgcgggatatgggacacaccgatagaattgagaaccttcggaaaatctgggtcttcttaaagaccgcgtttcatgccaggttgcgctgcatgtgtacatgtaataggtgtacattctgcatctgtcagaattttttgaactcagatttgctccagagcgtgaaaaataagatttttaccgccgtcctaaaccgccatgtaacacaggccgacctgaaatctagcacgttttggctgagagccagttttggagctactgtgtttgcggtactcgggtttgcaatgtataaagcgctcctgaagcagcggtag

SEQ ID NO: 131816 - DNA, 1953 bp, Artificial Sequence
  Description of Artificial Sequence: Synthetic coding sequence
atgaagaaggacgtgcggattttattagtgggggagccccgcgttggaaaaacatcactcataatgtccctcgtgtccgaggagttccccgaggaagtccctccccgggcagaggagattacaatcccggcggacgtgactccggagagagtacctacacacattgttgattacagcgaggctgaacagagtgacgaacagcttcaccaagaaatttcacaggcaaatgtcatttgcattgtgtacgccgtgaataacaagcattccattgacaaggttactagccgttggatcccactcatcaacgaacgtactgacaaagacagccggcttcctttgatactggtcggaaataaaagcgacctggtagagtatagctccatggaaaccatcctgccaattatgaaccagtatactgaaatcgaaacttgcgtggagtgctccgcaaagaatttgaaaaacatatccgaacttttttactatgcccagaaggccgtgctccacccaacagggcctttgtactgtccagaagagaaagagatgaaacctgcatgcattaaagccctcacccggatcttcaagatcagcgaccaggacaatgacggtaccttgaacgacgccgagcttaatttttttcagagaatttgtttcaatacgcccctggccccccaggccctcgaagacgtcaagaatgtggtgaggaaacacattagtgatggcgtggctgattctgggctgactctcaagggttttctttttctgcacactctgtttattcaaaggggccgtcatgagacgacatggacggtgctcagacgatttggatacgacgatgacttggacctgactccggaatacctctttcccttgctcaaaattcctcctgactgtactaccgagctcaaccatcacgcatatctatttttgcagtccaccttcgacaagcatgacctcgatcgagactgcgcgctgagccctgacgaattgaaggacttgttcaaggttttcccatacattccctgggggcccgatgtcaacaacacggtatgtacgaacgagagaggatggatcacataccagggtttcttatcacagtggacactgactacctacttggacgttcaacggtgtcttgaatacctggggtacctgggctatagtattctcaccgagcaggaatctcaagcaagcgccgtcacggttacacgggacaagaagatcgatctgcagaagaagcagacgcaacgcaatgtctttaggtgtaatgtgattggtgtgaaaaactgtggcaaaagcggcgtgcttcaggccctgctcggtaggaatctaatgcgacagaagaagattcgagaggatcacaagtcatactatgccatcaatacggtgtatgtgtacgggcaggagaagtacctcctattgcacgacatttccgaatcggaattcctgactgaggctgaaatcatatgcgacgtcgtctgcctggtctatgacgtatctaaccctaaatcttttgaatactgtgctagaattttcaagcaacactttatggactctcgaatcccatgtctgatcgttgctgctaaaagcgatctgcacgaggtgaagcaggaatactccattagcccgacagacttctgcagaaaacacaaaatgccgcctcctcaggcttttacttgtaacaccgcagatgctccgtcaaaagacatcttcgtgaagttgacaacgatggctatgtaccccgaagatcactaccgggacaggctctccagagacatgggccatacagataggattgaaaatctgcggaagatctgggtctttctcaagactgcacttcacgttacccaggccgatctcaagtcctctacattttggctgcgagctagtttcggtgctaccgtgttcgctgtgcttgggttcgccatgtataaagcactcctgaagcagagatag

SEQ ID NO: 131817 - DNA, 744 bp, Artificial Sequence
  Description of Artificial Sequence: Synthetic coding sequence
atgaaaaaggacgtgaggatcctgctggttggagaaccgagagtgggcaagacctccctcataatgtctctggtgtcagaggaattccccgaggaggtgcctccaagggccgaagaaattaccatccctgctgacgtaacgcccgagagggtgccaacacatatcgtcgactattctgaggctgaacagtccgacgaacagctgcatcaggaaattagtcaagccaatgtgatttgcatcgtgtacgcggtgaacaataaacattctatcgataaggtcacatcgcgatggatacctctaattaacgagcggacagataaggactcacggctgcccctcatactagtgggtaataagtccgacctcgtagagtattctagcatggagacgattctgcccatcatgaatcagtacacggagatcgaaacatgtgtggaatgtagcgcaaagaacctaaagaatatctcagagcttttctattatgcccagaaggctgtcctgcacccaacaggtccgctgtactgccccgaggagaaagaaatgaagccggcctgcattaaggctcttacccgcattttcaaaatttcagaccaagataatgacggtaccctcaatgatgcagagctcaacttcttccaacggatttgtttcaacacgcctttggccccacgcttcggttttgagcaggttctggtgctgctgttcctccagttctgggcccttttatgcacgaaacattactag

SEQ ID NO: 131818 - DNA, 1857 bp, Artificial Sequence
  Description of Artificial Sequence: Synthetic coding sequence
atgcgccgggatgtacggattctgctcctcggtgaagcacaagtcgggaagacctctcttattctcagcttagtcggcgaagagtttcccgaagaggtgcccccgcgcgcggaagaaattaccatccctgcagatgtaactcctgagaaggtaccaacgcacatcgtcgactattcagaagcagaacagacagacgaagaactccgtgaggagatccataaggccaacgtcgtctgcgtcgtttatgacgtgtccgaggaggctaccatcgagaagattcgcactaagtggattcccctggtcaatggcggaaccactcagggcccgagggtgccgatcatcctagtaggaaacaagagcgacctgcgctccgggtctagcatggaagctgtcttgcctattatgagtcagtttcccgagattgaaacttgcgtggaatgctctgccaagaacctgcggaacatctcggaactcttctattacgcacaaaaggccgtgcttcaccccacggctcctctgtatgatcccgaagcgaaacagctcagacccgcctgcgcgcaggccttaacccggatcttccgactctctgaccaagacctggatcaggctttgtccgatgaggaactcaacgccttccagaaatcctgctttggccacccactggccccacaggcattggaggatgtgaagaccgtggtgtgccggaatgtggcaggcggcgtgcgtgaagatcgcctgacactcgacggattcctgttcctaaataccttattcattcagcgcggtcgccatgagactacctggactattctgcgcagattcggttactcagatgcactggaactgactgccgattaccttagccccttaattcatgtcccaccaggttgctctaccgaactgaaccacctgggttaccaatttgtgcaacgcgtgttcgagaagcacgatcaggaccgggatggagccctttctcccgtggagttgcagagcctctttagtgttttcccagccgccccttggggccccgagctcccaaggactgtccgcacagaagccggtcggctgcccctacacgggtacctctgtcaatggacactggtgacatacctggacgtacgctcttgtctagggcacctcggatatttgggatacccaaccctgtgcgaacaggaccaggcccatgcaatcaccgtgactagggagaagagactggaccaggagaaagggcaaactcagcgaagcgtgctgctgtgtaaagttgtaggagcccggggcgtggggaagtccgcttttctccaagcatttctgggaagagggctgggccatcaggatacgcgcgagcagccccctggttatgctatcgatacagtgcaggtgaatgggcaggaaaagtacctgatactgtgtgaagtcggtaccgacggcttattagcgaccagtcttgatgccacttgtgacgtggcgtgcctgatgttcgatggcagcgacccaaaatctttcgcacactgcgcgtccgtttacaagcatcattatatggacggtcagacaccctgtctgtttgtgtcaagcaaggcagatctaccagaaggtgtggctgtctctggcccatccccagccgaattctgtaggaaacatcgattgcctgcgcctgtgcccttctcctgcgccggccctgctgaaccttccaccaccatctttacgcagttagccaccatggccgcttttccccacctggtacacgccgaactccatccctctagtttttggttgcgcggactgcttggtgttgtgggagccgccgtggccgcagttttatccttttccttgtaccgagtgcttgtaaaatctcaatag

SEQ ID NO: 131819 - DNA, 777 bp, Artificial Sequence
  Description of Artificial Sequence: Synthetic coding sequence
atgcctccacagcagggcgacccggcttttcccgacaggtgtgaggctccaccggtcccaccccgtcgtgagaggggcgggcgagggggcagaggtcctggagagcccggtggcagaggaagagcaggaggggccgagggaaggggtgtgaagtgcgttttagttggcgacggcgctgtcggaaagacatctctggttgtgtcgtatacaacgaatggctatcccaccgagtacattcccactgcctttgacaatttctctgccgtggtttccgtcgatggaaggcccgtgcgtctccagctgtgtgacacagcagggcaggatgagttcgacaaactgcggccgctctgttacaccaatactgacattttcttgctgtgtttctccgtggtcagccctagcagcttccagaacgtttccgagaagtgggtacccgagattaggtgtcactgtccaaaggctccaattatcctcgttggaactcaaagcgatttgcgcgaagatgtgaaggtgttgattgaactggacaagtgcaaggaaaaacccgtgcctgaggaagccgcgaagctgtgcgctgaggaaataaaggccgcttcctatatcgaatgtagcgcacttacccagaaaaacttgaaagaagtttttgacgccgccatcgtcgctgggattcagtattcggacacacagcaacagcctaagaaaagcaaatctaggacgcctgacaagatgaaaaacctctccaagagctggtggaagaagtactgttgtttcgtttag

SEQ ID NO: 131820 - DNA, 1527 bp, Artificial Sequence
  Description of Artificial Sequence: Synthetic coding sequence
atggatcacttaggagcctcgctttggccccaggtcggctccctgtgccttttacttgctggggccgcatgggcaccccctccgaatctacctgaccccaaattcgagtccaaagccgcgctgctggcagcccgaggccctgaggagcttctgtgcttcaccgagagattagaggatctcgtgtgtttttgggaagaagccgcaagtgccggggtgggtccgggtaattatagtttttcctatcagttggaggacgaaccctggaagctgtgcaggctgcatcaggcccccacggcgcgaggcgctgtgcggttttggtgcagcctgcctacagctgacacctcgagcttcgtccccctcgagctccgtgtaacggctgcctccggggcaccccgttatcatcgtgtcatacacatcaacgaagtggtattgctcgacgcacccgttgggctagtagctaggcttgccgatgaatctggacatgttgtactcaggtggctgcctccaccagaaaccccaatgacgtcccacattagatacgaagtggacgtcagcgcagggaacggcgcgggttccgtgcagcgcgtggaaatactagagggaagaacagagtgtgtcctttctaatctgagaggacggacccggtacacttttgccgtgcgcgcgagaatggctgagccctcatttggaggattctggtccgcctggtccgagccagtttcactgctgactccaagtgacctggatccattgatcctcaccctcagcctgattttagtcgtaatactggtgttgctcaccgtgttggctctgctgtcacaccggagggcattgaaacagaagatctggccgggcatccccagcccggaaagtgaattcgaggggctctttaccacccacaaaggaaactttcagctgtggttgtaccaaaacgatggatgcttgtggtggtcaccatgtaccccattcactgaagaccctcctgcctcgctcgaggtcttatccgagcgctgctgggggactatgcaggcggtggagccaggaactgacgatgaaggccctctgctcgaaccagtgggaagtgaacacgcccaagacacttaccttgtgttggacaagtggctactccccaggaatccgccgagcgaagaccttcctggaccaggcggcagcgtagatattgtggccatggatgaaggttctgaagcatcgagttgctcaagcgccctggcctcaaaaccatccccagaaggcgcctcagcagcctctttcgaatacactatcctggatccctctagccagctgcttcggccctggaccctgtgtccagagctgccacccacgcccccgcatctgaaatatctgtatctcgtagtaagtgacagcgggatctctactgactacagcagcggcgattctcaaggcgcgcagggcgggcttagtgatggaccctattccaatccttacgaaaatagcctgatcccagcggccgagccgcttccaccttcctatgtagcttgcagctag

SEQ ID NO: 131821 - DNA, 2550 bp, Artificial Sequence
  Description of Artificial Sequence: Synthetic coding sequence
atggcagctgcggcccccgctgccgctgctgcctcttcagaagcgccggccgctagtgctactgcggaacccgaggccggggaccaggactccagagaggttcgcgttctgcaatccctgagaggaaagatctgtgaggccaaaaatctcctgccttacctgggccctcataagatgcgcgattgtttctgcacgattaacttagatcaggaggaggtctatagaacacaggtcgtggaaaaatcactgagcccttttttctccgaagagttttacttcgaaataccacgtacctttcagtacctctctttttacgtgtatgacaaaaatgttctccagagggatttaagaattggaaaagtggccatcaagaaggaagacctgtgtaaccactctggcaaagagacctggttctcattgcaacccgtggattccaattccgaagtccagggtaaggtgcatcttgaattaaagctgaacgagctgatcactgaaaatggcaccgtgtgtcagcagctcgtggtgcatatcaaagcatgccacggcctccccctcataaatggccagtcctgtgacccctacgctacagtgtccctcgtaggcccatcacgtaatgatcaaaaaaagacaaaggtcaagaaaaaaacttctaacccacagtttaacgagattttttactttgaggtcactcgcagctcttcctacacccggaagtcacaatttcaggtggaggaagaagatatagagaagttggaaatccgcatcgatttgtggaataacggaaacttggtgcaggatgtgttcctgggtgagataaaggtccccgtcaatgtgttgaggacggatagtagccaccaggcctggtaccttctgcagccccgtgataatggaaataaaagcagcaaaacggatgacctgggcagcctgcgcctcaatatctgctatactgaggactacgttctcccttccgagtactacgggccgctgaaaaccttactgctgaagtcgccggacgtgcagcccatttctgcatccgcggcctatatcttaagcgaaatttgccgcgataaaaacgatgcagtgctgcccctggtccggctgctgctccatcacgacaaactcgtcccattcgcgacggctgtggctgagttggacctgaaggacacccaggatgccaacacaattttccggggcaacagcttagcgacaagatgcctcgatgagatgatgaagattgtgggtggacattatctcaaggtgacccttaaacccatcctcgacgagatttgcgattcatccaagagctgtgaaatcgatccgattaaactgaaagagggggataatgttgaaaataacaaggaaaatctgcgttactatgtagacaaactctttaacaccatcgtgaaatccagcatgagctgcccaaccgtaatgtgcgatatattctacagcctgcggcaaatggccacccagcgattcccgaatgacccacacgtccagtactcagcggtcagtagcttcgtcttcctgagattctttgcagtcgctgttgttagccctcatacttttcatttgcggccgcaccatcccgatgctcagacaatccgaaccctgactctgatcagtaagacaatccagactctgggttcctggggctcattgtctaagtccaagagctccttcaaagaaaccttcatgtgtgagttcttcaaaatgttccaggaagaagggtacatcatcgctgtgaaaaagttcttggacgagatttcttccacagagaccaaagagtcatccggtacatccgagcctgtgcatcttaaggagggcgaaatgtacaagcgggcccagggccgtacacgaattgggaaaaagaactttaaaaagcgatggttctgcttgaccagcagagaattaacataccataaacagcctggcaaggacgcgatttacacaattcctgtcaaaaatatcctggcggtggaaaaactggaggaatcaagcttcaataagaaaaacatgttccaggtgattcataccgaaaagccactgtatgtgcaggcgaacaactgtgttgaggctaatgaatggatcgacgtcctttgtagagtcagtaggtgtaatcagaataggctctctttttaccatccctccgtatacttgaatggaaactggctctgttgtcaggagacgggtgagaatactcttggatgcaagccttgtaccgccggcgtacccgccgacatacaaatcgacatcgatgaggaccgagaaactgagaggatctactccttgtttaccctgagcctgctaaagctccagaaaatggaggaagcatgtggcacgatcgcagtctatcaaggaccccaaaaggagcctgacgactattctaactttgtgatagaagactctgtaaccacattcaaaacaatccagcagattaaatcgatcatcgagaagttggatgagccccatgagaaatacaggaaaaaaaggtcttcaagtgcgaaatatggatccaaggaaaacccgatcgttgggaaggcttcctag

SEQ ID NO: 131822 - DNA, 834 bp, Artificial Sequence
  Description of Artificial Sequence: Synthetic coding sequence
atgatgaaaattgttggaggccactatttgaaggtgactctgaagcccattctggacgagatctgtgactcctctaagtcctgcgaaatcgatccaataaagttgaaggagggcgacaacgttgaaaacaataaggagaacctcaggtactacgtagataagctgttcaacaccattgtgaaatcgagcatgtcttgccccacggttatgtgtgatatcttctattcgcttcgccagatggctactcagaggtttcccaatgatccgcacgtccaatacagcgctgttagtagttttgtgtttctccgctttttcgcagtcgccgtcgtgtcacctcacaccttccaccttaggcctcaccacccggatgctcagactattcgcacactcactttgatctccaaaacgatacaaacactagggtcttgggggtctttgtcaaagagcaagtccagcttcaaggagactttcatgtgcgaattcttcaagatgttccaggaggaaggctacataatcgcggtgaagaaattcctggatgagatttcgagcactgaaacgaaggaaagtagtgggactagtgagccggtgcacctcaaggaaggcgagatgtataagcgagcacaaggaagaaccaggatcggaaagaagaatttcaagaagaggtggttctgtctgacctcccgtgaactgacgtatcacaagcagccaggcagctgcgtgtatgccctgctgtggggtttcagctggttctcagtgaaagtgtcgttgcccctcatcgtgacactggtcaatccctttagcaacataaccgtggtttacggcttttcgcactag

SEQ ID NO: 131823 - DNA, 2553 bp, Artificial Sequence
  Description of Artificial Sequence: Synthetic coding sequence
atggccgcagcggcccctgccgcagcagctgctagcagtgaggcacccgctgccagtgctactgctgaacctgaagccggtgaccaggacagtcgggaggtccgagtgctgcagagtctgcggggaaaaatctgcgaggcaaagaatctgcttccttatctcgggccgcataagatgagagattgtttctgtaccatcaatctggaccaggaggaagtgtacaggacacaggttgtcgagaagagcctgtcccccttcttctcagaggaattctacttcgaaatcccgcgcacatttcagtacctgagcttttacgtctatgataagaatgtgcttcagcgtgatctgcgcataggaaaggtggccatcaaaaaagaggatctctgtaaccactctggtaaagaaacctggttttctctccagcctgttgacagtaatagtgaggttcagggaaaagtgcacctggaactgaagctcaacgagctcatcacagagaacggtacggtttgccaacaactcgtggtccacattaaggcatgtcacggattacccttgattaatggccagtcttgtgacccctacgctactgtttcactggtgggcccttcccggaacgaccaaaaaaagactaaagttaagaagaagacctccaacccgcagtttaatgagattttttatttcgaagtcactcgatcatccagctacaccaggaagtcccaatttcaggtggaagaagaagatattgaaaagctggaaattaggattgatctttggaacaacggcaatttggtgcaggatgtctttcttggagaaattaaggtccccgtcaatgttctccgcacggactctagtcaccaggcctggtacttgctgcaacctagggacaatggaaataaatcatctaagacagatgaccttgggtccttgagattaaatatttgttatacagaagactacgtgttgccttcagagtactatggcccattgaagacccttctgctcaagagccccgacgttcaaccgatctctgccagcgccgcttacattctgagcgagatttgcagagacaagaacgacgctgtccttcccctggtgcgactgctgctgcaccacgacaaattggtcccttttgccactgctgtagcagaactggacttgaaggacacccaggacgcaaacaccatttttagggggaactccctcgccacccggtgcttagacgagatgatgaagatcgtggggggccactacttaaaggtaactctaaaacccatcttggacgagatatgcgactcttctaagtcatgcgaaattgaccccatcaaactgaaggagggggataatgttgagaataacaaggagaacctccgatactatgtagacaagctcttcaacactatagttaagagcagtatgagttgccctaccgttatgtgcgacattttctacagcttgcgccagatggccacgcaaaggtttcccaatgacccccacgtgcagtacagcgccgtgtcctcgttcgtctttttgcggtttttcgcagtcgcagtggtgtcccctcatacttttcatctcaggccccatcatccagacgcacagaccatccgaacattaaccctgatctccaaaaccatccaaacactaggttcttggggaagccttagtaaatccaagtccagtttcaaggaaacatttatgtgcgaattctttaagatgtttcaggaagagggctacatcatcgccgtgaaaaaattcctagacgaaatttcttcaaccgagaccaaagaaagtagtgggacctccgaacccgttcacctgaaagaaggggaaatgtacaaaagagcccaggggagaacaagaatcgggaaaaagaactttaagaagaggtggttttgtctgacctctagggaactaacctatcataaacagcccggatccaaggacgccatttacaccataccagtgaagaacattctggcggtcgagaagctggaggaaagtagcttcaataagaaaaatatgtttcaggtcatccacaccgaaaagcctctctatgtccaggctaacaattgtgtcgaggctaatgaatggatcgatgtactgtgcagggtgagccgatgtaaccagaatcgactcagtttctaccacccatccgtttatctgaatggcaactggctgtgctgccaggagacaggagagaacactctggggtgtaaaccctgtaccgcgggcgtacccgctgacatccagatcgacattgatgaggaccgggagacagaaaggatctatagcttgtttacgctttccctgttgaagctccagaagatggaagaggcgtgcggtacgatcgccgtctatcagggaccgcagaaagaacccgacgactatagcaacttcgtcattgaagactctgttacgacgtttaagaccatacagcaaataaagtcaattatcgagaagctggacgaaccccatgaaaagtacagaaaaaagaggagttccagtgccaaatacgggtctaaagagaatccaattgttggcaaggcttcttag

SEQ ID NO: 131824 - DNA, 2505 bp, Artificial Sequence
  Description of Artificial Sequence: Synthetic coding sequence
atggctgtcgaggatgagggcttgagagtgtttcagtcggttaagattaagattggtgaagccaagaacctgccatcgtatccaggacccagcaagatgcgagactgttactgtacagtcaaccttgaccaagaggaggtgttcaggactaagatcgtggagaagagtctgtgcccgttttacggcgaggacttttactgcgaaatcccacgatcattccgccacctgtctttctacattttcgatcgtgatgtctttcgccgcgactctattattggcaaggtcgccattcagaaggaagatttgcagaagtaccacaatagggacacgtggtttcagctgcagcacgtcgacgcagactcagaggtccaggggaaggtccacctggaactgaggctgagcgaggtaatcaccgataccggggtcgtgtgccataagttagcaacgcgcattgtcgaatgccagggacttcccatcgtcaacggacaatgtgatccttacgccactgtcactctggccggaccctttcgcagtgaagccaaaaaaaccaaggtcaagcggaaaaccaataatccacagtttgatgaagtcttctactttgaggtaacacggccatgctcctacagcaagaaaagccactttgatttcgaggaggaggacgtggataaactagaaatcagggtagacctctggaacgcctccaatctgaagtttggagatgaattcctgggcgagttacgcatcccactaaaggtgctccggcagtcctcatcctacgaggcctggtattttcttcagccacgcgataatggaagtaagtcccttaaacccgatgacttggggtctctgagactgaatgtggtgtacaccgaagatcacgtgtttagctccgattattatagccctctgagagatttactgttaaaatctgccgacgttgagccagtcagcgctagcgcggcacatatcctcggtgaggtctgccgagagaaacaagaggcagctgtaccactggtacgcctctttctgcactatggcagagtggtgccttttatcagtgcgatcgcctccgcagaggtgaagaggacgcaggatcccaacaccatcttccgtggcaacagcttagcttccaaatgcattgacgagactatgaaactggctggcatgcactacctgcacgtaaccctcaaaccagccatcgaggagatctgtcagagccataaaccatgcgagatcgaccccgtgaagcttaaagatggggagaacctggaaaacaacatggaaaatctccggcagtacgtggatcgggtttttcacgcgatcaccgaaagcggagtttcttgcccaacagttatgtgcgatatttttttctctctgcgcgaggccgccgccaagcgatttcaggatgatccagacgtccggtacactgctgtgagcagcttcatctttttgcgctttttcgcgcccgcgattttgtcccccaatctgtttcaattgactccgcaccataccgacccccagacctccagaaccctgacgctaatcagtaagaccgtgcaaaccctaggtagcctatcgaaaagcaaatcagcctccttcaaggagtcttatatggctacattctacgagttttttaacgagcagaaatacgccgatgcagtgaagaatttcctggatttaatcagctcaagtgggagacgtgacccaaaatccgttgagcagccaattgtgctgaaggaggggttcatgattaagagagcgcagggcaggaagaggttcggtatgaaaaactttaagaagcgatggttccgtctgaccaatcacgaatttacttaccacaagtctaagggagatcaaccactgtactccatccctattgaaaatatcctggcagtggaaaaactcgaagaggagagctttaaaatgaaaaacatgttccaggttattcagccggaaagggctctgtatatacaagcgaacaactgtgtcgaagccaaagactggattgatattctgacaaaggtttcgcagtgcaatcaaaaacgcctcacagtgtatcatccttcggcatatctgtctggccactggctgtgctgcagggcaccttcggactccgccccagggtgctccccttgcacagggggactgcccgcaaacatccagttagatatcgatggcgaccgggagaccgagcgcatttattcactgttcaatctctacatgtccaaattggagaagatgcaggaggcctgcggctctaaatccgtgtacgacggcccggaacaggaggagtactcgacctttgtgattgatgatccccaggagacatacaaaaccctgaaacaggtcatagcaggtgttggcgcgcttgagcaggaacatgctcagtataagcgcgacaaattcaaaaagacaaagtacggctcccaagaacatcctatcggcgataagagcttccaaaattatattcgccagcagagtgagacatccacgcattcaatctag

SEQ ID NO: 131825 - DNA, 2409 bp, Artificial Sequence
  Description of Artificial Sequence: Synthetic coding sequence
atgcgggactgctattgcacagttaatctggaccaggaggaggtgttccggacaaaaatagtggagaagagtttgtgccccttctatggcgaagacttttactgtgagatcccaaggtcattccgccacttgagcttttacatctttgatagggacgtcttccgccgcgacagcattattggcaaggtggcaatacagaaagaagacctccaaaaatatcataatcgggacacttggttccagctacaacacgttgacgcagacagcgaggtacaaggcaaagtccacctggagcttaggctatctgaagttatcactgacactggcgttgtgtgtcataagttagctacccgcatcgtggaatgtcaaggcctgcccattgtcaatggtcagtgcgatccttatgcgaccgtgacactggccggtccttttaggtcagaagccaaaaaaactaaagtgaagcgcaaaaccaacaacccccagttcgacgaagtgttctactttgaggtgactaggccttgttcgtattctaaaaagtcccattttgattttgaagaggaggatgttgacaaactggaaatcagggtggacttgtggaatgcaagcaaccttaaattcggggacgagtttctgggagagttaaggattccactcaaggtccttaggcagtcttcatcttatgaggcttggtacttcttgcagccgcgggataacgggtcaaagtctttgaaacctgatgacctgggctcactgaggctgaatgtcgtgtacacagaggaccacgtgttcagcagtgattattacagccccctccgggatctgcttctaaaaagtgccgatgtggaaccggtctccgctagtgcagcacacatattgggcgaggtctgtcgcgaaaagcaggaagccgccgtgccattggtcagactatttttgcactacggaagagtggtcccattcatctctgcaatcgctagtgccgaagtgaaacgcacgcaggaccccaacactatctttcgaggaaattccctggcttcaaagtgcatcgacgagactatgaagctggcgggaatgcactacttgcatgtaactctgaagcctgccatcgaagagatctgccagagccacaagccttgcgagattgatcctgtcaaactgaaggacggcgaaaatcttgagaataatatggagaacctgaggcagtacgtggacagggtatttcatgccatcactgagtcgggtgtcagctgccccactgtgatgtgtgacattttctttagtctccgagaagcggcagccaagcgattccaggatgaccccgacgtgcgatacactgccgtgtccagctttatttttcttaggttttttgccccagccattctctcacccaatcttttccagcttaccccccatcatacagacccccagacttccaggacactcacactcatctctaaaaccgtgcagactctgggctctttgtcaaagagtaaatcagcctcctttaaggaaagctacatggctaccttctacgagttcttcaatgaacagaaatacgccgacgcagtgaagaacttcctggacctgatcagttcttccggaaggcgggaccccaagtctgtcgaacaaccgatcgttctaaaagaggggttcatgattaagagggcacagggtagaaagcggtttggcatgaagaactttaaaaaacggtggtttcgcctgacgaaccacgagttcacctaccacaaaagtaaaggcgatcaacccctgtattccatccctattgagaacattctcgcggtcgagaagctcgaagaagaatcattcaagatgaagaacatgttccaggtaatccagcctgaaagggccctctatatccaggcaaacaattgcgttgaggcgaaagattggatcgacatacttacgaaggtttcccaatgtaaccaaaaacgactgactgtctatcacccttccgcatacctgagcgggcactggctatgttgcagggctccttccgacagtgcaccaggctgcagcccgtgtacaggcgggttgcctgctaacatccagctggatatcgatggggaccgcgaaactgagagaatatactcactgtttaatctctacatgtcgaagcttgaaaagatgcaggaggcttgcggcagcaagagtgtgtatgacggacccgagcaggaggaatattccacgttcgtgattgacgatccacaagagacgtacaaaactctgaaacaggtgattgcaggggtgggggcactcgagcaagagcatgcacagtacaaacgcgacaaattcaaaaaaactaagtacggttcccaggagcaccctatcggcgataagagcttccagaactatattaggcagcagtcagagacctcgactcatagcatatag

SEQ ID NO: 131826 - DNA, 399 bp, Artificial Sequence
  Description of Artificial Sequence: Synthetic coding sequence
atggctgtcgaggacgagggactgagagtgttccagtctgtgaagatcaagatcggagaggcaaagaatttgccctcataccccgggccctcaaaaatgcgcgactgctattgtacagtaaatctggatcaagaggaagtgttccgcacaaagatcgttgaaaagtcgctgtgcccattttacggggaggatttctactgcgagataccgaggtcatttcgccatctgagcttctacatctttgatagggatgtgttcagaagagactcgattattgggcagtcagccccaggcgcagcagcagagagagggcaccaccggcactggggcagacttccgcaggcccggcatacgcaccgacgggtcccagggcccccgcacagggagtgggcgatgtag

SEQ ID NO: 131827 - DNA, 2412 bp, Artificial Sequence
  Description of Artificial Sequence: Synthetic coding sequence
atggccaagcggagtagtctctatataagaatcgtcgaaggaaaaaatctgcccgctaaggacatcactgggagctccgacccttattgcatcgttaaggtggataacgaacccattatcaggacagccactgtgtggaaaacattatgcccattttggggcgaggagtaccaggttcacttgccccctaccttccacgctgtagctttctacgttatggacgaggacgccctgtcgcgcgacgacgtgatcggaaaggtgtgcttgacgcgggacacgatcgcctcccatcccaagggcttctcggggtgggcacatctgacagaggtagaccccgacgaggaggtacagggtgaaatacacttgcgtctggaagtgtggccgggagctcgtgcatgtcggctcagatgctctgttctggaagcaagagaccttgcaccaaaggatcgcaacggaacctctgacccctttgtgcgggtgaggtataaaggccggactcgggaaacgtcaattgtcaagaaatcatgctacccgcgctggaatgagacctttgagtttgaacttcaggagggtgcgatggaggctctgtgcgtcgaagcatgggattgggacctggtgtctcgcaacgatttccttggaaaagtggtgattgacgtccaacggctccgggtggttcagcaggaggaaggctggtttaggctgcagccagaccagtctaaatctagacgccatgatgaaggcaatttaggctccttgcagctggaggtgagactgcgtgatgagacagtgctccccagctcttactatcagcccttagtccatctgctgtgtcacgaggtgaaattggggatgcaaggacctgggcagctgatcccattaattgaggaaacaaccagcacagagtgcaggcaagacgtggctaccaacctactcaaactcttcttggggcagggcctggccaaggatttccttgatttgttattccagcttgagctgtctaggactagtgaaactaatactcttttcaggtccaattctctggcttcaaagtccatggagtcatttctgaaggtggctgggatgcagtatctgcatggcgtccttggccctatcattaataaggtgttcgaggagaagaagtatgtggaactcgatccctcaaaagtggaggtgaaagacgtgggctgctcaggactgcacaggccccagaccgaggcggaggttttagagcagtccgcccagaccctgagagcacatctcggggcactgctctccgccctgtctaggagcgtcagagcatgtcccgccgttgtacgggccacgttcagacagctcttccgtcgcgtcagggaacgtttccccggtgctcagcacgagaatgtgccatttatcgcggtcacttccttcctctgtttacgttttttttctccggcaatcatgtcgccaaaactgttccacttacgtgagcgccacgcagatgccagaacctcacggacactgctgcttctggcgaaggctgtgcagaacgtgggcaacatggatactccagcctcccgtgcaaaagaagcttggatggaaccactgcagcccaccgtcagacagggtgtggcccagctaaaggacttcatcactaaactggtggatatcgaagaaaaagatgaactcgacctgcagagaaccctcagtctccaagcccctccagtcaaggaagggcccctgttcatacatcggactaaggggaaggggccacttatgagctcttcatttaagaaactgtacttttccttgaccactgaggcactcagctttgcgaaaacaccctctagtaagaaatccgctctgatcaagttggcaaacattagggcggctgaaaaggtggaggaaaagagcttcgggggatctcacgtgatgcaggtcatttacacagacgacgccgggcgtccacaaactgcctacctccagtgtaagtgtgtcaacgagttgaaccagtggctgtctgctctgaggaaagtatccataaataataccgggctgttaggatcctaccatcccggtgtctttcgtggagacaagtggtcttgctgccatcaaaaagagaaaactgggcagggctgtgacaaaaccagatcccgggtaaccctgcaggagtggaacgaccctttagatcacgacctggaggcccagcttatctacagacacttacttggcgtggaagccatgctgtgggaaagacacagggaactatccggaggcgctgaagcaggcaccgtgcctacaagcccaggcaaggtgccagaggattcactggctcgcttgctgagggtcttgcaggatttgagagaagcgcactcatctagcccagctgggtcaccccccagcgaaccgaactgcttgctggaactgcaaacttag

SEQ ID NO: 131828 - DNA, 2274 bp, Artificial Sequence
  Description of Artificial Sequence: Synthetic coding sequence
atggccaaaaggtcctccctgtatatacggatcgtggaagggaagaacttacccgctaaggatattacgggcagctccgacccctattgcatcgtcaaggtagacaatgagcctatcattagaacggcaacggtgtggaagactctatgcccgttctggggagaggagtaccaggtacacctgcctccgaccttccacgctgtggctttttatgtgatggatgaagacgcactgagccgagatgatgtcattgggaaggtgtgcttgacaagagataccatcgctagccacccgaaaggcttcagcggatgggctcaccttacagaggtcgatcccgacgaagaagtgcagggggagattcacttgcgactagaggtctggcctggagcaagagcttgcaggttgcgttgctctgtgcttgaggctcgcgaccttgcacccaaggacaggaatgggacctccgacccattcgttcgcgtgagatacaagggcaggacccgggaaacgtctattgtcaaaaagtcctgttaccctaggtggaacgaaacgtttgagttcgaactgcaagagggtgcaatggaagcgctatgcgtggaggcctgggactgggatctggtcagccggaatgatttcctgggcaaagtggtcatcgacgtccagcgacttcgagttgtgcagcaggaggaaggctggttccggctgcagccagaccaaagcaagagccgcaggcacgacgagggaaacctggggagcttgcagctcgaggtcaggctacgagatgaaacagtgttgccatccagctactaccaacccttggtccaccttctctgtcacgaagtgaaacttgggatgcaagggcccggccagttaatcccattgatagaagagacgacatccaccgagtgtagacaggacgtggctactaatttactcaagctctttctgggacagggactggcaaaggattttctggacctgctgttccagctggagctctcccgaaccagcgagaccaatactctatttcggtcaaactcacttgcctccaagagtatggaatcctttctaaaggtggccgggatgcagtatctccatggggttctcggacccatcataaacaaagtgtttgaagaaaaaaagtatgtcgagttggacccctctaaggtggaggttaaggatgttgggtgctcaggcttgcatagaccccagactgaagctgaagtgttggaacaatcagctcaaaccctccgcgctcacctcggggcgctgttaagcgctctgtcaagaagcgtgagagcctgtccggccgtcgtgcgtgcaactttccgacagctgttccgcagagtgagagagcgctttccaggcgcacagcacgaaaatgtgccttttatcgctgtgacttcttttctgtgccttcgtttcttttccccagctattatgtccccaaaattgtttcacttgcgggagcgccacgctgacgctcgaacaagccgtactctgctcctcctggctaaggccgttcagaacgtgggcaacatggacactcctgcaagtcgcgctaaagaggcttggatggaacccctgcagcccaccgttcggcagggcgtggcccaattaaaggacttcataactaagctcgtagatattgaggaaaaggacgagctcgacctccagcgaaccttatcgctgcaggctcccccagttaaagaaggccctctgttcatccacaggactaagggaaagggacccctcatgagcagctctttcaaaaagctctatttcagtctgacaaccgaggccctttcattcgcaaaaactccatccagcaaatgcgtgaatgaactaaaccagtggctgtccgccctccggaaggtgagcattaacaacaccgggcttctaggaagctatcacccaggagtattccggggcgacaaatggagttgttgccaccaaaaggagaagactgggcagggttgcgataagactcgatcgcgcgtgactctgcaggagtggaacgatcccctggatcatgacttggaagctcaactcatctatcgtcaccttctgggagtcgaggctatgctgtgggagcggcatcgggaactctctggcggagctgaggcagggacagtacctacgagtccgggcaaagtaccagaagatagcttagctcgcttacttcgggtccttcaggatctgcgagaagctcacagcagtagccccgccggaagcccaccttcagaaccaaactgcttgctagagctgcagacctag

SEQ ID NO: 131829 - DNA, 2196 bp, Artificial Sequence
  Description of Artificial Sequence: Synthetic coding sequence
atggacgaggatgccctttcgcgcgatgatgtaatcggcaaagtctgtctgactcgcgataccattgcctcccaccccaagggcttcagcggctgggcacatctcacagaagttgaccctgatgaggaagtgcagggagagatccatctccgattagaagtgtggccaggagctcgggcctgcaggctaagatgctctgttctggaggcccgagacctcgccccaaaggaccggaacggtaccagtgacccattcgtcagggtacgttacaagggacgaacgcgcgagacctctattgttaagaagtcctgttacccacgctggaatgagacattcgagtttgaactgcaggagggtgccatggaggcgctctgcgtggaagcctgggactgggaccttgtatcccgcaatgacttcttaggcaaggtggtaattgacgtacagcgcctcagggtagtccagcaggaggaaggttggttcagactccagccagatcagtctaagtcacgcagacacgatgaaggtaacctaggctctttacagctggaggtccggctgcgcgatgaaaccgtgctcccctcctcttactatcagccattggtgcatctgctctgtcatgaggtgaagttaggcatgcaaggtccgggccagctaatcccattgattgaggagacgacttctaccgaatgtaggcaggacgtggcgaccaacctactcaaactttttttaggtcagggtctcgcaaaagacttcctggatctcctcttccagctcgaactgtcacggactagtgagactaacaccttgttccggagcaactctctggcctctaaaagcatggagtccttcctgaaagttgctggaatgcagtatctgcatggtgtgcttggccccattatcaataaggttttcgaagaaaagaaatatgttgagttagacccatcaaaggtggaggtgaaagacgtcggctgctctgggctgcaccgccctcaaacagaagcggaagtgctagaacagagtgcccagaccctgcgcgcccacctcggagccttactatctgctctgagccgcagcgtgagggcctgtcccgcagttgtgcgagccactttccggcagctgtttcggagagtgcgtgagagattccctggagcacagcatgaaaatgtgcctttcatcgcggtcacttccttcctttgcctgcgctttttcagccccgccatcatgtccccgaagctgttccatctgcgggaacgtcacgccgatgctcggacgtcacggacactgttattgctggctaaagctgtgcagaacgttggcaatatggatacgcctgcctctcgagcgaaggaggcctggatggagccgttacagcccactgtgagacagggagtggctcaactcaaggacttcattactaagctggtagatatcgaagagaaggacgaactggatctgcaaagaactttgagcctccaggcaccgccagtcaaggagggtcctttgttcattcaccgaactaaaggcaaggggcccttaatgtcttcatctttcaaaaagctgtacttttcccttactacagaagccctcagcttcgctaaaacaccatccagcaagaagagcgccttgattaaactggctaacatacgcgctgcagagaaggtggaagagaagtctttcggcggtagccacgttatgcaggtcatatacacggatgacgccggtagacctcagaccgcctacttacagtgtaagtgtgtcaatgaactgaaccagtggctttccgcattgcgcaaggtgtcgatcaataataccggactcctgggcagttatcacccaggcgtgttccgcggcgacaaatggagttgttgtcatcagaaggagaagactgggcaaggttgtgacaaaacacgcagtcgtgtgaccctgcaggagtggaatgacccccttgatcacgacctggaagcccaacttatttacagacacttgctgggcgttgaagccatgttatgggaaagacatagggaactaagtggcggcgcggaagcgggcactgtacctaccagccccgggaaggtgcctgaggactctctggcccgactgctacgagttctacaagatttaagagaggcgcatagtagcagtcccgccggaagcccacccagtgagcccaattgtttgctggagctccagacttag

SEQ ID NO: 131830 - DNA, 2415 bp, Artificial Sequence
  Description of Artificial Sequence: Synthetic coding sequence
atggccaagagctcatctcttaatgtgagagtcgtggagggaagagcactccccgctaaagatgtgtctgggagcagtgatccatactgcttggtaaaagtcgatgatgaagtggtggctcggaccgcaaccgtatggcggtcccttggacccttttggggtgaagagtatacagtacacttgcccctggatttccatcagttagccttctatgtcctagacgaagatacagtcgggcacgatgatattatcggaaaaatcagtctcagcagggaggcaatcaccgcggacccacggggtatcgattcttggatcaacctatccagggtagaccccgatgccgaagtccagggcgagatatgcctgtccgtgcagatgctcgaggatggccaaggtcggtgcttaaggtgtcatgtacttcaggcccgggatcttgctccacgcgacattagtgggacttcagacccatttgcaagagttttctggggatcccagtcgctggagacttctaccatcaagaaaactcggttcccccattgggatgaggtgctcgagcttcgtgaaatgcccggggcacccagtcccctgcgggttgagctgtgggattgggatatggtgggaaagaacgatttcctgggaatggtcgaattcagccctaagaccttgcagcaaaaaccaccaaaaggctggtttcgcttgttgcccttccctcgggccgaagaggactccggcgggaacctgggagccctgagggtgaaggttaggctgattgaggatcgagtgctaccatcacaatgttaccaacccttaatggagcttctgatggaaagcgtgcaagggcctgccgaggaggataccgccagtcctctggctttgcttgaggagttaactctaggcgactgtcggcaggacctggcaactaagctcgtgaagctgttcctcgggcgcgggctggccggtcggtttcttgactacctcaccagacgcgaagtggccagaacaatggacccaaacaccctgttcaggtctaactccttagcaagcaagagcatggaacaatttatgaaactcgttggtatgccgtacctgcacgaggttctaaagcctgtgatttctagggtctttgaggagaagaagtacatggaactggacccctgtaaaatggacttaggccggacacgccgaatttccttcaaaggagccttatccgaagaacagatgcgcgaaacttccctgggcctcctcacggggtaccttggccccattgtagacgctatagtaggttcagtaggaaggtgtccccccgctatgaggctggcctttaagcaattgcacaggcgcgtggaggagcgctttccacaagcggaacatcaggatgtgaaatatttggcgatatctggttttctgttcttgaggttcttcgccccagcgatcttgacccccaagctttttgacctacgcgatcagcacgccgaccctcaaaccagtcgatcacttctgctcctcgcaaaagctgtgcagagcattggcaatctggggcagcaactcggccaggggaaagagctctggatggccccactccaccctttcctgctccagtgcgtgtctagggtgagagacttcctcgataggctagtggatgttgatggggacgaggccggtgtgcctgccagagccttgttcccaccctccgccattgtccgagagggatatcttctcaagcgcaaagaagagccagcaggtctggccactcggtttgcctttaagaagaggtacgtgtggctgtcaggagagaccttaagcttcagtaagagtcccgagtggcagatgtgccactctatcccggtgtctcatatccgggcagtggaacgggtggacgaaggagcctttcagctgccgcacgttatgcaggttgtcacacaggatggcacaggtgctctacacacaacctatcttcagtgtaaaaatgtaaacgagctgaaccagtggttgagcgctctgagaaaggccagtgctccaaacccaaacaaactcgcagcctgtcaccccggtgcttttcggagcgcacgctggacttgttgcctccaggcagaacggtctgctgccggttgttctaggacacatagtgcagtcacactgggagactggagtgatcccctggaccctgacgcggaagcccagacggtttaccgtcagctcctcctcggacgtgatcaactccgactcaagttgctggaagattctaatatggacactacgctcgaggccgatacaggtgcatgccccgaggtcctggcccggcaaagagccgcgaccgctcgcttgctggaagtcctcgccgacctggaccgcgctcacgaggagtttcagcagcaggagagaggtaaggcagccctgggaccactcggaccatag

SEQ ID NO: 131831 - DNA, 2331 bp, Artificial Sequence
  Description of Artificial Sequence: Synthetic coding sequence
atggctaagagcagtagcctgaatgtgagagttgtggagggaagagcgcttcctgccaaggatgtcagtggatcttccgatccctactgtttagtcaaagtggatgatgaggtggtcgctaggaccgcaacagtctggcggtccctgggtcctttttggggggaggaatatacagtgcatctaccactggacttccatcaactcgccttttatgttctggacgaggatactgtggggcacgacgacattatcggcaagatttccctgagccgggaagccatcacggctgatccgagaggcatcgactcttggattaacctgagtagggtggatcctgatgctgaggtccaaggagaaatttgtctgagtgtgcagatgctagaggacgggcaagggaggtgtttgagatgccacgtcctgcaggctagggatctggctccaagagacatttcggggacaagtgacccctttgcaagggtattctggggctcccagtctttggagacttccacaattaaaaagacgaggttcccacactgggacgaggtcctcgaacttcgagagatgcccggggctcccagcccactcagagtggagttgtgggactgggatatggtcgggaagaatgacttcctgggcatggttgagttttcaccaaaaaccctacagcagaaaccccccaaagggtggttcagactcttaccatttcccagggccgaagaagatagtggcggcaacctgggagctttgcgggtgaaagtccgtctcattgaggatcgagtcctcccttcccagtgctaccagccactgatggaactcctgatggagtccgtacaaggacctgcagaggaggacaccgccagtcctctggcccttctggaggaactgaccctgggcgattgccgccaagatctggctactaagttggtcaagctgttcctcggccggggcctcgcagggcggttcctggattatctgaccaggcgggaagtcgctcgcactatggaccccaatacactcttccgctctaatagcctggcctctaaatccatggagcaattcatgaagttagtcggaatgccctaccttcatgaagtcctgaaaccagtgatcagcagagtgttcgaagagaagaaatacatggagcttgatccctgcaaaatggacctcggacgaacccgtcgcatttccttcaagggtgctctgagcgaagaacagatgagggagacttcacttggcctgctgacaggatatttggggcccatcgtggacgccatagtgggctctgtgggacggtgtccccccgccatgcgcctcgcttttaaacagctgcataggagagtcgaagaacggtttccacaggctgaacatcaggatgtgaaatatttggcaattagtggcttcttgttccttcggttttttgcccccgccatccttacccctaaacttttcgatttacgtgatcaacacgccgatcctcaaacaagcagatcactcctcctgctagcgaaagccgttcagagcatagggaacctgggccagcaactgggccaggggaaggagctgtggatggctcctctgcatcctttccttctgcaatgtgtcagccgagtgcgagatttcttggatcggctggtagacgtcgatggcgacgaggctggcgtcccagcgagagccttattcccaccttcggccatcgtcagagagggttacctgctcaagaggaaggaagagccagctggtctcgctacccgttttgcttttaagaagcgatacgtgtggctgtcgggcgaaacactgtcgttctccaaatcccccgagtggcaggtcgtgacccaggatggaactggcgcactacacactacttatctgcagtgtaagaatgtgaatgagttgaaccaatggctctccgccttacgtaaagccagtgccccaaaccctaacaagctggcagcttgtcatcctggggccttccgctcagcgagatggacttgttgcctgcaagctgagaggtccgctgccggctgttcgaggacccattccgctgtgacactgggcgattggtctgacccactcgatccggacgccgaagcccagacagtgtatcgtcagctgctcctgggaagggaccagttacgactgaagctgcttgaagacagcaacatggataccacactagaggccgatacaggggcatgccccgaggtcttagcgagacagagggccgctaccgcaaggttactcgaggtgctcgccgacctcgatcgagcacatgaagagttccaacagcaagaaaggggaaaagcagcccttggccccctaggcccatag

SEQ ID NO: 131832 - DNA, 2421 bp, Artificial Sequence
  Description of Artificial Sequence: Synthetic coding sequence
atggccaaatcatctagcctgaacgtgcgggtcgtcgagggccgagcactgcctgcaaaagacgtgtctggctcttcagatccttactgcctggtgaaggtcgatgatgaggtggtggcaaggaccgccactgtgtggcggagcctcggcccattctggggtgaggagtacactgtgcacctccctctggactttcatcaactagccttctacgtactggacgaggacactgtcggccatgatgacataattggaaagatcagtttatcacgggaggctattaccgccgacccccggggaatcgacagttggatcaacctgagtagagtggaccccgacgccgaggtccagggcgaaatctgtctatctgttcagatgttagaggacggacaggggcgttgcctgcgatgtcacgtactgcaggcgagagaccttgcgccccgggacatctctggcacctccgatccctttgctagggttttttgggggagccagagcctggaaacatctacaatcaagaagacaagattcccgcactgggatgaagtcctggaattacgcgagatgccaggcgcccctagcccccttcgcgtggaattgtgggattgggatatggttggtaaaaacgactttctgggcatggtggaattttcccctaagactctccagcagaagccccccaaagggtggttccggctccttccattcccaagggccgaggaagatagcggagggaacctgggggccctccgggtcaaggtgaggctgatcgaagacagagtcctgccaagtcagtgttatcaacccttaatggagttgcttatggagagcgtccagggacccgccgaagaggacaccgcatctcccctggctctcttggaggaattgacactgggcgattgtaggcaagacctcgctacgaagctcgtgaaactctttcttggtcgtggactagctggaagattcctcgactacttaactaggagggaggtagctagaacaatggatccaaatacactctttcgttctaactctttggcgtctaagtcaatggagcagttcatgaaactggttggcatgccatatctccacgaggtgttgaaaccagtgataagtcgtgtgttcgaagagaaaaaatacatggagttggacccctgtaaaatggacttgggccgaacacggaggataagcttcaagggagccttaagcgaggagcaaatgcgagagacgtcgctaggactcctgaccggatatctcggtccaatcgtggacgccatagtgggctccgttggacgttgtcctcctgcaatgcggctggcgttcaagcagcttcacaggagggtcgaggagcgctttccccaagctgaacatcagcaggatgtgaagtatttagcgattagcggattcttattcctgcgattttttgccccggccatcctgacgcctaaactgttcgatttgagagatcagcatgccgacccacagaccagtcgcagtcttttactactggccaaagctgtccagagcattggaaatctaggccaacagctgggtcagggcaaggagctatggatggcaccactacatccctttctcctccagtgtgtgagcagagtaagagactttctggataggctggttgacgtcgacggtgatgaggaagctggggtacccgctcgggctcttttccccccctcagccatagtgcgcgaaggatatctgcttaaacgcaaggaagaacccgcagggctggccacgaggtttgctttcaagaaacgatacgtatggctcagcggagagaccttatctttctctaagtccccagaatggcagatgtgccactcgatcccggtctcccatattcgtgccgttgaaagagtggacgaaggcgcttttcagctgcctcatgtcatgcaggtggtgacacaggacgggacaggcgcgctgcatacaacttacctgcagtgtaaaaacgtcaacgagctgaaccagtggctgtctgcccttaggaaggcgtctgctccgaatcccaataaactggccgcgtgccaccctggggcttttcggagcgctcgctggacatgttgtttgcaggctgagcgcagtgccgcaggttgtagtcggacccattccgccgtaaccctaggggactggagtgaccccctcgacccagacgccgaggctcagactgtgtaccggcaactccttctgggcagggaccagctgcgcctaaagctcctggaggattccaatatggacacgactttggaggctgacactggcgcctgccctgaagtgctcgctcggcagcgcgcggctacagctaggctcctggaggtcctagcagatctggatcgggctcacgaagaatttcagcagcaagaacgagggaaggccgctcttggtccattgggcccgtag

SEQ ID NO: 131833 - DNA, 3714 bp, Artificial Sequence
  Description of Artificial Sequence: Synthetic coding sequence
atgcaaaaatctgtcaggtacaatgaaggtcacgctctatacctcgcattcctggctagaaaagaaggaacgaagcgaggtttcctgtcaaaaaagacagctgaggcgtccaggtggcacgagaaatggtttgcactttaccagaacgtcttattctattttgaaggagaacagtcatgtagaccggccggaatgtacctactggagggttgcagttgtgagcggactcccgctccaccaagggcaggagcgggccagggaggggtaagagatgcacttgataaacagtattatttcacggttcttttcgggcacgagggtcagaagccactcgagctccggtgcgaggaagaacaggatggcaaggaatggatggaggcgattcaccaagcatcttatgcagatattcttatcgagagagaagtactgatgcagaagtatatccacctggttcagattgtggagacagagaagattgcggcgaatcagcttcgtcatcaactggaggatcaagacacggagatcgagcgcctaaaatccgagatcatcgccctaaacaaaactaaggagagaatgcgaccttatcagtcaaaccaggaggacgaggacccggatatcaagaagatcaagaaggtacagagttttatgcgcgggtggctgtgcagaaggaaatggaagactattgtgcaagactatatctgttctcctcatgcagagtctatgcgaaagagaaaccaaatcgtctttacaatggtggaagccgagtcagagtacgtgcatcaactctatatactggtgaacggctttctgcggccactgagaatggcggcgtcctctaagaaacctccaatatcacatgatgatgtctcgtccatctttctgaattcagagaccatcatgtttctgcacgaaatcttccaccagggccttaaggcacggatagctaactggccgacactgattttagcggatttattcgacattttgctgcctatgctcaacatttaccaggagttcgtacgcaaccatcaatactccctgcaggttctggccaattgtaagcaaaatcgggattttgataagttgctgaagcaatatgaggccaatcccgcgtgtgaaggtagaatgctcgaaacctttttaacttatccaatgttccaaatcccaagatacatcatcacgctccacgagttgctagcccacaccccgcacgaacacgtggaacgcaaatcactcgaattcgcgaaatccaaactcgaagaactgtctcgggtgatgcatgatgaagttagtgatacagagaacatccggaagaatcttgctattgaaagaatgatcgtcgagggttgtgatattctgctcgatacttcccagactttcattcgccagggaagcttgatccaggtgcccagtgttgaacggggcaaactatccaaggtgcgcttgggcagtttgagcctgaaaaaagagggagaaagacagtgcttcctcttcactaagcatttcttaatttgtacacggtcaagcggtggtaagttgcatctccttaaaaccggcggtgtgcttagtctgattgactgcaccctgattgaagagcctgatgcctcagatgacgactcgaagggcagcggacaggtcttcggtcatcttgacttcaagatcgtggttgaacctcccgacgccgccgcattcactgtcgtcttgctggctccaagtcgacaggagaaagccgcctggatgtctgacatctctcagtgtgttgataacattcggtgtaatggtctgatgaccatcgtgtttgaggagaacagtaaagtcactgttccacacatgatcaagtcagatgctaggctacataaggacgacacagacatttgcttctccaagacactcaacagttgcaaggttccacagatccgctacgcctcggtagaacggctgctcgaacgccttacagacttgaggtttcttagcatcgatttcttaaatacattcctccacacatatcgcatctttaccaccgcagccgtggtgctggggaaattgtctgacatctacaaacgacctttcaccagtattcccgtccgttctcttgaactgttttttgcgacatcacagaataacagaggcgaacacctggtggacggtaagtccccaagactctgtagaaaattcagttctccgccacctctggcagtgagccggacttccagccccgtgagagcccgaaaactatctctgacctcgcctctgaattcaaagatcggcgccttagatctcacgacctccagtagccccacaaccacaacgcagtctccagctgcgtccccaccaccccacactgggcagatcccgctggacttgtctaggggcttgtccagccctgaacaaagccctggaactgttgaagagaatgtcgataacccccgggtcgacctgtgcaataagttgaaacgctctattcaaaaggcagtcttagaatcagcacccgcagaccgcgccggcgttgagtctagtcctgctgcagacaccactgagttgagcccgtgtagatcccccagcaccccaaggcaccttcgataccgacagccagggggccagacagcagacaatgctcactgttccgtcagtccggcatcggcgtttgccatagctactgctgccgccggccatggaagcccccccggctttaacaatacagaacgaacatgtgacaaagagttcatcatccggcggactgcaacaaatagagtactgaacgtcctgaggcattgggtttccaagcatgcccaggattttgaactgaacaatgaactgaagatgaacgtgttaaacctgttagaggaggtgctgagagacccagacttgctgcctcaggagcgcaaggcagccgcaaatatacttcgcgcgctatcgcaggatgaccaagacgatattcacttgaagttggaggacatcatccagatgaccgactgtatgaaggccgagtgctttgaatccctcagtgcgatggaactcgctgaacagattaccctccttgaccacgttattttccgatccattccatacgaggagttcctgggacaaggctggatgaaacttgataagaacgaacgcaccccatacatcatgaaaacaagccagcacttcaacgacatgtccaacctcgtggcctctcaaatcatgaactatgccgacgtttcctccagagccaacgcgatcgagaaatgggtggccgtggctgatatttgtcggtgtctccacaactataatggagtgctggaaatcacttccgctctcaatagatcagctatctatcgcctgaagaagacctgggcgaaggtgagcaaacaaacaaaagcccttatggacaagctgcaaaagactgtgtcatctgagggacgctttaagaacctacgggaaacactgaaaaattgcaacccacccgccgtgccatatctgggcatgtatctgacagatcttgccttcatcgaagagggaacccccaatttcacagaagaaggtctggtcaactttagcaaaatgcgaatgatttcccacataatccgggagattcggcagttccaacaaacatcctaccgaatcgaccaccagcccaaggtcgctcagtacttactggataaagatctgataatcgacgaggatacactgtacgaacttagcctgaagatcgagcccaggctgcccgcctag

SEQ ID NO: 131834 - DNA, 4431 bp, Artificial Sequence
  Description of Artificial Sequence: Synthetic coding sequence
atgacgtcaagcagtcctgcaggtctcgaaggctcagacctgtccagcataaacaccatgatgtccgctgttatgtccgtggggaaagtcacggagaatggcgggtcccctcaaggtattaaaagcccttcaaaacctccggggccgaaccgaattggcagaaggaaccaggaaaccaaagaagagaagagtagttacaactgtcctttgtgcgagaaaatctgcacaactcagcaccagctgaccatgcatattagacagcacaatacagacactgggggagcggaccattcctgtagcatatgcggaaagagcttgagcagcgcctctagcctggaccgacatatgctcgtacactccggagagaggccttataagtgtaccgtatgcgggcagtccttcaccacaaatggtaatatgcacaggcacatgaaaatccacgagaaggatccaaactctgcaacagctacagcacctccatcgccactgaaacggcggagactgagttcaaagcggaaactttcccatgacgcggaaagtgagcgggaagatcccgccccggctaaaaagatggtggaagatggccagtctggcgatcttgagaaaaaagctgacgaagtgtttcactgccccgtttgctttaaagaattcgtttgtaaatacggattagaaacacacatggagacacactcggacaatccactgcgatgtgatatctgctgcgtgacttttcgtacacatcggggtttattgagacacaacgccctcgtgcacaaacagttaccgcgggacgctatgggtcggcctttcattcagaacaatcctagcatccccgccggctttcatgatctggggtttacagattttagctgcagaaagtttccacggataagtcaggcctggtgcgaaacaaatttaagacggtgtatttctgaacagcaccgctttgtctgtgatacgtgcgacaaagcttttcctatgctctgtagtctcgcacttcacaagcagacccacgtggcggccgaccaaggtcaggaaaagccacaggccacacccctgccaggtgatgccctcgatcagaaaggattcctggcactcctgggcctccagcacaccaaggatgtcaggccagcccccgccgaggaacctctcccggacgacaaccaggcaatacaactgcaaacgctgaagtgtcagctcccccaggatccaggatgcacaaacctgctgtctctgagcccattcgaagcagcatccctgggcggtagcttgaccgtgttgccggctacaaaagatagtattaagcacttgtcactgcagcccttccagaagggttttattattcagcctgatagttctatcgtagtgaagcccatttctggagaatccgccatagagcttgctgatatccagcagatcctcaaaatggctgcctctgcccctccccagatcagcctgcctcccttctccaaggcccccgccgcgcctctacaggccatcttcaagcatatgcctcccttgaagcccaaaccccttgtcacgcctcgaacagtggtagctactagcacacctcccccgcttatcaacgctcagcaagctagtcctggatgcatctccccctcccttccccccccgcctctgaaattgctcaagggcagtgttgaagctgccagcaatgcacatctgctccagtctaaatcaggtacgcaaccccacgctgcgacccggctatcccttcagcagccaagagctgagctccccgggcagcccgaaatgaagacacagctggaacaggattcaatcatcgaggccctgctgccattgtctatggaagccaagatcaagcaggaaatcaccgagggagaattaaaagccttcatgactgctccgggtggcaaaaagactccggcgatgagaaaagtgctgtacccctgccgattttgcaaccaggtctttgctttttctggggtgctacgtgcacacgttcgcagtcatctggggatttcaccttaccagtgcaacatctgtgattacatcgctgcagacaaagctgccctgattcgtcatctgaggacacattcgggtgagaggccttacatctgcaaaatttgtcactacccttttactgttaaagctaactgcgagcgccatttacgcaaaaagcatctgaaagcaaccagaaaagacattgaaaagaatatcgaatatgtttcctcctctgctgccgagcttgttgacgcattctgtgctccagacacagtctgtcggttatgcggggaggatctcaagcattaccgggccctcagaatccatatgcggacacactgtggacgaggcctgggcggcggtcataaaggccgaaagcctttcgaatgcaaggagtgtagcgcagccttcgccgctaagagaaactgtattcaccatattctgaaacagcatcttcatgtgcccgagcaggatatcgagagttacgtgctggcagcagatgggctaggcccagccgaggcacccgccgccgaggcttcgggacgtggtgaagattccggatgtgctgccctgggggattgcaagcctctaaccgcctttcttgagccacagaatggcttcctccaccgggggcctacccaaccacctccaccgcatgtgagcattaagctggagccagcctcttcctttgccgtggatttcaacgaacctttggacttctcacagaagggtctcgccctggtgcaagtgaaacaggagaatatctcttttctaagccctagcagtctcgttccgtacgactgttccatggagcccattgatctgtcgattccaaaaaatttcagaaagggcgacaaggaccttgctaccccttctgaggcgaaaaaacccgaggaagaagctggctcatcggagcaacccagcccctgtcctgcccctggcccatctttacctgttaccttggggcctagtgggattctcgagtctcccatggccccagcccccgctgccacccccgaaccaccagcccaacctctacagggtccggtccaactagctgttcccatctactcctcggcactggtttctagtccgccgttggtcggctcatctgctcttttaagtggaacagcccttctgaggccattgcggcccaagccccctttactcctgcccaaaccccctgtcaccgaggagctgccgcctctggcctccatagcccaaatcatttcctcagtttcctctgctcccacattgcttaagacaaaggtagcggatccaggaccagccagcactgggagtaatactactgcatctgacagcttaggcggatctgttccaaaggcagcaactacagctacaccagccgctacaaccagcccaaaggaatcctccgaaccacccgccccagcttcaagcccggaagctgcatcaccaaccgagcagggtcccgctggcaccagcaaaaagcgcggcagaaaacgcgggatgcgctctaggcctcgggcaaatagcggaggagtggaccttgactcctctggggagtttgcctcaatagaaaagatgttggctactacagatactaataagttcagccccttcctacagaccgctgaggacaacacccaggacgaagtggctggagctccggctgatcaccatggtccttccgatgaagaacaaggatccccacccgaggacaagctgttgagggcaaagcgcaactcctacactaactgtctccagaaaattacttgtccccactgccctagggttttcccatgggcctctagcttacaacgccacatgctgacacacaccggacagaaacctttcccatgccagaaatgtgatgctttcttttctacgaagtcaaattgcgagagacatcagcttcgaaagcacggagttacaacctgcagcctgaggaggaatggacttattccgcagtcaaaggagagcgacgtgggctcccatgattctacgggagaaaggccttataagtgtcagacatgcgagcgtacctttaccctcaagcattcactagtcagacatcagcgaatccaccaaaaggcacggcatgccaagcaccacggcaaggattcagacaaggaggagagaggcgaggaagactcagagaatgagtccacacactccggaaacaatgccgtcagcgagaacgaggccgagctggctccaaacgcctccaaccacatggctgtgactaggtctcgaaaggaagggctggcctctgccaccaaagattgtagccatagagaggagaaggtgacagctgggtggccctctgaacccggacagggagatttgaaccctgaatctcctgcagcattaggtcaggacctgctggaaccgcggtccaaacggcctgcgcatccgatcctcgctacagccgatggcgcgtctcagttggtgggtatggagtag

SEQ ID NO: 131835 - DNA, 5064 bp, Artificial Sequence
  Description of Artificial Sequence: Synthetic coding sequence
atgacaagttcctcccctgcagggcttgagggatctgatttgagctctataaacaccatgatgtccgcagtgatgagtgtaggtaaagtcactgagaatgggggatcgccacagggaattaagagtccttcaaaaccgcctgggcctaatcggattggccgacgcaatcaggaaactaaggaggaaaagagctcttataactgtcccttgtgcgagaagatatgcactacgcaacaccagctgactatgcacataaggcaacacaacacggatacaggcggcgccgaccactcctgctccatctgtggcaagtcactttctagcgcatccagcctggaccgccatatgttggtgcactccggggagaggccctacaagtgcaccgtatgtgggcaaagttttaccactaacgggaacatgcatcgtcacatgaagattcacgagaaagatcccaattcagccaccgccacagccccaccgagccccttgaaaagaagacgcctgtcttccaagcgtaaattgagtcacgatgctgagagcgagcgcgaagaccccgcccccgcaaaaaagatggttgaggatggccaatccggcgatctagagaaaaaagccgacgaagtcttccattgcccagtgtgtttcaaagaattcgtgtgcaagtatggtcttgagacccacatggaaacccatagtgataatccgctgcgctgcgacatttgctgcgtcacttttagaactcataggggcctgctgaggcacaacgccctcgtgcataaacagctgcccagagacgctatgggacgaccatttatccagaacaaccctagtatccccgctgggtttcacgatcttggatttacagactttagttgccgcaaatttcccaggatctcccaagcctggtgtgagacaaatctgcgtagatgtattagtgagcagcaccgcttcgtgtgcgacacctgtgataaagcctttccaatgttgtgttccttggcccttcacaagcaaacccatgtggcagccgaccaaggccaggaaaagcctcaggcgactcccctcccgggtgacgcactcgatcagaaggggtttttggcactcctggggctccagcatacgaaagacgtgcggcctgcaccagctgaggaacccttgcccgacgataatcaggccattcaactgcagaccctgaagtgccagcttccccaggaccctggatgcacaaaccttctttctctgagcccattcgaggcagccagtctggggggctcactgactgtcctgcccgccacaaaggactcgattaaacacctgtcactgcagccattccagaagggattcattatacagcctgactcaagcatcgtagttaaacccatcagcggagaatcggccatcgagctggccgacatccagcagatcctgaaaatggcggcatcagcacctccacaaatttcattgcctcctttctccaaggcacctgccgcccctctgcaggctatatttaagcatatgccacccctgaagcccaaaccactcgtcacgcctcgcacagtggtagctactagcacccccccccctctgattaatgcacagcaggcaagcccgggctgcatctccccatcactgcctcccccacctctcaagcttctgaaaggctctgtggaggccgcatccaacgcccacctgctgcagagtaaatcgggcactcagccccacgctgcaacacgactgtcgttacagcagcctcgagcggagcttcccggtcagcccgaaatgaagacgcagttggaacaggattctatcatcgaggctctgctccctctatctatggaagccaagatcaaacaggagattaccgagggagagctgaaagcgttcatgaccgcccccggaggaaaaaaaacccctgccatgagaaaagtgctatatccatgccgcttctgcaatcaagttttcgcgtttagtggggtgctcagagcccacgtcagatcacacctgggcatctctccctaccagtgtaacatctgtgactacattgcggcggacaaagctgccttgattagacacttgagaacgcactccggtgagcgcccgtacatatgtaagatctgccattacccatttacagtgaaggccaattgtgagcgccatcttcgcaaaaaacatctcaaggcaacacgcaaagatattgagaagaatatagaatatgtgagcagctctgctgccgagttggtcgacgcattttgcgcccctgacaccgtgtgtagactgtgtggcgaggacctgaagcactatcgggccctgcgcatccacatgcgaactcactgcggccgcggcctcggaggagggcacaaagggcgcaagcctttcgagtgtaaagagtgttcagcggcctttgcggctaagaggaactgcatccatcacattctgaagcaacacctgcacgtaccagaacaggacatcgaaagctatgtgttggccgctgatgggcttggaccggcggaggcacctgccgctgaggcaagcggtcgcggagaggacagtggttgcgccgcactcggggactgtaagcccctaactgcatttcttgaaccccaaaatggctttttgcaccggggcccaacccagccccctcctcctcacgtctcgattaagctggagcccgcatccagtttcgctgtcgactttaatgaacctctggacttcagccagaaaggcctggccctagtgcaagttaaacaggagaacatctctttcttatctcctagcagccttgtgccctacgactgttcaatggagccgatcgacttatccatcccaaagaacttcaggaaaggtgataaagatctcgctaccccttccgaagccaagaagccagaagaggaagctgggtcctcagaacagccaagcccttgcccagcgcccggccctagcctgcccgtcactttgggcccttctggcatcttagaatcccctatggcgcccgcccctgctgccacccccgaaccccccgcccagcccctccaaggcccggtacagctggcagtgcccatttatagttccgccctcgtaagttcccctcctttggtgggatcgtctgccttgctgtccggaacggccttgcttagaccactcagaccgaagcctcctctcctcctcccaaaaccccccgtaacagaagaactgccgcccctagcctccattgcccagataattagttccgtatcctcagctcccaccctgctgaagaccaaggtggccgatccagggcctgcgtcaaccgggagcaacaccacggctagtgactccctgggtggcagcgttcccaaggctgccacaaccgccacgccagctgcaaccactagcccaaaggaaagctccgagcctcccgcgccggcttccagccccgaagccgcgtcgccgactgaacagggccccgcaggcactagcaaaaagcggggcagaaaaagagggatgcgatcaagacccagggccaactccggcggagtcgatctggactcaagcggcgaattcgccagtatcgagaagatgctcgcgacaactgacaccaataagttttctcctttcctgcagaccgctgaagataatactcaggatgaagtggccggcgctcccgcggaccatcatgggccttccgatgaagaacaaggctcaccccctgaggataagttacttagggctaaacggaattcctacactaactgtcttcaaaagatcacctgtcctcactgtcccagggtgttcccctgggcatcctcgctgcagaggcatatgctgacgcacactgattcacagtcagatgccgagaccgccgctgctgcaggagaggtgctcgacctcacatcccgcgaccgcgagcagccctccgaaggtgccaccgagttgagacaggtcgctggggatgcgcccgtcgagcaagccaccgccgaaactgccagcccagtccaccgggaagagcacggcaggggcgagagccatgagcccgaggaagaacatggcaccgaagagagcacaggtgatgctgacggcgcagaggaggacgcttccagcaaccagtccctcgacctagacttcgcaacaaaactgatggacttcaaattggcagaaggagacggcgaggcgggtgccggaggagcagcctcacaggagcagaagctagcctgtgatacatgcggcaaatcatttaaattcctggggacgctcagccggcatagaaaggctcacggaaggcaagaaccgaaagatgaaaaaggggatggcgcctccacagctgaagagggccctcagccagccccggagcaagaagaaaaacccccagagactccagctgaggtggtcgagtccgcaccaggagcaggtgaggcacccgccgagaagctggccgaggagaccgagggccctagcgacggggagtccgctgccgaaaagagaagctctgaaaaatctgatgacgataaaaaacctaagactgatagtccaaagtctgtcgcgtccaaggctgacaaacgcaagaaggtttgttctgtatgcaataagcgcttctggtccttgcaggatctaacgcgtcatatgaggtctcatactggggagaggccatataaatgtcagacctgcgagcggacatttaccctgaagcactcgctggtccggcatcaacggattcatcagaaggcacggcatgccaagcaccatgggaaggatagtgacaaggaggagcgaggcgaggaagacagcgaaaatgaaagcacacactcaggcaacaatgccgtgtcagaaaacgaggcggagctcgcccccaatgcgagcaatcacatggcggttactaggtctcgcaaggaaggcttggcatctgctactaaggattgctcacatagagaggaaaaggtgaccgccggctggccaagcgaacctggccagggggatctgaaccccgaatccccagcggccttggggcaggatctcctagaaccgcggtctaagcgacccgcacatcctatcctggccaccgcggacggggcgtcacaattggtggggatggaatag

SEQ ID NO: 131836 - DNA, 5064 bp, Artificial Sequence
  Description of Artificial Sequence: Synthetic coding sequence
atgaccagtagctccccagcaggcctcgagggctccgatctgtctagcataaacaccatgatgtcggctgtcatgagtgttgggaaggtaacagaaaatggtgggtctccccagggcatcaaatcccctagcaagccacccggtcccaatcgcattggccgaagaaaccaggaaaccaaggaggagaaatcctcttacaactgtcccctgtgtgaaaagatatgcactacgcagcaccaattgactatgcacatccgccaacacaacacagatacgggcggagctgaccattcctgcagcatctgcgggaagagcctgtcatctgcttcatcattggatcggcacatgttagtgcacagtggcgagcgaccttataagtgcactgtgtgtggccagtcattcacaaccaatgggaacatgcacagacacatgaaaattcatgagaaggatcccaacagcgccaccgctaccgcccctccctctcctctcaaacggcgcagacttagttcaaaacggaagctgtcacacgacgccgaatctgagagagaggatcctgcacctgccaagaagatggttgaagacggtcagtcgggagatctggagaagaaggcggatgaagtgtttcattgcccagtgtgtttcaaagaatttgtgtgcaagtacggcctggagactcatatggagacccactccgacaacccattgcgatgtgatatctgctgcgttacatttcggacacatcgaggcttgctccggcacaacgcactggttcacaagcagctccccagggacgcgatgggcaggccgtttattcagaacaatcctagcatacctgccggcttccacgacctgggtttcactgatttttcctgtaggaaattccccaggatctctcaggcgtggtgcgaaacgaacctgaggcggtgcatcagcgaacaacatcgctttgtgtgcgatacctgtgacaaggcctttcccatgctgtgcagcctcgccctgcacaagcagacacatgtagcggcggaccagggtcaggaaaaaccccaggccacaccgctacccggcgacgccctcgaccaaaaagggtttctggcactgctgggcttacagcacacaaaagatgtgcggccagcgccggccgaagaacccctacctgatgacaatcaggcaattcagctgcagacactgaaatgtcaactacctcaagaccccggctgtactaacctgctttccctgagtcccttcgaggccgccagcttgggaggaagcctcacagtactgccagccaccaaagacagtatcaagcacctgagtttgcaaccttttcagaagggcttcataatccagccagatagctcaattgtggtgaaaccaatctccggcgaatccgccatcgagctggcagacatccagcagattctgaagatggcggccagcgcaccgccccagatctccttacccccatttagcaaagctcccgccgctccgctacaggcgatctttaagcatatgccaccactaaagccaaaaccccttgtgactcccagaacagtagtggccacctctacccctcccccgctgattaacgctcagcaggcttcccccggttgcatttccccctcactcccaccccctccattaaagctattaaagggatccgttgaggcagcctcaaacgctcatctgctgcagagtaagtctgggacacagccacatgctgccactaggttgagcctacagcagccacgagcggagcttccagggcaaccagaaatgaaaacacaactggagcaggattccattattgaggctctgctgcctctgtccatggaggccaaaatcaaacaggaaattaccgagggtgagctcaaggccttcatgactgctcctggagggaaaaaaacaccagctatgagaaaagtgctctatccttgcaggttctgtaatcaggtgttcgcctttagcggcgtgctgcgcgcccatgtgcgttctcacctggggatcagcccctatcagtgcaacatctgcgattatatcgctgccgacaaggctgcactcatccgacatctccggactcatagcggggagagaccttatatctgcaagatttgccattacccattcaccgtgaaggctaattgtgaacgacaccttagaaaaaagcacctgaaggccactcggaaagacattgagaaaaatatagagtacgtttcttcctctgccgctgaactggtggacgccttctgcgctcccgacaccgtgtgtcgcctgtgcggagaagacttaaagcactacagggcgctcaggatacatatgcggacccattgcggtaggggccttggcgggggacacaagggaagaaagcctttcgagtgtaaggagtgcagcgctgccttcgcggctaagcggaattgtatccatcacattctgaaacaacatctgcacgtgcccgagcaggatattgagtcatacgtccttgctgccgacggcctgggtccagcggaggctccggccgctgaggcttcgggtagaggggaggactctgggtgtgctgctctgggcgattgcaaacctttaaccgcatttttagaaccacaaaatgggttcctccacaggggacctacacaacctccccctccccacgtctctattaaactggagcctgctagtagcttcgcagtagatttcaacgagccattggattttagccagaaaggacttgctctggtccaggtgaaacaagaaaatatctcatttttatccccaagctcactagtcccatacgattgtagcatggagcctattgacctgagcatccccaagaatttccggaaaggagacaaggacctggcgactccgagtgaggcaaagaaaccagaggaggaggctgggtcatcagaacagccttctccctgccctgctcctggcccttctctgcccgtgacactgggaccttcaggaatcctggagtcacctatggcccccgcccctgctgctacaccagagcccccagcccagccattacagggcccagtgcagttagcagtgcccatctattcttcggccctcgtgtcaagcccacctctggtcggtagcagcgctctgctctccggaaccgcgctgctgcggccgttacggccaaagccgcccctgcttctaccaaaacctcccgtgacagaggaactgcctccactggcatctattgctcagataatctcatcagtgagcagcgcacctacactgttaaagaccaaggttgcggatccagggcctgcctcaaccggctctaacacaaccgcatcagattcactcggcggatcagtgcccaaagccgccacaaccgccacccccgcagcaacaaccagcccaaaggagtcttctgaaccgccagctcctgcgagctccccagaggcagcgagccctaccgaacaggggccggccgggactagcaagaagagaggtaggaagcggggcatgagatccaggcccagggctaattccggaggtgtcgatttggatagctcgggtgaattcgcgtccatcgaaaagatgttggctacaactgacacaaataaatttagtccattcctgcaaactgcggaggataatactcaggacgaggtcgctggagctcccgctgaccaccatgggccgagcgatgaggagcagggatcccctcccgaagacaagcttctcagggcaaaaagaaacagttacactaattgtcttcagaagataacttgcccccactgtcctcgggtattcccctgggcaagcagcctacagcgccatatgctgacccacacagattcacagagcgacgccgagacagccgctgccgctggagaggtactagacttaacatctcgggaccgagaacagccatccgaaggtgcaacggagctgcggcaagtcgccggggacgcaccagtggagcaagctactgccgagacagccagccccgtgcatagagaggaacacggcagaggagaaagtcacgagcccgaggaggaacacggcactgaagagtctactggggacgccgatggtgccgaagaagacgcctcttctaaccaatccctcgatctggacttcgctactaaattgatggacttcaagctcgccgagggggatggcgaggccggcgccgggggtgctgcctcacaagaacagaaactggcatgcgatacctgcggcaagtcttttaagtttcttgggaccctgagccgtcatcgaaaagcacatggacggcaagagcctaaggacgagaagggggatggggcatcgaccgctgaagaaggtccccagcccgctccagagcaagaagaaaagcctcccgagaccccagcggaggttgtcgagagcgcacccggggccggcgaagcccctgccgaaaagctggcggaagagacggaaggaccctctgatggcgagtcagctgccgaaaagagatcatcagaaaaatctgatgacgataagaaaccgaaaaccgattctcccaagtccgtcgcgagcaaggccgacaagcggaagaaggtgtgttccgtgtgtaacaaaaggttctggtccttacaggacctcacccggcacatgcggtcacatacaggcgagcggccatacaaatgccaaacttgcgagaggaccttcaccctcaaacactctctggttcgccatcagcggatccatcaaaaagcacggcacgctaagcaccacggaaaggactcagataaggaagaacgcggagaagaggattccgagaacgagtctacgcattcggggaacaatgccgtttccgaaaatgaagccgaactggcccccaacgcttccaaccatatggctgtaacccggagcaggaaggaaggacttgcctccgctacgaaagactgctcccaccgggaagaaaaggtcacggcaggatggccttctgaacctgggcagggcgatctgaacccagaatccccggccgcccttggacaggacctgcttgagccccgcagcaagcggcccgctcatccaattctggccacagcagatggcgccagccagctggtgggaatggagtag

SEQ ID NO: 131837 - DNA, 5229 bp, Artificial Sequence
  Description of Artificial Sequence: Synthetic coding sequence
atgacatcgtccagccccgcgggtctggagggatctgatcttagttctatcaataccatgatgagcgctgtgatgagcgtggggaaagtgactgagaacggcggttctcctcagggcattaaatcaccttccaaaccacctggcccaaacagaattggtagacgcaaccaagaaacaaaagaggaaaagagtagctataattgtccactttgcgaaaaaatctgcaccacgcaacaccagctgaccatgcacatcaggcagcacaataccgacaccggcggggcggatcactcctgctccatttgcggcaagtccctgagctctgcctcgagtctggatagacacatgttggtacacagtggggagcgcccgtacaaatgtacagtatgcggacagtccttcactactaatggcaatatgcatcgacacatgaagattcacgaaaaagaccccaactccgctacagccaccgcacctccatctccacttaagcgtcggcggctgagctcgaagaggaaactgtcacacgatgcggagtctgagcgtgaggatccagcaccggcaaagaagatggtggaagatggccagagtggcgacctagagaagaaggctgatgaagtgttccactgtcctgtgtgtttcaaagaatttgtgtgcaaatacgggttggaaacacacatggagacccacagcgataatcccctgagatgcgacatttgctgtgtgacgttccgtacgcatagggggcttctgcgccacaatgctctcgtgcacaagcaactgccacgcgatgcaatgggccgcccattcatccagaacaacccaagcatcccggccgggttccacgacctcggttttactgacttttcgtgtaggaagtttccccggatctcccaggcatggtgcgaaaccaacctgagacggtgcatttctgagcaacacagattcgtgtgcgatacctgtgataaagcctttccaatgctctgttcccttgccttgcacaaacagacacatgtagccgccgatcaaggccaggagaaacctcaggctacaccactgcctggcgacgcactcgaccagaaagggttcttggcgctgctcggacttcagcacaccaaagacgttaggcccgccccagcggaggaaccactgcctgatgacaatcaggctatccagctgcaaaccctgaaatgccaattgccgcaagacccaggatgcacgaacctactgtccctttcacctttcgaggccgcgtcgctgggcggatcacttacggtcctccctgctaccaaggactctataaagcatctgtctctacagcccttccaaaaagggtttatcatacaacccgactcttctattgtggtaaaacctatcagcggggaatccgccattgagctcgcagacattcagcagatcctgaagatggctgcaagcgctccaccacagatctcgctgccacctttttcgaaggcccctgccgcccccctgcaagccattttcaaacacatgccaccccttaaacctaaacctctggtgactccccgaactgtggtggccacctcaactcctcctccactgatcaacgcccagcaagcctcccctggctgtatctcaccgagtcttccaccccctcccctaaagctgctgaagggcagtgtggaggcagcctctaatgcccaccttctccagtctaaatcaggcactcagccacatgctgcgactcgcttgagtctgcagcagccgcgggctgagctaccaggccaacccgagatgaaaacgcagttagaacaggacagcattatcgaggccctactcccactgtcaatggaggctaaaatcaaacaggagatcaccgaaggcgaacttaaggccttcatgaccgcccccggaggcaaaaaaacacccgcgatgcggaaggtgctgtacccttgtaggttttgtaatcaggtttttgctttctcaggcgtgttacgggctcacgttaggagtcatctgggcatcagcccgtatcaatgtaacatatgtgattacattgcagcagacaaggctgctctgatcagacatctccgcacccattctggtgagcgcccttacatctgcaagatatgtcactatccctttacggtgaaggccaattgtgaacgacacctgcgcaagaaacatctgaaagcaacacgcaaagacatcgagaagaatatcgaatatgtgtcttcttcagcagccgaactggtggatgccttctgtgccccggacactgtgtgtagactttgtggtgaggacctgaagcactatagggcccttaggattcatatgcgaacgcactgtggccggggactgggggggggacataaaggcaggaagccctttgagtgcaaagagtgtagtgccgctttcgccgctaagcggaattgcatccaccatattcttaagcagcacctgcacgtgccagagcaggatattgaaagctacgtgctggccgccgatggcctgggacccgcagaagcaccagctgcggaggcctctggcaggggtgaggactctggctgcgctgccctgggagattgtaagccactgactgcctttctcgaaccacagaatgggtttttgcacagaggcccgacacagcccccgccacctcacgtcagcattaaactcgaacccgccagttcttttgccgtggattttaatgagcccctggacttttcccagaaaggtctggctcttgtgcaggtgaaacaggaaaatatcagtttccttagtccctccagcctcgtgccttatgactgctccatggaaccgatcgatttgtcaataccaaagaatttcaggaaaggggacaaagatcttgccacgccttcagaagccaagaaacctgaagaagaggccggctcttccgagcagccctcaccatgtcctgctccgggcccttctctgccagtgaccctggggccatcaggtatcttggagagtcctatggcccctgctcccgcagcaacccctgaaccacctgcccagcccctgcagggtcccgtccagctcgctgtcccgatttatagcagcgcactcgtcagtagccctcctctggtcggcagttctgccctcctgtccggcacagccttgctccgaccactgaggcccaagcccccactgctgcttccaaaaccgcccgtgactgaagaattgccccctctggcatctatcgcgcaaattatttcttccgtctcttcggcccctacactccttaaaactaaggtagccgaccccggcccagcgtcaactgggtctaatacaactgcttccgactctctggggggatctgtccccaaggccgcgacaaccgcgacaccagccgccacaacttctcctaaagagagctccgaacccccagctcctgcctcaagccccgaagccgcttccccgacagagcaaggaccagcagggaccagcaagaagagagggcgtaaaagagggatgaggtctaggccccgggcaaactccggcggagtcgatttagacagtagcggcgaattcgcttccatagaaaagatgctcgcaaccaccgatactaacaagttctcccctttcttgcagactgccgaggacaatacccaggatgaggtggccggcgcccctgcagatcaccacggcccttccgacgaagagcagggctctccccccgaggataagctgttgcgagcaaagaggaatagttatactaactgcttacagaagatcacttgtccacactgtcccagagtatttccttgggcctcttccctgcagcggcacatgctgacacatacaggccagaaaccgtttccctgtcagaaatgtgacgcattcttcagcacgaaatctaattgtgagcggcatcagttgcgtaaacacggagttaccacctgcagtctaaggaggaatggcctgattccccagtcgaaggagtcagatgttggcagccacgatagcactgattcacagagcgacgccgaaactgctgcagcagccggagaagtgctagatctgaccagtcgggatcgggagcaaccaagcgaaggcgctactgagctcagacaggtagccggtgatgcccctgttgagcaggccactgccgagacagcctctcccgttcaccgcgaagaacacgggcggggagagagccacgaacctgaagaagaacacggaaccgaggagtccacaggcgacgccgacggcgctgaagaagacgcctcttctaaccaatccttagacctagattttgccactaaactgatggattttaaactggcggagggcgatggcgaggccggcgcgggtggagctgctagccaggaacaaaagcttgcctgtgatacatgtggcaagagcttcaaattcctcggcacactgtcccgacaccgcaaagctcatgggcggcaggagcccaaagatgaaaagggtgatggtgccagcaccgccgaggagggaccacaaccagcccccgaacaggaagagaagcctcccgagaccccagcagaggtggtagaaagtgccccaggagcgggcgaggcccctgccgagaagctagcagaggaaacggaggggcccagcgatggggagagcgctgccgagaagcggagctcggagaagagcgacgatgacaaaaaacccaaaacagactcccctaaatcagtcgcttctaaagctgacaagaggaagaaagtctgttctgtgtgtaataagagattttggagtctccaggatctgacaagacacatgcggtcccacaccggggagcgtccatataaatgtcaaacctgtgagcgaacattcaccctgaagcatagcctggttcggcaccagcggattcatcagaaggctcgccacgccaagcaccatgggaaagatagcgataaagaagagagaggggaggaagatagcgagaatgagagcacacacagtggaaacaatgccgtttccgagaacgaagcagagttagccccaaacgcctcaaatcacatggctgttacacgctcacgcaaggaaggactagcgtccgcgaccaaggattgctctcatcgcgaagaaaaagtgaccgctgggtggccatctgagcctggccagggggacctgaaccccgaaagtcccgccgctctgggtcaggatctcctcgaacctaggtcaaaacgacctgcacaccccatcctcgcaactgcggacggagcatcccagctcgtcggaatggagtag

SEQ ID NO: 131838 - DNA, 15 bp, Artificial Sequence
  Description of Artificial Sequence: Synthetic coding sequence
atgactagctcttag

SEQ ID NO: 131839 - DNA, 495 bp, Artificial Sequence
  Description of Artificial Sequence: Synthetic coding sequence
atgacatcgtcttctcctgccggcctcgagggatctgacctatcctcaatcaacaccatgatgtccgctgtgatgagtgtggggaaagttaccgaaaacggcgggtctccccagggcattaaaagcccatccaaaccacctggtccaaacaggatcggtcgacgcaatcaggaaacgaaggaggaaaagagttcctataattgtccgctgtgtgagaagatctgcacaacccagcaccagctgacgatgcatattagacagcataataccgacaccggtggggccgatcattcatgttctatctgcggcaagtcactgtcttctgctagtagtctggacaggcacatgctagttcatagcggtgagcgcccttacaaatgtactgtttgcgggcagtccttcacgacaaacgggaacatgcaccgccacatgaaaatccatgaaaaagatcctaattccgcgaccgctaccgctcctcccagccctctgaagtag

SEQ ID NO: 131840 - DNA, 2337 bp, Artificial Sequence
  Description of Artificial Sequence: Synthetic coding sequence
atgacatcaagctctccagcggggctagagggcagtgatctgagcagtatcaacactatgatgagcgcggtgatgtccgtaggtaaggtgaccgagaacggaggatctccacagggcattaaatccccctccaaacctccagggccgaatagaattggaagacgaaaccaggaaacaaaggaagagaagtcctcatataattgcccgttatgtgaaaagatttgtaccacccaacatcaactgacaatgcatattcgacaacacaacacagacacaggcggtgcggatcatagttgcagtatatgcggcaagtctctgagctctgcaagcagcttggatcggcacatgctggtccactcaggagaaaggccctacaaatgtactgtgtgcgggcagagctttacgacaaatggcaacatgcatcgacacatgaagatccacgagaaggatccaaattccgcgaccgccaccgcgccaccatctcccctgaagagacgcagactgagttccaagcgcaagcttagtcatgacgctgaatctgagagagaggaccccgcgccagccaagaaaatggtggaggatggccagagcggggacctggagaagaaggcggatgaggtgttccattgccccgtgtgctttaaggagttcgtctgtaagtacggactagaaacacatatggaaactcacagtgacaatcctctccggtgcgacatttgctgcgttacgttcaggacccatagaggccttctgcgacacaatgcactcgtgcacaaacagctccctcgggatgctatgggccggccattcatccagaacaatccctcaattcccgctggcttccacgatctggggttcaccgacttctcctgccgaaagtttccaagaatatcacaggcctggtgtgaaactaatctgaggagatgcatcagtgaacaacatagatttgtgtgtgacacatgcgataaagcctttccgatgctatgctccctggccctccataagcagacccacgtggcggcagaccaggggcaagagaagccacaggctacacctttgcctggggacgcccttgatcagaaaggctttcttgcgctactgggcttgcagcatacaaaggatgtccggccagccccagccgaagagcccctcccggacgataatcaagctatacagctccagacactgaagtgccagcttcctcaagacccaggttgcaccaatctacttagtctctcccctttcgaggctgcctctctgggagggagcctgacggtgcttccagcaacaaaggacagcatcaaacacctctccctccagccttttcagaagggatttatcattcagccagattccagcattgttgtcaaacccatcagcggcgagtctgctatcgaactggcggacatccagcagattctcaaaatggcagcttctgccccaccccagattagcttacctccattcagcaaagcccctgccgcacccctgcaggccattttcaagcacatgcctcccctgaaaccaaagccacttgtgaccccgagaacggtggtagctacctctacccctccgccacttatcaacgcccagcaggcgagcccgggctgtatttccccttccctaccccccccaccactaaagctgctcaagggttccgtagaggctgcgtctaatgcccatctgcttcagtctaagagcggaacgcaaccacatgctgccacgcgtctaagtctgcagcagccccgggcagaactgcctggtcagccagaaatgaagacccagctggaacaggacagtatcattgaggcgttattaccgcttagcatggaggctaagatcaagcaggaaatcaccgaaggagaactgaaggctttcatgactgcccccggaggaaagaaaacacccgccatgaggaaggtgttgtatccatgccggttctgcaatcaagtatttgcttttagtggtgtcctacgtgcacatgttcggtcccacttggggattagcccttatcagtgcaacatctgcgattacatcgcagccgacaaggccgccctcatcaggcacctcagaactcattcaggtgagagaccatatatttgtaaaatatgccactaccccttcaccgtgaaggccaattgtgagaggcacctgcgaaagaaacatctgaaagccacacggaaggacattgaaaaaaacatcgagtatgttagcagctcggccgcagagttagtggacgccttctgtgctccagacaccgtctgccgcctctgtggtgaggatctgaaacactaccgcgctctccggattcatatgaggacccattgtggcagatag

SEQ ID NO: 131841 - DNA, 411 bp, Artificial Sequence
  Description of Artificial Sequence: Synthetic coding sequence
atgacaagctcttctccggcaggtctggaaggaagcgacctgagctctatcaacaccatgatgagcgcagtgatgagtgtaggaaaggtaactgaaaacgggggtagccctcagggaattaaatccccttcaaagccgcccggacccaacaggattggcaggaggaatcaggagactaaagaagaaaagtcctcctacaattgtccactctgtgaaaagatttgtaccactcaacatcagctaacgatgcacattaggcagcataacacagatacaggcggggccgatcactcatgctccatctgcggcaagtcactgtcatccgcctcatcactcgacagacacatgctcgtccattctggagaaagaccttacaaatgcaccgtctgtggtcagagcttcactacctag

SEQ ID NO: 131842 - DNA, 189 bp, Artificial Sequence
  Description of Artificial Sequence: Synthetic coding sequence
atgacatcctcgtccccagctggattggaaggcagtgatttgtcatccattaataccatgatgtccgccgtgatgtctgtaggaaaggtgactgaaaatggcggcagcccccaggggatcaaatccccctcaaagcctccgggccctaataggatcggacgccgcaaccaggtcagcgtacatacctag

SEQ ID NO: 131843 - DNA, 834 bp, Artificial Sequence
  Description of Artificial Sequence: Synthetic coding sequence
atgtccaaaagtcttaagaaactggtagaggagtctcgggaaaaaaatcagccagaagtcgacatgtctgacaggggcatctccaacatgctggacgtgaatggcttgtttacactatcacacatcactcaacttgtgctgtcgcacaataagttaaccatggtgccccccaatattgccgaactgaagaatttggaggtcctgaacttctttaacaaccagatcgaggaactccctactcagatatctagtctgcagaagttgaagcacctgaacctcggaatgaatcgcctgaacactctacctcgaggcttcggaagtttgcctgcattggaggtcctcgatctcacatacaataacctgtctgaaaatagtctgcctggtaattttttttatctgactaccctcagagcactgtacctgagcgacaatgatttcgaaatcctgcctcccgatatcgggaaactaacgaagctacagattctgagtcttagggacaatgatttgatctcccttccaaaagagatcggggaactgacccaactgaaagaactccatatccaggggaaccgtctcactgtactgccacccgaattggggaatctggacctgactggtcagaaacaggtgttcaaggctgagaacaacccatgggtgactcccatcgctgaccaattccagctcggcgtgagccacgtgtttgaatatattcgttcggagacttacaaatatttgtatggccgccacatgcaggcaaatccggagccaccaaagaagaacaatgacaagagtaaaaagatttctagaaagcctctggccgctaaaaaccgatag

SEQ ID NO: 131844 - DNA, 675 bp, Artificial Sequence
  Description of Artificial Sequence: Synthetic coding sequence
atggttccccccaatatcgcagaactgaaaaatctggaggttctgaacttctttaacaaccaaatcgaggaactccccacgcagatctcctcactgcagaaactcaaacacttgaacctgggcatgaaccgtttgaacactctccctaggggctttggctcactgcctgcactcgaagtgctcgacctcacgtacaataacctgtctgagaatagtctgcctggcaactttttctacctgaccactctaagagccctgtatctgtcagataacgacttcgagattctgcctcccgacataggtaaactgacgaaacttcagattctcagtctgagagacaacgatctcatctcgttgcccaaagagattggggaactgacccagctgaaagagctgcacatccaagggaatagattgactgttctacctcctgagttagggaacctagatctgacaggccaaaagcaagtattcaaagcagaaaacaatccttgggtgactcctatcgccgaccagttccagctgggcgtgagccacgtgttcgagtatatacggtcggagacgtacaaatacctttatgggcggcatatgcaggcgaaccctgagccgccgaagaaaaacaatgacaaatccaaaaagatttcacgcaagccccttgctgcaaaaaacaggtag

SEQ ID NO: 131845 - DNA, 834 bp, Artificial Sequence
  Description of Artificial Sequence: Synthetic coding sequence
atgtccaagtctctgaagaaactggtcgaggaatctagagagaaaaaccagccggaggtcgacatgagcgaccggggcatttccaatatgcttgacgtcaacgggctgttcactctgtcgcatattacccagctggtgttgtcccacaacaagctcacgatggttccgcctaacattgcagagctgaagaacttggaggtgctaaatttttttaacaaccagatcgaagagctgccaacccaaatcagttctctgcaaaagctcaagcacttaaacctgggaatgaaccgcctaaacaccctgcccagaggctttgggtcactgcctgccctcgaagtcctggatctaacttataataacctatctgagaacagcttacccggaaacttcttctatctgaccactctgagagccctgtacctgtctgacaacgactttgagattctgccaccggacataggcaagcttaccaaactgcaaatcctaagtcttcgtgataacgaccttatctccctaccaaaggagatcggcgagctaactcagttgaaagagctccacatacagggcaaccgcctgactgttttaccccccgaattgggcaacctcgacctgacggggcagaagcaggtttttaaagctgaaaacaatccttgggtcactccaattgccgaccaatttcaactgggggtgtcccacgtgttcgagtacatccgcagcgaaacctacaaatatctgtatggccgacatatgcaggctaacccagagccgccaaagaaaaataatgataagagcaagaaaatctcgcgtaagccactggctgctaagaaccgctag

SEQ ID NO: 131846 - DNA, 945 bp, Artificial Sequence
  Description of Artificial Sequence: Synthetic coding sequence
atggcagctaccgcatctgcgggggcgggaggcatcgacggtaagcccagaacttctcctaagagcgtgaaattcctgttcggcgggcttgcagggatgggcgccactgtgttcgtacagcctctggatctagttaagaatcggatgcagttatcaggagagggcgccaagactcgggagtacaagacgagctttcatgctcttacctccattctgaaagcagaagggctgcgcggaatctatacgggactcagtgccggcttgctgcgacaggccacttataccacaacacgtctcggcatctacactgtactgtttgaaagattgaccggtgccgacgggactcccccgggatttcttcttaaagcagtaattggaatgacagcaggagctaccggcgcatttgtgggcactcccgctgaagtggcattaatacgaatgacagcagatggccggctcccagctgatcagcgccgggggtacaaaaacgtgttcaatgctctaatacgcatcacacgggaagaaggagtcctgaccctgtggaggggatgtattcccacaatggcaagagctgtggtagtgaacgctgcccaactagcaagctactcgcagagtaaacagttcctgctggactctggatatttttctgataacatcctgtgccacttctgcgccagtatgatatccggcctcgtgaccaccgctgcttccatgcccgtggatattgccaagacaagaatccagaatatgcggatgatcgacggaaaacccgagtacaagaacggtctggacgtgctgtttaaagtggtgagatatgaaggcttcttttcattgtggaaaggctttacgccctactatgctcggctcggcccccatacagtgctaacctttatcttcttagagcagatgaacaaagcttataaaaggctgtttctttctggctag

SEQ ID NO: 131847 - DNA, 1530 bp, Artificial Sequence
  Description of Artificial Sequence: Synthetic coding sequence
atgagcatgggggcgcctcgcagtctcctcttggcactcgctgcgggtctggccgtagcacgacctcccaatattgtgcttatttttgcagacgatctggggtatggcgatcttgggtgttatggccatccctcctctacaactcctaatctcgaccagttggccgccgggggactccgctttaccgacttttacgtgcccgtttcactttgcacacccagtcgtgctgcactcctgactggccggctgcctgttcggatgggcatgtaccccggcgtcctggttccgagtagtcgaggaggactgccgctggaagaggtcacagttgctgaagtactggccgctaggggataccttactgggatggcgggtaagtggcatctgggcgtggggcccgagggagccttcctccccccacatcagggattccatcgcttccttggaatcccgtactctcacgaccagggaccatgtcagaaccttacatgctttccaccagctaccccctgtgacggaggatgcgatcaggggctggtccctattcctctgcttgccaacctgagcgtggaggcgcaacctccctggttgccaggcctggaggcgcggtacatggcatttgctcatgaccttatggcagacgcccagagacaggatcggcctttcttcctgtattatgcatctcaccacacgcattacccacaatttagcggccaatccttcgccgaacgaagcggccgaggaccgtttggcgacagtttaatggagcttgacgctgctgtgggcactctcatgacagcaataggggacttaggattgctggaggagacactcgttattttcaccgcagacaatggcccggagacaatgcgaatgtcccggggcggatgcagcggactcctgcgatgtggaaagggtacaacttatgaaggtggagtacgcgaacctgccttagctttctggcctggacacatcgctccaggagtgacacatgaactcgcctcatctctggacctgctgcctactctcgcggccttggccggcgcccctttgccaaatgtgaccctggatggctttgaccttagtcccctgctgctgggcactggcaagtcgcccagacagagtttattcttctacccctcctatcctgatgaggtgagaggcgtgtttgccgttcggacgggaaaatacaaagcccacttcttcactcaaggttctgcacatagcgacactaccgccgaccctgcatgccatgccagcagctctctgactgcgcacgaaccccctctgctgtacgatctgtcaaaagatcctggcgagaactataatttattgggaggcgtcgctggagctactccagaagtgttacaggcgctgaagcagctgcagctgctcaaggctcagttggacgccgcagtcacattcgggccatctcaggtggcgcgcggcgaggatccagccctgcagatatgctgccatcccgggtgcactcctaggcctgcctgttgccactgtccggatccccacgcctag

SEQ ID NO: 131848 - DNA, 600 bp, Artificial Sequence
  Description of Artificial Sequence: Synthetic coding sequence
atggccaagtcagccgaggtgaagctggcaatcttcggcagggccggagtcggaaaatctgctctggtggtgcggttcctcactaagaggttcatttgggaatacgatcccacactggaaagtacctacagacatcaggcaaccatcgatgatgaagtcgtctctatggaaatcttggataccgccggtcaagaagataccatccaacgggaaggccatatgcgttggggagaaggcttcgtgttggtctatgatatcactgaccgcgggtcctttgaggaggtgctacctctgaaaaacatcttggacgaaattaaaaaacccaagaatgtaaccttaatcttggtggggaacaaggccgaccttgaccactcaagacaggtctcaacggaagaaggggaaaagctggccactgaactggcgtgcgcattttacgaatgctcggcgtgtaccggcgagggaaatataaccgagattttctacgagttgtgtcgtgaggttcgccgcagacgtatggttcagggcaaaacgcgccggagatcctctaccactcatgtgaagcaggcaattaataagatgctgacgaagattagttcctag

SEQ ID NO: 131849 - DNA, 120 bp, Artificial Sequence
  Description of Artificial Sequence: Synthetic coding sequence
atggccaaaagtgcagaagtcaaactcgctatcttcggacgggccggagtggggaaatcagccttggtggtcaggtttttgaccaaaaggttcatatgggagtatgatcccacgctgtag

SEQ ID NO: 131850 - DNA, 600 bp, Artificial Sequence
  Description of Artificial Sequence: Synthetic coding sequence
atggctaaatccgcagaggtaaagttagcgatcttcggacgagccggcgtcggaaaatctgccctcgttgttcgctttctgactaaacgatttatctgggaatatgaccccaccttagagtctacttaccgacaccaagcgacaattgatgatgaggtcgtgtcaatggaaattctcgataccgcagggcaagaggacacaatccaaagggagggccatatgaggtggggcgagggttttgtgttagtttatgatatcaccgacagaggctcattcgaggaggttcttccactcaaaaacatcttggatgagatcaagaaacccaagaacgtgacactgatcttagtcggtaacaaggccgatctggaccacagccggcaggtctccaccgaggagggtgagaaactggccacagagctggcttgcgccttctatgagtgctctgcttgtactggggagggaaatatcacggagatcttctacgagctttgcagagaagtgagacggcgccggatggtacaagggaaaacacgccgtcggagtagtacgacccacgtcaagcaagcaattaacaagatgctcacaaagatcagttcttag

SEQ ID NO: 131851 - DNA, 600 bp, Artificial Sequence
  Description of Artificial Sequence: Synthetic coding sequence
atggccaagagcgcagaggtgaagttagctatatttgggagagccggtgtgggcaagtctgccctggtggtccgcttcctgacaaagagatttatttgggagtatgatcccacactggagtcgacgtatcggcaccaggcgacaatcgatgacgaagtcgtgtcaatggagattctcgataccgccggccaggaggacacgattcaacgggaggggcacatgcggtggggcgaaggatttgtgcttgtgtatgatatcacagataggggcagttttgaggaggtgttaccgctcaagaatattttggatgaaatcaagaaaccaaagaacgttacactaattctcgtgggaaataaagccgatttagaccactcccgtcaggtgagtactgaggagggcgaaaagctggctactgaactggcctgtgcattttatgaatgcagtgcctgcacaggggagggcaacattacggagatcttctacgagttgtgccgggaggtccggcgacgaaggatggtccaggggaaaacacggcgccgaagctccacaacgcacgtcaagcaggctatcaacaagatgcttacaaagatcagttcttag

SEQ ID NO: 131852 - DNA, 543 bp, Artificial Sequence
  Description of Artificial Sequence: Synthetic coding sequence
atggcaaaatccgcagaggtgaaattggccatatttggccgcgcaggtgtcggcaaaagcgagtccacctataggcatcaagctaccattgacgatgaagtcgtttctatggagattctagacacagcaggtcaggaggacactatccagcgggaaggacatatgagatggggtgagggctttgtcctcgtgtatgacataacggaccggggaagctttgaggaggtgcttccgcttaagaacatcctcgatgagattaagaagcccaagaatgtcacattaatcctcgttggtaataaagccgacctggatcacagtcgccaagtcagtacagaggagggggagaagctggctaccgagctcgcctgtgcattttatgagtgctctgcctgtactggagagggcaatataacggaaatcttctacgagctctgcagagaagtgcggagaagacgtatggtgcagggaaagactcgcagacgatcttccactactcacgtcaagcaggcaatcaacaagatgctgacaaagattagcagctag

SEQ ID NO: 131853 - DNA, 612 bp, Artificial Sequence
  Description of Artificial Sequence: Synthetic coding sequence
atggtgagtacctatcgcgtcgccgtgctgggagccaggggagtcgggaagtcagccattgtgcgtcaattcctgtataacgagttttcagaggtgtgtgtgcccaccacagcaaggagactatatctacccgcggtggtcatgaatggacacgttcatgacttgcagatcctggatttcccccctatctctgcattcccagttaatacccttcaggaatgggctgatacatgctgtcgcggtcttcgatccgtgcatgcctacatattagtatacgatatttgctgctttgactcctttgaatatgtgaagaccattagacaacagatcctagagacacgggtgattggcacaagcgagacccccatcatcatcgtagggaataaacgtgatttgcagcgaggacgtgtgatcccccggtggaacgtatcacatttggtgcgcaaaacatggaaatgcgggtacgtggaatgtagcgccaaatataactggcatatcctcttgttgttttccgagctgttaaaatccgtgggatgcgccaggtgtaaacatgtacatgcagccttgcgctttcagggggccttgaggaggaaccggtgtgctattatgtag

SEQ ID NO: 131854 - DNA, 729 bp, Artificial Sequence
  Description of Artificial Sequence: Synthetic coding sequence
atgcgccctctgtccatgagcgggcacttcctactggcccctatccctgaatcaagcagcgattatctgctgccaaaagatatcaaactggccgtgcttggcgcaggacgggtggggaaaagcgcaatgatcgttaggtttctgactaagaggttcatcggtgattacgaacccaacactggcaagctgtactctaggctggtttatgtggaaggagaccagctgagcttgcagattcaggacacgccagggggcgttcagatccaggacagcttgccacaggtcgtcgacagcctgtccaaatgcgttcaatgggccgaaggttttttgttggtttacagtattacagactacgactcgtacctgtcaatcagacccctataccagcacattaggaaagtacacccagattctaaagcccccgtcattattgtcggcaataaaggtgacctgttacacgctcgtcaggtccagacacaggacggcattcagctagccaatgaattgggctcactgtttttggaaattagcacaagtgaaaactacgaagacgtgtgcgacgtattccaacacctgtgcaaagaagtatctaagatgcatggattgagcggcgaacggcgcagagcttcgatcataccccggccacggtcaccaaatatgcaggacctcaagagacgatttaaacaggctctaagccctaaggtcaaagccccaagcgcactcggctag

SEQ ID NO: 131855 - DNA, 747 bp, Artificial Sequence
  Description of Artificial Sequence: Synthetic coding sequence
atgcggctgatccagaacatgtgtaccatagctgaatatcccgcccccggcaacgccgccgccagtgattgctgcgtgggcgcggccggtcgcagactggttaaaatcgctgtcgtgggcgcctccggtgtgggaaaaactgccctggtggttaggtttctcactaaaagatttatcggcgactacgagcggaacgcaggaaacctgtacacaagacaagttcagatcgaaggtgagactctcgctctgcaagtgcaggatacgccagggatacaggtgcacgagaattcactcagctgtagtgaacaactgaatcgttgcattcggtgggcagatgctgtggtgatagtctttagcataacggactataagagttacgagttaatctcgcagctgcaccagcatgttcagcagctccatctgggcacccggctcccagtggtggtggttgccaataaggccgatctactgcacataaagcaggtggaccctcaactgggactgcagctggcatcaatgctcggctgcagcttctatgaggtatccgtctcagagaattacaacgatgtgtattccgccttccatgttctgtgcaaggaggtgagccataaacagcagccaagctccacacccgagaaacggaggacgtctctgatacctcgccctaagtccccgaacatgcaggacttgaaaagaagatttaagcaggccttgtccgccaaagtccggacagtgacctccgtctag

SEQ ID NO: 131856 - DNA, 927 bp, Artificial Sequence
  Description of Artificial Sequence: Synthetic coding sequence
atgactctgaatgggggcgggtctggagctggtggatcccgaggtggaggacaggagagggaacgacgccgcgggtcaacaccatggggacctgcccccccgctgcaccggaggtcaatgccagtggacgagcgagatctgcaggccgctttgacaccgggcgccctcacagccgcggccgcaggcacggggacccaaggacctagattggactggcccgaagattccgaagatagcctgtcttctggaggcagcgactccgatgaatcagtgtataaagtccttctgctcggcgcccctggtgtcggcaaaagcgcccttgcaaggatctttggaggggtggaggacggccctgaggccgaggctgccgggcatacatacgatcgttctatcgttgttgatggcgaggaagcatccctgatggtgtatgatatatgggagcaagacggcgggcggtggttgccaggccattgtatggccatgggcgacgcgtacgtaattgtctattccgtcacagataagggaagcttcgaaaaggcgtcagagcttcgtgtgcagctacgacgggccaggcagactgacgacgtacctatcatcctggtggggaataaatcagatctggtccggagtagggaggttagcgttgacgaggggagagcgtgcgccgtcgtatttgactgtaagttcatcgaaacttccgctgcattgcatcataatgttcaggccctgttcgagggcgtggttcggcagatacggctgaggcgggactcaaaggaagcaaatgctcgaagacaggcaggtacacgccggcgtgagagccttgggaagaaggcaaagaggtttctggggagaattgtcgccaggaattccagaaagatggcctttagagccaagagcaaaagctgtcatgacctgagcgtgttatag

SEQ ID NO: 131857 - DNA, 927 bp, Artificial Sequence
  Description of Artificial Sequence: Synthetic coding sequence
atgacactgaatggcggaggttctggtgctgggggctcgcgaggcggcggtcaggagcgggaaaggagaagaggcagcacaccctggggtccagcaccgcccttacaccggaggtctatgcccgtggatgagagggacctacaggccgcgttaacaccgggagcattgaccgctgccgcagcagggaccggaacccaaggtccccgactggattggcccgaagattcagaggactctctatcaagtggcggctcagattctgatgaaagtgtgtacaaggtgctgctgctcggcgcacccggcgtcggcaagagcgcactggcccggattttcggcggcgtcgaggatgggcctgaggctgaagcagccggccacacctatgaccggtctattgtggttgacggcgaagaggcatctcttatggtctatgatatctgggaacaggatggcggcaggtggctgccaggacactgcatggctatgggggatgcctatgtaattgtttactcggttacagacaagggttcttttgagaaagccagcgagcttagggtacagctcaggagagccaggcagacagacgatgtcccaatcatactcgtaggaaacaaatccgacctcgtaagaagcagagaagtgagcgtggacgagggacgcgcctgtgcagtcgtgtttgactgcaagttcattgagacgtcagctgcgcttcatcacaatgtccaggccctgtttgagggcgtcgttagacagatccgcctgcgacgggactccaaggaggctaacgcacgaaggcaggctggtacacggcgcagagaatctctggggaaaaaagcaaagcgattcctgggccgcatagtggcgagaaattcacgtaagatggcctttcgagcaaagtcaaagagctgccatgatctttccgtgttgtag

SEQ ID NO: 131858 - DNA, 579 bp, Artificial Sequence
  Description of Artificial Sequence: Synthetic coding sequence
atgcaggcaattaagtgcgttgtcgtcggcgacggggccgtgggcaagacatgcctgctgatcagttatacaacaaacgccttccctggggagtacattccgacggtcttcgataactactccgctaacgttatggtggacggaaagccggtgaacctagggctctgggacacagcagggcaggaagactacgacaggctgcgaccattgtcctacccacagacggatgtatttcttatctgcttttctttggtgtctcctgccagctttgaaaacgtcagagctaaatggtatcccgaagttagacaccactgtccacacacccccattctgcttgttgggactaagctggacttgcgagacgataaggatacgatagaacgtctacgcgataagaagttggcacctataacctatccgcagggcttggctatggcaagagaaataggctccgtcaagtatctggaatgctcagcactgacacagcgagggctgaagacagtgtttgatgaagccattagggccgtgctttgccccccccctgttaagaaaccaggaaagaagtgcacagttttctag

SEQ ID NO: 131859 - DNA, 942 bp, Artificial Sequence
  Description of Artificial Sequence: Synthetic coding sequence
atgcctaacactgctatgaagaagaaagtgttattaatgggcaagtcagggagcgggaagactagcatgagaagcataatttttgcgaactacatagccagggacacacggaggcttggagccactatcgacgttgagcactcccatgtgcgctttctggggaacctcgtacttaatctctgggattgcggtggacaagatacctttatggagaattattttacctcgcagcgcgataatattttccggaacgtggaagttctgatctacgtgtttgacgtagaaagtcgggagctggagaaggacatgcactattatcagagctgcctggaggcaattctccagaactccccagatgctaagatcttttgtctcgtgcacaaaatggatttggtgcaagaagaccagagggatttgattttcaaggagcgcgaagaggacctgaggcgcttaagcagacccctggagtgcgcgtgttttcggacctccatttgggacgagactctttacaaagcctggagctccattgtgtatcagttgattcccaacgtgcagcagctggaaatgaatctccgaaacttcgctcagattatcgaagccgatgaggttcttctgttcgaaagggccaccttcctggtgatctcccactaccagtgtaaggaacagcgagacgtgcaccgcttcgaaaagatctcaaatatcatcaaacagtttaagctgtcctgcagtaaactcgcagccagtttccaatctatggaggtccggaattcaaacttcgctgcgttcatcgacatctttacgtccaatacttacgtcatggtagttatgtccgatccctcaatcccctccgcggcaacccttatcaacattcgcaatgccaggaaacactttgagaagctagaaagagtggatggacccaagcacagcctgttaatgagatag

SEQ ID NO: 131860 - DNA, 1125 bp, Artificial Sequence
  Description of Artificial Sequence: Synthetic coding sequence
atggaagaatcagatagtgaaaaaacaacggaaaaggagaatctgggtcctagaatggatccccccttgggagaaccagaggggagccttggctgggttttgcccaataccgcaatgaagaaaaaggtcctgctaatgggcaaaagcggctctggtaagaccagcatgcgctcaattatatttgctaactacatcgcacgcgacacaaggaggttgggtgccacaatcctcgaccgcattcattccctgcagataaacagtagcctatccacttatagcctggtcgactctgtggggaacactaaaacttttgatgtcgagcactcgcacgtccgattccttgggaacctcgtcctgaatctatgggattgcggcggtcaggacaccttcatggagaactatttcacatcccagcgtgacaatatatttcgcaatgtggaggtccttatttatgtctttgatgtggagagtagagagctggagaaagatatgcattactaccagtcctgcttggaggctatcctgcagaactctccagacgccaagattttctgcctggtgcacaagatggatctggtccaggaagaccaaagagaccttatatttaaagagagagaagaggacttacgtagactgtctagacctctggaatgctcctgtttccgtacatcgatctgggacgaaaccctttacaaggcttggagtagcatcgtgtatcaattaattcctaacgtgcagcagctcgagatgaacctccgcaatttcgctgagatcatcgaggccgacgaggtgttgctgttcgaaagagctacattccttgttatatcccactatcagtgtaaggaacagagggatgcccacaggttcgaaaagatatctaacattattaaacagttcaaactgtcctgctctaaattggctgcctcattccagtctatggaggtgaggaacagcaacttcgctgctttcattgacatctttacctcaaacacatatgtcatggtggttatgagcgatccaagcattccgtcggcagctactctgattaatatccggaatgcccgtaaacacttcgagaagctggaaagggttgacggcccaaaacagtgtttattgatgagatag

SEQ ID NO: 131861 - DNA, 1041 bp, Artificial Sequence
  Description of Artificial Sequence: Synthetic coding sequence
atggaggaatctgattccgaaaagaccaccgagaaagagaatctaggcccaaggatggatccccccctgggagaacccgagggctctttgggatgggtgctgcctaatacagccatgaagaagaaagttctgctgatgggaaaatccggatccggcaaaactagcatgaggtcaatcatctttgctaattatattgctagagacacaagaaggctaggagctaccatcgatgttgagcactcccacgtgcgcttcctgggaaatctcgtactcaacctgtgggattgtggtggccaggatacatttatggagaactattttacttctcagcgagacaatatcttcagaaacgtagaggtgctgatctatgtgttcgacgtggagtccagggagctagagaaagatatgcattactatcaatcctgcctggaagcaatcctgcagaactcccctgacgcaaaaattttctgtttagtgcacaagatggatctggtgcaggaggaccagcgggatctcatctttaaggagcgcgaagaggatctacgccgtcttagcaggccgctggagtgctcgtgcttcagaacaagtatctgggatgagaccctctataaggcgtggtccagcatcgtttaccagctgataccaaatgtgcagcagctcgagatgaacctgcgaaactttgccgagattatagaagccgacgaggtgctgctatttgaaagagccaccttcctagttatctcacactatcagtgcaaagagcagcgggacgctcacagatttgagaaaatctccaatataattaaacagttcaagctgagctgtagtaaactcgcggcttcattccagtccatggaggtgaggaattctaatttcgccgcattcatcgacatctttacttcaaatacatacgtcatggtggtcatgagtgatccaagtatccccagcgccgctactcttataaacatccgcaatgctagaaaacacttcgagaagctcgagcgggtcgacggccccaagcagtgcttgttgatgcggtag

SEQ ID NO: 131862 - DNA, 585 bp, Artificial Sequence
  Description of Artificial Sequence: Synthetic coding sequence
atgaagaaaaaggtgctgctgatggggaaatccgggtcaggtaagacctccatgcgctccattatctttgcgaattatatcgcccgggatacccgcagactgggagcaacaatcgatgtcgagcactctcacgtgcggttcctcggcaacttggtgctgaatctctgggactgtggcgggcaggacacttttatggaaaattattttacttcccagcgggataacatcttccggaacgtcgaagtgcttatatacgtgtttgatgtcgaatccagggagctcgagaaggacatgcattattatcaatcatgtctcgaagcgatccttcagaattcaccagacgctaagattttttgtctagtacacaagatggacctcgtgcaggaagaccagagggacctgattttcaaggaacgggaggaagatcttcgacgcttgagccggccactcgaatgtagctgtttcaggacatccatatgggacgagacactctacaaagcttggtcatccatcgtgtatcagctcattcctaatgtccagcagctcgagatgaatcttcggaattttgccgagatcatcgagtag

SEQ ID NO: 131863 - DNA, 1200 bp, Artificial Sequence
  Description of Artificial Sequence: Synthetic coding sequence
atgagtctgcagtacggcgctgaagaaacgccactggctggttcgtatggtgctgctgactcatttcctaaggactttggctatggtgtggaggaagaagaggaagaggcagccgccgccggagggggcgtcggcgcaggggccggtggcggctgcggacccggaggggccgattcatctaaaccccggatcttgctcatgggcctgcgccggagcggcaagtccagtatccagaaagtggtgttccacaagatgtccccgaatgagacattattcctggagagcaccaacaagatttacaaggacgatatatctaacagttcttttgtaaatttccagatttgggatttccccggccaaatggacttttttgatcctacattcgactacgagatgatctttaggggaacaggggccctgatctatgttatcgacgcccaggatgattacatggaggcgctgacccgcttgcacatcaccgtaagtaaagcatacaaggtaaatccagacatgaattttgaggtgtttatccacaaagttgacgggttgtcagatgaccataagattgaaacacaaagagatatccaccagcgcgctaacgacgacctggcagatgcaggcctggaaaaactgcatctgtcgttttatctgacttcgatctatgaccattcgatcttcgaggctttttccaaggtggttcaaaaactgatccctcaacttccaaccctagagaacttgctgaacatcttcatctcgaattctggcatcgagaaagctttcctgtttgacgtggtgagtaaaatttatattgccaccgatagttctcctgtagatatgcagtcctatgaactctgttgtgatatgattgacgtggttattgacgtgtcatgtatatacgggctgaaggaagacggctccggcagcgcctatgataaagaatccatggctattataaagctgaacaataccacggtgctttatttaaaagaagttacaaagtttctggccctggtgtgtatcctacgcgaggagagtttcgaaagaaagggattaattgattacaattttcactgtttccgcaaggccatccatgaagtgtttgaagtgggcgtcacaagccacagatcttgtggacatcagacctctgctagttccctgaaagcactgacacataatggtactccaaggaatgcaatctag

SEQ ID NO: 131864 - DNA, 750 bp, Artificial Sequence
  Description of Artificial Sequence: Synthetic coding sequence
atggaagcactcgcccggctgcatctcactgtgacacgggcctacaaagtcaacactgatatcaattttgaggtgttcatccataaagtggacggtctgagtgacgaccataaaattgaaactcagcgggacattcaccagagagccaacgatgatctggctgatgccggtctggaaaagatccacttgtccttttacctcaccagcatatacgaccactccatttttgaggctttttcaaaagtcgtccagaagctgatccctcaactgcccacattagaaaatttgctgaatatctttatctctaattcaggtattgagaaggccttcctgttcgatgtggtgtccaagatttacatcgccacggactccacgcctgtagacatgcaaacgtacgagctgtgctgcgatatgatcgatgtggtaattgatatcagttgcatctacggcctgaaggaggatggggccggcacgccatatgataaagagtccaccgctatcatcaagctgaataataccaccgttctctatcttaaggaagtgaccaagtttctggcattagtttgctttgtgagggaagaatctttcgaaagaaaaggcctgatagactataacttccattgctttaggaaagcaatacatgaggtttttgaggtgcgtatgaaggtggtgaaatctagaaaggtgcagaatcgcctccagaagaagaaacgggccacccccaacggcacacccagggtgctgttatag

SEQ ID NO: 131865 - DNA, 1203 bp, Artificial Sequence
  Description of Artificial Sequence: Synthetic coding sequence
atgagccaggtgttgggtaaaccgcagccgcaagatgaagacgatgccgaagaagaagaggaagaagatgagttggtgggcctcgcagactatggggacggccccgacagcagcgacgccgatcccgactccggcactgaggagggcgtgctcgactttagcgatccattttccaccgaggtgaagcctagaatcctactgatgggtctccgccgcagtgggaaatcttctatccagaaggtggtttttcataagatgtcacctaacgaaaccctgtttcttgagtctactaataagatttgcagagaggacgtctcaaattctagctttgttaactttcagatctgggattttcctggtcaaatcgacttcttcgatcccacctttgattatgagatgatcttcagaggcactggagctttgattttcgttatcgattctcaggatgactacatggaggctttagcgagactccatctgaccgtgacccgcgcttataaggttaacaccgacattaactttgaggtgttcattcataaggttgacggactgagcgacgaccacaagattgaaacacaaagagatatacatcagcgcgccaacgacgacctcgcagacgcggggctggaaaagatccatctgtccttctatctcacgtccatttacgatcactccatcttcgaagccttctccaaggtagtgcaaaaactcataccccaactgccaacgctggaaaatcttttgaacatcttcataagcaattctgggatcgaaaaagcatttctgtttgacgtcgttagcaagatttatattgctacagatagcactccggtcgacatgcagacctatgaactgtgctgcgatatgatcgacgtggttatcgatatcagctgcatctacggccttaaggaagatggggccggcactccatacgacaaggagtccacagccattatcaagctgaacaataccaccgtgctgtatctgaaagaggtgaccaaattccttgccctggtctgcttcgtccgcgaagagtcattcgagagaaagggtctgatcgactataatttccattgtttccgcaaggcgattcatgaagtattcgaggtgaggatgaaggtagtaaaatcaaggaaggtgcagaaccggctccagaaaaagaagcgagccacacccaacggtacaccgagagtgctcctgtag

SEQ ID NO: 131866 - DNA, 348 bp, Artificial Sequence
  Description of Artificial Sequence: Synthetic coding sequence
atgctgcgggacaccatgaagtcatggaatgatagtcaaagcgatctctgcagcacagatcaagaagaggaggaagagatgatctttggagagaatgaggatgacttggatgagatgatggacttgagcgatctcccaacttccctgtttgcttgttcagtccatgaagctgtgttcgaagcccgcgaacaaaaagaacgcaacatgaatttcacacgcgaacagtctcgccaccccgcttggtggttcatgagcgtcaaagtgaagcttaagagaaagaaacgtcagaagaccccaaatcgaaaactaccccgccgcggcgctccgaccctgcgtccacagcgctag

SEQ ID NO: 131867 - DNA, 726 bp, Artificial Sequence
  Description of Artificial Sequence: Synthetic coding sequence
atgctgcgcgacacaatgaaaagctggaacgacagtcagtcggacctgtgctctactgatcaggaggaggaggaggaaatgatcttcggcgagaacgaagatgacctcgatgagatgatggatctgtctgatctccccacctccctgtttgcttgctctgtgcacgaagcggttttcgaggcaagggagcagaaggaaaggtttgaagcgctttttaccatctatgacgaccaggtgacattccagctcttcaagagctttaggcgtgttaggatcaacttctcaaaaccagaggccgccgcccgtgccaggattgagctgcacgagactgacttcaatgggcaaaaattgaagctgtattttgcccaggtgcaaatgtccggagaagttcgtgacaagtcgtatctcctgcctccacaaccagtgaagcagttcctgatctccccacccgcttcaccgcccgtcggttggaaacagtccgaggatgcgatgcctgtgattaattacgacctgctgtgtgcagtttctaaactcggacctggggaaaaatacgaattacacgccggtacagagtctacaccttcagtagtggttcacgtgtgtgaatcagagacagaagaggaggaagagacaaagaatccgaaacagaagatcgcacagaccagacggccagacccgccaaccgctgcccttaatgagccgcaaaccttcgactgcgccctgtag

SEQ ID NO: 131868 - DNA, 522 bp, Artificial Sequence
  Description of Artificial Sequence: Synthetic coding sequence
atgctgagagacacaatgaagagctggaatgacagccagtctgacttgtgcagtacagatcaggaggaagaagaagagatgatcttcggcgagaacgaagacgatctggatgaaatgatggacttgagcgacctgccaacgtcactgttcgcctgctccgtgcatgaggccgttttcgaagcacgcgaacagaaggagagatttgaagcactcttcacaatctatgacgaccaggtgacgtttcaactcttcaagtctttcaggagggtcagaatcaatttctccaagccagaagcagcagctcgggctagaatcgagctccatgagacagatttcaatgggcagaaactgaaactttatttcgctcaggagcgaaatatgaactttaccagggaacagtcgaggcaccccgcctggtggtttatgtccgtcaaggtcaagcttaaacggaagaaacgccagaagaccccaaaccgcaagctgcctcgtcgcggtgcaccaacccttagacctcagcgctag

SEQ ID NO: 131869 - DNA, 198 bp, Artificial Sequence
  Description of Artificial Sequence: Synthetic coding sequence
atgctcagagacactatgaaaagctggaatgacagccagtcagatctgtgttccactgaccaggaggaggaagaggagatgatttttggagaaaacgaagacgatctcgatgagatgatggacctcagtgaccttcccacgtctttgttcgcatgctcagtccacgaagctgtgttcgaggcccgtgaacagaaatag

SEQ ID NO: 131870 - DNA, 696 bp, Artificial Sequence
  Description of Artificial Sequence: Synthetic coding sequence
atgttgcgggataccatgaaaagctggaacgacagccagtccgacctctgctctaccgatcaggaagaagaagaggagatgatatttggagagaacgaagacgatctggacgagatgatggatctttcggatctgcctaccagcctgttcgcttgttcagtgcatgaggcagtctttgaggcccgcgagcagaaggaacgcttcgaggctctctttactatttacgacgaccaggtcactttccaacttttcaaatcgtttagacgcgtccgtattaatttttcgaagccggaggctgcagcacgcgccagaatcgagttgcacgaaactgactttaatggccaaaaattgaagctgtatttcgcccagtcatatctcctgcccccacagcctgtaaagcagttcctgatcagccctccagcaagcccccccgtggggtggaaacagtctgaggacgccatgcccgtgatcaattatgatttgttatgcgctgtgtcgaaactgggccccggtgagaagtacgaacttcatgctgggactgaatccactccaagtgtcgtggttcacgtctgcgagagtgagaccgaagaggaggaggaaacaaaaaacccaaaacagaaaatagctcagacacgacgtcctgacccacccactgcagctctaaatgaacctcaaacgttcgattgcgctctgtag

SEQ ID NO: 131871 - DNA, 552 bp, Artificial Sequence
  Description of Artificial Sequence: Synthetic coding sequence
atgctgcgagacactatgaagtcctggaatgattcacagtctgatctgtgtagcaccgatcaggaagaagaagaggaaatgatattcggggagaatgaggatgatcttgacgaaatgatggacttgtctgacctccccactagcctctttgcctgctccgttcatgaggcagttttcgaggctagggagcaaaaggtccagatgtctggggaagttagggataagagctatctccttccaccacaaccggttaaacagtttctgattagccctccagcgagtcctccggtgggctggaaacagtctgaggatgcaatgcccgtaatcaactatgatctcctgtgtgccgtttccaaattgggcccaggtgaaaagtacgaattgcatgcaggcactgaaagtacgccgtcagtggttgtccacgtgtgtgagtccgaaacagaagaagaggaggaaaccaagaatcccaagcagaaaatagcccaaaccagacggcctgatccacctactgccgctctgaacgagcctcagaccttcgactgcgccctgtag

SEQ ID NO: 131872 - DNA, 900 bp, Artificial Sequence
  Description of Artificial Sequence: Synthetic coding sequence
atgcactctctggccaccgctgcccctgtccccaccacgctggctcaggttgaccgcgagaagatttatcagtggatcaatgagctgtcgagtcccgaaacccgggagaatgcattgctcgaattgtccaaaaaacgggaatccgtgccagatcttgctcccatgctgtggcattcgttcggcactatagccgcccttcttcaggaaatcgtgaacatttaccctagcattaatccccccaccctcaccgcccaccagtcgaaccgggtgtgcaacgccttggcattgctgcagtgtgtcgcctctcatccggagaccagatccgccttcctggccgcgcacatccctctgttcctgtatccattccttcacacagtaagcaagacaagaccttttgaatacctgcggttaacatctctgggcgttatcggggcactcgtgaaaactgatgagcaagaggttatcaactttctgctgaccactgaaatcattcccctgtgtcttcgtatcatggaatctggatccgagctcagcaagaccgtagccactttcatcctgcaaaaaattctgctggacgatactggcctcgcctacatatgtcaaacttacgagaggttttcccacgttgccatgattttaggcaagatggtgttgcagttaagcaaggagccaagcgctaggcttctgaagcacgtcgtgcggtgttatcttagattatcagacaaccccagagcccgagaagcactgcgtcagtgcttacccgaccaacttaaggatactacattcgcccaagtgctcaaagacgataccaccacgaaacggtggttagcacagctggtcaagaatcttcaggaaggccaggttaccgacccccggggcatcccgctccccccccagtag

SEQ ID NO: 131873 - DNA, 996 bp, Artificial Sequence
  Description of Artificial Sequence: Synthetic coding sequence
atgcattcattggccaccgccgctccagtgccaacgacgttagcccaggttgatagagagaaaatttatcagtggataaacgagctgtccagccctgaaacacgcgagaatgcacttcttgagctcagtaaaaaacgggaatccgtaccagaccttgcacctatgctttggcatagtttcggcactatagctgcgctacttcaggagatagtcaacatctaccctagcattaaccctcccaccctgactgcacaccagagcaatcgtgtatgtaacgctctggcacttctgcagtgcgtggcttcacaccctgagactcgtagcgccttcctggcggcccatattccgctatttctctatccctttcttcataccgtctcgaagactagaccttttgagtatctgagactaacctccttgggcgtgatcgtggaaacgggttttcaccatgtgggccaagccgacctcgagctgcctactagctcagatctccccgctagtgccagccagagcgccggaattaccggggccctggtgaaaacagacgaacaagaggtgatcaactttctgctgacaacagaaattattcccttatgcctgaggataatggagtccggttctgagctcagcaaaactgtcgcaaccttcatcctacagaagattcttctggacgacacggggcttgcatatatttgccagacatacgagcggttttcgcatgttgcaatgatattgggcaagatggtgctccagctgtctaaggagccatcagcccgactgctgaaacacgtggtgcgctgttacttaagactcagcgataaccccagggcccgggaggcgctgaggcagtgtcttccggaccagcttaaggacaccacattcgcccaagtcctcaaagacgataccacaacaaagcgctggttagcccaactcgtgaagaacctccaggaaggccaagtcaccgatcccagaggcatacccctgccgccacaatag

SEQ ID NO: 131874 - DNA, 900 bp, Artificial Sequence
  Description of Artificial Sequence: Synthetic coding sequence
atgcactccctggctacggccgcccctgttccaaccaccctagcacaagtcgatagagaaaagatttaccagtggatcaacgagctgtcttcccccgagacacgggagaacgctcttttggagctgtcgaagaagcgcgagagtgtgcccgatctagccccaatgctgtggcactcgttcggtactattgcagcgctccttcaggaaatcgtgaatatctatccttccatcaatccacctaccctgacagcacaccagagtaacagagtgtgtaatgctctggcgctgctccagtgcgtcgccagccacccagaaactcggagcgcctttctggcagcacatattccacttttcctctatccttttttgcacacagtcagcaaaactcgaccttttgagtacctgagactgacctccctcggtgtaataggtgcgctcgtaaagacagacgaacaagaggtcataaacttcttactgaccactgagattatccctttgtgcctccgcatcatggaaagtggctctgaacttagtaagaccgtcgcaacttttatcttgcagaagattttactggatgatactggcctcgcgtacatttgtcaaacctacgaacggtttagccacgtggccatgattctcggtaaaatggtgctgcagctctctaaggaaccaagtgccaggctcctgaagcacgtggttcgctgctatcttaggctctccgataacccacgtgcacgcgaggcattgcgacaatgtctacccgatcagcttaaagatacaacatttgcccaggtgctgaaggacgatacaaccacaaagcgctggctcgcacagctcgtgaagaatctgcaggaaggtcaagttacagatcctcgggggatcccacttcctccacaatag

SEQ ID NO: 131875 - DNA, 777 bp, Artificial Sequence
  Description of Artificial Sequence: Synthetic coding sequence
atgcactcgctggccaccgccgccccggttcctaccacactggcccaggtggaccgggaaaaaatctatcagtggataaacgagctgtcctctcctgaaaccagggagaacgcgttgctggaactttccaagaagcgggagtctgtgcctgacttggctccgatgttatggcactcatttggtaccatcgcggcgttgctgcaggagattgtaaatatctacccttctataaaccctccgacccttactgcgcaccagagtaatagagtgtgtaatgcgctggctctactccagtgtgtggcaagccatcctgagactcggtcagccttccttgcagcacacatcccattattcctgtacccttttctgcacacagtttctaaaacgcgaccgtttgaatacttgagacttacaagcctgggagtgattggtgcactggttaaaacggacgaacaggaagtaatcaacttcctccttaccactgagatcattcctttatgcttacgcattatggagtcagggagcgagctaagcaaaacggttgccaccttcatcctgcaaaaaattttgctggatgacaccgggctggcatatatctgtcagacctacgagcggttctcccacgtggcaatgatcctgggcaaaatggtgctgcagctgtcaaaggaaccatctgcgagactgctcaagcacgtcgtacggtgctatctgcggctctctgacaaccctaggttttcggatctcaccttctgctggagttcgttccaaagaaaatag

SEQ ID NO: 131876 - DNA, 990 bp, Artificial Sequence
  Description of Artificial Sequence: Synthetic coding sequence
atggccgccctgggaggagacggactgcggctgctgagcgtgagtcgcccagagagacctcctgagagtgccgccctggggggcctgggccccggcctctgctgctgggtatctgtgttctcctgcctttcattggcctgttcatacgtcggatctttgtatgtctggaaaagcgagctgccacgggaccacccagctgttattaagagaaggtttacttccgtgttagtcgtgagtagtttgagccccctctgtgtactcctgtggagagagctgacaggaatacagccaggcaccagtttattgactctcatgggtttcagacttgaaggcatctttccagccgccctgttgcccctgcttctaactatgatattatttctcggccccttgatgcagctgtccatggactgcccttgtgatctcgccgacggcctgaaagtggtcctagcgccgagaagttgggccagatgcctgactgatatgcggtggttgcgtaatcaggtgatcgcacctctgactgaggaattggtcttcagggcatgcatgctacctatgctggctccctgcatgggcctcggtccagccgtattcacgtgccccctgttctttggcgtcgcccattttcaccacatcatcgagcagctgcggttccggcagtcgtctgtgggcaacatctttctgtctgccgcgttccaattcagctatactgccgtgttcggggcatacacagctttcctcttcatccgcacagggcatctgatcggccctgtgttgtgtcactctttctgcaattacatgggattcccagccgtgtgcgccgcactggaacatcctcaacggagaccgctcctggccggctatgccctgggagtcggattgtttcttctgcttctgcaacctctcactgatccaaaactgtacggcagcctgccactgtgcgttctgctggagagggcaggagatagtgaggctcctctgtgcagctag

SEQ ID NO: 131877 - DNA, 927 bp, Artificial Sequence
  Description of Artificial Sequence: Synthetic coding sequence
atggcggccctgggtggggatggtctcaggctgctgtctgtctctcggccggagaggcccccagagtcagctgccctgggtggccttggacccggcctatgttgttgggtgtctgtgttttcgtgcctctcactggcatgctcgtatgtgggaagcctgtatgtgtggaagagcgagctcccgcgcgatcatcccgcagtcattaaaaggaggtttacctccgtgctggttgtctcctctctgtctcctctgtgcgtgctgttgtggcgagaacttacgggaatccagcctgggacttcgttgctgactctcatgggattccggctcgagggaatattccctgcggctttattgcctcttcttctcacaatgatcctcttcctgggccccctgatgcaactgagcatggattgtccttgtgatctggccgatggcctcaaagtcgttctggcccctcgtagctgggccagatgtctgacagacatgcgctggctccgcaaccaagtgatcgccccactgacggaggagctggttttccgcgcctgcatgcttccaatgctggctccttgcatgggcttgggtcctgctgtgttcacctgtccgttattctttggcgtcgcccattttcaccatatcatagaacaactgcggtttaggcagtcgtcggtcgggaacatattccttagtgctggtcacctgatcggaccagtactttgccactctttctgcaactacatgggcttcccagcggtctgcgccgcacttgaacaccctcagaggcgacccctccttgcaggttacgctctcggtgtggggttattcctgctgcttctgcagcctctgaccgacccaaagctgtacgggtcactgcccttatgcgtgctattagagcgggctggagactccgaagcgcccctgtgctcatag

SEQ ID NO: 131878 - DNA, 1164 bp, Artificial Sequence
  Description of Artificial Sequence: Synthetic coding sequence
atggtgccgaaaggcgccacaatgctggtcattccaccagggctgtccgaggaagaagaagcactccagaaaaaatttaataaactcaaaaagaaaaagaaggcacttttagctttgaaaaaacagagctcaagctcaacaaccagccagggcggtgtaaagagatccttgtctgaacagcctgtgatggacactgccaccgctactgagcaagccaagcaattggtgaagagtggggcgataagtgcaattaaagccgaaacaaaaaattctggctttaaacggagcagaaccttggaaggcaaactgaaggaccccgaaaagggaccggtacctacctttcagccatttcaaagatcaatctctgctgacgatgatctgcaggagtcctccaggagacctcaacgtaaatccttgtatgagagctttgtttccagttcagaccggctccgcgaacttggaccagacggcgaggaagcggagggaccgggggctggggacggcccccctaggtcgttcgattggggttacgaagagaggagtggcgcacacagctctgccagtcccccgaggtcaaggtctcgggacaggagtcacgagagaaatcgggatcgggaccgggatagggagagggacagagaccgcgaccgagacagggaccgggaaagggatagagatcgcgatagggacagggatagagatagagagagggatagagacagggaacgcgatagggaccgggaccgagaaggtcccttcagacggtccgattcattcccagaacgaagggcgcctaggaaaggaaataccttgtacgtatacggagaagatatgacacctacattgctccggggagcattcagtcctttcgggaacatcatcgatctgtcaatggacccacctaggaactgcgcatttgtcacgtacgagaaaatggagtcggcagatcaggctgtggcagaactcaacggaacccaggttgagtctgtccaactgaaggtgaatattgcacgcaagcagcctatgctagacgccgccacggggaagagcgtttggggatcgctggcagttcagaacagtccaaagggatgccaccgggacaaacgtacgcagatcgtttattcagacgacgtgtacaaagaaaatcttgtggatgggttttag

SEQ ID NO: 131879 - DNA, 1143 bp, Artificial Sequence
  Description of Artificial Sequence: Synthetic coding sequence
atgcttgtaataccgccaggcttgagcgaggaggaggaggcactgcagaagaaattcaacaaactcaaaaaaaaaaaaaaagctctcttggctctgaagaagcagtcatcttctagcacaaccagccagggtggggtcaaacggagcctgtccgagcaaccagtgatggatacagcaaccgctactgaacaagctaaacagctggttaagtctggggctatttcagccattaaggccgagactaaaaattccggcttcaaaagatcacgcacgctcgagggcaagctcaaggacccagagaagggcccagtccctaccttccaaccttttcaacgctctattagtgctgatgacgacctgcaagagtctagtaggaggccacaacgaaagagcctctatgagagctttgtttcctcttctgaccgtctgcgagagctaggccccgacggggaggaagccgagggaccaggggccggcgacgggccgccaaggtcctttgattggggctacgaagagagatctggcgctcattctagcgcctcgcctccacgaagccggtcaagggataggagtcatgagaggaatcgcgatcgtgaccgtgacagggagcgagaccgagatcgggatagggatcgggaccgcgaacgagatagggatcgggatagagacagagatcgagaccgagaaagagatagggacagagagcgggacagagaccgcgaccgcgagggtcctttccgcaggtcagattcttttccagagcgtagagcccccaggaagggaaacacgctgtatgtttatggggaggacatgacccccacccttctcagaggagctttctcccctttcggaaacatcatcgatttgtcaatggacccaccccgaaattgtgcatttgtgacctatgagaagatggaaagtgcggaccaggcggtggccgagctgaatggcacgcaggtggagagcgttcagctgaaagtgaatattgcaagaaagcaaccgatgctggatgcagcgactggcaagtccgtctggggctctctagcggtgcagaattcgcccaaaggatgtcaccgcgacaaaagaactcagattgtatatagcgacgacgtctataaagagaacctggtggatggcttttag
